United States Patent 10,982,187 (BOS TAURUS VARIETY 'HO840003150607238' AND METHODS OF USE THEREOF) - sequence listing, part 4

SEQ ID NO: 36490 - DNA, 201 bp, Bos taurus
tatgtgtttaattccatatgggaataccagaacatgctgaaatagaaatgccaagtactctgtaggactgagcaaagacataattcgattttggcctcatytatgtttctctggactatattgtgatgggaatatggaagcattttgctccttttgttttttaatcttgacaatgagaagtaagagtttctttagggcctt

SEQ ID NO: 36491 - DNA, 201 bp, Bos taurus
cattagcattgatgagtgaggccagaatggacagggaacaggtcaacttgttcatcagtgggttttatgacctcttttgccctgagtggaactcagctttstaggtaacattctgggctggcccatgaccttggtctcacatgggtgtcatgtgacctgcaaggcaagtaccaccattcccagaatatcctctgggatgtt

SEQ ID NO: 36492 - DNA, 201 bp, Bos taurus
gtccatggaggcctgctgccctcctgcagtgggcactggtgtgggcacaggtggaaacagacagcctcggaaacaaagagtagtcatggtgcatctttgcrggggaagataccaggccacctgggcccccaagatccagtgacagcatctgctaccatgagaagatgatgcccagggtccgctcttacctgatttacaggc

SEQ ID NO: 36493 - DNA, 201 bp, Bos taurus
cttttcaggacttttcaaacttaggatagaactagccaccacttacactttgcattcccaccaatatgtgattcctcatattctttcaatgatcctttttsaaatgttgtcaatttgcttggtaaaaagcaagaaaaaatgtaataggtttataatacttttcatgcaaataatacatagaaacaaacacaaacaataaag

SEQ ID NO: 36494 - DNA, 201 bp, Bos taurus
tagtatttcagtttcattccatcaatttttcatcataaaggtaacataattcaacttcccacctactccttgtcccaaaaaatgaactagcaagtggtatrggggctacaagataatgaacaaaagctggaagcaggaagagcaatttagatggtccagtggccctggaaattaattagcagtcagaatcagggtggttat

SEQ ID NO: 36495 - DNA, 201 bp, Bos taurus
acctcaaattgcaattctctgctgatctcaaataaacttctctttgcaggagaaatatttggctgtttctgatcaatattaggaacacaggcacccatcartgtttctaccctccgagttactaagttttcagaccatatccaagaatcagcttgacctttattgttaaattctctttgtaaaaagtacatatatgggatt

SEQ ID NO: 36496 - DNA, 201 bp, Bos taurus
gagcagatgctcttgtgtcttcctttttgctgtttcgtggctgctgctcctcggacaccacttctgcttgtctcttgtctaggcagcttggccagcgcgtycctgccctctaccatcccttctcgaccatgtggcggtgcagatgtgatcatcctttgtggaagtggccatccatgctttggccctcccattctaaccctg

SEQ ID NO: 36497 - DNA, 201 bp, Bos taurus
gctttgcggaaaagaatttccacaaagacggaaagtagtgaagcaactgaagtatttattaacaggaaaaaaagagtacagtatgaagtgtggacagaaaygagtggcctgagagacagtcgctgagctgcaccctcgtggcagtctgaattacttttatggagttttcttctgggtttccattgactaatcattttgatt

SEQ ID NO: 36498 - DNA, 201 bp, Bos taurus
acactttcaatgtccacaatgttatatgtcaaatacattcaatataaatgctggaaagatagaatttttaaacagaaatggaaatcattggtgtaattttrttaaatactagagaacaggaaggagggccttggctccggctttctattttccatcatctatctaaatatgactgttagtccctgtgaaatatggatatat

SEQ ID NO: 36499 - DNA, 201 bp, Bos taurus
ataacatgaaaagggaataaaagaaaataatacaaatatccgatgaaatactagaagtgctcaaccacacgagtaatccaagaaatacaataaaattgcayacttttgttatttatcaggttagtgaaagaaaaagacactgctgtgtgtgagagagatggtgaggaagcaggccccacgaaaactaaaagctcaaccact

SEQ ID NO: 36500 - DNA, 201 bp, Bos taurus
ggagctggcctgcccctttggccccttggatgagattccagcccttaggacgagaggtcaggatcaagagctggaggagccagatgaggctttgttatttkatgcagacagtgctgtttcaaggcccacgggacagtatacctgagcctgggaagatggtcttgtgttttaattctacatttgacccttgttcagtcagtc

SEQ ID NO: 36501 - DNA, 201 bp, Bos taurus
ggaaatatttggccaggggaggggagtttacttttaaacatgatggggtgacatcagcaacatggctgaaagacaggtgcctcatcatttttctcgccacyaacaacactttggcctccatccatggacatactcaaaggaggaaaaaccctgccaaccaagggtactctatccagaaaagtctttcaggaatgaaggata

SEQ ID NO: 36502 - DNA, 201 bp, Bos taurus
atcaggaatattgaatggactctgaacaccagaaggaaggtttaaaacaacactgaactatgaaaaattaatagtcatgctcatggaccgattcattcacrtattgcaatcacgaagatttttttcccattctcaggaatcatctaaagcagacaacatctgaataacttcatagtgcttttcaggtctactttatccttc

SEQ ID NO: 36503 - DNA, 201 bp, Bos taurus
ttttatgccgctatgtgcacacccactgttgcttctttggggtagccgccagaaacagaactaatgggtcagagctgtattttggccctggactgagagtraggcttcatcctacaggaagtggacgtgggtcctttgtgtttcagaaagtgtgacagagccttcctctcaccctcggagtcacccgaaggaagttcgctg

SEQ ID NO: 36504 - DNA, 201 bp, Bos taurus
acctagtgtgtgccaaggccagtgctgggagagcacccactgtgtgccagccccatgccagggagccctggtggtttgctgggtcctgcactagacgagtrtcccatgtatgccaaattctgggccaggtgaggacccaggatatggtcagcactgagcacggtgagcatgcactgtgcacctggcactgtgccaggggag

SEQ ID NO: 36505 - DNA, 201 bp, Bos taurus
agaagcctttctgcggtcatctgcaactcaacagcctgacgatgctggtctgaagaagccttggggaccctcgggacagcacattgcacctgtgttcaccrcacagaggcagcccttacagtgacccagatggagacacctccatccgtgagtgtgtaaccagaatagagcccagccacctcaggaacagacagagttgag

SEQ ID NO: 36506 - DNA, 201 bp, Bos taurus
tgagaacagaggtacaagtcagtgccttccgggaaggcggttgccatggttccagggaagtggatcaggggctgcggccatggggagagagaagaaagacmcagtaaaagacccgtggcagatggcagcatctcccgtccatgggctcttccacagtgagacctcgacacacccctaccaagaagtgaggcctgagtctct

SEQ ID NO: 36507 - DNA, 201 bp, Bos taurus
aaacacctaaactccccatcttttctgtcttcccttgtcccaccgtccttgctgtagatggcagattttgttgcctaaaaagggccacagagacatggacrgttctcattagctcatctagaaccatcctcccaccaaaggggaagactcatttccctcccctcaatgtggactggccttaggacttgcctctgacagaaa

SEQ ID NO: 36508 - DNA, 201 bp, Bos taurus
tctacttcccacactggtcacaccacacctactgctaaagtcaacatcagcctactcagcgcctttgtgtaattagaataaggcaaccactcctctgggcrgatatgactctcagtcatgcagctggagggcagaaagaaggacgggtttcaggcccactagcccttcactggggtgccatttttgcagtgcacaacatgt

SEQ ID NO: 36509 - DNA, 201 bp, Bos taurus
aaacacatgccaacatagctaagggtctacagtgtgtgcaattacacgtggttcaaaggatagaaagaagagcttgttcacttggacacataagagagacyctggagcaaaacactaattatcagtgagtctgataaatacagtattggtgttgtccaattaaaaaatatgtacaacctaaacccactttagtattcttgc

SEQ ID NO: 36510 - DNA, 201 bp, Bos taurus
ttcttctctaaattaattgtttgtcagtacccaagaagcctctgaatggctttcagtcatctaaaggttcactttctttttccttttttcttcctagaggytacatggtgatgggagattctttcaacacttctctcttcaagcagacattccaaagaattttcagtaaagattttaatggcaatttccgaatggcctttg

SEQ ID NO: 36511 - DNA, 201 bp, Bos taurus
ttttgtcttacagttgtgtggaaaacagaatctggaagggatgaatgtggatattattaataccttcatacctttgtcttctctttcttttggcctgtacyctcatcctgtacctgtgttgtcaattcctgcttatttttcaaagcgagctcaaataccaccctttgagaagccttgtgttgctccccagaagtggcccct

SEQ ID NO: 36512 - DNA, 201 bp, Bos taurus
cgcacgggtcccgacagccacgggtcacccatcacgggaccaaggctccaaagcaggctgcctctgaggacagacactctgggccgtcactccagccgccstgtgtcccatctggaaggagtcagctgggtgagcgcacagaacagcccctgcagaggcccacgtggatgctccaggaattaattacctccagcccgtggt

SEQ ID NO: 36513 - DNA, 201 bp, Bos taurus
actcctggacactgattcatagccatccacttcctcccaagctcagcaaaccaccaggtcctctgggaaatggattagtcacagcccagccaggcaccttkcgtgccatggtcggtattagctccaacagtcatgcgtttaggaggaaaaggtaaaaactgctgcaccatcttcctttggggaaggaataaggccttagtt

SEQ ID NO: 36514 - DNA, 201 bp, Bos taurus
ctgtctcagcccactctatgagcttcactgaaagtcccggatcctctgccctcagctgcaacaagtttcaactcttggccagttttgaacttactgcatcmccacccaattccccttcctcctttatcattttgtagcaggtacatagcacttcacccaggaccacaggtgtgtctttaggtagcagggccccagcatcac

SEQ ID NO: 36515 - DNA, 201 bp, Bos taurus
cgttactgggttctcactgcctgggacacaatctcctgcccagatcacctggggaccaggtcctggacagccagggaccacccccatggcccacagcccaytgacaggattcaaattatctgaccctaaatctgctctgcctgctcatgaccttgcctggccctttccttcccacagaagccacctccattcctctctctc

SEQ ID NO: 36516 - DNA, 201 bp, Bos taurus
gcgagcacgctgtcctccgagccccgggatgctccgtgacagcgacctccaatcaggctggcgtgttttccgcgcgattggagtcagtgcgcccgctcagrgcacgtgcctcgctcgccaggccaccagtgctcctgggaaatgtagttctccaggaggccagcccctgagaccgcctctccagatgggtgcagcatctgc

SEQ ID NO: 36517 - DNA, 201 bp, Bos taurus
agctgctgagcacccacctggcttctgcagacccgttacttcccccccataactggtccccagcgaatgcactcagagctctcagtgcatcagcccacgarggcctgggaaagcttcatctcaggcctgttacccacagcgactcagccgagccctgacataagcatgtgagtgcaaatagctcattcgggagatgacact

SEQ ID NO: 36518 - DNA, 201 bp, Bos taurus
ctaaacttctcgaagacagtgggtccttctcttctctgtacactcctccttgctttggtcaacgaagtgtcttctgggatgatccatggccccaagtcacstagtgggttttttgcctttacatagtacatacaattgagcatgatttgaccttgaacctttgatcctgttccagcatttctacagctctcagtgtggcca

SEQ ID NO: 36519 - DNA, 201 bp, Bos taurus
gcctgagctcacacagaccagagttagtatgaatctacatttctgggttttccaggatgaagtaaatttgaagtcttttatcacatgatcccttctttatktatccctaaggaatcttatctggccccgtggattttttttttttaacttttaattttgaaataattatagagtcacaggcagttgcaaaatcagttgcaa

SEQ ID NO: 36520 - DNA, 201 bp, Bos taurus
ttcagttttacttaggacaaatatgtgatccactgaaaggtgatgtttttcaacttcccagatgggcatggccatatgacttggtttgggccaatgagttraaagtaaaagtgttgtgtgaggtctcttcaagagcagatgcacctctttctctgttccttactttgtcagtgggcctagaacatggatgtgatggatggc

SEQ ID NO: 36521 - DNA, 201 bp, Bos taurus
gagtggcaaatggtcaggaaccttgaatggcttctaggagtcacattgggttcctggccagagacatcagtcctacaaccactaggaactaaattattccrgtgaacatagaagaagaccatgagacttgaatgagaatttcagttccaggttcacatttgacttcagtctggtgagtcctcaagcagagggacccagcca

SEQ ID NO: 36522 - DNA, 201 bp, Bos taurus
aaggaaggcttcattcgaccagggcctgtcattccagtttcctctaaaaaacaaaaagcaagaaaacctccctcttgaacactctgagacttatgacaaawggtacctgggaaaaaatagaggccctaacagtgcaggagcagctgcaaccatgggtctttgcccgggtggacacggagccaagctggtgagtcattgtca

SEQ ID NO: 36523 - DNA, 201 bp, Bos taurus
tctcctagatggggaggaggaggaagaggccacacagacatctaccatttttggctacaaagcatttctccctgttcctaaggtcacttcctgtgccattygggaaatactccttccccatctaggagaacataagatccctgcctttccctagaagtgtgacctctggggtcctctgctgttacttacctcttcttcccc

SEQ ID NO: 36524 - DNA, 201 bp, Bos taurus
tctgtgtccattgtatatacaaggccgattaatcattacaggtttctgtgctaatcacccaccacagttgggctgaccaccagggctggccaggaatgacrgatttctccccaagacttggcaggaaccaagctgcaccgttttcattctgacgccgctaagagatagctcccctgttccaggccttatcaatttttattt

SEQ ID NO: 36525 - DNA, 201 bp, Bos taurus
gatacagctgccacttactgagtttataaataggcgagtctctaaaacctctttagcatcacgttcctcgtgatgacgttagaaattgtggcactcttgcrggggaggaaatggcaatccactccagtactattgcctggaaaatctcatgcaggctacagtccacaggatcacaagagtctaacacgactaagtgactaa

SEQ ID NO: 36526 - DNA, 201 bp, Bos taurus
ggcccatgggagccccagggttgggagaggcatgattagaaaagaccatgatcctccccaccccacaagtcatctctccccgcaaccagaaaaacacacaygcataaaactaaactgaggatgtttttcatttgctttaatgtgggtcaggggtggcctattttggtataacagcaaggggcatgatagtcccaaaactta

SEQ ID NO: 36527 - DNA, 201 bp, Bos taurus
gtgctgcaggccatgggatcacaaagactgaacaacaacaagctgaaataagtgtaccaccctcctccttcctgcagcaaagaacattcaccacaggccaycttcaaataacattcgtctccaatctttgaaaatgaacatcgttttccatgttttggggggcaacatttgcctttcccatgagcagtctgctcttcagtc

SEQ ID NO: 36528 - DNA, 201 bp, Bos taurus
aagagcccaagcgctgcaacaaaaacccagtgcagccaaaataaagtaaaatcatcatgatgatttggtgacttctcttcattttctgtttaggcttccaygcctgcagatagatgcagtcaacacaagctggatgatatcgatgctattttaattgtagcttccattcatatgtaaaagaggagtattttgttttgttta

SEQ ID NO: 36529 - DNA, 201 bp, Bos taurus
taatttcccagccctcagctccactcctaatccccttctccacctgcatccagagctgttttccccaaacaaaatctgctcatttttcttccatggcccgrtgtagccatcacctccacaagtcatcccaagggcaaaggaagggcaaacactttggggttcccagagaccttctcctcgtggcctcatatccttaaccag

SEQ ID NO: 36530 - DNA, 201 bp, Bos taurus
gataaatctagggcacacgccaccccctccaccccagcagcccccaccactgacaggtggagaaaagttagacaagtcaccttggattccacctctttccrttgaggccctaacaacctgcatcgtggagctgttaaccccagcaggggtcatccctgcaagagccattccaaaccttaaggtgttgtgcaaacgagctgg

SEQ ID NO: 36531 - DNA, 201 bp, Bos taurus
tcaggctgtagcacagacactcatggagtgctcagttctctttacatccaaccccatttaaacccccacaacgatcccccaaggcaggccctcccgtcagygctactctgtggtgaggcaagcggactcagaggctgagtaactggcacatgccggcacccggcagagtgggggccacccaggggccctgtgcaccaccca

SEQ ID NO: 36532 - DNA, 201 bp, Bos taurus
tgggcaggacaaccccactgttaggccagcccatggctactcctctgtctacgcttccttctgcggaaaagggaaggagcccagggaatggtgtcactggrtgtgtggaggcctgcgacagtgtcttctctcccctagcctggtgctgacgggaggggtcaagcccagggtccagatgaaggactggacaggacaggtctt

SEQ ID NO: 36533 - DNA, 201 bp, Bos taurus
atgctgtctcccctccatccccaggcctccgggcagccgccccccgacaggggcacaggggcccctaaggtttgggccatgctccaagggccgcagccatycaggtgtggctgaaggactggatcctctactgttctgtctgtcctcccccagacagcctgggggtgtcatgagtccacccaagactgccccctgctgtcc

SEQ ID NO: 36534 - DNA, 201 bp, Bos taurus
ccgtcccctccgctctgccaagggctggaacacagcctccctggaggagcagaaagtccagaagcagacctgacaacgcctggtgactttcttgtgtgccygagggccacaagtgggcaaaggaagaaaaccacacccacctgccagccattgacaatcttctggttgaaaatcccaaactcatagcggatcccgtagccg

SEQ ID NO: 36535 - DNA, 201 bp, Bos taurus
ttactattaggggagaaaatattgggcctaaagtgttgaaagacactgtagttagaaagtagaaactagcactaaggataggggctggattgggagtgacrggtggtggggaagcagcagctcctgcttgagtggacggagtccttgctgtgagcctgggttggaaatcagtcttgtcagtgatgtgcatctgatgtaaat

SEQ ID NO: 36536 - DNA, 201 bp, Bos taurus
tttcgtacactcctcccaaacacagaaaccagagagtgaagtttaatcacgtaggattttacatgtgtcaagcgttcactataaacatttcttgggcttamtgcttccaaaggcctggaggagacttctacaaagggacaaactgggagaagggagccagaccttctgcctatgagtcaccatgcagaacacatgtgggta

SEQ ID NO: 36537 - DNA, 201 bp, Bos taurus
agaaagagggcttctgtcacatttaagggccagcaagttggctgatgtgggtggagtttagtgagggagggaaaaaggagctgaagataaggtcagaaagkcagagggcctagggggtctgtgtcctgtaggcttttgaaatatcttcaggcttagagaaacagacaatgatatttcaggtttcaagcagggtagttacat

SEQ ID NO: 36538 - DNA, 201 bp, Bos taurus
gatggacagggaggcctggcatgctgcgattcatggggtcgcaaagagtcaaacacgactgagcgactgatctgatctgctcctggaacaggctgaggggyagccgaacactgcccaggcctcagccagtttactgggcagcccgtgtgccccctggcccacagatgccccctcattgcctctggatccagttcactcccc

SEQ ID NO: 36539 - DNA, 201 bp, Bos taurus
ctctctcctggcccattgttgttggacctggggtgaaccctgagattggtgggtagtgtctgaggacaatctattttccagtggccccattgtttataggkggggcagggtttggtgggtggctggggatttgggcaagacttagcccagtgtctcgtttggttatatctaaagtaggggcctggagggttaggtcccata

SEQ ID NO: 36540 - DNA, 201 bp, Bos taurus
gaagcccactcaccttggagcatcaccactggtgaagggtgggggccacggggaccactccatttttgaacgcacctggtgatgcacccacagctgcacaygggagccaagctcagctcaggccctcgctctgggggcaccacctcaccagaccagacttccggggatcttctgtcccctcacccaccgcctgcctgactg

SEQ ID NO: 36541 - DNA, 201 bp, Bos taurus
tcgcattcctcctgggcacagaaccccttctctccgagtgcaggtggagagaacgaacagcaactgtatacgagtattcgggcctgcgcttgacgacatckgcgagcgtgagagaccgtgaagaggagtaaccgccagggcgcgactcctcgccgcgaccaggaggacggtgagggcttaccgctccgggttcctccggtt

SEQ ID NO: 36542 - DNA, 201 bp, Bos taurus
ctccactctagctgacctcacctggaggtgcacagcccagacctgcctctggtctgcttctgacacacccaacatatctcatgtggtggtgagagtcccaragagagtgaggtcaaaggccaatggctaaaatcctgagggcactgcagctatgactggagtgacaacagatgagccagtatagaccactggagcctggat

SEQ ID NO: 36543 - DNA, 201 bp, Bos taurus
gcaaatcaggtcacacgttacttcttcagagagctcacttttttgaatactacctatagccaccatcactccattattttctgtaacatagggtcagtacmttggggccctcaggctaaatagcgcttactgcctattttcctaaataaaattgtattggaatgcagccacatttattttttaagattgcctgtggctgtt

SEQ ID NO: 36544 - DNA, 201 bp, Bos taurus
ctgtccatgggattctccaggcaagaatattggagtgggtcaccatgcattcctccaggggatcatcctgaccctaggatcaaacccacaaagaggccaarttcaacaaaaccgggtggtctggatcttgtactagaacaagaaccccaaatacaccaaggtagtttgggcacccactgttacaggaactggcccctaatt

SEQ ID NO: 36545 - DNA, 201 bp, Bos taurus
acagcttcctacaaatagaatgtcctaattcagtatgtcagttggatcattcgatgaggtgaataaatcatttgtaatcagaataaaagaaataatgtatrcaaagaaaagccaaaaatgcaaattaaggaaaacatgcattttgctggctttctttgataatctacttgcatgtgttaaaaaaaaaaaaatagcacacca

SEQ ID NO: 36546 - DNA, 201 bp, Bos taurus
actttctgataaaaagatgttatttttatttggttaacattaaaactggatttggaagaaccatgcaaattcatacttgtaataaatgcatttatgtaggkacatttaaatttcccattcacaagtacatacgctctttctgaataaggtactttattgcctggcataaggcacttatgcaaaggtttagaaataccaggc

SEQ ID NO: 36547 - DNA, 201 bp, Bos taurus
cctgctcttaaccacatttccaccccctgcctcccagtcagagactcacagtgctgagttgcaaggcagcgactccagcaatagggccgcaggtctgatgmagactttctcgttgagttttgggggggttttgttttagtttcttgcctcaccacaggccttgtggggtctcagtgccccaaccaagtatcaaacccaggc

SEQ ID NO: 36548 - DNA, 201 bp, Bos taurus
gattaaatctatggtctctggtgctttgtttgctgactgttccagtggccacctaagtggtcacttaagagccattttactctaagggaagaagacagagratcaggacttcagatgcagggcccccgggggcaccagctgccctgtcttctgcctagacggtgactcccagcagcaggactgtctccatcggcattgagt

SEQ ID NO: 36549 - DNA, 201 bp, Bos taurus
gtgccacctcctgggcctttggggaagcgctacacctggctgtccggatgctggctggagcagggatgggtgctgggccatcagggagcccctgaggggcrcttagtgctggcaggttaacatcttgatgcgaagttgcatcacaggggaaacaccccaggcctctggaaacatccctccacagctggcaggtgtgtgggg

SEQ ID NO: 36550 - DNA, 201 bp, Bos taurus
caaaggcttcatttctcaaagcttttaattcgttgctttaaaaaattgtcttaacaactacttatattcttctttgatttggcaaacttctttttcagtcrtgtgaaaaccaagttccaattgggcatggtgggcttctcacaaattccaaaatagtgaagtacaaattaaaagagatgtattaaaagcaactctcattac

SEQ ID NO: 36551 - DNA, 201 bp, Bos taurus
ccgcagcaaacttggttggtatgtacttcacagagccacagatctcagcatgctacagccctctctcctccaagctgcagtttaagataggagatgcgatrtaatccgtgttttatactgaggccataccgtagcatcacgtcatataatactgcaataatgtcaaagaacccacatgcatactggaacaaagccaaggta

SEQ ID NO: 36552 - DNA, 201 bp, Bos taurus
tctcccgtcccccagctccaggacccactgagcaggcccagctcagagtcatcccaaccaccgcctgaccactgggcacgaacttagcagcagagcagcayccccaatttgtggggcagctctggcccgttaccaatggtgaccccagctccgagaagctccagtaaagaaaagcctgcatgttaagggccatgtaataaa

SEQ ID NO: 36553 - DNA, 201 bp, Bos taurus
cctagaaaagagtttcataagcggccgcatcatcagtcccttgtggggaccgcacaggatccccttactacttgcgcagcagatgtgcgtcgagtggacayagggaaaagaggttaagtcaaggccgtcccgtacaccctgagcagcctgacagtggtgtactcctggctgccctggacagaaggcaatggcaacccactc

SEQ ID NO: 36554 - DNA, 201 bp, Bos taurus
ttcaataacttattcaccaaaaattgattttaggcttccaagggtacatgagagtaaataagagagccttgcgccctcatgtttagggtatgtgggcagcrtagcggccagggctcatggttcaaaaccctaaagccatgcacacagggctaaatgctcaatgctgcctccctgaaactctgaataaggccagtatttctc

SEQ ID NO: 36555 - DNA, 201 bp, Bos taurus
tgccagggaagtccccagaacaatatatatttaatctcataagacctgcaaaatcttacccaagtcacccacataatcaggtggattgtttgtatgtaatygaatttctcttttggtgactcccacaggtgtgtggagcacaggggtcttgacccatgttgggcttcaggtgactcacactctcaaaacctgatgaagcat

SEQ ID NO: 36556 - DNA, 201 bp, Bos taurus
ccggggccagcagagagcaggagaggactgggggaggagctggttcaaagaagcccgggtgaggaactgaaggcttcccttgacttttggtttcccagccygctggccccaagggttccaccttgcccctggggctccgaacgaggacaacagatgggctcgggctcaaggtgaaggtgcagggaacaccatccatccgtc

SEQ ID NO: 36557 - DNA, 201 bp, Bos taurus
taatgtctcagatggcaccagcccctccgggtccctacctcagtgaaacgtagcgccttcctgctggcctggcattgtagttaatgagatgtgggtatcamtgaggaaaaagtaaaaagaagaaatacatgaagatatttggttaaaacatgtgatcagtaattcggcagttatggaacgaaatcaatggcaaacagaaat

SEQ ID NO: 36558 - DNA, 201 bp, Bos taurus
tggtttgtcttgacctttgtttctgcccttggccgtgagaacactgcttgctggaagaaaggtgctttccctgggtctggactgagagggtctggcacagmggggcagcctgggagggccacagagacaccgtccacatgagcccagaggctgggggtgtgcagagcccgtagtacctggggcgtctctggacttggacag

SEQ ID NO: 36559 - DNA, 201 bp, Bos taurus
gagtgaaaatgcaatgagaccttgactggtgagaagctccccttagagaaggatgatttatggtgagaaaacacaaacacaggctgggtcaaaaaatgtcraaaaagattaaaagttaaggcatgtatgctcacaatggagaaggcaatggcaccccactccagtactcttgcctggaaaatcccatggacggaggagcct

SEQ ID NO: 36560 - DNA, 201 bp, Bos taurus
tggacaagagtttgcgccgatttcaagagatagtgaaggacaggaaagcctggcgtggtgcaatccatggggctgcagagaggtagatacaactgagaaaytgaacaacaacattttaatatactagttatgaacatttgttgcaaaaaatgccagataagcaaagaaaaaagtcacctatagtcaggacatctggagata

SEQ ID NO: 36561 - DNA, 201 bp, Bos taurus
gaggtcatggaactggtcccctccttgcactcttaaattctgccaaagtaacagaaatcaagacgatttatagagtctgctttgtgatgaccgagaaactytggcctctccctagaaggtcatccaaaaaaacacaggattcttcttaaaagtccacgtcatgtggttgacttataggcacagatctaaaggatgaacatg

SEQ ID NO: 36562 - DNA, 201 bp, Bos taurus
aagaggccagcagctcctcccccgtggtggggggacacagcaatgccacagctgtccccgtcatccgccaccacacagaaaccgcatgtcaaacacacacrtgtgctccatgcagacagcctggcccagctcactcaaccatcccccacaccaccctccttccctgggcgcggtgactccagacaagagccagggcccaag

SEQ ID NO: 36563 - DNA, 201 bp, Bos taurus
gagttcggccccaggcgtgcaggacttggaaggcgtgcgggtgagccctgtgcacagcggtggcagccctctgccaaagcaggttctctcccagtcagccrgagacgctcctgaggcctctggtgggcgagcgtcagggctgaaagaaccagagcggacgggtggagaagaggaggaggcactgcgtctgcaggaaggctg

SEQ ID NO: 36564 - DNA, 201 bp, Bos taurus
atgcttgtagttcctctgtaactatagatccaaagcaaattgcaagttaatgataaaatgatgggttgtggaaaaaatgagctgcctataggttgaatgtrgtgggagatatcctccttcccatgtgcttctctccccaccagccttggcaggtggagctgcttgtgcagttgtgcactcctgatgtggatgttgcagggc

SEQ ID NO: 36565 - DNA, 201 bp, Bos taurus
tgccagccattctttaagttataagcaatcaacattgttaatttactcagatttctatattctgaacagactgaggcaaaaggccaccggctacatcccgkcaagactagggggaaaaaacagagttgcagcctgaatgtctgctaagcgatggtacaacatgaagaggccacacgtctgaactccccactgggcacgggc

SEQ ID NO: 36566 - DNA, 201 bp, Bos taurus
agagaactataaaggatattctgcattttgcaggttacatttgcaggtaacacagccagctattgcatcaagaatggatattcatgcaacctttgacttaygggtagaggacattttcacaaggaatgagcataatacgaaaggcttctgagactaaaaaattccaacatatgggagaggtgcccttggtggcagccttcc

SEQ ID NO: 36567 - DNA, 201 bp, Bos taurus
atcttttctgcatgtgctgtatatggctggacaaggatgccctaagatattaatacccacatgttgctatgtggcacactctggagtctgccagggtctcmacttgaaatgctgacagtggggcccacgtgcctatatgcgggtagtgataacacatgggcagactacatatgccaggcaagtaatcaagaaaacttacac

SEQ ID NO: 36568 - DNA, 201 bp, Bos taurus
tttgaggccctcttccatccccttgagacccactggattgctgcagctcccaggcatcaggctgacctgttcagaggagaaagcacagttgctgcccataytcatggccttactcgagtctctcatcccaaatgggcacctcgcaggctgacttcaattttagtccctaaaacactgagtttggacacaagtttaaaacaa

SEQ ID NO: 36569 - DNA, 201 bp, Bos taurus
agtctctagttcatagtattatgaactagtattatctattaagcagtcttgataggaggttgctcaagaggttaaagggactacagcatgaaaaggatttyggacagactagttgggcaagaattagaaaggaagaagcatgcaggttatgcacagagcacattgcccacatcagaaaactatacagtatggaggctcatg

SEQ ID NO: 36570 - DNA, 201 bp, Bos taurus
atgctcaaatatatctcttgcttcctctttaaaattatttttgttgaccctgtgccaggaagcactcactttgttttggccttttatatatatcacacagkatcttcctgttttccttgcaaggtcagtgtttgctacaaccaagtagggccctttggatgaaggatctgactaaaatttctatactctacaaaagctgta

SEQ ID NO: 36571 - DNA, 201 bp, Bos taurus
gccccacataccagtcctcagacactatccttgggactcctccaggacgctgcagccagccactgagaccctgtctcatgaaccacttggctgataccaaygcctggacacccagggccctatagccagagatcccaggaccccgctccactcaccagtggaccagaactaacccttgaactagtatcacccattagtggg

SEQ ID NO: 36572 - DNA, 201 bp, Bos taurus
cgctgggaaagcagacctagtgtgttaaagaccagaacaagaagcaaagcgcaccagcacacctgccttccctggggaaacccagtggcccacttccggcrgtcctttatagaaaattcagtcaagacagacagacacaggcagacagagagacagagagggaaatagaccgaatgcttcctctggaagaacagagagtga

SEQ ID NO: 36573 - DNA, 201 bp, Bos taurus
ctgaagtacaaagtgcagctgattatgtagctttgtcttctttcaaatgcttgctttcacaaagctccttctggcatggtttgggtatcatcttgcttgaygcagtaggttggaggttatgacctcttaaaactcatatctctcaatgccattttctgattactccaaataagtacgaagtttgtgactttttaaagaact

SEQ ID NO: 36574 - DNA, 201 bp, Bos taurus
ggaggaaaaggggatgacagaggatgagatggttggatggcatcactgcttagtcttacatttctgactctttagaaagaaatcagtcggaaaaggaaatkttattttaaagccaatttcccccattgaattccacatttgtgggaaaaagcattttttgagccatagtttaggattaaattgtatgtcttttatccacct

SEQ ID NO: 36575 - DNA, 201 bp, Bos taurus
tctcctgaaaacagctcttgtttctgaagtccttttactgggaaatgctgttgaacaatttgcacaggacaagtaggagagctggagaaaagacaacaccraacctctgcattcagttcagtacatttaatggatacctcgatcagtcttctattgacatgaggttcttccctgggccatagtttcatattcctatcttga

SEQ ID NO: 36576 - DNA, 201 bp, Bos taurus
ttggcctccaagttcatgcataaagagaccatagagcacagttagcaaaccaatatttataacattttaaaacactttgaataaatacaactcactgatcyggttgtaatagctgttacactgcttggagaaaggcaatggggaagggatatgtgaatatccttccccataggctaggagaggttggatttctccctgact

SEQ ID NO: 36577 - DNA, 201 bp, Bos taurus
tttgggtggactccgggtgttggtgatggacagggaggcctcgtgtgatgcagttcatggggttgcaaagagtctgacatgtctgagcaactgaaatgaamtgaactgaactgcacatttttacctttaaggcattcactgctacatccaagagattctacatcagtaaaaaggcagtgatttagagaagaactgtgtttg

SEQ ID NO: 36578 - DNA, 201 bp, Bos taurus
agatctatgggatggctatcaggcatattaacatgtatgttgggagtctctgtaaaagaggagagagaaaagggcagaaaaaagtttttgaagaaataacrgccaaatagtttccaaatattttattaaaagctagtccacagatccaacaaactcaatcatttccaaggagagccacacctagagacatcatggtcaaac

SEQ ID NO: 36579 - DNA, 201 bp, Bos taurus
tttatatatttagaacttacctttaaggaaaacctgaatgaactgtttggccaacccagtatattttatgtataaataatggagttcctactcaatttctmaatttttattcttcccagaacatttctgagcattttcctacctgtttttctctgtcccagtcatgacgtttcctttataatgtatgcattgattttatac

SEQ ID NO: 36580 - DNA, 201 bp, Bos taurus
atgatttctaaagatgtccaatgattcatatataagagaaggtaagaggcacataaactagattagagtagccatggactaggctgaggatagagaccctrtggatgtacagccatcctcttcccctcagacccttggtcagctcctaatgctttgagtctctgcagcttggagtttgccctcatcaactgtatgagaacc

SEQ ID NO: 36581 - DNA, 201 bp, Bos taurus
ttctttgaagggttctagtgagtaactgaatggtaaaggggagagtttaagagaactcctcaatttgtagacatctggacataagtgcatgtagcctgacrttagaagtgaggatagtctatgagcctaaagcccttaactcgtgggctctgcattgactgtaggtagagtcataattgaattgctggacaccagatggaa

SEQ ID NO: 36582 - DNA, 201 bp, Bos taurus
aaaatctgctgtgatactgtgttcacagtgtttggctgcttgccattcaaaagccaatatttgagagacaagtgttggttgaaaagaaaaatttgctttgrataccaggaatctggagagaaggcagcctcatgttgaaaagccaactctgaggattctgtttgactataaaagtttttaaaaagagaacggaaaagataa

SEQ ID NO: 36583 - DNA, 201 bp, Bos taurus
aaggaaaaatgagatgagctatctgtctttcactgccatttctgagctaatatgagggcttattggaaaacttgaaacaaccaatagagaccatgaaaatrttagtatcagaaatacatagaataaaaattttgttaagaccagctatgaatttaaaatggatttggaaatttctcttacaaggacccacttgtactcttc

SEQ ID NO: 36584 - DNA, 201 bp, Bos taurus
aaatcaattttctaatctagaatgatctccaatgccaggtatgattctgattttccctggtaatacaaccgatagtagtgatttttaaatgtcttcagttyaactgtgggcaataaggttgtatcatctcctccacaaaaagagactgctcttgggaactgtcacatctttgcctgaagttctctcactcagtgctggaat

SEQ ID NO: 36585 - DNA, 201 bp, Bos taurus
tgctgacttctgtgctgcctcaatgagtcttccactgcctctgcgccagctggatggggctgctgaggggtatcatcttccatctcactaggtccttcatyctcctgggcctccatcagggacccctggtcacgggtatcactcttctcctcatccacaccagcagccgagctgtcctcttcatcctcctctgcttccttc

SEQ ID NO: 36586 - DNA, 201 bp, Bos taurus
gattaggtgaaactctttcagatgacttcctaacaagaagtggcaagcactctgttgctttccgaaaactccaaaactagaacaaagcacttgttataatraagagagaaatgaaccagtgtgtttttctggcacttttgaggctgaagatatccagctttcacagtggaaaaatacttctttttccatcaggctccaatt

SEQ ID NO: 36587 - DNA, 201 bp, Bos taurus
cattagaacctgaagcaaaatgaaaaatcagtaatacttatcctatttattcaaaagatttatattttattcatcatgggttttgtattgtcatttttttwaaaatatttcttatcttgagagacaagatagaatacaacagtccagcaagaaaaggagacctacagccactgagccccatagccagagcccagacactgg

SEQ ID NO: 36588 - DNA, 201 bp, Bos taurus
tgttaactaaaggccaaaatgcccagctgaggactaacagatttgcatgattctttgtgtcaaccactgactaggactgccataattgaacatgcatttgycatgtgggtggtctcctgtcctaggttaaacaacatcttcctaatgtgacccaagggaaatgggatgggtctgtaagagctaacaatattcaccccattt

SEQ ID NO: 36589 - DNA, 201 bp, Bos taurus
gttgcagtgattctccttaaggagtgaggggtccaaggcccacactaggctccccagcctagggatcctgcatcaggaagaagagcctacagaacattttkctttgaaggtcaatggggccagagagctataggaaacagagtgctgtgcttagttgtttgatcgtgtctgactctttgcgaccctagaccctgactgatt

SEQ ID NO: 36590 - DNA, 201 bp, Bos taurus
ggaaagagcaaacagttcaaggcaaatgttgcaggatcctcctctcaaatacttaaaattaccaattagcttaagatagaagatatttcgggaaactttayacacataactttctttaatcatttttaaaggaaggtcacctaaaacttaatacaaatccaggtggccaaacatctttggctccctgacaaattgacagta

SEQ ID NO: 36591 - DNA, 201 bp, Bos taurus
cctcttcaagaaaagacttgttgccagctgcagaagcgattgtggtccacagacagcacccagatgtcagttccatcaggagctgccttacctcaggccaygcccttccaagtacagtccatcctagaatggatataaaggctgggcatttttcaatttaacacaggacaactctggcaagcaatcattcctccagagctc

SEQ ID NO: 36592 - DNA, 201 bp, Bos taurus
gaatgctgagaatcttttcatgtgtttattagccatctgtatgtcttctttggagaaatgtctctttaggccttctgtccactttttgattgggttgtttrtttatctggtattgagctgaacaggctgcttgtgtattttggagattaagccttcatcagttgttttgtttggtattattttctcccattctgagagttg

SEQ ID NO: 36593 - DNA, 201 bp, Bos taurus
gggaatgccttctctggataaggtgagctggtgtgatggccgggctcttaccctccacctacaggctgcaccaaagagcttcctacagggaagtttgcagrggcagggcagccacggggccatggagatctggatggcagccacgtgtccttgcaaattttgcggtctgtattatgagcggctgattctgaggttcctttg

SEQ ID NO: 36594 - DNA, 201 bp, Bos taurus
tcagagtcaggcttttccgagtcttcatctacttgcctctccagcctcacatctgtcgagtttagcaacacatcttcccttctcatgtctccctatgccarggtccaaggcctcctgcctaaatatgacgaagtcccaacatctttcaaggtcaactcatctaagaagtccttcttgattgctccagtctcccatctgcac

SEQ ID NO: 36595 - DNA, 201 bp, Bos taurus
tcctcaaaagaatgttccttcccacagttctctttgtccttttaacaacacaggtgccttaccacctccatgctctgagtcacaaggtcccctcagatggrgaggccttccccagcatttctccgtttctcaagcttcaaggcccctctctgactcactgggcaagcaagggtggggggctcgcctgcctctgggtggtct

SEQ ID NO: 36596 - DNA, 201 bp, Bos taurus
aaatgtacattagggtgcatatttaaaatgtttttactgatgggaatatgattaaaacattttaaaacatgactgatttttaagcctggtgaaattgggaragaatattagatctggaaggaatttcaaaggccttcagttcccccatcattccctctctcatttgatgtgcaaatctctctgttacattagattgcctcc

SEQ ID NO: 36597 - DNA, 201 bp, Bos taurus
tttggccagagatcttgtggtttccctcctaggtcctcttcccaccctgctccctgctctttgtcctgggaggttgctcttcagggatcatgtcaatgacytcccttgtcctctggccttcagctggacctggcccatggggagcaatggcaggctgtgggagggaggaggcgaggttagggtatctgttccccagctcta

SEQ ID NO: 36598 - DNA, 201 bp, Bos taurus
actgctgtgtctgactgtccccaactgcagtggcctcttgcttcctgtccccctcttgcctcctccctgaccctctcctctccatcctcaccatggccacmagagtgtgcttttaatttacaaattggatcctcccacacctctgctctcagcccaccagtgtgctgcacacggattgcaatcccacctctttactgtgac

SEQ ID NO: 36599 - DNA, 201 bp, Bos taurus
cacccaccacctccatccaggtaagcatcacccgttcaaatgaaccccagctgttgggaccgcctgctctgacattctgcgtctccatgtggcctaaggtyctcaggctccagctgctcaagaaggtcctctggactacactgtgaggaccagggagtcctttgcatggccctctgcactgaggcccaggccctgtgacac

SEQ ID NO: 36600 - DNA, 201 bp, Bos taurus
tcgtgacagagtgacaacagaggcaagaatccccagccacaagtggggttccctttccacatgtgcctcccatgagaggcccgcaccctgggctgatctgygaggctctggtgaaattccccgtcatggtgacatatgtaaacagtggttaaccctggcaggcctccatgggaattggagggaaggggcaacctgagattt

SEQ ID NO: 36601 - DNA, 201 bp, Bos taurus
ctcactctttatttttcggccgaggcatgcaggaacgtggctccccgaccaaggaccgaaacctcacccccggcagggaaggtgtggagccctaaccagargaccaccaggaaatgccctcttaatctttatgtaactgaatatatcaaatctttgtaaatgtatcaatctattttcccccatttttgttcaataaatcct

SEQ ID NO: 36602 - DNA, 201 bp, Bos taurus
ctctccccaaccccgcaaagcaaacttgtggaccggcttcccaccagcagaagcgacagagctcttgggtcgatgcctggctggggccgtgattctgcttyggcatcgtggggggtctccctgcctggtctcttctgttctctccctgcccctgcaattgtttctggggccccaggcaccctgccaatcaggacatctggg

SEQ ID NO: 36603 - DNA, 201 bp, Bos taurus
agcatgaggaggggaagtggggccggctgctggctgtgtgtagggggctggcagcctctcgctaggctgcgtccaccaggcagcacccgtataccctgttktggccatgtggaggtgtggaccatgtggagatgggtctgttgatgccgcgcgtgtggactcgtgtgtttcagggctgatgtgggaggtaccggctgatct

SEQ ID NO: 36604 - DNA, 201 bp, Bos taurus
agctccaccacctcctgcaggtgaggttgctcccatgtcatggagacccacctgtctgtcttctgaccctgggtggcctttgggccagccggtgggcagcyggtcccactcctgtccttggcactgctctcccaagcaggaaatggatcccggcagctgcggtcctacagggcaggaaggcggcctcggggagggcttttc

SEQ ID NO: 36605 - DNA, 201 bp, Bos taurus
tttgggccccgccaggcctggccctggttctcatctatgacatggcgtgacagctcacaggaatcgccccccgctcaccaggcagctgtgagccttaaagragttaaaacacagaagctcctggcccagtcaggtgtgtgggagaccctcagggaatctagtgacagtggtgccgatgacagtgtcaaaagcagccggagc

SEQ ID NO: 36606 - DNA, 201 bp, Bos taurus
ggccacgaagacgcagtggtccctgagtgtccatgcagggcacgagtgtgtatcatcaatgctggcatctgagactctgctctgaactcaggggtgttctkgtcctcctgtagagggccttggtggcacttgaacttgggctcctgtaaggagccctgctggacccctggggctccctgcagggactgctgcatgggaggg

SEQ ID NO: 36607 - DNA, 201 bp, Bos taurus
atgccctggcaggcgtcactcaccaatcccagggcccttgccctaaatcctgaccctctgctgtccagagccccgggcagctcctggtggcagtaacactygtcctctcagcctgggtcacccttgatggagggtggacgaagcagagtcctgagctgcgggctgcgggaggagcatggagaccgtggggctgggcctcac

SEQ ID NO: 36608 - DNA, 201 bp, Bos taurus
cctgcagcaaactagaagctttacaactcttgcccacagatggtttgagaagcacgtcgagaagatatgacgtgtgttcagttaacagggatacgttcctkccctgcaccacccgcgtggccagggctgggcgcccagtcagcccccaatgcgaacacgcacccatgttgccattctccatgccgcggatgtcagggcgta

SEQ ID NO: 36609 - DNA, 201 bp, Bos taurus
gggccaccagctggggggcactcatagggtgtctgagaagggcactgacagcacagaagcctggtttcccagacgatccttactggagggtccctggtgtkgcaaggaaacagctggagtgatggagcaggggggcccggggggactcaggccaggcgagggagagggtcaccaagcaggggtggggcaaggatctgtgcg

SEQ ID NO: 36610 - DNA, 201 bp, Bos taurus
aatgaaattttccctgagtagtccgtttttttctttcagctctgttttttctaaagttaatttctgtcaccttcttgaataggccaagcaaatccagataygtataactaaatttaatagaatgacagacgaacagggaaagcgattctaagaattttagctactttacatttccctatctcctgaggcctagtttagtgc

SEQ ID NO: 36611 - DNA, 201 bp, Bos taurus
gtctccatggtgagtggagggtgtgccccaaagcccagaggacccatcacttctacctgcagctgacggctgacaatgaccaaagaaaggatccatcctaygggctaccagtgtggcctgagaacttacacgagggtaaatcagagaatgactcttacggaccattcagagctgtggagagcaacctggtccatttcagac

SEQ ID NO: 36612 - DNA, 201 bp, Bos taurus
gcggaattgtacacaaaacttctctaaactttcgggatgaacagaagctgtgatttctgaaatgatcagactgtaggggcatgcggcccctgggactcacrgggactatgcacagtgtgtaaggaccagcccagacaccactctcgtcaaccggctccgggatcgagttaccagtaacgagctacaatccaacggccattt

SEQ ID NO: 36613 - DNA, 201 bp, Bos taurus
agatccgtgacagatggatgccttgcctgtgtttatccacccaaggcggcctcccttatgcagcaagcagagggatgctggttggtggccactgctggagrttccagccatgggtaacacatccatatgttcatggacactgtctcctcaatgccccactggcttcaaggcctcgggatcagaacaagtgtccttcctcac

SEQ ID NO: 36614 - DNA, 201 bp, Bos taurus
tcggatattagaaactcatcttcttgaaatatcttacttacctagaactgcctggtcacctaactgagatttatttccaaaatctcatttggaaaaattakggagattatttcttggggaaatattacacatcacaatgggagaacattttatttcagagaaatggttcttttccatttgatctgcctttaaaatccaccc

SEQ ID NO: 36615 - DNA, 201 bp, Bos taurus
gcagcagcagggctatctgggaaggcatatacaattgattggtgtgtgtaattgtcagacgtattgaatggacacttaagatctgtgcatgttaatgcccrtaatttataccccaattaaaatgacagtcacatagataaaggtgtctatgtgggattctgcagggaagttctatgaccctggaaactttttgcagaggaa

SEQ ID NO: 36616 - DNA, 201 bp, Bos taurus
ggtggacgtggggagacaccactgttatctatacatgtgcaacaacggctatagcaaactcaggccttccctcataaataaaatcttatgatcatgtgacrttctgttttcctattgtcaggagtgatgggagcatctcatttgcaaagagtcttgggaaaacaaaatctgtagaaaacatcatgagatctcaccctttgc

SEQ ID NO: 36617 - DNA, 201 bp, Bos taurus
tgggtatggggcccgctgccactgtgtgagctgccagcaataccatccttgcttccacatgtccacaaaggcagctctcgagactggaagcttctttagcygggcagaaggccaagcggggcgagctggcgagctttttatctcggctctgaactcgtgctctgaggttcagacttaactcagattctcacatgttgggga

SEQ ID NO: 36618 - DNA, 201 bp, Bos taurus
acctgggggagttctcgcataatcccatgctgtttacatttttccagacctctccccagattcccaccttggcttctgctggccattgactcctcactgtkgtctttaagtttggtttgggctctgcaaggtctcaagcaacaaaagtgaggttgacttcactctggcccagagacagcatagctcccctacaatgtatgg

SEQ ID NO: 36619 - DNA, 201 bp, Bos taurus
gagagtcttgtctggagggtcggccacttcaccccacgctgcatgtagtatgaaagctgccgcatcaaacatagagacactaatcactggtaactattctyggccctgctaagtgatgcttttcctgctgtgttcctgaaaattcagcttctcatctagaattcatccggagtgcctgcccgtgaattaataattttgagt

SEQ ID NO: 36620 - DNA, 201 bp, Bos taurus
acaaagtgtgtgaacaagcccacgacaatggggatttgattgaaacccaagccccgtgttctagaagtttccatggcctgtgagggatgccacgccctccyccacttcatcccacaccgatggaaaggtgaaggtttattactgtcattttcatttaatagaggccatcgtagcccctaaaggttaattaattttcacaag

SEQ ID NO: 36621 - DNA, 201 bp, Bos taurus
tgaacagtcacgtccaacctgagcgccgatggccttgaccaccctgcctcccccgtggatgggggtggggatgtgctgggctgctgcatttggaggccagrgcttcatacaaccaggctccctttcagcttccttccttctgtctgaggtccagcccgcatccggtcagcatgaaatacaccacagatgacctcgtccccg

SEQ ID NO: 36622 - DNA, 201 bp, Bos taurus
gtgcagtaactgtcacctacacagtgtaaccaagccccaggccgctgcatgttaacaagcggaggtgggcttttcagcttcctgacatcacaaggtcaccrggcagacactcacacatggccagttggaggggtggttgtcccatccagtcttaaccgacttagcttgaactagacacagctgactccaagttcttggaac

SEQ ID NO: 36623 - DNA, 201 bp, Bos taurus
agagatgggccagggatcattaaactggctggctttctctccctcctccacagtcatggttagactgaacgtgaaatgaacatctagtccaccctccatcrtgggagcctagtagggccagatcaggatcgtgcttcaagttccccaaagtaagcgtcccctcactttggggaggcttccaccagacaactaagcacacag

SEQ ID NO: 36624 - DNA, 201 bp, Bos taurus
gggccatccctgagctgggccctcagaaggccttggactggctgcagaggagaaaactgccgaggagcccagtaaagggagacgctgggcaaaggaaagcrtgcatgacaagaaggcccgaggctgtctgcagcccccaggaccacagtgtcagaagtaagagccaaaacctaagctttcaaagttcctgccactgcagtc

SEQ ID NO: 36625 - DNA, 201 bp, Bos taurus
gctccatgcaggggcctctgaaggcagggccaggggcttgtgcttttgggacaacctgtgaggaactgtggaacacgtgcctagaccctctggaggctcckggatgaagattctagaggcctgtcccaggccagcgctagctccaatgttaccttctactctcccaacccaccagaaagctccctgctgggaagtcctttg

SEQ ID NO: 36626 - DNA, 201 bp, Bos taurus
gggaccccagagccctggagcacagagatgctgttctctctttagcgaggaaataacagtaggataggagtggatttcattcttcaaggaacagagaccaygtgtgtgattggcagagctccctcgggaagacaggttctcatttagccagtctgagtgacaccttgaacaccatggctatcgatgggtatttgtgaggag

SEQ ID NO: 36627 - DNA, 201 bp, Bos taurus
cagagcctttctggaaagtccagtggacacccactgtggtgtggtgctgagagtgggtggtcagggaggaccttggaaaccagacagaggtcagaggtgayggtgccctggagctgagataggcctgttccccttccttctggtgtgagcaccccaattctgttcttaggccctgctcttccctcacaagtgctctgggct

SEQ ID NO: 36628 - DNA, 201 bp, Bos taurus
aaactgagccatagagcagccaatctcagagccagagtggttcaagcccagggaatctggttagaggctgtgcccttaaaccatgagtcctccgtggtggygctacggtgcccagattggcctggagtcagcctttgtcttggatgaactatttggattaaaataaaactgacttacttcactctgtataatgggttccag

SEQ ID NO: 36629 - DNA, 201 bp, Bos taurus
agagaaaggggctggaccccgtgtgagttatgaaagggaagaccagatgagaggagataacagcttcaatgccttgcttttattatacaaatctgcacttycagttggaagaaaagattttttttttctattggtggttatttgcttaagagaattggagacctgagagctgtctcggtggatgattaatgggaaaaaatt

SEQ ID NO: 36630 - DNA, 201 bp, Bos taurus
tgttggagaagtgactcacactgttggtcacactctttattttgaaattggggaagcaaccctaagacaagtgacgaacttacatacaccaagcaaccacrgcatctcacagggtacatcattctggaagaactgccatccttggcactcagctttcttacctgctgaaccactggtgccttgcagcagcccagctcaggt

SEQ ID NO: 36631 - DNA, 201 bp, Bos taurus
agctcccattgctgaaggcacctcctaaactctttaaaatttatttatctaattaaaaacctctcagcagcccaacacactggaagatttcatttttaacyaacacacagtcaacccaacctgtctgggcagggcagtcccatcccaggagcatcacccccaccgggccttgggaggccagggtgaccagaacagccatcc

SEQ ID NO: 36632 - DNA, 201 bp, Bos taurus
agtcaggacacggccagccaccctcagccacagccaaaacccacgctggcttccgtggtccccgactggctgccaacctgggcttggcacctaagcaggaygtctgcaggatttgctgggccctttgttcaaaaatgatcagttatgaagaatttcaagatggtgacaatagaacatcaaaccaagcacgggcccttctga

SEQ ID NO: 36633 - DNA, 201 bp, Bos taurus
cccccagacgccaatcgccagccctgtaggacctgaacctgcaaacagacattgtcctgccagtggtttgcaagtggccgctctggtttcctaaccctgcmgtgcaagttggggtgtgttttgaggagtcttctcaagcgctcctcccctttggggcagccacaaggcccaggagttaggaaatggagtgtaactgccatc

SEQ ID NO: 36634 - DNA, 201 bp, Bos taurus
actacaagctgtccgctcgctccttcatcggccggcacagccagagcaggaggagggaagatgccctgtcctcggtgagtgcctgagcttctagggccctrgatgcccccatcaagtgcgtgtggtgttggggttgagtgctcacaattggggcagacagagcggctcccagcaggatgggccctcgccctcccccagatc

SEQ ID NO: 36635 - DNA, 201 bp, Bos taurus
gctagatggctgtttgaattaggtggcttatggtttacagccaaaaacatcttctgtaagacaagattccaacctacacagaaccccaagtcaggagaccmaggtcgattctgggcccagcttctccggaaacctgagaccggcatccatgcctcactctattcacctgtgtggggaggaggcgaatgagacactgcacgt

SEQ ID NO: 36636 - DNA, 201 bp, Bos taurus
tacagtttaagcattttggttacaacgggcaattttctgtacttttttgtgttttcctctgtggattttatggtttcatcaaggcaaagagttacaccagrctgtaattaacagtattgtgcttgtttgaatacttgtttttgtgtattagctccagaaaggtcaggaagaggaacagctgctgactgaaggtggattcag

SEQ ID NO: 36637 - DNA, 201 bp, Bos taurus
ggggccagaggaggctgctgggacaaagatgcactgagagctggaggagtccagcaggtgaaagctggaggattcgacagcaagtgcaaaggtcctgtggygggctctagtgtgggggccctcccagaccacagtgacagctttggcttcttcctcaaggatgatggggagccacagagggttctgagctgggggagtggg

SEQ ID NO: 36638 - DNA, 201 bp, Bos taurus
gaagaggcaggtatagccagagttctatgttcagcaggagtaagatgaggaagcttccaattatcagtttctgtgttctaggactagaggctgcagatcaratctgcagagacaaagaccaaaggagtgatggatcggaagagagtgaagaagatctaagaacgtgtggcaggcaggtggagaccgagctgaaggcagaag

SEQ ID NO: 36639 - DNA, 201 bp, Bos taurus
aagactataaacaaaaatgtccacaccacagttccctttgcaggcacaaaggtgtctctgagggcagcacaggcatcctttttggccagaagccttcattygctcactcactagttccttgtgtgtcctctggagttacaggagcaaagcacagcctctgcttagggaagcatgtgtcctccggggccacaggaaaccaat

SEQ ID NO: 36640 - DNA, 201 bp, Bos taurus
ggccagcccatcttgcatttactcaacctgcttttgcagccctggaaaatatgtaaataaatgggtaatgctgttccaataaaactttatttacaaaagcrggtgatagggtggagttggcccacaagccctagtttgccaagcctggtttagcccaacaggaactgagatgcacaaattgaagcaagctgacctcttcac

SEQ ID NO: 36641 - DNA, 201 bp, Bos taurus
ctgcttccctcagtttcttgtgcctcattctccaccaagcgtccatcacaggcagcagtggcccaactcaagggcatccttacagctactttcttggccarcatcttcatctgccagggaaggactctgattggtcagtttgggtcttggatccacccttagaccaatcatcatgcccaaagaaatgggacactcccattg

SEQ ID NO: 36642 - DNA, 201 bp, Bos taurus
gtccagggcaggcttcggtgcccatggacagctttccctacagctgaccgcaaagccagctctgagagccattctgtcaccttcctctatttgccttggarccagctcgggagatggtgtgacacacccacacaaagcttggcagtgcttctcggcttggcaagcgctggcggagatgcgcagaggtgttcgtgaagggga

SEQ ID NO: 36643 - DNA, 201 bp, Bos taurus
ctcgctgtcagcaggctgaagcagagcttcccaacccaggtttgcctgaatcagctgaagcagagcaaatgtgagaataaatgcttgttgttgaaagaaakaaatcaggaagaatcaggccaagtaacacagagctcagtgaggcagggaagggccagtggtctggtgtctcaacagtaagcaaattcctggagggcagga

SEQ ID NO: 36644 - DNA, 201 bp, Bos taurus
ttacgaagaaatacacttatttctaaaatttccaacctattctctatagccagtttggggccagatctatagatatcacccaacctttaagagatggcccyatttcagtctaactatgagaacaaagaaacaacccaaattctttctcaaggtcccagcaaggtgagggggattcagaattctctccaagtgtttctgggg

SEQ ID NO: 36645 - DNA, 201 bp, Bos taurus
aggtctgactaatatccttagaaaggcctgctggcaagattggctttggcggttgtataggaacttggtttcagggagagtttccaccatccctgagttgrtaagaatggagcagggcctaaactgtttgtacaaacaatgtgattcatacaggacacctgcttcccttcaaagagtctgagactttggtccacgccacac

SEQ ID NO: 36646 - DNA, 201 bp, Bos taurus
tgcaagctccctgagccctgacgtttagggttttacggaggatccatttcacggttgtgattgagtaaatcattggccattggtgattaactcacttttcmgctcctctctcctccctggaggtcagaccaaccttctaatcattccaagatctctttggccacagtccccttcctgaagccatcaagggcccccaacatg

SEQ ID NO: 36647 - DNA, 201 bp, Bos taurus
catgctgagtgctattatgtgccttggcccattattcaaaataaaaatccttcgaggcaggatctgttattacatttgggtccaaggtcgcacagctgcaygtccaatagaccctggcctctagccccagtcagcctggcttcactggccatcctcccgtcatcacttctggcttttgggaggatgctgtgccttcaggag

SEQ ID NO: 36648 - DNA, 201 bp, Bos taurus
tcaaatttatatatcccattaaacatctttcctgaatttcagatccacatattcaactacctacctgctgtcttggatgtgtaacagtcatctcaaaactyatgtccaaaacctaatttactttcctttaccttgcccctttaagcttgccattctctatgctatactaagtcacttcagtcgtgtccgactctgtgcgac

SEQ ID NO: 36649 - DNA, 201 bp, Bos taurus
gcagaaagaagaccagaaagtaaagcccaaacatagttaaaggaagccaaagccaggaagtaggacagatggcagaacagcccccggcccttggttctcarccttcccttgagggtttggggctggtggacactcagttccccaactccaactcggaggctcctttcagcaggtctaggtgggcctgggtgtccccgttcc

SEQ ID NO: 36650 - DNA, 201 bp, Bos taurus
gccaccaactctggatggctcaagcagacatgcgtggatggttgcctgagtgccagcaggaagtgggcaagagcaagaacataaaaaagcacaccttttcyggccatcatggcctgcactttcagctctacaagctccaggaccccacaacactgagatccctgccatgtcctgcagccaaggaggggggcacgattttat

SEQ ID NO: 36651 - DNA, 201 bp, Bos taurus
cctggcccgtcacgtgcaccagaacatttccaaatatatcttttagactctacctggagctggattcacagtctagtcaaggaggcaggacacacaaacarctctagaaggagaaattgttggccttagccatgtgaagtgaaaagcgaaagtgttagtcgctcagtcatgtccaactctttgtgaccccatggactgtag

SEQ ID NO: 36652 - DNA, 201 bp, Bos taurus
ggcagggcctggcagccaaccaggccagcggatagccctacctactctatgaccacagtattcagccctgccacaacagaagggcccatgcagcccaagcrggggcacctctacagcatacagctctagtgactaggcagagaatgctgctgggctgcataagaggtgtccaaacaaggccactcctgcacaaccgggaaa

SEQ ID NO: 36653 - DNA, 201 bp, Bos taurus
gacaggccacagagatgacatggtcttttgctccgggtgagccgggagtcactcaaaagtaatgcccagaactccagcccaggctgtgcctctgagtaagygagggccctcctgggcctcagtggccttacctgagaaatgggacttgattgtgtgtttgtgttagacactcacgccagctccgtggggggtggagggcac

SEQ ID NO: 36654 - DNA, 201 bp, Bos taurus
tcagtttcgagctgagtggagaaaaaactgccaagctcaggctggtggagaaagcaaacccacacaggtaagcagtcacaggcctgtgtacagaatgagaygttattgttgctcatatgctgagtcaagataaggatacaagcatcctcaagctccctgtgatctgggggccattaatgatagtttgtatacctccttatt

SEQ ID NO: 36655 - DNA, 201 bp, Bos taurus
cacagtaatcctcatttctaggaatctaaatatacacaaactatgcacaaagttattcattgcagcttcatttgtattaacaaaagattggaatcaacccraatgaataaacaaggatacatttccttctgcatatcaaatgaccccaatctggtgaaacacaaccaccacaggctttattttgctcacggattctgtagg

SEQ ID NO: 36656 - DNA, 201 bp, Bos taurus
ttgaaagaggtcttttccctcctccactccactgatcctctggggcaacactgcctctgttttgcagcccgtgagttacctgccttggccaatgtagggcrggaaccttgcctttccatccagccccagccactgctccctcccctctacctgtagctctgcctctgctttggcccatgatgcatctgggtcctgccgccc

SEQ ID NO: 36657 - DNA, 201 bp, Bos taurus
gaaatgagaaaaatcctgtgccggcttagaacatgcctgtcacggataaatagcaggggctcagtaaatggtagctattcccttgcaaaccaaatctcccrtggagaccaagctaggacatgaggaaagaatgggggctctgcgaaagctgaagctctctcctctctaccttgcggtggccacagaggcccctctcaaaag

SEQ ID NO: 36658 - DNA, 201 bp, Bos taurus
aaattataaaagaaaactattattaacatccccagagacataaaagaacacatcataaaactatagacaaaatgttagtggaaaatgaacattccccaaayaagaaaaagcccttggaaattaaaaatatggtagtgtgtactaaaattcaatagaagggtcagaagatgaagctgaggaaatctcttcaaaagcagagcc

SEQ ID NO: 36659 - DNA, 201 bp, Bos taurus
tgctagccagagatgtatatgctagaaatgactggtctaggtgctccactcagaagcaggagtgttccactcccgctctctctccctggcctaacaatggyaggcaaggctctccatgatctgggtccccgcgacctttctgacatcatcttctgcaaccctctctgtggctggcccttctccagctttatggtcctcctg

SEQ ID NO: 36660 - DNA, 201 bp, Bos taurus
aagagtactggagtggggtgccattgtcttctccgattttgtactaagagctatacatatattttttccctctaataaggatccaactagctatatctgtscccactgaacagatgaggaacctgaggctcgaagcgaacatgtaatttccctgaagacacagagacctggggccaggtctgagattgaaacttgggatgc

SEQ ID NO: 36661 - DNA, 201 bp, Bos taurus
aagacacctccctgtcgcctaggtaagcagaaagaaaaaaatgtaaagtgaacacctttgcccctgagaccccacaacacctggccttggtgatgatgctratactgaggacaatggtgggggtaggggagcaaagagaagaggagggaaagaggaggagaacaccaatggccttcactcactcgcggcttagtattcgcc

SEQ ID NO: 36662 - DNA, 201 bp, Bos taurus
gtgacaacctctggtggcctgaatccaaagaagagaaacacagaggaagtggcaggtataacaggcacacattaggggaaggagatgggctccctgagatktacagagaaagggggccatccccatggcggtggctttggttcccagaagcggagtgagtgtgtggggcttttgaactggatgaaaagcatctctggatta

SEQ ID NO: 36663 - DNA, 201 bp, Bos taurus
ggactaagaaaaagtccaagaagctcaagtactgcgaccaaggggcagctcagaataaaagggatcttcaggttcaacaggggccaacccctggaggctgyatcatggatttatttgtcctttaacaccagagcaaagtcatataacaattgtgctatttcacttagaagtggaaattgatgttcagagaggccaggagac

SEQ ID NO: 36664 - DNA, 201 bp, Bos taurus
aagtcatgagggaaaagataaaagatttaggggaaagatccaggaatcctaacatgcaaagacacaggttccagatggagacaaaataggagtagaaaaaraggcaaatatcaaactcagaccagaagaagatttccctgaactgaggaaagatctagatagcctgtgcactccctggaaacaaaagtgcttctggctaag

SEQ ID NO: 36665 - DNA, 201 bp, Bos taurus
ttactgctatggcaggaaatattccattcctcgggtcttataaggcagatattattggaatggggtgggggtaggggagatttttgcacactagacacatycagtcatatctggagatattcttcatcgtcataactgagtttgctactggcatctagtgggtagatgctgctaaatattctacaatgcacaggatacaca

SEQ ID NO: 36666 - DNA, 201 bp, Bos taurus
agactcattgaagataagccacgaacaagccataggcggtcttattctggaagcagatctaggtaatgtattgaagggtattgggggagacagtatttgcyacaaacaaaagaaaattcaagcagcagtatttcaattactgctgaattgaaattaggtcaatttttagtttcttttgttattggcattgttgggttcttt

SEQ ID NO: 36667 - DNA, 201 bp, Bos taurus
ttctctctggtaaccactgctttgtacctatatgctcatatctacagttttagaaggaactttttggatcatatccaagttcactttccagcagagacacrggggccttgtagaccaaggggcagaggagcagtgactacctgcctgcctgctaacctggagcttctcccatcacactcctgactcaagaagtttccttgg

SEQ ID NO: 36668 - DNA, 201 bp, Bos taurus
acatgttggtgtctattcttctagatttcctctgtatgcttgaacacacacatttaataaaaatgagagtgggcttaataaggcgggacaaggaggggccrgcactcagtgagtcagcagctggtgtccttgaaggtgaggaagaggaaaacggaaaaaaaaaaaaaaaaagccaaacacaaaaatccagtggaggggaag

SEQ ID NO: 36669 - DNA, 201 bp, Bos taurus
tgaaaggagtggagggtgttggtgcaaactgccagtttcttaaccctctgcgttcaccaccctcgcccctctcttccgtctcccagaggcctgtgggcacraccattctcccctgctaccttcagctacatgtctaggatgcatcgaacaccagaagcacttctgtggatcgcaggttccaggatctagccaggggtgtat

SEQ ID NO: 36670 - DNA, 201 bp, Bos taurus
aggtgacagcaaagcatgggcctcctgcccgagatcctgggcccaaagggtcaagccgagatggtcactcccccaccccacaaaactccttgcttgggaamcccggacctccggcccctctgccttagcacgtgagagtcctcttctccacccctttcacctgcctctgtatttgacatgttcttacttgctgtgccctgc

SEQ ID NO: 36671 - DNA, 201 bp, Bos taurus
cttagcctgttgaggacagcagtctttcatcggacctttacagatcctaacctacaggccctcaatttatgttcatggaatgaatgaacgaatttgtcatyttctgttattacataaccatctttcagaacatttcctttgaattcattgttagtggatagtcttctagttaagtcagattccacaggaaagcataaaaaa

SEQ ID NO: 36672 - DNA, 201 bp, Bos taurus
atccatggtcagccctccctcgtcttgcggcccgatctcctccccaggctgcggagcctccccgggtctgaacctgctctcctccagcctctgggcccctmtttctcccctgtgcctctaatccagctgaggaagggacttccgtttcttgaaaatccccagggggcctccatgcactctccctgtctggtccttcctggc

SEQ ID NO: 36673 - DNA, 201 bp, Bos taurus
tcacgctttttttttgttttggccgtgccattggcctgtaggaatcttagttccccgaccagcgatccaacccgcgcccctggcagtggaggcgcggagtyttaaccgctgggccgccagagaagaccctcacacttttcttaaattatctttttgtttgtttttcatacaaccctctatcctaggatatccgctctattt

SEQ ID NO: 36674 - DNA, 201 bp, Bos taurus
ggaggacaccaggaggctgcgggggccctccagcccctggagccggcctcaccctccggctgggctgtgctgaacagatgaggtcggggtcagctccttcrccatgctttcagccttacgcgggccacccctggcttccagagctattagtgatgtcctgggaaagacaatttgcattgcctttcagagtctcaggagaag

SEQ ID NO: 36675 - DNA, 201 bp, Bos taurus
gtgatgcaagtttggacttgactttaggcaacagtacatccatttccagcccacctgagatccagcaaactggagaatcccagagaccgtttcagagatgkcgagcagaggccagagtggaatctacggatcgactccctcaacatccgtttcaccctcattcctgtatctctctattgcctcgaggccagaaggttaaaa

SEQ ID NO: 36676 - DNA, 201 bp, Bos taurus
ttagttctcaagctgtgcaggcaacagatgccagtgggctctactggtctgtctagtacaccagccaccggccccacgtggccgctgagcacttgaaatgyggattagtataattgaggaatgaactttaacttcctgtcattttaattgatttcagagtggccggcacttgccatgttagatagcacagctctccgatct

SEQ ID NO: 36677 - DNA, 201 bp, Bos taurus
tctggtggcccagttttcatgatgtgaagatggaagaggttgagcatatcctggaacagctgccctggaaacaccttttcccttccctgccctcctcctcycttccgggggcctggctgacttcgtgatccagattccccctcctcggctccccagtcccagccccaaggcctggacaggtagggacaagtggtgcaggcg

SEQ ID NO: 36678 - DNA, 201 bp, Bos taurus
atcttggccataaaatgtgtaaataaactctttctatgatgataggtaatcccttcccggaacctgcatggtagacgtcacctgtttccacacgggaaaaytgcagattagtgagtggccctcagtcacttagtagtgagtggtaagttcaagtcaagatattattctgtcaaaatccactggatagagtgcctgacatct

SEQ ID NO: 36679 - DNA, 201 bp, Bos taurus
tgctgaccccagcccttctcttcctcactcccctccttgtctctcttccagtcactgaactggggtgtgagaagctcagtcagctgccatctttcctcacragcccacctaccaggccatggagataagccagctctgctttttggcaacccatcttgccctcctgggcagccttgtggctggtataccagggtgtgaaac

SEQ ID NO: 36680 - DNA, 201 bp, Bos taurus
agctccatccaccctggtcctggctgctgttccaacacacaccaggcacgttacttctgcagcctctgctcaaagcctccttatcacagaaggtttccctraccctggagagaaaaaggacagcaaactttttccacgtacctctctaccttcaggaaacttataatctaccacaggatttctcccctctgctattgtttg

SEQ ID NO: 36681 - DNA, 201 bp, Bos taurus
tatcaaacggcaagtttcaacatcaaccaacatatcttaaataaaatagtaggtaaaatggaaaagagaccatgtttgtgctatgtgtatgctcaatcatrtccaactctttgcaacctcgtggactaaaactcgccaggctcctctggccatgggattttccaggcaacagtactggagtgggttgccgtttcctcctcc

SEQ ID NO: 36682 - DNA, 201 bp, Bos taurus
attcaggtaaccctacagccggcccagggtctggggagacagccaggggaagttttctggatgaaggtcataagtcacccctggcccaggtcctccactgrtggttccatctccactggggcacattcacctgctccatctcccagcatttcctctgcttgctgcaccactggtccagagccccagccccctgggccatct

SEQ ID NO: 36683 - DNA, 201 bp, Bos taurus
tgctcctgcggtacaatgagaaactggatagactgttcatcagtgaactcaacacacagcatatacacattgaccccaaaaccactggtcctagaggagaygccaccggcaaatctcagaagaaactcctgtctgcacagcccgcggtcaacaaagaccttggcacagctgcaaagtccccagttgaaccattgttttgct

SEQ ID NO: 36684 - DNA, 201 bp, Bos taurus
cagacaagattaacaaggctcaagtgtcagacccaggagttgagcctgaggccacagcatccccaccagtggagtggccacataagagtgtgctttaggaragaaggagggggtccggttgcacacaccagctgggcagctcacccggaattccatgtccaggttgctggtggaggccacgggatccttcaggagggagta

SEQ ID NO: 36685 - DNA, 201 bp, Bos taurus
tcctttgatgctgcgcaaggtttgatttcacacaggaggttttctcaccttcattacatatacggggtttctctcctgcatgaattctctgatggatgatragggctgacttcaggcaggattttccacattcatgacacacatagagtttccttcgttctctgatgctcagtaagattgaacttcacaaagaaggacttt

SEQ ID NO: 36686 - DNA, 201 bp, Bos taurus
aacgatacaaatgtgatgcatgttacaaggcctttaatttttattcactccttattcagcatcagagttcacactggagagaaaccctttcagtgtgatasgtgtggaaaggcctttagccaaaagtcaaccatgcaacgacataaagaaactcatactctagggcaaagctttgaatgtagcagatgtgaagacatcttt

SEQ ID NO: 36687 - DNA, 201 bp, Bos taurus
tccgccctgggaaccaatgtcggtccccagtggcacccactggcctctggaatctcaaacctagcttctggcaggctcaaactagagccaccttgaacaamaacaacaacgaaacaggctggagggcccctgagctatccttaagctacagcatgcagtttggcttcagactccacagaaacaccaagatatcccaggagt

SEQ ID NO: 36688 - DNA, 201 bp, Bos taurus
gtttcaagcagtgtgggcatgtcggccgtcctgctcaagctcgggtttaaagagtcactggtccagtcaaaaatggcagctggcaccagccccttcgtggkagcgtaggccacccactcacacacacccatgaggatcagtgttaccttagtttcctggcccttgactgtcagatatttttggaaagtgagaatttttaaa

SEQ ID NO: 36689 - DNA, 201 bp, Bos taurus
cttaaaagatgaggagtagggcaaggggcccactgatttcaggggacattttctgtgtccttgagagaacctaagagttgagttcatgcagctccagaatkgaacctcttgaaggcctccaacaaccagctgtgcagccttgaagatgtacttaaagccgaattaagtgtgcgcaggtctctggggagagagacctgctag

SEQ ID NO: 36690 - DNA, 201 bp, Bos taurus
agacaaatgcaaggtggtcaggagcctttgcctgtggccaggaagggatcctagggaggactggtgagcagtctttctgggttcacagtgggtcaaccccrattcccccttttgtgccctgccttccaggctgctcagtaccaattggaagctcagctctaggcccagttgtgggtatgtgtgttttaataacagcttatt

SEQ ID NO: 36691 - DNA, 201 bp, Bos taurus
atgcgggtcatccatcaaaggcgccaacctctcaaaatgggaggagtgtcgcaacctcggctcgtaagccacacttgactgcactacaacaacaagaaaamggaattccaatttcctcctctgctctggaatagataacacaaggtttttacttacctttggagcgggtggaaatatccatgccctctaccacctcctgtt

SEQ ID NO: 36692 - DNA, 201 bp, Bos taurus
tgtgtgtgtatctgtgtgtgtttgtgtgtgtctgtgtgcatctctgtgtatgtacgaagctggggagggtggacggggccctgggcaggtgcagtgggacygtgtcgcaacgagcagcatttgccagaacccaaagcccagcagagaatgtgacgcaggcttgacagggtgagagtctgacaggggcctcgagacagaaag

SEQ ID NO: 36693 - DNA, 201 bp, Bos taurus
cgcctctcccatctaacctccaagctccaaccttcctatccaacctccatccaacctccaccgttgccagaagggttctgttaaatcacagaccgggcccsggttctgctccaaacccttcaacagctccgcgtcacccttgaactaagactcagagtccttgtcatggccacaaggtcccacgtgatatgcctcctgccc

SEQ ID NO: 36694 - DNA, 201 bp, Bos taurus
agaggcgctgccatcgtctctgtctgcagaaggcagttggtgacgtgcccgggttcttagaggaagagagtggaggggttggtggtttgactggccatgcrgttccaaagtcggctcctccccatggtgatgcctgggtttcttcatgcttgtgaagagccacgggccaattatgctcattacccgttttacagaaggaaa

SEQ ID NO: 36695 - DNA, 201 bp, Bos taurus
attagtgtagggttgatctgggagtgctttaatgtctacttttctctggtgagaaagccatttaattttgtgagatttcaccccaacaagagaggagggcmtccaggcatattgaggaagctgtgctctaaacatgctttttccagatgtatagattccaaggtagaagaaggagtgcacatatacaaatcccctgggtcg

SEQ ID NO: 36696 - DNA, 201 bp, Bos taurus
ggtcaccacggcatcagcgtggcctggttcccaggtcatttttaatttgtattctgatgaaacctcccaaaccccatcaaactctgccttgagccccaacrgaagtcacacggctgggcccaaggggacctctggttaggggccagggggcggaaggggaggggagcagagggtgtctgatcatttcgtgtgactgatgtg

SEQ ID NO: 36697 - DNA, 201 bp, Bos taurus
ccagcaaggggtgggccaagaaagatgccgccacgggacacctcgatcgggatgtgcgagatccttcccgagggagggggcagaggccccggcatggatcyggagcacagagaaaatcagggtcatggctctgaagcaggtcttgacggcaaccattcccagagcgatgcggccaagaaaaccatgaattgccccttgcgt

SEQ ID NO: 36698 - DNA, 201 bp, Bos taurus
caagacaccacatgagatttcccttctcctggctctcctgggggcttacccaagtctatgttgggaggggtagcaggagttaatgtcgactcctgtgactrttcttggggaggggctgccccagttgactgaccaatggctcttttggagactttcaggatcctcagagggtccttggagttcagccagggcagctctgtg

SEQ ID NO: 36699 - DNA, 201 bp, Bos taurus
agggcctcagaggacggacctgctcctggtggtgcctccttcatcacagacacaggcagttggtccccaagatgcatcctgacagcatccaggaacaaacmtcagcctgtgtctaagaacctcgggcctccttgctgcagtcattgtacatgctgctgttgttcagtcgctgagtcacagccaactctttgcaaccccatg

SEQ ID NO: 36700 - DNA, 201 bp, Bos taurus
tgtggtctcccaatatggccactcccacccactgaatgcccattgcacacagcctatcgcagtgccactcacgccaactcttggggagctacactcctgtytggtaaccatggcctcacaggtcagcaaacacatatcagaggctgaaacctactgttgtcccatctgaagtgctccttgtgtgtagcctttccccggctg

SEQ ID NO: 36701 - DNA, 201 bp, Bos taurus
aggaaaggggatgttagtttgtaataaacaggcctattctttgagggccaagtacacacaaaaagacgacaagagtgaagagtcagaacttcaattcaagmgacagatcccaccccatgccaaatcatctctgtagctgaaaagcggatgggatggggctcctctggtcacttgccccccaggctgtctgtggcaacatgc

SEQ ID NO: 36702 - DNA, 201 bp, Bos taurus
ccccgggcctccaccgggcagaagctgccttcaaacagcacctgcatcttgcttacacccatagggaagagcacacggccgggtggcactggcaccccatytcatgtctgtgcagacatcactaatcaatcggtgattctctctgagcccaacttggcctctagacaggcagccactgtcaaccaattccaacaggcacca

SEQ ID NO: 36703 - DNA, 201 bp, Bos taurus
gcaagaacactggagtgggttgccactgccttctccgaatgagctgcctacttactctcaaaaaacatccaacttctgcccacatgatgccaaggccctgygtgaactgtcccctgatctctgttctttcacttattctgctttaccgcactcaccgtcttccccagctcacaaaacatgccagactcctgcttgcctcag

SEQ ID NO: 36704 - DNA, 201 bp, Bos taurus
tgcacgtgctattccctccaaccacaacgctcatggccctcctttaacccagttaatatcagttcaccttgcctgacttctcaaccagctcaaagcccacrttcaggccccagcagctccgtaaacccttcttagagccaccacagctacaatgtaacctatgagattattcaagtaaggcctgtctccctcaccagagct

SEQ ID NO: 36705 - DNA, 201 bp, Bos taurus
aaatttatacgtaactcaaaaccaaagttcctggccctttggtggtcgtttgctgacatgaacacacacagcagcaaaacgctcgtcccccagggtgcctrttcccagctgggctgaacaaggcctccgcgtttcagcttttttactgtaaataaacaagtggggacttgctggcggtccagtggttaagggtctgcatgt

SEQ ID NO: 36706 - DNA, 201 bp, Bos taurus
cagtgtacctccacctctggcaaataaagataactagaccttaatcttgctgcctctggagtattctctaaaattacctgatgtgtcatattttcacaaaycaggacttaagcttacaatttgggtttatagacactgtcactgaggagacagaaaagggatttttggacaaacgtttagtcccttaacattaaaaatata

SEQ ID NO: 36707 - DNA, 201 bp, Bos taurus
agccgggcaatttcaggacgcatgcggtgctgaaacaagacacgtatgtcattaaacacatgggcagagaataaatggacagttttaaagactaagttgcyagtggaaaatctggggagatgacatttgaaaagaacagggagaaaagagcagaagagaaacagcttcttcatctgacacaaattcaccacggctggtctt

SEQ ID NO: 36708 - DNA, 201 bp, Bos taurus
acttgggtgttctgtatttttatttgctaaatctggcaaccttgttgtagagagcatctggcctgggatgatgtatctgttctttaaggaaccctggatgkactttgtaccttctgagtaacttgtatctctgctgacttgaactttcctcctgagttatttgcagggaaatggtggcttatggaatctcccgatagttta

SEQ ID NO: 36709 - DNA, 201 bp, Bos taurus
agggagagaccagggaagctcagagaagaggaacagtgagcccatgatccacatttagccattcccgggggacagtgacaaagtcaccaggatgcagcggyggggcctggctcccctctaggaaccttgggtgagagggggcaggagggaataacaggctggaaggctggtctgcctgtgaactcaggggatcgttggggt

SEQ ID NO: 36710 - DNA, 201 bp, Bos taurus
aagatggagcagaaagagacagggccacaagccgaggagtgctgacagacagcaaaagctgggagagatgagggctggactctctcccagagcctctggamgaggatggccctgccagcactttgatttcagcctttcggcctccagaactgtaacaggatatacttctattgtttgaagccattcagttcatggtaattt

SEQ ID NO: 36711 - DNA, 201 bp, Bos taurus
cttccaggccccggtggccgcgcggagactgggaagtggagtgtgctgagcccagtcagcctggaacaaagccccagagtcagggcgaggggagccagagyggcacctagggaagctgggtgttgtcattcacatttcaaccttctcatcgcccagaaaaagcacgcactcggggtgacggggatgcttttgaactgtggt

SEQ ID NO: 36712 - DNA, 201 bp, Bos taurus
aataaattagaaaaataaagccttcctccactcaacccccacccccttccccacgcagccagccactgcggggctggatacagaccagggtttgggccccrgttgagctggcttcctctctatccccacgcctgacttgctgtgtgacctcaggcaagtcactcagcctctctgggccttgtgtcttcatctgtaactggg

SEQ ID NO: 36713 - DNA, 201 bp, Bos taurus
ggtgctcctcgaggccaggctgcgggtcccagtatctggagagccagcctctgtgcatttctgagtcccggggtccgcagcagcacatgctcaggcatggygggcccaaggcaggacccactgtgttcgcagagtctgtgtgggttggggcctagctggctgtttgccttctccaagttttcttttttaaagtcacctttt

SEQ ID NO: 36714 - DNA, 201 bp, Bos taurus
gactgcccccacctgctagatgagctctgaatttagactgagtaacccagagggccccctcatcattttattgtatatatatgaagtagtggctgcaaagyatatgtaatggggggggcctagatgaaacccaatatatttgatgtctcgaggactagcagtggggatgctctgctcttttgaagatgccaggaagctgtg

SEQ ID NO: 36715 - DNA, 201 bp, Bos taurus
cggagtgcggcctctagggagctggacatcatggcatgctctgctaggcagggagctgggaagacagcacttgcccttcctgcctgaatattgtttgctgyagagggccccgggggtgggggggtgtgctttctaccaggctgagttctcagcccggctccgggctccagaaaagccttcttgatactccaactgctgacc

SEQ ID NO: 36716 - DNA, 201 bp, Bos taurus
ccgttaacgtttccaagaaaaaccagaaacctcgactttgtggggagccgcccagttttcaactatcgacaactaattataaattattttgttaagacagmgtgggtcaggcccaacaactcgggccaaaggccaccaggtaagcctctggattgcagatgtctcctctcccagggaagcgtggaaggggaggactttgga

SEQ ID NO: 36717 - DNA, 201 bp, Bos taurus
gtcagagacctgaggtagtatcttagttttctgtggctgctgttaacacagtaccattaacacaacagaaatgtgggacttgccgggtggcccagtggccrggactccatgcttccagtgcagggggctcaggttcgatccctggttggggaactaacatcccacatgccttgcagttgggccaaaaaaacccaaaacatg

SEQ ID NO: 36718 - DNA, 201 bp, Bos taurus
tctgaaatgacaggttccccctctggccttggccaggccataaagcttgcttcagcggaggaatgaatccaccctaaaaatccgggcgccttatcagttgrggggattagcaaaggccttgtcctgacctgaaggaaaatcccggacaccctccacactccctgagggaccctccggagtcaaatattttccgaaccaact

SEQ ID NO: 36719 - DNA, 201 bp, Bos taurus
gggttcagatcccgtctctgcagcgggctggcagtgggcctcctccaggtgaccacctgtgcactttagttttcacagcggtaaatggagaggggggacgrgtttctctttgctacaggtgtgctgtgagggttaaggtatgtttattcggtccttaggagactactcagcatggtgtaggcactctacaaaataagccgt

SEQ ID NO: 36720 - DNA, 201 bp, Bos taurus
tctttggcttctggatagatcagggtttaatattttctggatgtttaaagagtcttcttggtctcttttggtccatgtctgagaccatggggcccagacamttttagtttctgcagtaagagtgtttgtggcattttggattcgggaatccactgtcccatctgtgcgtgtctgttcctactcggcggcctctgaggcatg

SEQ ID NO: 36721 - DNA, 201 bp, Bos taurus
cttccaagcagaggggtcagcgggtgcaaaggccctgaggcagagctcaagtatgcagaaggatcagcaaggagggtgatgtgcttggaccatgtgatgcraaaaagatgaggccagagagataatatggagcccaaaggtgaggcatggaaagctctgtggtaaggtgatggccacagtggcctgtgactctggatctgt

SEQ ID NO: 36722 - DNA, 201 bp, Bos taurus
aagctcaggccggtgggctggctctgagctgaagtgatgtgggaagctgccaagccttgccctcaaaaacagaacaagccctcccctgcccacttgctgcrggctgaatgcgggcccaggtgacgcgatggtgagccaaggtggaccttccagagggtgacactctggaatggagacagaggaacaagcaggagggagcct

SEQ ID NO: 36723 - DNA, 201 bp, Bos taurus
tgcgtgaatctggagcagatttgtgaaggtgtgtgaaatccagtgccaaaatggtcctatgaatgcttttcctcaagaactgtcttgaaggtattaattgmagagagctctccatcagatctgcatggcagccctgactttgagaaccagtgaaaaccagcagccttgtgatctggggtgtttcatcagcagctcatagaa

SEQ ID NO: 36724 - DNA, 201 bp, Bos taurus
cgaaggcttccaaacttctgtcccttagaggaggtgcccttttatttcacaattcggttcacaccatcatactcactggcaactaaacaaaagcttccccygaacaatacttaccccatgcactcttatctatcctcctgtctggggttactttgtttaaatgctggtcataactcattaaacagatttcctgtcccatcg

SEQ ID NO: 36725 - DNA, 201 bp, Bos taurus
agtaaaaaacaaaaagactcccaaacaaagaatacatcaaacaggaaagcagagcttatactcttcgtgtttgcaagcgggatttcgggccaagcagcacrgaaaccttgaaacagtattttgtgtgtgtgcgtcatgtttctcccaggcaaaggtgctgggtagagcccagaaagcttatggccacagatccaggaatcg

SEQ ID NO: 36726 - DNA, 201 bp, Bos taurus
caggcaacaagcagaaatgcccagtgtgttcaggacaccgtccggcccctcgctcctgccctgccatggagacatggatgctccacataccccaggcggtrtagctgtgagatgcgggacagtggcctggcgtgcctcagagtttccatgagtgaggaattaacttgcacttgactttagatactgagatttcaggggcca

SEQ ID NO: 36727 - DNA, 201 bp, Bos taurus
acgctggccgttcacactttttctcaaaaatgctaccgcgtagcgtcttatcttcctgatacgctcatgaaacagaccctggatgacaacagatgctgggygttggtggcctgccagccactgcgggcctagggatctgtgatgtcgggggtcttgggaccgtatttcgtatggagcagttattggagccttactgagacc

SEQ ID NO: 36728 - DNA, 201 bp, Bos taurus
tggacttccaaagacgggttagcaaagggcattgagatctttaggtaaggtgtgacctcaggtaatttagttatatgattagggaatgtaatggcttctcrtacaaattggtttcacagcagtggcctatttgaagctatgttaggtatgtgtcataagatggaatttgcctagcattcacctacattgtcctctgtgatt

SEQ ID NO: 36729 - DNA, 201 bp, Bos taurus
cagatagtaaatattttagacttaagggccatatgatctctgtctcagctactcagctctacctttgtagctagaatgtagctgtggacaacacataaacrgggcctgtcttcatcctgataaaccttcctttgcaaaaacacaggccacgggctcgatttgccccagaagctgtagttgcctgatctttggtcaacacga

SEQ ID NO: 36730 - DNA, 201 bp, Bos taurus
agcgggtgccagcggtccctgggctgactcgtttcaagaggctcacctgggccatagagaaatctagatcttagacattcagtggaggatctccagggccytcggacgtccagtggactgcgtctgagagtcctcctgggttggtgactgagcaaacactgtgtctgtcagaaacaggtggcatccaggtgtagcctgtgc

SEQ ID NO: 36731 - DNA, 201 bp, Bos taurus
atgatgtgaacatcattattatcccagtgcctagccctagtgatcatcattgtcaccccaataattgatgccttattgaggtctgaccgtgggccaagatmtgaacttatcactgtatgtgtgttatcactctacactttcacaacaactctgtgaagtagagggtgttatatggcctcatttctgcaatgagacagttat

SEQ ID NO: 36732 - DNA, 201 bp, Bos taurus
gcagggggcggtgtgtaaaggcctgaggacctcagtaacaatttcagcttctactctgaacgcagtaggaagccacttggagccaagaggagacatgtatwcatgaacaaagttacacggcctgaactccgtaaagccagggcagaaactgaatccccagctcacttcctcctgccgtatccatccccactcgcgtgtgct

SEQ ID NO: 36733 - DNA, 201 bp, Bos taurus
aggctacccattcccatgttctggcctggagaattccacggactgtatagaccatggagtagcaaagagtgggacacgactgactcactttcaccttcacytcactttcagtgtcacagggccagaaatatgggtgcaataaacgaacgtgttttggaactttcttccaaacaattaggtctttaaacctctggcttaagt

SEQ ID NO: 36734 - DNA, 201 bp, Bos taurus
cttttttaaagagcggtactggaatttcatcatattgaatataaacgggaaaaagtacatggtagaataaaacttaaaatgcttttatggaattttcattrtaaggctgtctgtaatggagttgacctcatattcacctaagattctctggctccgagttcagatttcatgccaattaacatgttaatgacatatatcatt

SEQ ID NO: 36735 - DNA, 201 bp, Bos taurus
taagatagtgctcagatgactggtaaatttttcagggggggaaaagttaaatatctcatgctatatatatttcagatgaatcaaaattaaatctagaaackaaaacataaaacaactagaggaaaatgtaagtcagtagttacctgctatcagtcaaggaagttatttccaggtataaatactaagaaagaatagtagaaa

SEQ ID NO: 36736 - DNA, 201 bp, Bos taurus
ggggcccggaagcagcttctttggtgtgcatcttccggtgatcgatgagactttctttatttggaaacagaaagccgcagaccatgcatatcttatacggygaggagacgccctcggccgcgggctcctgcaccacctcgttgatggtcgccgggctctccaggccgggctgcagcctgctcttcgcccccgacttgcccg

SEQ ID NO: 36737 - DNA, 201 bp, Bos taurus
ttttcagcaggtgtctggcccctgctcctccctgaatcacctccaggtacctctgctcactggattgcagccacactctggcaacctctttcttgaagaarccgagtgtggctgggcctgaaagctttgctctctctttctcttgggcctccagggcttgtctcctagacactaggctgcccaggtccttcctgtcagtat

SEQ ID NO: 36738 - DNA, 201 bp, Bos taurus
attcctgtaaagctgaggccagagtcggatctttccttctggatgcgtttcccagggctgctgtcacagcagcacctccagcacgaaccttagaacagtaygagcctggggcctccctggcgctcctgtaggtagccttccccttccagcgcaggggttgtgggttcaacgcctgcttggtgagctaggatcccatgtgcc

SEQ ID NO: 36739 - DNA, 201 bp, Bos taurus
ggataaaatgtgatttcatcagatcggccagaacatgagtaactaccagagtcattcattaccaaggaaggttgatactgacctccacatatgaactgtcytttccttaaatgaagttgtcttctgatttttttttttctggttctaacaaggaacatgttgcccaaacttctcctaagtacattccaggctagttgatga

SEQ ID NO: 36740 - DNA, 201 bp, Bos taurus
aagatcaattactgctcaacaacagtgatatcatttattggctgtcggctgttgctttaatacaaatacacaaaataacatatatgtaaaatatatttgcrttctgaagcatgataatgaaatagacaaccggaccttagcacccaccttaagaagtcaagtatcacctttatcatcagagttcttgtatgtctctctttg

SEQ ID NO: 36741 - DNA, 201 bp, Bos taurus
agtcccagcatgctccttaaaatcacacatttctgcggctcatgcaatacggtgtgcaaaatctggtgtttggctcagaattcggaactcctaagtcaggygttgtaggtgattcagatgtccgcgtggactctcgggtgaatgggcttcttgtctgttgtctggtaacactggttgtctgtgtggctcccgtgtttgcac

SEQ ID NO: 36742 - DNA, 201 bp, Bos taurus
gtctctcgctgtcgccccacattttgtaaataatgattatgtaacagctgagcacgcttagagcactgcgcatgcgcacccaaggtactcgcgcggactcrggctgctgttgttacataagcttcacctggaaaatcgctggggggctgtgttatgttgtatctgctgctatggctgcttgccaggcaggagggaataaat

SEQ ID NO: 36743 - DNA, 201 bp, Bos taurus
aagctcagtctaggctgtcatttacaattgccttgttattttaaaagtggccgtttctggattttattattttctcttcatctcgatcatttttctccaaygtgtttctccaccattcggtcacccttgggcagctctcagttgactctacccggaaaacctctgctgtaagatttcagctgtgcgtttgctgtagctgac

SEQ ID NO: 36744 - DNA, 201 bp, Bos taurus
gcaggagagacaaagctgggaaaattaaacagtgtagactggctggtgaggatcatttcagtgggctttgagctgaaggggtggtcctggttccttggcayctggccccagggtgaattaggcagaggcatgttactccctgctgggatgtgtggctctggtctggtttacttgagagaggagtgctccagcctggccttt

SEQ ID NO: 36745 - DNA, 201 bp, Bos taurus
tttttgaattcatcagagaaatatatgtacagctcataacaggaatagaagctgcaaagataattcacccactttaagtgccaagtcacagtactcaccaycttccatcttaagtgaagtgtgacagtcgtcagtcatgtccaactctttgcggcctcatggactttagcctgccaggctcctctgtccatagaattctcc

SEQ ID NO: 36746 - DNA, 201 bp, Bos taurus
ctgtaatccaagccatcttcttccaggtctttattgagaatttgctctgtgcttagccttgattcaacatgtatttgataaacagtttatattccaattayggtaccaagcactggaaataaaattacagatagcatattctagaggggaagaaggatggttaataaactaattagttatgatgagtgcttttttgggcaa

SEQ ID NO: 36747 - DNA, 201 bp, Bos taurus
cacaacccagtttctccctgtatttgctccatggtggaaactttactaacttaatttgatagaaacccacaattccagacattttccttttgataccagayagtgcagcaatttcaagcctcattttcttaagctacatagtccagggaagaagaatcttctttagtcctcaagtattgcttggcattcattctctcattt

SEQ ID NO: 36748 - DNA, 201 bp, Bos taurus
ccttaggttaaggtttcctttctgcttttgatgaaaatcatagtgtatgggaaacctttgaaagaacacccagctccaggcctcaccccagcccagatggygcttagaggctctgagttagtaggttttggtgctgtgggtgggcgagcacagtgggaggtttagaactcccgctgtgcatcagctccgggctctgtgatg

SEQ ID NO: 36749 - DNA, 201 bp, Bos taurus
ccacgctttgtctgtaagcaggttttcctgtgacttgtggtccacaggaaaaaaatctgttcagatgaaagtatttgaaagtcttctccgtggccccagarcaagctgaagcacttcaaagcaatgacaaccaccctggaggagagctttctgaaattcgcctgcagtaaacaacctgcctgagacggaaggccaggcggg

SEQ ID NO: 36750 - DNA, 201 bp, Bos taurus
agaaattgctctaaaactccaggtccccatggaaaccattggaaagactgcctattgactctacatgtgatgctgctacgactgctcccttgataacaaayggatgctattaaaagcctggctcaaatggaagcctgctatagctcatggcgagagccacattctctttggactgacagggcgaaaagaaatcaccctctg

SEQ ID NO: 36751 - DNA, 201 bp, Bos taurus
cttttaaccattgtcttgcttaatatggtggtgatttactttaattttttttcttttttggttgccttggataggatactgtggtgcagatatcaagtcartatgctctgaagctgctttatgtgctctgcgtcgacgctacccacagatctataccactagtgagaaactgcaattggatctctcttcaattaatatctc

SEQ ID NO: 36752 - DNA, 201 bp, Bos taurus
cacctcgtttcagcttccagaagtcttgattcccaggtggtcagtttcacactatgctccttccctgctcttttgcccctgttttggcccttatgatgctrtcttgtcattgcctgttttccatgagacacttaagctttgtaaaattgtggactcagactgtcttgttcatatttgtatccccagggcagaacacctggc

SEQ ID NO: 36753 - DNA, 201 bp, Bos taurus
tgaggctacgacctttaaccctaaggtcctgcctggtccacagcaccatcagctccatctaaaggagtatctaggagtctgaggccagacaaggatgaagrgagggtatggaggacagggtccccagagcagggagtggagcctcagtggaaagaacgggagggcaggccgggccccactccctgcatccctgcctgtggg

SEQ ID NO: 36754 - DNA, 201 bp, Bos taurus
gagactgcacacagatacagcaacgttattataatgggcagacggagacacaacccaactgcccagcagcaggtcaccgaataaacaaaacggcccacgayaccactgtggtatgatatgaactgtgtcctgcccaaattcattagctaaagccctattcccagaatgtgagtcaaggccttcaaagaggtgattaagtta

SEQ ID NO: 36755 - DNA, 201 bp, Bos taurus
acatacagatggctaacaaacacatgaaaagatgctcaacatcactcattatcagagaaatgcaaatcaaaaccactatgaggtaccatttcacaccagtsagaatggctgcaatcctttggtctcttttgattctgtgatgtttattctacttctcattgattttctgtgactcttgctgttgcttttgttctggcttct

SEQ ID NO: 36756 - DNA, 201 bp, Bos taurus
ttaactagtaggagcccattgtattgagatcgccataaagtttgtttggatttttccataagatggtgtgaaaaacccgaatgaacattttggccaacccratagttctcctgaataaaaatctctagacaaaggggtttgtcacagtctggtcaagaaaacagaaaacactttgtatgtttcaaaaaaaaaaaaaaaaaa

SEQ ID NO: 36757 - DNA, 201 bp, Bos taurus
atcttaccaaaatccagctggaaaaagagaaatatggcttttagaaatccagatgcagtatcacaaagcaaactataaaagggattttggccaagaaaaaktagcttaataactgatacacacacacacacacacacacacacacacacacaacctctgaaaatacactcaagattctgaaaaaaaatgtgtattctatga

SEQ ID NO: 36758 - DNA, 201 bp, Bos taurus
atatgtctattttcaattgtttctgaactaatatgcaaagcttttctctcttcttatactaaagatcattcgaggaaaagttttgctatgccccaaatttrtttgttgactgagaggcttggggagttcaatagacatttaaatcaatgaggttgaatgaaatcagttttgagggctgcagttaaggacagtcttggggta

SEQ ID NO: 36759 - DNA, 201 bp, Bos taurus
tcatcattttggcaatgctctataaatgtgtagaaactaatgtttataccttctgattccactccagttctcccctttgtgaggccaacttacgaaatgcytatataagcttttttccaccctgttcattagtataacccccagagactaggcagctcctctgatactagttaattcttatcatactatcctatcattcta

SEQ ID NO: 36760 - DNA, 201 bp, Bos taurus
ctgggatgtttggcattgagcaggccacctgttttctcttggtaactcaagcttgtaaaagcttttctggctgttagaaatttattctttctgttcatttytttgctgagacatcacacccagtttttgcacgatgttcttgttagaaagaaagaaagaaggaaggaagaaagaaagagagagggaattacaagatatcta

SEQ ID NO: 36761 - DNA, 201 bp, Bos taurus
gaagatccagcacaaccaaaactaaacagatagataaataaaaataattatcaactgaaaaaaagaatttaactttcctgaatgttgacaatgggcctccytggagaaaaatctatttccaactttttgcctcaggctgggatgttgagaaatctctgccagaaacaaatagtacacaaacatagatggttaagatgtgtg

SEQ ID NO: 36762 - DNA, 201 bp, Bos taurus
ggacagaggaacctgacaggctatagtccatgggctcgtaaaagagtcagacatgacgtagcgactaaacaacaacaaaagacaccttagaatggaatgayttacacatgttttcaacttcaataaatactgtcaaacagttttccaatgtggttctaccaatttatattcctacgagggatataggagagtatccttact

SEQ ID NO: 36763 - DNA, 201 bp, Bos taurus
ctttccaaccctgatatccagttcatgctccagcaactcaagacaggtcaagcttttacaacaccaccacagttaacccatagatgtgagttaacccacartgagaaaaaaatgactgttgtaaaagctgctgagttttggaatggttttttatatagcattacctaaatgataatacactctccatgaaatggatcttca

SEQ ID NO: 36764 - DNA, 201 bp, Bos taurus
catggaaactgaggaccaaagggattatgtgggttgctatcattacacagctggtaaaagttggagcttggatttgaacctgcgtcctcatcctcaaacaytttcagtgactgcagccgctcccacgtttctttggtcagaatctaaccccttggttaaatagcatattaaaaaaaagatagtttgggaagagttttccac

SEQ ID NO: 36765 - DNA, 201 bp, Bos taurus
tctggcaggctatagcccatggggtcacaaaaagttgagcacaactgagtgattttcactttcaatgggttgaacagtggcctcaaaggatatgtcccccyagaacatgtgaataagacatatctggggaaagggtctttgcagatgcatttaaagatgttgaggtgagctcatcttgggtgtgggtggccctcaatcaat

SEQ ID NO: 36766 - DNA, 201 bp, Bos taurus
tccatcctgcatttcataacctgacctgtggccccagaatcatgctttatctccaaggaggactcatttcaagcaggggttttcttcatgttcctagaacrggaatgtcaagtgccaggcctactcagacttcccgagtctgggatgcaaagctcctgtatccaccttccagctgtgatcagagtagcaaaggtagcaaag

SEQ ID NO: 36767 - DNA, 201 bp, Bos taurus
cggcccactaccgcctggcgggtggcgctgggaagcagatcgtccctgctgaacttccggtacacgctttccagaaggcccaactgcgtggcacatgaacycctaagaacaaaggaaaattacatgcacatgccggctttaaacgaatactccacgagggcccactatgctacaagtaaatgctaatgattatgaattaga

SEQ ID NO: 36768 - DNA, 201 bp, Bos taurus
ccagctcatggaccatgaaacacgagatgaaaggaggaagcaggggagagatactgaggtgtctgtgaccacagggacagcagccctaggggaggggcagyggccggggcagtgggcatgcccacagcgggctggatcatttactttttagtgatcaaccccttggaaaaaatctctcccactggttacacatctggtctt

SEQ ID NO: 36769 - DNA, 201 bp, Bos taurus
caggtggccgccttcttggagagccctcgcctgcccccaccagagagaagcagctcttgggagaaaatcaggctaagtcacattcacatcagaggtgcccrgggcctggctccccatgctgagcaggagtgacctctgccatggggacccatcccccgatgggctggcctactcttctgctctttcctccacacgggcagt

SEQ ID NO: 36770 - DNA, 201 bp, Bos taurus
ggccgggacctcttgacctggaattggatgccatggaggctctgtgccgcgtgactgtttaataaactcacagatctgagcagcgtgtttcataccttccraggccattatgtggaggacggagcaaggctgagatgagactcccccaccccagcccaggtgatcccagctgtgcatgtgccctgtggggcgtccgttgtc

SEQ ID NO: 36771 - DNA, 201 bp, Bos taurus
gtgtttcaaacgttacataaagaggcacttggctggttaactggctcagttctgcctgggtttcgtctcaggaagcatttaagctcgctccccaggactgyacccctagtaaacaccctgctttaagggccctccgcacacgtaggctcattgttcctcctgagaaccaccagtttataaaaatcacaaacacattgtgtt

SEQ ID NO: 36772 - DNA, 201 bp, Bos taurus
gctggggtccttgggctgggtccctccctgcctctgtaagggccacacggtcacttgtgtgtgtgctgcgggatcatgtggcctctgcttctccttctgcrcacggaagtctgtgtctggcaccgctctatcctctgtgtgagggtccagctcgtcctctctgggaaggacttccaacatgcccccatgactgttcctcac

SEQ ID NO: 36773 - DNA, 201 bp, Bos taurus
cctttggcgttgcgaggggcagctcgggattcatgtaccagcctgaggccgggtacatgggggaagctgcctggaggcctgggctgcagccaggctgaatyagctgtgtctgtggacacctagaccagtctctgtggctgagaaccacggccagctgtcttttcccaggtctgtgcttggtgatctgggctcagcttggtt

SEQ ID NO: 36774 - DNA, 201 bp, Bos taurus
accctggactggcaactcgtttcttacatgatattttacatgtttcaatgtcatgaaaagagaatacagaggaaggccaccaagtagatgtatcacattaygttgtcctatgtcctccttgatggattccaatgctcatccatcttctgctgtcactgatgccgctgagcatcctggaggaggccacattccctcttatac

SEQ ID NO: 36775 - DNA, 201 bp, Bos taurus
agttttttatgtcttctacaagtgaactttgctggttagagaaataaaacaatctatttccttatcttctctcatcttttccagattgaaattcattaaayccggctttcctgaacataaatcaataccatgtgggatgttatttattgtcagtaacaaagtggagtgtgtggtatggcataggatgtgatcagaagacac

SEQ ID NO: 36776 - DNA, 201 bp, Bos taurus
tgccagtttatatgttgaagtttctacccctagtaggtcagaaagtgaatgtatttgaagatagagtttctaaagaggtaactaaattgcagtgatgttayaggcctgactctaatcccataggactgttgtcctcataaaaagaggaggtcaggacgcagccagacagaggcaagaccctgttaagttacaggagaggac

SEQ ID NO: 36777 - DNA, 201 bp, Bos taurus
gcttaaaggaaatgtgctaccaggccatggaaagaactttaaatgcacattcctaagtgaaagaagctccctgagaaggctaaaggctgtatgactccaaytgtatggccttttgaaaaagacggaactatggagacagtagaaagttttagcgtttgcagggtgaagcagcagttaaagttgaagtttagtcactcagtc

SEQ ID NO: 36778 - DNA, 201 bp, Bos taurus
atgaccttctcctctcaagcacatacttgttagagaattctaactctccaaaaatccaagtttccttctaactaaaactaaacttagttcctgcctttgckaagtaatgtaaccacttcaggtgggaaatatatgtaaccttcactcacctgtgtgtctgacatgatattttcctttaaaagctgaaaagttggtatctcc

SEQ ID NO: 36779 - DNA, 201 bp, Bos taurus
cgccaaatcagaataaggaacctgggtaatttccatctgcctttgacaactaggtggagcaggccctgttaaaccagtcaccactctaaccgaaggaagcyacctgccacagggctgatcccaatgattcaggtctcattaaatcaggagatgacgctcagtcaaagcaaagaaaaatgtcgcaaaacgtggttaagacac

SEQ ID NO: 36780 - DNA, 201 bp, Bos taurus
agactccaaggcccctgccatccctgtagttatatctctttacatacgcccatgaggatccctttcccaacctacctccagggcctgcctaaactcccatyatccatcatctgaactcctaatacatcctggtacccttgctcatccacggtcccaggaaggtgcttctttccaggacatccttcccccacctccagtatc

SEQ ID NO: 36781 - DNA, 201 bp, Bos taurus
atgctctatgcagggatgagagaaagacaaaactcatgattgttctgcatcctggattcacagggaccactggtccgcatgctcagtcacttaaaacctckcttggagtttagttcatatatattctcaactacaccttgtggcatgttccacacccatgccactgtgatgtttaagatgcagatgagagagaaaaaaaga

SEQ ID NO: 36782 - DNA, 201 bp, Bos taurus
cacagcagttctcaaaagacctgcagacatctccaatcagataaagaaggaaaaggatactgaaaatcaagctgaaagagctgatcgaaaaattaggttcrgaaagtgtatttttttttttttaagtgaaaagggcccatcctattataaatcctgatgagttcaactactttagaaaattgtccggcagtaaccaggtgg

SEQ ID NO: 36783 - DNA, 201 bp, Bos taurus
gggagcccgtgcagcctgagtgaggctcacacaaaacccagttcacaaggaaccagtggggaagcacaagcgcaagcagtcttcccggccgtcacagaccrtccactttggacggaacaatggctgcttttgttcttgccgtcctgtttgttggctttcgtgtcctcagctgtgacactggtggatccggcctgatcgatg

SEQ ID NO: 36784 - DNA, 201 bp, Bos taurus
ttcattttttaaaaagccaagtaagagctaagtagtttttctgttgtcagaatcacagcccccaaaccttaatcttatactaattagaggggtttaatagragaatatgttaagaaaaatttaaaacacgtttcccacaaaaatttttatataccagaaatggaagagacaaattcagtcctttcatctctatctgattca

SEQ ID NO: 36785 - DNA, 201 bp, Bos taurus
cctcttgcagtccagggtgtggcccgggaacacccagacctacgcggcttgtcctgctccctggaccctataggagagaggccagctgccaggtgactagwtgtatacacaggccaacttgagagcggagacaaagatctccagagcatgccttggaaggttaactcattctcagctcatcatttcctgaagctttttcct

SEQ ID NO: 36786 - DNA, 201 bp, Bos taurus
ctgccagcttcccactgtatccttgtgatcccaaagaggacgagaaagctctgtgggttgtcgtctataagagtactaatcctgctcatggtcctctacaytcatgaccctgtgacctcccactgtctcctcagtgacctcacactggaggggtagggttacaacacgcaaactgggggatgtacagtgctcgtccttgaa

SEQ ID NO: 36787 - DNA, 201 bp, Bos taurus
cttgggggatttaagtatcctcagatggggaaaaggaaggaaaaatgtatattaccatttcttcagagcatgcttcttcctctgtgtcacatctatttccygtactgtgcctgggagtaaaaaaacaaaatttgattccacctttcatctctctaatgcccagtctttgctgctgcttaaaatacatcctccacaaaaagc

SEQ ID NO: 36788 - DNA, 201 bp, Bos taurus
ccccatctgatcctgtgatgatgtcaaccattctacccaaggagtttgtaattatttcaggaggaaagcttctaattagcaccaaacagttttccagcagyagctggaacatccacatccaggacacaggaagccaaatggaaggagggatccagacaaggatgcacacagaggcacagacaaggatgcacacagagggat

SEQ ID NO: 36789 - DNA, 201 bp, Bos taurus
gaaatccaagtaaattaaaaggaacagaagctggaaatatgcaggcatatttgtggctggagtcattccactccttgtacattatgtggtttacctcagcrtgtggaaaaatacagtaagtgcttcattgtatggggggtagttgtattgtgtaacttagacggtttattctttcttggaaatattttatgataaacacat

SEQ ID NO: 36790 - DNA, 201 bp, Bos taurus
aatctcaagaagatgtctctagctgtatgatcctgccttttgggaaatacaagttaattttccagaatgtttagaaatcagtgattcataatcgagtcacycttgtgtgcctggcatcttcacatgtttttactgaaacatctaactccaaagtagggactgtttccatttgttgatcaaaagtgggcagaaggaggtggc

SEQ ID NO: 36791 - DNA, 201 bp, Bos taurus
atataatttagtacaagaaagccaattgtgtagtcttgactcagactttgtgttaaaaagcattcatcatgtgcgcttccatgtaagaggaatttaaactytcctcttcgttaggagacctgcctgcagtagaattaaaatagcttctccctgaatgggaacactgacttggcaaagatcaggagcagtcattcaagagga

SEQ ID NO: 36792 - DNA, 201 bp, Bos taurus
tacgtgaagtgttcttaaattttaaactaataagtagtgactttattggcacttagccatgtctgtgagtaggacggccgtgtggttctgagggtatgtcrtggagagtgcgacttctgttttctgcttgtgccttgttgccgtgatgtatacaaacggcctccagattccagtctcctcccgggtcagtaaggtgatgac

SEQ ID NO: 36793 - DNA, 201 bp, Bos taurus
gtatcactgtaaattctggggacatccgtcttcctaagaacgtgtgagtcatgtggatgaacactactgttttctgaactattccgttgctcacttactcrtgtccattcctgtgccccactccagccagtctcttaaagtgactttcctgcctcattttccattttctctacaactccagaaaggaattcccccgcatgt

SEQ ID NO: 36794 - DNA, 201 bp, Bos taurus
ctctctcctccccttctttgagtggaaatgctcacactctgacatacaatatcaaatgtcttctcttctgagaagtcttcctttattatctgaagaagagyttgctgagttgctcactgtgctagccagagaagtgctgatacttagtctttatagttatataattcatattaaatcccaagaagagaaagaacagatcac

SEQ ID NO: 36795 - DNA, 201 bp, Bos taurus
ttctaactctagaaaggtaaatggggccacagcacagtgacagcatcctctggtttatatcacaacctggaagcagtacggaagctatttaagattcagarggagaaattgcaacactcgatttcttctctctatattcctgctttgagtgggcagggcaattcagggggtcgactgatgtgatcggcaggaatgcgcttt

SEQ ID NO: 36796 - DNA, 201 bp, Bos taurus
gagcatggaagtgatgacgtggatgctgcttgctgaggggccaggccagggcaccagcacttgtggtgcttcctacaacctcagaggtatcagcatctccrcgcctgtgcagcctcctgagggcacacggggaactggccaacggagcaaccaggaccgcccatcagcacgagtggcaactacccccaaacaaggccaagg

SEQ ID NO: 36797 - DNA, 201 bp, Bos taurus
acttctgagtccaggagcccagtgttcacgtgagttatttgttgtattaaccaatgaggactaacctctctgtgaaaagcttctgtgtttaaggcactggrctgatgaccctttggtgtgaattcataaattaatttctccagtgatttgagcaattaacaagaatatccgatacagcttttctaataggtacacatgcta

SEQ ID NO: 36798 - DNA, 201 bp, Bos taurus
tttctaccacttctctgggcaagactcagacctactgattgtgtttataattaaggaataacgagaaatacgactcaggggtacagataagcaggtacacrggaaacatccattttccttaaccttagtagatttcactgctcacttgcatgagtgcagaaggtataaatctctaaggaccctttactaaaatcgggaggg

SEQ ID NO: 36799 - DNA, 201 bp, Bos taurus
aaatgggcaggggaattctgaactggagagaaggtgaaggatagtgtgtatagctggaatgggaagatagcttttgagatggaaaatgcacttaaactagmcatgaacttgagagcatttgtgtagacaaaaagtcaccttaatgaaggcattcttgagaaatccacctttacatcatagcttattcaagaatataccact

SEQ ID NO: 36800 - DNA, 201 bp, Bos taurus
gctggcagaatccctgactacctttggtctttgctcatggaggatactatatttagctgtctagctaccaaaggttccattaattttggatatttcccctstacaatctgtttaagggcagtgacaagatatttcctgagtgacctgtcccttctgaaaagaatacataacctgaacgccagcactttttgtcatcaagat

SEQ ID NO: 36801 - DNA, 201 bp, Bos taurus
ctttgaaagctacattattcaatatgccagtggtcctttccataatggcaacatattagcaattcatgctgctctaatacagtggacttccttgatgtacygcactccctacagacccagaggggcacccctgctttagctgcatgtgtcctgcacagcacctacccaagtgatggttggcaaaacagctgtgcagtggtc

SEQ ID NO: 36802 - DNA, 201 bp, Bos taurus
ttaaccaaaattaaactgtatttgcttgattgcatagatcctcttcctacagaaggcattgacttgagaggagggagaatattcagcttttagaaaatgayttgaaggcttttaaatgcgcacaattcatagtcttacagtagattaaaactggagcagaattacaataggagcagaagctcttacaaagaaaaaaaaaag

SEQ ID NO: 36803 - DNA, 201 bp, Bos taurus
aagagccacctgacatctgggttttgtctttcctcttctaattctatacaaatagttttcttgatttaagtaatcctaaatattcgtggcttctacctaaygtatacttcccattcacaccctaaaaagctgcactcagaaacaagccaacatttaatgatggaaaagtgatgctagcaattcacagaaatcacacgtcag

SEQ ID NO: 36804 - DNA, 201 bp, Bos taurus
cttcatgaatgaaagaactttaaagccagaaaaatctttaggattgaatgaaagaactttaaagccagagaaatctttaggattttttttaggtagatatkatatttaagtattaatccataatgtaacaatggaggaacaaccaagaacaatttatttccctataaaaatagttgcatttttattactatagaaggtatg

SEQ ID NO: 36805 - DNA, 201 bp, Bos taurus
caaagataaagcattaattccaaactttagaaaccattctcctatttcctcactgcccttattatttatagattttccacttttttttataccttgaattrtccagataataattttaattctccacatcaatcatggcaacaaacactgccacagaaataagtaaccttaggcaagtctctttacctcgcaattcctaat

SEQ ID NO: 36806 - DNA, 201 bp, Bos taurus
ttggcctttttttttttttttagttgcctcaagtcattttgaaaagaggtaggaagtctaaaaaatagttcaaaatataggagtccctttccccctctcgmtgcatgatttctaaggccaattaaaatgccatttcctccaggaagcaacggggatttcctgaacttcaatccattagtactccttctgtaccaccagcac

SEQ ID NO: 36807 - DNA, 201 bp, Bos taurus
ttcactaattcaaaaatcacacattttcaagatagcaagagactcttcagctccaagttaggctgatggtggctgccaaatccctactcctcccatgaaaycgtccatggttgattaagaaagtgactctaccctcaacctgccctgtttccacaggtagtccctgatctctgccctgattaagtgcgccctgcttccttc

SEQ ID NO: 36808 - DNA, 201 bp, Bos taurus
aacccttacctttttcaccatggaataggcaacaataaagctaaatccttcagctgtttgatctttaagaaatccaccttaaagaactgaccttcaagaayagaatttttaaatggttatacaagcccattgaaagaaaaatcctcaatgatatggtactcatatatgtgatgctaatgtcatatactatgaaagcaggca

SEQ ID NO: 36809 - DNA, 201 bp, Bos taurus
tcattcttctttctccggggtctagaacccaccttgcccagagaagagtttcagaaaactttgttgctatggaaggaagtgtggaatgaacagcctgagayaggctggcatcattactttctgtggtatgtgattcctttgtattgctaattctattatcaatatttattggaattaatcagatgatgatgttctgactag

SEQ ID NO: 36810 - DNA, 201 bp, Bos taurus
cacacggttattgaaaatctaaacctatatgttgctttccctagtgtcactttatttaagattgcaggttgaagctattgtaatcttaggtaaatcagtarttaacttagcacaaagacataatagagagatgaaatcataagacctaagaggcatttttaaagaagaattttaataaatatctagcagaatataatcctt

SEQ ID NO: 36811 - DNA, 201 bp, Bos taurus
ttaatatctttggccaaaacaacatcacaacaagaaaccgacgagtttttctgtgggtgcaaatgatcacagacaagctcattttatttcatgtttacatmaaaatacaaataattgtattagtacatcctcctaatccattcttggcttgagaattgtaagcgcatagaaagagaatttgttcccagagctttttcagct

SEQ ID NO: 36812 - DNA, 201 bp, Bos taurus
acgtgtacagcttatctaaacatgactgagataatccactgttgatgagtgattccaggtgtttgttaaattgcgatccatcaccaccaacacaaggttakcccagcaattcttatatatatatttatgtattcctatataagaatagtttgcataggttgacatatgcctcatttctctgtaagattccatatcttaaaa

SEQ ID NO: 36813 - DNA, 201 bp, Bos taurus
agatgttttaagagtcatttctattaataatctgtagttaacagatctgaatctctcaatctagtgttttacttcacaaaattctaattcccagaagtcakaaattaatcttaatggagtaatatagttttaatcagcccataaggttaataaattgggttgattgaaatacacatcattagacagcgaattttggcagat

SEQ ID NO: 36814 - DNA, 201 bp, Bos taurus
ttaaactctataattcatctgtattttcattcagttactcattcattcatataaaactgagcttttgtcatatgtaaaacattgtgtcatgtttatactgkaagatatgtaaatcctaatatggaagatatattcattgtctttatggaattcacagtttacaatagaaaattgatacccacagatacaatagtacaacat

SEQ ID NO: 36815 - DNA, 201 bp, Bos taurus
gcattggcaggtgggttctttgacactagtcacacattaacactctgatcagcagatcatcatggaaagactacactacccaaagatacaatatattgggraaggagacttagtgaaaagtccatcttatataaagtctgcctaggcaataaagccccaattgagaaaatgcaaaggaaattgctgagattgcacacttct

SEQ ID NO: 36816 - DNA, 201 bp, Bos taurus
ccccagaggacttcagcatccctgggtgtgacctatgccctccctggcctctctcttgacccctcactccatgtccctcagctccatcccacctctgtcarccaatcctgagaatgtgccctggatttgtttccactctgacacccacaactccacagaccatcccctctgaccgtacctgcccacccatccatccctctc

SEQ ID NO: 36817 - DNA, 201 bp, Bos taurus
cactatgacccaagccagtgaccaaacacagtcaagctctttaatacagtcaagttctacatcagcgagaaaacagcaaggttagcaacacaaagcacatyagggctggtaagttcattagcaacaatgcccgctgataaaaatctgtaatatttgttctccataacaaggtggataagtgatatttgcgtttaaaaatta

SEQ ID NO: 36818 - DNA, 201 bp, Bos taurus
ttctgctccccctgccagtacctccaatacctgctgcagggagcctgatgacacccagtcacattcagagctggtaggtagccttttggttcacttagcawtggggctggagcagtatttccaaccttagaatctgctgctactacaacccacagaggccagacaggcattgtgtctgctttgtgaaaggaaaggcaagat

SEQ ID NO: 36819 - DNA, 201 bp, Bos taurus
cactgccacagcccacagtggaaaggccactccagggattttttttttttttccgacagtttagagcaggaagtttattcatggatgtgtggaggacatgrtaagggccctcggactggaaggcaaaggggcgatggatggggactgagaacagacaccccaagtcagattctgtggagtcctcaggaacctggtgtgtgt

SEQ ID NO: 36820 - DNA, 201 bp, Bos taurus
aacatcttctttatgtagttcattagtttaaaaatgtgttgtttgaattgaatcaatatatcgaaattgagaaagatgagatggacagaaagaataactamcaatattgtaggaaatgttataggtcaaagagaagtccttgcttcaaagaaattttcagtatccaaaaaaaaaaaaaaaagcaattagggcaattaaatg

SEQ ID NO: 36821 - DNA, 201 bp, Bos taurus
tctatataatttatcatccaaacaaggacactttgagagtgaaaagcaatgctattaataattgtgccaagccagtaggaataaaccaggattgtcccccmaaataaggacatatggtcactgtattgattacctcatttcaatattaccaagacaacatcggtaccctttttctgctttcttttgctacctgacttcata

SEQ ID NO: 36822 - DNA, 201 bp, Bos taurus
aagtataattcacaatagaaaataatgtcacctgtagaaagacccatgcaaataacatttcataactaaagaaaagccagtcctttaaaagtcattgtccytggtttcatccttctggatatttttccagtctcaagctctctgtttcttcaaatgtctgtctagcaatggcaccccactccagtactcttgcctagaaaa

SEQ ID NO: 36823 - DNA, 201 bp, Bos taurus
cccaacttaaatcacagtggtaagaaagggaggaggtgtgtcccaacctggatcccattttccaacaaaaagcccatttccagcacactggcccacaattygggctcctgcacgaatgtgcctcacaaataataacctcgctgcacatcaagctgggaaatgaacactggcagagtcctgctaaattcccttaaactggcc

SEQ ID NO: 36824 - DNA, 201 bp, Bos taurus
agacacaactgagcgacaaaggatgcacaaagtaaatcagaaattcatatttcagtaaaccttcactcagacacatatttgaagcagttactgatattttyccctgtggaaagtccttgtatttcccatccaccgactcatcttccttagtctctttcaaaattaacctcttgcaggaagcattctctgatcaccctaatc

SEQ ID NO: 36825 - DNA, 201 bp, Bos taurus
cacacatgcttttataaaatgcatcttctatcagaagaagtattactcctgaaatactaattaacaaatgttttaaacggaatttagatgttcccctaaaytgatattctgaaaattttcttcacagagattcagggttaaaaataaaatgtaaaaatgattttttaattaaaaaaataaaaataaaatgtaaacaagttc

SEQ ID NO: 36826 - DNA, 201 bp, Bos taurus
aggcctcctagggggagagtccatgctgagaatgaggagcatcagcagggagaaggggtgttgggatgcaccaggggaagggaggaggaagcatgctccargcagagagaacagaagcacaaaggccagatggcaaaagagcaggagtccctggaaatgtagcgtggctggagaagatgcaacagggaggagggttggcag

SEQ ID NO: 36827 - DNA, 201 bp, Bos taurus
tgggagagggaagggtgcaggaggtcaggaaggggtgtggaggggaaaggtcgctatttttccaccattacaggtttaagatgaatactattatggggccyagtcccagctcaagctgctcaaacactgaggttcagcccataggaaataaaaggataacttcttactccagtctcagaatatttttctttgttcatcaac

SEQ ID NO: 36828 - DNA, 201 bp, Bos taurus
tgcacaggacaaaccaagctcagacctggttctgcatgggttctggcctccagggtatcttctttgaaatttcctacggcctcctctagtgcctggggtcrccgagagccagcagagccccttggtggggcatcctagcttggaccagggtccacgtgggccccagttccttttgatccccaccccctgtgctctccgacc

SEQ ID NO: 36829 - DNA, 201 bp, Bos taurus
tggccactgccttcattgagcttgaggttaaagggccaggattaccctcctctgaagatgatatgtaaatattggactggacacattaatgtatttcccamaaccaaaactctggctggagattaaaggttgtatttaaggacatctgaattagggaaagaatctgtgaaaactaggaatgagttttaaacagcctttttt

SEQ ID NO: 36830 - DNA, 201 bp, Bos taurus
aatatttttttaaagtctattcaaactgagtctcataggagggcccactccaaactgtcatcataaggaaagttaacaatattgaacaaacctatacaaaygtgtgttgagaaagttattaaaaatataaaagaacattttctggagagcctgttcctaagggaaaagggctatattgtgtcccaaaaaacttcctttccc

SEQ ID NO: 36831 - DNA, 201 bp, Bos taurus
actggcccactcgcattcttctcttctttctgaggatggttggtggagtgctaaacttaggcacacttggggaggtcaaaggaacagcctcgccgtctgcmccattacaaccgtttcttttcccttcgagtacaagactgacgttaaactgacattccatggcaccttcgttgtgctgaattcgcattagtttaactgggg

SEQ ID NO: 36832 - DNA, 201 bp, Bos taurus
tctggtgtttgaaaaagcaaataagctggttattccccttttccaagcatcctacttttcccctctctgatttatagttgccattgaacacatggctctcrtggttgtgttgacttttcttgtctcttcctgatcattcgagatcatttttaaggactgccaatcactgtaggttttcattctaagtgaactcaattaagc

SEQ ID NO: 36833 - DNA, 201 bp, Bos taurus
tccgactctttgcgaccccatggactgcagcccaccagtctcctttgtccatgggattttccaggcaaaagtactggagtggggtgccattgccttcttcraatcatcatgctatttatttctagttaaattgcccaactgttagctttaagtgttagagcagagagatcgcgatatgggtctggccatttttgctgcagt

SEQ ID NO: 36834 - DNA, 201 bp, Bos taurus
tactttaaattttcaagcctcctattgggaggcttctaattcttaatctgccactgagattttgtttgtgatgttcagtgatctaaaacaataaaatgctrtaagtatttacaacaatgtagcaatcagaagcaatgaaattttgactagatattttcattttcagagaatttgcaacaggcagtaatgcactgaatactt

SEQ ID NO: 36835 - DNA, 201 bp, Bos taurus
catggaaataatgaagaatgttccaggcagaaggattagcaagtgcaaaggccctaaggcaggagccagcctagtacatctgataaaccatgaggccactrtggctagaacagacagagcaaaggcttagtgacaagaagtagagtccctgagatgggctcagaacgattgtaggggccagtctacatagggttgtgtggt

SEQ ID NO: 36836 - DNA, 201 bp, Bos taurus
cacttcaaaaccctgacttatgttctggccacgccctggggagcaggtactcaatacagatgccttcatgcctgggaccctctcagctctagtaagcagayggtatagataggaaggcccaggctgagcacagaaagtgaaaaacaacgtgaaagccagtcagctgacagtgtgattaaacgtaggaggctcatccaccca

SEQ ID NO: 36837 - DNA, 201 bp, Bos taurus
tttgcactgggcctggaaaattgtgtcgacacgtttcactgtggcaggtggcgttgaggcagggtgatcatatagttttcatttaaactgggacacttccraggatgcaggggcctgctagtaataattatgcagggaagcaggtgtacactgggattgtacctggctaatcagaaagcacagttattccccattgttgga

SEQ ID NO: 36838 - DNA, 201 bp, Bos taurus
cttaaatcctgggaaagtttcagccaaagcagtttaaaagatctagatagtatggtgaaaaactgactttccttaggctctcagataatggtgatgttcaytttgaattcatagttgttctcaaagagagtgaaacattgtttgattgggaaattgagcaggttttaaaaggtcctcaatatctatgacacagcaaatcct

SEQ ID NO: 36839 - DNA, 201 bp, Bos taurus
tgaaaggcacacagtctaaactcccaattaattcagaatttagacagctgggctcaggatgaaagggtattgatgaagagtctgaaaaagtgggtcacgcraggggccaggcacagaggaacaggcagggaggtcacttggttgttccactcagagatcaaacttgtgcctctggttctgcagatgctactcggctgtagg

SEQ ID NO: 36840 - DNA, 201 bp, Bos taurus
aaagagacacacgccagcgtaattgcccacgtcacggcctgcaggaagtaccggagaccaacgaaggtaaatgccctcggtgcagctgtaatggcgagcgygctcagaaggccctgggggtagcatgcgatgatgccagaactgtctgtggtttccactgccaggttcatgtttaagcgcagcattgtcagtctcataatg

SEQ ID NO: 36841 - DNA, 201 bp, Bos taurus
gaaaaggtctctattttgacagtattaatattgacattctggttatgaagctctactatacttacgcaagaccacgacttttcagggaaactgggaaaagrgcatactagctctttctgaattatttcttacaactgcatgagaatctacaacaatatccataaaaatttcaattaaaaatatacaatgagttttaaacac

SEQ ID NO: 36842 - DNA, 201 bp, Bos taurus
agtatagctaactaatcaatatggatgttggatgatatgctgtaccaatgtacagttgatatgatccttggatgcagatccaggagagggagaaattgttkggtggctaaaaagagctccactggagctgggcttcagagatttgtagatttccggtgagagagaagggggagggtatttaactaggggaaactgagtaaa

SEQ ID NO: 36843 - DNA, 201 bp, Bos taurus
ctttctattcttcttcttctttttttttaatttgcttcagactcaaaagatataggtaccaaataccttaagtttttgtacacatttaaagatgttctttkacatacctctccctcgacatctttgaaaccaatatttcacttctgttctgagctatgctgttatccactgtccataaatcagtggtgcctgacttctggc

SEQ ID NO: 36844 - DNA, 201 bp, Bos taurus
aatttagtgtcctattagagcacataccctgttttgttaatcaactgatttgtttattaagttattaatatgttctctttcaccacactcattgcataaakcttcatagaagaaaggtgtgaagtgaaatggtttcagctctaaggacattctggtctcttaggaagattatctgtacaccaagttgaaaactgttaagta

SEQ ID NO: 36845 - DNA, 201 bp, Bos taurus
cagtccacggggtctcaaagagttgaacaggactgaagtgactgagcatgcacgcacaccagagcagtttcaagtggttcctcataacttcaggaagttakctgaaggccggagacagcacacagaggaggggagactaactcaaggtgtcgagacgcagcatcacagtctccgagggtgtcagacaggaaaagaagcacc

SEQ ID NO: 36846 - DNA, 201 bp, Bos taurus
gaatgccatagcaagaagataagccagcagtgatgctgagaaaactgctccagtggccttaagcagatgagtccagcctggctcgctgaaccctgggcttscactgactataaacactgtcgcctggaagcattttgttttataatgtatgttgggagaggcttaatttttttaatatgttcagtagtaagaatagctatt

SEQ ID NO: 36847 - DNA, 201 bp, Bos taurus
atgtgatgtcacacaattcatacagaaagtgttattaagaaaattagttacttagttctggagagaaacatatccaacttaggcgtttgtaagaggaagamctagagtttgaattatgttctctccactctacatcgtaagggctttctacagtttcatgttgctggattaactaataaatttcccgattcactcatgtat

SEQ ID NO: 36848 - DNA, 201 bp, Bos taurus
caacgcatgtcaggaaggataaggccatgttgcaaggggtttttgtctccttaggtgcatggattttaaattaattcactgtgtaatgagggacaatgatmggtttggtttctttaaaggccagaccaattgattgtccaaacttctccatgctattttttattgactccagaatgaggtcaaaatcatcacttattttca

SEQ ID NO: 36849 - DNA, 201 bp, Bos taurus
gcttgggaggactcacatgggtatcccccaagggctcagcatagaatgaggagacagaaattcacgtctctcagccttttccagaaagaggccagtttgcrtatcttaaaagctgtagcctgaaggtcctaaactagcatgcactgggggactgagtgtgattggagaggccggctggagtcatctctacattctccctct

SEQ ID NO: 36850 - DNA, 201 bp, Bos taurus
gcagtgtggcctaagattctgtgagaaggaaaaggaaacacatacctagaatatttattaattataattaattgggataaattacagctctttccagagtrgaagaggcccaatgtaatagactggccagcatggggctggtggatgtttttcaagggatagtgctgcagcaggggctctggattttttctgggttgccat

SEQ ID NO: 36851 - DNA, 201 bp, Bos taurus
aacaaggactggaggcaaaccagaggctagatgagatgaggacggattttccctgctggtttcacagacagcaggccctacagacacctcggttttgaacrtccatccctcagagctgtgagcaatacattcatcctgctttacgccatgcagtttgtgttacttggttacagcagccctgggcgactaacagccacggct

SEQ ID NO: 36852 - DNA, 201 bp, Bos taurus
caagaaaaaagaagtaaatatttagttaatggatgtattaattaactcagtggcaagaatccattcacaacataaacatatatcaaatcatcatgtcataygcattactacaaatttatctgtcaattatgtatcagtaaaggagaaaaatgcatttctgtgggcagcaaacaaaaattgcaatggagcaattccttcaaa

SEQ ID NO: 36853 - DNA, 201 bp, Bos taurus
cgttcctcaagttcactttccatgtgtgagaaaaacctctttggacatttctcccattttcaactatttctcaagacaaattgttagtctctaaggacgcytgtcgtccgccaccaagtatccatttcgaacattgcatccttgtctcctttgtcaaggtctgcgttctgtctgtcagttttttcttcttcttcttcactt

SEQ ID NO: 36854 - DNA, 201 bp, Bos taurus
gataactaaatatgagggatgatagtcaaatttgctttaaaatggatttttcaaagtaaaaccttaaagtttgatggtagaggttgttttgtgtgtttttktttttcaaataggcaaaaataagccagattaagaaaagttatataagaatcaactgtattactggactttttccctccaggattgcaggcaacttgaaaa

SEQ ID NO: 36855 - DNA, 201 bp, Bos taurus
gatcttctagttgaaaggatcgcagtaggcctcccaggtcagtgcttcgcaaactgaatttggagacttcaaggaacccacagaccattcttagggagacygagggcctatcttctgaccatttttgttctctttctgttttcatgcatcttgatttcagtgtctctgtttgcacttaggtttacatgggcttaccaggtg

SEQ ID NO: 36856 - DNA, 201 bp, Bos taurus
gctcaatgagagcaagttttctctgtttaaattattacatgttaacagggaaaagatgcaaattcaaaccttaagtctctagattcaaagcattatctctyacatgtttagcactgaagtcctgctacacaggtgttttgctcaatgcactgaattctcagaagactattttgcaacagtgaaaatgtggatttgatctta

SEQ ID NO: 36857 - DNA, 201 bp, Bos taurus
ctgaacagaccccagctctgtgttctgttctcagtcatggctcagcacccaacccagaggcctgagctccttcagacaccttcagctgtgcactctttcayggaaccaatagtcatggaagatgatttttctgtctagttcaacacttagtttcctgctgaagaccaaggcgtggaagcagtaaggtcatttacttaaggg

SEQ ID NO: 36858 - DNA, 201 bp, Bos taurus
tgccttcaaagagcttaaaatctaaaaaaggggaaatctaggtcaacaggataacttggggcattgaggtaaatggtatggtagacgtcaaggagaggatytataggaacaaatgaaagaggcccctaattcaatgtggggaggatcagggaagaaaactggaggagcagcttccaacaggaaatgagaaagctaaggtgg

SEQ ID NO: 36859 - DNA, 201 bp, Bos taurus
tgttatattatatattttagtaaaatattagctttggaaccaaagctgcagcatgtactttgtaagctatcattaacagccatgtctatgaaggaaagctrcctcttttgaaataaggaaaactgaaatttaatattcatgctggggactgttccctttttacaatgtgaattcaggaagttgttgtaaaatttaaaatta

SEQ ID NO: 36860 - DNA, 201 bp, Bos taurus
ctgctttttcccctacaatcttatgtacaagtagtgaattatatttattcgcaactctccagaaaactcatggaattttttttctttagtctaataacatygttggtactttagtttcacttataaaatattgtattgctttaatgaaagtaagagcaactcgtgacatttcaccatgtgttagtgctgaaaatgttttgc

SEQ ID NO: 36861 - DNA, 201 bp, Bos taurus
tcgaaagcagaccctctaagcgtgtgtcttcctcccctcaccctttgggagttgcgtgacctcatttgccgtccttaccgcggttgggcccacaggacttkgcaggcgtgtccctaagttcatccatggaaacaccccttgccctccttaccttttttaggcccacaggactttgtggtgtgtccttaaattcatccatga

SEQ ID NO: 36862 - DNA, 201 bp, Bos taurus
atatcagtgtttgtttctttcctattaacttggagatgattacaaatctgactgtgtattttgataattggtatacattcaacactcaaaatatctgtaartgaaaagagagaaataaagaaggaagggaggaggaaagataggttaggaatagaaatagctgtaatatatttatagcatgtaacccatttaagggaaaag

SEQ ID NO: 36863 - DNA, 201 bp, Bos taurus
aaagctgtatgagccaaaagtcaatggaatgacatctctgaagtcctgggaaggaagggggaggaaagtttactggcgaccattcaataatctgtcaaatrtcatttaaaaataaaaattaaatggagatttttcaaaaaattaatttttaattatcagcaaaatttatcacaaataatggtaataaccattctcaaggca

SEQ ID NO: 36864 - DNA, 201 bp, Bos taurus
atatgagttggtcagctcatatgggtatgagcatacaaaactgtcctgatcatttgccctcagccagtcatttttactgactacctcataaatcataagaycagtctgatgccaaggtgatagaggtggagactctttctgggcccagcagctgagaagcacttaaaattgacctcccagcaatggacaccaattttgaac

SEQ ID NO: 36865 - DNA, 201 bp, Bos taurus
cccccttggcagatgaattcttacttctgcaccatgtgggaagccccttgcctgagtcaaatattaagtattaatatatagctggcccttactttccaggmtgctcaatggtaaagaatctgcgcgccaagcaggagaggcaggttcaatccttagtggagaagatactctagggaaggaaatggcaaccaactccaatat

SEQ ID NO: 36866 - DNA, 201 bp, Bos taurus
atgtgacaatttaaccaagtgttatttgggctaaagaagttaggaaatatattcctgggtttcctaggaattatagagctgccagtggggtgatccatttycagtgtgaaccaaaggaagaaatgacagttttcacagacatgtgctatgctcttccaaggacaaagctcaaattcctgacagggctaagtaatccactta

SEQ ID NO: 36867 - DNA, 201 bp, Bos taurus
tggtggcctggttgaataattctagtcccttctcacttggaagtgaacagacaatagaagttaatttagtttctgaaagaggctttttagtcactggcagmaaccgggcaacagtaatttgcaaaccctgccctttattaaaattcattgttgctttcagagttagagaactgtaatttcagagatccaagcaagaccaaa

SEQ ID NO: 36868 - DNA, 201 bp, Bos taurus
tttgtttgtttagttttatttgcctatttttgtctgtgctgtgtcttgttgctacatgggctttgctctagttgtcaggagtgggggctactctctagttrcagtgtgagggcatctctgtggtgtcttctcttgttgctgagcacaggctctagggtgtgtgagattcagtagttgtggctctagggctctagagcacag

SEQ ID NO: 36869 - DNA, 201 bp, Bos taurus
gtggaagttccagcttatactacttcaaatgagtatgatctcatactcaaaatcagagcaagatcagttattttcagtatctaaataagtgtcacagtaaytaaatgtaaataaaatttgattttaagaaaaataaatttctgcaaattattaagcttttttcttcttaataccaataattttgattttattttgtgactt

SEQ ID NO: 36870 - DNA, 201 bp, Bos taurus
acaaagctggaagtatcacactccttgacttcaaattatattacaaaaccatagtaatccaaacagcaaggtactggatgcactgaatgactggcctggcrctgcagattgagaggagagcctgaaggtgcaggggaaattatgaagccacttctgttagtgaacctcaaaaaatctgaggcagaatggccaaaatgacag

SEQ ID NO: 36871 - DNA, 201 bp, Bos taurus
tgatggcaaataatttcccatgtttaagggaaaagaaacagtgagactaaagtatggtgaaggtaaagttgctttgtatgagatgagtgagaagggtggaygaagaccagaatttctaggccttctgaggactgagtaaggagtcaaaatttaattcaaggttaatgaaaagtaaagcttggtagtgacatgtcagttgga

SEQ ID NO: 36872 - DNA, 201 bp, Bos taurus
ctccaaggggtcttcccaacccatggatcaaacccaggtctcctgcattgcaggtggattatttaccagctgagtcacaaggggagccctcctaaatggawagtggtatctcattttagtttgcctattcttaaggatattgcaaaagtaggaagtcaagaaacacctgggtaacaggcaaatttggccttagaatatgga

SEQ ID NO: 36873 - DNA, 201 bp, Bos taurus
ttaccctttatagatttctcctttgccaactcgtctcatattatttgcaccaaaactgaactagcggtcagtttctttattttttcatcatttttcacctyttagtatgcttttctctcaacctcaactgctccctctcatcggcttcctacatctattaaatgcagtttttccatatattttttttatataataattcag

SEQ ID NO: 36874 - DNA, 201 bp, Bos taurus
aatgactagtcaaacatagattatttatatttttcctacaatttaaggactactttctatttcagtttattcatcccttctgtaagttgaattcatagtayacacatattcaccaaattatactattaaatactgagctatacatatttaggatattggcatttgtaatgtttaaaatgcaaaatatttattttcccaact

SEQ ID NO: 36875 - DNA, 201 bp, Bos taurus
tataaaataattattcaaaaattctttatgtatgtatgaacaatgtttaacttgtgccaatgaacattttagtaatatacaaataatatgctattattgarttaattatggaatgactttagatatgctatcgccaggttatcctttaatatctagttcttttttgtgtgctataggaagtttttgtgctataggaagaca

SEQ ID NO: 36876 - DNA, 201 bp, Bos taurus
tctgtttggttcatggtttccagctttattttatataccttaactgaggtggaaacataacacagatgtcttttatactgtctaagaggtatgaaatgttkgcaaattttgtaatcaatttactatgattctacttaaacatattgtatcttttctgtagctctttgtggagggaatataactgcaatgaatggaaccatt

SEQ ID NO: 36877 - DNA, 201 bp, Bos taurus
tagtcagttcaacttatttaaattacttttgctgtgaggtttggaagtggagatagaaagcaagagaaaccactttaaataaaggttccaatgtggattgyaagtagcttctgttctaaccactagaatcattaaactttattgaacacatatgaagaatgaagatctaagggaataaacaaaagaaaagttgtaaatagt

SEQ ID NO: 36878 - DNA, 201 bp, Bos taurus
aacattttcaagactcccgagctcttgatatatggtggtgaataacatagaacccttggctgagagaagctgttttggtgtgtgggtcaaatggaagagartattttataggataggttgataacactgataaaaatgaaaggaactatggaagcacataagagacagttttcctgatctgtttactgcaaggagagcttt

SEQ ID NO: 36879 - DNA, 201 bp, Bos taurus
tattttttcatatttattttaatgactgtcaaactctattcctctcttacaggataacttattgctaaattcaatgcatattttactggcttcaatttttyggtcactgcttgttacagtaatggtatttcttcttgcccttgcttctgtcttatcatttggatcattcttccgaacccttactaatgatcttcactattc

SEQ ID NO: 36880 - DNA, 201 bp, Bos taurus
ggccagagaggccttctgattgccagctacaagagggtcaaaaaaaaaaaaaactctgatagagccataattcctgtagcagagacagtccatgtccctgkacagttggccctgccagggtccccataacccaataatagtaggagacattaacaccccactcacaccaatggacaggtcatcaaaacagaaaattaataa

SEQ ID NO: 36881 - DNA, 201 bp, Bos taurus
tataagaatatgtatagattttatgattaaatgaaaataattttaaaaatcaaagaaagggttatctgcattatggaaaagcacaagaacaaagtggacaytgtaaaattagagaaagcacaataataattgcaaatattattataacctataaaatgatgagtaatgtatgaacatttgtcaattatgaagatctataaa

SEQ ID NO: 36882 - DNA, 201 bp, Bos taurus
gtgatagaaatgagaggtcacattctggaaggatcattttcatgggaatcagatcacaaaatataatgacaggaataatatggacaagagtagcaatagtycaagagctaaaatcttcaggtttcaagggatgagagtgtgtcttaagaagaggtcagttcagttcagttcagtcgctcagtcatgtctgactctttgcaa

SEQ ID NO: 36883 - DNA, 201 bp, Bos taurus
agtggtgaggaaaaaaccaaatctgcaaaattatccttcaaaactgagagagaaataaaaacttatagaccaaccaaagttggaggaatttgtagcctgtwgatccaacttgcaagaagtgttaaatgtttttttaataagaaggaaaacggcataaggggagactgaatctacataaagaatggaagagcaccaaagaag

SEQ ID NO: 36884 - DNA, 201 bp, Bos taurus
ctcaaattgttgaacatctaactacttgaaatatagcccaatcagatatacagcatttagagtctgccttctttccatatcacatgaaatttcacccaacmtctgttagtcatacaaggacagaccatttagctatagaaaaccatcaactgttactgtccttcagagccctctgattcagagtttcccccccctgctgtt

SEQ ID NO: 36885 - DNA, 201 bp, Bos taurus
ccactgggatctgggtgtatctgtccattaaaatcagcactctgtggatttgttagtcctactccataaatcaggtactgacttgcgtcaggtcagctaaygtgaaaagctagtggagctgatggaattccagctgagccttttcagttctaaaagatgaggctattaaagtgctgcactcaatatgccagaaaatttgga

SEQ ID NO: 36886 - DNA, 201 bp, Bos taurus
gaagcagtagcaaacaaactacccttcttccttatcagtggttgattgttcttgctcctttacagcaaaacaaaagtctctaaatatgactgtatgtattmatcctgtcaaaaagtcagctatttttttaactcatccattaatacattttcattaaatatacagctgtagaaaaattcacactttataagcatgcatctc

SEQ ID NO: 36887 - DNA, 201 bp, Bos taurus
actttcttccattagagaaaagctaaagaagagatgtagagacttacttggccagctgttgcttagcaaagaaaaaacattattctacattgatgtcacakaaaagcaactaccagaactcacggctcttactaaagctaaaattatatttcctgctatcaatcatagggaaatatggtggatctgacactaaaaatatca

SEQ ID NO: 36888 - DNA, 201 bp, Bos taurus
aatttcctactttattttcaaacattccctgagtcacatcactctagatttacatagctatggaaatacaccagtatatgccagccattatgtttaataaygtttttgttgttttaagatatgctcacatatccacatatccactaaaattgtttgataagaaaatttaaatctttaacactgctcaaaatgactattaaa

SEQ ID NO: 36889 - DNA, 201 bp, Bos taurus
tagctggtaaaatgttatttctgggggtgtcttaagggtgtttcaggaaaagactaacatttgattcagtagactgagtaaagctatctcctctccaacakagagaggcatcatctaatagagtaagggccagattagaacaaaaatttcatggaagagtaaatttccactctcttcttgaactgaatgttcacctttttc

SEQ ID NO: 36890 - DNA, 201 bp, Bos taurus
aatctagtaatgttatgtgtgaatcttttaattcccatataaagatgttgacactttattgtgcatataattttaatggaagctttcattaaagatttcayaaagtatctcccacaaatattccaaggatcttctctccatttttttcacttcatttttctgtatgttcttaatcttgctagaaatctacaactaaatatt

SEQ ID NO: 36891 - DNA, 201 bp, Bos taurus
cacaaagatcaacagtgttcactgttgagccaaccatctctgagaaaataatgatatatctaaaatttgtttttggtagcctttcaatttattcttttcaktgttcaaatctccctccatttggacaccctctgctcaggtgctaaagtccaggctttttgtccaccttagctgaagtattcctggcaagccctctccttc

SEQ ID NO: 36892 - DNA, 201 bp, Bos taurus
tgtaagatcctgaagaaaaggacctggcttagccatgtccaaacttctgacacatagaaatgatgaggctgtttaagtgtgctgttttaaaccacgtcatytgtggcccaatttttaactaataatctttccacatagaataaaaaatctacacttatgtaaatctcttctgagtgaaaagaccatctttttccaaatatt

SEQ ID NO: 36893 - DNA, 201 bp, Bos taurus
gaggggaattagcaatattgtcgacatgccaaacatatattgaggcttccaaaagtattactgttacagcaaacaagacccaaagtcatcaccctatcttmcgtgtgttccccaaatatgttgtgttccactgataagggcattaataactaaaggggtttgaataaaataaaatcagaaacatatttatatcttatttct

SEQ ID NO: 36894 - DNA, 201 bp, Bos taurus
ctggaaatctcatgaacagaagagcttggtgggggctacagtccatggggttgcaaagactcaaacacgactgagtgactaagcgtgtacacagggtttgkggagatgccatgaatacagataatatccctggtggtgatggcttgtgggatacccagggaagccaataactggtcagaaaaggtcattagggaccaagcc

SEQ ID NO: 36895 - DNA, 201 bp, Bos taurus
tgggattctccaggaaagaatgctggagtgggctgccatttcctcctccaggggatcttcccaatccagggatagaacccatgtctcctgcactgcaggcrgattcttcaccgctaaggcccaagggaagccttgtttcaataatcatcataagaataatcatatcttaatgaaggttaaaaaccctgtgtgtaggcacag

SEQ ID NO: 36896 - DNA, 201 bp, Bos taurus
atgtgatttaaaaaacaaatttaaaaagatatttagtaaagtctttctgaccccagttttatctgtcctttccctctattatttcttttttactagtttcytgatatattcttccagaggtggatttgtgtgtatgtgtttgatttttatttttctggccagtataagcataaagtgatatatttgtttaaaaaatacaaa

SEQ ID NO: 36897 - DNA, 201 bp, Bos taurus
ccaattcttcctaattaccaggcagtaaagtaggggactattcattgcctgatttattatacagtttgatctttatgtttgttgctagtccccacagactkcactcagatagtataaattaaaccataaggccctcgtattttctaggagagctgtggctctgtcagcatccattctttctctccaaaatggtagtaggtt

SEQ ID NO: 36898 - DNA, 201 bp, Bos taurus
ggtgccattgccttctctgtctcatgatctacaacttccaatttgttcttcctcactctacctactttcctctttccttctcctcttcctcctcatttccrtgtctgtctgtctgtctctctccaacccttacctcccagtgtcagccacagtctcagcaaagtttcctcccttcactcaggtactcatctgctgaacacc

SEQ ID NO: 36899 - DNA, 201 bp, Bos taurus
acttcaaaaattaagacttataagaatacttttagaattacaatgcttacaaggcaaatagtgtaatatagcttctatacataataaaaaaagctgacctmtatgtgttttaactctatattctagtgtataggtgaatatttcctcaagtataagcacatgtaggtccttgacttcctttacttttcctttccttggagc

SEQ ID NO: 36900 - DNA, 201 bp, Bos taurus
aggggcgctgcgtgtgccagcagagcctcgagttggccctctgtgggggagatccgagagcagcggtgacagttggtgtcacagggtggcacacctctgtktgtaacacgatgtggcctttctgctgtgactcctccagttctccaggataatcactgagcatcaccaaatcccaagtgtgagtcacctcttgtggagaat

SEQ ID NO: 36901 - DNA, 201 bp, Bos taurus
ttggccagttatatttcaagctttagtactttgtgattatagaatgttttcacactttgcttttgcaattgaggttatttttatgacttactgttaattaktgtaactgtcatgcttttttaggaaaaatgtatatagtctttgtgttttcaaagttagataataggtaagtcggtcattatttatagtgttcaaaattac

SEQ ID NO: 36902 - DNA, 201 bp, Bos taurus
cctccctgcggaccagatagcaaccaggcaaagacaaaggtccatccatcttcaggttctgtttgagtcaggtatttatgcttcagagaatatgtacttakggttcttaatttgtaacttttaaggaaagagttcattaaaaaaataacagaaggaaaataaatcaaataggttgctcatggaattttggtttatagttca

SEQ ID NO: 36903 - DNA, 201 bp, Bos taurus
ctaaatatctttttactatggtttcttagtaattctgatgatgcccaatgcaaatatgtttctgttcccaatgacattttaatactttcttcaaggaattkttgaaatatttaacaatagtaaattaactaaacatatttttcctttcctttcttttaagaaaaatagctgtctttttgttaaatttttactactattagt

SEQ ID NO: 36904 - DNA, 201 bp, Bos taurus
ttcattcttgcagtaaacataaggaaatggtttcagtcttgaaaatgtgcaaaaggcgggcaactctgccacctgtcatttgtcccttgtgtctttgtcaytaatttgttttttactaggctgccagcatctcaagttatgctacttctagaaaagtttaattgggttttttgaccctttggtatgaactgtatactgata

SEQ ID NO: 36905 - DNA, 201 bp, Bos taurus
ctccagaagaagctgaaaggtggattgtaaatttgattagaaatgcaaggctggatgccaagattgattctaaattagtgagtgttgtctgtgctatgtaytagatgtcagttgctgattattttatacttttgggggagtttttgttaggacattcattctagaatttttgttttaatatataatagtttttttgaaggc

SEQ ID NO: 36906 - DNA, 201 bp, Bos taurus
ttccataatttaaaaaacaataagaaagtaatagccttaaagaaaaggcaaaccaaaattttaaataaaaaactgcaatgaaaacaaaacaagaaatgaasaggctaatgtgcacaaagttcctacaactatgccagcacaaattgatcaataaatgtgagctcttgtgattcatgcagtacatatatatattaagcacca

SEQ ID NO: 36907 - DNA, 201 bp, Bos taurus
gtagttctagctaatgtcacaaaccaacctcatgtaccaacttactaaaaaaatttctcagaaccaaattagaatagaaaagtgccactcatcttagatayacatgatggactgttgacaaagaagaaatttagttttaatacttcagcatatcattagggagacaagctgactgagtgaaccgagcctggcatttatcac

SEQ ID NO: 36908 - DNA, 201 bp, Bos taurus
ttgctcttcacatatctcacaatttgtaaccatattggattgactattgttgtaatttcttctttttttttttccttcctgaccaagaattagtaagctayggcccatgtgccagatctgtttttatacaacctacaaactaagaatgacctgcacacaaataagttatttaaaaaatcaaaagggagactaatattttgt

SEQ ID NO: 36909 - DNA, 201 bp, Bos taurus
cttgaaatgttccttttcaatacatatcatggacttggtgtctatgtaagccacagaaataccaggtcattcagaatacattacaatatgactgttgtggraagggcataaaactaaagtcataaacctaaaagttacatagatttatgaaaaacattttaaaagaaactatagttcagggtacttgggaccataaaaatg

SEQ ID NO: 36910 - DNA, 201 bp, Bos taurus
atcctaacttctagatcttgaaaatgcgtacttagtgaagagcaaattactggcatgttttctggttaaatcaaaccctggatagctagagttgtgaaaarggtaataaagtttttataacaagcagtaaatacaaatctctgttaggactgatggaagaaggtagttcatcgtctatatttggcttatttctggcctccc

SEQ ID NO: 36911 - DNA, 201 bp, Bos taurus
actcatgtactctattttagtgatgagcagcataaacagtcataaatgttcacgctgggcaggatgcactggaaatgcgctgtggtggcctgaattaagcrctatgtctcactgcaagctaatgcgacagcaataccacacagtgctcgcagtcactgcgttgggaacattactttcagtgggaatgactgaagacgttgt

SEQ ID NO: 36912 - DNA, 201 bp, Bos taurus
ataaaaagtacaaagggagtaggagatacatctttccagaagattggcagggattctcagaggaaagatctctttgagtagacctttgtattaaggggccyagatttttaatgatctaacagattattctaaagaattgggctttatcccagtggaaacagagggtcacggaagaattctgaacgtagaactgatatggtt

SEQ ID NO: 36913 - DNA, 201 bp, Bos taurus
gtcaggaagatctcctggaggtgggcatggtaagccactccagtattcttgcttggagacacctatggatagaagagcctgtgagagggttaggcaggaargccaggggtctccaaatggaggaaataggctgcaagtgtcagacatttttaatctcttttaagcggcaggaggaaacaaactagtgttatattttttccc

SEQ ID NO: 36914 - DNA, 201 bp, Bos taurus
aatgttataagctaaattttcttgaaaaaaaatattataaactaggataaattatcagttatcagttattaatacatttccttttgagatcttgtgtcaaygtccgaagggaaataaaaacctgcctaggccccagaacttgcccagtgttcatgtatatgactgtggcatttcttaatatctgttaattggctgattaag

SEQ ID NO: 36915 - DNA, 201 bp, Bos taurus
tgagaggctacctttctaacaagccacaagtggagctgatgctgtctctgaaccatccttgaacagcacagtaactcaatatataaagtgaggggaagctmtggccatttaatgactgcagctttatagattcaatgctgttatattttgggaatcaaacataaataatcaacagtgatcacaaaaaagtaagtcttagaa

SEQ ID NO: 36916 - DNA, 201 bp, Bos taurus
ccaaagtgttgcttactcctgtgtttggctcagggtctagaagaatttgaagacaagaactttctgcagggactttctccatagggcaggcttgcagaacrgtggcctgagtgtagttggatttcttacagcttggctcagggtgacaagtgcaaatgttcaggcaaacgaggttgaggttgtgttgcccttgctgaccta

SEQ ID NO: 36917 - DNA, 201 bp, Bos taurus
ctgttcggggagctaagatcacatatgccacgtggccaggcaaaaacaaaaagctatccttctatctagcctgtttcctggctttttgcagggctgaaatktttaactttggccacgtggctacgatgaggctctaaaatatagtactgcaatttataaaagtgaagttagttctcttcttggtatctgctgagtatcctt

SEQ ID NO: 36918 - DNA, 201 bp, Bos taurus
gaaaaatggtttgtgaaaccagtcctgtagagattgaaaatcttacctattatttgggcagacagcatagatgtgtatgctggccatcaagcaccagctcyggcgacccctctcgtgggtcttcctgacgttggagaagatgtagtttcaaggctggctctgtgtggtttgcctgatgtccattttggccttcagggaggc

SEQ ID NO: 36919 - DNA, 201 bp, Bos taurus
aggggctagttttcacttgtaaagcaattaccgccagtaggcaaaatactttaggaggcagagacactagcataaaaatcatggtggagtattgctccackgttgtagattttgtaaatgctagacacaggctcagtatgttttgcacttgtaaacgttgtacaatatccaacatagcttataaggtatcttgattaagat

SEQ ID NO: 36920 - DNA, 201 bp, Bos taurus
caaaaataaaagtcaaaactttaaattgtcattacctagaaatgaaagttggttgaaccagacacaatacatttatagatatttatgtgaaatgttgaaawtaaagtctgtggtttttagtcatttttacatagaaatagtattaaactgacaatgaaaatcaatggtacatattattttgcaaatatttaagtttggaga

SEQ ID NO: 36921 - DNA, 201 bp, Bos taurus
aggatcagagatacaactggtgtagacagcaggatacccagcaggtagaggagcccgaggctccactggatggaggacgccagtggccaccagatagcatstggcactgtgtggctgtcattctctctgcatgcgctctggtggaaaacagggacgcatggatgggtccccagacagcaaggaaatggcgttacaggccat

SEQ ID NO: 36922 - DNA, 201 bp, Bos taurus
gatacacagagacagagaaactaaatttacctggggaggtggacaaagcttcacagaagaggcatttctgaattttgttttgaagggttaaaaaattttgyaagactgacagaggtaaacaaaaagatattagaaaaacaaatccagaccttcagaaagtttcagaagacaacatacagaatgatactgcatttataaaac

SEQ ID NO: 36923 - DNA, 201 bp, Bos taurus
aagagatttttaaaaaattcctctggacatttatatctatgattgcaataattaccaaaaaaaaaaaaaccttacagaaaagttaaggcaatgttcaaggmaaaattaatagagcttttttccttttaacacctttcatcagaccgttgccttcttttccgccatagcagccatcgtcagtatcaaatcctaatgcgctgc

SEQ ID NO: 36924 - DNA, 201 bp, Bos taurus
aaaaatgtttccattctaaaaacttagtacttcttcaaaaaattgtttagaaattaaatgttggctgtctcaagtcagtgaaatcaatgaaggttagataycaaatttataataaagattatagtaaatgagaaaaggagttttagttaatttatgtcctacttgacgaactgcatgccaaatatataaaacatatagaaa

SEQ ID NO: 36925 - DNA, 201 bp, Bos taurus
agagccggaaaatgcagaactggggcttcttgttagttcagcagggcgagagagctggctatccaaaagtcagaaaaaaagcagccaattctcaaagctckacatacagtcagctagtcataggactgaaataaacttatcaggtggtaaagtaagacctaaaaactgtattattattcttggcatattgaatttcaaatc

SEQ ID NO: 36926 - DNA, 201 bp, Bos taurus
taccttattctactcctaaatgtacattactccacattcctggactgatgggaaaatccaaagggtctaaggaattatggaaaacaatactaatcctcatygaatctaattgattgtttctgtttgtgtctacatatacaggctggttagaattggtacattttgttagaacatcaatagaaaacaaacataaaaaaccat

SEQ ID NO: 36927 - DNA, 201 bp, Bos taurus
atagttattagtaatgttggccatacatttgtgttcatccacctattgggcatggatataatggcacttccctatccccttgcaactaagtgtggctacayggctttttttggccaatggattgtgagaggaaatgatatgtgtcccttctggatgaaagtgttaaaagtaaggtataaatttagtgacatttggctcagt

SEQ ID NO: 36928 - DNA, 201 bp, Bos taurus
gggaagaagggttccagggcagttgctgcatggtgttttctaaagacgggggtacacaggtaggcacacccaccaccacccccaaaaccccacccagtagrtagcatagggccaactgagctcatctcctgaagtgctccgggtaatcattcactcattcattcattcaacagactgagcacccactgtgcgtcaggcatt

SEQ ID NO: 36929 - DNA, 201 bp, Bos taurus
aacttctctagattgaaaagaaatgcattttttgcaattatttgggataatttcctttgggcaaatacatcttggtggaaagtaggaggaaagttctaacrtagaggcagtgatagaagataggagcctggagatatccattccactgtggatttgacacatgtacaaggaaaccctaaagttacctatatataggaagga

SEQ ID NO: 36930 - DNA, 201 bp, Bos taurus
tttgatacaacaagcggccagggtactaatcttggtttctgaatacaaacaataggcttttttttatctaaatttaaatagaaaccagtttattagaagaygtaaaaaaaaaactgtcagagggccatggaaccttgtttcaaaactcaagtcaggaacttccctggtagtccagtggctaagatcctgagctctcagtgc

SEQ ID NO: 36931 - DNA, 201 bp, Bos taurus
agataaacaggggtaagttctcagagaagacatcaggtcaatatggccggctaccagtgatgtgggagaatctctactcttccacttcaaatccacagaayggttgaatgttgtccttagttgaatgagtagctgaaactgaatctgccggttcaaaaatcaagaaggaatttaaagtaactgttggaaccaaagtggtcc

SEQ ID NO: 36932 - DNA, 201 bp, Bos taurus
taagagctataaagaaatcacgttttctaattaaaagtacaatttagaagattaaaaacaatggaacagatccttgaaaatgtatataaaaattcaaatakttagctccttgtcaagccctcctgcagtttgagtgcatattttctttcaataatggttaaaaatatccaaccaaacagaaggcaccagggagctcagtct

SEQ ID NO: 36933 - DNA, 201 bp, Bos taurus
ttaactctttattggagagatacatgaaaatgttagctttcctcagatgaaaaccaacatgtattaggaggcatgagaaattacaaaaagaagtaatacaygggtggagatcagtcacattttaaaaaggcaaattttaaacaacacaaggttatgagtaattaaatactgagtgaaaacaaatggcctctgtttaataat

SEQ ID NO: 36934 - DNA, 201 bp, Bos taurus
gcctggcgtgctgcagtccatggggtcacaaagagttggacatgactgagtgactgaactgacttcattcatgaaggtggcacccttatattcaagtcatytcccaaaggccccatctccaattagcactattttagggatttagctttaacatatgcttaagggggaatcacaaaccatcatccataacaacccctaacc

SEQ ID NO: 36935 - DNA, 201 bp, Bos taurus
aggagatattaaggctaaactatattgtacaaatcaatatctaatcaattcaaaatgattgatgaccataaaagcagaggaataagaaggatctctctctytccacatgcaagcaccaaagacaggccaagggaggacacggagagaaggcacctctgtgcaagttaggaagagcacctccaccagaaactgaatcaactc

SEQ ID NO: 36936 - DNA, 201 bp, Bos taurus
aatataacagtaaaaagtgtcaaccacagattggccctctccgtgggggcttgccatcacctctacagggattaaatcaagtgaagcagcagctgcagacrtttaatggcccctgaaggagtttagggtggagagcagaagggaggcaccctgtgttcagggaaaaactggcaggacaggtcttcagacagttaaatactg

SEQ ID NO: 36937 - DNA, 201 bp, Bos taurus
tgtgggatcttagttcccccaaccagggatggcacccacacgctctgcagtggaaagctcaggagtcttatttcctcggccaccagggaagtcctcccctkactcagtttagattccatcgtcagtcactaaagttactcccgtggaccttcagagcacaatcaccttaaccgcttggccacctgtcccgtgtaccttcaa

SEQ ID NO: 36938 - DNA, 201 bp, Bos taurus
gtagcgggtacaagaggacaatgactgtgaagctctatagataggacgttcagtcgcggagcaccaaagacaactgctctcaagatgttataggtatgacracaagaggacccttccagagacccaaactgcatttaaagcctcagagtactcctaacagatgtctcctctgcttgtatctccttatctagctttcaggca

SEQ ID NO: 36939 - DNA, 201 bp, Bos taurus
agaatacacaccatggagtagggatcctgtttcaaaggaagcttctgatgtatttggagaatctctgatagtgctgagaatgccaggaatgggggttgatrccctagcccaagtctcttgttttacactcttatttttcagtgtcacagacatttgttgctgtttagttgctacgtaatgtatgactctcttgcgacccca

SEQ ID NO: 36940 - DNA, 201 bp, Bos taurus
atctaaggatggcaatgggagataatctgataaataagaggctacagcatcagagcctgttcaatgctttcctggtacccagaggaaaggccagtataggstttaccagatacaatttcagttgagattaaagacagaattaccagagagaacaagtcagctttgtacctcagttcagttcagtcgctcagtcgtgtccga

SEQ ID NO: 36941 - DNA, 201 bp, Bos taurus
taaaagaaaacattttcatggatatctaaaagtactgtgggcctgaagctctgtttcctagtacctaatgcataagtcaggactgttttctggtgggagcrgatttcatttccctcaaggggccttgccacaaaaagaggagaaggattttctgtcctgtggatcgctgtgatctttgagagcatagtattagagttaacg

SEQ ID NO: 36942 - DNA, 201 bp, Bos taurus
atgacgtgaaacctaagcattgataaggaactaaactttgaaaacaacatgcactcaatttttaccttaccttcagaaaaaccccaaccacagctataccrtcggcatgcttcagagcagttgcataactgttatactttgaattccagtgaaccaaatggagctgaaaccatagaacagacgttaggaggtacatgccta

SEQ ID NO: 36943 - DNA, 201 bp, Bos taurus
ttttagattccgcacatgagtgttatcacatggtgtttgcctttgtctgtctgacttatttctcgaagcacatttttaagtccatccacactgctctgaayggcagtatttctttctttttagactttgtattattccattgtgtctatgtctgttttctgtctatttatctatcgatctatcacctcttcttaaaacaac

SEQ ID NO: 36944 - DNA, 201 bp, Bos taurus
gacttgctcaagagtcaactatgtttgtttaattttaatgaaatgagagactgaagtgtgtttgtttttgctaaaaacattttacttccccaatgactcaktggtaacctccctgtaatgtgtctcctaagacacaagggatgcagatttaatctctgggttgggaagatcccctggaagaggaaatggcaacccactcta

SEQ ID NO: 36945 - DNA, 201 bp, Bos taurus
ggagtgagagagagtctcagagaaaagttgttcacggttattctgacaggtcttgaggagaaaaataatctgtgaagacttcaggtgtaggtcagaggcgrgctgcctttgaacactggtgtctgggagtcctcactgacttttcaagtcagagtgagtgtgaccacaacatttcttttgggagaacagtgagttagtttt

SEQ ID NO: 36946 - DNA, 201 bp, Bos taurus
aaagaatatgtcaggagccaacaagttcatagcttgtgcctaaaaagtatctctaatattctataaactatgaattccaacagataaatgttcattttggytgcaagttagtgggtgcttacaaagtgctgactatgggacattcattacccttaggcactgaagcgtcctgaagggcaggcttatttcccattttccaga

SEQ ID NO: 36947 - DNA, 201 bp, Bos taurus
gcagaacaggctggtggatccaggcaaggaaactgttcacggagtttgtgtttaaactgaaaatgagagtatcaggtggcctaattctaacttcaattctkctagtaagaaattacctgtgttcttatattctttctggaaaattaaatgcatgaaatattttcagtcttgacaggccatcacaatcataatcactataga

SEQ ID NO: 36948 - DNA, 201 bp, Bos taurus
aggtgcaatacaacccgagacctcaaaaatcagaagaaatcagtcacgcacaaagctaagagcaaaattcccatgcagagaactggccaagactttctggrcagaaataacactcccttgtggaaccgagaaagactgtagctgcaacataatcaacaagagggaacaagacaaggttggagagataagcaggaaggaaag

SEQ ID NO: 36949 - DNA, 201 bp, Bos taurus
tgagctttcacagaagaagccagcttatttagactatggaatattctacacgctggatttggttgtttcttgtattaccctttaacttcgtcctttatcamagctaatacctcccataaagagagtgagaccagaggtctgacagctatgttgcctttttcacactggtttgctctctgaacttcattcttctgccggggt

SEQ ID NO: 36950 - DNA, 201 bp, Bos taurus
gaggagtctggtggcctacagtccatggggtcacaaagagttggacatgactgagaggctgagcatgcacgcagcagacggttcctatgatcagcaagttyatacagcatggagacgatgcagtgtttttctgggctgatcttcagaccacggccaagcagattatgcaaggagctgctctcccgagttcttaccaaaaat

SEQ ID NO: 36951 - DNA, 201 bp, Bos taurus
aggagaggcggctcgggcaggttcctcagacttaaggactccccctgctgcttgggcggattcgctgctcgtcccttctcggtccctaggggtgtctctcmgcaatgcttcgagcggtaagtgtgggacttgctgctattaaagtgcgcggagcttcaggtaaggcatcagagaaatgaatgcgtgattgtattttacccg

SEQ ID NO: 36952 - DNA, 201 bp, Bos taurus
atgcagatgagttgagagaaaagtctgctggacagctctcaaaagaagtaaagcaaagagattctgggaagatggtttatagactacaggcctcttcctartctgtcagttttttcctatctgcatttcctgagccagaaacaagaagcctctagctctctttgagatctagcagagagaaatggtgtgtggcctttagca

SEQ ID NO: 36953 - DNA, 201 bp, Bos taurus
tctgctgagtccaaggtggtccaaagagaagagtagacgaagtgctctctcatctccttaaaaataaccaaacccgcttaacctcccagggctgagaaagrgagaaacaagcctatgtatcaccctttaaccagcagacagttttcttatacaaagcagactcagttagaaacctgaaatttggctagataaattaaaact

SEQ ID NO: 36954 - DNA, 201 bp, Bos taurus
aaattgtttgaagaaagtaatcctggggttttagatgtctctatagcctgctgaaattaagttaagtctatagtacactaggttacccactccagcattcrtgcctggagagttccaaggatgcaggagactggcaggctacaatccatggggtcataaagaataggacacaactgagtgactaacacacacacacacaca

SEQ ID NO: 36955 - DNA, 201 bp, Bos taurus
attaataatccttatattggtgatcaagttatttgcagttacttattaatattcacaagcctgtaatgagcatatttgttgatagttattctgtacctagrcatatatttctgtagaaagaggattcgtgatagaactactgagttaaaggatgtaagcaatagtcactgccaaattatattttaaaaggctataaaaagt

SEQ ID NO: 36956 - DNA, 201 bp, Bos taurus
gccatagataattcacaggtggattctaattattgattgtggataataagaaagaatccagtcctccaagttagaaactttcaagttcgattggttctttstgctccaggccaagaagcctgccatccacaacagaagtctctggatctgtaaccagagggtaagctatgagcactgtgatacgccaatcatagcagatga

SEQ ID NO: 36957 - DNA, 201 bp, Bos taurus
taatagaggataccagcataccttcccagcttttattttatagataaggacattaaaaccaaccaatatctgagaatgttaatgtttcataatatacccarctcaggccataaaatcaaaaaacaagctacacaaagcaagtcagtgttaccaacagctcgcaattcagacgtgcgcaagtgcctctagatttttgctcat

SEQ ID NO: 36958 - DNA, 201 bp, Bos taurus
atagtatacctgcccttacagagttcacagcacagcgtgttatttctgataaattattttcttctaaaatgaaacacacctctgtcgaccatctcagcagyagctgaaacaaggcctttccagctgcatgtaaaagaaaccatgctgctagagtcctgcgaaattcaaaagagaaaatgtcatcaataaaatgctgggaat

SEQ ID NO: 36959 - DNA, 201 bp, Bos taurus
tcaagtatgtattacatgtctgtaagttattcaagacaggaccaggatctgtgaaggacctgacagagaacaccgccaaccacagatcatggcaaacaaakgagtgaattcttagtggggacacagtcctgcatgtgataaacaacgaaatggctttataaataagtcaagaattgagtgaaacatagggtcaaatttacc

SEQ ID NO: 36960 - DNA, 201 bp, Bos taurus
acctttcatgacagtaggagcatcagaacacattagagcaagaagccgaaggaggttatcaaattctagagcaaggcgggccagctagcagagcttgtgtyaatacaattctttcactaaagtaaggtattgggctaggagaacaaaagtatgtttttaaacagtagtctttaaatagtggtttccccttaaccatgcgat

SEQ ID NO: 36961 - DNA, 201 bp, Bos taurus
cacaataacacaatggtattagaaattagatcttgcactgtcaccagaacacccaaagaaagtcactgggataagaattcgtatctcctcctcaaaagtamtgtgtcctattttactttaacgtctgctttagtctgtctgacaccgtgaggacctagagtgcgtgggtgttgattgctttttctatgtacgtagtacatt

SEQ ID NO: 36962 - DNA, 201 bp, Bos taurus
ttattctagatgcaatttcattagcaataaaacaaaaattgatacagcaagaataattctacttctagaagttctgcaagcaatgctcttgtacaagctamaggaaatgtcgagtcacaacactgcagggcagcttccgggctaagtcagccctgaaaagatccaggtcatcagtaaatcaaggactgcaacaaattctta

SEQ ID NO: 36963 - DNA, 201 bp, Bos taurus
ccagaaaacgctcgcccagccccagcctctgctgcttccttcttacgtcctctcaccagtcgcactaaaccgtgtgtctctgggccgtccaggtctctctkctgcctctgggcacttactaattcatgaattagtccacaaatactcagtgagccctccccacttggcaggcacagttacggcccctggaaacgtgccgcg

SEQ ID NO: 36964 - DNA, 201 bp, Bos taurus
aggatgccacagattgtttccaaacgatttccaaagagtcagtaattacacctcaattacagtgtaattctgtaatgctgtaaatgtgaatgctgcagtgytgtgacataaaggataaaatagggtattattgatttgtttcccatggttttagtaggattgaatatctctatatagagcagtcagagtttccaagggagt

SEQ ID NO: 36965 - DNA, 201 bp, Bos taurus
cgagctcactgctgcccatgattgcgcgtgtccccggggacccggcccaccccacaagtgactgtgcatgtcctcggaacctagcccaccaccgtggatgmcggcacgtgtcccaggggccaagcccacggccgtgaccgcgtgtgtcccagggactggcccaccgccgtgggtgaccgcgcatgtcgtggggacccaacc

SEQ ID NO: 36966 - DNA, 201 bp, Bos taurus
gaaagcacgtggccctgtgtcaccgtgatcccacactgccagcctcaagagcttcagacggtgaatctgcgtgcctgatgcacgtggtgccctgtgggtcmgctggtagcagaacaagcgaggcccctgtgctcgtggaacttcaggtccagagaagaggcagatggtaattcttcactcagatatttaattacgagctgt

SEQ ID NO: 36967 - DNA, 201 bp, Bos taurus
ctagttttgaaaactaaattcttcatttaaaattgataaaaattcttaatttaaaaatggacttattatgctcagctcccagctggccaaccattcctgayatctggtttaaaggataagtgaaaagaagctccttgtaaatgccagccccgttccattaagcccgtcaccctcctgaggacactgagacaggcggtcccg

SEQ ID NO: 36968 - DNA, 201 bp, Bos taurus
gtgtgcccggctcaccaggagagcgaggtaagagggccgtgcctcttgctgggtgcgctgacacgggggtagcaggggagctcatgcagggacagcattcygaagaatggactaaattaattctgccccatctattctccagcttcttgtttgtttatccccaatattgagaaagttgagtaagctacaacgtgtttatta

SEQ ID NO: 36969 - DNA, 201 bp, Bos taurus
tgtagcttccagcaagatttccaagactcactatcattaagagaaacagctgttttgaaaggcactgtgcttgcaaactcttttattcccactaatgtcarcttttaagtagcgtttagaataaagaagaaaaaatttccttttgccataaaaagaaacaagatggtgtggtctacatcaaaggttcatgtaattatcatt

SEQ ID NO: 36970 - DNA, 201 bp, Bos taurus
tcagcgggtggcgctgtctctcctgctcggccacaccctgctctggtgggggagagagtcttggtctcggacctggcatttctccacctccccccttagtmgctgtggggccctgggtctgtgagccttggtttcctctactgtggaaggagggtgataagatggtgtccttggcagaatcaggtgaggtgataattcaag

SEQ ID NO: 36971 - DNA, 201 bp, Bos taurus
actgtgcatatttgaaaggaatggaattgacctaggccctgaccctgcctctgaccagagtaggagtctgtgtagccttgggagggagtggaaccagctcyggggtggaggccatcaccgcaggtatgcgcatccacatgcagacctgggaacatgtggaaacagctcagtagtgtgactccagccccttcagtcctgagc

SEQ ID NO: 36972 - DNA, 201 bp, Bos taurus
tttttgtggaacagatttgtacagtttgtgaaatctgtgcaaaattcccattacaaattacccaggtctggtcaaagggaccaaaaaatcccaggaagaaygcataggaatttttaaaaagtttaactgtcatgtctgttttttaagtagacaagtcatatagacattgaatagttttcatgacatgccttggaaaaggca

SEQ ID NO: 36973 - DNA, 201 bp, Bos taurus
aaataaaaataaaccaactaagaaaataataataaaatgtaaagatatgcatgccttaaaaaaaaaaagacaacagtcattgtatttagggcccatcctaratccaggatgacttcatctcaggattcttaattacagcagcaaagacctttttacaaaataaagcacctcacttgttccaggatatagttcttttgggag

SEQ ID NO: 36974 - DNA, 201 bp, Bos taurus
tcttttccacaacctcttactatgggaatgcttgagggctcaattttcatactcctgttttctttgttttatgcttatatccttggagagtgcatgcagtmttatggcattaaatgcaacttatatgccaataatttcctaatttatatcttcattctaaacctcactcttaaactctagtctcatacatctaggtgtcct

SEQ ID NO: 36975 - DNA, 201 bp, Bos taurus
agcatcctagaactaacaccaacaaaagatgtgattggaatgaaaaggtaggaagtcaagaggtacctggaaagtatagtaggtaaattgtactgagattsggattctagacccagctttatgatttcatgggagattcttacagttactcaatttctatctaagccttaatttctgaaaatattatgtttgggaagcatg

SEQ ID NO: 36976 - DNA, 201 bp, Bos taurus
ggctctaaggacccagcatccagcaggatgtgacacactgatttctattgaggcaacgtcagaacccgctctctaaacaaactatagcaatagctctctamagagtaccaagaaatggatgggataaggtcatgtttcaaggagcgtgtgaggcaagaaaattgatgactattttatctccttgccccaaatgtattttta

SEQ ID NO: 36977 - DNA, 201 bp, Bos taurus
gattttgagattaatgtttgtcattgcaagattataaactcaaactagagatgtgttttaacaatagagaaaaacagttcaaaataagtacgataattaayaagaaagctagaattactgtctctaaattattaagacttcacatgtaaatggtgaaaatagcgaaagaggcttctacactgatttctgtttggatctagt

SEQ ID NO: 36978 - DNA, 201 bp, Bos taurus
gtctgtattacattgtttacatttaggtttgggtttacttttcttttccttagtcagaacttcttctaagtgtcatctgttcatctgcaggttttagacaytgaatatatcgatcatctctcaagtccctttctcgatgtttcctttttaacagtactgcaatattctgcattttcccaaagttatattatctaattattt

SEQ ID NO: 36979 - DNA, 201 bp, Bos taurus
atgaaattaagatttatttccaaaaatggtatgtaaaagtcatcaagtattttagattgattgaaattgttttccaaacaagggccaggatctagatgtcytcccattctaacctctgctgccacagtctttctcagccactatgtacactattaacccaccgcccacgagcctgacaacagaaagaatatttagttggca

SEQ ID NO: 36980 - DNA, 201 bp, Bos taurus
gtagttaacttgaaaataaatcaagacagttgtcttaacttttaagcatctattaaagttgtaatatgcaggagacacctgatcatgcagaatatctaaayagggaaaataagaattagaataagaacactgaataatttctttattctaaattagtatttatcagaacaactagacaatatattttaacagatggcattt

SEQ ID NO: 36981 - DNA, 201 bp, Bos taurus
ctgagggttggaggatccaatttgtggcttcaactactcactccctaggtaggctcttcatctatttattcgtccttttcctctgaaatcccttccagggmcataggttgtcacttggtcacttacctttccttcctatctgattccacatggatctttctttcatccttagttgtttgggagtctttctgccagtttcca

SEQ ID NO: 36982 - DNA, 201 bp, Bos taurus
ttttagcttaactttatctgtgcaatccttttctatgcccaaacatggatagttgactttttctagcagagctgattaagcagttctaaaaatctctctgyattttagcttgcagctatatttaatcaaatttaataaagcaaagaatgcctgcttaaaaactgcacatatttcatcattcataattgtattgctaattat

SEQ ID NO: 36983 - DNA, 201 bp, Bos taurus
tggaagttttggtgaaatatcttgttggatcttttaaagaaaataaaaaccatattatcctaatataatttatatattgatgtcctggtttgaacttacaytggtgtttgttgtataatcaactctgatagatgcttaaacctttttttttttttttatttacttgattgaaacctcactgtaaaatccttatgcttattc

SEQ ID NO: 36984 - DNA, 201 bp, Bos taurus
tcaataatctttgttcactctcctttttattttagtgattttcataattttgaaatttttattatactcaaaaaatctagcttcttactagaaagaaatcrttttagagcatgaagaatacaaaaagaatccctagtccactttctcagcttttaggatggttcgatacagctttcctatctcttcctagcaggattttta

SEQ ID NO: 36985 - DNA, 201 bp, Bos taurus
tatttttttagttttattttttcatatttctgggaaataggtgatcatttaatttattatttcattgctaatgtctcttatggcctaaataactcccagarggtagttaataatcactttcaaaatgaattgatagttgaataacaaaatcctctttcatgttcaataaatgcaaatatctgaaattgactaagtcaaagc

SEQ ID NO: 36986 - DNA, 201 bp, Bos taurus
caagagtgaggtttttggtttccagacaacctgctccccttctacctctctggagcctactttggtttgcttaataaaacacttgctacttaaaactgctytatgtcccttgactgaatgctttcctttgggagaaaaaaggactgaggaaattgctattttgacattaacaacagtagaatgaaacagatatccaatata

SEQ ID NO: 36987 - DNA, 201 bp, Bos taurus
ctcttccaagatcttcctgttttgggtcatcttctttcctttgaaattgtataaatttcagccaccattttggataatggagtctgagcaagcaatggccrccaatcaataatagctttctgtccttcatgttattgtgggactacagactagattgtcttccctggtggctcagtggtaaagaatccacctgccaatgca

SEQ ID NO: 36988 - DNA, 201 bp, Bos taurus
atttggaggaaaatgattcagaactttaaaatccacacagaagaactttgggatctatagaataagaaatataaaactattttaacttcttgaaaaatggytatcaagatagatttggaaaaattcatatgtgagacaactaaagaggatacctgagtgaagtcagcaaaattttgaaagttctatatggtggtacaaaat

SEQ ID NO: 36989 - DNA, 201 bp, Bos taurus
gtttgggccagttcaattacctcaattattcatagttctatttctgtgatcacgttttgagaagtgtgataccaacatgtcaccacagattcatgccccaygaaaacatgcaaatgggattttgaaaaatgcaaataaggatccataacccatgcccatccataaaggaagcttgattgtgtctctttaggcaacattttt

SEQ ID NO: 36990 - DNA, 201 bp, Bos taurus
tcactctacgcccaaattgaaatggtctgccacagtcttcacttacagcaacttgccagaagttcacacagcattcttctgtgtcatcctacacccacggrgtcatgtggctgaagtagctgagcagtttgcatgtcaaccacatattatagcaatcttcttttcatttcacacaaaggaaacaaatcaaagcaaaaaaat

SEQ ID NO: 36991 - DNA, 201 bp, Bos taurus
aaatatattatttaacttttttcaagttctcagatgttaacatattttatcttgatttttactgggatgatagaaaaactttgcaataaagtttaatattyaattcagttcatttattttcccatgtgataatctgtgttaattttttcccttaattctgaaactataaatcctatgtcctaagaatactagaaattgaaa

SEQ ID NO: 36992 - DNA, 201 bp, Bos taurus
tctctctctcaaaataccttattgtattatattaaccctttttgttaagatgatgtgagatgacaaacacctgtgtgataattccaagttaagtgaatggygtggcattgttacttagcattaacctactactgagctgatgataagaggagaggagaatcaaggggagaatcattcgctccagttgatccttggtcacag

SEQ ID NO: 36993 - DNA, 201 bp, Bos taurus
ttgctatgaaacaaagaaaagtaatggaaccttaaagctgatatcaaacttactttggaaaaacttctagttcatgaagtaggaagcaaccttgtatattratgaaggtatttctctagaatgttgttttaaagtcttagaaagtagattgttaaagccaataagtatgataagtagcatggccattaaaagacaggttaa

SEQ ID NO: 36994 - DNA, 201 bp, Bos taurus
ttaacatatcagagagatacaggtattaagaaggtgctattaagaatattgtcataataattgaaaagaaatgagtacaggctgtttaactgcattttctyttatatattctagatgttaaagtttagagacttatctgtggggtaggtgactaatagagcattgtgatatgaaattcaacttatctaaacagtgatttct

SEQ ID NO: 36995 - DNA, 201 bp, Bos taurus
ctttgttggcaaagtaatgcctatggctaattcatgttgaagtttgatagtatacatttctagtgaagtcatctggacttattacatattgcttttgttgyatgcaaatgaggaggcaagatcttaaaatacaaatgcaaattctatactagatatacgtctcctcggattatctatttcaccttatggtgatttgatact

SEQ ID NO: 36996 - DNA, 201 bp, Bos taurus
cccattttaatcctactgctgtttattcttttactaatctgccatttttatatccataatctttttatgcttctttcaccccctatgaatctattatccakaaatcaagagacataaatacaaagaattttgctactttgcatgtgttgaagtttcattcaatagcattctcattttggggaagaaaaaccctgcttttcc

SEQ ID NO: 36997 - DNA, 201 bp, Bos taurus
tctagtggaagtgggactgaggttttctgactggagtggcaccgggtttgagttctatagggcttgttgttttgcaagcccagggcggcacgggtggggaratttggggggtggttgtcttctgcccagacctcagggaattgttgagttaatggtccctctcaaccgtttagcccttctggcttcccgtccaggagattg

SEQ ID NO: 36998 - DNA, 201 bp, Bos taurus
agaggacaggttgacaccatggcctgtttttccccagctgatttcctctgtgggaggtagcgttaagatatgagatggcagaggaaggagggaaggcccgyagtattgctgccacccctatcaccatccctacctcacaccagcctctcctgaggctgcatttaaaattttggccatgagttttccatggtttccactcta

SEQ ID NO: 36999 - DNA, 201 bp, Bos taurus
accctcctccctcctccctccccataccctccctctgggtcatcgcagtgcaccagccccaagcatccagtatcgtgcatcgaacctggactggcgactcrttagaaatcactgactagctttacgaacgtgaaacttcgttcaagttttctttttttcttttttttttaaacttgatttattttagtttacttttggcca

SEQ ID NO: 37000 - DNA, 201 bp, Bos taurus
agagaattcatgcccccccccccttccaagactttcaagatcacatttttatttatattaaggtcacatttcttaaaaaagaacaaaatgtgagccaagtraaggacgtctgcaggctaaaaaatattcaagtttttcccttgcaaagctagatattttgtttgatcattcagctgccacctgcatcacacccccagctct

SEQ ID NO: 37001 - DNA, 201 bp, Bos taurus
tttatttcatcttcattttaaaggatgacttcataatttacaaaattctgggtcagtggttattttctcccagcactttactctattcctttcttttcttkcttgcatggtttcagaggattagtcagatgcagtttctgttacggttcctccctagataaggtttctgtggtttttgctgagatatcctaaagcacagaa

SEQ ID NO: 37002 - DNA, 201 bp, Bos taurus
atatctgaggttattgaaatccttcaataaaaaaattaattaaaaagtaaaagaagatggataactcaaaaataaaataaaagtttttaaaaatgaaatgsagagagaaaaccaaaccactgcaccttcaccagaaaattgttatcaacagtaaatttcactcactgttaaactagattctaaccgggttctgagtcatta

SEQ ID NO: 37003 - DNA, 201 bp, Bos taurus
gggaccagaatagtagagcagtgattgcagttaggctctgagaaggggtgcattttgatctgggatttgaggacagtgaaagaaatacactggttgaaaaraaagaccctctttgagattgaaatggcatatggggagagatgacaaatgcagagaaccagtcatgtataaggaagtattttatcctctagaaatccaact

SEQ ID NO: 37004 - DNA, 201 bp, Bos taurus
tcgactctgtattggtgtcctgatatccagaagtcaaaaccagactggtggtagacacccatatttcaaggaagcaggtctggcttccttttttctctctrtttgaacaactggtgcatttaatagagaactgtgttcatcttttcaaactcgctttccacttttgtattttcttcttctcatgatatttttcaggaaaag

SEQ ID NO: 37005 - DNA, 201 bp, Bos taurus
gactctgctaccacagcctccttcccaggccagggaactgggctattccagttccttttctccaattagacttccaaaggaagtcacttcatctgggcctmaagtttttatctacagttgctacctggatttaaaatcccaacttctccccacagttcagtcgctcagtcatgtctgactcttcgcgaccccatgaatcgc

SEQ ID NO: 37006 - DNA, 201 bp, Bos taurus
ccataacctgtcctcacgaatatggagaagccaaagaaaaactctgcccaaagactgtgtgtgtgggtcttgcatcaagccaggattgacagccttcttcytggccagcgacatatgtaattttaagtttctagtaatcacacacataaaaaagaaataagtgaaattaatttcaataatagattttatttaacaaagtat

SEQ ID NO: 37007 - DNA, 201 bp, Bos taurus
cctgaggctgtggccttgatgagcgggggaaggaggcagaaagtctgcaggagacaaatttggacgtaggtctggggaggaggaagtcagaagcaaagacraccataaagctgtatgatcaattgaaactgataagtttgcaaataaagatgagtgcattcactcagtttgggggcattcatgtttgcaatcaggttgtct

SEQ ID NO: 37008 - DNA, 201 bp, Bos taurus
atttgtaatcataaagaaataaaatactttaaagtaaatgaaatcctaaagaaatgaatatcctacatttcaaatctagggggatactagtgatcagtatyaaaaggaagatgtataggcttggtggctcagacggtaaagcgtctgtctacaatgcgggagaccaggattcgatccctgggttgggaagatcccctgcag

SEQ ID NO: 37009 - DNA, 201 bp, Bos taurus
gtatttgagcaaggcctccggtgactctgatgcttgttcaagcttgggaacggctgatccagaccacacgtaacgaggtattaaagagtgacagggaaacrgcgaggaggggcgtggaaagtgaggccatgaggttatctggtgaagtaaagccctgggggaccatgaggagtgcaggggctgagggctgcaggaggaagg

SEQ ID NO: 37010 - DNA, 201 bp, Bos taurus
ttactcagaaaatcttggtttaggagttttcctgttggcccagtggataagaatctggatgcaagttccatccctggtctaggagctaactacatgctgcrggacaactaagcctgtgtgctcggccacgagtgcagccaaaaaaatttttttacataaattctaaaaaagaaatttgtttagaagtaggggaaaggtaca

SEQ ID NO: 37011 - DNA, 201 bp, Bos taurus
tgtcagcttgcgggagtctccctgcctaggtcagtaacttgtacagatgcattatgtgtttctaccaggactgactgatgcctcactcaggagggccctgrgctatgggaaaatgctctagagatgctgggaggaggcagaggaaggaaggcgcagacatagaaaatggctgtctcttctccatccccggccttggacact

SEQ ID NO: 37012 - DNA, 201 bp, Bos taurus
tgttactgcaaagcaccttccaaatgtcagctgacttaaaacaatcagggcggtacatgcaaaaatggattctgaagagcgttttttgatcaaaagacacytgcctagacttctgactagaattaggaatcagtgtatctgtgtgatggaaattcctctatgtgtcctactcagtaaacccaaactcctctcatcctgtcc

SEQ ID NO: 37013 - DNA, 201 bp, Bos taurus
tggcactattcacattttggctcagataacgcattatctggggggagggggacctgtcctatacattataggatgtttagtagtaatcttggcctctagayaccagtatctcttgtcattgtgagaatcaaaagtgtccgtagacgctgacaaatgtcttctgcagggtaaattgccctagattaagaaccactgaggaac

SEQ ID NO: 37014 - DNA, 201 bp, Bos taurus
aatctttgtatccatagtcatcaaaggtattttctgttttggcagtgtctttgtctggttttgatgatcagggtgatggtggctttatggaatgaatttargaatgtttcttcctcttcaatctttttgaagtgtttgagaaggatcactgtaagctcttatttgtgtatctggcagaatttcccagtgaaaccatctggt

SEQ ID NO: 37015 - DNA, 201 bp, Bos taurus
tcagccattttgggagcttattttaccatgaggatgctggtgctgtcaagtgccattctggaatccttcctctggattattagcactgggaactggccttrcctgctagtctaccagtgccagtactaccctcagcctaagtgcctaccttggcaggaacacacgcccacccaccagcaggccagctgccttaaggcctcc

SEQ ID NO: 37016 - DNA, 201 bp, Bos taurus
atcttcattcccctggcctgtacctaggaacccaatcagagcctcaaagcatttggggttgactggctggagtgaaatggactgtcatcagtggagcatcytccctggaactcctggccagaggtatcccatgggcctactaggaccagacctcagaccttctgatcttaccacaatcttgccatagtcactagctgaagc

SEQ ID NO: 37017 - DNA, 201 bp, Bos taurus
cttcagggctgaaatgtaccaaatctctttaggttttaggatctttgcctgttattttcattctacctcccactcctctaagtacaactgtgccacccctytccacgtagccaaaatcattccttcttcagcactaagctcaaagattatttaagggcgatttcatgtccctgacttggtcaaccctacccctctactgcc

SEQ ID NO: 37018 - DNA, 201 bp, Bos taurus
gggccctctcagctgaaagaggccctgagggagcaaatcttaagctcaggacccacatagccataagggtccccagaaggtagattcaggcccaggtcccwagaagactcgctggggccaagtgggcagtgaagacactggccatgttcccctccagtctctgatcccctgaaggtttctcaccatccccactgattccca

SEQ ID NO: 37019 - DNA, 201 bp, Bos taurus
cagccctggcccctgtggagttactattttttgctggattccagtgtatgtaaaaccttgtttttaccctccaagtgtagagtctttgtttctcccagtcmtgtggagttcctgttctctacttctactggccttcaaagccaaatgctttggagatgattgttcttacggccacactctggggagcctgatgtggggctc

SEQ ID NO: 37020 - DNA, 201 bp, Bos taurus
aacaagtcatttcacttaagtatctagggtaaaagttctctttatatgaattggtaatattgatttccatcattgtcattaattacttcaatatttggatmtatttacattttacactgtattttttaactacgcctttttattctcttttcctatttctttatattgatctgtttctttaatccttcttttctcttttac

SEQ ID NO: 37021 - DNA, 201 bp, Bos taurus
aacaacaatcaacaaagaagatattctacatccaaagataagaagaatccacaatgagacagcaggaagagtgcatctgcaacacaatcaaattccattcygactgaatgggcaacccacaaactggaaaatacatcacagagtttctcccacaggactgagagttctgagccccagatcaggctccccagtctgcaagcc

SEQ ID NO: 37022 - DNA, 201 bp, Bos taurus
caactagaggcaagttttccccttctttataacttatcgttaaaaactatataatcaccttttagggtgttggaggaatatttaggccccattttttataygtctgtaggaatggagagaatttctataagagtgaaagtaataggaagacctgtttttctccatttctttacttccaactctccacagagaaggcacacc

SEQ ID NO: 37023 - DNA, 201 bp, Bos taurus
tgataaggattttgcatctgcaaagcacatttcttatcagccccatcttggcgctcctgctctccactgcagaaccaggccacaggaacgcatctcacacyacaagcagcttacctaattacattaaactgtatttcatcggttgtggagcccacgagccacccagcatcgtcagcacaggcagcgggagcaggagtacct

SEQ ID NO: 37024 - DNA, 201 bp, Bos taurus
agtgtatcaggttgtcatgtatatcccttgaggaggaaccaggaccctgcctcatggctgcactagttttcttgactgtctttcctttgtttctgttatcycttaaacgccttactcccctaactcataactgtttgaatctgcctttggaactcaaggaagctctgagaggctgaaacattcctacaaacaagaaacagg

SEQ ID NO: 37025 - DNA, 201 bp, Bos taurus
atgagccaattggtcagtaagccaaatggatttgtgaacactctgtaatgttatacaaatgagtgaagttttgtgattatgatatgtaccctggaagccamgccaccattttcacattttgattagaataatgttacagtgtctaattatttttctgatgtgatagagaaagagtctcagggaatcggttttcaagattta

SEQ ID NO: 37026 - DNA, 201 bp, Bos taurus
actgatcagattatgggctaggaatgtcaggttgggacaaatcaatatctctcaatttgggaagataggaaagatactttatcataccgttgatccagcaytggagtttcgctgggcaggatatgggtgccaggaaatggaaagtgtggatgagaatgaaataaatccaagcaatcaataacagactctagggaggatgag

SEQ ID NO: 37027 - DNA, 201 bp, Bos taurus
gttagcacatattactcaagtaccttatatatcacaccagctgttctgttctggcatgtattcatcactggggaaagttttaacctttgatggtgtacttmgcatactagtaagaagtgattccatttcaaaacctcattttagttgctcttctattgaaaacctcctggtagcaactatcacaggatgtatgactgtgaa

SEQ ID NO: 37028 - DNA, 201 bp, Bos taurus
tggtggtgtttcttgcttaaagaacactcacaaacagatgagtcacttcccagagggttaatgagtctctcccaaggcctcagtgttacaggagaagcatmtgtattggataccaagcatttatctctttcatctcttccagttgaggcataaagcacttctgaaggacatgacacagccctcttgatgaggactggaagt

SEQ ID NO: 37029 - DNA, 201 bp, Bos taurus
ctacagccacagtgtgtaataattacttagttaagatggcattaaatttgcacaggaagatattttgagagagagactgcgttcatgtagcttttattacrttgtattgttataactgttctattttatttttagtagttgttagcttcttcagtttggagaaggcaatggcaacccaatccagtactcttgcctggaaaa

SEQ ID NO: 37030 - DNA, 201 bp, Bos taurus
acagcaagagcagcacaatggctgtatctactggttggtgccctcggtggtgttgtttgtattggagagtctgaggttggaatgtggccgtgtcctcagcrgactggtactgtggtatggggattttggctgtaatccaggttaatgcattagcttcccttgttcttgactgttttccaaacctggcctcccttgcaatta

SEQ ID NO: 37031 - DNA, 201 bp, Bos taurus
ccataggtcaaattcgtgtgtaaaaatagtcttcttataacttaccaggggcctagtacacagggtggaaggaggaagattttcctgggcaaaagggaggygggagagtgcagagtgcatgaaggccacctgaataagcactaacatagtatgcatgggaaccttggaacaggctagaaaagagtccttaatggggagctt

SEQ ID NO: 37032 - DNA, 201 bp, Bos taurus
agcatgtgccacgtgggctttagatccaggtggcaatgcacactgggaagctgcagagattaaactactgttgcccctgactccgagaggccatatcactytatggttttagatggtagtgttttagactctagggaaaacccattcaaaatggaggttgggccaaatttctttgtcttattgaatatgcttttttcctct

SEQ ID NO: 37033 - DNA, 201 bp, Bos taurus
gaagggcctgcaaaataacaactgtccatcaagacagagggaaaggaagatgaaggagttccagagcaaatgtcagactggacactgggtaggtcaggagyagtgtctggaaagtcagggcctgaacctcagggcaaaggcttaaggtaaccataggcagggatgctctaagctgagagtccacatgctagtcagagggtg

SEQ ID NO: 37034 - DNA, 201 bp, Bos taurus
ttccatcacctccactagctttgttcatagtgatgctttctaaggcccacttgacttcacattccaggatgtctggctctaggtcagtgatcacaccatcrtgattatctaggtacttaaaaggccaggaacacaagatggtgtccattattccaataaatgcccttagcttctctatgacatgaactaaaataatcttag

SEQ ID NO: 37035 - DNA, 201 bp, Bos taurus
tgacaaaaaggtgcagttaattcttcaaaaagctaaaaaaataaaaaaaacttctcaataattttgcaaattggtcattcagcaaataggcctctttccayagtagggcagatactttgataagtataccatgaagtgtatcagttcagttcagttgctcagtcgtggccaactctttgcgaccccatgggctgcagcacg

SEQ ID NO: 37036 - DNA, 201 bp, Bos taurus
cttggcgctcttcacggcattgccgcctctgttggtgtgagcagttcctgaagaaaaggggcttcttgtgctgaggcttcaactccccacccatcagtccyagggcccagtgtagaccacagcctctctgcccctgcagaagagagctcacgaggagtccagccagtttcctctcccacaggaagtaggagctgcgtatgt

SEQ ID NO: 37037 - DNA, 201 bp, Bos taurus
aattttgttaattttacctcagtagaaccagaaggaaaaaaaagattggactccatggggtagagttggagcagtaggtggaaagttacagagtgacagayttcagcacagaagcagccaaatgtgagatcgaccagcttcagcaggaggatttctttgtcagaagtttttgagcaggagctgggtaaaccctgggaaaag

SEQ ID NO: 37038 - DNA, 201 bp, Bos taurus
tgtgggggccgggcaccttacatggccaggcttcagagccacgaagccgtcttaccagtcatagatgtcaccatcgcaggtgacaggagtaacctggagcrttaggggcctcactactcaaatcctgtagtttccattttgaacagctctcaaatctctccagtgtctgtcctcgcagctcctaccataggccaggccatc

SEQ ID NO: 37039 - DNA, 201 bp, Bos taurus
gagaaatgtctatttagttctttggcccattttttgattgggtcattttgtctgctgcttttggatgaaatattctataatatcaattaagtccatcttgyctaatgtgtcattgaaggcctgtgcttccttattcttctgaatgatctgaccactgatgaaggtggggtgttagagtcctcccactattttgtgttactg

SEQ ID NO: 37040 - DNA, 201 bp, Bos taurus
gggtgatctgaacagttcagtgagcaatgaactatttcttgtcttccctacacacctgaaccactaacttgtggagacataccccaaagacggtggccctkcaaggcaaaaaggaaattatttctacccctgccccttgcatctacatcctattatcacaaggtttcgaccactggacgagctaaagcttcccattatcgt

SEQ ID NO: 37041 - DNA, 201 bp, Bos taurus
tgaattattttcttctaatattaataactaatttatgggtagtgtggttaaagtaattttaaactttgttttctggattgctggatcctttttaattagcrtgtgttatttttacaaaagcaatagagcggtttttctataaaacaaacaaaaaagctaatttgctaagatgttaacagtaattgattctgggtgcagata

SEQ ID NO: 37042 - DNA, 201 bp, Bos taurus
aacaaggtctccaaattggctgccaccagtatatctgtccccaaggggtgttccagttgcctcttgcctctccaagagactatccaagatctgcaagaggrctgaccatggttcctttcaaatgatcatctctgcactgggttggaacatgagattttgcatatacccttcaagtgcaaagtctctgtttcctacagtcct

SEQ ID NO: 37043 - DNA, 201 bp, Bos taurus
ctccatcttctgggatattctgaggaaattacagtcacccaagaaatggaagtgggtagcaagtgtcaattagcttctgtcccgcgtgtccccacacttcyagagatgctctggggaaggtagcaaggatgtgagggcccaaggtgggtgctgtcagctggagcgtgtgtgaaactggctgaagtctgcagagtggttgcc

SEQ ID NO: 37044 - DNA, 201 bp, Bos taurus
ccatgaaaggtcacgacagaagcagacaggagggaatgtaaacacctaactctcatgaacgggtctgagaccaccagtcatttcactgcttcagggggccmtgtatctagggacggtctcggtagggcttctggttggaatggggcaacctctgtggtggttgggagacagccggccatttcctcttggtccccctcactg

SEQ ID NO: 37045 - DNA, 201 bp, Bos taurus
acacctggccaggtggggaaacagtcccacctactgtcaggcataatgcccaaagacgagcccacagccaccccagaatactacactgtccaccagagggygcagcacctggccccacacaccagggcaccagcactaatcccaggacccccagggccctgcaagcagagacctaggacccagctctgcctaccagtgttc

SEQ ID NO: 37046 - DNA, 201 bp, Bos taurus
tggtgatggaaaacttaggccacagtacttaaacaataagaagccattgtagggttttaatttgggagaggataataacagatttatttgaaaaaattcargagaataggttgaaagtggccagaagtaaggaaaccagagtgaaggctagtgcaatcattcagttgggaggttatgatagcttggattaggaaaaagtag

SEQ ID NO: 37047 - DNA, 201 bp, Bos taurus
actgacagaggggctgggtaacctgacccttgtctgtgggacccgctacctttcccctccaccagaaggatcaccccaagatcaggacagacgggagaatrttcaacagcaaaggtaataggaaaagacagtgttacttcagttctgaaaagacagtttagttggagatccttcagtcacagtatacattataaaaagaac

SEQ ID NO: 37048 - DNA, 201 bp, Bos taurus
gcggacttcagctgggtgcgttgtccttccctctaaaatttccctgtaccaggacaacaggtttccatatgctaattcggatgttccactgtccgtggaayataggcctgtcagagaagagcagccctaagcctgctttgttttcattttctcctggtgtttcccctctggtctgtgaataagcctaagcattcaggacct

SEQ ID NO: 37049 - DNA, 201 bp, Bos taurus
ggattaagttactgtctgtacatctacctctgaacagcgccacagagcgagaaaaagacaggagcccgaacaggaagagtgttcctaacgccagccaattygacgtcacggtataatgctccaggcggtatcgctgaaacacgaagtggtaacatttctagaaagaaagaaaactgctctgaaaaaaagatacaccttgca

SEQ ID NO: 37050 - DNA, 201 bp, Bos taurus
ctgggaggggaaaggggtatgtcatccaaacagcccggagggcactgtctgagctggtgattagagacacaaaaacaagggtctccagactgtctggcctrttttgggtaggggttgggaaaacggcttttggatgcagagatgcctaaagccctggtctgcccactgaaattggcctctgattctgagggatcgagaatg

SEQ ID NO: 37051 - DNA, 201 bp, Bos taurus
actgccagaggaaatgaagctgtggccctaattggttaattataagggaaccctgcagcagcaaaaccctgccctctgaatcaaggcttccctttctacayggttggcctctggtctcagtctgattgccatcctgcctgaatatgcacaacagaattttcttctaccaccttccgtgaagaaagcccttgcctccacaca

SEQ ID NO: 37052 - DNA, 201 bp, Bos taurus
gcacttagataaaatctacactctttattttagtccacaaaacctctggccaagccccaatcacctctcccaccccatccgtggccattctcccttctgcyaactctctttcagttacagtagtctctttccctgcctcacactccccaagctgttccaacctcaagacttttgtactagctgtttcctttgcctagaatg

SEQ ID NO: 37053 - DNA, 201 bp, Bos taurus
gctaacggcgacctcctccgagaggactgataccacacgccacgcctcccagggctgctgcagccggagccgctgtccctgcggcaggtcactgctgaccygtgccttcacaagagacactcagaccctcaaatacaggtctggctcagtctcttgtggggatcactgctcctttcccttcatcctggtgtgcacaaagtt

SEQ ID NO: 37054 - DNA, 201 bp, Bos taurus
gttgaggagggaggatgatgtggcctttaatcaaagggcggaatgaggctggtgaatgtggtgggtggtcgtagggaggcaggccctccagggtgctcagmatggctttgagcacatttcttctcctcagacttctgtttccacctcttctggaagatgcagacagaactctgagcctccagttccaacctgggagtgcct

SEQ ID NO: 37055 - DNA, 201 bp, Bos taurus
gtggggcaggaggtggcgctcccatgccctctccaagtgtaccatctccgatacctccatgggttccccagcccagaagctctctgaatccctgtacttcyggaatcttatggaggcctcatcacttaggtgtgtgtgtttgtattagccactcagtcatgtccaactctctgtgacctcatggactgtagccctccaggc

SEQ ID NO: 37056 - DNA, 201 bp, Bos taurus
aggaaggcaccatccatcttcctggcccaagaaccaagaaaccaaaatagacttgttgagctagtggtacaatatcgccaggaagtttgtttacggtcagrtttcctagggcttgagaggccatgctatgacttttctttttttctttactctttttatctcctcctccctgtatttctcacttaaaaaaaaaacttttta

SEQ ID NO: 37057 - DNA, 201 bp, Bos taurus
ttatatcaatggatgcagaaaagcattttataaaattcaacattcatttatgataaaaactctcaatagagtgggcaaggagggaacatacctcagcatartataggccatatgagacaaacccatgcagatgtaggagacatgagttctatccccgggtcaggaagactccctggagcaggaaatggcacccaactccaa

SEQ ID NO: 37058 - DNA, 201 bp, Bos taurus
ttgcagggatgtgtcttctgtccccaccatctgcagtccaggcttgggaatgaacaagacgcatggtggggatgggccagggctgggacctgacttgagargcttaggagaatgccagggcaggaggctgggctactggagagagtcgtttccaaattgttcatcctgaatctcagatgagaggatggaggccagtgtaga

SEQ ID NO: 37059 - DNA, 201 bp, Bos taurus
acaatgaagactttttaaaactgttcattgtatgcagttttaaaggttactttccatgtgtagttattacaagatattggcagccttccccacgccatackgtatatccttgagcccttcttacagccagtagcttgtacctcccacccctacagttaagaatttaactgttctttcagattttttctgtctatataaaca

SEQ ID NO: 37060 - DNA, 201 bp, Bos taurus
tcaagttccggaggtgttttagggccagggttagacacaaaccctgcttttctgcttccttttcacctgcttccccacattgccaccctctgtggtttatyctacccttacagcaggggcccccgtgccatcgcacaaatgaggcaagtagacagagtccagatctccttctggggtgggcagtaaggggcaccgggattc

SEQ ID NO: 37061 - DNA, 201 bp, Bos taurus
cccagccttctttaaggtgagaatttttatagcagacactgtgttttaaaagccagcgtttaatattttttaaaaagaagacctctagattttggtgtttrttatctgccagtatgaaaatggatgattaaccaagcaagattccaagaagtcctttggaaaatggtggggtcagtccttcattccaagtcagtcatgagt

SEQ ID NO: 37062 - DNA, 201 bp, Bos taurus
tctgtgctgaaaaatagtgctgctttttgctgaccttagtacccatttcagcatcatgagatttacggccatccctgatggcctcttgtgacactgattartactgactgcttaattaaagtgaaacagtgacatgctttggggattttatttaccctcactcttccctttttacatattagcatcttctggagtttgcta

SEQ ID NO: 37063 - DNA, 201 bp, Bos taurus
acggtcctgcaagggaacggggagtgccatgcgggaaactgaggcccagacagtcaaaagacttgtccaaggtcagagcaaggactgagagcatctgagcyctgaggggaccactctggctcaggccctgctgggaggcactgtgccacctgctcccaagcttcgggaaagaggtgagcttctggccttctgctcaggagg

SEQ ID NO: 37064 - DNA, 201 bp, Bos taurus
aaaaatcagctgcttcctaactcaatgtaataaactataaccatcccccccataccttcacagtgttgtgaatttcagaggtcattaggtttctagccgcracgatcacatcctgacacttcttgttagcaaaatgagaattgatattacgggcatatttcagcaaatcagtagtatctccttttaaaaacctcatctcct

SEQ ID NO: 37065 - DNA, 201 bp, Bos taurus
cttgactcagaatgcactagaacagccaggccctgggttgtagaatcagcctgctagcctggagaccatgattaaaaaaatatgtatcttgtttgagccaytgcatttcaagtttctggccctgccccatctttctttacaatagtctagcctccatcttcatacaagccaactgtgcagcttcatttggatctcatacag

SEQ ID NO: 37066 - DNA, 201 bp, Bos taurus
ttcctgcacatatccctactaggctgcctgccatgccctatacatctgatctcctgaacaccttgagaatgtttttattcccaccttccacagtttatgcyacttttccattccaggccgcgaccacttccttcctgcttggtcccttacaatagcctctcaaagacgggtttctccttgttaattaactcgtgctctgct

SEQ ID NO: 37067 - DNA, 201 bp, Bos taurus
agaagggaaggggggatacaggaaggaccagctccatgttccctgaagttgctaaccaggaggctcaccgcttggccagttctggcctcctggctttgtcyggtggcttgagaagacggagggagagtactgattacttggaagggtttgtgtcttagggggctggggtcacaggagtccatcatctcttacagacagagg

SEQ ID NO: 37068 - DNA, 201 bp, Bos taurus
ggacctctttcgttcggtggtctgtgtctggtctcgcgggtcttgtctggtatattggggttggcactaaacgcatcaccaacggctgcgtgtcctcattyacaggcctctgatccgtgggcctcagctgcttcgctctgcaggtttgcgatttccctttccaggggggaaaaaaaatccttaaaaaatgctttgggaagg

SEQ ID NO: 37069 - DNA, 201 bp, Bos taurus
ggagtcaggctggaatggcttgcacccttgacctagaagaaaggaagctgggagcagagtctcgaagcccctgggcctgctctgcccccagggcgcctgcyttctgggggctctgtcctccctgagtcagatgggctctcttttcctgggactagccttcgaggcatggatgaccatggggccgtgtgtgctccccgttaa

SEQ ID NO: 37070 - DNA, 201 bp, Bos taurus
tctgaaaagatctctcaggaagaaattagtagaagggttccagaaagcacccacgtcctagtttccagcttgccttatcaagagaggcctcctgctctttkcctttcaccctccctcctgtctgtatgcttggctacccacacctcctccccacagcctcctacggcctgtctcatgcatgccccatgcatgtaacacagt

SEQ ID NO: 37071 - DNA, 201 bp, Bos taurus
ctcattaatacctgtccaaattattttctgcctcacaaattattttttattagcatgtctgccacaaaactcatcagttgagtctctatcattgtactttycatttctggaaattctatttgtttctatttcaaatatattctttgttgccttttatcattttttgtttcctgaggatattttacagtttaccttttttcc

SEQ ID NO: 37072 - DNA, 201 bp, Bos taurus
ggaagaagtgccatggcctcctcatgtgggctgtcgccaccacctcgggtgctcagagaatacaaggaatttcacaattggcaggcccttcacttaactcrgagctcccaggagttgggctgtcaggggagagtttcacgttgctgccagtcccttctgaattgctaatacaagaaagatgcagatccctgctggaggccc

SEQ ID NO: 37073 - DNA, 201 bp, Bos taurus
caattaactctctcctcatctgattccagaatatctttctcctgccattttcccaccatactcccctccaccaggccacacactagcctccaactcattcycacctctgtgctcacaggtgacccctgctaagaaagaatctaggctttagaagccgacttggattggtggggccctagcacagaacagggtgcactggaa

SEQ ID NO: 37074 - DNA, 201 bp, Bos taurus
tattagttcttagagctcagggactattgaagaatatgtcctaatttcatcctcaaaatatttgaagtcagtgatgaattgaatcaaaccaaaaccacaaygaagacccgatccagttcaactgcagatctggtggtctgacataaaacagggtatgcctttccctgaagtcaaacattatttgtcaagtttctgctttgt

SEQ ID NO: 37075 - DNA, 201 bp, Bos taurus
actctaggctctcctcctacctgcccttctaaagctctttctgtaactaagcaggagtctaggagccttcctgggacagactcctcccctaaaacctcttmcgtagctcctccctgatgcacatttcctaagttgtttcacagaggctaaaaacctcaactagatggaagaaatgaactacttgatgaccttgagctggaa

SEQ ID NO: 37076 - DNA, 201 bp, Bos taurus
ggaggatcagctgggcaacgtgctttgctgggtgaggctggggcaccatatggtgcttatgaaactgtcattagccgaggtggcagtggtgaatgggggargaggggggcaggggcgagcagaacacagaccagcgttattctgaaggaaaaagcaggatgtaccatttatccataacaaggaaagaatgaaatttctacc

SEQ ID NO: 37077 - DNA, 201 bp, Bos taurus
atgaaggcgagagaagggggcaggcaggcttcatttctcagttctttttcctaggcaaaaagggaattaagagtcagtctacgcgggcctgggggaatcarcactcaggattcagagagccggcagacacagagggtcaactttctagtgcgggagcaggagagtgatctggccgcgaggctgggaagggcagcgggttgc

SEQ ID NO: 37078 - DNA, 201 bp, Bos taurus
ctttttctgttcccactttggcccctgactgctgtgtgactctgagcaacctctccacctctctgagctgtggtccccattggtgaaaagaggagttcctrctggccttttacagatctgattttctggggctctcagcctcccatagccgtcactgataggatattttggtggtaaaattttttggagggccaatctgga

SEQ ID NO: 37079 - DNA, 201 bp, Bos taurus
ctccaggttttagggtccagactggttcagcaccatctgtcatgattgtactcacccacgttgcacagccaatatggcattgtctcttcgcactcacccayaaattggctcctgtacaactcctccccattattggcctctgttctcagactgggcctccagaattctagcgaatacttctggcatcttaaagttctcata

SEQ ID NO: 37080 - DNA, 201 bp, Bos taurus
attaagatatatctatagacactagaatgtgaagtaggagatgctaagtgttgaaagagaggcacagatacctagctacaggaatcagagggaagagacaraagttccacgtgggtgattcaaggaagacttcatggaagaagtggcattcaagataggctttgaaaatggataagattttgccacaagttgataagagga

SEQ ID NO: 37081 - DNA, 201 bp, Bos taurus
cagccaacagaactgtgatttctccagccacacagcatcactctagggaagcaccccagatgcataaaactctctggaagagcaaaatggcccacagtgcmcctcaagtagccctggtcattgccaagttcattcccaaacctttgggaccaagggacctggggccagactcaaggagaacttgcactccttgcaggggca

SEQ ID NO: 37082 - DNA, 201 bp, Bos taurus
gtactgttgtgagagtgaaaagcaaagcccatcgcaaggggcccggcacctgcacgctcgtaaagacaacaggagcagcagttgcagtcacagtagctgtkacgggaaacagcccacaggccacattttaagaagtacaaattaactaattaatttcagactaaagcaggtcataaacgctaagacgaccgagatggtgat

SEQ ID NO: 37083 - DNA, 201 bp, Bos taurus
tgctccctcagtcctcacagaaatcctgagaatgggtcctattagagtcctgattattcagatgaggacattaaggcacagagagatggccatacacataytccctaagtttgcacagctaataaagcgtggagccaggatttaaaccctgatgttttcattctgtctactctggaagtattcatcagtgatggccatgtt

SEQ ID NO: 37084 - DNA, 201 bp, Bos taurus
tggccccctgtcaaagctaaatcaatactcccttttttctctgcaagaacatctcagtaatcctaattggtcactatggcaaccccatctgcagctcttcrtggcctcaatgaagagacagaaggatgagatggggtgagatggaggttaagcctacttattgtataatgctctgcctttgatatcacctagatccacatg

SEQ ID NO: 37085 - DNA, 201 bp, Bos taurus
aacagaaaggcgggacatgctctatcatcttggaaatggcacagtcgtggtcattgtttttgccaggacaggctagattttgctgcagagacaaaaacctmcaagtgccatcatttaaaacaaccacagtctgttcctcactcacactgcatgtccattgagggttgcctgggagacctgggctgtcagcacctacctggc

SEQ ID NO: 37086 - DNA, 201 bp, Bos taurus
atggtggggagacatatatctcaattcattctcactcagggacccaggctgacagcatctccagcatctcaaatgtatcagtcacaacagcagaaaggaawcacagtgaagtacatatcatctcttaaggcctctgtccaaagacaatcttctactcacattttgttttcaaaagcaaatcacactgcaatgcctaacttc

SEQ ID NO: 37087 - DNA, 201 bp, Bos taurus
caaagttacagggaacaggccagtgtggaggcagggcagggcagggtgaggccgtcctgatggccactagagacatcctggccagcggtgtcctagccccrggaactttccagagggtgttgctgccacacacacctgttctggcagctggctgggatggggcttgtctggatatgagtgtggggcggtgggtacctcata

SEQ ID NO: 37088 - DNA, 201 bp, Bos taurus
tatggttctggcccaggactcacccggaccttgatggttcgagggaagtcctctcacagagttcttactacctgctccccactacctaccagaggtaaaayggccctttagcagcctttctccatcctaaggacaccacataccctgccctgcctcctccatctcacgctggccagtcaaaaatgttctttcttcacctgt

SEQ ID NO: 37089 - DNA, 201 bp, Bos taurus
ctgaggataccaaaaaagagaggaccaggcccctgggccaatgtcctctgtgcttttgacctggtatacagattactccaaaaaaaaaaaaaaaaaaaaamctgtccaaggcctgtttaccacttcagtatagaaagcggctctcagttctcaatttcatatataagagactatgttttaagatacaaagtctatatcaaa

SEQ ID NO: 37090 - DNA, 201 bp, Bos taurus
ggtcacatcctagcctagatcggatagaacaggaatagcaggttaaaatagaaagtgaagtcagagaatctgaaagagatgggagacaggcagaagagacragaagttttcaggccatataagcttaaaggggcttccctgatggttcaaatgataaagagtttgcctgcaatgcagaagacctgagttcgatccctggat

SEQ ID NO: 37091 - DNA, 201 bp, Bos taurus
ctgctcagggcctttcctggggcatgagagcatgagttccccgtctcctctgagttcaggagggagcagcaggagcctgagtccctgggggccttgcgtgycctgtccaccttcctggtatagttagaaccactggtttcagagcaggacaagcctccccatctgagcacgcactcacccacttcagttatcaccactgca

SEQ ID NO: 37092 - DNA, 201 bp, Bos taurus
agtccatctctcgccccagacaggccccccagcttcacctgtcatacttccagacacaaaaggttcacaccattgcatctttgacccaccgtcaccttcartctctgggcctggctccccggcccactgcagcccccagcccccaacccagaggtcggacttgggttccctcttcaccgatctccctgctcgcaactggct

SEQ ID NO: 37093 - DNA, 201 bp, Bos taurus
gacccaagccctgtctccaccgatcttgcagttctggctgctccagcaacccaggcatggagggcatcatggagaaaggaagccacagcacaggagcgagmgttagaggggccagggctgctggtcggctgcctagaggagagggctcaggtgggcaggacatctgcatactagtggtcagtgtgcccatgtagaagagga

SEQ ID NO: 37094 - DNA, 201 bp, Bos taurus
agaagccacatgtgcaaaggccctgaggcagaaggcgcatgcatgaaaggagccactgtggctctggaacagaagagactggttggagaaggatgcagacrccagtccaggcaggcctggtggttcctgggtgaattcaactcttattctcaggagaatgggaagcctctgaagggccttaagagagctgttgcaagcaag

SEQ ID NO: 37095 - DNA, 201 bp, Bos taurus
catgataatccaaatgaggtagttattatttttatccccaacatgcaaaatgaagaaacagcctcagagagattaacttgctcaaggccacacaactggtragtggaataagcagactacagaccgagctctgctttccaccactctgtgacggtgcctctccaagggaacaacgccgtcagggccagccctccttaaagc

SEQ ID NO: 37096 - DNA, 201 bp, Bos taurus
gctttacatgctgatacattctctgtttgatacacctgagttgtgtctatgagcatatctcttaggccaggtacataactcatcttcaagacatggggctmccaaaaaattctctgggaattcttagagacagtgtctaactccactcaaaattttttacccacaatttaaacttcaaccaaggttattttcttaccattc

SEQ ID NO: 37097 - DNA, 201 bp, Bos taurus
tggatcccagcccgcttggtgccgtgggagtggtggccggtgggggagccggaggtccctcagcagatgccacctccccactccaggtttaccgctccaaratggatggcgaggccaccagccccctgccccgcacccgcagtgggccactcccctcctcctctggctcgtcgtcttcctcctcccagctcagcgtggcta

SEQ ID NO: 37098 - DNA, 201 bp, Bos taurus
cacgactgaagtgacttagcagagcagagcagaagataatcttcagaagtactgtttccttgaccaatctgaaaaatcctaggacagattcgataggcccrgtttgggtcatgtgtccatccttgaaccagtctttggtgagggagatggagtattctgattggtcaggcccaaccctagcgctattgacaatgacgtcaa

SEQ ID NO: 37099 - DNA, 201 bp, Bos taurus
ggccacagcaggggcctctaaagtgcaggcccaaagttggagccccccttgctcttgtctttgcatgcattacactcagtgactgtttattgaccatttastataggccagacactgtcagagattcagatcagtcgctcagttgtgtctgactctttgccacctcctgaatcacagcacgccaggcctccctatccatca

SEQ ID NO: 37100 - DNA, 201 bp, Bos taurus
aaaggaagtgagaaaaggagaagtgttttactcctggggccaaggtgggggcaaaacacccaactgtgtatggcttcagctctgaccagaggaggagggarctcttctgggaaagggccgggggctgactggaaggcagtggctgtgcctgggcgggcagggagccccgagctctgggcagagggaccgtgccagtgaacc

SEQ ID NO: 37101 - DNA, 201 bp, Bos taurus
atccaaagaaagcatgagtgcccaacacagactcaaaaagccaagttcactaggtcccacatcatcactgttgtgatcacaaacactagtccctctccggractctgtcatctcttcccacctggaccctcaacctcagtacctggagactcactgtgagtctccatatggccctccagaagccgtgtccagcgtgagggc

SEQ ID NO: 37102 - DNA, 201 bp, Bos taurus
cctggacttctctttttttgtgggagatatgaggaccattaaatgagggatctctgaagacaaagcctaatgagttcactacccagctcacagtaggtacytgaaagatgtgtaatgaatacacaaggaaggcacacagccagaagggattcatgggtgctgattttcccatgttcccagctccatggcacccgagtatgg

SEQ ID NO: 37103 - DNA, 201 bp, Bos taurus
ttcagattgttcttatgcacctggtgccattatatccttgtggtcaataactttctccttgttgtggcttactccacaaattaaaataactttttggcccrttatattttggtttgtgtattttatctctcatccagcatagtactggatacctggtagattcttagtggaaaattatttgaaaagtcaaagatatcgaca

SEQ ID NO: 37104 - DNA, 201 bp, Bos taurus
gatacacctacctccctttaggtaaatagtagatttggcagtctgccgtctcagcatttatctgttactaccagtagtggtatatgcctgtgggtggccaygctgcccctaactctctttgtgcccctagccctgctctgcgtgttgtgccatccttcggttcttttgcttctcatgcagactcttaacaccagggcccag

SEQ ID NO: 37105 - DNA, 201 bp, Bos taurus
aggaggcaccctggccgggagagcaggctggggccctggctatagctctgctgcacaagacagggacaggacgggcactcacatggctgcgagtctcctcrttgccaaaggaacggcctgaactgaatggccctttcatggggcagtgggaggccagccgattggctgtgatcccccgtgcccctccctgcccagcgtggg

SEQ ID NO: 37106 - DNA, 201 bp, Bos taurus
tctagccaggcccggatttccttacctagcagttggcatgccctcaggtaggggcttaaaccatggcaacacacatgtcccactcagactggggacaaackctgtcgttcctttggggccatgttgtctccttcttttgtcctgcagcagtccttggccctgggaaatcccaggcaaagtgtatcatctctctggcctcag

SEQ ID NO: 37107 - DNA, 201 bp, Bos taurus
gccactgccctcgccatcacttaaggagcagggtgtgtgtgcctgtgtgtggtgggtgggggacaggaggggtgatcactgcggaggtgaaggtgttcatytcctgaggggcaggtctctttggccaagtcaagatgatgtgaggagagcaggaacacagcaacacagctgtgtagagagggccaggaagtggaaggccag

SEQ ID NO: 37108 - DNA, 201 bp, Bos taurus
ccttcgctctcctttcccctcatggaagacatagagacagcaggccatttcttcaattctgtctttatcaccaggaaggcgcttttaatcaaatcctaagytgagtggcaggaggcagaggggccttcccattctgccttcactaactctattccagagagtaactggggagtctcgaatcctgcttgcatcacattaaca

SEQ ID NO: 37109 - DNA, 201 bp, Bos taurus
tccctgggacgctcctgtccaaggtcctcgcctcctctctctcacgttctcccaaggtgaggtcatcttcctgtggctttaattaccatctagaggcccaygaccgcctctccagtgcgggcttgtctcaagagccagagacccatccatggagcagcttgtgaacgtctgcggacggaagcctcacggcccttccgtctc

SEQ ID NO: 37110 - DNA, 201 bp, Bos taurus
tgggatgggggctcctctggcctcacacttgggggggcggcagcagcagcagcgaggtcccagaactgccttatgccagagacccctggcacatctccccrtgggcctggggcctggggggtccacctgcaggctcctgggggcagtcaggcctaggaggtctctgtgtggcctctgggaggcctggcagccctcccctcc

SEQ ID NO: 37111 - DNA, 201 bp, Bos taurus
tgtggttgctgctttctgtgagctgaacagggtacatgagtgactgtgctgagtattccctgcagagaaaagcctgtgtaccagcagcaggtccgattggkttgactggcctgggacctggaggcctacggccatggctgccttgttctgggcaagccaccccatccctctgccggggcacgtgccccggtgctgccagag

SEQ ID NO: 37112 - DNA, 201 bp, Bos taurus
tgtccagttccgtccgctctgctggtgctggttgtggttcatgccagaccacgtccagctgatttccagccaggggccctgctggtggacaaggtcagacygagcctgatctcctgcagagtccaggaagctgagtgaagtcaacaaagagagagaaaagtaaagaaaaaccaaaacagcaatgcccgggcttgttttgct

SEQ ID NO: 37113 - DNA, 201 bp, Bos taurus
ctctggatttccactctggatgactgcagtggctgagtcaggaggaggtctccattagcatccttagcaccccaattaaacagctaacctcagaaagccaygcagactcagctatagacaagttcactagctccattcccccttgcagcctgactgcctttcattccctcctataaaaattctggagctgccgctgggaga

SEQ ID NO: 37114 - DNA, 201 bp, Bos taurus
acacacagctcctccggcgtcattcacagggcccatctctgcttggcagtcttcctcctggactcttatatgtgaggtgatgtgcatggcagcatgttgtkaagaggagcctggaggggccgtccacggtttctgttattaggataggacttgctgtgggtgggataccttgctgggcatctagcggaatgcaaagcatgg

SEQ ID NO: 37115 - DNA, 201 bp, Bos taurus
aggtgggcaggtggggggtctcctagcacgactcccgacatctgagcccgagggaaagaggtgggggcacaagactgaggggttcaccgagggaggcctcrgcttagcgagccagcaggctgaaagtgaggagttgagaataggcagcggctatatgtgaaggtccatgctctggcctgaattgtatacccccctcaaatc

SEQ ID NO: 37116 - DNA, 201 bp, Bos taurus
agggtatgagaagaacatggagggtgggcagaggccaggccttgtagggcccggtgggtgtggagggcttagtatgaaggaccctggtctttatccttaakagttgaagggtctcagcaggggccagtgtgaccatagttgaggctttgtagagatggctggctgctgccaagtgtctaacagaacaaacagaggccctgg

SEQ ID NO: 37117 - DNA, 201 bp, Bos taurus
ttgagagggacacatgggtgatatttacatcctcaactgcattatctgggaagtgggtgttttaactacttcctttttacggactaagaacacacagcccyagagaggccagcacctagaagcacgaggatttgaaaccaggtctgtttcctccaggagctctcccactggaaaggcagacagatggcagaagttatttta

SEQ ID NO: 37118 - DNA, 201 bp, Bos taurus
tgcaatacagtgctccatactaatctataaaggaaattatgccaaatgtcattactctgggtggtccaagggttgattatattaagtagattattctaacrttttgtttttcccacagaaacatcatctacactgtttgaaatgcagctctctaaaaggcagttaaattattaactcccatctagatcctaaatgagtgtt

SEQ ID NO: 37119 - DNA, 201 bp, Bos taurus
ggcctggatcagctgtggagcaatgagtgggtcagtggatgatgagtgggggctgggtgcagtggccaggctggttcagggtctggaggtagacagagtayccctaacccccaagatcctgaacagactgttcaactcattgtcaggtagcagtgtgttggggactagtagaacctgaggtgactatatatacagaaattg

SEQ ID NO: 37120 - DNA, 201 bp, Bos taurus
gtgcagttagttacacaggccccacacttaggactctgcactttgtttaatgctctgttgttgccatcttgaaattcttaacaaggggtctgaattttcaytttatgcagggccctgcagattatgtcaccagtcctgcatatacccactcattctccatcatcccctccctccaggtacctctccagccacagggaaagg

SEQ ID NO: 37121 - DNA, 201 bp, Bos taurus
tctagccgtgagtgtgtgtgtgcacgcacgcgcaggtccagccaccttccggggctaccagcctcattccctggcgttcccctcgggccctcaagactgtygtcacgccagtgctctgtgtttcccctcctgtttgattctccaagtcaaactgccctggccacggcgtgttccttcccggtgggagtcttgcctgcacta

SEQ ID NO: 37122 - DNA, 201 bp, Bos taurus
cctccagtggtaccacatgctgctgtgcaaacagagcacgtggtccggccaaacaaaggaacatgtgtgtgtgttgcaaaccacccccctatcacgggagygcgagctccgccaggagagggcccggcccgcgcgcgcgcgcgcgctataatttttcactgcagttgaaacaccccgtaagctctcaggaagcagcggggg

SEQ ID NO: 37123 - DNA, 201 bp, Bos taurus
gctacctttgagcctgagttggaaatggagccaagggggaatctgagatgtaattcgggaatacactaatgatttccaataaactggtaaaatataaagaygacaatttcacagtctccactcaattctgaagctctggacattggctagaccctgtgttttctttggtcatattattcttttttaaattgtagtataatt

SEQ ID NO: 37124 - DNA, 201 bp, Bos taurus
ctatggggtcgcacagagtcagacacgactgaagcgacttagcagcagcagcagcagcagttcattgggatcaatattaggggtttgctgggagacagtgrcttcactaacacctcaatatgctttgagaatgttactttttattactgatatgatgagttggctatgaatagatttgtaattctgacactaaggaataga

SEQ ID NO: 37125 - DNA, 201 bp, Bos taurus
tttccattggatccttcatcattatggacaattatctaaatcacaatctccaccctttagagtggatactatataaatgctatgattagtactttgttatytagatgcacatatttcccaactctaaaaatcttctatcatcagaataatggagacacaatcgagtaaataaaaccaacctttgtaatcttctgaccagaa

SEQ ID NO: 37126 - DNA, 201 bp, Bos taurus
atttatatgaccctgacttatatttgtttacccatttctctctcccactggccaatgaactctacggaaatatggattctttgtttgtaatggccagaacmtagtacagtgtccagtgtagagtaaaaatttcctggaattttctctcttccttccttcctcattgacctccagcactggcaatttggccatgccttctat

SEQ ID NO: 37127 - DNA, 201 bp, Bos taurus
aatgtttccaaactcctaagacacttccctcctgtttttatctcaaccagcaagactaatgtatatgagcagaagagtacgtctctctcatgcacacagamctacttccctcagtgattcagatcctgacatggcagagtctctcaaagagctctgcttctccattcaagaagccccagttcacacaggaatcaggcaatg

SEQ ID NO: 37128 - DNA, 201 bp, Bos taurus
gtctgatgttgtagccacaaaatcccagtccctcccaaatgagtaaaccaggtctcggccaggacgcggctgatttataaagcgcatatggtgggcccttrctggctttcctgccaggaagggggcgaaccagctcccccccaaatccctgacccatctccccaagaacgggcctgccaggctagcagctcagccctggtg

SEQ ID NO: 37129 - DNA, 201 bp, Bos taurus
tgtcaccacagagcattgagtagagttccctgtgttgtacagtaggttctcattggttatctattttatacacagtatatacggcaatcccaatctcccarttcatctcaccccacttctctccccttggttttcatacatttgttctctaagtctgtgtctctatttctgctttgcaaataggttcatctgcaccatttt

SEQ ID NO: 37130 - DNA, 201 bp, Bos taurus
gcctctttcaaaagagctcactctacagtgttggacatgcccggtcccatctttcttcttataatatgcttcatctttgatttctgtgctggttggtatascttcttggtttcctattggcctatttctatcttaaaacatagagagctgcccagcgtctcctggcctcaatggaccggaagtagcaacagccttgttgat

SEQ ID NO: 37131 - DNA, 201 bp, Bos taurus
tcttcaaagtattttttccgatttgcaactcaaatggaatgagtagtcatttaaggggaattaaattgtgacttaacattggccttataatcaagatgggyagacattctttggacaggaaaccatggcagagaatggttattttctggagcgcagggcagctccagagctcaggagggcctgggcttcccacacagggaa

SEQ ID NO: 37132 - DNA, 201 bp, Bos taurus
aacaggtctctcatttcccgaccttcagaggggctgtctgttctttctgggtggacctttgtgactctgccttttctctctggacggcgccgctgcccctyaggccaagccgcaatcatggagccggctgatatggcgacagcaaaggtaggatggaaatgctgccggccgcactgtgcgtaagtggcttcgcttggcgag

SEQ ID NO: 37133 - DNA, 201 bp, Bos taurus
tgggtgaaaaatcgggctgagtgagatcaaaagaccttctgctttggagattcttggagtctgtggttatgtctctggcccctataagagagaggagaccytccctctcaatctggagaagtatctatagaataagagcagatggagattccctactggtctccaggatgaaatcagaaggccccgtgctcatccctaccc

SEQ ID NO: 37134 - DNA, 201 bp, Bos taurus
gctcctcgggggtcaaggtctgtgcagggtcctgcagctcactaggtgacccgggctctgctcctggaggcactgtctcctcggacaggacttcctggccrtgaacatggacagtcacctgggaacaattccaacttccagtcaccgctgagtcaggataaagtcctgggtgtcacagatctcacatcagaagaagctgcc

SEQ ID NO: 37135 - DNA, 201 bp, Bos taurus
ccagcctgggtagggattaacgaagtttttccagaaaggaaggtgcctaagccgagtcctagaggagtgcaataggaagagagttgggtgtggaggggaartgcattccagacaagaactcaatcaatgcttgcgaaacagagctggagcagagaatccagactgagttgaagctggagtcaggcttgtccaggcacttct

SEQ ID NO: 37136 - DNA, 201 bp, Bos taurus
gagaattacatgggcagaggagcctggcatgctgcagtccatggggccacaaagagtcagacacgactgagcgactgagcacacacaaacgatagctatcrtttatgaagtacttagagtgtgggcctgggtcagagctgtagggagtcagtagataccactgtttcttgctattcaggaccacttgtgagacagactcag

SEQ ID NO: 37137 - DNA, 201 bp, Bos taurus
tttcacttgtgaaaaacaactgtactttgcctcattttctcaagcttgggggacatctctgagtaactcccaaatacttttgatacttataagtcagttayacaacctcattaaatccttataacagccaactattcaataggtactattatccccatttcacagatgcagaaactgaggctcagagatgctaagcaacat

SEQ ID NO: 37138 - DNA, 201 bp, Bos taurus
tgagtagcagcagtgctgggccgagctgtgtgctccgaggcggctgggagcgggcaggcagaagaactcatcgcatggaggcagggagtggagaccaggcrtgagccaaggcttcaggcctccttcagaagtatcactcctctagaataatgctgaatatctagaatgtgtgtttttattctacaaacacagtctgaaatt

SEQ ID NO: 37139 - DNA, 201 bp, Bos taurus
taattttctgaatgccttttctctgagctacaagccttctttgctgtttttggtttggaagttttctggaatttagtagcttgtttctccaaattaggtayacctattgagattttgcagtttatatgaccttgtaacataatcactttctgaaaagggccttatggccacataggctggagaagttatggccctctttac

SEQ ID NO: 37140 - DNA, 201 bp, Bos taurus
ttttagctcaatggattttatgattaaagagatttttaagagcatactgttttacttataatttgttgaaaagtactaatttattttgggaccatgtattrtaaagttttcagtaccggagaaagttttaggtgtcagtgcaatgatttttctctgcatataatattcaagtgtcagtgaaatatgcaaaattgggaaaat

SEQ ID NO: 37141 - DNA, 201 bp, Bos taurus
ttccattttctggatgtaccacagtttattcactcatctgctgaaggacatattggttgcttccacattttagcagttatgaataaagctgttataaacayccatgttcaaggtatactgcagacatatgtcttcatatggtattgacatttaagtcaacaccaaggaatgcagttgctgggtcatatgtaaagagtatgt

SEQ ID NO: 37142 - DNA, 201 bp, Bos taurus
aaaaatcagctttcttctcttttgctcaagaggaaaatgaaatagctggtactcatggaatgagaagtattttgaatttggtggtatacagaggacactaytattttgagaattaagtcaccaaattatcttaaactgcttccaattcaaaacttccatttcttaagaggaaagccaaggaaatcagatctaggaatgtac

SEQ ID NO: 37143 - DNA, 201 bp, Bos taurus
gcagatgctcttagaaaaaatcttgagatcaagactgtcctcatcattggtctattctttgatgaatagaggagaaatttagcaggagaaataagaacatygtgatctcagcaatatataatataatctatgccaatttttttttgtccaattgttctcagaacaaattaaaggttttgttttatttttaggattttaaat

SEQ ID NO: 37144 - DNA, 201 bp, Bos taurus
actcacagccacccacattcagaggcgcccacaattcacgactgaggagctagaaggctgaaggtgagggtggggagagtaggtagagaggcccctccttrtttttctcatggagtcattttcctttctcagggaagttctgtcatggtttttaggtgaaggccaccgtcttgtttatccttcttccgttggcttcctcct

SEQ ID NO: 37145 - DNA, 201 bp, Bos taurus
tcctttcactgctcttggttaccttgctttttcctgaacaattggcttccagtaatacactttggggataccgaaagtcaagcctcaccagggccctggtrgtcactcagcatctgaaccccaaagtccagcatcagccttgtagggttgagacgtgccctgcaaagaccatgctggcccctgaagcagtgctctgtctac

SEQ ID NO: 37146 - DNA, 201 bp, Bos taurus
tagtccaaaaaaaataaaagaaaaaaccaaaaaagtgaagcccactactcaactgcatcaaactcagacctctactgggcctttgaaagcagattagttayggggctcattgggacagaggcatttggtcactgagaaataaaaccaatgacttcttggatccatgaggcccccttctgttctctccttccagcctgttct

SEQ ID NO: 37147 - DNA, 201 bp, Bos taurus
atgtattatccatcttcactgaaggaggtaaataattacatatattttcattgtataggctcaaggatgttttctgacaaaaataaaagtagtaactgacytcaaacttataaatacagaaatcagattggtagttgccagatgcaaggttttgggggcgggtgggaaaaataagggggtcaaaaggtaggaaagaaaaat

SEQ ID NO: 37148 - DNA, 201 bp, Bos taurus
caaacgtgcatacagcaactatggactatactgtccttgcaaattggtcacaactagaaaatgagtatgtagttagaggcagtgctactgtcctgtgcccygatgtggatctcaaaccattagtcctctctgaaaaatactatttttgccctcactctactagatcaacactgaggagcattctaccaagatgtcagctgg

SEQ ID NO: 37149 - DNA, 201 bp, Bos taurus
ccccttttgttgaatgtatctcggtcagtgcaaccagcccaacataagactttcaactagagcacaggacagcaaaccagagccccaggccacggggggcrcccaactcttactttggtaagtttttattggaacacagcccctcttatctatttacctattattgtctatggccgcctccaggggataaaggcagagttg

SEQ ID NO: 37150 - DNA, 201 bp, Bos taurus
gtctttgatttcattttcatgtatctgcatgtgtactttattttcctgccaggaagtcatgatgaaatggtgttggaaaattttgcgccctgacatcttcraatatttactcttctcctcttctggaattccagtctggtatatattgaaccaattgactcggtatttagtttttcttaacttcacttccatattgtcgat

SEQ ID NO: 37151 - DNA, 201 bp, Bos taurus
ggcagcgtgacccctcgaaaatacttctagggatgaaaacacaatccacacagatggcttgttagatagggagtgcttctgaatgttaactgcatcccacycccctccattagcaggggttggcagggggcagatggtggtagtggaagagcccaggccccaggcggccctcagccccatccacactccaagagtgggtag

SEQ ID NO: 37152 - DNA, 201 bp, Bos taurus
cgtaaaatcgcaactatgatacatttgaaggaagtatatgtaccgtgaagctttgtagaatgggatttgacctaatcatggaggccatggaagtgacagcygaactgaaaggtgagacataaaaggaattcagtatgtgaagacatgaaggaagactgttctaagaggaagaacagcaaatttaaaggcctgtggcaggag

SEQ ID NO: 37153 - DNA, 201 bp, Bos taurus
taatttgtctctggggtttttaaaaagaagtatgtatttatattcagattgatggtccagcatctttaaccctgactaaataggtttgggacaatctactraaattcctgtggtggacatatttcctgaaagcctctttgagatcaccactcctagaggctttacatggtaaatcattggctctatggaaatttcatcaaa

SEQ ID NO: 37154 - DNA, 201 bp, Bos taurus
ctgattggcagggacagtaagtgctggggctttgagagagagcctgttgtgggctggagcactgaggaagtctcccagggcaggtgggccagagccagcargtggctagaggggaagtaacagagtgtctaaaaagacagtgcacctgatcggtgtggggcagggggttgaggagatcactctttatatcaggggccatcc

SEQ ID NO: 37155 - DNA, 201 bp, Bos taurus
atgataacatgaaaacatcaaatctgcatggtgatgcatagtttgacattgctaattatctatggtatttccatctgagtcataggaaatgtgaggttaayttcattccctatgctgacttttcacaccacctaccttcaacctgaccacctaatgcttaatgggaatatgacaaggttagaaaaaacaaaaaaacatgtg

SEQ ID NO: 37156 - DNA, 201 bp, Bos taurus
caagcaaataggacaaactgctgacataagcgtggcactgacgtatctgtctatttgccttcagttgctaggattcactgtgtccatttttctctaagctstaaaacatgcaactctttgatgttatgaagagtccatggttaaacaaaaagttggcagaacatttaacataaaaagtatttcaaattcaaatctctaatt

SEQ ID NO: 37157 - DNA, 201 bp, Bos taurus
tggccatgccgttaactctctgtgtccttcagcaaactgcttaatctctcgggacctcagtttcctcatttgcaaaatgaaaggttgagtaaggaagtctytaagggcctttccagttctgaatcattgaatctgaagcaaatgccttctggagagaaagccagtaagagtcggaagtttccactggaatctctcctttta

SEQ ID NO: 37158 - DNA, 201 bp, Bos taurus
ggccagaggccatctaggagagaggacttgggactggaaagtgcaatgagggaaaggcaagccaacacaggtgaatcagacacgtgtttgtgtgcttgtgkgcacacatgtggccagcagaatagcaaggatagctgcttgtgtttgctgacatctggggcatgggtgcactgggaggctctcctaaaagtatctgaggta

SEQ ID NO: 37159 - DNA, 201 bp, Bos taurus
cgcagattttccaaaactataaattataaaattataaatttattgaggggccagaaatagaaaaataaattttctttaagctatgtctgtttctttcaagmcttgttttataaagtcaaggtggccctctttttgataacagctgtaacttctgagcccttgttttgtgccactcattgtgctagggaggtccttcatgtg

SEQ ID NO: 37160 - DNA, 201 bp, Bos taurus
tgcttactctgggcttaaacaagattgaggggggtagggagaagagacaaaagaaagtgaattaacatttgcggagtaatctaattaggagccaaagcctrtatgtcttaagatcttggtaaattctcaactcttcagatacattctgagatcctagcttcacctctcttcctctgttccctcagctcttccaattattct

SEQ ID NO: 37161 - DNA, 201 bp, Bos taurus
cacaaagagttggacacaactcagagactgaacaccacctctaatatagagtaggactcatatatcttaatgaaaggaagggcaaaggggaagaacacaartgcctgggagtctgtggcaacggggagaatattagtagagtataactacccttgtgagctatatagtcactgagtagccctcaaagagctagatttgttt

SEQ ID NO: 37162 - DNA, 201 bp, Bos taurus
tgtctcctgcattggcaggcagattctttaccattgcaccacctgggaagcccaaacttagtagtttaaaaaccttaaatttattatcttacagttctggraatcaagtctaaaatgcctgtcagcagggctattttcttctggaggttccagaggagaatctattttcttgccttttctagtttggggaggccatctgca

SEQ ID NO: 37163 - DNA, 201 bp, Bos taurus
caataaaagaagaaaatctagagattcacaaatatgtggaaattaaaccacacagtcttaaacaaccaatgggtcaaagaggaaatcaaaagaaaataatytgagatgaatgaaaacaaatcacaagataccaaaactttgagattcagcaaaagcagtccttaggggtaaatttatagatgtgaacatctataaaaagat

SEQ ID NO: 37164 - DNA, 201 bp, Bos taurus
aactattaccaaaaaacacatggaaaattcaacagttgctatatgctgtcatttaaaacatttttactcatctctaacagcagaaagtctgggggttggtragtaggagggaagaaagttgtttctgaaagatcaagagcttagtagctcaatatcccacaggagagcttgaagcaaaagagtaggtcaactcttaagata

SEQ ID NO: 37165 - DNA, 201 bp, Bos taurus
tgcgtgctcactgatggacttcccacaaaacccccagctccctgtaaggacccctgtgtggccacctctgcctccccacaacatacaaggagctggccctrgacacagcacctgctccaattctccatcatattctcaacttgaggtttactatggggaggaatgtggagttgctctggtctgttcctatggtggtggcct

SEQ ID NO: 37166 - DNA, 201 bp, Bos taurus
agatgtcacgtaaatgcagaatttgggcgatcggaaatgatcacccaggctctcaggagcctgaagatgagttgcgaggacagactgatcacacagaaccrgtggccctctcgggggtgccaagaggatattgcttagacaatggcctttctccttgtgagtttaacagcagccttatttagaaggtgaagaaatctagga

SEQ ID NO: 37167 - DNA, 201 bp, Bos taurus
cataagtattttatttaacagctgttatgttagccatcagtggcattattaatcgatggctacatgtttgtttcttccttgggaggctttgtgggccccayggcagctagaaaccaaggggcctgaggacgagtcccgtatgcctcccgctgagccttgcttcatctttctgcagaccacaatcctctatctctgaagtga

SEQ ID NO: 37168 - DNA, 201 bp, Bos taurus
tgactgaatttgtaagtcaaaggcagaagtccacaaacttttctgcaaagagctagataataatcttttccattttacggaccatatagtttcttttgcakctactcagtctaccgctgtagcacgaaaaccaccaccatagacaatatgtaaatgaatgaagcatagttatgctccaataaaacttgccatgggctgcat

SEQ ID NO: 37169 - DNA, 201 bp, Bos taurus
accagcacccagtcaaagcagatgcagttacccctgcttccccttttcaaccaccaactgaacccaacacctgccctctcccctagcctcagtctccaggmtagattccattctccaatctctcaagaagcccctctgaactattacagaaacaacatcttctctctcacacctgttctgctggttacactaggtcgcaag

SEQ ID NO: 37170 - DNA, 201 bp, Bos taurus
aagcaggcagatagtttcctacttctgttaatatcacaaggtcctggggaaggcctgcgatccgttggttccaagtgagaaaagcaggcagggaaactggrtgctgtcacaggctgaaagcagggccagcaagccaggggctggcggtaagcctgggagaatgttcagggcaggatcgggcagacatgtcagagaagaaag

SEQ ID NO: 37171 - DNA, 201 bp, Bos taurus
acaaggtgtcaaaggcatcacgttctgaaaaaaagagaaagcaaatagagcccagagctagtgccgccccaggccccaggccccagcctctacagaccagyggtcaactccaggtgagaattctctgggggataaattgtgctggaaacttgggaaactgcttaggcagaggtttggggtggactcttatcttgggggcct

SEQ ID NO: 37172 - DNA, 201 bp, Bos taurus
gtcttctactctgaggcatagcaaccatctcacagaggcccagagcagcccgtggtcccccagtggatcaccttggccctccctgcctccagctgccctgmgagcagaagtccggtcacctgatggtggtcacagccacaggtaaaggcagcaaatgccacggagaaagatgaaaggtgagggccaacatggccttggcaa

SEQ ID NO: 37173 - DNA, 201 bp, Bos taurus
ccactggctgttgtataaaatccactttttgttgcacttcacaatccaatcaagaaaatgttcattgctgttgcacagaataaggtgacaacttaaacagmgattttttaaattttctgtcagctcatgaggtcagctcacttatcaagttttttcacctttccaatttgcttcaaatacctaacgaacatgctgagttct

SEQ ID NO: 37174 - DNA, 201 bp, Bos taurus
cccttgccttaaatcactaccctataagtgatcagtaaatgttaattgattgaatgaatgaataagtcgtaagaggcctttgttatttactcacgcttagkgaacaggatccagctttggtggtggtggaatgctttcaatgtttctaagaataccatctcattcccatcttgaaacattggccagtcttgatatttatag

SEQ ID NO: 37175 - DNA, 201 bp, Bos taurus
gggccatttgctactcagctctagctaactgtgggtcatgggttgccataaccttagattttcaacaatctgaaagtccacattttcaggtgaaatgtgayatttaagcattggtagataatctgaattttatagaaccagtgtgggtcacattatgcagtttcagcagaacatgcatgttgtgtaccgcttaaaaaaaaa

SEQ ID NO: 37176 - DNA, 201 bp, Bos taurus
atttatagctagtagttggggaactgagtgtaaatctggggatgcctttggcattgtatatctgaacaatgtcatcatttgtttccagaaaaaaaaaagtyaagcattctactacttgtctacaagatagggtacatatttttcagttttacttatcctatcaacctcattctctgccctccttgcttttcatccacttat

SEQ ID NO: 37177 - DNA, 201 bp, Bos taurus
acttggcaccaacacaagcccacaatgtgaggttatgatggggagctgcacagcataccaccatgctgtaaagctaagattgtaatatggcaacctgatcrccccactgtacctcccatgatagcatcacacatgtattataatatttcaacactctgacaataaccagcatattataaaaccctgacctcacagctttca

SEQ ID NO: 37178 - DNA, 201 bp, Bos taurus
agtaggagggtctagagcacttttctttgagaagtaaggagctttataagggtagttttgtcaaactcagttcttggcctggggcaggccagttggcagtycagaagacttaactctccaaggaaataaaaactctactaagaagcccaacgtgttagtcctgagggccagacatctttcagagattacacctgtgtacgc

SEQ ID NO: 37179 - DNA, 201 bp, Bos taurus
cattccctccggtagctccactcccaggcccagggagtggctggggcagagcaaacagattcgcgcgggctaggtctggagtcaggctgagccgggagatygcgctccaggccagggctggggtcaagggaaggatggggtaccgagcactctccccaggcgaccctgtccgatgagctgtcagaggcagcagatagagag

SEQ ID NO: 37180 - DNA, 201 bp, Bos taurus
taatacagaacgttgagacatcataaaggttttcacatctttcatgtgataaatatttttaccgtcatgcttgagaaatggattttgtttgaaacggcctrtttcctttgatggcttctttgacatggattcaaagcctttcctggtcctgcaagagcctggggttgggagggcctgtttgttaacttttttcgaaggaca

SEQ ID NO: 37181 - DNA, 201 bp, Bos taurus
gcttaatgggggatggatgacacagaatcaaagaggactttatcaaaagtcaccacccaccctcattcagaggccagctttgggggcccacagaagagccrtgtctgactccagggctttctggaactttatgcaggtctcactaatggatcagtgggccgtgggaggagtctggggtatatttgcatacacacctcccac

SEQ ID NO: 37182 - DNA, 201 bp, Bos taurus
gtcctatttatgccaaacttggtccatggtgagccctcaggttctgctccttttctggtaggtcttcctccttgcttggccttcctgaagggagaaggtgytgtcccaggatcccttaagcccttgcccttcctcaagggatgctgctgtcttcagcctgggttttgccaccacctgctctacctcctgcaggccagagcc

SEQ ID NO: 37183 - DNA, 201 bp, Bos taurus
tttcaagaaaatatcctgaagctgaatgacgtaagtttcacaataaacaggcccattgagttcccagcacaattgataaaaatagtcactccaaggcatakaagggaaatttcagaaccccgtggccaaacaaaatactctaaaagttttcagagaagggtttaaaaaaaagattaccataatgcataaaatatgattgac

SEQ ID NO: 37184 - DNA, 201 bp, Bos taurus
gcccagaaacacagtcatgaaaactcagccatttgaaggctaaattttgagcaggagtgactgacagctctgagtgagtgaggcctgtgtagagctgtgcrggtcatgaactggagtacaaagcagaagtgggctggcaggacactcacaatcgggacaaggcaggcagcaggggacttgggtggtgcttaagtcgccagt

SEQ ID NO: 37185 - DNA, 201 bp, Bos taurus
agggaaggaggacattcacacaggccaatctcaccacctcttctcccagcccccacacacagcctccctctctaatggcatcaaagccacgacgggctgcycccactgacgagggccctaagcctcagtgtcagggacatgcagagcagggattcattatcttggaccctgcgctggttcccgagagaggctgtaacaaag

SEQ ID NO: 37186 - DNA, 201 bp, Bos taurus
ctttgctaaaatagcaataagactgactttcacccacggacgctcaatgcctccagaagaactggctgctcattttctgagctctgggcctgttgacaackctctactgaaacaaattgaaatttctatcatcaattcacttcgaaatgtcataaagccgcttaggcctcggctggctgagcagtaaagcaggccctcttg

SEQ ID NO: 37187 - DNA, 201 bp, Bos taurus
ataaggagactgtttgtgggcctcaatagcctctgcagtgccagagtctatcaggagaaggacccatgaggaacccaggtgagctggagccaggatgcccrgatcctgtgagaggcccattagcgcaggatttcagaacatggactctggagtaaggccaacctgggctgaagtcatagctcttccatatgctggtcaaga

SEQ ID NO: 37188 - DNA, 201 bp, Bos taurus
gtctgatttctttcactcagaataattattttgagatttatccatgtttttaagattcacccatgttttcctatttgggcctgttacaaataatgctgcartgaatattcatgtataagtctttacgggtaaatacctaggagtggaacggctggatcatatggtcggtatgtgtaactctttttaaaatggccaagtgtt

SEQ ID NO: 37189 - DNA, 201 bp, Bos taurus
aggcacagaggaagagctgaatcagcaatacctgatggcatgcaaaccaatcaacaccaggacttgaatccattcaacatctgagaactctgaagggcccmaactggaaccatctccaatgggctacaggaacagagagcggggttctgggctcagagaccacatggaaactacaggccactcgatgtgccagcctgcagc

SEQ ID NO: 37190 - DNA, 201 bp, Bos taurus
cacgactgagcatctaagcacagcacacaactactccaaactagctatcaataccctagaaggtgagggctgacagaggctctatggctgcctggctctayggctgccactgatgcttcagtcaggggaggaatttctcctatgggagttccagttgcagccaatttctccctaaagtggccaaatgttggttaccacatc

SEQ ID NO: 37191 - DNA, 201 bp, Bos taurus
tccctaggagtcattcaggagttagctctctggcttggcttggggactctgctctctagtctcagggaaagctatctccaccaaaggccattttatggctygctagtttgagccaggaccaaggagaaagaagcacctcctccctgccctgccctggccttctctacattctgtcctaagaagcaacctccaggtaaagga

SEQ ID NO: 37192 - DNA, 201 bp, Bos taurus
tggtacaacagctaaaggttgcaagtcaagtaagcagtaaaatcaaggttagagaagttttcaatgatccaaacgttgttggactaagaataaagggtgtrgactgttgccccagaaagaggtttagagccatcaggtgacatcaggacaccagccattaggttgagcaacatttgggtactggatttagaatgacttgga

SEQ ID NO: 37193 - DNA, 201 bp, Bos taurus
tttcatctggacagtgtgtcttatctcaattaaagtcaaagttctgatgttagatttcatttttctgctcccctcactccatgacattagctttgttcttycacatattaatctggtccttcggactttcctatacaggtaggttttgcttaccttgaccttcatacactacggagtgttctcttggaacctataggaagc

SEQ ID NO: 37194 - DNA, 201 bp, Bos taurus
aaatggaaatattaattttgggggtcatatttatattagtgttactgttagaaactgtggtttcctgtactttttaagaatagctaccttaaaaagttatmtgttctcattttcttttgcacccttcttgttgttttgtgcttcccactttttgttccttgtatgaataccaccttatggttaccacgggagctctgaacg

SEQ ID NO: 37195 - DNA, 201 bp, Bos taurus
ggagcgtggcagtagaatttctgtacttctctcatgcccttaacagctggattactggaactgctgccttaaccaccaccagatataatgtgacccaaccrgtccatgtatttagccttagtttttacaagaatgggtcaggtttgtaggatgatgagaaggacagaaatatataggaaaatcacagattaagaaacaatc

SEQ ID NO: 37196 - DNA, 201 bp, Bos taurus
attttgtttctttttcttttattattatctgggaagaatttatagtatgatgctaaataaaagtgatagcacttttcttttaaagtttcattgttgcactwtttatttgctaaaaggtatttgataaatgtctatatcagattaaggacttccctgaaggtccagtggttgagagtccacattcccaatgcaaggtgtcac

SEQ ID NO: 37197 - DNA, 201 bp, Bos taurus
ttcaggatcccctttgtgagacggaggtgtgctaagtattacagggctgtacggcactaacttaactaaccccacccacttctctcattccgtttcaactratcctttcctctcttagcggaacgctcttctgctcactaaactctatcagcttctgttttccacaactgtccacagtcttctgcattagaaagaatcgca

SEQ ID NO: 37198 - DNA, 201 bp, Bos taurus
acagtatcttttctttttttatattggcctcagactcatggcttttttatgcaagggaatccccactagcggttacattctaatcttgtgtcctttctttkctattctcaaatgtacctggaaagctgtatttacatctcagggttaaactctatgtaatttgtttgggtctctttctatgcataatgaggccataattat

SEQ ID NO: 37199 - DNA, 201 bp, Bos taurus
actagggaaggaagagtcaagctgcagatgggaaccgccctgcaagcaggcctgtccagatggggggccatctaaaaggccttggcttgacacccaccaayggacctaagcatggtgcttccccatcctcaagtggggctgtgccttctgcacatctggcccaagacatcccagataggtggttcccaggggcctgcctca

SEQ ID NO: 37200 - DNA, 201 bp, Bos taurus
cctacctgacagactattaaacttcctttaccaaatctacttcctcccccagctacagaaacatacccatggttctgtcctcggccctcgcttctcccacyaccgtctctttcttcctgacctaaccgactcccacggcttccctgtctctgtctccagccctggcctctcacggctctgaacgtactcttccagttgaaa

SEQ ID NO: 37201 - DNA, 201 bp, Bos taurus
atgaggtcgcaaagagtcggacacgactgagcaactgaacaacaacaagcctctggggcaaggcatacatgtagttctgtggtaaaggcattaacttctcrgggaaggccgcctgcatcagcaatgtgagagatagctgtgggttctattctgacctcaccggttccggtttgtccttatgaattctagtttgccctcact

SEQ ID NO: 37202 - DNA, 201 bp, Bos taurus
cccgaaggggatagttactacctgatagccgggtacaggcccagctcttagaggcactagagacgtgggactggggaaacctgagactccaggagacctgracagaaggaggccggtcaaaagggccccaaatcttcctgcagagacagagctacacatagcgcccgccacccgcccccaacacacccccaacacacacac

SEQ ID NO: 37203 - DNA, 201 bp, Bos taurus
gaccatgggagcagaacgttgtaaacagaggctatggcaggggcatagcaatgggatagcatgatttgtagtagctggtagttaggatctttggttgcaamaatcacattatcttaagtgatagacttctccaaggcaacgtggaagaataaagaagacaggaatctcagtcacataggactaagaccttgtgggggatta

SEQ ID NO: 37204 - DNA, 201 bp, Bos taurus
tgattaaagtgttttcaaagtaaccagctttttttctgtagagatttgtggtttgagataagaagagtacttagctatttcggtagtcaaatctctttggmcttaagcaatgtttttttttccctaggaatatttcttgattcagagcggaggaagtctgatgccagctccgtcatgtctcccctgaaaatctccctcatt

SEQ ID NO: 37205 - DNA, 201 bp, Bos taurus
cacttgatgctcagggataagcatttcatctaaaccagggcccagtcacatgccaggagctgcttctcaaaaggtgtgtaattctctgctatagatgacakgactttgctccagactctcaggggccaactttatgattcttttgctgggttttgcagtgagctctagattgcatctttccccatcattgccacttccaac

SEQ ID NO: 37206 - DNA, 201 bp, Bos taurus
ctttgagctggtcttcatgcaggcctctcatctggaagtgggaccatggaccctatctctctgctctgagcccttgaagcaacatcttctgatgtctcatratcttacggccaagtcgactatagcccaagtcagacttggtgtcactctgcgccctctaatcatcagatgcatttagcaatctttgagaatgcagattct

SEQ ID NO: 37207 - DNA, 201 bp, Bos taurus
agaaggtttttaaaaaaacaaaaaactagagacacaacagcatgtctgttgtgctgatgtgaaagactagcagagagagaaaaatcgtaatgtaggaaagraagggcagaatgacgggaataacgcccttgatttgctgagagaagagggagctggtgagcaaagtggagggaggagccttggctggatgctctgagggtt

SEQ ID NO: 37208 - DNA, 201 bp, Bos taurus
ggcctcacaggccagactgagctgccttgaggaaagtcttcagtagctggtgctgcttctggagccatgtgctcattcctcaagctgcacccctctgttgrctgtgtagggtaagttcctgctaggcctcttctagaagtggccatcggatccaaggtggttgggggcgtgagggaggaccattataaggggaagtgtcac

SEQ ID NO: 37209 - DNA, 201 bp, Bos taurus
gagaaattagtgttggcagtcactaattagtgtcactagctggtgtggctaatttgtgtcaaggtgggaagtgctcacttaaagctgtttgcagcagtccktcctttctggcagctctctcagagtgaggacctcatgttccgctctacctcgtctgtcttttgtgcctagtggagcccctattcttcagtgaggatactc

SEQ ID NO: 37210 - DNA, 201 bp, Bos taurus
agcccgtgggctgttcggttcttaaagctgaggggccttgagtcaggaattcagagataacagacacctgcctctgcttgaggccctccaccctggcctcygagtcctcattaaagaaatcagacagacaggattgagcgcttggtctgcaagtctgcccatgacactccttggctctggggttaaaactcccacctctca

SEQ ID NO: 37211 - DNA, 201 bp, Bos taurus
gccggactctcaggtggtggcttccccggctttcagcaggcaggactcaggccagctctctggttccatgggcagattcagttcaccctgagcaagtctgraatggttgaagggaaggggaagggccgaggccagactccatggggctctcctgaggggtacaccgcaccagcctcctctgagcctggcttttgcctgtct

SEQ ID NO: 37212 - DNA, 201 bp, Bos taurus
ttcctcacacacgctgagagatcttccctgcctcaggacctttgtacttgctctttgttctgcctggtgggattttccttctcatcctgcaggtctcagcycctcagagaaggcctaccctgactgcctgatctaaaccagctccaaaacaggaggtaggtttctgtctacttcctgttttgtttccttcaaaggtcttat

SEQ ID NO: 37213 - DNA, 201 bp, Bos taurus
gccatggccagggtcacaatcccagcccccacctcctcctctctccatcccagccttcccaatcacagagcaaacactgaggctgtaggccatgtactcayagaacaccagaactatgagtgcttcagtaaccagtccacctccttctactacaggggaaataggcccagagaaccaagggactagcccagaaacagaatg

SEQ ID NO: 37214 - DNA, 201 bp, Bos taurus
ctccccttgaggcccacgcatgtgagcatctgtagtgaggttcacccttaataggtgatctgggaaagaaactcctatggattctgggagtaagctagagrctgtttgggccaggaatttgaaggtcttgttacttggatggtcttaaaggagtggataggatggactctgggtggacacatccctgtggccttgtccagt

SEQ ID NO: 37215 - DNA, 201 bp, Bos taurus
tttgcttgcttacattttattcctcccaattaatacatagtctcctcgaaatggtgtttattcctgtatcacaaataactagtgtttgggactaatatgtrctggagaaaacctgttactagaatttatacatgacttgtataatgcatatgccaggtggaatatacttcccaattcctttgtacaatatttatggagctt

SEQ ID NO: 37216 - DNA, 201 bp, Bos taurus
tcttggagaagagttttggatgaaaaagaaaagaattgctttattactttgccaggcaaaaggggacatagtggactcatggcctcaaaactgtgtatccmgaccaagggggattttttaaggagttttatggcactgtttcaagggtgaagttgttgataggaattaaaatgtgtgcagggcttgcattcctttaatctg

SEQ ID NO: 37217 - DNA, 201 bp, Bos taurus
gtgatcaatttctttgctccagtaagtggcctaatagggattccaagccaggactgtctgaaatcagaacttggtgctcctaaccactatactatactgcytctgcatgtgctcttggcccaaaaaagaaatatcatagcagaagcagatgtggggagggtgtgaggggtacagatgaattaagtttatatcaggtaactt

SEQ ID NO: 37218 - DNA, 201 bp, Bos taurus
gacaagggcatcagctaatcggtcccacctggtccaacccgtccagttcaggggcatcaagtgtgctgaggccccgggtgccactgtaggccctgtgaccrtcaccaacactgttgctgggctccattgggcaaatgtagtccgtcgattcatcaaacttcttttttcttatgtttccaaaatgtgaaaatcccagcttcc

SEQ ID NO: 37219 - DNA, 201 bp, Bos taurus
cccttcctgtatgccaattttcacagaataggccagaaatgacaggtgctctcttatgctcagagaggtgtctgttccaaagctgggaagtctacaacagygcagaggccctgcatctgaccatcagaaaaagtatggtacttccatgaccactgagactggagttgtgtggcaagaggtttgggacaaagtcatgcagac

SEQ ID NO: 37220 - DNA, 201 bp, Bos taurus
aacaaatcaatgaagtgaagaaaaaaaatccttggatgcaaaattgtgtagttgtatatttggcctgagcttaattttttaaaatagggggacaggagaartaaaaagattggaagaaaaagccaacgtgttaaattctttttgatgtcccaaagtttctaaaataatcgtatattctatcaatacttccattcataaaat

SEQ ID NO: 37221 - DNA, 201 bp, Bos taurus
gatctcatttctattacgctccctctcagccccattattctcccacactgcttacctcactccttgtacaggcttcctacaggcctcagtgttggctgttmctcagcctgtatttctacatggcttgctccctaatctctttcaagtgtttgctcaaatgttttaatgctcctcaaggcctaccattacctatattaaaat

SEQ ID NO: 37222 - DNA, 201 bp, Bos taurus
aagcgaatcaccacctgctcacccatcagcaggctctgacatagagtggttggtcattctttattttttcattcttttctcctcactctcaggcctgacasttacattcttggtgatgtctgtttcacaggcagaatcttcccagccccgagtattcaaataccagcatagctttcaagtaagcccgctgtttgtctgagg

SEQ ID NO: 37223 - DNA, 201 bp, Bos taurus
gctaaaagaatgtgatgggggagcacagcccaggggtcatcatcagtacttggtggtgatcaagtactacatcctcagtacttcagctgagggctgggtcrtgcctgttcttcttgttgttccctcattactctgtacatgtacagtgtgtgcactgtgtggcatacatgtgtattataaaaatgaaaccttggtaaatct

SEQ ID NO: 37224 - DNA, 201 bp, Bos taurus
aaatagttctcaaaaacaagttaataacagtataacgaaataccatggggcagcaaacaaacagatctatgaaggtcatttcaactgcaaagagtacaagytggcacatgcagcactcaccagccgagacagtgaaattctaagaaaaatgaattaccatactaacatttattgagggtatactgcatatttactatgttc

SEQ ID NO: 37225 - DNA, 201 bp, Bos taurus
caaggagtgataggccaaaagaagacaggagttaaaacaaaagaacaggattttgcaaacagtattgcattagacaaaagtatgtacaggcattcttttayattctaaagtagcctatagagtggggcaccatcaatacagccttaagaactgacttgagctctgagtacaactcatggaagcgagtgtaaagagatctgc

SEQ ID NO: 37226 - DNA, 201 bp, Bos taurus
gtttctccaaagacatacagatggccaacaggcacctgaaaagatactcagcatggctaattgttagagaaacgcaaatcaaaactacaaggaggtaccayctgacaacagaagaatggccatcatttaaaactctacaaataatagatgctggagagagtgtgaagaaaagagaaccctcctaccttgttggtgggaatg

SEQ ID NO: 37227 - DNA, 201 bp, Bos taurus
gtccatgaagctaagagaagacctaattatctcaatgccaaaagaccctctccaagacatattatagtaaaactgtcaaaagtcaatgacaaagacataayatttaaggcatcctggggataaagaactgatacagaacaaccaggaaacaaaatggcagtataattcctcattcatcaatcatcaccctgaatgtaaatg

SEQ ID NO: 37228 - DNA, 201 bp, Bos taurus
tgattaggaaccagatcttttgactgcagagccaaaatcatttcccttcatactacatctaaactgtctttctgccatgagtctggaatgagaccatcttratgaaaccttttccatgctcctaatagaaagtttctcacaatggagtttctagagcattttgtatctctcatagctcatgtcacattctaccctcactgt

SEQ ID NO: 37229 - DNA, 201 bp, Bos taurus
ccacttcctccgccaccaacacacactgccacgggaaggcctggactaagtccagccagtgctggacatacatcttcacgggcaactggctttcctggggmaactggttttcctgcttgaaggccttgtctagggacgggcccagagcaagacgggcagccacgcagtcctgcagattgtgcaccagtgccaaacgcagac

SEQ ID NO: 37230 - DNA, 201 bp, Bos taurus
gtctggttccctgaccagggatcaaacctgggccccttgcattgggagcgtggtcttagtcactgaaccaccagagaagtcctgaaaactccctgcttttraaatgcagttaggcctggcctatccatataatctccttttcttacagtcaagtatgtcatataatacaacctaatcagagaagcaaaacctgtcatattc

SEQ ID NO: 37231 - DNA, 201 bp, Bos taurus
aaaggagccagatcacatgggtctgggaattccctggtggtccagtggttaggactcttatgtgttcactgctgagggcccagggttctgtccttggtcgragaactaagatcctgcaagctgtgcatggaccaaccaaaaaagaaaaaagattatatcatgggcctggtaaggattttcaactgtaaaaggaagccagga

SEQ ID NO: 37232 - DNA, 201 bp, Bos taurus
tgtccaacaaagtgaagtaggaattccttttggaggaagtttgtagcctttgttcttgggtaagtttctaggggtaactcttaggatggcctgtctcagayggtggactgactgcctgcaggtctgatgtgctgcccagcagctacttccctggtggggtgagctcacagtttctgatgttgtttcaggcccagtgctgtc

SEQ ID NO: 37233 - DNA, 201 bp, Bos taurus
gagcactgaggctcagtcagtccatgcctcatagatgccccaccatctgctacatcattcctgttccttaagttcagggtctgtcttgtcaagttctcacrattcctggttgctttatatacacatttatttattttaaatgtactcatatagatatttatttattcaccaaacattactgggcaccaattaaattctggc

SEQ ID NO: 37234 - DNA, 201 bp, Bos taurus
ctgccctcagggagtctagagaatgaggaaatagtttgaggtggggggagagtggatatgaatggagtaagaaattggggaatcaggacagtaaattggcyatgtccccatgggtttaagcggcacatgcagtgaactgaaaggcaggtcttatctgttgattcatctcaagagctctagttgaaggtgaaaagatagagc

SEQ ID NO: 37235 - DNA, 201 bp, Bos taurus
ggccccctggcagcagtagctagtgatagaactacatacaagtgggactggagttgaactcaaaggggacaggggtgtttccagtatgcagtcagaaccaygacatcaggcctgacactggtgtgctggtttgcattcccataacagtcctccttaatcataagctctacctggattccaagctccctcaaagacattatt

SEQ ID NO: 37236 - DNA, 201 bp, Bos taurus
tatatatcaggacatagtgattatggaaaattctaatattttgatatgtcaaggtcaataacatatttcaatatttaggttaatttcacacagagtgcacytcataatttctatagagacattgaaggattattatgcagctactcccatcacaaatgaatccttctataagacaaccccaaattgctgcaaaagatgaaa

SEQ ID NO: 37237 - DNA, 201 bp, Bos taurus
gaaagaataactttctatggttcttactaccaattcaaagttactttattgtttcctgatcttttcctaggaagactcaagacctataggtccatgaacargccatataatagcattctaggaaactaattttctatatatgtagcaggtataaatgagctgttcttccaaacctctcagataatacatggtactgacttg

SEQ ID NO: 37238 - DNA, 201 bp, Bos taurus
cctgaactccttttagggagtgttaaagttcagcagctgcagtggctctaattggatctttgtagaggtagaacgcaagtgccaatttataggtgacagtrtattgtattgctttttaactttatcggtctatgctctctcttctccaaactttattgtatcaaagaatatcctatagtaatcttttctctacagctattc

SEQ ID NO: 37239 - DNA, 201 bp, Bos taurus
attcattaaactacacttcaacattcccattaaataaacagagttaatagaagggagaatagaggtgggatgaggagggatgtggctccaaatgcagcaargagcttgtgcgtgtaagtgatttaaacattactcatttattcagtacaaattaagtgttttatagaaattcaactagaataagcagattaaactatgaat

SEQ ID NO: 37240 - DNA, 201 bp, Bos taurus
tggtacaggctggccactgcgctgctctctccagtcctggacctagggctcataggtgcttcctacgccttcatcctccacatggtctgtcacctgccctyccacagcacccggcacaaggccctgggcacctgcggggcccatgccagtgtcatcaccctcttctacacacccgctctcttcttcctggctcacagtttt

SEQ ID NO: 37241 - DNA, 201 bp, Bos taurus
agtcattatgctcatatttcatatccaatggctcagtctgaatgccctctgtactaacactcattgggattcttggcctggagtcagcgcactgttagatyggggttcattctgtgttatgtaccttgtggctgtgattgggaatttcctaattacagtgataatcaaatataaaaacagactctctctctctctctctct

SEQ ID NO: 37242 - DNA, 201 bp, Bos taurus
ctatagtataaaacattcacccttcactatctgaaacgtcagaacattttatcctttatggcttctctgtgtattatcagagattatccctggtaagtcaytggggatagagattctgcattgattatgagaaactggagggttggcttcaaaaagaatgtgtatgccatgtcatccaatatagttccaggatgaaaaaaa

SEQ ID NO: 37243 - DNA, 201 bp, Bos taurus
tgagcccctcttttgtactgactgctgcagccaccatcatgcaagtgtcagggcaagagttgttgtctttcaccattgatgctgctgcttctgcctaagtygcttcagtctacttggtatgattaaagagtgaaacaggtttttctttctattaccataactctgtagggataaggctgcaagttgttataagacaatcaa

SEQ ID NO: 37244 - DNA, 201 bp, Bos taurus
gcttctgattccaaaaccagttgcagtctcattgctaatatagtgctgagatttaccttgaaatagcaccgaagtctattgttgttttggatagagagaaraactgcttggaatttccattaggaacaaagaagacagagttctttaaatttgttggactgcattattattccaatatattaaatataatttctttcattt

SEQ ID NO: 37245 - DNA, 201 bp, Bos taurus
agacaaaagccaccagagagcctcctctggtccactaagagctagcgataccagcagaagcagcgcattgcactttcaatctggccaaatcctgcaattcsctatctgtgtcctcagaaacctcatggacatcagcagtgtttttatccctatagatttgaggcacagccatgacaaagactcactttcaggttgctggcc

SEQ ID NO: 37246 - DNA, 201 bp, Bos taurus
cccatatcctggaggaccactgattcccctgccacctacactgttaaatccagtgggatttgatgctgggtataatccagctgatattcaatgaccacacktcttagcacctgctctcatgcaagatggctgtctagattactctgagtttctaatttgggtgagttgatagacatacaggacagtaaaagagagaaggtg

SEQ ID NO: 37247 - DNA, 201 bp, Bos taurus
gaaaaagtgagataaatgacaaaaacttagagaaagacaatacaggaaattgtgaaggtatttgcatatgcacacatgtatcacttatccaaatatttaaraatgaagttttaataaaatatttgttggagtacagctctgaatctatgtaaattatcatcttgttacattttggggtgataccttctatattcaattaac

SEQ ID NO: 37248 - DNA, 201 bp, Bos taurus
cctgaggaaccttactggtccccatatcaaaagaacagacaaagccaatggattgtctaaacttagttttactacttttcttgacccataaagaatatcayggatattttatatcccttcccaatcatacatacaagcactgacatatttgagttaggatggtctttgaaaaatcattagaccttaaaattattcatgaag

SEQ ID NO: 37249 - DNA, 201 bp, Bos taurus
gacagaggagcctgagaggctacaatcctctcagggttgcaaagagttggacatgactgagcgactaggcacacacaccaatgaaactgcagtgaaatccragtatagcaagaaaattgcaattcctctaaaggctttagtttgtttatagatatgcgatccatataggaagaaattgttattaaatcttatcctatcagt

SEQ ID NO: 37250 - DNA, 201 bp, Bos taurus
aaactatggctgaagaaacttacaaaaacatccagcctgattaaagatctggctatctcaaagtgagcccctaacccagcccaggtttccatcatcccccytgcacgcatgggatatgggcccaggacaagagcttttccataaaagtctattctgtttatagactctgatccacagaaaaattcagcgggtcactagggg

SEQ ID NO: 37251 - DNA, 201 bp, Bos taurus
tcacaggtttggtattgacatgacaatcaaaaaaaaaacaaacaaacaagtcttaaataagaaagtgctttgaaaagtgtgaagcaccaattaatctgacrggtcattataatatgattatcacaagctagctggagagaagattaatgtccatgaaacaattagaaggtgaaacagtatagttaattaggcaccaaatga

SEQ ID NO: 37252 - DNA, 201 bp, Bos taurus
tggcttctccaaggggaaatttgcaaccccaggggagggtgagtgggtcgggagtttgtgagcttattaaaactgtatctgagaattaaggtcatttaatrgagtgaaaccgtactttttgttttcccacgtgtcccacataaagttagacgagaaacagggtgaggtttctggattacttattttagccataaggacctt

SEQ ID NO: 37253 - DNA, 201 bp, Bos taurus
caagtccccggggtgagtttaactttcttggcccttctcagacacagcaggtggcaggcacatctcttaaatcctggattctggacccccaggtccttggmcactctgaaagaggaaccctgccactccaaaagctcatgctgccagaaagctcttccctgagctgctgactgatgggagcatccaaaacacagagctagg

SEQ ID NO: 37254 - DNA, 201 bp, Bos taurus
tgaggcgagctgatttgcattttttaaaaagatctttctggctgctttgagaagaatggattgtaggggagcactcgaggagggcagttaagaggctgttrgcagtagtctgagtgagaaatgatagttttggagttgggggcgagggggagtgtgagtagggtggcagagatggcgagatgaaattagaatgctttgaag

SEQ ID NO: 37255 - DNA, 201 bp, Bos taurus
caggtctggtccttcacacctgctccgtggatcaccagccctggtctctccaccccttgaagccacatgtgtgaccctgacttctgtagctctgttgttgytccagccagtgctgggtgtacctactcttccctggaaagcaccctctcctctctgtagggccagtgctctagcttgtgctccaagcgtgtctgagaggtt

SEQ ID NO: 37256 - DNA, 201 bp, Bos taurus
cagcccttttggctaaatgcagtttcattttcagaagtgactaccctcatttggaagttagaaagctgacttttcaatcgaggctacagatgaagatactrattaaaaggcctcctgttattcagatcccacatctccagctttcaatcaactttccagagggcagggcagacttgagaatccccctgcaaagcacagaag

SEQ ID NO: 37257 - DNA, 201 bp, Bos taurus
caacaagagaagccaccacaatgagaagcccatgcaacaaggagtaaccctcgatcaccgcaactagagagcccccacatgcaacaacaaatacccagcayggccaaaaaagctggagccaaattaaaaaaaaaaaaaatcctggctctaggactttaataactgcaagcttccccatctgtaaaatgggagtaagaatac

SEQ ID NO: 37258 - DNA, 201 bp, Bos taurus
aatgtcttcaccattgattctgatacctctgcatcacagaggagattgtattataaacctgataggttgttgggcttttggtttttttaatgcaagtgccrgacttaagctttgattgcctatacatctacttcaaagatggctatctttttcggggggtgggaagaggggagcaaataatttttaattttctttctttct

SEQ ID NO: 37259 - DNA, 201 bp, Bos taurus
tgcagactgcatgagggagctgtctatcccatgttcacttagctaggaccacagtatagatggggctgaggcagactccatggccatctgggtacagcccracccaaggatccctccccttacagttctccactgtctatgttgttggtctcctgcaagaggccctgcagagttaagcttgcttggtcatttggtgcttct

SEQ ID NO: 37260 - DNA, 201 bp, Bos taurus
gccaaaggaagcaccgttgtgcagcaagcagccaggctgagaacaggctagggatcttgggaagaggctggaagcctccaagacaggctagacctccacgmtgtcaggcctcctaaggacctaagctgaagcatgggtccaaagtgctctacctgctcagcctctggccagccagcaaagaagagcttcccaaggaggctg

SEQ ID NO: 37261 - DNA, 201 bp, Bos taurus
gggggccaaaggagcccaagtgactcactgactacaaggaagtgagtttggttcccagctcagtgtgaggatttcctccaaggcatcaccaccagagcaarggccccaccccactcaggcctcctgcatgggagggcaaggcctggggttcgatactcacctgctgacttcttggacattgttggctcgagcagcttccat

SEQ ID NO: 37262 - DNA, 201 bp, Bos taurus
ggtgacttgaagttgaatccaaagaacatttaccatttcagaaatcctaggccctttctgaatgctaaatctactctgccttgctctctaaatggagcaayaaagcctggaagacagcacatctgtttaccacatggtttactgaatattttaagcccacaagtgatatctattgctccaaaaatgattcctttcaaaata

SEQ ID NO: 37263 - DNA, 201 bp, Bos taurus
ggaccagggcccttgtcactgatcactggtctagtggctaggatctggtgcttttactgctgtaacatggtctcaatctctggctgggaatccaaatcccrttccaagcctttgtaggctgaggccacacaagattaacaggaaggctatttgtacatccagatgagaccttcgaagacacaggaggaaaaaaagcaaggt

SEQ ID NO: 37264 - DNA, 201 bp, Bos taurus
aaacatgatctccaataaaactaggaaacatgaaatgtaagtggaagagaggcctgaggagagacaattaaattggagaaagagggtaaaatataaggcaygaggttacaaaactcaaaaagatgtggggagtacatttcttcaactgcacttactgaggtataaaatttaaaccacattcccaacaacaagaacaaggga

SEQ ID NO: 37265 - DNA, 201 bp, Bos taurus
gtcttttgagcatctttccatgtgcttatttccatcatataccttcttggtggaatatctgttcatatctattgtccatttttgattgggtggtttgtttycttattactgagttttcacagtaattttgttttttgctttggccttttatagttgttctggatagaactccttctatggatactgattttgatagcttct

SEQ ID NO: 37266 - DNA, 201 bp, Bos taurus
gggggtggggaatgaaaaccctaagggaaccatggacaggcccaggccccatctctggatcctggtcagactgcctggcccctttttgtggacattgagcyttgctgttcagtgggcaggtcaccctccttgagggtgggttcccgaccctgttgccttatactattttcagcccaagtaagagcaggattttccactcct

SEQ ID NO: 37267 - DNA, 201 bp, Bos taurus
ggcttacacacccactgtgttccctgcagagtgaggaacctaaaaaccctgaaccttggactaatttggtcactgccggttctcagtgctctcacggcccrctctgaactctctctctttgtttctccctcctgtctctagttttttctagtcctggctctggtgtctctcacagaggctgcagtcagtgggcagggagag

SEQ ID NO: 37268 - DNA, 201 bp, Bos taurus
aaccctgaacagcttccaaactataggtcctagttccaccctcacagaacatgtctgtttcccctgctccagcacaacaatccacagatatgatatcagtyattcttcctgaattttttcttgttcaaatccagactcaattctttcaactcttccccatcctaaccacccatctttggccagaattcccaatttataaat

SEQ ID NO: 37269 - DNA, 201 bp, Bos taurus
ctgggctaccataaggatcaaatgaggactattccttattgcactcaactctaatctaatgattaaccttgtctttctggaacacacagaaaactaggaartaagtttaaagaaagcctctttagaaccaaaataactgcctctcattcttcacactttattactgataccagtagagttcctggagcctcaatcttcctt

SEQ ID NO: 37270 - DNA, 201 bp, Bos taurus
ccagtggatctttccgacccaggaatcgaaccgggttctcctgcattgcaggaggattatttaccaactgagctatcagggaaaccgataatacatagtayggcagatcaaatagccgaattgtctgcaaattattggggcaaaacagagatggcagtgaaagtgacatttgagctgtaataagaacggaaactgagagga

SEQ ID NO: 37271 - DNA, 201 bp, Bos taurus
ctcatcctctgccacccccttctacccaggcttttctgtgggccatatgctcccctgtacagacccctctgctctaaaccatgcacagcactagtgcattytctctccaattggccacttagtttctctgttctgtattcatgagctcccttgattctggtcagctatttttaaaatatataacatggatataattcttgt

SEQ ID NO: 37272 - DNA, 201 bp, Bos taurus
tcctggggagggagtggactagctacgctcagaaatgcaggcttcattcactcacctgtagccggactttagcagtatccaggggaaaggtgatgaggtcmgcaatgcaggcagctgtgcctgcccccaggaacttcacagtggctgtagggggcacatctgtggccttgaacccaaccataatgacgattcctgcaacct

SEQ ID NO: 37273 - DNA, 201 bp, Bos taurus
aaagaatttcaatgagcagagattgggatgaagggcattttatgatgagggaatggtagaaacagaagccaaaatcaagaatgttcaagtagtattgtgaytatagtctaaggcaaagcgaagcagggaataaacataaaaaggctatatgggcttcactaattagagttgtgactgtcatgtttttaggaagatatcgtt

SEQ ID NO: 37274 - DNA, 201 bp, Bos taurus
atctgagcaccattttcccaataaacctagaagataggtaaacacagctataagcacttgaaatgttgaccatattttttcctagctacagtagggaaatytgactttacaaagaagcataccaaattagtcaagtagacaatgtcaacgctgggctaacttaataaatacctaaggatactgatggtaatgattccaaag

SEQ ID NO: 37275 - DNA, 201 bp, Bos taurus
tgctgagtagtatttcactgtatggaggtgccaggttttctttaacctttcactactttttagttggtgttgtttgggttggatgtttggtttattttcargttctttattgcaaataaagctgctatgaacactattcttggtaaagacagtattggattaaatacgatccttggtttatgatacaatgtcatcactggt

SEQ ID NO: 37276 - DNA, 201 bp, Bos taurus
gctctgccctcaccaccattggtccggcccctccaggccccgccccgaagcgctcaccgatcgcgcagatcttgcgctcgcccagccaaactccggtgtarggtgggggccgcgcgcgggcgccgggtaggcccaggagctcgcacagtcgcaccgcgcacgcctccagcgcggccacgtgggcgcgcaggcgcaggccga

SEQ ID NO: 37277 - DNA, 201 bp, Bos taurus
tcaagtttacagttgaggaaattgtgttttgaccgggttaagtaacaagttgtttaatcttaccatcagttggtttcgttttcctcgaagtttgttattgrttcaggcttgacctgcctcacagggttgaagtaaagatcaagtgagacgatggatgtgagagcgtttcgcgcatcgtgatgattgagtgcctactgtgag

SEQ ID NO: 37278 - DNA, 201 bp, Bos taurus
gatccaacttgtataataaaacttggccatctcccttttcacaagtatgggacacggacagaaaggaggaagagatccccttgccctgctaatcaatacayctgcttgggtatgaggcaaacttcaggatatccaaagagggtgtgaagtactgcagggcctctcacaagctctcttcccctccccctgccacgcctcagc

SEQ ID NO: 37279 - DNA, 201 bp, Bos taurus
tgagtacaaagcagactctctcatcggccctcgggcaggaaccaggtcccaccccactctgtccccagggttcagcacagggcctggcacagagcaaagayggatgaatgagcgaagggctgaataaaatgaatgttctggcaaagaaaccctccctgatcacagtgtgccgagctctccagggccgggaaccgtttctat

SEQ ID NO: 37280 - DNA, 201 bp, Bos taurus
gagggggtgaggtaggctacctgggtgtgcaggtgagagggggccgatggattcccccacagaaggtgtcttcctgccatggtgggaggggctcccatcgraagaggtaggcagtggcaggcccagggaaggggatttattttgtctgtgttcttcctccactatactattcctggactccaccaagaccacgacccctct

SEQ ID NO: 37281 - DNA, 201 bp, Bos taurus
ggttttcatggctaaatggtaaaaaaaaattcacaaagacctgtgtggtctgtgtcctgagggaagagaacaagggggcgtatggcagtcaatggccagamggtggggagccagaccagctgtgctgagcagccccttctcattcctccattcttcaggccaagagtcaggccgggaaggtctgggcaggacaaaggctta

SEQ ID NO: 37282 - DNA, 201 bp, Bos taurus
tctgggtatggtgtcccatgtataaagatgcagagcaaatattaggattgatgtttgaaagagatttggaggttctgtgggccgtgtagtatggcacatayacatatcttagcacagaggtgtaaagcctttagtagtgcaaggcagggacaggccttcatctggaggcaggcactcttctggatacagaagagaagcgtg

SEQ ID NO: 37283 - DNA, 201 bp, Bos taurus
tccctgctgccggcccatcaacactgtgggtaagccaagaacccaggctgggaggggttgggttacagggcaaaagacttgggcttgggctgaaggggaayggaaatgggccagacacatccttgtcctcctggaattcaggttctatactgggaaatggacatactagcaagtaacccagatgcaaggcatctgagatga

SEQ ID NO: 37284 - DNA, 201 bp, Bos taurus
ggccaggctcagagtgaggtttaaggaacaggaggctgaggtttagggctttgtacagcaaacttctatggagatgggagtgggcagggcagacggggtcyctgaggatgtctggcctgctgtctgggaaactactgtccagtccagggttcaggaattcatccccccgagtaaggaagagccctgggaggtgcttgggct

SEQ ID NO: 37285 - DNA, 201 bp, Bos taurus
gcagccaaataatcataaacaaattctttaaaaaataaataagaagcaggttggtaaagacgatgtagatagggaagatgggcagggtgtggaaaaagagragctggggggaagacacttcggctccagagcacagtgtgagcaaagacccagaggtggaaaagtacattcaaggacacagcaagtgacctgatgtaacca

SEQ ID NO: 37286 - DNA, 201 bp, Bos taurus
caactaccatgtatctaagaggggaagactgttccaggccaagaagtaggaaaacatgaaggtaggcgtgtacttgaggttttcaaggaatggctaagaakttagtatggccggagtggagtgagtggtttgagattttgacaagcttgacagagatagggaaaaaggaactgaggatcaggacagcagaggaaatgacct

SEQ ID NO: 37287 - DNA, 201 bp, Bos taurus
agctgccagaagaaaaagaaatagactaatctgctttaaaaatttttttaattatttggattgaatttagtaaattagtttatggacagtgtgtttatggmcagtgttctttttcgggaaagattctgttaaagagatatttcaaagaatagaaattccaacccaaatagacagatttaagatactagaataattttgggg

SEQ ID NO: 37288 - DNA, 201 bp, Bos taurus
gaggagacatatccttggctactctgcagctcactggaatacttctgattccttccagcgtttaatgatgtgactttgggagaagcaactagtggatttaygtaaggtcgtatcacttcattggttaaatctctagatagtgtttctgctcacctgtttctaatctagttctctgttcttttttataaatagaatcaagtt

SEQ ID NO: 37289 - DNA, 201 bp, Bos taurus
ctctgaagaggaactgtcacttggccccaccccaaagccccacagaatcctagatttccaatcctagatttctcccctctgagtggggagagtgctgggcrggggccaaagagccagatgcgctctgcgcctggccaggcctcagcctccctcctgaacctcgaggggtgagagggcctgcatgagcccacagcagcctct

SEQ ID NO: 37290 - DNA, 201 bp, Bos taurus
agcacacactccaggcgcttgttcaacagaggctgagttttctgcacagacgctggtgggaggcccacgctaggatgccccaccaacggccctcggccccrtatcagctctgtgaccacaggaaaggtccttcccatcttggaatttcctcatctgcaaaacagattgagagcccagaagactaatctccaggttccctcc

SEQ ID NO: 37291 - DNA, 201 bp, Bos taurus
tggttgaagggctggggaggcccccacacaggacactttggctccaggaaggagccccgtgttcacaatagggaagagagccaagaaagtaggaagagacmgggacagtgggcctggagagtgtggcggggttgggaaggattccagagccttgacagaagtgccaggacagtcacaggggaaggtgcccagctctctgga

SEQ ID NO: 37292 - DNA, 201 bp, Bos taurus
ctagccccgtccccctccctcctccaccctccccgcatcaggtcgctctgccaagttactgagctcccctgctgctcctccagtttgctgctcctgctgcrgggccagtgaggaaagtggtgagagaccctgggcccagcaacacccctcttcaccccgctaagactgagggaacccactgggctactgtccccaggcaga

SEQ ID NO: 37293 - DNA, 201 bp, Bos taurus
aaccatagaaacggggtgggaaggactgtggcaccctggacccccaacttagtttctgctgccctttttactgaacacctgctgcaggccagtccttcatstcctgtggcaaatgagggtaaagataaccacagacagcctcaggtatctttagtctcaactactgacttggaaactgaggctcagagaggttaaataact

SEQ ID NO: 37294 - DNA, 201 bp, Bos taurus
cacccacagagctgaggatgtccagggccatgttgaccatctcagcagcgtgccggctcccgttgtgcctgggcactcccgaggccaccatgtaagcatcyccgatggtctccacctagaagtcatagccttcatgctccagtacaagcactcccctccctggactgatccacgtgccacacaaggctgcctctcaagaac

SEQ ID NO: 37295 - DNA, 201 bp, Bos taurus
ggtcgtatagttcaaaaatagtttagagtgaaaggtattttaaaggctcataaacattaaccataaatcaaaagtgcttattcatgggagtcaagagttakaaagaacttagttttcaatcccatccttgtaattccatcctttttaagagttcatggcaactctgggctttctaggtggcactaatggtaaagaatctgc

SEQ ID NO: 37296 - DNA, 201 bp, Bos taurus
tgtatctatctctaggtacaattgggaccctgaaaatgtaaagaagctgaggaaagaaggatgtgtgagccgtaaaggatatgaaacccaaagtttggctrcaaaagctgggtcacgaagccattactaaccgccatctcagcaacagtgcagaacacaggactatatctgcctgaagccctctttatccaggagaattaa

SEQ ID NO: 37297 - DNA, 201 bp, Bos taurus
ctttaagcctggccccctttctctgctcccaactgttcacaggtccctcaccctacagtcattcccctggtgaaacagaacacggcagacaccccagttgrtgctcctcaggccctgagcccagtgtgtctttcccaccacaaatccatcctccacctgaagtcttccattagctcaatcagaacaaggtatccctcctct

SEQ ID NO: 37298 - DNA, 201 bp, Bos taurus
catattttgcttcagagtttagagatgccaaccataattaaacccagatgcacacatccagtcgctgcttactgtaaaaggggaaaagctctaggcccaaytttaaattttctcaaactgcccaattttttaatgtcaaagaagaaaataaaaaccctcatccttaatatttatccgagaatgaacaacattgaggaagaa

SEQ ID NO: 37299 - DNA, 201 bp, Bos taurus
cagtctcaaaaggcttgttcttttcctttaagtctctgcagccctttggaattcatctctcatcacagagaagtttcagtgcctttagattagggatctayacccacaaatgatgatccactggactctgatccttggccttggagaagagccaacagagctggttacaaattcattgttaattactgtgtgtaatcacag

SEQ ID NO: 37300 - DNA, 201 bp, Bos taurus
ggtctagagttaggacttggcactttcactgctgtggcctgggtttagtccctggtcaggaaaccgaggtccccaaagctgtgtggcatggccaaaaaaamccccccagaacagagaaagatcatttcatcaagccatctagttttactgataaaaaaccaaaggccacggaggacttgcctcccatcatgaagaaagttt

SEQ ID NO: 37301 - DNA, 201 bp, Bos taurus
cagaagcctctttggaactcagaagaaagtgaagaactcctttctgtttctaggtggtcgaaacagtaccatgctttctgagaccaccacttaatgacttygatgaaccctgctgagatgttctcaggctgcttggggtcaaatgccatctcctctcactttcagcttcatgtttcacaatcaaccatgtttccttacaga

SEQ ID NO: 37302 - DNA, 201 bp, Bos taurus
gttagtccaaagggctggtcagggctgcagtgcacggtaaccttcattgaactggatatattggcagtttgcaccagaggtagtctcagctgcattgaggraggtcacgtttaaaacaccatctctccctgtcaatgccacttggcctaatcacacgctgtcaccaaagagaaatgactacagtgatagatctcttggcag

SEQ ID NO: 37303 - DNA, 201 bp, Bos taurus
tacttcaaatgagtaaggaaataatatgctatttcagggctattagctatatagtttttaaaaaataaagttagatctcttcttcatattatactaaaacktcaacttcttgtgtatcaaatacttagatgaagaaagaaaaccagaaaaacacagctgattatagctataatcttggagtaagaaaagccttcctaaact

SEQ ID NO: 37304 - DNA, 201 bp, Bos taurus
tttcccatagtgagaaacctgactttcattgttcttgatatatttatttatttgcttaatctctctgcatgtagctgatttcctgatactgctaggccccyaccccctctttgcaaatagacctgccctttgctgaggttggtgtcctctgcgtagcacgcagcttactttgttaggcctgactcatggctatttgatagt

SEQ ID NO: 37305 - DNA, 201 bp, Bos taurus
ataatgtgcatatacatatctacacaacctctttcatgtagttttagaaattcattggatccactgaagtctaataagggcccaccaaaaccaaataatamtttctattgtaagtggttgcttatgacatatagatacatattttcactttgaatgttatatatctggtttgtctctaagctcttctgctactgctactac

SEQ ID NO: 37306 - DNA, 201 bp, Bos taurus
tgaactcagggctttgcatggtctccagataatggaaaaccccctctgtccatggaaaagcggcttctcctgccattccacagacccaaaagggacctgargtttgggtgttctcaaggagatacacccagatttccacattcctgttctcagggtcccactccttccctgtggggccctaacacttgcagaactataaat

SEQ ID NO: 37307 - DNA, 201 bp, Bos taurus
attatttattactcgactaacatctgcctctgtcttttagactctgtctggtctagtccccagactctgtgatcaccagagttttctgtctttccctggayggctcactgcctagcacatgcatggtgcacaggatgcaatccagtttcatgaccttcttacttgaagactaagcatattcctgccttggggcctctgcac

SEQ ID NO: 37308 - DNA, 201 bp, Bos taurus
cccaaagtaaaacatgttatggtaaaaatgtaagagtttaatctggcattgcctctttgtatcagcataattgcttcccttacagaaaaacccagtaagartaagctcttggcgtcctttctggcctcaaaactttcagtgatctcttttgtctccttttgaggtccctatcctgtttttccatcttgctgacacctccta

SEQ ID NO: 37309 - DNA, 201 bp, Bos taurus
gactggaagtaaggaacatggtgaatacaagggtctaaactatggtcactgtaactagaacgcagaatgtgaaggtaaaaggagtccacaataagaaacaktgtttttttctaatactactgggaaacaattcatgtactttcatcagggacacgatatgacaaggttttttggtaatgtttattctgactcaagtgtgaa

SEQ ID NO: 37310 - DNA, 201 bp, Bos taurus
ctagttacatacaaaattcatgtagaatcacaattagtcacatggtagtcaaagatttcatacatcactgaaatttctggaatcatatatccattttctgrgtccaatgaatgcctgcctcatcttcattatgtcaataccatttaccattaatatgagcctaaaatacatatgtgcctcagaatgacccacttcaaacat

SEQ ID NO: 37311 - DNA, 201 bp, Bos taurus
tccaaactgctttcgttgtcccatcatgtcctctacagtcttgtctgttgtttctcttttataaagacacctgtgattacaaagggcccctcaagataatycaggataatcccctcaacacaagattctaaatctgatcatatccacaaagacccttttaaaatataagatgatagtcacaaggcccatggactagacctg

SEQ ID NO: 37312 - DNA, 201 bp, Bos taurus
attggattaaaatcaagagacgctttttatcaggaactaataaatatgtttggcaacagttttatttgtatgggaggaaacagcaactgcaaagtatcagygtcaactgggtgactgtaactatatcacaagatctcatttcacaacactgagttataacagcaggaggctaattctgcaaccacaatttaggcaaagctc

SEQ ID NO: 37313 - DNA, 201 bp, Bos taurus
aagcttatcttcccctagtatgaatacaaatgatgactcttttctcagctgtgtatgactttcttttaaaccacttcacacggataagaagcagacatcamccactttatccaatcaaggaaaattatatgtaagttttgatttggaaatgaacagacaacctaagtggccaaaactatgaaaaatatacaactacttctc

SEQ ID NO: 37314 - DNA, 201 bp, Bos taurus
ggggagaagaccagaaattattcatgtaattttaattccccacatccctaaattggcagatctttcaaccatgcacaaagcaaaagtatagctgcaacttyctgaaatcataacagattcctcatatttgtagaatcgtgagaccttcacggtctgttacgctatttactcttctagcatctctcagttgctcagatgcca

SEQ ID NO: 37315 - DNA, 201 bp, Bos taurus
tcatatctttagtgctagaaatcgggttgatcaaatcataaaagttttaacagaactttagaaattggataagccttttggattatctggtttaacttccygctcattgaagctctctataagaaaccctgcaagataatttttaaatctataaatctgtaaattaaggaaatagaacttcctgggactgatctgaatgac

SEQ ID NO: 37316 - DNA, 201 bp, Bos taurus
tttagtgcagatcccttaaggaaatacgggctaatgaaactgacttgatgatattgccaagtgttaggaatggcatttttaaaaggggagaaaatggacaraagactcctttgttgtcacttggctgtgatttgtggtattgattctggcctttggctgaatcttgaactaagtgcagcggaggtccaagtaccttaacct

SEQ ID NO: 37317 - DNA, 201 bp, Bos taurus
taaagaacaaaaatggttatcatgaaaactttctcaattagaagtgtatttaggttcaagaaataggaaacgtgtaaaattctctagtatggcttcaacayaggcattttctttactcataccataagaatctagagttagaccgttgctggtattggctcagtgactcatcaacatcaggattgatgatctgtgattctt

SEQ ID NO: 37318 - DNA, 201 bp, Bos taurus
ttttctctgtagcgtctggtgagccaaggaatggtaataggagcctgtgttaattctgtctgaaaacaccatctggttctaagcacttatctaggccatgkatgtcacagcctagatgtggtcaccatgatattcaaaggtcaaagaggggtctaattacatgccccagtacttaaagggcagattcaccagagcatgaac

SEQ ID NO: 37319 - DNA, 201 bp, Bos taurus
gtcataatttcccttaagaggttttgctgataattgcttaagacatcagatttcctagttgttttctattttaaataggccacaatgaaaaagtaattcargacccaaaggaccgaatgaaaggtagaaaattctaggcacagggatagcacttggtgcctcccatcatgctggcaaactaccaggccagtgctctattgg

SEQ ID NO: 37320 - DNA, 201 bp, Bos taurus
aaacttgcttctaggcactgggacagtctccaccccaaatctagcctgattgcgaacctcctgtgtgcagttcctattattgaaagctggccaagggactrttctgtttagggtggatcagacattggacatgagagttggggtgcctacctattcagtttgtgtgccattaagtgttagatacagctggggctgtgaaga

SEQ ID NO: 37321 - DNA, 201 bp, Bos taurus
aaggcacatacttgaagtctaccagtacatcagagtaatttccctcataataacatatttacattttaatccttgaaacaaccctttgaaaggtgtgactrttgttcccgttataaagacaaggaagccaaaatagggagggtaaagcaactcgttcctccagcttgttgcctacttcataaagcttagatatgctgccta

SEQ ID NO: 37322 - DNA, 201 bp, Bos taurus
tactctttgcgactccatggactgtagcccaccaggctcctcagtccatggaattctccaggcaagagtactggagtgggttgccatttccttctccatgkaactgctaggaagaagcaaaaatagtctacagggaggagacaaagggaggcaggacaagggtagaaacaagctgcatcatctctttccagtcataaatat

SEQ ID NO: 37323 - DNA, 201 bp, Bos taurus
tttgagaatctgctatatgaggaggcactggtgatgcagaaatgaataagacattatttctattttaaggagctcactatttaataattaaagggatttgyccaatctgtattacagggtaaattcagttgagtaaatccagttggctaaatatgaatttcaaaattgatcagaagtagaaaagacctctgtcaaagactt

SEQ ID NO: 37324 - DNA, 201 bp, Bos taurus
taaaaggaaacatatgttttattatgctcttttagattggatatgaatatgtatggttaccataaccatgggccaagaagaaaactggttatggtagatayaacattctgatactctctaactcaaaggacatggtattattcagaaccatatataaatatcaaaagcaaaatgtacttatttctagatacccttttcaaa

SEQ ID NO: 37325 - DNA, 201 bp, Bos taurus
agatcttgtcttgtatatttccatgtttgtgacacctgtcaattatgccagggccatttatttgcctcggaggagactggcctagtcaatataattgcaamgggaagagtcaatttgtagttgtgatcttcaaaattaagtttttgagtctccaacaaggccataatcttgaaaccaggctttactgaaaaataaatgttt

SEQ ID NO: 37326 - DNA, 201 bp, Bos taurus
tcccggtgtttctgttgctgtctttttgatgtcacaaagcgaagttgataaacacattcaagtcacaattaaaaaacattttcactgaccagttgccaccracgatatcatcagacagcttcgttgctgctgtaacaatgcgtttaatggtgttgatgtgcaggcgagaaggtgcttccctttatctggtccttacctcgc

SEQ ID NO: 37327 - DNA, 201 bp, Bos taurus
tgtttcaaatacttttgcatgaatatgtattatcttcatattttttaaaaaatgttctgaaatcctgggcaaaaataagttaggaggccttctcgtttggyccaatgttttcatgggacagtacgatgggccctggtgacaacactcttctccctgggggtgctgggccctgtgggggcccccaaggccatccaacttggt

SEQ ID NO: 37328 - DNA, 201 bp, Bos taurus
cttattgataaaaatataattaaactaagatatatggctaaaacttatattcagatatagtatcttacaattctgtaaatttaaaaagggttggttttctrgaagtttttcttctgtcaaggttacaaagtagaacaaacttctatgtctttccacatttttcaacaactgaaaccatggagccattgtaatcagctaagt

SEQ ID NO: 37329 - DNA, 201 bp, Bos taurus
gttgatctgtctggcttcaaaattcccatcgtaggcctgtcctctctattatgtgaattctgattctgacgtgttgtctctgtgttcctgtttcaaaactrcctaacactgcaaagaagggccatcttgattaagctttcagtttttagttgttaaagttactttgctggaaaggcaagagaagcactatcaaaaatgctt

SEQ ID NO: 37330 - DNA, 201 bp, Bos taurus
atatgactgcagagatgagtggtaccatccttaggcctgggcctattctggccctccacagtctgcatgtctccatggggcagggcctatgtggggccaargagccatgccctcccttctagaatctagaatctgcatcatgctgtgtatacccaaaccctggaattccctgtccacatctgcctccatggcctatgtggg

SEQ ID NO: 37331 - DNA, 201 bp, Bos taurus
gggaatgaggaccagcagctcagccccctcttcttgctgcccctgtacttccctgactcctgaggaccctcctggagcccttgggcaacagttcttagccyaggtccctagacttgctaaagcaatatgaaaatagctgtgtattggcttttggagggcaagactcctaactctcagattttctactgatcttccaaaaat

SEQ ID NO: 37332 - DNA, 201 bp, Bos taurus
atatacaaaaaatgaaaagttaacaacgaccaagaaaaagaggttgttttcattactctagaaggtatccctggggtcttcagggagcatatttccccaarggtgatctcaaacctttccctaaagaacccccaggcataagagccccagtgcatctccagcccaggatctggaggcatacacccaggcatgaaatgtctt

SEQ ID NO: 37333 - DNA, 201 bp, Bos taurus
gaaaccaaatggtcaagacttacaggccatgataggctgtatgcaaaacaaagatctaagaaaacagaatcctgggtaagaagtagccttgagaccagggrgatttagagtctagatatgaaagcctatctagactcagggtctggatagtcttaagactgtgaaaataaagtgttgcctaattgccctagttgctgcatg

SEQ ID NO: 37334 - DNA, 201 bp, Bos taurus
gaaggggcattgggctgagaagagtggagagggtagacagaaggtagcatcaggtcagaaagctggacaaacactctgggcttggatgagcagaggagatygcaggccccaagcctaaggcagcccgcaaccatatgggttggatggggactgtcaacaagattgagctttaagtccacaggactggctgggagtcacagt

SEQ ID NO: 37335 - DNA, 201 bp, Bos taurus
gggatggagaggcggctgcggccgctgccagactcgcagccaggcaggtgggcgcataggaaaacccggcgcggatcttgccaattcctggaggcaaaacmcctgagaggtttagggcccagtgggaaaaccaggaatggctccaggacaattacagacagtggaccggtgggaacctggacgaggtctgggactcagtcc

SEQ ID NO: 37336 - DNA, 201 bp, Bos taurus
cacttaaattggagcactgaacatttagatgcataccgaattatgcatgggccctaatcacacagacaaggctggtgccagccttaggcttgacacggcastgttcaccctctggccagacgactgtggttcaagacacatgtaaattgctttttaacagctgatactgtataagacaaagccaaaatgcaaaattaggct

SEQ ID NO: 37337 - DNA, 201 bp, Bos taurus
cgctcaggtggcgatggcgtggtcagtggcgtgtccggggtgacttgtcacactgcagcctcaacggccagagtgggccagccgtgtgacagccctgccckcagagaagagcatttccaagcagagggcacagcaaatgtgaggacctgaggtggaaaggacattggtgatttgaaggagatacaaggccggtgtggctgg

SEQ ID NO: 37338 - DNA, 201 bp, Bos taurus
gagagagagacattagcaacactaattttttcattgggaggcttatcgcatgattcaacaaatgtttgtctaccaaacatttgctcttcccatctttctgygaattgctgtccttccctttcaagtgccagacccctacactcctctccttagctcaaagttggcctataagcctctattcccgggctgcatgggaagagt

SEQ ID NO: 37339 - DNA, 201 bp, Bos taurus
cttctttaaaatgactccctgatcagagaatttacgtttatttagaaagcgactctatctaccttcgatggaaaatcaacatcactggccacagatacacrttacctgttacttaagtgttagtccctcagtcgtgtccgactctgcgaccccatggactatggcccaccaggctcctctgttcatgaaattcttcaggca

SEQ ID NO: 37340 - DNA, 201 bp, Bos taurus
ccaatagcaatagctgtctgggcccaggctttcatgcgcttatcaagctatttggaaggaactgaggcttggaaaggagatgtgacttaacagtgggctcrggctgggccggcagagagaggaaggacaaagaggaggcggggagactcttctggtgccccaccagcaaaggcggtgggctccggaggacaatgtggacat

SEQ ID NO: 37341 - DNA, 201 bp, Bos taurus
ttacaatttttttttcaattcttaggtgtgggcagaagaaaaaactggtgatcaacaatgggaatggaaccatggaggagagaaagcccagcggactcaayggagaagctagcaagtctcaggagatggtgcatttggtgaacaaggggtcgtcagagacccaagaccagttcatgacggcagatgagacgcggaacttgc

SEQ ID NO: 37342 - DNA, 201 bp, Bos taurus
ccaatcttccctttgagcttgccaataattcctcttctcgtttatgtctttcaccatccttctacccggataactgaaactgaagtggcctctgtgaaacrgaattagtgtggaagggacaaaaaggtaaagggttgtttcagtgcttcaccccacgcacttcactcaccttacggtcacaatctggcctccgtctaggac

SEQ ID NO: 37343 - DNA, 201 bp, Bos taurus
caggtctcctaccggcttggcctccagctgctccagctccagggagctctttccaaaacgttaagaatagacttggcacctggttgtgtccatcgccccaragccagcaagctcgtctttctaaacaggctggctgaggggcaggggcattagagagagggtacccagaagcaccccttccctagcctgtttcattctttt

SEQ ID NO: 37344 - DNA, 201 bp, Bos taurus
cctgtaagagcttgcacttcatactttatcacattcaaattgcctccttaacgtttgaatatcttccccattaggctttaaactctgtgagggaaggcccrtatctactcctggatccaatatttattaggtgctcattcagatttcattggggcttccctggtagcttagctggttaagaatctgcctgcaatgcaggag

SEQ ID NO: 37345 - DNA, 201 bp, Bos taurus
agaaaagaaagctgggcgaatgacatttatctccccatcccccagacgaggaaccctaaggatgggagaagttaggtatccccatggccagacagccaggragtcggaaggtggcagatgactgttctagctgtagagcagtggttgccatgggacgtcggagtcccctctcagtatgggtctcaaccttagagtcaccag

SEQ ID NO: 37346 - DNA, 201 bp, Bos taurus
tataaatgaccatccaagtgaaaaaggcaagtttagggctcaataaataattaacaaatgagtagatgtgcatgtgtaaaagattaccaggtggggctttycccattgtctctgtattctgctaaagcccaaggtttatgcttgggtgatgaagacatacccgttctaagagaagctctagacacacccacacaggtcttc

SEQ ID NO: 37347 - DNA, 201 bp, Bos taurus
catcccagaacacttagtagtaaatctctcctaagctgtcatcaactgatcccaacgcaagaattcagaaatttgcaaagattttctcctttatccttttkctcaactacaactgacagtcccaagcaaagatgcaccccataactttgacaatgaaataattgagaaactaatgtacaaacagattcttctattttgggt

SEQ ID NO: 37348 - DNA, 201 bp, Bos taurus
tcctagactttgctggatctgagaccatctcataggttggtgattagagtaaggactggctgtccttaggtaaggtggccagtccccccttgaccagggakatgggagtcacagggtgccacggcggcagctgagggcaaagaacttccagaaaggagttggcggcatagcatagctcccggaagtgtggccatccagggc

SEQ ID NO: 37349 - DNA, 201 bp, Bos taurus
gatgcaattaactgaacataaaatgataagcccaaagccagaagataggcagaccactggctggcctctccacccatcctgagtcttgtctttgttgctgytgtgtaaagatgtgattccagggcatttatgggctggcattcgattatagcttgacatgaacaactctgcgtctgggttagaaataatcgctttgcattt

SEQ ID NO: 37350 - DNA, 201 bp, Bos taurus
atgcaagtaaggtatcattattatgcccttctacagatagggatgctatctgtagagggtttgagaggaggtcctctcacttacccaagtccagaaaaccrggaagagttggctttcagtaaggacccccaattctgtggatcgttaaggtctccatgaaaacctcaggccagctgcatccctgctgaagcacccaggatg

SEQ ID NO: 37351 - DNA, 201 bp, Bos taurus
ctatttgaagattttcttcattgagactgactgtaagggttttacaatcctatctctgaaatattgtttcaactgccttggtgatccttttgatgcaagayggtagttggtctgagcacctaaaaagacagctatgctgctgctaagtcgcttcagtcatgtccaactctgtgcgaccccatagatggcagcccaccaggc

SEQ ID NO: 37352 - DNA, 201 bp, Bos taurus
ctcaccaaattttagctgtcagtatcaggcagcgccctccccgcccccactaaaagtgctgtgtcaaaacagcaattgtgattgcacaagtaataataackccaaagctaacatacagagcacatgtggccagaacctcaagccagctccttgaagctggttgtgtgctagctaaccaaaatcttggcagtcggcgagtca

SEQ ID NO: 37353 - DNA, 201 bp, Bos taurus
aaaaaaaaaacaaaaaacaggccaatttgtcagaggccaggcccacatttctacctttccagtttcccaagtttccaggctgctgccctggctcagttagygctcgtttcttccgcacaaaggcccgggcctcccactcatctctctccattgtggctccagggggagggtcctttgccccaagatacagtaacttgtcct

SEQ ID NO: 37354 - DNA, 201 bp, Bos taurus
ttggaaggtggaacagatgtctccagtttagaaaggatatctaataaagtctgaaacattggatggcacttctcagtcctcaaactccctcatgaagacaygatccttaggtcttcactttcttgaggaagggggagaaggcactcattaaatattttctgggaccagttagcagtagcaaagtagggagttccatgtcag

SEQ ID NO: 37355 - DNA, 201 bp, Bos taurus
gtttgcacatctgtcgttggaaatatttgccaagaaaacttcacgaagagtcttttacgaggaaaccaaggaaaccaagcaacccacatggtttgtctgcytcccctctgtatccctttctcataggattttatgagcctttaattgttatactgagagtcatcagggcttggtggataaaagggtgagttttggggtccg

SEQ ID NO: 37356 - DNA, 201 bp, Bos taurus
gtaaaaataataaaatggcaaagttagaattcaccccaaggcagcaaacagcagaagtgatgctgtggaaaaccgggttattgactcagttggtaaaattkaaaagtgctcctacaatgtggaaatcaatgaaagacaatataatagctttggtagatagaagacaaagatgctttaataactaactggtgttccacatat

SEQ ID NO: 37357 - DNA, 201 bp, Bos taurus
ttacttttaattatatttttattctgttgcttttagaagggagaagttggttataaatgctgttttaaacctcttctgttattttgtgaagtcttaaaccrtgttcccatacttgagagatttccttattcttttatttttatctgaacattctctcttttttcttctcctgctttggctttgttcaattttaaatcagtt

SEQ ID NO: 37358 - DNA, 201 bp, Bos taurus
atggacatgagtttgagcaagctctagagttggtaatgaacagggaagcctggtgtgctgcagtccatgaagtagcaaagagttggacataactgagcgartgaactgaactgatgcttatatatcatagaattagatgcaaaccttgcaaatccttgaggcttctttcaggatgcatgatggaagtttaaagtaagaaag

SEQ ID NO: 37359 - DNA, 201 bp, Bos taurus
ctatagaaattatttagtatgtcaatctttgccatttaagagctgatcaggatatcctagtgaatgaaatgaagctgtctctcctgtttgtcccacataarcaaacacttcatggaaactttggagactggcactggaaaagaaatttggatgattatcccatgcttctcatagttaaagattgtttactatgaaaaaact

SEQ ID NO: 37360 - DNA, 201 bp, Bos taurus
ctatcttttaatccagtaacagctattctttccatttcatgctgaaaatttctgatgattaggaatctatggaaaatagtagttaaaatagcattattaaractatcacatgaaagagacattctaatttcagagaagttacagtgtgaaaagaaaatatttctaagaaataaacaaaatttctgaacattttaatgacag

SEQ ID NO: 37361 - DNA, 201 bp, Bos taurus
gaaggaatgccttttttaaggcagtggtctccaacacttttggcaccggagaccagttttgtagaagacaatttttccatggacagagtgggggatgatgrtttggagatgattctcataaagagaaagcaacctagatcccttcatgtgtagttcacagagggcttgtgtttctattgttaccaagttcaagatttttcc

SEQ ID NO: 37362 - DNA, 201 bp, Bos taurus
taaatggacaataagaaaatacattcatccacatatccatgcttgtatgtttgtgggtacataaacaaaaggaatatcgtggtacaaaataaaactaaagkcagagaacaacacaactttttatcaaataagtaatatatctattacacatacacccaaattgattcttaattatatgcattcaatttaaaaaaaaaagtg

SEQ ID NO: 37363 - DNA, 201 bp, Bos taurus
actcttttcatagctatttgtaaggcctcctccgctctggtatagggtgcccatgacataaactttatgtataatgtgtattagcccaaagtttctcatayggaaaactttctttaagatactgaaagatgatagaaatcagaagtcattttatttatgcaagttcatttcatgataccatttgttgatgaatattcttgc

SEQ ID NO: 37364 - DNA, 201 bp, Bos taurus
aagctcattttatccctctaatagttttctaaaaatttgtaaccctgaaaatgtttcaacaattaactttgcttcaaaatgtaaaagcctagagggataartggtttttccaggtgttgctattagaataaaaatatatcaagtatgtaaaggacatatgttcacacgtttaaattatttattttgtgaaagtttaatata

SEQ ID NO: 37365 - DNA, 201 bp, Bos taurus
ttgttattgagagacttttaaatggctgcgtcctcagattaaaagcagtatacatgtgtctctactacatggtacttaatatttactaagctttctttccyttcaactcataaaagtactagttaaaatcatcttctcaggaaacatcacaatgcaggatgctgcagaagtaaaacagtttaaatcatttacatctcatgt

SEQ ID NO: 37366 - DNA, 201 bp, Bos taurus
tgttcctctttaggaaagtcagaaagcaaaccagtattgtggctatctgagaattcattgccccttaattctttatcaagggtccaatataaatctcagtragagattatgtacatgtcagatccatttatataacagctgagtcgatttggagacataaagctaaaataagaacatctcaggaagctgtctgtatatatt

SEQ ID NO: 37367 - DNA, 201 bp, Bos taurus
taccataggaaggaaaaatatcctatgaatcacagaaagagacttctcagagcaaagatataaaatcttttcagaaatattaataaatttaatagaaacaygacttttgaatattccaatgaacatggattagtaggtattaattttgcagtcaaaaaatagagaatacgtttatttcaagttcttgtggctcattttcca

SEQ ID NO: 37368 - DNA, 201 bp, Bos taurus
cttttgatgacacatgtcacatcccttttcaatgatgtctcagcactttgctgttttgtggaaaattttagaacaatcctaactcctttaatatacttggmagaatcaagccatttcaagccaccatctttttcctgtgccattttcatggatattttgatagctctaaatccaaatacagataatcctatctgtcagatc

SEQ ID NO: 37369 - DNA, 201 bp, Bos taurus
aaactggatgggaccctcaagaaactcatcctaaggaccactcttctaccttcaagaaacttacttgcttcccagttctgtagaaccaccactaccaccayatcactcaaagagacacagttgataatgcttgcctgagagcattctagaagttgtatgaaatcctgtatttaaaagctatttcttttttgttattgtttg

SEQ ID NO: 37370 - DNA, 201 bp, Bos taurus
ttagtttctagacatgaacatggatctgtatatgatatggacttagaattatatgtgaaggatcaattatagctactaatgggaattgctaactttgtatyagtaaggatgctgaccgcacctctgcaatgagaggtccccaaacagcatcttatataatacacacatgttttattttacatgctcactcaaggctgttat

SEQ ID NO: 37371 - DNA, 201 bp, Bos taurus
catcagggaagccaattatagacaaaatgtggtcaaccaagagaagaagaattccataaataaagctaatccagtaaacatcaggttggccaaaaagttcmtatgggcttttcaatatgatgttatgagacatcacatgtataacacatggaaaaacccaaatgaacatacataatatcatatggtaatacccaaagaact

SEQ ID NO: 37372 - DNA, 201 bp, Bos taurus
tcacatctgttgatgctaattcaggaatgactcattcatctgcccagttctctcattgtattatgttactaagaccattctcaagttcctcagctgacttytgcactcatctttcttcttatccataccatcccctctctagtacctgttagtttccgaaaaatagactggtgagaaagtttaaaagaaacagtaaagaaa

SEQ ID NO: 37373 - DNA, 201 bp, Bos taurus
gggccggtgatttagctgtctgtcttcctgctattctaacattgagagaaagaaatctgaattctctagaaactgggaaaactaaaggctacttgtaagayagcttacagaatttgacattatatcacatgttccctccatccctgtcagatatcttccaaaggaaaaaaatattttggggagaaatattcatatttaatt

SEQ ID NO: 37374 - DNA, 201 bp, Bos taurus
ctgtagtgtctttctttaagttctattccataaacctgctatagaacaactgccatccaggtgaaattaaatgcaacaatatgtttattgtgaaggtaggyaattgtagcatgctgaaatctgctattaactttcagcatttcttatacctgtcaaatatacattggctccagtcttaaaaactgactggataatttcatg

SEQ ID NO: 37375 - DNA, 201 bp, Bos taurus
tatgattgagaacgcagcacagaacactgactcacctcctcaacctacccatattcatcagccagcccagaaattgtgcttttcaaacacaccatgggackggggaatcctcctgtaccctcagagccactgtaaataatacagctatggaagaaggcacactctttccaaccaatttctgatttattccaggacgctttt

SEQ ID NO: 37376 - DNA, 201 bp, Bos taurus
tgtgagttcttttcctttcccttcatctcttcttttcctctccttccacaaatattcagttacctattttatatcagataatgatggcccctgagattagkagcttgtaggctagctgaggaggcagatataattaaatagtcccccaaaggcttccaagtcaagatgtacattacttagcgaaaggccacttctatcctt

SEQ ID NO: 37377 - DNA, 201 bp, Bos taurus
ctcctttccttcccaactcctagttttcaggtaaggtgtcctgatcatttttcttcacatatccccttcatcttatccatatgattaaaaagggaacagtygtattttttctggctggactctgactcctggatgcgatttatagacaacagacagacaatagacactccagactggattaatcgaaagtcatccctgaaa

SEQ ID NO: 37378 - DNA, 201 bp, Bos taurus
gtgtaaattaaggtgttaattaatttatctgtttattcagtcatatgattgtacatgaactatttgcatattttatcttaagccatagtatcttctttgarggagtttatagtgtaattagggggataaattaaacaaataaattacatataaagtgaggatatatgagccatataagataagtaaagtaaaagggctata

SEQ ID NO: 37379 - DNA, 201 bp, Bos taurus
gggaatgccaggttcctggggataaagaaaggatgatggcagggaggtacccagggagcctgctgatgctcggtaatacttgttactatggctggggaaayggaaaagtgcagtttcccaacctctgaggcaaaccggctaaagacaatggaagttttctaggaggcaattgagtcttcgtaggcttgagatatttatgtg

SEQ ID NO: 37380 - DNA, 201 bp, Bos taurus
acacacatatagtacattagaagtacaggtatttgtcagaagaatattcagccagaggggacaaccagtgccaaggccttaggacaaaagcatgactgatytgagaacagcaaaatagccagcgtgtctgaagcagagtgaaggagaaggaaggtagcaggacgtgaggtcagactggccaggagtgtcttgaggttagat

SEQ ID NO: 37381 - DNA, 201 bp, Bos taurus
aatcttaggggcctgtactgtaactttcctaccggggcttggcagagacaccacatggcatctttgttcagtacaaatacctcagtgacatgagatcagcygagccatatggctcaagtggcaaagcaacagcctggatctgtgacaaaggattttcttgctctgagcctcactcaagataagtagcccttgacatcaccc

SEQ ID NO: 37382 - DNA, 201 bp, Bos taurus
cgcactgctttagaaccaccgcagggcctatggcagaggttctgtaatgttctctctgacactacagttcaggagactgagatggcacagctgaaaagtcrcatggccaggatttgaacctaagcactgagcttctctggtggctcagacggtaaagaatctgcctgcaatgcagcagacccaggttcaattcctgggtcg

SEQ ID NO: 37383 - DNA, 201 bp, Bos taurus
tccttgcatggatactccttagtcttctttcatctcctcactgtaagccccaagagggcaagaatcttttctgcttttgcccaccattgtgtcctttaacmcttaaagttaacagtgcgtgtcattcaacagttgagatatctatgaatgtgttcagtaaaaaggatgaatgaatgaaagaaggtcaaggttgaatgttgg

SEQ ID NO: 37384 - DNA, 201 bp, Bos taurus
cttgcattcccactgtctgtctcaatatgcacccatgggatgtggtctgggagcccagtagcctcgctggactgaagtttagctgggcgactggcccacgrgtactcaacagagaactcatagtaggcacctgagtcctgccatgaaagccagtctctaagaaagggggaactgttccacctgtagcagccttgcctggcg

SEQ ID NO: 37385 - DNA, 201 bp, Bos taurus
tgtgggaacaaaatagaagctcttgtgttataaattttatatctgtgcttgaagtattgggaataaacactgtcagaagaactaagacccctggggtggaraggaccacctatttgtgccctgaggggtgcttaagccttcccaagggaaccctctcaatcttaatcttttccaccactcccaccggccccgataccaaga

SEQ ID NO: 37386 - DNA, 201 bp, Bos taurus
aaaaaccctcaccaactcctcccctcctacttcctaatattttaaaatatccttaatctaaatgagcgatacaaggtccaaggaactgttttgtaaccatygcctgtgtatattctgcacaagtgaatctgggtttgaaatttactattacatagcttgatgtttcaatcttgactgttcaatatgaatacatgtaacttt

SEQ ID NO: 37387 - DNA, 201 bp, Bos taurus
gtctccctagggcccagagtatgcaagcccactcgatgcttccagctcagggatgtgggccaacaccattcttgcactggggagcagggcccccagatatrttcaggcatccttttcattcctgggatcccgggactcaatggtgtgtctccacatctctgtcccagtatctggcttcatggtgccacgcccaggccacct

SEQ ID NO: 37388 - DNA, 201 bp, Bos taurus
agtaaaaagaggtcagcgggcctgacatccgctctccacgtcactcaagggcctcgttcgtgagactgtctcctcgttttttggtccaggggtggaagggragagtctttcacagccccggttgctcgtgtcactcctttcagaagaagtcgaaaaccctctgttctcgaggtcaacaggtgtttgtcttcctgtgatata

SEQ ID NO: 37389 - DNA, 201 bp, Bos taurus
gctgattttgagataataattgatagtgacaggatgaaaaaagctgattttgagataaccaatagaaagactataaaatgcagtcatgagaactcaaagarcacactggttcaagactgtttaatgtagtggaaacaagccctacacatttcagtacgtcttgagtgcatagctcctctctggccagcaacaggttcacgc

SEQ ID NO: 37390 - DNA, 201 bp, Bos taurus
ccatctcttatctatcaaaaaaaaaaaaaagaaaagttcattcaggtttttccataagaaggtatggcaaaacccaattgaaatttttggccaacccaatrtataaagtctataaaataaactgctgtctgtagaagtggcaagcagctcggcgattcccccttgtttgtgtgggcaagttctctccactctcagtggcct

SEQ ID NO: 37391 - DNA, 201 bp, Bos taurus
gggccaatattctggtttctctttagattgtataaatctttcaccttcttaaaacatgtggactttacaatcatttcaaagttttctatgagatggaaagyaagggaggaagggcccttgaacatttaatgttaatcatatacttcataccatatataaattaatgttcagagtttgttgtgcctctcaaggcctgcacaa

SEQ ID NO: 37392 - DNA, 201 bp, Bos taurus
agttggccagtgattacgattgtttgagccccaaagaaaccttcaaggaggccaaactatttaataccttcttcagatgtagccacagaagattggggaaragagaattttccagaactggactggccagattagcttcctctgccagagcaagtcttgactgttcaggccagtaggatttacctacctcgaaggcagtgg

SEQ ID NO: 37393 - DNA, 201 bp, Bos taurus
tactgtatggggcatttgttaccaagaggaccagtttcactggaaggagtgggtccttgattagctcatcaaggaggccaaatagatggaaagaaaataayacatgaagtcaccaagcctgggagacctgagccacgtagagagatgagagccctctctgtgtgagccctctgtggcctggagctgacaagacttgctgat

SEQ ID NO: 37394 - DNA, 201 bp, Bos taurus
atgcccacatctggacgccgactcttcggggccggctgagcgtccacctgcccctctgggcgccatgaccggtgccccttctccaccccctgccctttctyatcgctttctcctttatccccagaggaatttggcgtattgagttacttcatatttcttctgaactctccttttctctagctttaaagattaagtattttt

SEQ ID NO: 37395 - DNA, 201 bp, Bos taurus
aaagcagacctaatgaggctcacagagcctgatgactcgtccaaggtcgcataatgggcaagttgtgtaaacaagcaggaacccgggtcttctacccacaragtgtcttgactggcttatgcagtattatgggagccattgagcctcctccaggctgaaacatttccactcttctgagcatatggtacaagcttgagacaa

SEQ ID NO: 37396 - DNA, 201 bp, Bos taurus
aactgtgctcaagagttgttgggaatccaaggagggttttctttacggtacttggagccacctgtctcatcctgccgtgggccctacagcaggccccaccrcaccctgtggtctcacctagggcaccaagaagctgggttcttacagcccgcacggatgaaaacaaggcctccctgaaggagagcccagatgcagataaca

SEQ ID NO: 37397 - DNA, 201 bp, Bos taurus
cttgcatcagagctggcgcaggaggccctgccagcacacagcagcctcttttccagatggtccttgcaggctcagctcccacaaatgagacaaccgggggygaatggcacaggcctggtgatccagctccaaccttcttcttgtccaaaagggccccacctgccacctgcgcccaggctccctcttggcccactccatgcc

SEQ ID NO: 37398 - DNA, 201 bp, Bos taurus
tcgcaaaagagtcagacacgactaagcggctaaacaacaccaacagggagaaggcagtttgtcaaatgtgatgttcgcggagcctctgcctggccgtccarcttcgaggcatccaggctgtggaagtgcttgaaaacatccacacagaaatgagtgcaccaaggggcccatggccacaaggtggtaacagccagaaatgga

SEQ ID NO: 37399 - DNA, 201 bp, Bos taurus
gagagtcagaagcagacatgactgtgttcccctgggctactcctaggtaggtgggcccttgctgacccaacaggcagtgataatcgaggaaaggccaaggrtttggctagtatctcccatccctctgctagccttccccagtgtctgtcctagtttctgaaaccagaatgttctggatcacctttgcccaaggccttcctt

SEQ ID NO: 37400 - DNA, 201 bp, Bos taurus
taggagctcaggtctttaagacaaagaccaaatatgtttattactataccacacctctccactgcttgctgtgctagcttcatcctagggggaattcctgytggggtcttctgcaggatgtgcctgccatttgcaataatggcttcgtgctttctccagagggtaggacagtcattcccatgagggaggtgcagcatctga

SEQ ID NO: 37401 - DNA, 201 bp, Bos taurus
cttcctgtgaaccgtggatcaggctgttcttctcacaatggatctgcaaggtgggagccctaggaagctgacccctgggcgctaacgggtaggactggccygggagttaatggacatgactttagggaagtgagggtgtccttcagaactggtttgtgagcttgggggtggaggacacagctgaggctgactctacaaagg

SEQ ID NO: 37402 - DNA, 201 bp, Bos taurus
tcatggggtcgcaaagagtcggacaggactgagcgactgaactgaactgaagtgctaaacaaacaagatgtttattatcatcaatgttatcatgacacctyatatgaatcaataggcctggaagggatcctaatcaggatgaggaattgatgctgtgagtaaaacaccaccaatgaaaataacaaaatgcgaatctctggg

SEQ ID NO: 37403 - DNA, 201 bp, Bos taurus
gcttaggcctttgatatcatggtctgccccacatctaagagttaagagttattcttgccaggcagctgtttttgaagttcctcggaatgttaagcagtgcrtgaggccccattcaagctcttgatcagggaaatggagagatgatcatcgtgaacttaaagctggggctctgggatcagctgctgcctgcctacaaaacct

SEQ ID NO: 37404 - DNA, 201 bp, Bos taurus
tatatatctaagaataagtggaagggcttaccattgagactttaggaagaagaacagagaggttcagggacttgccccaggccacacagtgacctcaggtycaaaggctctttaatcacgcggtcaaggatcagtgatcttagtggcttagtcaacaagatgtactgagcactacaggtgtccaggccctgacctgggaac

SEQ ID NO: 37405 - DNA, 201 bp, Bos taurus
gttcatctgaagctttcctgggctgaaatatctggcagactgtgggcaggaggcctctgtttctcactgccttggcctctctgcaggacagcttgacttayattttgatgcggctctgggctttcaccagggtgagtgatccaaggaagagcagggaggaggccacagtgccttttgtgacacagtcctaaaagtgacacc

SEQ ID NO: 37406 - DNA, 201 bp, Bos taurus
gcagccagcccctcccggcctccaacctctgcgctccgaggcccgggacacagtcagccacagcgcctcccatatgagtaacagcgctttaattaggataytataggaagtggggcccacggcggcttctggcgagaagtgccagcagcaattccggagccgcacgaagatggatggatcgtgtattacaccctgcaccgc

SEQ ID NO: 37407 - DNA, 201 bp, Bos taurus
gaattggcaggacacagccctccaagcagcggcatgagaggggcccttagtaccaggacaagaccacgaagttactccttaggatctaagccatcaaggcrctacacacagccgaggtggggccgggtcagccctgcctacgtggcgctctgaccaccatttcctggctggaaacaggtgcctctgtgtcagcaggaaaca

SEQ ID NO: 37408 - DNA, 201 bp, Bos taurus
ctctggggacctcaaacagccaggaaaggccagtctggtctcttgaagcagaaaggagccaagccctaagaaagcctgggattccatctggtaaacccttrcccctactccccaggcccccaccccctcacctgcctcctggccagctcctgccccctgcctctcactcctcacacgcccccacttcctcttgctcatgag

SEQ ID NO: 37409 - DNA, 201 bp, Bos taurus
catcgtgttaatgtcccatgtcccacctcctcaggactctgttccgggcactctaaagaggactgtaggaactccacggtgctcttggcagggtctgtgaktggcctcctgcttcctctgaggctgaggacccctggagaggtgggtcagtggcatccgctccatccgctctgccacctgaaatgagagtgatgaggaagc

SEQ ID NO: 37410 - DNA, 201 bp, Bos taurus
agcgctggctgaacccctgaccagtgtgcacacactggcagtgccctccgtgaggagcagggtcttaggaggacaggtgagcctgcagaaatgtcctcccraggcctgaactgggagtggggcccctttctcagcactcctgcaggaaaagaggggaaggccgtgaggagtcgagccacagcagagacgtctggtggagcc

SEQ ID NO: 37411 - DNA, 201 bp, Bos taurus
acacgtccaatcgccatctcgtgaggcacaggccaggtgcaccaatggtgccggtgcgtaggggtgtgtgtccacgcacgtgcagggcacacacggcacayaagacttcagagcgacgtcgtttcccagaacgaatgcggagtgcctcctgggtgccaggcacagtgaaggctggggatgccgcagtgacaaggccaataa

SEQ ID NO: 37412 - DNA, 201 bp, Bos taurus
taaaatttccttcaacttttagcagacaagcacataacccaaaatggaagaagccaagttgattttcttggtatatgatgaaagaaatgctagttgctaawagggaaaaaaaatctgaagaaacaaactccatattgtaggagcttaaaatctggggaagaggacgagagctacaaacaggaaaacagttacagaaaatac

SEQ ID NO: 37413 - DNA, 201 bp, Bos taurus
tctatggggtcgcacagagtcaacttagcagcagtagcagcagtctctactttgaaggactgtgtatgtgtgccagggagagatttctgggagggaggcayaggcccagcagggattattcacaggggatatctaatagcagaggtctcttggaaatgcagagccttaattcttctccaaggaatagtaatataacagata

SEQ ID NO: 37414 - DNA, 201 bp, Bos taurus
ggccctcagtccgctcgagagggggcagctggctgccactcgcggccatgccctcaaaggtgccggggacctgccaggaggcgctggcctcgccagaggartagttaggtgtgcttctttcccagcgcagagtgtcgttgttgaaggtcagcagattgtggcaagcgcggcagcggttcaagtggccacgggacaggttgg

SEQ ID NO: 37415 - DNA, 201 bp, Bos taurus
cttgagctgtgagggaagccttgaagagcgccttgtagacgtgagtgcgacgactcgcgcagtcttgggaacgaaactcccggggcctgcgagccacgagrcttccgaggtgtgaggtattatctgcgacccgtgctgtcactgcagctccggagcgcagagccctcaggcaggaggcgcagctggccggccccaggcccc

SEQ ID NO: 37416 - DNA, 201 bp, Bos taurus
ctggcctggggcagaatcaagtctcccagtttgacgcttctccaaatggaggagattcagggctccctgactcccagggacagtggggcaggaaggagggrtataacaacagggggccgaaaaggactaagagcttcagatgtgaacgtggctctccggtggctctgatcgtcttggttattaacagtccttggggtgacc

SEQ ID NO: 37417 - DNA, 201 bp, Bos taurus
ctgttctgtgtcgtcaggtgtcttgcttcaatgagttagagatctgtatccatcctgatggggtcatcccagtgctgactttcctcagggatcacagcaaygcacaattcaaatccttggctgacttgacggcggtggacatccccacccggcagaaccgttttgaggtcagtcaggagatttgaggtttggagcatgaag

SEQ ID NO: 37418 - DNA, 201 bp, Bos taurus
atcaactttacgtttcttcttatgaaatcagcatcatcacaatacttttcacctttactcctccttctctctcaactactgttataaatatatttacataktgctaggtttgggaattccctgacggtccagtagttagcaatctaactcctgggggcacaggttcagtccttggtcgggggactaagattctacaagctg

SEQ ID NO: 37419 - DNA, 201 bp, Bos taurus
aacagctcatttccatcattactgacatatccatagttactgactctccaatcagccggaggcattttataagacacatgacatcccgagcaacatccacrtctgtaagaggaaggtgacattcacgtctcaggtcaatgaagagctgctagttaatattatactaaaagatattaagaatacatgacaggtagctatcta

SEQ ID NO: 37420 - DNA, 201 bp, Bos taurus
ccctgggtgatggtggggaattccagggtggctttggacgggaagtgatctttgaatccagtcttgaagtcctctagtaggtacaagggaataattctcartggctgtgataaaaaggacagtgaattttttaccgggccacattgcccgatgatggtgggaacaatacaacttgactgtgtaatactttggttttggact

SEQ ID NO: 37421 - DNA, 201 bp, Bos taurus
acacatttgtgatcataagtattgatacatgtcttcaaatgtacaactttgagccagacctgggatgtaatgagccttctgtgtagctctttggcctcccwaattactttcaacctgattgtctttatcacattcagttcagttcagtcactcagtcatgtccgactctttgcggcccccatggactgcagcacaccaggc

SEQ ID NO: 37422 - DNA, 201 bp, Bos taurus
ctccttcctcatgacctttgccacgggtggagtacctcacgctggcccccaacatcttacctgtgcttctatttcctcatctgtataaaaaaagcagtgaytataataatatccacattacaggcctgttgtgagaattaaatgaattaatgtatgtatagcaaatggcaagtactattgcaatgctagctataattatta

SEQ ID NO: 37423 - DNA, 201 bp, Bos taurus
tctcaccgtatttttcattgacattcatcctaaggttttttcacttggtaatttctccttctgcctatataatacattttcccattatagtctcagtttakaagttaattaataagtacagagacacggttgtccttcaaaagaatgttcctgtgacctcacaccagacaccattatatccacactctagagtcaagaaag

SEQ ID NO: 37424 - DNA, 201 bp, Bos taurus
gttctcactgtcacctacttgaatgactcttggggtcttacacagccaggatcctcaatttgaactctgttcccatcatgagagagattcacatgcctcartttattaacatgattaactccctgtctcactttattaatgttgccaaaatcttggcactgcttctgaatagaaatatggagacagggttttggagaaaag

SEQ ID NO: 37425 - DNA, 201 bp, Bos taurus
actgggccacctaagaagcccatctttaattctgtatttttcaataattaaataagacaatgtttaaacatttctataccatcattcatttgagaagaccrctgtggacttgcatacttaatgggcctgccctagagataggtttaattaaaagacttgcatactacaaaaggaaaattagccaagaataaaaaaaaacag

SEQ ID NO: 37426 - DNA, 201 bp, Bos taurus
tttgagccaaagattaagagtaaccatttattggaaattgaggcatggccatcttagtgagtatgtttctcctgaggactctcttcagtgcttgttttacrtatttgttcctcagagtgtagatcaatggattaagtactggacttacaaaggtgtagaaaacagctattatcttggattcttccaccgtcttgtctgttg

SEQ ID NO: 37427 - DNA, 201 bp, Bos taurus
cgttgattgacaagatgaatgaataattggatggatgaatggataaagaggtaccactgcatccccaaatacttgcaagaggcctggaaccttaggaatcmacacagtctgtcatttttagctttttcctccaatttccattctagataagaatttatgccctagaaaacatccttttcaacacggccctatggatggtat

SEQ ID NO: 37428 - DNA, 201 bp, Bos taurus
ttcaaaagaaaaataagccaaaggaagcgtgaatgtataacctctttttgatcctagctgtgtgtttcagctctttgaatcagagaggcatactaaagaaraataaataaatgcagcaccttgaaagaaaacaaagcagtgtgcacagatttcaatacaactccattgtgacttaagtagctgttttcctgcatctcataa

SEQ ID NO: 37429 - DNA, 201 bp, Bos taurus
tccatggtaggttggttacatttcttgaccttggagaagtggccctctgtagaaggcaccctatgcttccacacctgccacccaaggggtgatctgcctgyatctctgggctcagtctgtaagctgcagggctgcaatcttcttgcttctgcaagaaaacttttcttttgcctggtgagtgaggcagtctggagatttatg

SEQ ID NO: 37430 - DNA, 201 bp, Bos taurus
caaatgcgagaggaagtggaaggaagtttcaacaacaaatttgctgcattttgctcttaatagaagagacgctcctccagcagatgcccctggcctatcartccagtcctctgaacctggggacagcacaagatgggcagaagtcttacgagagctccctgtcctgctccttcccggggcctgcacttataccactaaccc

SEQ ID NO: 37431 - DNA, 201 bp, Bos taurus
attaaacttgttgaaaaaagaaagacatggaggcccaagaagagactatgaccgtgccccaaatttgaagcaaatttgaaggagaattgggcatggcctartatctctccttgggactccttcaccctgggttgcccaagatggggagagcatccaattctcattcttggggtcatcctctttccacttcaaagggccagc

SEQ ID NO: 37432 - DNA, 201 bp, Bos taurus
cctgagctccagcagaggagcgggaagccggaactcttcccttcaaggcgttttggcagcacgtcaagtgatggaggcccggaggacgggtcgtctaccaycgagaaaatccgagagcgttacgagaacggaggcgatgtgtgaagtgcctcatcagaaggaacgtctgctttgtccgtagacagaggagggcagacaccg

SEQ ID NO: 37433 - DNA, 201 bp, Bos taurus
ctccggaagagctctcgtcactggacacaaactctttgctcttgaagctctcgctcagctgccttgatgaagacttcgatgatgagccccgggagggtgtrgattttttctccatcttcactttgactttcttcttcttcttggacttgtccctaggtgagcaagagggaagggggtgctgggccctcaggttccccacat

SEQ ID NO: 37434 - DNA, 201 bp, Bos taurus
ggcccttggaaatgaaggcatggaatccaggggagtcccaggttctggagtcctgatcccaaccttagagtcaccgtgcggcccccatccccgccccgctygaatggtgtgactccaggaaagtgactgtgtgcccctgcgcctgttaggaatggagttaatatcagaacccacgtcctgagtctgagaatggccactggg

SEQ ID NO: 37435 - DNA, 201 bp, Bos taurus
ccttcaccccaccggcagcttcctcaaacaaaacagtaagaggatgcccaacacagtaaacagatttaagggtggcctttgtaggcttggaggggctcccrgagcaccccagatcagtgtccaacccccttcctaagatgatcctgaagcatatctcctgggccctcgggcaccaaggatgccatctgaaaactcccagac

SEQ ID NO: 37436 - DNA, 201 bp, Bos taurus
cagggggcagcttggtgagaagatgtaaaggggtatcggctgctgaccctcacccggccatcagccacggcggccaaccctggcctgcgcagagaagactrcaggaaaccagagacaggctcagccagcgctccacccgtcctcactaagcaccaccccccacacaagggagagccagggtaggggccgggctgccccggt

SEQ ID NO: 37437 - DNA, 201 bp, Bos taurus
gataactgatattgaacgaatttgccttgtctggtcagggagacaagcatctgaggagttgtagcattctgttagaaacctgggcctcccccttccaccaycttttttttttttttttttaatgtggaccatttttataagcctttctggaattcgttacagttttgcttctgttttctctttggggttttttggccgcaa

SEQ ID NO: 37438 - DNA, 201 bp, Bos taurus
gtctgtgttcagacagtaatatttccttttatcttttttcatctttcttctcaattctcaatgacttatctttttctgttttaactgttactaatggtcayctccgctccttttatttccataatattttattcaccgctcactccgatacgtctttccttcagttgttctaaagccttttattttcctcacatccaaata

SEQ ID NO: 37439 - DNA, 201 bp, Bos taurus
cgctgaggactgagtccctccccaccggagccttgccacagactgtttgggcttcctcatgccatgggggctgggctccaggaagcaggcagaggaagccrgtgttaaggcctggaaaccgccacagcatcgctcccatccttctctgctgtaacacgcttccctggtggctcagacggtaaaaagtccaccgcagtgtag

SEQ ID NO: 37440 - DNA, 201 bp, Bos taurus
aatgaggaatgagacttgggcaaagcagaagagcagggaagaactggtgaggaggaaggagcaagactggccacatggccgctcccgccacttagacctgygctcctggtggcggcacgtccttgactgaagtttaattctggtggtggtcctgggcacgtggtctgccttacatccctgcagacaaggtggggccagtaa

SEQ ID NO: 37441 - DNA, 201 bp, Bos taurus
cgattgcttctccgggccaggcatgcgtcctgcttctcttttccccaaggtttctccagggttaaagatgaaaggggaaccttgatgaagctcctgacccygggaggtggccacaatgggccttgtctttcccttggtgaataggctcccgtgtacccttgctgggtaaagtgtgtggtgtggggagccctgtgttcacag

SEQ ID NO: 37442 - DNA, 201 bp, Bos taurus
gcataacgctagtgatgagcatacatggggcctgaatctattttctatgtgattagttaccagagtgtaaagtgtacatacaggccttgagtatatttcaygttttatgtacaacaaaatgatataaaagctaagagagtgcaaatacccaaatgggacgggcctggcagagctgctgggaaacgtgcccacactcggtct

SEQ ID NO: 37443 - DNA, 201 bp, Bos taurus
taatattcagaatatacaaaaaactggcctaactcagtaacaaacaatgcaattaaaaatgggcaaaaggcttgaatacacagttcttcaatgaagacacmtgcatggccaacaggcatgttaaaagatgctcaacatcactaatcataaggtttacaaaatcaaaatgaaatgttacctcacacccattaggatggccac

SEQ ID NO: 37444 - DNA, 201 bp, Bos taurus
tcctgactgctttttacatgtattacacttgctcaaaacgtggatggaatatagaagcttacctgtctcttgaaaatagctgcaaatcctgaattttcagkctgatctaaagctcttcaagggtagaatttaaaaattctgtggaaggagctctctgtgtgatgctaaccaaagggtgtccttataattgtcacttacctt

SEQ ID NO: 37445 - DNA, 201 bp, Bos taurus
ttaatatatcatgttcaagacttcaatagtctcacaggtaataggatacatagaacaagtaattcccacagagtgggatactgagaaagtcctctataaaraataaagacatcagagagtaaaagtttaaagtgtaagtccagactaagaatatctgagtgcaaattctatctccgccttgtatgagatgaccgggtattg

SEQ ID NO: 37446 - DNA, 201 bp, Bos taurus
aaagatcaaataaaggctttaaagcaggtaaccatgtttggcccagggtagatgcttaatgaatggcagctgtatcagtaatagtaacaatattattgtayactaggccaaagaagagagagagggacctggggggcacagggcgggtggtaaaaagatggactgattgaacgtgtgtatgaaataggtcacatcaggcag

SEQ ID NO: 37447 - DNA, 201 bp, Bos taurus
agctcctcctaaaataggatttgctttcatatttgtttaacatttcattatgcttatttttacaggatactttgtttcaaagcaaaacccagaggtgcttrgaggtaaatacaatcttgattctcaaattggagtttaaaagttatctcagtaggtatttctttcactggcaataagtaaaaacattaaacttacatagat

SEQ ID NO: 37448 - DNA, 201 bp, Bos taurus
tggtgcgctccttttttgggccgtcaccttgcatttcttcagcagctgacagtttctccagtttttcaaagtaattctaccacacgagaagacggtttcakttgcagcaagcgcagcacacggccgctctttaccatgaagcggcttataccagtggcagcgatgctgctcgtgctctatatgtactggcttttaactttt

SEQ ID NO: 37449 - DNA, 201 bp, Bos taurus
tactcagacacgggcatttcaatattcgcttacacaataagaggccagccacaagcatccgtttctgcaaaaattccctggtcgttaaaaatctgtggccrgactatctgacagtgatctttttattttcacaaaatcacacttctttttatgcaattgagtttcatatgtttcggtatcgcctctttaaaaagtctgtaa

SEQ ID NO: 37450 - DNA, 201 bp, Bos taurus
ggcagtgttccttgggaggtgggcagatgggtgggccttggtttccacgatcaggtctgagtctaccctcaagcctttaaatagcagttaaccttgggccrgttcctgaacccagctgggctttaatccctgctctggaaatcaggaacagcagaacttacctttcaagcctggcccgaggatcccttgagatcacgtgag

SEQ ID NO: 37451 - DNA, 201 bp, Bos taurus
gaaactctggaagagggccacagggtgaacccagagtaacgttcttcccttccgaggtgaggaaggtttttgcagccctgagttgtccttcacgcctgtaracgggagtggtgcccctggccgcggccaccctaccgtgtgatctatgatctcccctccgtttctgtcgtcctttcagccctcacagatggaccctcacct

SEQ ID NO: 37452 - DNA, 201 bp, Bos taurus
ctcaagtattctggcctggagaatcccgtgcacagaggagcctggcaggctacagtccacggggtcgcagtgtcagacatgactgaacagctaacactttyactttcaagggccaccaaattcaactcaactccttttattttatgccagaggcaattcagcattaaagagataaaaatcctgttctcccagcaatcccac

SEQ ID NO: 37453 - DNA, 201 bp, Bos taurus
ttttcagcagtctccagccctgttggtttgaacgtctggaagcaaataggaaagacaaaaaattatggttgaaagaggttggtcagcaggctgcataataygggcgaagcactgtgcgaggtcaaaacagggaatcaagaagggctgtgcgtgatggcctgtttggtcatccttcttaaatgataaataccccattctcag

SEQ ID NO: 37454 - DNA, 201 bp, Bos taurus
ttactacctattttaaacatatgtttctcctagaatcgttattgtggttttttgggggggggcggtaatattgggaagacccgattttctgatgctactamcttatacccacagttgcccagaaacctggggaaaaacgagctggttgttcacaagtgcactttaatttgctcgactgaacatcccagagctagtaggtgg

SEQ ID NO: 37455 - DNA, 201 bp, Bos taurus
agagaccagggagacagatatggtgagaaagccatgctctgttctaagacttctcagtacaaggcatctccacgtggaaccatgcctgcccaccagaggaytgagacaacaggaaagtgattgaagttaatacaagaaacagattggtttaagtaagaggaagagaaactaatttctgttaaatatacaccatctgtcagg

SEQ ID NO: 37456 - DNA, 201 bp, Bos taurus
acagacacagaacgttgtccccctggcctgcagctcttgagccccgccggcttcctggggcgcgcctcctgctcctgctctggaggggaagcgactggccyggtgacacgatgtagctgatttccgagccaaaagtgacatttgggatggtctctggaagggggaatgttcagtggaagggtaacaaaggccttcagggga

SEQ ID NO: 37457 - DNA, 201 bp, Bos taurus
ccctgtggacacgatgcggaaggcagcgcagctgggcttcgggggggtgtatgttcaaacagatgtcggaggggcgggcctctcgcggctggacacctccrtcatctttgaagccttggccacaggctgcaccagcaccacggcctacatgagcatccacaagtgagtgccagcccggtggacgcagcgtgtgctggcgtt

SEQ ID NO: 37458 - DNA, 201 bp, Bos taurus
ccacgtgacgaagcatccactgagaggaaaggccactgctctggggaattggggggggcggggccgggcagcctcctcccacatgtgcatccagacccccrggtgtgcccaggggtgagtcctctgcggggctccaattcactgccctgagttgcaataaagccacagagttgattccaggcctgcttggcagtgtctctc

SEQ ID NO: 37459 - DNA, 201 bp, Bos taurus
ggcctggcggggcccagcctgtctgggctgcaggcggatcaagatgcatgtgatggtggctgaggagcctccgtttattgtcttcggggacgttcgttacratcctggcctgcttgagaccgcctgattgattcgtgaggctgaggcgaggcggttccacatgagtctctggggtgcgtggtctcctgcctcgcagagcgg

SEQ ID NO: 37460 - DNA, 201 bp, Bos taurus
gcctgccgtaggggggctgtttagtctgtgtcttgccctcacttccctccgcccttctcgccagtggtcctgctttgctctcatctctggagcctgacccrcacttcttggccacagctcagctctgtgagcagcgtctccgcagggagcatgacatctggtatggccgggggcccgtctccctcgcagcctggagttccc

SEQ ID NO: 37461 - DNA, 201 bp, Bos taurus
tcaggtgggtgcctatggcctccttcgtccccagaaggggcgcccctgatggcacttgtgacctcgtggacacacaggcacatttctgaccaactgctgcrgagcgatagggccaccagggggcacggggccccagcagggtccccaccctgccccgtccggccgcgctccaaagcaagaggccatggctgaggccccgtc

SEQ ID NO: 37462 - DNA, 201 bp, Bos taurus
tcctcttgagatgacgggggaatcttgtggtttttttcgagctgtggggcgacgtgtgttgtttccctcaagttatgacggggtattcagggagcctctcrtatggccccagggaagtccagtctccattcaagttacgagggggagcacggcattgctctcgagtcacggcatgggaatcgggcctcaagacacgttgaa

SEQ ID NO: 37463 - DNA, 201 bp, Bos taurus
atcttgcgatgacaggggaatcttgtagtttttttcgagctgtggcgagatgtgtggggtttctcacgagttacgacaggaaaatcagggagcctttcgtrtggccacagggaagaccagtctccattagagttgcgagtgggagcgtggcattgctttcaaatcacggcaggggaattgggtctcataacgagttgaagg

SEQ ID NO: 37464 - DNA, 201 bp, Bos taurus
tctttggggccagcctctcaccctctgttcttggcctcatggaggagagtgggctggaaatgtctctcagagtgtctgggcctatcattgtgggaaaagayccctcaaagggatactttatacatgggcattcggcaaagccaggacaaatgccctggcatcaggccccaggatggcgtgagctgggatcctagaagccag

SEQ ID NO: 37465 - DNA, 201 bp, Bos taurus
gcttcactatcctcatagcctttcacactgatgccagaggataagtaagtctatcctaaacacccttcagtcatatcactctgctgtgcacttatgtagcractcccccgcacctctagatctgagatccaagtccttggggcaggacaagaggctatcgtgactttttcccataccctctccccttctcaccagtcttga

SEQ ID NO: 37466 - DNA, 201 bp, Bos taurus
aggagcctggaagagcctgagtcaacactatcgctgacattgcttctatggctaaagatggcccagccttcaaaacatgactccaatccttttctcctcamctctcttctcctttcttatttcatctcccatgcccttctctccctctcttcttcaccattttcactttatttattttcctttcttctttttgttgctatt

SEQ ID NO: 37467 - DNA, 201 bp, Bos taurus
cactaggctacaggggtgggcagggctctccctggttccttcagtgatgtcttcgaagggctgcccaccccgcttgcctgcggtggggccccacatggtgyttcagtgcctcgacgctattgcttcccctttgtctggggcagtcatctctctgactagctctcagcacagccccaggggtgatgaggccttagaccatga

SEQ ID NO: 37468 - DNA, 201 bp, Bos taurus
gccttgggggagaagttgagagggcttacaaaggcttctgtcttttcctgtgctttctgttgattcttaatgatggaaaagtcagaatggaacagagcacyggcctggagagggccagtgactaccttgggtggaaggaaggaggagtgactggcagaggatgtctgggacctggcaattccttgactacttagtggttat

SEQ ID NO: 37469 - DNA, 201 bp, Bos taurus
ccagttctttttccctttttcaagtctttatgaatttgtaacaatagtgcttctgttcagtgttttggccatttggcccctgcagcatgtgggaacttagygccctgaccagggtctgagcccgcatcccctgcacaggaagatgaagtcccaagcaccggcccgcagggaggcctctaggcccaggccttatctccagcg

SEQ ID NO: 37470 - DNA, 201 bp, Bos taurus
atagaaggcgccctcgggccatagaagaaagcctaactctctgatgctggcctttttttctccttacaatgctgaacggagatgaacgcatcggggcctcrtgtctagatatgaattttcctttgtgcagcgctagtcatgatgggaattccatagcaatttatcaccgtaatgactacagattctagagcatcagggtga

SEQ ID NO: 37471 - DNA, 201 bp, Bos taurus
accagatgtgtaaccttggacgagtcactgatcctcaatttcctcaacttaaatgaagataataagtacctctcaagtttgccatgagattacctcacacmggttagaatggccatcattgaaaaatctacaaacaataaatgctggagagggtgtggagaaaagggaaccctcttgcactactggggagaaggatatggc

SEQ ID NO: 37472 - DNA, 201 bp, Bos taurus
ttcatactgacccatcattagcctcttccacactgctgagcacttggagtataacctcagttctctgtgtaatggcattcttggtctcttgcatgataagrtgttccacatctgtcatgcatatttcttgttctagatctagaatcatccacttttcaaaggagttctgcttcattttagtgagaaatggtatttagagag

SEQ ID NO: 37473 - DNA, 201 bp, Bos taurus
ggccctcatggcagcgcttgagctttcctttttcaagtcccaccgatcactcctcaaagaaacagaaacaaaaactagtttctactctgatggaaacagayggcccacttcttacgcagatgtgctttcaggccctaaacacttgccatgaataaaaacggaatcaaagatatgataaagatacatccttagatcataaaa

SEQ ID NO: 37474 - DNA, 201 bp, Bos taurus
gggaatgagaacctaatctgccttttcttaactaacccatcacccaacaaaactacagttatcccatttcaaaaataaattccaaggaaaaaattctgtaygtggaaacaagaaagcactgagagtgaggaggggaaggcagtcctagaaacgttgatttcagtgataccagctctgtcttgcagctggagcaagaggttt

SEQ ID NO: 37475 - DNA, 201 bp, Bos taurus
gtgcgagtttggctctgggaagtgctttggagcttctccatccagccactgagctggtcatcgtcagttgtataaaatccaccttttgttgctcatcccartatgatcgagaaatggttcgttgttgcatagtatgagagaaaacaacacttcagaacagtgatatttttgatttttggtcagatcacgaggcttccactc

SEQ ID NO: 37476 - DNA, 201 bp, Bos taurus
ctaaggccttaaggcaggatcatgcatggcctgttaaggaatagctgtgtgattggaaagggtgaatgggagttgttaggggaaaaggccagggatgtgayagggaccatatcatccagggcaattagctgctgtaaggattggtctttactcttgttatagccacacattctgggaaacaagctcactcagaaggacaat

SEQ ID NO: 37477 - DNA, 201 bp, Bos taurus
gaggggtggggtgagtgccttttgtgtgtgggagggatgtgaacactagtggccagagggcagaggtagccagcctccacgatggcccccagtgatcctgktttcctggtggtcacacctttgtgtagtttcttgcacactgcaccactagcataaaagtgatggcatgccacttccgagatagcttatcaaagactatgg

SEQ ID NO: 37478 - DNA, 201 bp, Bos taurus
agttggtgatagacagggaggcctggcatgttgcagttcatggggttgcaaagagtcagacacaactgagtgactgaactgaactgagggccaggaaagcrctgtgctctttgacctattccagggaggaatcaagaggatcaaggcaacagcctctttggtgtatctggtctgttctgggtgggggacgtttctggagcc

SEQ ID NO: 37479 - DNA, 201 bp, Bos taurus
aataggaggtaggaaagcctacaactgcaggtaagggtaggagagccttgtgtgctctcgagtcagggtaatgcttcactgtgtgtatgtgagcacacgtrggcctgtctcccttgaaggaggaaatgccagcccgctccagtattctggctgagataatgccctggtcagaggagcctggtgggctacagtccacggggt

SEQ ID NO: 37480 - DNA, 201 bp, Bos taurus
gagtccataaaagaccccgagcctccaaacttttctaattattcataaaatatatttgcacgtcctgtaaactcaccgttggatgaaggctctgggcctcytagtctagatttggtctgatgagaccacctgggaaaagacagagatgctttcctcccaagagattctttcatctccttggcctcccaagggttaaccaac

SEQ ID NO: 37481 - DNA, 201 bp, Bos taurus
cctcgggcggggggctgggagccagcctggggtcgggttccggggagagcggtgcggggaacctggacgtgcctgatcccgagggccgagggaagaaggarggcagccggaagcgggggtccggttcccgcgagctgtccgccgccggctccatctcccggtgtcggcagtctctcacggaggtagggacgcggagctcga

SEQ ID NO: 37482 - DNA, 201 bp, Bos taurus
ctcttcttactttgtattattgtattttgtttatgtatctattgtctgtttgacccccattgaaatataagtcagggtttttaattgaccactcttttctrttgcttttattgaccactctattctattgcttagtaagtagtacctggttcgtatctgacacagaatagacactatttgttcagtaaatgaatggacata

SEQ ID NO: 37483 - DNA, 201 bp, Bos taurus
ctcatttcagaaatgttaaaatatgtataggggaagaagggagatgcatattatgatgaagagaaaatggtaatcaggagacagtcaaaccaatggcctamttaaattcatcagtaaatgcagtcagcatgatttattgacctgttctgtgatagagaacctttttaggtgagaggtttttgtgtgttgatggacacactg

SEQ ID NO: 37484 - DNA, 201 bp, Bos taurus
ctgggtgtctcctgggacatggggctcagctggtgtccagtgcaaggcaggccctggatcccttgatgggcgatggcgagcagctcaaacagctctggccyagaacgccattgaccattgctaccctctcccagctctggcagcatttaaagtcctggtctcaccagccctgggacttggtgaccaggcctgggaagggcc

SEQ ID NO: 37485 - DNA, 201 bp, Bos taurus
tcagaatctgatttttatcaccatttttggagtctcagacaaatttaggatattaaacatgcaactttggaaacacagggcctgacacagaaactctgaaragtttaagaactcaacgcattctacacctgatattcaaatttgctgtcagcctctaaatcagtgtttctgaaagtgtttgtggcccacctgcatcagaat

SEQ ID NO: 37486 - DNA, 201 bp, Bos taurus
tgccggtaggccccgctgctgatctgtttcaccagcatcttgtggtcctgcccatcaaagggcatggagccatgcaccaggatgtagaggagaacgcccarggaccagctgtccacctgagggagagacggggtcagccaggaggtcctcatgccgcagggcaaacggctccaggctccccttcagtacccacggagggga

SEQ ID NO: 37487 - DNA, 201 bp, Bos taurus
caactgcttcaaattgcttagttgttattattttcattggaggttcagtcacacatttggtaatgccaaaaacaactatcttgtaaaacaaacaaagtacraaaaacatagctagccatattattaaagtcttaagtaagaatgaagccagaacttacactaggtgcatcccagtatattctcaagtcatctgacttagac

SEQ ID NO: 37488 - DNA, 201 bp, Bos taurus
aggcggcttctccaccacactttcttccccttccacagctgaccagagtcagtgagactcctcacacctcatttgccagttgctccactgccgtcatcaayggcccacttccaaacatgttcggcattggtgtctgctccagtctggaagagaaagggagctttcaagactcacccaactcagcagtccaaggagaagacg

SEQ ID NO: 37489 - DNA, 201 bp, Bos taurus
cactatgaccatcccacagatgaggaaaatgagactcagagaggtgacatgactgtcctaagatcacacaagtttctcttgagtacctgagaccaggccaygggaccctcaagctcagattctttcacgatgtcatccttcatgctgttatgcccaccgaccttcctcggccttcccaggacaggcctttgcccttttctg

SEQ ID NO: 37490 - DNA, 201 bp, Bos taurus
ctaaatagcattctttaagagtgatgatgttaggtatactttgctcatttaactagaaaagtaaagagcggatagagttaggttcctttggaggaagtgtytagaatttattacatcagaacttattatgtcagaaagaggggacttaagctaagtatgatgactaaattgggcacgtgttgctcccatttttctccttgc

SEQ ID NO: 37491 - DNA, 201 bp, Bos taurus
tgcaagtatgctctctgctaacaaaatagtaaacgcctgaaagattgtgaccataccttatattcttttgccattccctcattagttcaaatttggatgtrgaacttactgactaaaaagttgggtcatgtggaattttcactaaacatgaaaatctataaattgatagtaaaattaacacagagaaatcttaaaacacta

SEQ ID NO: 37492 - DNA, 201 bp, Bos taurus
tgtttcggttctgttgtccagagctgttatctgttggaggactccctgcccattttgtaagcacacagctggcaggccctgttgcaatctcgctgccttcsgatcagccctgccccggcagcaggcaggcagggggtgggggtggggggcctgggaaacacgcggccaaacagttgtggtgagtgtcaaaataaaagcccc

SEQ ID NO: 37493 - DNA, 201 bp, Bos taurus
aggtctcagggtcccacctggccagactcaacgcttctctgacagagaagtcagagctggagaaaccctgaccggctgtgcagctgggcccacagagatcyggggaaacgtgactcgtgtgggaaagactccgaggtgagacagcaaagcgctgggcacctccctgaccaaagccagggtgtctccctccccccaagaggc

SEQ ID NO: 37494 - DNA, 201 bp, Bos taurus
tttgaacagcagatttagcatttttttccctttttttcttcttagcaccttcttacatttttctctttttcatggtgtttggtttttttgctctttttctyccatctattttcaaagaatcttatttcagagatactcagtaagtagaattttcctctgtgtgttactattccttgcagaaaaaggtgacgtaaaataaag

SEQ ID NO: 37495 - DNA, 201 bp, Bos taurus
cagcccaagagagcaagtgaaccccaatgagatttggcctttgccccctcatgtccaaggcaggaacagtggaccaaagtggcaactctaaacattgggarcaactacaacctggaataaggccagatctgacactgaagtcaccctacacggcccacagcaggtccagagacctttctagaaacattagaggcctttggt

SEQ ID NO: 37496 - DNA, 201 bp, Bos taurus
caggctgtcacagcaatagaaatttatttttacagttctgaagcctggaagtcctagatttaggtctgatagcattcagtcacatggccttccctctgcayatgcatgaggttgagagagagtgagctctgtgatgtctcttcttataagaactctaatgctagtgaatcagggcccctcctttatcacttaatttagcct

SEQ ID NO: 37497 - DNA, 201 bp, Bos taurus
agtgggtagcctttcccttctccaggggatcttcgcaacccagggatctaacccaggtcttctgcattgcaggcagattctttaccagctgaaccacaagkgaagaccctgaggcctgttactgagtcctatttgagccttaattcttggtagatcatacagggatcttgtctccagagagaagggcagtctggggtcttt

SEQ ID NO: 37498 - DNA, 201 bp, Bos taurus
aaaaaatggccacagatgcttcctgtccttgtatctacatctttaagaatccctccaatttgaggtagaagctttcttcatcctttgagtttgggctactytgtcatttgctttggccaatgggacaaaagtaacaaatatgatataagcagaaccttgcaaatcactttgtgcattagggttccccttgttgctgctctt

SEQ ID NO: 37499 - DNA, 201 bp, Bos taurus
tctcactgcggtgacttttcttgttgtgtgtcacaggctctaggtcatggcctcagtagttgtggtatgtgggctcagtagctgtggcttgtgagttgctrcatggcatgtggaatcttcctgggccaaggatctaacccatgtactctgcatcaacagatagattcttatccactgtactacaaaggaagtccgccaaat

SEQ ID NO: 37500 - DNA, 201 bp, Bos taurus
atagacttactaaaagattgatatgtattatttcaagtgttggaattaagatgtctcctggacaccttggattaattagagaacattccagtttagctttmaaaggggtctatgtctgtgagggagttatagacccagactgccaaggagaaatatgggtaattttacaaaaggaaaaaaaaggatgatctatttatcaat

SEQ ID NO: 37501 - DNA, 201 bp, Bos taurus
tggtggctgccagcccactcatatgcaggatgaagtattgatagagctggcttcagggcctaagtgtacttgagctggtgatatcacacccaagagcaagrtgagataccagtgtagcagctgtggagcccagtggagtctggggttggtgctgtcatgctgctgagttgttaagcctctggtgctagtaagctatgtatg

SEQ ID NO: 37502 - DNA, 201 bp, Bos taurus
agagatttcaaggattcagcccactacaaacccaagtatttttatccttaagtagttataacctaaggaagaaaaggaagatgacttcatttcttctattkgactagcaactcagagtctttaaggtttgtaccaaagaaagaactcgggaccgcactacctcttcattcaggcagtgaatggaaataggttcctagtagg

SEQ ID NO: 37503 - DNA, 201 bp, Bos taurus
tctgtagtttaaacattgaatagcatatcttcttggtcatcataatcaagccatctgtgttgttctgcatagaaattggaaggaaaatctagaagtacacrgtgatttcctttgacagctttagagaggtataatttacatgccataaaattcattcatgttaagtgtagaatacaaccacgttaatatatttacaaattt

SEQ ID NO: 37504 - DNA, 201 bp, Bos taurus
cttttgaatatgctgtaactgaaattcagagcagattttggtttttctctttcgcaagccatttatgtgctcacaaacagaccaaactcactatcaaaatrgcctatttttacaaacaaaaaattacaaagactatttgaatgtactctctttcacattcttatttggctattatttagataaatccattgaaatgaaagg

SEQ ID NO: 37505 - DNA, 201 bp, Bos taurus
tcatggttcattagggaacttaaatgtgtttctctcttttcttttaacacagagagtttctctctgaaaaggctcttaaaattttaatttttattcccttrtatttctcttgctcttttattccagtgtcccaggagacttttgcttttaaaaccatatagctttactacagtatcatttgctattagtcattgcaagttg

SEQ ID NO: 37506 - DNA, 201 bp, Bos taurus
ccattccaagtaattaacatgatttccttaatccttctatcctaccatcactccatcattctcaaacacatcaccacttcctcaaaatcagactgaaaacmagctgacaaactagccaatatattggagcttcacttaagttattctcttccacctacccaacaaattgctattctctgtgatccttccctgtagttaata

SEQ ID NO: 37507 - DNA, 201 bp, Bos taurus
tggtgctactgttattgcttaaacaaggataaagcagataatgaccagggagatacttcattgtacattatcataagccttacattgataaaccctgtagyacacactcaagggaagatgtcaaatagatcacaaagtggtacttgatagttagcctagtgaccatgactctatttgtaaatctcctgcacagctgggtca

SEQ ID NO: 37508 - DNA, 201 bp, Bos taurus
ctacatatagctaatgctatcacggaccacagaactttactgacacctagaacacaaattttctagcagcttcatggctgggcctcttatctatcatcaayagtaatgttctttgcatctgactgtaaaagtttccaagttacacagtctttccttgatcactttggcccaatttctcctagatcactatgcacaccacag

SEQ ID NO: 37509 - DNA, 201 bp, Bos taurus
aatgtgaacaatttaggggtaaaattgagcttcctaggcttttttagtataattccatgattgtctagagatttgcatcaaaagatcaaaatgaggaggtkattatgcgcaggttcaaaatttcaatcacaccatccatgggtggtctcagtaatgagaccctcattgcctaagggaatgaaaatctgcaggctagtttct

SEQ ID NO: 37510 - DNA, 201 bp, Bos taurus
gacctaaccaatggggataaaagaaacactaaaacgcatgccagttttcaatgtcagagacccaggaccctcctacctggttagagcttctgctaaattgmtcctcttctgcatttcttcctagatcactgcctccccaggatccccagttacactactgtacttaccaagttttctatgagactttgttcttcattaaaa

SEQ ID NO: 37511 - DNA, 201 bp, Bos taurus
agactccacatctccttgggcctgcctgcaagggagcttccctgtgcacggaaactcctcctgtttcaggactccctccctccttcggggcaaaaggtccygcccagaacttctctgtctttcccctttttaggtctccatcctctctcctacctcttttcacgttgcttagactgttaccctggaggcctgggttcttct

SEQ ID NO: 37512 - DNA, 201 bp, Bos taurus
ataacccactgttaattatagttaaacttccccaaagcatcctatttgtatacctttccatgtttaactaatctgcaatagggatattggtataagcttaycagggcaagtcaactctgtgattccctgcatgtttaaatgcagtgaaatataaagaatgaatgaaacatgaataaacaatatcatcatttaagtctctgc

SEQ ID NO: 37513 - DNA, 201 bp, Bos taurus
tgagaagacatatactacaaatttttttcatgtgatattaagtacaaaatgtgacatgagtgatcaaaactgtgaaaaatcttaagcagtcagcaaaggaragaggttctatctaaatatcatgtttctttaatattattacaaacaatcaagatacaggttagtgtgcatacagttaagtatagttgtgaaaaatgagag

SEQ ID NO: 37514 - DNA, 201 bp, Bos taurus
aaaggagaagggatgggggtctgggactacagaggggaggaatacaatttacagggagatgggaagagccagtgtctggaaaataaacatttatcatgccrtgtagagataatgggacaagaagaatttcttgagaatcaagaacaatgatagattttttcttataatatttagtcttttgtcttcaattcctagaaaact

SEQ ID NO: 37515 - DNA, 201 bp, Bos taurus
acaatactttttgttggatgtactgtgtatagctaagcactgctctgcttatatatatttataatatggtcatacatttatttttaaccgtgctgattttrgatttagccaaaaatccaaatgttaggcagtgtaagccttagttttttcagataacttattagaaagaaaaatgatttggagaaaggaggaatgatgaaa

SEQ ID NO: 37516 - DNA, 201 bp, Bos taurus
ttgaaaatcctcaagtagaagctaagcaacaaacttcaggagaggtaatagcagaggagacagcatgggtgtgaatagggccatatgactcacacttctcycaaaaaaagcaatactctgattttatcagtcctcaaagattctcctatgggccaataccattgttatcttactggtattttttccctaaaaatttattcc

SEQ ID NO: 37517 - DNA, 201 bp, Bos taurus
gagaatatttcaggttagacttttactctctgtggccataaattccccccaaattgatagaccagcttcttggcttctgggcagttctgcaaacaggcaaycataggcaaatgctgtacagacataaagcctgaaaaccctggtcttttactcactggacttagtattatggtcaccaccaccatcgccagcatgtaactg

SEQ ID NO: 37518 - DNA, 201 bp, Bos taurus
tacagatagacattcaaggaattttagatccaaatgtgccatgtttatagtctaaattgtgagagttggaaagatggttttattttaggaactagtgagarattgcttaaaaagcctcaatttgctttggagaacattgattgataagaattttgatgtgggtcttctttgtaacagagagacactgctgttagttaagca

SEQ ID NO: 37519 - DNA, 201 bp, Bos taurus
ctacaaataatatgcaccagaatcactggggagcttgccaagaataagtggtatctcttcacaaaaggaaactttgttatagaaagcatgtcatgtgatayatgaatctgtaccttttaaaaatacataagtatttttagggtgagtgattctagaaccacattttgaaaacaacttcttaaaaccattttcttattctga

SEQ ID NO: 37520 - DNA, 201 bp, Bos taurus
aatattaatgaaactatcgttaaaaaaaatgaatgtattcccaaaggtgtatatgtcaacccctttttcttgagaagagtgtgagcttttaggaatgtaayaaaggaagaaagttacacacacaaacacatatacacagattgttattcttctttccttgaaaacaggtaacttgcgaaaaaacttaaatttgtacttaat

SEQ ID NO: 37521 - DNA, 201 bp, Bos taurus
aaggtttcactgtattctctgttgaaattcctaagaaagcctaatttacacagataatgaaccctatccatatttacaaataactttagtccttgttgttraaaaatgggttcacactagtatgtgtgtgtatctgtgtgtgtgtgtgttcaattgtgttcaactctttgggaccccatgaactatagcctgccaggctcc

SEQ ID NO: 37522 - DNA, 201 bp, Bos taurus
aacactgctggcttattgaaatagcgggtggtatttttttgtccacaatattctttctatattccagatatttctagactgttattgcatttttaacatayacataagtcctacaaatttttaatcactttctcatgtaaatctcagttagctttttatttaaattttattgtgtacaggaatatgcttgagataatgtat

SEQ ID NO: 37523 - DNA, 201 bp, Bos taurus
gtgacctgtaatgaaatcctggtaaacttagaaattataggcaatgtggatgtcctcagtaattttgttttctactctggccaggtattagttgtgggttktttttttttttttctttagaaactactgaaatgatgatgtaacacctggatagaatctgtttaaaaaggaataactgaatgctaaatctttcaggccaga

SEQ ID NO: 37524 - DNA, 201 bp, Bos taurus
gataaataattaacattcagctgaaaatatttataattatcaaaaaatgataaggaaattataagattacacaaaatctatttttacaaatggcatgaaayctgaaaaacacatcaaaaatcaagtcaaaggaaaaggaaacaacaaaaaaagattcatgaaagacttacttaagaaatgtaagagaaattttacaaaatt

SEQ ID NO: 37525 - DNA, 201 bp, Bos taurus
tccctggaccagcattgtaatatcagatgaactaagggcactagttctagcttcttctactttaatgtacttcatctgggccttccgatctcatatcagtmctacagaggggcaactgcccacctactcaagagctaggttgatttctttatcaggtatgcacaggtaggcccatctgtaggaaggtaggtaggtatttcc

SEQ ID NO: 37526 - DNA, 201 bp, Bos taurus
ttaatggatttttcccaaaaggccagggttttaatacagctccaaaataacatatacattacaatttcattttcaatccatgggtaaagttgaattccccmttcttttttcttatccttgtggcccaagagggggaaaggggtttatttaggaactaattactgattcctcctttttatcccacttgcctctttctttctt

SEQ ID NO: 37527 - DNA, 201 bp, Bos taurus
ggaatattctggctattttggggaagggggtgggcatttccataaattgggccccggcccacactttgacctttccgattcgccttggaactgtcatggcrtctgtgggtgtcatttaacttgggaatatgttccaatgagcatatactgaggttcaagttctagtgggagttgactgtcatcttcctatttgatctgatc

SEQ ID NO: 37528 - DNA, 201 bp, Bos taurus
acacaacaaattcagctcaaggatctatgatatttcttccagttcccctggagattaacacttattattagtacttgttaaatttctgcaacatacattcratcatgtatttgtggcactgataccatcagtaataattattagttttaagttaacttattgaaacatcacatgtgtatatttgtgtgtatatacacaata

SEQ ID NO: 37529 - DNA, 201 bp, Bos taurus
agttaccaccactgttcactgtagttgatacattattctggatcccagaatgagagctttaatgagtagaactcccaggcctgctcatctatgcatatggmatgggcaggaagtaaattgtggtggttgttttaaatttgtcaagacagcataggctctattttgaattataaaccaaacttgaaaaattggccttcagtt

SEQ ID NO: 37530 - DNA, 201 bp, Bos taurus
gagatgagaaggagtctagagactagcctgttgaagatgggtgaggacaaggaagaagaaacaagggcaggtctggccttcggcattccatggaagatgcygtgcttatgcctgcttggggaaagcaacatcatcccaacaagatgagtgggggccagaggggacccaggtgagaataagacaagcatgaaccctcatgtg

SEQ ID NO: 37531 - DNA, 201 bp, Bos taurus
ccagacatctgaaaaccacagtgatactgtctattggtatgttgttttcaaaaaattgtttacatcaaaagagagaagagatactcattttcagcatctcrcttcagggtggaaggagagtaagattagggccaagttggggatttgagataaagactgaaaattctggtgagttcaggaagagatctcaacacaactggc

SEQ ID NO: 37532 - DNA, 201 bp, Bos taurus
atttttgttacagaaaagattcatacaatcatttcatattgtttaagttttataaagaaaataaattagggaatgtgatggagcatgactccatggggccrtttttgtgggtcagagcctttagctgaatgaccagatgaactagcaatgatgagactgagagcagaatcttctagagagagggtatgcaaggttcaacag

SEQ ID NO: 37533 - DNA, 201 bp, Bos taurus
ttcttctttgggccccttagacttatttcagcaaagatgctgcaagttagattggttaaaacctttcagtgatgtgtcattttgctcagagaataagtcamagttctaacaaggggcctagaaagcccttcaaatgtgtcccctcacttttgtatctgtttgatctgacctcatctcctgccaaagctggcttctaggtcc

SEQ ID NO: 37534 - DNA, 201 bp, Bos taurus
ctacatggcaaacggaggttgatgtttccaggttagtgagatgggcccagtgtaatataagggtccttacaagagagggccaggagggttcagaccaatcrtaaaatacatgaggacagaagccagaggctggtgtggtgtatggatgggccaaggaatgcaggtggcctctagaagctgaaaaaggcagaaaaagaggtt

SEQ ID NO: 37535 - DNA, 201 bp, Bos taurus
aaaaccaccttccttaagtattccattcttaactcctcctatatgtcaggtgggggagattttgactccatatggctcatctgggccagtcatggcactgyggaaaatttatttcaggtctcaatttaatgagagtctttcactttgaagtgccatcttttcccctaaattattgtgcagagagcatgtcctaggggtcat

SEQ ID NO: 37536 - DNA, 201 bp, Bos taurus
tttggtaaagaagttaactaaaaatcatacaacgaggtgctttgtttctctcaaagcttggttttggttcttccagtagaaacctgggagtggcctctccrgttctcaggggctggttctcaagtagccccaggactgagtcttttctccatctcttatccccaggcccccatcccccaaggactgattatctcctcaaac

SEQ ID NO: 37537 - DNA, 201 bp, Bos taurus
gagcagaggggagcccctaggatggttggaaaaggaaaacagggactcttgtagaatatatacataccacattaacactaaatgatagacaatattgattrtggtaagatgcgtttaccttgtagttgttacatattaaagttgcaaaaggaagagttcatctttgttccttcctctcccacctggaatttttaaagctgt

SEQ ID NO: 37538 - DNA, 201 bp, Bos taurus
ctaattctggatgctctgttttgttccattgatacgtatgtctgtctttacacctatactacactggcttgatttataatgagttcagatcagctgggtakatgttttccaaatctgtttttcttaagagttgtcttgactattcttgttctttgcatttctgtgtgcgtgtgtgtgtgtgtgtgtgtgtattagtatcag

SEQ ID NO: 37539 - DNA, 201 bp, Bos taurus
aatgatatgatccctaccccgagaacctggcctttctgtggtctcctatgaattgtgtaggctgtggtgtatcttcactctggctggacttcaacttgaayttctgtcacactgggtggcctctctagtctctgcccaggtatttgggttacttttctgtgattccctcctcttgtaactcaccatcaaatccagtctttt

SEQ ID NO: 37540 - DNA, 201 bp, Bos taurus
gcatcaaaaagaataaactacttaggaataaacctaaggaggtgaaagatttgtactctgaaatctgtaaaactctgatgaaagaaattgaaaataacacraactaatggaaagatgtactgtgcccatggattgaaaaatgagtattgcttatatgttcaacaggcatcccaaaatgtatgtggccaatacctttcctca

SEQ ID NO: 37541 - DNA, 201 bp, Bos taurus
gattactgcctgtagtcctgatccatggagattgggagagaatgaatatattttttaagctgctaaattttcaacaatcaaacaataatcaaatgacaaaycaggctgactttacctactaaaaattcccagattcatgaaaaagagtaaataaagatttcaagcttatggattggacagtattttaagaacccacggctt

SEQ ID NO: 37542 - DNA, 201 bp, Bos taurus
cgtagagtctcccctcatggcagcacctgactgtattggcgtaactgccagcggcttgggtttcatcccagagcagataagacacctcaggccaaaacaargtgggaagtgaagagtaataaatctttataaatgcaggacactttaaaaacgcaattccagggtaaggtggaccgataaatccagtcgttggccaatgag

SEQ ID NO: 37543 - DNA, 201 bp, Bos taurus
gcagtgattttggagcccaagaagaggaaatatgtgactactttcatgttttccccttatattttccatgtagtaatggggccagatgccatattaggttktttttttttttttaatatttattcttaatctggctctttcactctcctccttcaccctcatcaagaggccctttagttcctctttgctttctgccattag

SEQ ID NO: 37544 - DNA, 201 bp, Bos taurus
atttgataatattgtgtctgatagccttttgatgaaacagcagattgtactcagttggttatatctgtgtgaaatgacatatgcttgaaacagaaaataarcacccagccactgaatgtattgcacataacaggaactctcttgtcaggggcagtaccatttattgtacactgcacatttaaaatttttaaaattaattat

SEQ ID NO: 37545 - DNA, 201 bp, Bos taurus
ccttttccattcttctttttattttgttcttttgtaatgcccacctcattctttttttgctttgcaggggtttgcagcagatacaggtctgtctgcacacyggaagcctaacatgcaacatacaagatttgtgtgtgtggtgtgtgtgtcttttttagcgaactgatggttgtgaagattattttcctagagtaacatatt

SEQ ID NO: 37546 - DNA, 201 bp, Bos taurus
tagtgagcaacactgaaactaggttaacacaaactgactccacattgttcaaaagtggatgacagtaatacaaattgataaaattatttttagagacatgraaactgccataataatactaataaataagatctttatgtctggcacaagtggcaagagctatatgtgcatatgctttgtttcttggttggaaaagttgaa

SEQ ID NO: 37547 - DNA, 201 bp, Bos taurus
agaattgattttaaaatattttttttcattactggaaaacataccttgaacacattctcatgtcaaagaatatagaactatgtcatttgctgtaatagtcrcataacttgtactgatttcagtgttggccatctggtgatgtccatgtggagagtcttctcttgtgttgctccaaaagggtttttgctatgaccagtgtgt

SEQ ID NO: 37548 - DNA, 201 bp, Bos taurus
tggatgagaacaaagcctttatcagacggtcaccaacacctcatactgagcagtcacctctgatttcatggagggggaggcagccttggcttctgttgtgyggctaatttcattctcaggaatcaggcagaagtcttgtttgcttgactttttaaataaattaatatccactgagttgataactaacacaatcagaaatgg

SEQ ID NO: 37549 - DNA, 201 bp, Bos taurus
cagttgtgtctgaccctttgcgaccccatggactgcagcgtgccaggcttccctgtccatcacaattcccagagcttgctcaaactcatgtccatcgagtyggtgatgccaaagaagagtaaaagaacttaaaagggggggtaatgtttctacattccttttactggccaaatctccacactgctgctgctgctgctaagt

SEQ ID NO: 37550 - DNA, 201 bp, Bos taurus
ctcagtgtgtatatgctatacaagtcagacagttcccactagcaccagcacacagtgaagattcatctataaaccaagcttatcttttctttcttttcttytcaaccacctggtcatagtgaatttccctaggtatgtgggttggagggaatgttaacaaaacagcaggggtagataccgtggaagctgggccagcagttg

SEQ ID NO: 37551 - DNA, 201 bp, Bos taurus
caggcttttcccttctctgtctttcagccaccgccattttggacttcattttcctattctaactgcctaacattcctccctcaagaaatgggaggcccaayttttggaaataggggcgttgagggtgtctctggctacttcttgctgaacttggatggagaggggcattgggcctccactcttgctgttctcaagcctcag

SEQ ID NO: 37552 - DNA, 201 bp, Bos taurus
gaagacaggtttattttctcctggctaatgcagcagctgtagcagcagccatggcgtaacctaacacaacacaacctctctccttcttggcacagcagccrtagccgaggacacactatattctctcttctcatggctgacccaatcaacacagccgtgatgcgacagtaatggagccgttttctagacagggctcacata

SEQ ID NO: 37553 - DNA, 201 bp, Bos taurus
ttattagctgaagacacaactacatctctgataaactaagaaggcaaaaagaagataaattccaagtttctaaattgacaaaagaagaaacttgtcaggtrtaagatatagaatatacatagcttatgaaacagatttgtcaaaaatacagaactaaaagatacaattgccttaaagaaaggagaaaattatttgtgctta

SEQ ID NO: 37554 - DNA, 201 bp, Bos taurus
ctgatttgtgcaaagagtgaaggttatagggttaattctttttttttttcagtattattcattcggtaaatatagtttactggttttatgtacaaggaagktaggttgtctgagtatgcacagaaatgacagctatgccaaaggaagaaggaagagcgaccatttggggttagtggtgaagaacttaaaattaaattttat

SEQ ID NO: 37555 - DNA, 201 bp, Bos taurus
cccatggactgcagcctaccaggctccttcatccatgagatttttccaggcaagagtactggagtgggttgccattgtcttctccatgagcagaacatagrcagcattaaatataggagaaaaatccataagtttaagaactatgaccaggaaagtcttttggatgtggtaactttcacacacaattgcttgaaaacaaga

SEQ ID NO: 37556 - DNA, 201 bp, Bos taurus
acctttgaaaaatattctgttaactgattattggggatatcagttaatgcatttctgatgtcaaaacatcagtatttctgctttgtaaatttaccttttcytcattaatcctgaaagctatccatcttcaagggtgtctccaagaagtgttttcaaaggacttggagcttgtgataagatttccttgagaaaaggtcataa

SEQ ID NO: 37557 - DNA, 201 bp, Bos taurus
gatacacccatttgttttcaaaattaatctaaaattcattaaaatactaaaaaattccagactttttcatataatttaatatgatatttgccattatctakaagtgaaagtcagtaaaatatctacattaaaaatctctgaaaaacattagaaaaatgaggtagaccttgtctcataaggtattaaaatatttccactgat

SEQ ID NO: 37558 - DNA, 201 bp, Bos taurus
gtgctgcaattcatggcgtcacgcagagttggacatgactgagcgactgaacggaactgaactgatacagtgtgaaatgtatcaaaagaaaatattagtcyattaaaagaggccattttcctgctgatccacattaagcaattctaaatggttaacactaattttataagattcaataggaggaagagcttaccaaaatgc

SEQ ID NO: 37559 - DNA, 201 bp, Bos taurus
gagagctaggcaaggcctgattggccgggtgacctttgatcagagtcttgtaagacgaagtgttttgccatggggagagctgaagaccttccaacagaagrgaaagcacttgcaaaggtcaggccttaaggaggtttgtttgagaaactgtaaataggaaagtgaaactggatcagaatgatctagggataggctgagggt

SEQ ID NO: 37560 - DNA, 201 bp, Bos taurus
tgggttgctgtgccctcctcacgggatacttctaacccagggattgagcatgggtgtatagcatgcgtgggtttaatatttttggtgtgaaggctgttttyggtgtgaatgccccctgcctttttccttggtgtgtgctggccatgctacccttgttgcaggtgtgcagatgtggtggctgggtgctcacttccagagttc

SEQ ID NO: 37561 - DNA, 201 bp, Bos taurus
agaaatccacttcctctcaccacccatactgctgttctcctgatccaagccacctgatatcttatgtggattttgcacagtctctcaaatggccttctgaytgtgtcttgtctcctggagtcaacgccccaacctaacacccagagtcactttgttaaaaagcaagtgagctcacaggattcttttggtaattttccttca

SEQ ID NO: 37562 - DNA, 201 bp, Bos taurus
gttacagactgagttcagggattttctgggcccactgtgagagggaccctatctaaaactctgttgatcacctgaccttcatagtcccttctgtggctgargggccacagtgatattttggatcttttggaattagtgtccaatatttccccagagattcaattattaatatttcctttaccacaatgtaccctggtaaag

SEQ ID NO: 37563 - DNA, 201 bp, Bos taurus
tagggtctcacaccttgcttatgccctgaaccccatcatcttctgctacttgttcacttgctcaccctgcttcagccacactgatctttttgctattcctrgaactcaaacggccaggtcctgtttcaggaacagagactctgtcgctccccttgcccaaagcactttacgccgtttaggttcttgccaggctccctcact

SEQ ID NO: 37564 - DNA, 201 bp, Bos taurus
aacgtgtctgttcattataagaagacactactatttatggggtggattggcacaagaggatgtggcagagagagagctggccagttctgaaacacactacrgacctgttaatttgatattattctctgacgacaacagcaagggttttaacacaggggtgagatacggcccgagttgcgttctaaaaaggtaattctggca

SEQ ID NO: 37565 - DNA, 201 bp, Bos taurus
gaatcccatggacagaggagcctggcagactttagtcaaaggggtcacaaagagtccaacacaacttagcaactaaacaacagcagcaacaagaagttagragacagttttcattctgtctgtgcctcttagtagctttgtgattataggccagctacctaacatttaactttctcagtttcatcttctgtaacatcagaa

SEQ ID NO: 37566 - DNA, 201 bp, Bos taurus
tagcaagccagaaggtgtgatgaatatccctgtttcattttgtttcctctttattcctgctctgagaatgattccagataaggagctgaatgatggcagtygtggccaaataagaataaaatatgctaagaaaaatctagctttctggccagagaaaccagaaaagtgccccttgtggcccaaagaatgtatggcacaaaa

SEQ ID NO: 37567 - DNA, 201 bp, Bos taurus
caacaaaattgaagcccagagaagtttactgactcccccaaggccagcaagcctagttctctagcacaggatgaatactaacatggccctcctttctcttycttggggtgctctttacctatatgctcattttttggtttcttcaaactctagattgaattctttcaagtcccaagcctgtgaattaaataatttttgtga

SEQ ID NO: 37568 - DNA, 201 bp, Bos taurus
taaatgggcttcatgttcatcctggctctacaagaattttgatagcctggtgagaatcatttcaactgagttgtgaagtcattatggacccagtggatggmgagtaggtttaattttgtgccctctaaagacatgctcaagtcgtagccctcataccagtgaatgtgaccatgtttggaaatagagccttggcagatatga

SEQ ID NO: 37569 - DNA, 201 bp, Bos taurus
aacataaaaaacagctcccttatattgcaaaatacttaccctgagacattatttcttttcaaatcataggtgaagcacagtgttggaactgtgactgttayatcaaattaacaagacaggtattagtggagactttaagaaagatcatgtcaaaccagatactaagtttgcattcactaaatggtcttcaatgctttattc

SEQ ID NO: 37570 - DNA, 201 bp, Bos taurus
atacataagcacccatctattttgatataatcactccatatagcctgttttataaatagagaatggaaagaatggggatgctcctgaagattcatggaagycagtatagcatagccaagaagcccttggctaatcagcccctgtcctacccaactttatcttgcttggcagaagtagggcacaacaggagctctgttggct

SEQ ID NO: 37571 - DNA, 201 bp, Bos taurus
aactccgggaactggtgatggacagggaggcctggcgtgcggcagtccatggggtcgcagagtcgcatatgactgagagactgaatgacccttgtgctgayagaaagaacactggccataccgtatcatggagagtaacaagagcttctcatcttccaagaatgttatacatatcatgatttagtatgtgtacaaagtaaa

SEQ ID NO: 37572 - DNA, 201 bp, Bos taurus
aatggtcagatcaaaggatgcctatttatattgatgacattaatggtcagaaaagtcataccttctgaaatgtcattgtcctagtgtacaattctgccccmaaatcagattcaccccatgagaggtggggagagagacctagaaacagtattgtactgaaacagtctccattgtccatcctagacatcatattaaaaagga

SEQ ID NO: 37573 - DNA, 201 bp, Bos taurus
tattctgaagtcatatttttgtagtacaaactgttaaaaactttttactctttcaagtgctgagttttcttcagatgttttatgagttctgaatatgcagktttttatagcagaaattgtacatcagacagaaattgtctattttaaactatctttctgcagtttctacttgggcaaacttttggtaaacagtcttaagaa

SEQ ID NO: 37574 - DNA, 201 bp, Bos taurus
tattttctttagttcttaacaactaccttactaagtaagtactgttattcccatcttatctagatgaggaacttgagtctcagaaaggccaagtggcttaytcaaggctcaaagctactcagtggtacagtcaaagccaaacccaagtacacctcagttctggctcagaacctttctaacacaccattcccactgcaggcc

SEQ ID NO: 37575 - DNA, 201 bp, Bos taurus
tctactctaatggaatgatgaaaggatgaaacaagataattaatgtaaaacacttagaataatgtgtggcgaattttaagaattgaatatattattattaygaaaaattaacaaacatttcatatattactggtataaaggcattgcattcaattggagagggtgaaaccagctgtttacattgtccacataacgtaatta

SEQ ID NO: 37576 - DNA, 201 bp, Bos taurus
ctagactcttcttgggagtcctggcaggacaaagcaagaaaggttaaagacctatgccgaattagaatgataacttctttgtaaagaatgaataaatgcayttcccagagaaccccactcattaccaaaagctgccttctctgagtcagtatgaccccttaagccaaaaagaaacattttctagtcttctgacttggcatc

SEQ ID NO: 37577 - DNA, 201 bp, Bos taurus
gcttcatgctaacagtgatcatcagaaagaactgagcgttgtcaaaggttatctttccattcaaaggtaccacatgagaggcggagatagaacttcatacmaaatttcgtcctgtgaatagaaatcattgaatgactgtccaaagaggccaggagggttttaataaaatatccaaagaccagggcaacagtgaccttgaat

SEQ ID NO: 37578 - DNA, 201 bp, Bos taurus
gatatagcttgtttgtagcttgtttcatttgtgcttcctgattagtccttgtaacagtttcatttatctgctgcagcgccgttcacctggcttaaatgaarcaactcttgtctcctctattctactctggtatccatcaattccatctccatacaccccagggaaattccattctcttggcaataggcagagcacttctta

SEQ ID NO: 37579 - DNA, 201 bp, Bos taurus
ctaatggaaaaaccctggggacaaggcctttgacacagagttctacaggacagtgagagtgacatcaagtggatgaaggagtgaatgaaacagtcccatgractcagtcccgtggtagaggattgccattctgtgaagcaggcttcctgttcagagtcatccttaggattcagtgtttggttctaccccccaccctggttc

SEQ ID NO: 37580 - DNA, 201 bp, Bos taurus
cccttccccaaaccaagaagatgtgagggccattgtctgaaatcctcatccagagaaaccctgtattctggaagaccagtccacaggcaaggatgtgtgtygttactaaagatgggccattccttgaaaatatgctgaacactgaaactctggctcccttttgcttaatgaccaaaatgaaagtggttgcctcaaagaggc

SEQ ID NO: 37581 - DNA, 201 bp, Bos taurus
aaaagttacagcagaaatcagcaatatattttattacaagacttaacattagcaatgctttattatagttccatagtttttaaggacatcaataacttgaytcaaaaaaaaaaaaaaaaaaactatgttcaaaggcatggctcaagtttttcaagccatattttacaaagtatgccataattacattttgctctgatctat

SEQ ID NO: 37582 - DNA, 201 bp, Bos taurus
ggcctggagaatcccagggacaggggagcctggtgggctgccgtctatggggtcgcacagagtcggacacggctgaagtgacttagcatagcatagggtgrgagtgaaagaagaggccctcagagaacttgaactaaacacagaaacataccttctgtcttgagtatttcttttatttagaggatcttttctttagatctc

SEQ ID NO: 37583 - DNA, 201 bp, Bos taurus
acatctgcatggccaaacccctataaaaaacaaactgggggaaaatatttgcagcttataacctagggaagggataatttgcttaatgctgggtctgtaartgcagtcccaaggccaaaccctgcttttataaactgagttttttagaacttgatttatacacccatcggtttgcatcttgtttggggctgttttcaccat

SEQ ID NO: 37584 - DNA, 201 bp, Bos taurus
aatccttctttcctcacacaaagtagttctgctcagcatctgccctgtagactcagatatttccccctacagtccttatcaaaacggcttctcaacagaargaattgtccccataagtcctttttataccagttcagaaaataaatgttttcctaccattatacactttctgtgctcagtggctctgtcttcccaccgttt

SEQ ID NO: 37585 - DNA, 201 bp, Bos taurus
tcaaacttcactgcccagggaaccctggggttccatggagcatccttgggtgaaagtgctctaccctacttactagtatccttttgttataagatgaattytcagttataaaaactgtagctgtaaagtttgggaatgagtgtgctaggtactgatttagggaagaagcaaactctgctcctgtaacaccagcttaggtga

SEQ ID NO: 37586 - DNA, 201 bp, Bos taurus
cagagattactagaaaggccttcagcggaacaggcctccaaatgaccataacaagacaaagtcaccacagcaacatcctggtttctgtcaatcaaggataygctcctacagtggttctggcctataattctgttcgctccctgtttcctcaactttctctcttggtttatttctactcatgtcaacaagacacaggctggt

SEQ ID NO: 37587 - DNA, 201 bp, Bos taurus
ctcccaggggatggccagggctaggtatcccctccaccagctcttctattgaaggcattttgtctagaaaacccttatggctcctggcttcttaagaactyatgacttctgctacagtggcccaaagtgagcccacgagggtccagtgtaggatgtggagacaagaggagggggtggatgggagctgtgtgtgtccagact

SEQ ID NO: 37588 - DNA, 201 bp, Bos taurus
ccatttttgcccacgctttggccacttgtactgggaaccagagtggatagcctgatttcagcacagtgtagctggtggtagcctgattggtgttttcttartcctggagtcctttggggcccctgtagggtgctaatttttaccacattctatagaatacgggatgaagtagctgaaggtagattaacaatccctgttctc

SEQ ID NO: 37589 - DNA, 201 bp, Bos taurus
ccctactccttccttgcctgaggtgcctcagtgatgaagctgatgaaataagtgatgtggatttttcatgctgagggcccttttcttcctctctctccccrcctctgctctgagaacccctcctgcatcctctctggtggggacctgccaccacccgctactcatgcccaggagagtgaagccacactgggctgcccccag

SEQ ID NO: 37590 - DNA, 201 bp, Bos taurus
acaatgccccagagtgtaatctagcacttgcctcttaagccttctcagacctgaaggcgaggctttcttcaacaacttggactcaatgtttcatattcccmgaaactatgcccctggtaccccgcgtcatcacaccacactttccagactccaagcctccaacactggagactacatgcaggttcattcatctcttagaac

SEQ ID NO: 37591 - DNA, 201 bp, Bos taurus
agtgggccagccatgagcaacggccccatcaggcaggcctggtgggtctctctgcatgactgatgttcatcctagtgatctgagatcccggagtcgggtcygcatgcaccatggcccacaagatgcagagcacacatccagagtgtagacggctagacgagggctcaggggaacagccttatgtgggtttggatggccaca

SEQ ID NO: 37592 - DNA, 201 bp, Bos taurus
ggagctgcagagtgagcgggggcttcagatgcactggggcactgagttggagtaaaaagggggtgcccacagtagcactcgacagggacagactcgggccrcttcgcctggttccctgagtgcagccaagtctggattcagaagcgtttccatgggaaggctgctctgtgagtccagacgagatatagtgctagggccatc

SEQ ID NO: 37593 - DNA, 201 bp, Bos taurus
gtttgttatgagtattaaaattgttcttatttgaatagcacttagaacgttgcctggcacataggcagcaatatgtgttagttcaaaaaagttcttttgakatctttgctgctaataaatactacttgacaccatatacatacctagacacatgtggacgtctatcctgtaggagcttgattcaatgtgacttattatgtt

SEQ ID NO: 37594 - DNA, 201 bp, Bos taurus
tatgagtcctaacccagcatcacaaagatttacttctatgttttcttccaagagtttgtagttttaggtcttccatttaagtccatgatccattttgagtyaatttttgtgtgtggtataagtaaggggacatcaagtcatccctgtgcagcttgttgaaaacattattctttccccatagaattgtttgggcacccttgt

SEQ ID NO: 37595 - DNA, 201 bp, Bos taurus
atgttggccttgaaaggccttgtggcttccattttcaccattttggaacactgtgctcagtccagcctggaggatagaggacacgtggaacagagccaagygctccagctgaggcctcctatactaacatgtctgtgcttgcaccaaatatttgacacacagatgaagccatcttacattatcctgtcccaggcaaaccac

SEQ ID NO: 37596 - DNA, 201 bp, Bos taurus
taaagataagctgagggaggggagctgtggggtgcatgctcagctcatggaaattcttctgattggttggtggtaagctaattgggagtcaacatcattamtcttttggttcccaactggcttggtttctatgtgcttatgagcaaaatatagctaacttcatccatttgcaggggatttcattagctgcagaaaaactca

SEQ ID NO: 37597 - DNA, 201 bp, Bos taurus
taaagagcctcttgatgagggtgaaagaggagagtaaaaagctggcttaaacttaatgtcaaaacaaacaaacaaaacccaaacccaaagttaacacaccrtagttggctgttatgtctctggtttctgctaatctacaacagaagccctcagaattttgttgactttttatgataatgatttgctctaaggggccacact

SEQ ID NO: 37598 - DNA, 201 bp, Bos taurus
aagaggagcaagtaaaattctggaggtgggagaagggaaggggtgggtgcctgtgctttgaaattctgccctggaaaggcctcttcagtggatccccttcyaacctgcccagtacaacaactggacctggcatgtgacaggcgctgtagacagatcgcatttcacacatgcagctgtaatatctggccacaggtgtttggt

SEQ ID NO: 37599 - DNA, 201 bp, Bos taurus
agcggggagctggagtccctgtgccagggtgagggcagccactgaagcagatgctgggcaactgagaagaactattgatttcagtcgctcagattcctcasggcggccgcctaccccctccctctggtgggagggcagaggtagctgggagctgtgttgcccaccactgcccatcaccagcttctggcttcaaacagaagg

SEQ ID NO: 37600 - DNA, 201 bp, Bos taurus
tggctttccatgaaagtatgagatctggcaaatctcatgctgaattctctcatggggactcttggagctgaatgttgtcagccttcctgcagtcaggtgtytctggtttcccagagtccccatacaactgctattgttcccaacctattcacccacttaaaatacctgcatgacctcaggtagcattttgagctgacaaac

SEQ ID NO: 37601 - DNA, 201 bp, Bos taurus
taaacaagaatttgaggtacacaaggtatagaatgaaaagtaactctgcctcttccaactagtttcttgctttagagagaacttttttatttttaattctsctgattattaccccagttttatatataatatgctaaaccttacttttgatgaatcttaagtaatctagtgtaccttcattgagaaaaataaaaaatttta

SEQ ID NO: 37602 - DNA, 201 bp, Bos taurus
agtctttcacttttggcaataattgtctccacatttactttatagagtcccctttggtggagcccacaggcggagaggaagcacaggattcataagatggygggcgggtgagtgactgagaatttgggctgaaattggagaaaaaaaaaaagtggcagtggttacaccttaataagaggaatgaatttgaagtctaagttg

SEQ ID NO: 37603 - DNA, 201 bp, Bos taurus
caatgtggaactaactcatagatgagagatgaataaaggatagtgagaaaaatttagaatgatgtgttagggacctgataaaaacagagagagcaggaagytatagtgtaagcacattaggagagcagtcctgggagctggaggagtaggagacattgtgaaaaaagaaaaccaaatctaagagtcggataggattttaaa

SEQ ID NO: 37604 - DNA, 201 bp, Bos taurus
ggacttcataggaaagaagggagagttttagatggtgagatgaagggaagctgcctggagcttagtagagggagctagtgtcactcatacttctgctctaraccttgagtacgtagacaattaatcaattgatgattgttaaaaaatattttcttagacagaagcagatttccaagctggccagatggttttcttactcat

SEQ ID NO: 37605 - DNA, 201 bp, Bos taurus
actcactacagtcctaagagctatggccaggattattatcctgttttacagatgagaaaactgaaatggacaggttcaattgacttgcacgaagtcacacrgtgaataaacagcaggccacggaggcaaggctaggcctagtgcaggtgttcgtaaccaccattaaaggttggttgattcagtgagttaaattcagcaaac

SEQ ID NO: 37606 - DNA, 201 bp, Bos taurus
tgccgtaatgcgacttacgtctacttcggaaaaaacacatataacatacacacaggcagaggaaccatttctaaacactttcacaaagcagcttagtatgyggacggggtaaagagtaggagtgtctgggagtggttcccctgcattgtcagctaacccagtgattcttcaggggctctagtcaaaggactagttctatga

SEQ ID NO: 37607 - DNA, 201 bp, Bos taurus
tttttctagactagtaaaaggaaatataaagcacaaatattttgaaactcccagtggtattttgggtaagcgactcgaactaaatttgaggaaggaatgayactccttaattctcctcttttgaatcttaattctgtgcttctttttcattttcttgacaataaagttctttttcttcccaacagggctcttagactcttt

SEQ ID NO: 37608 - DNA, 201 bp, Bos taurus
tgaactctctcattgtaattttcttatttctggtagttgccttttcttttccacttagagaatttcctttaatgtttgttggaaagctggcctgatactgmtgaattctcttagcttttgtttgtctgtaaagcttttgatttctctgtggaatctgaagggcggctgcttaaagtcttcctgaccatggcctgcccactg

SEQ ID NO: 37609 - DNA, 201 bp, Bos taurus
tgccaagttaactatatgatataaaaagagaaagggaaaacagcaaaatttaaagcaaaatatatttactgcagttttggaaaaataaagaaaagagcttrgaaattgatatagcaactgttattgttcagatatttgagaatcactgctctttaatattttaagtgggcccctctctgtcaaacaacctccatagtctag

SEQ ID NO: 37610 - DNA, 201 bp, Bos taurus
tgactgcatcctccttgggccctttgtggcttgcgtagaggcagtggcgcagccctgtaatgacttttcggttcacagacctgtgtttaacttgctatctyttcacagtataaaaggtcagaggaagtgttctgcttcagagatcacctctgcacctgctagatgtgatgtggagctggaaggtgatcgtagcaagggcct

SEQ ID NO: 37611 - DNA, 201 bp, Bos taurus
ccatctatatctgtatcctgagatcaagggaagctttgactttcaccaaggatactctctgaatgctgtgcagctttgggtcaacaaagctgtcttctgtkagctgccttgtttgataagacattccattcattcagttgtttgtgtgtttatgcatgctaagttgcttcagtcatatctgactctacgaccctatggact

SEQ ID NO: 37612 - DNA, 201 bp, Bos taurus
tgaggaatgttcagtgaagattaagcatttggctgtaagcaggggcatgggcttgtccatggatccacccacttttggcttgagtgcttataatgtcttckcacacccacaacctggactggtggtgttatgagcagtttctaattcctgcactggtctgtcggattaatgggatcctcttctatcctcactgtttgtctc

SEQ ID NO: 37613 - DNA, 201 bp, Bos taurus
tttcatttccctatggctagttaagggaaaccgggaagatggccacttggcagtctcagccgctatcctaggaagctggtttcagtctgcagggaagaatrgaaagggggaatgggcctttccccagacaaaaacaaaaatcccagaatcagaatgaagaaccaagcagtagatattgctggagcttataaatccattcca

SEQ ID NO: 37614 - DNA, 201 bp, Bos taurus
cagctctggaggctggaaggccgagataaggtgtctgcaggtctggctttgcctgagggctcggtgtttggtttacagacggccaaccttttcactgtgckctcatgtggcttttctctggtgtggtgtctctctattttgtcctaatcgcctctttttataaggataccggtcagattggattggggcccaccccaaagg

SEQ ID NO: 37615 - DNA, 201 bp, Bos taurus
ttaacatcagaacttccacttttcaataagaaggccttcattcaatgtactttgtttgggggtggtatgagggaattcactgttcgctggtcacaggtacraatgtaatttggggctggcccagctgagctccccccatcgcctgatatgaccttggactgtcagcctccatctttgttattatgtggataggattttcta

SEQ ID NO: 37616 - DNA, 201 bp, Bos taurus
aaacagagctttgggttacctgcatgattctgagaatgtaatgcgcctaacccaaccctaccttcagttatgtatgttttatattacaactgtgtatccckttggaagaaatgtttttgaagtggttccaggtgtgtgtgaagtgatgacacttgtctggaggccgtatcagtcacacaggtcctgccctgtgtctggatt

SEQ ID NO: 37617 - DNA, 201 bp, Bos taurus
tctgtgacatgggcaccattacttgtgggaaaggaaactgaggctcagaaatgttaagaaattttcttaaggtcacacaactggttaagtagttgggccargaagagactttagtgtgtgtatgtgtccaaatcctatccaagacaggaattatttcttcgacatctctcatagccattagactctgtgaaccatatggtg

SEQ ID NO: 37618 - DNA, 201 bp, Bos taurus
aaatctccgcagtctgcaggcatccaaggggcctgggtaaaatggcttgtcaggactgccccctaggcttaactatcccctcagctgaatgtgccttgcargctccagtgggcctgagctgcagcaccgaccaaagcaaatgtgcataggcacaagccgccttctctgacctcagcaccagaggctgcattagcagggaaa

SEQ ID NO: 37619 - DNA, 201 bp, Bos taurus
tgatgctaaatgttcagatcataccagcatgtactgcatatataacactgagaggagccttatttagcccagagctggttttggacctattgtttccaaaytggtttctgagcagtaaaatagaggtgagtaaggttataaggcttctgtctagtcatcatcagaccattttactatacagtttcaaggagctgactacct

SEQ ID NO: 37620 - DNA, 201 bp, Bos taurus
agcaggtttggtgacaacacatgaggccttgaggaatgggagaagcacaaatcccagggaaagagtgcggaatgagacagtggaagctgagaaatccatcygacttccatgagaccttgcaagaaccctactgtgcccacctccaccctttcctcctgaacagctcctccccttcaaatgcttcagaagcttgccagggaa

SEQ ID NO: 37621 - DNA, 201 bp, Bos taurus
catttctataagctgctgcagtattcgaccctggtgacatagaaaaaaataagatgtgattatagggttacatttcatatgactgcttggaatttcctagyaggtgggtttgctgaacagatatagataaatacacaggcatacaagaaactattttttttaaatacagtacttgtttttcaaagagataccctaggactc

SEQ ID NO: 37622 - DNA, 201 bp, Bos taurus
aaataacaatggaaacctgacattgttgtttttaataaaatagatttattggaatctacttttgaatctttggttttggcacaccaccagtttggaaacaytggtattctacattgtgatagagacttgatatcaaattagaatatgtgctgcagaactttaatattaaaaactatttttttaaagaaggaaaattcatcc

SEQ ID NO: 37623 - DNA, 201 bp, Bos taurus
caaggatgctcaccgccatgggctgactcatgttcttggctagagaagtggatgccagctcagtgtcctagaaagcctgctctccttctgtgaagttggarccctgaaatgtttatgccggagagctgggaaaagctggaagaataatttctaatatgctcatctcttattccctctcacccctatttccacctctagccc

SEQ ID NO: 37624 - DNA, 201 bp, Bos taurus
atttggtgctcatactggctgaggcctcagatggggtgagaaaggatggcattgcctacagaaggcagcttagctcagtctacattggaacacacatgcaygggcctcagccaggtctgacgagtagagtctgcagtcttgaaaaactaactcaatatctgtgagtcatttttctcatttgtaaaatgagattaatgacag

SEQ ID NO: 37625 - DNA, 201 bp, Bos taurus
ttattcttttgttctaagtagaaatgtctgacttgtttccagactgaagaacttgggacaagttgtgttgtcaacatccaatgcaagttatcagaatttayatatactcaaaggccaggtcctttttaagtctatgattatatactatgtttggcactctgacctggaaaaaggctggatcttcaaaagaagtcctgaaag

SEQ ID NO: 37626 - DNA, 201 bp, Bos taurus
tggaatttgtctttttaatgagctctcgcacccccattcccaccaccatgatgttcatacataaccaaatctagaaccacaggccaaggggcatatccatyccctgagaacaagtctgattcatattcttccctaactgagtgaagcagaataagacaaggttcctctgccctgtacctggtgtggccctggctcctgggc

SEQ ID NO: 37627 - DNA, 201 bp, Bos taurus
cattcctagtctgggaagtaacctcctgcaagtcacatggcacagccaaaaagaaaagaaaatccagtatgcaagtttgtgcctatttcttccctgagctyggctccagggttgcatgcatgctaaattgcttcagtcatgttagattctctgcgactccatggactatagcccatcaggctcctctgtatgggattctcc

SEQ ID NO: 37628 - DNA, 201 bp, Bos taurus
gtttattgagagacagggtcatgtttaaggttatagtctccatgccacagactgtgtatgacatataacagagaaaacttatgactgagtaactaaaatamatgaataatgaatggatacatgaatgaaaaaaatttgcatacatatatgacccccaatgtccttttataatcttgaaatatagcactaaattagctacat

SEQ ID NO: 37629 - DNA, 201 bp, Bos taurus
taaagggtcctcagtgacagttttaaagccccatcagtagagtaacattgaaaacctctgtagccatcttgaaattcttagagttaggtcattaatcttayttcctaaagttagagaagtcctatgtggcagagtcaaattctgacatcagtccggtggccctgttctgcatttctataatgtaattgtataaattcttta

SEQ ID NO: 37630 - DNA, 201 bp, Bos taurus
catgaaggaggaactggctctactggatgggtccaatgtggtgtttaaacttctggggcccatactggtcaaacaggagctgggggaatctcgggccacartgggtaaaaggctggactacatcacagctgagattaagtgatatgaatcccagctccgggatctagagcgtcagtcagaacaacagagggagacctttgc

SEQ ID NO: 37631 - DNA, 201 bp, Bos taurus
tctgcagccagttaaggttctctggttttatggactcctgtgattacactgcgcctatggggatgatccagaataatttccccagctcaaggcctgtaatyttaatcaaatctacaatgactctgccatgtaaggttgttaggctgcacccacaggcctgtaagccttgtagctagttgccaggcctcaagacagaagaaa

SEQ ID NO: 37632 - DNA, 201 bp, Bos taurus
gaaccagaagtttgatgtcaccaaggcctgggcggatcggcttcagaatgctagaggagtgcctgtcgttaaaccattgagatctggacgaagaatctgtmaagtgaggccccctgcagtaggaagagtaagaatctgagaggtaagtcccagaacggacttgtgtaactaagagggaattttggaaagggacggcggcac

SEQ ID NO: 37633 - DNA, 201 bp, Bos taurus
ttttctaagcccttataatggagcttacataatatgtgaatttactaagtattacattttatatttattttagctcccttttaccaaaggatttgggatgycttgcatgaataattgtaggacaattatttttccagacaggacatctggattaaacagatgatattagccaaagcacagacactgcagctgccaaagaga

SEQ ID NO: 37634 - DNA, 201 bp, Bos taurus
catgtgtacattaccatgtgctgcctaattgctcttgattcttggttttcaaaagcaagttcacttttgaagcaggaaaaacagattcttaaattggctcycataagtattccaggaagtacacttcatttctcaactgtattgttactctgggaagacaaggtatagtcaactggctgctttgaagccatgaaatgcata

SEQ ID NO: 37635 - DNA, 201 bp, Bos taurus
tctttttttagaaaaccacagtttcatagcacaggtaagtgcaaaacctcctggtcaagctaggatattccccgggaattcccttaactgacctcatgtgytcttgcctctgggccttgactccaactaccctaaatttctttccattttcattgaataaaatcccagccatcctctgggatccaatcagacaacagcctt

SEQ ID NO: 37636 - DNA, 201 bp, Bos taurus
gtaaagctgcttaacgaagtgctagttggttggcaagaggtcagctgaatatggtgaatgaggcaaaacttcatagcccaatgtgttcaacttttgtaagygttggttgtgtgctatgtggcccagcatcgtggagaagaactgggcccgttctgttgactaatgctggctgcagacgttgcagttttggatgcatctcat

SEQ ID NO: 37637 - DNA, 201 bp, Bos taurus
aaattgaatttgcagtatattacttgtacagtgacagatttttaatattttcctactatctacaggcaaaagactttgaccccttaggtggggcaacagarctctccccaagcagacctcaagctgactttgtggcaataattcctctgcagtacttgtctactcactgggcctgtgcttcttgcttacatctgctctgtc

SEQ ID NO: 37638 - DNA, 201 bp, Bos taurus
ccatcaaatatcgtctactcttgcccacttctgattcatattctattcttcattcagactgatctgcttctaaaaatgtcaatcaaatcatatcactctaytgtttaaaatccatccaagttagagtagatgtctctgttgtagcactctgaacttcaccttagcatttgtcacagctgcaatccatcaattattcttaca

SEQ ID NO: 37639 - DNA, 201 bp, Bos taurus
gttgaacctatgtgagttcaaaggcctcatgggtctgctgtctacagccataacagcaaagcttctaattatactttggatcagttaaaactctgaacaayccagaatgatggcctagatcctgacttgattaaataaggaaagggctaaattattacactgacaagcaggtggcaagacaaacactggtcctctcctatt

SEQ ID NO: 37640 - DNA, 201 bp, Bos taurus
actaccctaaaaatgctctgtgctccacatattctccccttcccacgccataacccctaacaacctctaatctacttcagttttgccttttctagatggtyatagagttggaatcatacagtatataacctttccagtctggcctctttcatttagtaatatgcgtttaggttcctctatgtcttttcatagcttgatggt

SEQ ID NO: 37641 - DNA, 201 bp, Bos taurus
atgtgctgtggttcatggggtcacaaatagtcagacaggactgagcgactgaactgaactgaactttctaccatcatctaataagacactagaccttagaraaggaagaccagaatccttacttccttatctctgtacttctttggatcctgaattcatcaccctgattgaataactctggtggcaacctgccccttgctg

SEQ ID NO: 37642 - DNA, 201 bp, Bos taurus
tggctacccactccagtattcttgcctgcagaattccatggacagaggagcctggtgggctatagtccatgaggttgcaatttgtcagacacgactgagcrattaacactaactaactaatgagcaaattaaaaccagtctttttggatgactcttataaaatataaagatgtgtaagtttaacaaaacctatgcctactt

SEQ ID NO: 37643 - DNA, 201 bp, Bos taurus
agaccatggattcctaactgagtcacatgagcactaaatcctttcatatttcctttgatgtgtgagtgtgtgaggtggggtgtccaacctctctctgggcycttagcttcaaggagagagacacagagaatggagagggaagaaaataaccatctagctgctcaaagtataaaaatttaatagtagtggtaagtgttgagt

SEQ ID NO: 37644 - DNA, 201 bp, Bos taurus
tccctttttactgtcctttttactggctcatatacaagagaatctcactgtttgaaggaaaatttttctagatatctttggaattagaaaaatctttgacrttgttcttctcattgaccatacccacctcctttcccattttaggggaagagacaggtgctaggtagaaagacagaagcaaataaatatatcctctttctt

SEQ ID NO: 37645 - DNA, 201 bp, Bos taurus
agatcgcagaggaaatgtggaggaatgtgaatggtattattttatccagcaaaaaacagagacttgtctgcttctctttcccagcacggcctcactacgaygtcataatgttcgatgtggacagtaaggacccaaccctgggaatgagctgtccacccccagcatttgtggcccagcttttcctgcagaaggtcaaaagca

SEQ ID NO: 37646 - DNA, 201 bp, Bos taurus
atttcattgagcctcagctgttcctctgtaatacacagtgtctcagtattttataatattgaaaagggcagataaattttcaacatattcaaaatatgtcraagcttgctcaccaaataccaccaacttgaacaaatatgtcttctctggggcttttaaagtgtgatttatatatgagacaaagtacaaaggagctggcca

SEQ ID NO: 37647 - DNA, 201 bp, Bos taurus
tgtgctcccagagagcaagtggttacttcatgaaactattgccagtgtaatgttcatatataaagttgtcccaagtatgacctctctttggttgtatttarttataaatggttttctgccgccatagactgtttggtaccagatgcataaagtccttttttaagcaatttttaaagagagctttatagaagttttgattgt

SEQ ID NO: 37648 - DNA, 201 bp, Bos taurus
gtttccatgttaatttagaatcatttattaagtgtttcattgaaaaattattaggcttttggttgattacattgattctatgtatcaatttgggaagaacstagcatctctgtgtactccaaaaagccaaacttttgaaagttttatttctagaatatttttcgatgttgttgaaaattgcgttttgtgtgtgtttgtgtt

SEQ ID NO: 37649 - DNA, 201 bp, Bos taurus
gttgtcacagtagttactggaaagtgtttggggacagcagaagtggtttgggtttttcctacagctttctgctgttcacctaaaaatcaccagtatcagcrttgttggaagctgaaactactggttgtagcatgagtctgaacttcaaagtttcctaaagttgttcttgctgacttttgtttgcccaatctttaattcctg

SEQ ID NO: 37650 - DNA, 201 bp, Bos taurus
caactaacatgcttagagcacagtgaacaagagggagtgtggctggaggtgagggcagagaggaggcgaccactaggtcctgcaatgccttgggaaggggkttgggttttcttaggaagccttcaaagaatttaagcaggcaggtgtcatggaatgctttaaaaatctctctgctatgcagagaataaattgtaagagtga

SEQ ID NO: 37651 - DNA, 201 bp, Bos taurus
cagacacactgattattttcatctggtatttaatttgatttattaatgacacttagctttcctcatttacacttgcacttcctctccttcaaaattctctrtcagcttcattcttgttgaatctcattttgatgtggtgaactatctagtctcctcttttctcttcttaattgaaatatagtctatgatattgtgttagtt

SEQ ID NO: 37652 - DNA, 201 bp, Bos taurus
ggaaggggtggggtgggagagcagggcaggagactgggagcagggcagggggcgagctgggggagcagggcagggcaggtagggccagcagtctctagaaycggctctggctttggctccaagtgaagctgggagctgttgttctgcaaagggaagtagaagtgacaggatctaacccaagtcacttagggccaggtcact

SEQ ID NO: 37653 - DNA, 201 bp, Bos taurus
gcagtttccagccccgactcagccgggtctagagttgggctgtaagacagggtccctcccagtctgctgggtcagcgtttagaggactcctgtcttggttyggcccaccttcagggtcccatctgcccctgccccacccaagcagctcatctcttatctgatgggtgggagaggtgtcaggagagttgaggggcagaacct

SEQ ID NO: 37654 - DNA, 201 bp, Bos taurus
ggtcaacaaatacaaatacttagggattcataatttaataaatgcaatatgagttttcttactttctcacaatgacaagttatcatgcagtttcatgcagyatgcaaagggttttaaaaatattttcaaaaatcttttctgttttattttcaatactttattttatattgagttttaacttgtaagtcctataaagtcatt

SEQ ID NO: 37655 - DNA, 201 bp, Bos taurus
ggaccagtcagcgagcaacttccttaggtcacatcttttctaactaagagggagcatggggcccaagcagaagctttcagagtaggctcagtcctaggggkagcaattacctaccagacaaggtacacagaaggccctatacccaagcctccagccggcctaacatcgctcccctcccctccctcacacccaccattcttc

SEQ ID NO: 37656 - DNA, 201 bp, Bos taurus
gaagatttcttctggcccttacaagtcttgtctgggagcagtttgaaggacttccttatccctgagagagagccaagaccaggagtggagtgacacctccktggatgtcccctgcacaccccaaatccagtgggtccccctgactcattccctccaagagctccccatgccagggagcagtaccaccaccacccccccaac

SEQ ID NO: 37657 - DNA, 201 bp, Bos taurus
gttttctcatttgtaaaatgggggtaacaatccctaccttgtggggttgatgtgaggattagataagctaaaatgcatgaagtgtttagaacaggcctgcrtattctagactcacttcagggtgagtgtgcacgcatttgctgcacaccagggagtagatgtgagggttggaggaggtagccctctatgtatctgggggcg

SEQ ID NO: 37658 - DNA, 201 bp, Bos taurus
ggctgtgacctgggggagattgatggccagcctgtgcggtggatgctaacagtttccctgatttatagagttacttacgctaagtgaggccacttagacgygtctggatagtaaaccttttaactggactaaaaaatcataataaataaataaaccaaggggcacacgtagggcccagcagctgggcccccccagttgccc

SEQ ID NO: 37659 - DNA, 201 bp, Bos taurus
gtcaggaggcctcggccccctccactccccagagggtacatacccgctgcagctccacctccatggtccctgcactctgtctccaaagcctgtgtctacaygaggcccagggtgggaccaggccttctgacccctgcaccaacggccacagccccgggcactccccggaaggagcatctagtgctgttttcctgggtttag

SEQ ID NO: 37660 - DNA, 201 bp, Bos taurus
tacattggctggagttctgatatccccagttctccggagaagcaggattttgatttagttacagaaaatgaattatttttattctttttttttttaaaaaragaagcattttgacagtctcaatgaacaatataatttcagagctgggccatcacccgaaccatcgaccttatttgacagactcaaaaaacaaaaacaaaa

SEQ ID NO: 37661 - DNA, 201 bp, Bos taurus
agatgtttgcctcagcaaggccaactgaggccacatggtgaggccaccatgtaactttccagctgatagccggggctgaggtcccagccaacattggccayctgatgaatgaagaagacagacacctccacatggtcccagccatggaaccacccccagctttcaagtcttcctagctgaggcccccagatattgtggaac

SEQ ID NO: 37662 - DNA, 201 bp, Bos taurus
aagacgtgaaaacaacacgcgacagccagggtttggcaagagaccaacatcagctaggacttcctacctgagcacaggccatttggctgtgactctgtaayatgaaatttgtatcaactctgattccttcctttaagcgatcagaggctttcctaaaatttgatggggctcaaattcaagtttcataaatggccttttgaa

SEQ ID NO: 37663 - DNA, 201 bp, Bos taurus
gaaaaggccttattgatgatataaagtttgtgtggtctggatacaagatcaaaccagccacaacattgccgtaagccaaagcctaattcagagcaaggtcytctccctttaattctatgaaggccaagaaagatgaggaagctgtagaaggaaagtatggaactaacagagattggattatgatgcttaaggaaagacgtt

SEQ ID NO: 37664 - DNA, 201 bp, Bos taurus
gctatgttcatgcctgcattcataaacagcccaggtcccctcattttcaaatattagattgtatataaaagtatcactgaaagagacaggggataccaaaycttggggatttctcataatatagaatgaaaaggttgttggaaaagctgagccgagaactctcaccatccccgctgttgttcctctcgctccggaagatac

SEQ ID NO: 37665 - DNA, 201 bp, Bos taurus
agcctggcacacagaaagagctcagtagagtaagctatcctatcactattgttgtgatgtggttgtttatacagttatggacatctgccagaatggtgtcmgaaattcggacggaaggaagaactaagacacacaccaatgtcttcaaacagagcaatggtagaggacagtgtaattgaatgatacactttggcataaaca

SEQ ID NO: 37666 - DNA, 201 bp, Bos taurus
aagaacaaaacagaaaggatccgatttcaaaaatggataaaggggaatttcctggtggtcaagtgtttaggactccatgctttcactaccgagggcctgcrttcaatccctggtccctgaactaagatctaacaagccacttggtgcagctaagggggaaaataatggatgaaggatttgaatatacagttctccaaaaaa

SEQ ID NO: 37667 - DNA, 201 bp, Bos taurus
agccgagagcatctgtggagtgaccggccctgatggggggtgcttgggtcatggtgcctgtcagctcctggttcagctttcacagggctggtttcacaggygaagcctaagttcaggcctgaggtttccccttggacccatcctgttcactcctccaagacaagcacctctgtgcccgggcaggatgctggctttgcagcc

SEQ ID NO: 37668 - DNA, 201 bp, Bos taurus
tctccacttcccaccctacccccttcctttcctaggaaagaaagagctcagagctgtggtttggcagccccactgctttgagacggcacctgtggacagartttttctgggggaatccagaatgcgtgcctgcattctggtgcctgcatctgtgatgtggtgcgggaaggagacaaatcgacacacacacacatgtgcccc

SEQ ID NO: 37669 - DNA, 201 bp, Bos taurus
ttgattcaatggatgttcttgatgtcgacatcggtggtggtattgacccaggaatttttcctgcacagagaatcagggatgaacgctgtcattctcccgaragaacaaatgtaccggagaatcacagatggtgacagacactaggctgaggcgactgactgggaggaatcatggagctgagagctgctccagggagcccat

SEQ ID NO: 37670 - DNA, 201 bp, Bos taurus
ggttgttgtgagtaataatgcaggaagcaatcagcaagtatactgccctagaagtgctgcacgttgtgggcccaggagggaagaaaggggcaagactctcraaccatcatgggatgctgggacaggatgttggaggctttgccctgccatggcagctggtaagggctgctggggaagcaagctcttgggcccctggagctg

SEQ ID NO: 37671 - DNA, 201 bp, Bos taurus
acccagcctttcctgtctgaccttcacacatagaaaacgtggccaatcagaccagggcacagatcaacagaacacacagtgggccgtgcagcttcgctgcrttgcctgtctgtctgctgaatttccgctggttgggtcagagtgggcttggagagaggccagtgcgaaatgaaggggtgagtggggaactgagtctacaga

SEQ ID NO: 37672 - DNA, 201 bp, Bos taurus
agggccatcagcacaggccaccggtggcaaagatccaagtcacagcagctggggttctgctgaccgagttgtggctcctccctgtccacactcacggcatraggccagcaggatatgtgacaagattttcctttcaggctgaatagtagaaagtcgttttggcttaggggtgcagggtgttaagagggtcaggagatcaga

SEQ ID NO: 37673 - DNA, 201 bp, Bos taurus
atcgtctcagaggcattgttttggttaggagggaagatgacaggactgcagccaaccaaagcagaaaggcggagaatggcaaggggcctgcggttttgttyacgaacgctcttctccaaggctgaacttcttggaaaggggtttattttgtttcacgctgacccagctccacttctaggtcattttaggatctcagttggt

SEQ ID NO: 37674 - DNA, 201 bp, Bos taurus
gctggctgctaagcttccctggtgcctcatttcctgtgaatgcagctcactcctgataacaaagccctcacgatgggccaggtctgcctttcatccacgcycccttgagtaccgccctcagacccccagctcagtcctcaggaccactcagcctgctctgcccacctgctctgcctaccctgttccagggcctggaacctt

SEQ ID NO: 37675 - DNA, 201 bp, Bos taurus
gttaattaatgaataataaaaaagggagaagatgactgcaaggatgaaagcctgggctcccaggtgcctagggggacatagccggcccccagggacatcarctcttgttgggagttgccaagggctgtcatctcgtcactctctcccacaggtagaggcctgggtgggtgtgggtgggggggcaataaaatctaaaatgcc

SEQ ID NO: 37676 - DNA, 201 bp, Bos taurus
ctccgtgcaggctctgacatgctggcccctccctggtcctggcagcagagcgtggtaacagggggaacatgctggcccctcttgatctgtgctgggcactyggggcagacggaggaggaagatgacagtctggctggagaggaaaaccaggcctgtgtgggtggggtccccatagtgctgagaggccttggaattagccat

SEQ ID NO: 37677 - DNA, 201 bp, Bos taurus
gccctgcatggtggctggctgagcccagggaccccagcacggagtccttctcatccgccccatcaggctgccagcccatagcatggtgctgaggggacttytgtgacacctggcccatgcaggtgctgacccaatgttcccattggatctgcatgaaaacatcgaggcctcaagccgccctgtccagcctctgtggtctcc

SEQ ID NO: 37678 - DNA, 201 bp, Bos taurus
aacctgaaatctcccaaacctgcagaatggtcccctcctccctaggaaaagctggcacccacctccacctcccatcctaggaaataatgcagaggcctcartgcaagaaatgttcccacattctctactaaatattgggcggaaaacttgggttacataacagtataactcagaaggcatgtgctggcctgataggaaagg

SEQ ID NO: 37679 - DNA, 201 bp, Bos taurus
tgataaggagcccattgggcaagtcctttctctctgagctggggccctgcatcagtaacagaggctgtggttcagcctccccttgttcctgagaacagacrcagcgattcctgctcctaccttggccgggcattttagcctgcaggctccacagcatcccagagccccacatcaagggttttggaagtaccaaaaacagat

SEQ ID NO: 37680 - DNA, 201 bp, Bos taurus
ggaaaagaggaacaaggggactgtctccatggctccctaagggtgagaacacacggggtcagggtgataccaaggaaaccagaccataccctgtcttcccrcaggccccaaactgaagttggcacaacattccaagatgttctctgcagcgcccacctctgccccagccttgcaacacaccttgttagcccatgtaatgat

SEQ ID NO: 37681 - DNA, 201 bp, Bos taurus
gcaactggttccttccaaattgtcacataaagatttggtaaatgtcagacacatcatttactagaaaatgatgtttcactgccaggggaggtaggtggctragagaataaggtaaaaggcccagagatgaccttaaggcagctcacggcatgcagtcctctagcctggggctcctaacttgggtccctctcgcctggcagg

SEQ ID NO: 37682 - DNA, 201 bp, Bos taurus
tgaaggcgcctggcagactatcgtccatggggttgcaaagagtcagacaggacttagcaactgaataacaacattaaccccaaactcccaggccatccctyccccaccctgcagggagttccataatcttggaccagaatcctggctcttggaatacaatgtcaaaggaaagtcacagaggccacagtcatcttcccagaa

SEQ ID NO: 37683 - DNA, 201 bp, Bos taurus
atgatgtactatgaacgctagaatttaagctggaagaggcagagaggggctctctgagcaaaggcacccatggtaaccagggattagctcataagtgctgygatacaatgggcagctgtgggtaaggagcagcaggcggtcacagttccaaggtaaactgagggtccgcagcagtcagagaccgagatgtgcaggtgagtg

SEQ ID NO: 37684 - DNA, 201 bp, Bos taurus
ctcctcccacagtccttggccgtgagcccctcaaagtgatcagacgaccagcagatccgagcccaccctccttcagcgtggaccagaccagggtgaacccycggcctctggaaacaaaaccaccaactgagagaagtcagtccaaccctccgtcctgagccctttaaacacacgccacagagactggagtcagaggacaga

SEQ ID NO: 37685 - DNA, 201 bp, Bos taurus
ccacctgtctagggaccctgggtatgactcctggattggccacaggggggcgcacagctccttgtgagccactccccacctccacccctgcttgcctgagycaacctgagttacctggccacctacagtcagagaggggtgggtcaccaactggggcctacccacatcccaccctgatgagagcccacccacgcctccaac

SEQ ID NO: 37686 - DNA, 201 bp, Bos taurus
attcagagggtgcaccctggcaggagttcacagcccagtacacagggaggtgcagggtgaactgggctgcctcctggagccactgtgataagggtcaggaygctgaaccatgagaagtctagcctaaaccagagaacctgaaatagggatctgctggagtgtctgggttttattgatgataaatgattacaaattaaaaaa

SEQ ID NO: 37687 - DNA, 201 bp, Bos taurus
gggactgggttcctctccacccatcccagggagggagtctggcagggaagccccctacccgtgggctatgagcagggcaccactttaatggccaatactaytcgacatgaagagcagcacttggttgcaaggttgagggtcccaggaaggtacctgcccacatttgagccctctgcccaggctgctagcccggccgtcttc

SEQ ID NO: 37688 - DNA, 201 bp, Bos taurus
gtggcatggatgccagtcctcggctgcagtgggggttggggaggtcagagtgtgggtcacagggtggtagttcccctggcattagtgggaggttctctaarcactgggccctcgtaacgctcttatttatttgaacacaaatggtgcaggtaatcccagaggccccagggacccggggaccagcagaatgcacgactggca

SEQ ID NO: 37689 - DNA, 201 bp, Bos taurus
ccttccatctgtgcgtctccctctgtttttctgtctcaagtctctctctgtcctgctcttgtacaaacacctgtcactgggtttagggcctccctggatcrttaggtctcatcatctcatggcactcagttacctctgcatggaccttttctctgaataaggtaacagtcacagagtccagggattggggagcggacatgc

SEQ ID NO: 37690 - DNA, 201 bp, Bos taurus
ctggggaggctggaccatgagtgcaaagtgaatgggacctgccaaggagcccttatgagatgttagggaggactctcctggtggggaggtgagggtggcckggaactggacatcattgcccagggggagcgttttattgtctcaggaacatgagggtggaaaggaccaggctttggagtgaggccccaggtcctactcttg

SEQ ID NO: 37691 - DNA, 201 bp, Bos taurus
gggacccacagcctgatcttcttccattccttccaggcccccctggcttctaagaatctcagtaccagctgcagactggacaccattctcttgcaacacaygaagtatggccaaagagtctttgcagtggctctgttgtgactgatgtaatttaaaaaaattaaattaattaatttattatttttgactgccttgtgtctt

SEQ ID NO: 37692 - DNA, 201 bp, Bos taurus
atggacacacgtctctggaagattctttccacctgctggtcctgtcccaccacacagcaggcacaggaggagctagaagagtcacccttttaagaagagcyggcctcccctcacttgggccctgaggtggatgatgagacttggtgcaggcttttagccctttgaccaatggacactggccacgtggggtgctttctgcag

SEQ ID NO: 37693 - DNA, 201 bp, Bos taurus
catcaaccatctcggaagcctgggggactgtctggagcaatagcaaggtcagagaagccccctctcctgtccattttggaacccgacacttggtgggttaygaggactgatgcccaggtgaaggactgtgggtgtccagctgtaggcgggcccagcacacccttaagactcctcccttgtgatctgtgatggctttggtgt

SEQ ID NO: 37694 - DNA, 201 bp, Bos taurus
ggaggtagatgttggcttctgtgacttagctcaggcctgacagatcctggccttcatctttttatttcttctgcagtttttctttcattttccaatatccragggttcagtttatggccataaatcttccactaattcctatttggaatgggattctggttcaaggcttctttctcatcttagctctgtgttcatttcctt

SEQ ID NO: 37695 - DNA, 201 bp, Bos taurus
aggcaggtacttggtcacgaaattaagacattgtataagactgtcagttgtgtactttggaaatcagctccacagatttcccttcctcattttcccaaagrtatcatcggccatttagatggagagtctctcagaatttgacctctcaaacaagaagtccatcaacctctggttcccatctcccttccaagccttatttca

SEQ ID NO: 37696 - DNA, 201 bp, Bos taurus
ctctctggcctggcccaaggcccagggtaaacagatgctgaaatggacaggaagccccagagccatgaaggtgaggcttgtgcatgtcaagtatcgggacrtcaccctttcctgccaccaggcctctcacaccctttcctgccacttcccagcagttcccctgccctgtgccttcactcaccctgctcttcaaggtatcca

SEQ ID NO: 37697 - DNA, 201 bp, Bos taurus
tggccattgttgcacctgctgaccctttcacctggcacgggtaagctctgtcacccctcctttttctcctcccaacttgggtaaattctgttccttgtgtytgggcaccagggaagctggcctgctggtgggagcagggtttgcctggacccaggagaagccgggacagcccaggatttattgggaagggaaggaagagaa

SEQ ID NO: 37698 - DNA, 201 bp, Bos taurus
tcggggaacccagggcagctccgggttgcagacccctgaggacaaggagcagcagccgtgcaggctccgatggccattcgctgggcccctgtctttaatayaagaagtcacacatgtcgtgaagggaggaaagctctggatgcctttgcagacccagctcagcatcccagaccctgaggagagggcagggtagtggccaga

SEQ ID NO: 37699 - DNA, 201 bp, Bos taurus
gcaacagaactatttcctaaagcaaaatcccaggtagacctcactcagggatgcgttagatgaactgttttagtgaaccaccagagaggttcttttttccygtaatatttattcacttttctctttatcaaaatatactaatctttcaatctagcaagttagtaataaagaaagatgtcggttcaaataacttgccggcaa

SEQ ID NO: 37700 - DNA, 201 bp, Bos taurus
ggctgaactattattattttacctagcttgactgttttcctttttgcattttgtcacttctctgattaaatattctttggaattcagggaaggcctaggargctgctgttattctatagaggggcaggtagaagacactggggggaggtggtctgttcccagaaggccccatagggtcctgctcagttccaggggtacaga

SEQ ID NO: 37701 - DNA, 201 bp, Bos taurus
attcaaaagagtgtatgtaacatatgtaaacaactaaaagaacagtaatacaacaagcacggtctacccagcccccgacctgaaggcgcatgacccataakggggttgtcttgctcttttctgtcacctctgcatacccccgagcccacaccttcctgaatgctatgtgcctcccaaactgtcttttcctttttaaaaaaa

SEQ ID NO: 37702 - DNA, 201 bp, Bos taurus
gtaagaagtatcaagtcaccaatgagttattctgctgagccttccatcctgttgttccaggcactcccatccaaacccactcactgacccgtgagtcagcrggtggatgttgcgagacctgagcacttagtttaagtttttaaattatagtttcaaatgcttaaattgcaccaacatttctcctagtctactccctgttat

SEQ ID NO: 37703 - DNA, 201 bp, Bos taurus
agtctcccacagcagccaaaatcagaatcatccagcccacatggccagcggtgccagtgcccagggctcatgtggtgcccctggccaccccaggagcagcracaagctgcctccagccctggctgctctccatccctcccagacagaaagctggaagaatgctctacccaagcctgggagctttgggctcagagtgggtca

SEQ ID NO: 37704 - DNA, 201 bp, Bos taurus
tgtcatgcctgagattggaggacagtgtgcaggtttcccaccacaaaacaagcctcccggcatggacagggcggtcggccacgctcagctcgaaccaggaygagctgatggtgcctgggggacacgtgaggagtctgacacctggaaccatggggcatgtgccctgagaggctcagcagcttccggccttctaggtgatgc

SEQ ID NO: 37705 - DNA, 201 bp, Bos taurus
aaaaggaagctgactgacttattcattaggataatctgggcccgtgtgtgaggtccagtgatgaaagaaccttccgtggcctcttgggcctttaagaagcyccgttgaggtggggggggggggggcttcaccatcagagcccagccagggtggatggaagggtcacatgcccacatgatgtgatctcacatgttgtccgga

SEQ ID NO: 37706 - DNA, 201 bp, Bos taurus
ggcccggctggacatcaggggccaaaacagacccccagcacctgtgctactcagcttgaaaataaaatcatgaactaaggaccatatgggctttattttcyggctgagctggatggccagaaccaaagcaccgacatggacgctttgtcatggccccacacagcccccacggaggaggcaggcagagagggccagcaaagt

SEQ ID NO: 37707 - DNA, 201 bp, Bos taurus
ccgcttccctggggccttagaaacaaatgtctcagggactcagaggtttttctggttaagcgccttaccgcccacatgcacaggccgcagccaatattttmaggtctttatagagtcttccttccactttctgattgatgctcctgttggatgagttttatgtgaagcgttctccaagcccccgtgagataaaaggcctgc

SEQ ID NO: 37708 - DNA, 201 bp, Bos taurus
cttctgtgacaggcagcatggtagcccctgagaagcctgttttcaacaagagacattcctttcagagtaaccaaccaacatccaagcggaagccacgtcakggcctgtccaggtggagccgtctctgaaccccaagcagccctgagccggggccccacaggacggctccatgcactccagggaaagcgccagctccttcct

SEQ ID NO: 37709 - DNA, 201 bp, Bos taurus
gccctgacagcagcgtctctgtctgagcatttggactcatggcctggctggcgggcttggcaaggagcctggacagcatgaggatcttccctgcagagcaygtgtttgacggtgctgtgcgggcctgcagggggacccaggtctccaggataggagaccttgcttcccaggaggaagctgggccatcaccatctgcagcca

SEQ ID NO: 37710 - DNA, 201 bp, Bos taurus
gggagaggacgccaaggacagctgaccacaaggattgcagacctgccaggctgtgaacttgtgtggaccccaggattcaatttctgcaggtcccattctgrccaaattgcattcccccaaacccaaatgctaagtcctgacccccagtacctcagaccgtgccctcatttggaaatagggtcgctgcagatgtctgaagtt

SEQ ID NO: 37711 - DNA, 201 bp, Bos taurus
tgcacaccttcatgcaatgcaaaatttgcccctcatccacacagcacacatcgggtgtacccccacatacacgcgtgtggttgggcccctccagacgcttyccttgccctgcgaggaagaccgggaacgaagtccacagagaatatgaagtcccacctactggcctccctctgatccctttcgctctgtaggggaggggcc

SEQ ID NO: 37712 - DNA, 201 bp, Bos taurus
aggggaagaaaagagaaagggggttggtattcacaaggctgcgtgtcaaagcggctgccgagccttctctcctagaagaagtcaggactccttcccctgckcacctttggtcagcttctggccatttccgggcacttggagccgcgcctgcttgggaaagtgtcagaacaaggccgcctttctcaccgcccatctaagcta

SEQ ID NO: 37713 - DNA, 201 bp, Bos taurus
ccctgccctggccacagagcggcagctgccaggagctactcatggtaccaggaaggtcacaggctctgaaagtgggaggagagcaaatattgaagcctcakttgagggcccctgagcaagagaatgagtgaaatggggctaatgaacacagcgctgcccggatgcacgactgccgaatcgtatttaaaattactccttagt

SEQ ID NO: 37714 - DNA, 201 bp, Bos taurus
ggaaagcaccgcattggagcagttgagtatgaagtctgagctctgaggctttttctcttgggcaagtaacttcttattgttttcacatgtgaaacaggagkgatacagtgaggactgaaagggataatgtctgggctgtgcttagcacaggatctgatggctggcaaggatgctataacaagtttgcaattattaactatt

SEQ ID NO: 37715 - DNA, 201 bp, Bos taurus
tgctggccaccttcctggacagtttccattcatagctgagatgactgtgtccaaatgcaagccaattccatcagttccttacttaaaaccttttatggacktctttctgctccctggccaaagcagagcttcctaccagggacctgcaagtccctgggccccccgtggtatagcccccactgacctctctcattgttcctt

SEQ ID NO: 37716 - DNA, 201 bp, Bos taurus
ctccctgttcccatccccaggactgatcaccagggagaagatgctacagaaggatgaagggtggggggagggaacctttgtggccataaaccattaattaraggcaatttccaaaatgtaggcattatggtgccagattttatgtctgggattccatcaatcctggcctttatttcccctctgtctcagccctgagagtgg

SEQ ID NO: 37717 - DNA, 201 bp, Bos taurus
gactggtgggtttggtaccaagtctgaagagtccggatgagccacggtcaaggatgtggtctcctttgaccctcagcacccagcccaggacctggcctctyggaggagctcaaggaaagaggaatattggtggagtgaaaggctgagtgagtgctagtggcagcctaggacacagagcaggacatctgagcaaaaaggcct

SEQ ID NO: 37718 - DNA, 201 bp, Bos taurus
cctacaggcccagcaggagccagacatgcacatggctcccggaagagggtctcagacccagggagcaaaccacttagcacacacacctgatgcaggaaagygttaggactctccaagaggccagcatggtaggagccaatgaaggggaagagaaagtgggtcagggtgaggccagtggctagtcagggaggcaggtgtctt

SEQ ID NO: 37719 - DNA, 201 bp, Bos taurus
aatggcctggcatcaatctcaggatggggactgtttcccaatactccagaaggccggacactgcctccatggttactgcaacctgtgctttctggcccatycccacttgctgtagatgaagcagaactgtaaccacctcatatcctcataggtacctactcatcacctccaaatgcaaagttctcatctggtcacacgaag

SEQ ID NO: 37720 - DNA, 201 bp, Bos taurus
ccagaacacagtaggtgctcaatacataattcctgagagtcgtgataagagaagtgtcatggaagcacagtctccaagagagcttggcaagcctgccagcrgtggcccttcagggtcagcggggctttaagtgaagaacagaaaagagggttgtaagcagcatgaccagctttgagaagtccgagggaggcttagagaatg

SEQ ID NO: 37721 - DNA, 201 bp, Bos taurus
ctccaccaagattcaaacagcacctcctctctcacgtcctctcctgcttggctgcattcatctaggtttctctcccattggccgcagtgaaaacagcacarcattgacaagcagcagccatctctcccttccaccatcatcatcaaatcctgactgaagaatctgcaggaaacaatgtaaccttgtctgcagtcccatggc

SEQ ID NO: 37722 - DNA, 201 bp, Bos taurus
agtatttaagtgccaatctgttctctgcagccaaaggatatagcagctaggtggaatgaaaatctgtattcatatagggccattctgagcatctcttttaygcagatgcatcacaagaggagtgactagttaacattctctgatgtccttatcagggttcggccacatatttcctgaactgcctttgaaaacagggcttcc

SEQ ID NO: 37723 - DNA, 201 bp, Bos taurus
gcctggtccaccactcagtgatcaagatgagtgatctgagatgagtaccacacagaatctggctcagctacccatcacatcttagaatctagctccttctyacggcagggccctcaacttttgtcttttcccctctctgtggcacctcttcctggcttccatttagccaggtccttctctttcttccacaggtcctctttg

SEQ ID NO: 37724 - DNA, 201 bp, Bos taurus
gcaggtggattctttaccagctgagccacaaggggagcctctagatggggagggctcagcccaaacccccatctggccataactgttacagatgcagaagmctgatttttattaaaacagagaagcatcctggtgaccaactcagaagtcacagagggatgagccagaagctgatttcatgacttccgtgggagaaaggcc

SEQ ID NO: 37725 - DNA, 201 bp, Bos taurus
gtcagtgacaccaccccaccatcttatttcagcacttggaactgatgtgggatgcaagctgtcaggagtcaaccagaaccagcaattttcacaactgcttygtcatttcccattagcccaagatctctttgtacctgctttgttttcttgcatcaagatccttcttcacagcaggaagatcttattaaaatatttccattt

SEQ ID NO: 37726 - DNA, 201 bp, Bos taurus
tctttgttctcagaagcttttacaaagcccttcccaatagacagggccctcaaggagacattcctggcctctttggccctcgttttaagacaaaaaaaaarattaaggagagagaaaagtctagtgactcaaaaatatatttttttctgtcagcacacacatactattggccagaagtagtaaaatataattatcataata

SEQ ID NO: 37727 - DNA, 201 bp, Bos taurus
cagcacagaagaccccagagcttcaaaattcagcccctcttgccttaaacaactgcattcttattccaaacaaccttggccacattaggcaggcatccccraacctgagtgggtcccagaacttcaggaccacctgctaatgcaaattcccaggccctgctcaccagagtgctcatttagtgacttggagtggtatcctgg

SEQ ID NO: 37728 - DNA, 201 bp, Bos taurus
tccatggggtcgcaaggagtcggacacgactgagcgactgaacaagtcagtacatgaagcataggcctgcctaagacacagcaaagggccccagggtgacrggcagcagaagccagagtgacagccacttgagctccttctccgggtggaggcaagagatgaagaaggaaggttctggccagcacggactgtgcggccatg

SEQ ID NO: 37729 - DNA, 201 bp, Bos taurus
gaaaagaatgctaagtgaatacatttctttgatctgcagagtgtcaaaatggcaagataatacaggctgctctttctttcctcccaaaaccaaccttggakaaactattgaaaaatgaacaagccacaaagatgtggcttccataaagtaagaacagaaaatagtaacaaaaggttggaaactctggctaaaacctgtctt

SEQ ID NO: 37730 - DNA, 201 bp, Bos taurus
gttactcagacttccaggtgtctaagtatctcaagagaaaacagcttacaccacaacaatctggctatatccaggatcaggacacacccttctaaatagtrtcatatagaggatctcctaccacccattaaagaaattccactctatttcaaggatctcgttccatatagaactcttcctgatttgggcctcaaacttaac

SEQ ID NO: 37731 - DNA, 201 bp, Bos taurus
ttctttaaagagctcactaaagtaagtcattttttagtcagcagctctcaataggaaaaaaggttacatgattcctcatcctcaggatgccaaacagctcrtttaacttgagtctccccagtggtctgacagcccgactgcccgcttcagcagaatctagtccaatctgctggggaaatggtaaaattctctccaccagaa

SEQ ID NO: 37732 - DNA, 201 bp, Bos taurus
cctgtgaaaaccattgccattgtaagttggaggtctatgactgaagagagcctctcagaccccagtttctcctttagccaccagacccaaaggattattaytattggcacatttgatgagtcattagaataattccatctccttgttagcaccgatggcagtgcctgactcataaaaggtgctgggtgaatatctgttgaa

SEQ ID NO: 37733 - DNA, 201 bp, Bos taurus
ttgtctcaccgccctggcattctttttgctccctgggaaagttgatctttaacaagggatgttcacttgtccctctcattactttggctgaaggctttgcrgatgaactgctgagtgtccagccagcatttgacatccttttctcttgaatggtgaaattcaaatcatgtgttgctgtctttcctctccaatcattttctt

SEQ ID NO: 37734 - DNA, 201 bp, Bos taurus
gtggaaagggctctgaggggccgcaggcatgtgtgagtggatgaatgcacactcctggggcctctgtcacaagggccatcaggggataggccaacatcacygcccttggcttttacccccaccaagtaacccctgcccgcctgtggtcagctagagacacccagattacctttcagcaggggcagaggcctggagtagggg

SEQ ID NO: 37735 - DNA, 201 bp, Bos taurus
ggcctggcatgttgcagtccacggggtctcaaagagtcagacacgactgagtgactgaactgatgaagcactttcttagcacatatccaggtgtaatattktggggggcctgtgggtttgaaacttctttttaaattagcaagcaagattaaaacttctttttaatctcacttttcaagtgagatcttaaagggacccaat

SEQ ID NO: 37736 - DNA, 201 bp, Bos taurus
gggagaagaggcatgatctctcaagttatttcccctcaagtctcaacaacaagagtaccaacaatatgtactgagcatctacatgggccagacacaggatyactgctgggtcaacactgataaataagatgcatgaggtcttataagccccctggagctggccaccccagaagaaataagaatgcacatcatttcaaattg

SEQ ID NO: 37737 - DNA, 201 bp, Bos taurus
ctaaaatgtatcttctgtattcaatctccatcagccctctggaaaatcacagcaaatactaattggcaatatttacacaatccttgccatgatatacttayaagtatttgattaaattatacaaaccagcaacaatgagcagaatctgactatattacagaaagagttttccatctctcaaaagcaataaagtatttttct

SEQ ID NO: 37738 - DNA, 201 bp, Bos taurus
agattagcatttgattcagtagactgagtagacttccacacgcaccaaggtgggtgggaatcatgaaatccatttcaggccatactgaacaaaaaagcaamagagggcagaattctctctcgcttgagctgggatgtcgatcttttcctgcccttgaacatcagagctactaggtctcaggcccttagacttggactcctt

SEQ ID NO: 37739 - DNA, 201 bp, Bos taurus
tatagtcgaagggatctctgttcttgggtcaggcctcaggaattacaaatacaggaaataaaaagggtactcggggctgaaaacttaatttaggactctaraaaatcctgggacaggaaaaaaggactttggcatttgtggttgaataaccaggtatggaatgtttgagtcatttaggcatccggattaattagattttat

SEQ ID NO: 37740 - DNA, 201 bp, Bos taurus
aatctataaaactggcactatgagtatgcgtttgtgtatattatctacttctctatatttcacctaaaaaacaaacacaactccataaaaaaggtacaaayaagtacataatcccaagggttagaataagatggcacaggctcatttacaaaaaagactacgcatttctcctcattaatttatcatttaatataaatgctg

SEQ ID NO: 37741 - DNA, 201 bp, Bos taurus
tagttcatagaagctagttcatttagcagttgatgtggtgcttctcattttacttgtaagtttcattatgtttacatgctagtcatggtggaactttattrttatgtgccattgagaatttatttttctagatagagaactttggtaatttttatacttgtgaaaatttcatttggaagaggagcatgatagtagatttta

SEQ ID NO: 37742 - DNA, 201 bp, Bos taurus
aaactctttatacttttatttctgatgaccataataaatctaacagaaacaagctgtaaaatcaataaaaatgcacacttaccatattaatttaatgttayggatgaggttattttcctgaaactaaactgctggtcacagtttgcgtgtgatcctgacagttatagtacagattttctttgagtttggcatgcatatggg

SEQ ID NO: 37743 - DNA, 201 bp, Bos taurus
atgaatgcacatgaaattaatccatatcaaccagttcttttagggccttaccaaactttctttagacagtctttgactaaccccattttcctgtttgtggrgcatggtggagtggaattagctgtccctctgacgttttgcatacatttatcttgtaatggttatcattttttcttttatacttaaatgtttatactgtca

SEQ ID NO: 37744 - DNA, 201 bp, Bos taurus
tggtgatagtaaagaacaaaacaaacaaacaaaaaagcacttgaggggaaaaatatgcaagagttgcagtagccttgatgatccatagtctagtgaatggrtttgaattggatcaaatgagtcaacactgtaacctaatggtagatactaagatgtctctgaattctgttttactgttaagtatctttaatataccatatt

SEQ ID NO: 37745 - DNA, 201 bp, Bos taurus
caataaaactggggaaaatttaatgatataaacttacattatataacattaaaaacagaaaagttgtaaatactggaaatgaattaataattattttgccrtattctactgttgcttagactcttgagtctgtttattgtctgttttgtctgatggaaatgacatgtaatgatgtgcttctcaattccaatttatttatat

SEQ ID NO: 37746 - DNA, 201 bp, Bos taurus
tttgaaagtaaaaaggtcagtttttattcagcactgtgctggttggttaagtattcctttgacctttcaaaatgcagttccccttttcctttctgttgacrccagaaagaaggatcaattcatattccagaggctctctctccttgcgggaccatatttgaataccacacagggttagaaaacaagaagtgaagagcaaaa

SEQ ID NO: 37747 - DNA, 201 bp, Bos taurus
tatgaggattaagtgagagcaaggatatgactttcttaatgcaatgcctggcacataaacagtcctccagaagtgctgctggtgttaccttttgcttactrcttaaccgtaccaagaaggatttgtagtttacccaaatattttctttttttataatttatttattttttgactgtgctgggctttcgttgctgcatgcag

SEQ ID NO: 37748 - DNA, 201 bp, Bos taurus
gacaacctattttatagtgttcactgtctccgaggacaagctttagtgagcaccatgtttgcttcttatagtattaaaatagacaatgaaatctgcttctyagaagatcatttcaccaagtccctgttgctctgtggggaaaatttgtttcctcatttatattcatgtctctaaaagacaagtagaccttggatgaaattt

SEQ ID NO: 37749 - DNA, 201 bp, Bos taurus
gctttcagtggaacaattttcctaacggagtgactctgctgccaccacccttctccagaaaagaccccaaagacacttaaattggccaaaggtgagccagyggaagcagctgagctgcccttgtctgtccaaatccctccagcacgaggcaggcagtcacaccccatcgtctggacattcacacagagaccggtgcgggtg

SEQ ID NO: 37750 - DNA, 201 bp, Bos taurus
acagagcgagaagagttcaaggtccaggggcccagcctggagtaagggttgatgatgggtgccctggcgaggcaaagaaacttgcaaaaatgcctgagggrcagatggccaaccagcttttcagaacaggaaatatctactgtttcatttgaagatgtgaatgctgccgtgtaaataagcaccttccaaatcgacatcgaa

SEQ ID NO: 37751 - DNA, 201 bp, Bos taurus
ttgctgtaaagctgtcaggtggagctacagtcaattgcaggctagactggggctggagggtccacttccaaaatggtgcactcacatcatgctagttattkgtaggaggcctcagatcatcccccattgggcttccatttccatgggctacttgagtgttcttggaatacaggggctggcttcaatcagaatgaggactcc

SEQ ID NO: 37752 - DNA, 201 bp, Bos taurus
gatgccgtcagtagcaaggccagggtgaccatggagatgctagtcctgatctccctttaagattgttatcccattttatagatgaggaaacagaggctccraggttgagtagctggcctagactcacacgagagctggactccactgtctttagttttggattcaacttcctcactgacctgaagggtctctgcccacact

SEQ ID NO: 37753 - DNA, 201 bp, Bos taurus
ttctttactgattaaagaaaaaagcaagagaaaccctaacacacacacacacatgcatatacccctatatgtacaattcaaggaaaatactgaacgcatgragaaaaattgcaaaaaagcaactctaccaggaaactaactatatattaccacattacataaaaactatgaaataagtgattattattcaataatcttagc

SEQ ID NO: 37754 - DNA, 201 bp, Bos taurus
acaataagcagatattccatcatggaaagcattttattggaccactccagagcagacataaaatttcttttattcctatcttttcagcatcttgggacttmgatttgtttgcacccaatctataaatccccattatggatcacagccttcttgtggtgaaagggcttgcataactcagtaaagctatgaaccatgctgtga

SEQ ID NO: 37755 - DNA, 201 bp, Bos taurus
tggtttgagtccatatactttacatacctttgcaggggaagctgccaattacttgaaagagttttatgtgctggagaaagaagggactttaccctccaaamtgccttccagaaaacacgatggaatttctctaaggagaagcacagctttcagattaaattcccagatacaagtgctaagcgaaattcacaataaccgtgt

SEQ ID NO: 37756 - DNA, 201 bp, Bos taurus
aatgctttcagtgtggaaaactgtgtagaaaggttaataaacttggtgggaaggagagcacaagggaaggaaaagattatcccaaccattgagctgtatcrtgatttagtgagaagagcctacatgttggcatcaggcaattctgttcaccactgtgaccctggtcaccacactactgagccccacatgaaaacaggtact

SEQ ID NO: 37757 - DNA, 201 bp, Bos taurus
accacaccactcaatcaccaccactagcatcaatgcaatccaatcaacacaactctacacaacacatgacaaaggtcccatcaatttagaaagtcatgacytatacacagttaaactgataatctctacaattcatttttactataagagccaaccatcaccatatgacaaggccctagatgaaggacactccgtacaatc

SEQ ID NO: 37758 - DNA, 201 bp, Bos taurus
acatgaatggctggctataaagcagtactcgttttctttatggccatttgccttatgtaggccattaagactttaccactcaagcaaggaggcctaacttkatttttaaataagaacgtgttatgacttcaagacatttgtacactccagctggaaggcatctggcctttttgtgaaggacaaaggacttggtgtcctggc

SEQ ID NO: 37759 - DNA, 201 bp, Bos taurus
agcacgcacatatgactcatggggggaaaatattttaaatctggtgaatatggaagtccaagccatcctccatgaggccctctttattctgctgctaccartcacttcatgcagcctttcagctgttgacttttttgggtgtagtcaggtaggcccctgagtgcaccaagcttcagggaatacatatcaagtttcttgggt

SEQ ID NO: 37760 - DNA, 201 bp, Bos taurus
tatagaaaaaatactattagaaaagatatttgcaccctatgttcactgcagtattgtttacaatgcccaagatatggatgcaaactaagagtctatcaatyagctgaatggattaaaaatatggagcatgcaaatatataaaggagtattgctcagccctaagtatgaaatcttgccatttgcaacaacatgagttgacct

SEQ ID NO: 37761 - DNA, 201 bp, Bos taurus
ctggggctccacatatctcattattttaaacatgtctaaccagatggagactagaatctaatattttgcctttcccaacaaacatagctgatatccacagkagagcatgagtttacacagctgaatagccaagatccagtaaagaaagacaaaaacagacagcatacactatctgaagcagaatcttttgaacaagtagaa

SEQ ID NO: 37762 - DNA, 201 bp, Bos taurus
gccaagtgcctctaatgctctcctgggtattttatgattcatctcgctagaacctctttatcttctcgaaagtttgctgagctgtcaatcctcctttagckgacctcagataacatcatatcctgctctctgttcctgggaccctcttttgtgggtctgagtcctgtctagatgatgcaggctctgcccagaccaccacaa

SEQ ID NO: 37763 - DNA, 201 bp, Bos taurus
acttgcttgccccatgctagctgctgctgagtatgcgaagataaatcagagacagttcctgctcttaaagttatatgttccatcatgcctagcatgtcacrggggcccaataagttttcattgagtattaccttagccttcagctctgtgtggcctctattctctgccttcccaggtactttcgtatattgttctgttgtt

SEQ ID NO: 37764 - DNA, 201 bp, Bos taurus
tcaactaccatctccactttgttggaggcccccaccctctgcaggggacgtgatcctgctagggaaacttaatagaggtagtcttgttgaggcttcagaartaggagagcaggcctttgactaacttctgaccctagctggactgtgtgtgagcctgcaagcacaccaattgttaccagcaagccaagcagcactttagat

SEQ ID NO: 37765 - DNA, 201 bp, Bos taurus
ggaagacaggggccaaaggacagagcagggaggaattccagagttaaagatggaggcatccaagagagatgggagcggcaggtcagaggagagtaggaacrgtgagcagccgggggccgctccgggcaggatggccgtggagccgaggagaagatggagctgtttggagacagaagagcagaaggagctgcagacaggcgt

SEQ ID NO: 37766 - DNA, 201 bp, Bos taurus
gagcaacgttcctggtggtctggtgctaagacttcacgatcctaatgcggggaacctgggtttgatccgggtcagtgacctagatcgcacatgctccaacyagagattccacacaccgcaacgaagaccaaatatcctaagtgccacaactaagacccggcacagccaaataaataaacgattttttaaaaaaagaaaaac

SEQ ID NO: 37767 - DNA, 201 bp, Bos taurus
ttagaggaagctgtgtttctgatcatctatctgttcagaagagggagtgtacatatggagtgatgtacaccttagcatgcatgtagggtgatgtacacctyagtttgactgctgttggtatgtgtatctgcttggaagaggagacagcatatattaatgggattttttgtttgctcattttaaaatttgttaataagaaaa

SEQ ID NO: 37768 - DNA, 201 bp, Bos taurus
ggatcttcctgacccagagatcaaacccaggcctcctgcattgtaggcagattctttaccagtcgagccaccagggaagccctggtgactatctgggaacraacgattacaactcaggccacccactctgagtatcacacgatagaaggagacccctagcagtgtgggcaagctgacaggtagcagagaacaagcgtgggc

SEQ ID NO: 37769 - DNA, 201 bp, Bos taurus
agtttttttttatttgtctttatataattttatttagttgcttttggctgtgctggatcttcgctgctgcttgaaggctttctctagtcgcagtgagtggyggccacactctggttgcggtgtgcagtggcttctcactcactgcagtggcttctcttgttgcagagcatgggctccagttttgtgaacttcagtagttgt

SEQ ID NO: 37770 - DNA, 201 bp, Bos taurus
taaaatatcatggtttcatttaaaagaataagaattacttacctatgctgcttcaattgttctgaatttaagccatcctagtatgagatcaacactgttcytaacttgaagcttcacccttgacagaaatatgtgtaggacacaaaaaggcaggaatgctttcattaatcattaaggggggttccctgaaactcattgtca

SEQ ID NO: 37771 - DNA, 201 bp, Bos taurus
tgtgcgggctgtgggcccctccaggcagacaccacttctctttggtggcctcctccgtcttctcacgtccgtcagttacagggcctctcagttgtgcctcytacactaactttaaacccttctccattgcctttatcctctctaaacatgcactatggcccaaagctccctgactagttttctcttcaatccaaccactgt

SEQ ID NO: 37772 - DNA, 201 bp, Bos taurus
acatctttaccatgtctgatctttacgtctccgttatccatgatttcacttctgattcaaagtgcctttattcatccagttagatattaagtgttctgagrtcctcaaatctcctttgatgcaactcctttccacaatatcaaacacggcaggtttgccagcaaattgagatatttctcagtcacttgaaagtttaaattt

SEQ ID NO: 37773 - DNA, 201 bp, Bos taurus
ccttgtgcccacttctggaattccaaataagcctgccacctatgagcaagcattctcccacaggaagcagaggagctgctctgaaattaggagcataactrttgtagtcttgtggcctagggcctgcttacttccaaaaccagggtgcttgctctctgagcctgaggctgtgtctggagttcatcaaaacttctactctgg

SEQ ID NO: 37774 - DNA, 201 bp, Bos taurus
gctgccctctgctgtcgggacctgcttgttgtgtgaccttaccctcttcaggtattcattccacagaacctgtcaccctcctcacttctaggccactaccrcacaagaccagcccgacaccctccagccaccccacctttcaccaggggagctggacgttcccagctggtctgcccagtggccccagagcctcagccctag

SEQ ID NO: 37775 - DNA, 201 bp, Bos taurus
actgtcattttaattaacctatgtttaatagcttttccttccgaactttgcaaagccttctcggtaaacacattgcaaagcgtcccctgggaggcccagcytccctgtgtgtactgtactgtgcagacatgaaaaacaaacccgtttactgtgtatttgtaaatagcctggtcatcaggccattttcagccaatagtcaca

SEQ ID NO: 37776 - DNA, 201 bp, Bos taurus
tccttgctcctgggtggcctggtctatggcgctccctgtcccctgcttcaccgcttggaggttgcagagcaggtcccggccttgctcccacagcccctggrtcacccaataaggatgtgccgggctcaggctttcttggctttcttcatccctttgaggggcataggcctgggcaagaagcttggaagaatctggaaggag

SEQ ID NO: 37777 - DNA, 201 bp, Bos taurus
tgttgcccagctgcctgcagctacatgtgcgctggagccatgtgccctgtgtcccctgctgccaccggattctctggggctgcgagctcagctgccgtggkgggaaggccaggactgcaggtaccacctctcatatttcctcagttctgcctcctatattccacttcactgacctttagatgtacagatatttggaattct

SEQ ID NO: 37778 - DNA, 201 bp, Bos taurus
tcgaatatcagagtggcagagacgaactgctcccacttctgcactgacccctctgtgaggtcttctctggacccttcattgctctctgcaccacagggaarggccagcagagtaatacctgtggccatgtggagcattctcatttgacgtgattgaggggaaaacccaaaacataaaagaaagttggtgctggaaaggagt

SEQ ID NO: 37779 - DNA, 201 bp, Bos taurus
gaaagtaaataaaataccaacttatttaacatgtttctattgcttaatatattctcagtgtttcttaatatgtatcctttatatcaattattttgttttgrcatgtgaattctttggaggtcagggcatttttttcatctgtatacctgcttatcaactgtagtttatcattactaagtatgttaggtacatagaagtatt

SEQ ID NO: 37780 - DNA, 201 bp, Bos taurus
tttcatcaggactcaaggccttagtgatgtctcttttcttgcaggcctgattagaaaaaatgttagatgctgctcacatccatggtaatcaaggacactcmtagagtaacaccttggcccaatccctgtcctttaccaagtctcagtttttgaatttctgaaatgaattgagagagagaaagaaatatcatccttctatat

SEQ ID NO: 37781 - DNA, 201 bp, Bos taurus
tggattcgggcccaccctaatccagcatggtgacagcttaacttgatcacatctgccaggaccctattaccaaataaggtcacattctgaggttgctggtrgacatgaatttgggggtgggggccctacccagctcggtgcagcatgcggacgggcaaccctggaccagtggctttatgtcctccgacttgcctctctcct

SEQ ID NO: 37782 - DNA, 201 bp, Bos taurus
cctgtgtcttagtaggatcacaatggttctgcattaagaatagactcaatagagaggggagcatatatggacacaaggtgaccagttatgaggcttgatcrggtgttgagctggagaggcctgagaagtgtgtgttgagactgctgcctggccaggaactgcctggaggcctagctggggatactgggctttctttttttc

SEQ ID NO: 37783 - DNA, 201 bp, Bos taurus
gatcacctctctggggtcctgtgaggggttttcgtttatatcccacaagcatttaatatgtctactactctgtgtcaggctctggagatactgtaagacayggcacaagcttggcccccaagtagcttttgtctaatgggagaagccatgaaattaaaagacacttactccttggaaggaaagttatgaccaacctagaca

SEQ ID NO: 37784 - DNA, 201 bp, Bos taurus
aatgccagtgtggagctcatggcctcagacaccgccacctgctactccttccctgtgcatctgtctgcagactcctaggcccgcgccttcatcccaggaargttttagctcttgcttactgcctctctccccatcttttctcctgacagcagttcttggttagtagatgacccttcttgtacgctggcctcttggttcctt

SEQ ID NO: 37785 - DNA, 201 bp, Bos taurus
ttggcttgatgtgtcttggttatcccttggtgaatcattttctcatctcaggaccagtggtccttttccctcaaagacttggccctttctcctaggagagrgtacacagcctgccctgtcagggggtgctaagtgagggctctgttcatcattctctttctttccttccaggcctacagattgtgttgaaatccatcatga

SEQ ID NO: 37786 - DNA, 201 bp, Bos taurus
gccagtagtctcacagcttttatgaaggagaaaatttttgaagtcgttactaattccagttgtattacccccaaagagtttatttaaaatgctttcacggytgtttggccatatagcattttacatctgaatatcagccagactcctaagcacagttggcatgcttcaccaattgtgaattattaatttaagtattaattt

SEQ ID NO: 37787 - DNA, 201 bp, Bos taurus
tactgtttttgaccaaaagcaaatctttgcttgtagaaacatccccatcttcaaagatattatacattccccagaaagaagggttttgccaagttaaactrtaattaacaaataataaaaacagatgccttctctgaaatttttataaagctacacaacatattttcttttcatatttaagtaagaagtttgagtcaaaaa

SEQ ID NO: 37788 - DNA, 201 bp, Bos taurus
ctttaaaatgggttcccaaaatccaatatgcaggtctcagagaatatccaagagactagtgaaaggccactgaattatgggtataccaaataaatacgatrgcacctaacaaccaaagctgcaatgacatcacccccaggaaaatgctggctgtcaaattctacaccccactgcctcaagtctgctcatttccaagtccag

SEQ ID NO: 37789 - DNA, 201 bp, Bos taurus
atttggctgagagtgaagaatgaaatgaagtccataaagatatccctgaggtgaaggatgaaggaactgtatctctgggccactgggacaagagcaacttyaagaagaaagcaatcttagcatcctgtccaccagtccttccagatgctggagggagtgcctttctcttctggatcaggcctagatcagcccaagtagaag

SEQ ID NO: 37790 - DNA, 201 bp, Bos taurus
ttttcaaggtatcgtactataagattaaaatgtattattttgtgtttgttttttatgtattatttgtgtgaaaaatatcataaatctattacagtacagtyctattaatatacagccaacggtgttagttggctacctaggctaactctgttggacttacaaacacattggacttaggagggtgacctcaggatggaactt

SEQ ID NO: 37791 - DNA, 201 bp, Bos taurus
tggctgattcattctgctgtacagcagaaacgaatgcgagatggtgaggcaactagactccaataaaactaaaggcagaaaacaaatgtaatctacttatktcttatgggctacacagcccattaggaacaccatgaaatgtgactatatttacactgccccagctgagaatcctcaaagtggctgccatggacttagccc

SEQ ID NO: 37792 - DNA, 201 bp, Bos taurus
tccctggccaggtgagaccacaagttttgctctgcagatggtgaactcataggttgtcactctgttcaagtgccactgtagcaaagcaagcaaaatggtcygattctttggcaacgaccaggggcccatgagaagaaaatatatgggcagctaagatcttatttgatttttttttaatgaaaaatgttccaaacctaataa

SEQ ID NO: 37793 - DNA, 201 bp, Bos taurus
gtggaattgattttttatgtcattcccccatggaaaagtggaattttcccttccttcccttgaaactgggctgggttgagagattggattgaccaatagarcacagaggaatgaagctctgggacttttgaagctaagtagtgggttggtacaaaagtaactgtggttctggaccatgaattttaaaccattataactagg

SEQ ID NO: 37794 - DNA, 201 bp, Bos taurus
tacggggttaaaaatggagagagtatgctgaaggcagtttctaaaaactcaaatagtggatacgttttttattgtcttttaatccctgaggtaaggctttktctgcttatggagggatctttctgcactcttgaggagctgattgttgagaaggcattgaagagatgccattccctgggcatgttgtcattttgatgaggt

SEQ ID NO: 37795 - DNA, 201 bp, Bos taurus
tattggtaataataaacttcttttaaaaaatgtgttgttaggccattgccctggaatacaatctcaacagagacaacaaatttgactcatagtgacttctytttgctcataagtgggagggtggcctgtggtcagtacaaaattcgagtttggagagaaacactctctgtctcaaaggttggcttagatgctgtttgatgg

SEQ ID NO: 37796 - DNA, 201 bp, Bos taurus
cagcctggagctgccccacctccttgccctctcggagctgtgtgagcatgatgatgaggggcgcctcttcctgccacaccatctcccagaagtccgacacygtgttgggcatggggccctgggtggcaatgtaggccttgtcctgcccgtcgtagccctgtaggcagggaggcaggcggtgagcacgggtctgtggcggcc

SEQ ID NO: 37797 - DNA, 201 bp, Bos taurus
gaaaaggagccgtgtgaggatgggagaagggaaggaaggctcctgtgttaccattaggacgcggctctgcacgcagtagtaggtccagattgagtcttggyttctgtcatcctccgttgtggccttctgtggccgcctctgccaggctccgtgttggtgcgcggggcccgcccacgtggggagcgcccgcgtgtgccgggg

SEQ ID NO: 37798 - DNA, 201 bp, Bos taurus
atatagtgcaaagaaaaaaaaaaaaaaaccccaactatttttcacttctgaaagtcaaaatggactttttcatttgtcactcaaatgaattttaaatagargtgatagatacttcagtcttacttctttacacaaaatttcaagaccttgcagaagtttttattttcctttttgctaatgtaaattattttaaacactctc

SEQ ID NO: 37799 - DNA, 201 bp, Bos taurus
tttatagctacatttgaaaatatcatcatttaaattgtaaaagacaaaaacttaattatgaaattctttctcctagaaacccaaattgtctggatacaagrgggcttgactctataggcccatttttaaatatataaactctttcttttttttaggtaagaagtggatttatttagagagaaacaaactctagagagagag

SEQ ID NO: 37800 - DNA, 201 bp, Bos taurus
ctgctttcagggctgggcgctggcccccgggtacccagagacacacacacactctgcccggctcagccttgcagcgttgataacattgttattattagacrtggcctctggaatcccggaggtcattcccaaacaacggcccttctggtgcaatgaaaaagcagctccggttatcacggtgggggcccggatccattacct

SEQ ID NO: 37801 - DNA, 201 bp, Bos taurus
ggtggtaaaacaagtagttacggggtagactctgaaaccagaccaccatctttaaatctagacactgccatcagcagcgtcacccgacctctctggccccytgttttctcacgtgtaaagtccaccccccccaccaccgccatcgagttgtgacaggggctattgcatgtgaagcagctggcccatggacagcccttactg

SEQ ID NO: 37802 - DNA, 201 bp, Bos taurus
gcctgtggcaggccttttcattgttgtacccacttgtttttccctgttcagtgcttgaggtgattttagtcaaacccggttctctatcgatatcctcaatkcatgtagcccgtgcagtctggaattgtgcttgtctgctcaaaccaagaaccaaatgtacacattcataccccttgcacatagtctccctcattattcatt

SEQ ID NO: 37803 - DNA, 201 bp, Bos taurus
gattttggtgaagaatctatggctgaggaccctaagaaaagtcagttactttcagtgtctctggctcttcaagacttaaggcttaagaaacctctaggaasacaccccagggttgctgaagattttggtaggcaagcagggaagagatttcatcatgagatttaagaggctcaggaaggtaactgcctagaaaccctttca

SEQ ID NO: 37804 - DNA, 201 bp, Bos taurus
gtccaaaggccaaatcaaatggatggagccaacgcgaggagttaaggtagcggaatctatatcccatgttttgagggattatttcctttagctattgaatsaggatctcgaagtcaggccttacttctgtgattaacaaaacctttgaggataatgaggggaatatggaaatggatttaagtttctcaaagaaaaagagct

SEQ ID NO: 37805 - DNA, 201 bp, Bos taurus
aagcctggcatgctgcagtccatggggtcgcaaagagtcagatgggactgagtgactgaacaacagcaagaacaactttaaaagccaacagatttacttaygacttagggggaacatttcagtgtattcatcagtgggcctggccacccatctcttttcacaatatactgctgctgctgctaagtcgcttcaatcgtgtcc

SEQ ID NO: 37806 - DNA, 201 bp, Bos taurus
aattgagaatcgtaactctaaagtataagcacattaatcagattatggaggaaaccaggtagaatcaatggaaatgaggagaaccagcgctatgggaaggrggagggaattttgcttttcattttctactattctgctttggtcgagagaggcaccatgaaccctacaaatgatcacaggccccacagacaatggtccttg

SEQ ID NO: 37807 - DNA, 201 bp, Bos taurus
tctatcattcctatttcgatcatttttatcattcattatttctattattctaccattcagtcatagagggaaatggaacaggggcaaagtgtactgatcakccagaaatccagaggagggtgaaataattcccagatttgtagcatttgctgatgtctgtggtgtaagcattcccatcacagtggatttcaaggtactaac

SEQ ID NO: 37808 - DNA, 201 bp, Bos taurus
ggggtcccaagagtcgtccacgactgaatgactaagcacgtgcgtgcacacagtataaagtacttactatgtgcaggccccattctaagctctttgcctaygttgtctcattaattctcgttacaacctgatgagattggcaccattataattcctcctttacagttggagaaagtgaggccagagattgttgaataactt

SEQ ID NO: 37809 - DNA, 201 bp, Bos taurus
aggatggctgttgtcttgctctctggtcccctgctcgaccaatgccgtttcacctgcaccctattcatgtgacgggccttcttacatccttgacccaggcygcagctggtgattattctaactttaaatcagaactctcctctatgtttatcaaagggctagtgatgggcatgccttctgctggtttccctagtaactgat

SEQ ID NO: 37810 - DNA, 201 bp, Bos taurus
tggtctgtcccctgatgagtgcatttaagattcaaaaaatgatctttgagatcagattttacattcattacatacagatgaggaaaatgctgcctggagayttacagggaagctagaaacagatccaccaggacacagacctgaagttcctgattcccagctaagttcttctggtaacacgctctccagggtaagattcca

SEQ ID NO: 37811 - DNA, 201 bp, Bos taurus
tagtttgccagctgttttcttacaaacaattatataccttcattcctttacagaggaatttactaatcacgaggttggaaaataatgtacttctcttgttyattatatgttaataatcatgaataagaaagtctgtctcagtgaagaaaacttacaaagctactttattgcattctgaatttgagtgttaaaacttgagat

SEQ ID NO: 37812 - DNA, 201 bp, Bos taurus
gagccccaggacacctgagtcccctaagtcaagggattatcaggactcaggagacctgggacccagtcgaagtttcccctccagccaatggcgtaacttaktgcaagccataaatgcttcttccatgttccagtctgtaaaatttatttcatatttattatcagctgaaggaggaaatggcaacctgctccagtattctgc

SEQ ID NO: 37813 - DNA, 201 bp, Bos taurus
ctcactctaggccttctgatcacctacccttggaccactcctttgggtgacgtagaggtatcacagggctggtgcatggaactcacttttccactcctctycagggtgaggctgaccttggccatgctgggtatgtccccctagctagaggtttcctgaccaagcacctttctgctatggcatttcccctgcttggcccca

SEQ ID NO: 37814 - DNA, 201 bp, Bos taurus
attttattggaaagggcacccgggtggagagcagtagggtaagggaacccaggagaacagttccgccacatggctcacagttttatggtgtttgggattartttctgggttgtctttagcccatcattctgactcacagtccatcctggtggtgcatgccttgttcagccaagatggatgccagcgagaaggattctggga

SEQ ID NO: 37815 - DNA, 201 bp, Bos taurus
tggacagagcagcctgtcaggctacagtccatagggtcacaaagagtcagacatcactgagcgactaaccctttcaagcttcactttccttttcacgataygtatgtatctccctttttgtctgaagttaaatctgacaacgctcagactgtatgactgtcttagaggctaatttctaggttgcaactgtgcctagtgatg

SEQ ID NO: 37816 - DNA, 201 bp, Bos taurus
ctcagcttggcgctagaactgagaaagtgaggtctgtctctctctgggaggttgaagataggagaggtgagtttgtgacctgctactggcctcattcttcyacacggaccaaggagcacaggaagaagtctgcagtatgaagaaacacataaccaatgcagatacggcttccgagaatgtgcctgggagccacggcctgga

SEQ ID NO: 37817 - DNA, 201 bp, Bos taurus
agcaacttccgttggttcttaaagataaagcttattgatgtgattttcagggtcccacaccacctggctctgacttctctctgctacctattctgtgtcaygtgacacaccctctcgctccctccactccagccacactgaccttcacacacactccccgcactctctccagctacgacacccatcctgtgctgttcctcc

SEQ ID NO: 37818 - DNA, 201 bp, Bos taurus
cagccagcaacccccaccattagcaagtctgctcggaaggacaggaggcctgggcagcagctgctgcagcccagctacccaagtggggcatctgctctgtyatctacaagctgtgtgaccttggccagctatttaaccttgtggagtctgttttctcatttgagtagtaatattttcatgatgctggggtggcagggatga

SEQ ID NO: 37819 - DNA, 201 bp, Bos taurus
tgaagtgacacgggagcttgggaacaaagccaaagaatagcagttcagattttagcgtgggacttcaaagcatgttgaagtgaggactgtgacaggtcctrccctccatggcctaagggttctctaaggaaagaggagagactgggaccacggctcgtcaggctacagaacagacatgccaagaaggatccagaaaccctg

SEQ ID NO: 37820 - DNA, 201 bp, Bos taurus
atcattaataaacatcttttcttttttcttctcttccaaagaaatatgttgaagttatgacccaatggtattgatttgatatggagtaaaaacttcacacracagcacaacacttagaataagataaagcagtgttctacgttgaacagcacagagactcaaaatttccttgtaaaaagtattttaataatgacagtctac

SEQ ID NO: 37821 - DNA, 201 bp, Bos taurus
gactaaatagcaacaacaaaaattacgtttctctctcttcctgtgctgcttttatgacttctttccttttttctttgacttttaacagttttattatgatrtgtctggttatagttttctttgtagttgttttgcttgaagtttttagagctcttcaaatctgtgacttactgtctttcaccaattttggaaaattctcag

SEQ ID NO: 37822 - DNA, 201 bp, Bos taurus
atggcacagccccgtggacggcccacggtggcagctgtgaagggagtggttctggggattccagcgagaccaggctcctggcgtgagacagcgtgagtgcrgggcctctcttctgacttattactggtttgataaatcgggtgtgctttctcatttacccagctgaaagaatatagcttttagcttagttttctttagagc

SEQ ID NO: 37823 - DNA, 201 bp, Bos taurus
tgggtagggcttgcatgtgacgtggtggccactggggagggatggagtggagcggaaggaggaagtgcaggtggagcacacagaaagtatgaaaagtggtrggagcctggtagttcatctccatgaatgcctgccacagaattagatcttcaggaggcagtggttcagaggagggttcaaggagaggctgaaggaccattc

SEQ ID NO: 37824 - DNA, 201 bp, Bos taurus
tacccaagcctgggatgggggtcgggtggcccatggtgttgagcaggggctacctgacctggcagcatcttgtcatccgctcccctgacaccacatctacratgatgctctggcagcccagagctgctgctcatcccgtgttcagtcacagacctgatgctcacagtcagcttggccctggagacttggctgtttctaatc

SEQ ID NO: 37825 - DNA, 201 bp, Bos taurus
atcataccttagcagggtgctttgacctgttctcaacgttatgtgttgctatcatcattgttattggtgagcttagcttttctggaaatgcagggatcctrtcaggtgctgaaagttttaaaaggggaataggggctaaatttgaacaggtagaaatctcccagacagatgattccaaggtctgtccctgggcccctcaag

SEQ ID NO: 37826 - DNA, 201 bp, Bos taurus
cctgagcatctgaaggagtggactcagagagctgctgcgccctacactctgaatgacccatcacctgatccagaaagtgttggggcctcctatgtgctgayggctgaaggcagttagaagagctctgcccttgaaccttgaacacataagagataagatggccaggcttgtggctgagtacaagataaggatgctttgctg

SEQ ID NO: 37827 - DNA, 201 bp, Bos taurus
cacctactgatgggatgcacagggccttgtggaaaaaaaaaaaaaaacaaaacacagtgtctagcagctcaggaaagaagtgtttacattatgacagcagrtgaggccaggaagggcttcccagaggaggtaatattctagctgggttttgtaggataaatagaaattggctagtaggggtgggaagtgctctctagggag

SEQ ID NO: 37828 - DNA, 201 bp, Bos taurus
agaaaagttaaataaaccttattacattatcaaacacaaaaatcaatattcttttatccccaatccttcctaaggccagaaagagtataaggaaaaaaatrtgcattgtgcaggttaaatgtatatttttaatgtacttgtttgggaatcaaaaggcctgaatatttcttccatctgagatacagcaaactgtgtacaaat

SEQ ID NO: 37829 - DNA, 201 bp, Bos taurus
aaggagagccatcctagaaccgttctattgggtacagagacaagaggtagagaaaaaaattggcctgtgaatacttacaaagtaaatcagtgcttttaatktaaaaatttaataatgatataaaagtggtaaggaaaccatctggaaaccagcaccaattattggagctggcatcaaggaggatgggcctggtctggcctc

SEQ ID NO: 37830 - DNA, 201 bp, Bos taurus
aaaatgaggaagttaattgcaattgattgccaagtccctttgagttctagaagttctagactttgtaagatcccatccaacaaacatacatgggtcaggcrtggtgctgggccctgctgaaggggcaagaggaccggatgcccttccttcaagggactcacactgtaggagggagaacaggagtttctgcaagtagctggg

SEQ ID NO: 37831 - DNA, 201 bp, Bos taurus
agggcttggccaattgcgtcatatttaaagtaagacccaagccaacttcacttcagcttccaatgctctccatcagacccaactggcactgcaaacagacygcgcggccttccgttcctcatccttctctctgcccaggactctgcagcgttccaggatctccttcagcctcgcggaaggtgtcccgtctcctctgaacag

SEQ ID NO: 37832 - DNA, 201 bp, Bos taurus
actggtggtttcctctcgggtgaagctctcgggatctgctgcagagcagtctcctggggtctgtggcaaggtttccagtgacgaaagttgggggtgtgtgmggtatccaaagaggccactgaggtccttagcagtggaggctactggagactgtgaaagagcaggacatggtggctcctgctgtgtgactgacacaggtga

SEQ ID NO: 37833 - DNA, 201 bp, Bos taurus
cccttaaggagttactgatattttcctcaaagtgatggcctgatcagccataacaggctacgtctcagagtccgtggaggcgacaccttccaagcgtgacyagactacctggcaggccatcaccctggaaatcacttccacctgaaactcttcactgcccggcagaatctcactccggctgggtcggcagcactccttccc

SEQ ID NO: 37834 - DNA, 201 bp, Bos taurus
ctgtcaagttggcacataaaattaaccatcacagtggctgacctgtccactgaagaatgttcagcagcatccttggcctctatccactccatgcaagaacygcctgtccagtagtaactacgtctccaaatgagccctgggaagaaaattcaccctccattgagagctgttgcctcagaggattccttctactggatatgg

SEQ ID NO: 37835 - DNA, 201 bp, Bos taurus
agcttgttggagatgcgaaacctcaggccccactcccgaccgactgaatcagacctgcacgtcacagagccaggagactcacaagtgtattccagtctgarcacagaacaggcctccccattgctcctcgggactccaggcttgtccgccctgcctgcccagcagggtggcgagagccgtccggacaagaaccgtgccagg

SEQ ID NO: 37836 - DNA, 201 bp, Bos taurus
tcacaggtgggatcttacttccctgaccggggattgaacctgcatcgcctgtattggaagcactggagtcactgggccaccagggaagtccctcattcttytctaactaacccaagttctcctcagcctgcaaaaggcaattcagaccccacttctcccatgtcgcttcccttggccactttatcccaccctggcgggata

SEQ ID NO: 37837 - DNA, 201 bp, Bos taurus
acgatgttccctacactgtcgaatggggatctgtcagaatccgtttctctcatccttgattacgagccccttatggagaggaccgtgtatcctgagatgaygtgtactaaagcagaggacagtgttatccacatcgtcagtatttctcaaactttaatgggtgcacaaatcagtgagaggatcctgtcaaatgcagtttct

SEQ ID NO: 37838 - DNA, 201 bp, Bos taurus
gggtcactcatagcctggtgccggacggggggactggttggccttgcagccctaggctaaatgaagagtaaatggtggtgtcccatcacccccaaagaaaygatgcaattacaaggttggtggccctgctctcatagctgccctgaacacccacccctgtccccagagcaccagggaacattcaccccctccagcctctag

SEQ ID NO: 37839 - DNA, 201 bp, Bos taurus
tacagacagaggcagctctgggctcatgtgtgaggcccaggaggccagtattccaggcatctgtggagagaagggagggggaccctgagccccagtcatcycccaagactcaggctcctgtgtggccacatgtgaggacagtgggctagaaaggcgctgccccgggggtgtaccatgtctgacctctgcaacgaagtgaac

SEQ ID NO: 37840 - DNA, 201 bp, Bos taurus
aaggtgaagaccgtgaaagtgtctgctgaggaccctccaggtgaccaaggacatggactccagctcctgctaggagctcgtctagaactcctagacggccrtgtgggaactgctgcagggctgcaggggggtgacctgacacgccatgctcccagagagatatgccctccccttttggccctaaatcctggagaagaaata

SEQ ID NO: 37841 - DNA, 201 bp, Bos taurus
tataggtccgtatccttccccacttctttctaaattcatcatctcaaaactcacctctcttctaagaagtctcctatagcactatgctcagattattctcycagagtttgaaacacaaacatatcaggctgttttctctcagaagacacgggcccagagggcaggaatcagatgccttctttttctactaaactgtatact

SEQ ID NO: 37842 - DNA, 201 bp, Bos taurus
aatcatagaagttatgtgtccagaataagttcacaaatcttaaaaaaacaccacccacacagtgtcatattacataatttgtattcttagtttgtcacttygtatttgccccaattttttcacattcacataattagatctatcttatcagcactgtatgtcactaatgatgctcttgatactcgcttactgacaaaaaat

SEQ ID NO: 37843 - DNA, 201 bp, Bos taurus
aggcctgggttctgtctctcaccaggagctctctatccacattcaagagcaggagtcctgctgccagtttgcatcccatagccaatggtggggggcggggrtggaatcaggcccccacatgaagccaagagatttctgtcccaaatggacattccccttcctttttagagctcacctgtatatttttacaaaagctactgt

SEQ ID NO: 37844 - DNA, 201 bp, Bos taurus
catggccttgacaggagctcatcagcagatagggggcctcctaagctactcaaaatccacccagcttgagcgtttgtcgctgttgttattgtagatgcagkctagacttaaagggcgtctgggacctgggcttcggggtcaaggcagtccagtctccccatcagagcagacgcccttcctcccaggggcgtggggcggcct

SEQ ID NO: 37845 - DNA, 201 bp, Bos taurus
atcaagatcaacttattaattgaatttctccaggtagttacaatagctttttaaaaaaaatcataccatctttttcttgaaatatagtttatgtacaataktatgttgatttcagacgtactgcttaatgatttgacttttgcatacattatgaaatgaccaccacaataactctggtaaccatctgtcccccctcaaagt

SEQ ID NO: 37846 - DNA, 201 bp, Bos taurus
acatctggggcgtgtttatgaggagggacaggaaggctcctgcaacgggcctctcacgctgctcccggaggcgcagtgcaaagggaagcaggaaatgacargcaaccataacttaaaccggccgtggcgcctgccctggttcacttcctaagtgaccactgcttaacaggccggcatctgagagaggacggtgtggtccta

SEQ ID NO: 37847 - DNA, 201 bp, Bos taurus
gccggtggaggacagcttgctgggaaggagcaacgtgcggcgagaggaccaccgctcggggtgttgcgtgagttgaaagaaggcctgggcataaagaattytaggcaatttaccaaggcagcaacagtcaagattgagttggagaacagtattacagttgagagagccaacctggggctagacttcctggtcacccatctt

SEQ ID NO: 37848 - DNA, 201 bp, Bos taurus
cacaagttcaagacagattagtcagtctctcagctcatacatactttttctaagaaaaattatgaacactcattttataagtggcatgatttacattttgscattagctgaaaggcagttgtgttttcacctaaagctgctgtgaatatatttgtaagtgaatataatttgcatattaaatttgcatttttatgaccaggg

SEQ ID NO: 37849 - DNA, 201 bp, Bos taurus
gggtgaggagatgtggccggtggatgcggtcacttccaggccaaggtggttaaagtaccttttggtgggttcagaggctatcagttgacagtagtggtgcrgggacttccctggtggcccagtggctaagactctgctcccagtgcggggtcctggtttcaatccctggtcggggaaccagatcccacatgctccaactaa

SEQ ID NO: 37850 - DNA, 201 bp, Bos taurus
tagaccttggaggacttgctgatgaatcacatgtggggtgtgagtgaaaggggggagtctaggatgatttccagatttgtggctggagaaacttcaaggayggaattgccattaactgaggtgggaagtgctgtgggagggctggtttggaggagaccaggaactggttccggacatgttaaatttgaaaggtctcttata

SEQ ID NO: 37851 - DNA, 201 bp, Bos taurus
cgtttttattccgtatcacagaccagtctgcctctaaaagcaatcattcaattcccaaatgtttaccatgtacatattgtcagcagaattataggaaatayaaatacggataagatccagttttgaaggaggttagattggtaaagaatccacctgcaatgcgggagacctggattcaatccctgggttgggaagatgctc

SEQ ID NO: 37852 - DNA, 201 bp, Bos taurus
tccattacacttattgtgtactttattttattattactacatcagctccgcctcagatgatcaggcatcaggtcctggagtttgggggcccctcatctagyacagtcaactagagattcgtgtagacacttgtccacataaatttggatcacagtggaggagtttggcctaatcaaatgaatttgggactccacgtattta

SEQ ID NO: 37853 - DNA, 201 bp, Bos taurus
ggaaaaggcttggtaatgtagactaaaaagaactctgaaatgagaagtgacatcagaatatttaaagcttgattgagttttgaatttagattggttgttcrtacttaacgtatttagggctagatgtttctcagctttgaaaggaaatccttgagaaatttagatgatttttaaaagaatgggaatacagtaagggttctc

SEQ ID NO: 37854 - DNA, 201 bp, Bos taurus
ttaaaatttaaacttaaaatgaacgttgttgtagtaaattctagatcaatgtgtagagatctatagtcattaataacttggagacatggagtgtaaaactyactgtctcccgtgactgccatcctccaatcagactttgctgaaagataatcaggtcaccagaaagccactagatggtggagaacactcttctcttgacct

SEQ ID NO: 37855 - DNA, 201 bp, Bos taurus
gaagagagaggagggctgacgccacgctctaagggctctaacgggtagctctggggtcaaagaggcagacgtgcacaagtgatggggaggaatggccagcraggtgagggaaaacaggaggtatcagttcatgggaggtccaaggaaaggagcctcttcaggaggaggctgggtttcctttgctgaaagctgctgagaagt

SEQ ID NO: 37856 - DNA, 201 bp, Bos taurus
gcacgtatgattatcattattttattgcagaatgaggagcaatgctccctgtgatgagaggtgccagaactaacatctaagaccaagacggcagagcagcrccaggtgcagggtgcttttctgtagagccgtgcccagtttggcctcggtgtcctgcagctgtgactgcggtgctaacctctgttgtctccagatatgctg

SEQ ID NO: 37857 - DNA, 201 bp, Bos taurus
gacaaatgcctctcctccatcctccagggcgacagcatcagtgaggaccctggtcgatggccgagacctcacgtggcctctgagcccttcttaacgttgtycttcagggctccaccaagaagtgaagtgatgtggcatgcaagatgcaatctctctttatccttgaagtaccagcgagagaaaatgggccaaagagacatc

SEQ ID NO: 37858 - DNA, 201 bp, Bos taurus
caggcaggaagctgtagaagtgttatcaatacgacaaatgaaatgtggatgcctctagagtcttatacaaccaccaaggcccctctcggaatcatacgtayatccatcgatacatacaattttgcatacaagctcataactggaagctgagatgtctcacttaggatactgtcacaaattacgtattttaaagacaaggca

SEQ ID NO: 37859 - DNA, 201 bp, Bos taurus
accagagtgagaatacagaaagggcctgaggagataccggaaggcacaacagctggaaacgtccctaaccgaggaaacggaacagtcacccaagtccaggyggcccagagagtcaggtacagtattaaaccagagaggaatatcccatgacacattgtaatcaaaatgacaaaaacttagaatacagagagaatattatga

SEQ ID NO: 37860 - DNA, 201 bp, Bos taurus
tccatattagcccaattctgactcatcccaacacactgcaaaatataacaacagacctatgaaattcaccatgaaatagccaatgtagttttcctaacatyatactctccctaacccaatatatatgtttataaaagacatagaaatcactgacaagatgtttaaatatagcccttcactgaggtctggattaggactatg

SEQ ID NO: 37861 - DNA, 201 bp, Bos taurus
ctggtacaatcagtcccattgagtgatgagtcatgtagggtgcttgttcttagtaaatccaaatacaaacagacccatggggctttctgctatgtgctcaygcacagtgctgaccagaaaactgattttacaagactatcagttcctaatggatatgtcataatgtcttggaagagcatattcaggaagtttacagcgact

SEQ ID NO: 37862 - DNA, 201 bp, Bos taurus
ttccatggacgaagtccatggggtcaaaaagagtcagacatgactgagcgactttcactttgactttccctccttttccggagtgtcccagtttatctttrgaagtcaggccctcagaaagtcgtgttctagcatcagattgtcagctctgacatcgctgacatcgctggcagctttaccggcagcttcactgactgaagc

SEQ ID NO: 37863 - DNA, 201 bp, Bos taurus
cttgttgctaataccagccacatctccgagagtggtctggagctgcccttgaacttgtcgtgggtcgggtccctgggccaccgccaggcacgggcaaggcrtatccagtgctttgtcacatgctggacacccacttaaggttggaagcgcctgtgagacaccacggtttctcaccccaggctccttggggccccgggagca

SEQ ID NO: 37864 - DNA, 201 bp, Bos taurus
tcagcaagctctgggagttggtgatggacagggaggcctggtgcgctggagtccatggggtcgcaaggagtcggacacaactgagtgactgacaacatgckaaataaaatacagttggccttcatgtctgaaggtgttgctgctgagagtgctagttttatgctaaaatgtttgccgtcagcaaacagtcatggccagtga

SEQ ID NO: 37865 - DNA, 201 bp, Bos taurus
gtccgtctgtggtggggttggaataggatcagtgggtgatttggattctcagttccaagagtgaccactacctgtggcctcagccattgaaaatgcagatrctggtgccttaagtgtttcctcctcctcaatgagactcattccctaggatgatcaaaaggcagaaaatgatatggccatgaaacgagcagctttgttgga

SEQ ID NO: 37866 - DNA, 201 bp, Bos taurus
ctccattccattccctctatttccttttggcaaagtggatgcctgaataaagaatacaataatttctagatctcattaggtgacaatacatggtttctgamcatacaagttagtggctcttcttgagatttctacagcaaataatgcctaaatatgagaacaaaccaaaagtgctgacagcaaatatatgccactgctgtg

SEQ ID NO: 37867 - DNA, 201 bp, Bos taurus
ttgaaaatttttgcatcaatgtttatcaaagatattggcctgtgattttccttattgtagtgcctttgtctgtttttggtatgagggtaatgatggccccrtacaatgaatttgggagtgtttcatcttcaatatttttgggacagtttgagaatatttcataacttgatagcagttggatgcatgcacttgggtgtttta

SEQ ID NO: 37868 - DNA, 201 bp, Bos taurus
aaattcatatatatatatatatatatatatatatatatatatatactcatttcattttattaatttggctcttttcaaagttttccatttcacttgttttrccctgctaagctattttatttcatatatttcattctcacccatttttgagctctccacagtgatactttgctgtacaacagctatcataagtccagttcc

SEQ ID NO: 37869 - DNA, 201 bp, Bos taurus
tgagtgcttcatgaagaagtaaaagcttgtgtggctattcctcagtctctctggctgttctgtgcatattatcctaggagaaacctgcttttctttaactytttgtctcctgtcctccatctcatctagcaaagttggaggacaggagggagctgaaggagtcatacccaaatctatacccttaggacttaagtctggcat

SEQ ID NO: 37870 - DNA, 201 bp, Bos taurus
tgtttgtttgttttttccagtacaggtattttattcacatgcagcctaagaataataatattagagactgtcattgagacattcatattcctactatggarttctttcctatcaccatacttgtaaaacctcagtaaatgacttcctagacagagacatcaattaatttcaaccattctttggaatgatcctaggtgctaa

SEQ ID NO: 37871 - DNA, 201 bp, Bos taurus
ttcttttgtctcttcactcttttctcctactccctaattatataaattgcttccttcatttcttaccttactcttctaaagatagaagtgagatcaagtgrtagtgtggaacagaatagataaacgtggtcatcactgagggagacccaagtttaagtcacttttttctttgaaaaatataaaattgtgttttcaatcgag

SEQ ID NO: 37872 - DNA, 201 bp, Bos taurus
gaaaaggcattttcttcttggttttcaaagattctcctgggtctgttgtttcttaaattaatcagcccaaaataatccttttgtcaaatgggcatattttkggggtactgtattatgctccctttgacaagtttgtgccataatttccttataaattcatctacagaaggacatcctgatatgtttaagtttttagccatt

SEQ ID NO: 37873 - DNA, 201 bp, Bos taurus
atccagttctgtacatcatcttatttattatctaccccagattcagggagctgcatttacagataatataagtcctagagaggaaatctgactttctgggrtatctaagaaaacagtccaagtgtggataaccccaaaatccatgttctgtgctattacttttttccccaaattatgctagggatactactggcagtgcat

SEQ ID NO: 37874 - DNA, 201 bp, Bos taurus
gaggatatatacaccagactggacatgtcacctgccctcaatcagccccagggcttcttggcctctcgcagaatgagcaatactcctcactgaatgggaakttaatgtttgtttaaagataggtatttaaacaaacctcattagcttatataaaaacctcattttcattacaaacaaatataattactacttctgtggtct

SEQ ID NO: 37875 - DNA, 201 bp, Bos taurus
tcagagccatgagtgcacccaccagatccgggtccgcgtgcaggcagccatcagcgtcagggggctttctctccactttcttctggcccacagttgctgtrgcgggacgagcccgatagccacctccgctgatgggagggggcacaggtctcaggctgggggcctcttccttcttcttgtcatagggccgatgaccgcggg

SEQ ID NO: 37876 - DNA, 201 bp, Bos taurus
aattcaataaaggacactgtgaaatgggcaggagaccttgaattgtacatgatgaaagagaaagcctaaaaacgaatgggaaaatagatgtttcaagttcytgatttcccatttgtttctaaactaaaccactgtttacagtgaatgtgtcagtgaaagctgtggagaaactagctccttttcctttatttttagactcaa

SEQ ID NO: 37877 - DNA, 201 bp, Bos taurus
atgttcaagctaccgtacaactgtgctcatttcatctgctagaaaggtactggtcaaagtccttcaagctagcttaaacttgaaccaaaagcttccagatrtacaagctggatttagaaaagacagaggaatctgagatcaaattaccatcattcgctggatcatagagaaaacaagagaattccagaaaaacatctactt

SEQ ID NO: 37878 - DNA, 201 bp, Bos taurus
agcagtttcagtggggccaggccagcagggtagagttctgagcctgaacgtgttcacatgaaagaccagattcattgccaggagacaaattctaagagccrgtggacagcacacataggtgctgcccccccccccccgcccccatcactgcaggtctcctccaactggtgtcatcttcagagcagcagcagcaaaagagga

SEQ ID NO: 37879 - DNA, 201 bp, Bos taurus
cccttgagaagtgcccgtgggcctgttcccaaccacgctcagggtgttctgaactgcagaagccctggatgaagcccctcaagcctgattctaaggttctyacagctctcttctctgggccttccaccccatgggggctgtaagcaagtgtgtccacccccaggtttcagggggaccaggagggaacagtgagtgtgcatg

SEQ ID NO: 37880 - DNA, 201 bp, Bos taurus
ctgttctcctgctctctgcacatcacctgcctgaccaggacctgtttccctgacaccctgcttacagggctgaccttcctacatacttgccccaggcctcrgctagtgactgttcttatcaaagtgtggtgaggaacttgcccctcttctggcttccctggtaaccaatgaatcactctgatgccagcaccccctataact

SEQ ID NO: 37881 - DNA, 201 bp, Bos taurus
cgtttgagaaagataaggaatgtaacatttgttccttgatggtaataactcaaaacgctcccctcccttccttcataacactaattccatccatggggccrtgataagtcactggaggctctcaggaggttcatcacccacacgatttgatacaaaaacatctgtgctgatgcacacagctttgtatcattacagatgata

SEQ ID NO: 37882 - DNA, 201 bp, Bos taurus
cagggaccccagaccaaataaactcacatctcattaaggtcacaggaagggagtgtccccctccagcgctgactgcaagccttggccctccaccccacccrcccaagaccgcagtgtctcttccaggggggtaaacagatctaaaacgcatcccccttaagtggaagagccctgaggggatggccacagcctgccaggaac

SEQ ID NO: 37883 - DNA, 201 bp, Bos taurus
accaggatgagtaacacacataacggcactgaagactcttaccaggatgggaaagcccaattaccattattttataattaaatactggagacgcatcagtktaacttccaggtaggttttaaaaatagtaatcatactggtatataattcacaacaatcactatttattttcttctaaactttaagatacataaataatac

SEQ ID NO: 37884 - DNA, 201 bp, Bos taurus
cagtcccacagtttgctgggccctgggtccacccattagtaagctgctccagccttcagaccagcctcacccaccagagggggaacaccagccctgggacracggcagtcctgtggcctgctatgacaggccccagtcaacatgtcagcaccagacctgggcctgggggagggggctgtcttgcccaccagcaggtcaaca

SEQ ID NO: 37885 - DNA, 201 bp, Bos taurus
ctttgtgtttgaggccatagttgacttccagctccatgagcagcacactcttgcgcacgtttaaagtcttctggagttcatcaaaggtagaatggatgtcrtccacaatactggccttctggttggttaactgatggatgatttccgagatgaactgaagagctgaatctatttctgggagcctggaggacagttgtcaga

SEQ ID NO: 37886 - DNA, 201 bp, Bos taurus
tcagggcatgctgagcccactgccttactgcttggggcccccatccccagatgcaagcttgtccctgtacccttggctctctgcccaaatgatgcctcctygctggggcctccccgaccctctcatcataagtgggtatcccctaccctttgttttttagcactttactgtgttggaatgacacacaattatttgcacgct

SEQ ID NO: 37887 - DNA, 201 bp, Bos taurus
tggatcagaagcacaggtgctaacctggccttgtgactggcttcagaagggagtggcggtaggtgggggagtggagggtgcggtcttgtgagaccaaaccyttggcctgtgggctctgatgcgctcgctctccagcgatcagtgtcagaactgaattgaactgtaggacaccctgctggtgttgcagaaaattgcttggtg

SEQ ID NO: 37888 - DNA, 201 bp, Bos taurus
gtcaactcgccagcacttggatggggtccactgcctcttctccagcatccatgctcaatagccttgcccagaaagcaccctgttgctggccccagcccacrtccgcacagtctggggcttctgctggatatatctcagtcacttagttaagagaggcagcgtggtggtgttcgagagtgccgaacctggggtaggccaccg

SEQ ID NO: 37889 - DNA, 201 bp, Bos taurus
gctatcgtatgacccagcaatcccattcctgggcatgtatctggagaaaacaataatacaaaaacatacatgcaccccaatgttcatatagccaagacacraaggcaacctaagtatccatcaacagatgaatggatgaagaagatgtggtacatatatattaatacagcaaaatatcagtcagccatataaaagaatgaa

SEQ ID NO: 37890 - DNA, 201 bp, Bos taurus
cactgactgcggctcccgcatttacacatttacgagctgggagtctcgtcagggtgaaccaataaaatcgtccttgtggctccgttgggcccacggtcttycctggactgcttttcccatgaaatgtcagctctcatcagaaaacaaaggaagccagagtgtgagcgggaggggaactaagacaccatctggtggccattc

SEQ ID NO: 37891 - DNA, 201 bp, Bos taurus
taaacagacagagttcttcccgggataggtcaaggtcagtgttgaggtcactggcaaggaagtctggagtggcttggactgaagctactgtgtcttggggraaaaagacttgttttcattgctttagtcatgagcacaaatcatgactccaaagcttgaaaacccaaagacagcacagcagcctcttatgatgtcactgtt

SEQ ID NO: 37892 - DNA, 201 bp, Bos taurus
caacaaatattcatttgctaaaggtatgaatactggtggcaagttcttaaaacatttttaaaaagaatttaatgtttggaagagacattaaataggtctgratgctaaaactgagattattctttaaaaaacaagacagacttctacaagtaccctatattctatatttgcaaaatacaaaaatgaacaaaaatgataaac

SEQ ID NO: 37893 - DNA, 201 bp, Bos taurus
tgggcatgtacataaacatatttgttcgtgaatgtgctgttttaaacaaagtggtcagggaaaaacttaaaagaggcatcatctttctgtaagacacagtmgagtgagggagtgcagagccccaggccgaggaaacagtaaacacagagatgggaggtggggacaggcccagcttctccaggagcaggagacagtttgcgg

SEQ ID NO: 37894 - DNA, 201 bp, Bos taurus
gatcaaggataatgccaacagtggggaagctgttgatagtatgtgctcctgacaggacgtgacgagcacgagccctggcctctgtcatcttcctcctaaamatggagtaactcagtctaatctcgagagtagcatcaggcaaacccaaactgaaggccattttacaaaatacctgaccagctctcataattgtcaaggcgc

SEQ ID NO: 37895 - DNA, 201 bp, Bos taurus
tttcagtggctgtgattccctgtgttgtacaatatgtctgtactgctgatctattttatacagtagtctgcctctcttagccccgtatctctaatctgtcyctccccacttcggtctcctcactgtaaccactagtttgttttctgtatctgtaaatctatttctgttcagattccacgtataagcgatatcatacagcac

SEQ ID NO: 37896 - DNA, 201 bp, Bos taurus
aatgaactctagccagattttcagaatccaggccgaattctgtctctatctttacacctttctagaactagaaaattcaattccttgaacccattatttgytctctacattatgcagttcatttggtgttattatcttgtaacttttggggtcagtgttgtcttgagttgacatttacttttattttttgaacagtagaaa

SEQ ID NO: 37897 - DNA, 201 bp, Bos taurus
tacaacatgccatacagaatgcaaaatttacatgattgttttgtcataacagtgttcgtgttctgcattttggtggttttgagcataggagaaaattagayacatgataaaatgtgtaatttgtattattggtaaaggcagttatactctttaaatgttccacatttcaggtattgatgaaccattgcacatcaagagaag

SEQ ID NO: 37898 - DNA, 201 bp, Bos taurus
gttctgcttctactcctgatcttgcctgagtcaagaacttcagaaaccttctggagatttgagtatggggaccatggcctggttggaatctgaagggacamggcacaaaccaggaaaaaattcctccaccatggtacatggggcagtggggcggccactggcctggcaactaaaccccagctggagcctgagacgctcttc

SEQ ID NO: 37899 - DNA, 201 bp, Bos taurus
ccaagggaggcagacagcaaacacttcacctgcagaggaatacaggcctgctctatcaaggtctcaccagtgaacctggcagatggaggagagatggaaarcaagggtgtggaaaagaggcctagaggaaggctctcagctgtgcaggaggaagctgcaagaatgctcatcccacttgtgtttgtgaaagagaaaaattga

SEQ ID NO: 37900 - DNA, 201 bp, Bos taurus
ggtccactcgtcatcatctaatacagagcagctcaattgggccgagtctgtgccaagcctcctcagagctcattggccaccctggtgacctgcctgcattrgttgggacaccaaataccacagcatcagatgcggtgcaggtagcatgattggcccactaagtgcaagaaccaatctgggaacccaggaaggttgtgctag

SEQ ID NO: 37901 - DNA, 201 bp, Bos taurus
tcagtgaggccagaccctcgccttctccatatgtagagaagcactaatttcattactttgagaagtctggctttctatacttaacagtgatctgtttgatrttctgactacctggtttttgttgcaaaaactcctctaaaccctggctcctcccttacccctttggagcagtccctcagcactacctgacaggctggttcc

SEQ ID NO: 37902 - DNA, 201 bp, Bos taurus
acagttgagttccagccaacgtcctggcttggaaacacattgtgttggaaggttccctcctgtccattctctccttccacacgcagaagctcaggcccagrcaggtaatgtctcctgctggagatcttgtgagtcttactagtgaaatcctgaatataaattctccactgcccaaagaccaggctcttccaggtctgggcc

SEQ ID NO: 37903 - DNA, 201 bp, Bos taurus
tccgctcctcctgggatcctagcacctcttctccccactctgaactctacagaaccaaatatctcacgggccttttaaaaatggggccaggggagcagagkgggtgtctcctgtgttgtcttagcatcatttgtcagaagattcaacagactcaactaagaatgccggcccagcaagctacaaactaattgagaaatcaga

SEQ ID NO: 37904 - DNA, 201 bp, Bos taurus
gactgaaactacccaacctggccaggcatcacagtaatcatgtgcctgagttactttacaacaggagggcccggtaaggaacatgaaattaacaagctacyatcaaccagaggcactcaggaaaggtcaaaaccagatgccacatgttctatccaacctcctagaattctcctcattggaatccgtcttggctgagcaatg

SEQ ID NO: 37905 - DNA, 201 bp, Bos taurus
ggcggggaggcctcggggagcagctgctctgcgggccctgccccgggagacacacgagtcagaacgggtgcggccctgcggggccctgtccccccggccaytgtggttctaaagatttctgaccatgattctcaaagaacaaaaaacggttacagttttaggaagaaaaaataaaaccagaaactctaccctcatagagga

SEQ ID NO: 37906 - DNA, 201 bp, Bos taurus
caacaccaaggtcatgccaccatgaatcctatggccagttatctcactctctcttctgtgaatacgcaaaacaaggggaaagatttagattttcactcatrtaacagtatggccaggccttagctgcacacacacaccctgcacgccttacctggaaccccatatctacaaaacatccaaagacagtgctcaagcaggccg

SEQ ID NO: 37907 - DNA, 201 bp, Bos taurus
agctgatgcacaatattacataagttacaggtgtataatgagtcataatttttaaaggttatcctccagttacagttacttaaaacattgtctgtattccytgtgctgtacatccctgtagctcacttcacatgtaacagtctgtatatctcaccccactgccctagagagtccctcacccttctctctccccactaataa

SEQ ID NO: 37908 - DNA, 201 bp, Bos taurus
cccatgctttcttccataaaatatttttaaaatttctgtttaacatagatcaattttgcttaacacttgagatactgttctaaatagccttttctttcccyactccagatggccacctggttatccgaccactatttattgaacagagcatctttctccaattaacttgaaacgccatcttttgtcatatactaaacatga

SEQ ID NO: 37909 - DNA, 201 bp, Bos taurus
aacacacaatgcaaatgtcagagttctttttcaatcaggtcccacatattttatcttttatataaagaagaaaaaataacaaagagaaaaacaagacttargaagtatttcattttatgtaaaaatgcatgttcctgaaaaactgagttgcacccgggtaataaaaaacccataccttattactgagtaaatatttttctt

SEQ ID NO: 37910 - DNA, 201 bp, Bos taurus
aacttcagagatatttctgttttccactgatttaagcattctttggactccttttatcttcagcaaaaagctccacgtatgttctgtgaagagccgtaccraggtcatcctagatatgatacaggtatatgtttatcatttagttgcagtgtatgtgtttattccaaggccggtgggaatggcattttgtaacttgttttt

SEQ ID NO: 37911 - DNA, 201 bp, Bos taurus
tacctaagaaacaaattaacagggagggagctatgtcttgttatactttttactcaagacttgaatgaatatattagttttaagactttaaatcagaaagrtcagcagtgataaagttccttagcagttcaattatttttgtatatattttaattgtgcttaacagaaattgctcctgttctgtcttgtttgttataatta

SEQ ID NO: 37912 - DNA, 201 bp, Bos taurus
gctcctggcatctagtgggtagaggccagcagtactgctaaacatcccacatggcacaggacagtccctcactaactatgaattatccagcctgaaatatmagtaggcccacagttgagaaatgatgatctctggaccatagtacattaattactccccttccctccctcgttttcttcccaggtgccaaggttgtcttcc

SEQ ID NO: 37913 - DNA, 201 bp, Bos taurus
tatttaaatggtattttctgggtttctccttgggaagaggtactgtgaaactgttatcatcttcatcaaatgatttcaatacattcaatatatggccttawgatttcctgttttatagaatgaattatcctgttcagttgtgtttatcttgatactgaaattgtctcttatttggccagtgggatttccttccagttggct

SEQ ID NO: 37914 - DNA, 201 bp, Bos taurus
gccgcagtcacacatatgtcacgtcctttttagctccgctcccctcgcaacccgcccctctaggtcatttcagagtgccaggccaggcgcccgacttctcmcggggtacccgtcctactcagggtagtgtgtacgcgataatggcgctttctccattcgtcccactctttccttccctcactggccttttcgttttctaaa

SEQ ID NO: 37915 - DNA, 201 bp, Bos taurus
tctttgattcagtaggggaataactattaatgagtatgaactgtagctccatttcactgtagaagacacgccagatggttggaagtgcactttagaagggrcagagtcagaagtactatgggctaaacaaaggctatttggagatggggtgtgtatggaagaaaccaagagtatggctgggtaaggaagaagatgactgct

SEQ ID NO: 37916 - DNA, 201 bp, Bos taurus
actccactatattttgatgctaaatatccagcaagtcaagctgatagaggattaattcattgtcttcaataactgaagaagaagacgtatcataatttttyattattttcttaatgacgtacattggatttggtagtctcgtctaccatttttgtttatatcactgtgaacaatgtggctctctttatttttggtaaataa

SEQ ID NO: 37917 - DNA, 201 bp, Bos taurus
gggcagaaacttcttaagtaagattttaagaaaccacttattggcctttcatattaaaaacatatcattttaaaagatactcaagaaaatgaaaaggtgtrttatagactgggttgaaatactggtacaacttatacatgataaaggatttatataaaggatatataagaaactcttccatttaattataagacaagcaat

SEQ ID NO: 37918 - DNA, 201 bp, Bos taurus
tttataagaagttataatcagggcaggaatatatttacaaaatgtcataccataaaaacaaattataatagctgttgtttcagtaccagagatttcatggyggattaataagatttttttgtgctgttattactttttttccttagtaggagattgtgtaagccaattttctaagtgaggaaaatgaaaataatcaggtgc

SEQ ID NO: 37919 - DNA, 201 bp, Bos taurus
aagatggaaacagagcaaagaaatctgagataatcactactaacaaattattattcttttacatatctctttatggacatgagaaatgtatactgaactaytttcaggttcagtactttccatattttaaggtggcctagccaaggcaccattctggaagaagatagggatcaattttgaaagtgtaacaatgcagtaaaa

SEQ ID NO: 37920 - DNA, 201 bp, Bos taurus
agctttgttgtcttgtgtttcactagaatttcactgtagattgatggaaccattagtcatacgtttaaactcgttctccaggccctctcccctctgtggakatcaggctgatatcaccaggctcagttccccaaccctcatgagtcatcatcttagtataaacaagggacccaaggtgagtcacagcattagcataaactc

SEQ ID NO: 37921 - DNA, 201 bp, Bos taurus
ccattgtccctgggcaattcttgctacttcctcaacgttgactaggaagataaatagtagacaaatcatttatttaataaaaccaaatctagggtaatgtrtcctctggaaaagattaaccccctcaccctctttccttccttttgcctctcattaattgcctctaattactcaattgcatctaattattgccttctccag

SEQ ID NO: 37922 - DNA, 201 bp, Bos taurus
acttaacacctttttgaataacttatgacttagctttgtacttgctatacgtgatccagtcataatgtaaacacatttaatttaaatgtacttggtgtctmtgaaaaggagcaatgtatattttttgagtatgtgaatgatgacagcatgaagagctatggcatcatgtcctctgagttatagtttaaaataaatatcatg

SEQ ID NO: 37923 - DNA, 201 bp, Bos taurus
tggggtctcaagagtcagacacttagccactaagccaccactagacttggcaacatttcaagtaatcttaaatttaggcttatgtggcctgattgagaaaygtttggtgctgaacatggagctgggatgactaagattttctgttttgttattaccttcacttggctcctgtacccaggcagtctgtgatacaggccagct

SEQ ID NO: 37924 - DNA, 201 bp, Bos taurus
tgcaaaggaaaacaaaattgaatacttctgcatattcaaatttaggttgaaggaaatgaagttcttcaatgtacctttgcctaacttcaaagataaattayacattaaatactcttacaacaacaatgataaatgtgagtgcattttaaatattaattttccatcaaagaaatttattatgcatttatctattagagctaa

SEQ ID NO: 37925 - DNA, 201 bp, Bos taurus
tatgaagagattgttttttcagctttattaaatatcttttgatatgtatggagacagtttaaatcttatttgacctgttgcattcccagcttaaatctttrttcctcattatgtgttattatttaattatgctcttggatttttcatactattattattttaggatatttagatgtaaagttcttttaatctttgttgttt

SEQ ID NO: 37926 - DNA, 201 bp, Bos taurus
atattggaaaacaacttctgaagaaaaaaagaaaacctttctgcttaccatggttatatctcagtaactgtgactctcaaacattttaaccctaatgggcrcatgtgtgagtgtgaaagtcagactgctgtcccctgcaccctggagagccaggggttgtgagtgtctccccacgaagcctcttgtgacaccatctgcccc

SEQ ID NO: 37927 - DNA, 201 bp, Bos taurus
gcatgttatgtttatcagaagatttccaactacaaaacttccttgctggctgggaagaagggaagctacatttgacaagaagaggcaaggggaaggcccakaactgcactgaacaaaataattccagggaatgccagcctctaaggggatgggtgcagttattttctacaagtgtcaagctgcttacttttgacccgcaga

SEQ ID NO: 37928 - DNA, 201 bp, Bos taurus
aactttcatcatagagtgccttgttacctgggagagttcacaacctgacggttcaagccagtttgttcgtcctcaccttcccccaccccgccctggccagrgttgactggtcacacagtctttctctaggagttttcaaccaaacatcttaagattcagaaacagtcagcagcctttttctctaaccaggctgctgccaaa

SEQ ID NO: 37929 - DNA, 201 bp, Bos taurus
caatagaaatcttcaatcactcactcttcctcacaaaataaaatttgctttaggctttcaatgagggccaattgaaaaattaatcataaaattgctagagyggtgacaaagctgctttgcaatgtttttaaatatttaattgactcttctttgcgatcagcatcaagtcctaaatgtgtggtcgaaaaaggaaaaatctaa

SEQ ID NO: 37930 - DNA, 201 bp, Bos taurus
tcaaatggccttttttgtagactgtacatcctttctttaaaggacattagtcatatctgagtaggacttcaccactgtcatctcatttaacctttgctgasaaggcacaggagggcctagaggagctatcccacattgaagatcaggaagggcggcagtgaggagatacccctcatccaaggtaaggagcaatggctgcgc

SEQ ID NO: 37931 - DNA, 201 bp, Bos taurus
gtgttcagttctcttcccatctctgctgtgttattagaaaataagagaatgcgtttttaaatattagagttttgaaaacccagtttgaggctgggatatgrgaatgaaatcagttctactcatagagaatggtcaggatgcctcactgcatccctttaggtgtcagatacaccttaagcctgagatctggtcctctcccag

SEQ ID NO: 37932 - DNA, 201 bp, Bos taurus
gtctcattcaattgagttgttaatcttccttaattgcaaatttggaccttatggggatcactcattattgcagtggacatttgtcattttcctgagactcwagtatatggggaattccatatcttatgagtcttggtaagagataagctggactccctttagagaagtggattgtctcattatcttacagacattctagtt

SEQ ID NO: 37933 - DNA, 201 bp, Bos taurus
gcaatgggaccacagggatcagagcaagagaagggaacaatatgggggcagtttggcgcaagatcagcatagcatcagaaaataataatagtaataataayagaacaaggatcctagtgaactgaattcatctggtttttaaaatgctttaactatggaagtacattagggaaaaaaaaagatgtatagtagatattacaa

SEQ ID NO: 37934 - DNA, 201 bp, Bos taurus
tgactaggaactcaacgcattcggctcttggtaaatggatctcacatccttggtggattcttccaaaataatcatctaataatctaaggaaagatgatttkgaatcctactctataagtgactgatgtgctagagtgagacatttcattaaatcgattattcactgagaaaatctgtgttcccatcttgtgccaaacacca

SEQ ID NO: 37935 - DNA, 201 bp, Bos taurus
atatcagcaggggttaggtttaagtacacacacaaaaatagcagtttaaataaggttgctttcatgcaaaagaatctcgagggtggccatctggagagatyatgttggttgtacttggttatcaaagacttgtggtcctcccaactcttccttctaccactagggagagtttcaggagctccatgagcagctcagctagta

SEQ ID NO: 37936 - DNA, 201 bp, Bos taurus
ttgtcatttggctttgccaagttttatcttgttttatttttttacctaatataatacaataataaattctcctagtgtttaaatataacttggtttcttaytagtgagggagcaatataaaaaatttaaattcaaaaaccctaatctgtcacaaaaatatttgttaaaaggaaaatctttgctcttttactatgtttggaa

SEQ ID NO: 37937 - DNA, 201 bp, Bos taurus
agtttaatcatgggtggttgagactgaaagaagaggaagagtagaaagtagcagcctgagagaacaagagcgaaaaagtgaagcagccggcccagattcaratcttcaagtctcctgtctgctctcgagccattggctggtaaccagcagccctgtggtgaatggaggggtgaggccaagttgactgaggagccacttgtt

SEQ ID NO: 37938 - DNA, 201 bp, Bos taurus
gaaacttctcgccttaagcaggatcaatccaggacctaaagcttcaggagacctggaagtaggagtcctggaggatcaggggaagacccggacagtcctgraaatagagacaatcatcccaggcctctttacgttctctcaatgagctaaaagtcagctgacattttccagtgacctaggctactaagatgaatgtgtgtg

SEQ ID NO: 37939 - DNA, 201 bp, Bos taurus
ggcccggttatccctccttcttgaactacttctatcatctccagaagacagctcatcttccagctttgatggagaagagctcacttgctcccatccagtcygtggttcagtcttatatgtgaaagaaaaatatcactgaaagtaaaaggacatttaagatttccttctcctaaaagtttctttttaacgagttagcttcat

SEQ ID NO: 37940 - DNA, 201 bp, Bos taurus
tttcttcagctgtaaaatgggaataatacccatcttactatatgggaatttttgaagcatgtgaaataacacaaccacaaggtaacaagcaccaaacaaaygttcattgttttgcttccacttttccagattgggtttgcatttccccaaaccatgtctctcggagaaggcaatggcaccccactccagtactcttgcctg

SEQ ID NO: 37941 - DNA, 201 bp, Bos taurus
ttgctttccttaactattaaatacctaacaccagaatatttaggaggactatgatgattaaacaccatgtgtcaaatataaaaactgagtgtgtataacayggtataattgagtgtataatagaaagaaaacaagaaatgagttatgactcacaaaaaaatgtaatcacaaattaaaattctaccaactataagccttttt

SEQ ID NO: 37942 - DNA, 201 bp, Bos taurus
gcatatcaaagctcactgacagctgtcatcaccacaatcctttctaacttttaacaaaaacctggaatctcattagagtatttacaggccaacagcttttktttttaataaatcagattggttctgaccagtagcaaagacatggggagtgctctccagttcactgatgagcagctgatgacggctgtccccgggcacagt

SEQ ID NO: 37943 - DNA, 201 bp, Bos taurus
aatggaaaagccagtggggtgggagaaaaagcaagtaggtgtgaggttactgagccaagtagagcaagcgtatcacagaggggaaggtgaacggccacatsagacgctgccgccaggaaagaacaggaagacggagaactgacgctggaggcggcgctctgacaccacgatgaccctcacagaacacgcagcggagggtgg

SEQ ID NO: 37944 - DNA, 201 bp, Bos taurus
ttatttacaaagtagggttttaagaccaacactgaggcctgatttcaccctatgccccttatccctactcccatcccaggcacccagctcacatggcccamgcccttcacacgctctttcctacatcacagactctcttccactgacaccctgctgtatttcccaccaagactgctcctaaggttactgcattagtgtgtg

SEQ ID NO: 37945 - DNA, 201 bp, Bos taurus
cacagggcaattaaaagcagaaacaccttaaaggcacaattctgaaaatgccatttttgcaaaacaaagcctaaagtgtcagaaaacacaatcggtctgarctagttgactgttcccctttccgtacctcctccctctgtctcaggtctctcctcaacctcttcactcagatgttctagaaaagctcaactctgattatgc

SEQ ID NO: 37946 - DNA, 201 bp, Bos taurus
tcaaccttcatagagctgaagagttagggctgtgctctgcattaggctttcgcttaaggggacgttgtggatggtttgattcactaaaactttctccatakcagcaacaaggctgttttgctttcttatcattcatgtattcactggagtagcacttttaatttccttataagaacttttcctttgtattcacaacttgga

SEQ ID NO: 37947 - DNA, 201 bp, Bos taurus
tcctgtgggactggccagaactgaggcagagggatggagcatgccgcctgcgcctggggacagtgcttattgatgcacctacctgggggtctacactctcraggatggatgaggccatatcaacgccaagctgattttcttggtccctacagcagcagagaaagtatcctgctgctgctgctaagtcacttcagccgtgtc

SEQ ID NO: 37948 - DNA, 201 bp, Bos taurus
aagccttcttttcagcttcaactctcacgtggccacctctttcattgctggtaggttcctgctgccaagggtgggcgacggtgggtgcccttgctaggacytcttatttaaacaaggccactttccagcctattttgcatgcaaatgcttacaagagcatgccagcttgctccttaaaattagatgaaataaagacacttg

SEQ ID NO: 37949 - DNA, 201 bp, Bos taurus
gtcgaggtctcactctcctcttttgttctcccttgtctcacagcaccctggagggatattatgtggacgatgccctgcagggccagggagtttacacttaygaggatggaggagttctccagggcacatatgtagacggagagctgaatggaccggcccaggagtacgacacagacgggaggctgatcttcaagggacaat

SEQ ID NO: 37950 - DNA, 201 bp, Bos taurus
ggtcgtctagaagctgggagcaaggggcctactccggaaccacggccttcggagcgtggggacggggaggaggaaacctgtggtcccgggcgcgcgggccrtagagggaacctcaaggaagggacgaaggagtgcattcagcctgactaggagtacgaaggcggggtcccgggcgggggtggcccggtgcccggtgggccg

SEQ ID NO: 37951 - DNA, 201 bp, Bos taurus
gttgtaaataatgctgcaatgacccctgaggtgcatgtgtctttttttttttttttttgcgtgtgtctttttgaattatgtttttctctgtatatggcccrtatctcccaccgtcactttaactgtacaactcttatcaggcttcacacagccttctttgccatcagacatgtgctacaaatgtgatcttagaagggagga

SEQ ID NO: 37952 - DNA, 201 bp, Bos taurus
agaggctccgggcatccttctcttccagccgcggcccgggtgaaggtcgcatgcagacgagctcgagagggcgcgaacgaagctgcggatgctgtgaagckgaggcgctgtctgccgcgggccggctggagctggagggtaaccggcgagcgcagcgcgctgacaaagcgggcgctaccaagcgaacccagtgagggggtg

SEQ ID NO: 37953 - DNA, 201 bp, Bos taurus
acagcatgatattttcacacttccttctcctacccgactctcttataggagaattctagatttttaaaagtctcttaaagcatctgggctgaaatgacaaygcattagctaacagaccagtagaaatttgagtggatcttctaattattcttctgctttttacctttcacactttctctctccctgcatcttcctatccct

SEQ ID NO: 37954 - DNA, 201 bp, Bos taurus
gaagtcctaaccaggatctcaccgtgtgactgtatttggagatagagcttttaaagaagtaattaaggttaaatgagatcatacggatgggccctaactgrtatccttataagaagcagaaattaggatgcacacatacacacacgcacacacacacacacacacacacacacacacacacagggaggcccatgtgaagac

SEQ ID NO: 37955 - DNA, 201 bp, Bos taurus
cttgctgtctggttttgcatcttttcatgcattcttgatctctcctctgcgtggttataagtccctctggagcagggtgacgacagtgatacccccctttrtaatgttgcacatagtggatgctcacagatagtttggtgataatcttttgtaacactgactgcaaaagtgactttcaacatgtgaaaaatgaaaatagct

SEQ ID NO: 37956 - DNA, 201 bp, Bos taurus
cttaagattagaaaacaatgctgggcccatttgaggtattccaggaagtgcggcactgtgtggctcctagacttttaggactatcttggattccttggtcrggaagaaggggaaagaactcataaatagctcatggggtttccagtggttatcttgggccaggaattgctcccgtggagtaagtcttggtggagtttagaa

SEQ ID NO: 37957 - DNA, 201 bp, Bos taurus
atgacgtcattttctcttcttttccaatattgtacagtcaaggtcattcattcaacaatagatcgcaaagcatgtaataatatttctaaagggctaaattrtttcaattttcatgtaacctctgtgtaaaaatagttctctacccatttaccttcttccattcacacattggcattgttgtggcccagtttattagactaa

SEQ ID NO: 37958 - DNA, 201 bp, Bos taurus
gttccccaggtaaatcccatgaggcaataccttagagggtttcctgggaagctttcttcatgctggagaagctgggtatctgccttgggccctcctttttkccctggagaaattacaggtcaagttggtggggaaggggaacctcctggtgtggcagcatactggcctggggtaggagagatttggccaaaaggaagcaag

SEQ ID NO: 37959 - DNA, 201 bp, Bos taurus
gctaacatttcaattaatgtcccttttgtctcactgagaaaaatcatttcacaatttattacactggattaaagagtgtatacattctggaggtagaacaygactaaaaggcaatctggcagaaaggatgtcgaaacagttggtatgtttaaattgttctgaattccttaaataaacgtttggggctgctttcccaagaga

SEQ ID NO: 37960 - DNA, 201 bp, Bos taurus
cttccactaaagtttttccattttaatatattgcccttgtaatttcagaaaagagtaaaatttttgcctgggttagagatattctcaattgatttataagyataaatttgggctgaattattcagataagccggcttctgctaagaatatctacatagatattaagttatttcctatgcataaaaagcaccttcaataaaa

SEQ ID NO: 37961 - DNA, 201 bp, Bos taurus
tttttaagaataccatctaaaggacaaaacagtgataattttttcttgttacaaggaccgtaatagttttccacaagataatgcacttcaatgggtactgrtatctttccttaaagtttcattgttttgaaaaaaaaaggaagaattcaaaactgggacagcctttttcatttaataactaagaaacaagtaaatattcct

SEQ ID NO: 37962 - DNA, 201 bp, Bos taurus
aggttaaggaaggaaaaaaatagacaatatagatgcaacttggcccttgacaacataggcaatgtgtcattttatatagcttaaacctaatcattgttgcraaagaaaaatttcagagttgtcatggcattaaagtgactttcataagcattagagcattgaaacatattaaagaagatttatgtctttttattcaatgct

SEQ ID NO: 37963 - DNA, 201 bp, Bos taurus
tccaattttaatagtcatacggtctcctggggatctttttaataatggagattttgattttaatgtgcttccagatgatgttgacactgctaatatgtggmacacacttaaaatactattagaaaggacacaaactatggtctgtattgcctcagatattaatcctatgatatttcttttctgtttcattactgattttaa

SEQ ID NO: 37964 - DNA, 201 bp, Bos taurus
ccgttctacttgaagaaatgaactctggaaaatagcaatatgtaaaaaagattacagtttacaattttgaaaaagtgaagaggttaaatgtctgaaaataratgattgattttaaaacacatcagtacaattataccagtagttcccaagactctttttcattagaatctattgaggagcttgataaaactacagattttc

SEQ ID NO: 37965 - DNA, 201 bp, Bos taurus
ttctggaagctggaaattctgaagtgaaggtaccagcaggttctatgctggatgacaccctgcttcttgcttcatagatggccatcttgctgtgacctcaygtgctggaagagctttctggagccccttttataatggcactaattccattcataaggatatcccctaaaaggccccaactccagatttcataacattggt

SEQ ID NO: 37966 - DNA, 201 bp, Bos taurus
ctcagttgtagagagccactttacccagtcatgatctgaggaagtggtccgcatccagtgcatggtgaagttgggaatataaagtctagctcaacttgaaygattgtcagtggccattgcagctccacagactcacatccagagattctcaggcctgaatctaacttgacttcttttacccaattctgctgcttcttcctt

SEQ ID NO: 37967 - DNA, 201 bp, Bos taurus
gtacttgaatctctaattctgaatgagttatctgagggttgctggtaaataaaggaaaattcttgtcaatctttacttaatttgatgcacttacttatttrtatctctggagagaaactctctcaaaacagtggaccaataacatctataattaaaatactacacttaaagttttgctttcatttaagtcagacagattta

SEQ ID NO: 37968 - DNA, 201 bp, Bos taurus
tctctatctgttgaggtaaagaaacaaacaaaaaaagacactatttgggaataaataattaaaagcaaaatctcctcccagaatgtgatgcccatcacagraaatccactaagaaactgcaaagagagaaagaaatcttactttttttatataatcaggtagattatcagtcatcacataaatgttcccaagataaatgat

SEQ ID NO: 37969 - DNA, 201 bp, Bos taurus
cttctgctggttgtggaagcatgttccttgcaaaaagttgtcaagatgcctgaagaagtggtagttggttggcgagaagtcaagtgaatatggcaaatgargccaaatctgttcaacttttgaaatatgtgttgtgcgacatatggtcgggcattgtcatgaagaagaattgggtcctttctgttgaacaatgaactgcag

SEQ ID NO: 37970 - DNA, 201 bp, Bos taurus
cttgaggaaatgagatggtatgaccaaagtatcagtcagaatacacagttagttattcatttcattgtgcttaagaattgatctaaaattagaagcatgtrctttgtctggcttatgtgatgttcaaatagttaacttcaaaagctataccattaaaaatcattttagtaaagggagttgaggggattagcagaaagcagt

SEQ ID NO: 37971 - DNA, 201 bp, Bos taurus
gacaccccagacttatataaccaatttcatacttgatatttttaactggatgccaaataatcatcttgttcaacctaccatcctgcttctaccaaattctyccacatctcaggtgttgacatctgcatacttcagtttaccaggcaaaaaacttaatgttaaagccctctcttttcccctcatatcctacatccaatccat

SEQ ID NO: 37972 - DNA, 201 bp, Bos taurus
tcaagtcaagatgaggtcactggggtgggccctcacccaatataactggtttacttgtaagaagaggaggagaacatagtatgatgacagattggagagakgcagatggaagcctggccacgagaagctaggaagaggcaaggaaggatcctacccagagtctcaaagggaggccagctctgcagacacctgattgtatgt

SEQ ID NO: 37973 - DNA, 201 bp, Bos taurus
tctttttcttacttacttcactctgtataataaagcctgttgctcttatcaatgactttatttgctgaatgaattcaaaactattagatggcctcatactrcctaatggtccttgtttctcacagttgttctctctatattcattcagttcagttcagtcgctcagtcatgtgcgactctttgcgaccccatgaatcgcag

SEQ ID NO: 37974 - DNA, 201 bp, Bos taurus
gtagggattctttcaaccattaggcttttgtaacctcttacacctgcaatttatatcattgctatggtctgaatgtttgtgtatccccaaaagtcatataytgaaatcctaaccttctaaggtggggtcgttagaatatggggctttcaggaggcacttaagtcactgatgaattgcattgctgctgctgctgctgctgct

SEQ ID NO: 37975 - DNA, 201 bp, Bos taurus
actctgggagttggtgatggacagggaggcctggtgtcctgtgattcatagggtcgcaaagagtcggacatgactgagcaactgaactgaactgaactgawctgataatgtagtctcaccaattataaaaatgtttcactgtggtacaggatgttgacagtaggggagaatgtgtatatttgggggagaaggagtacatgg

SEQ ID NO: 37976 - DNA, 201 bp, Bos taurus
tgttttcttgacatccttttttgtaaggtgggttatttagtttacacaaattctaagagaatagccattaggtcactcagctttatttgttgaggcttctrtcatgtttcccacaaaatcagacacttcttcactttgtcttttgcagcatgctagcataaattgaaggtcacattaagaggatttagtgaatgaccccgc

SEQ ID NO: 37977 - DNA, 201 bp, Bos taurus
tcaattctagagaatatttatagttaaagagaattgtaactagtagtgatttcaaatagtaaagaattgtctgtgagatctaactctgtgacctcgtctcyggccacgatctccattatgaccttacttttgccaaagctaatttgtttcttttcttaaatcacaagaatatgcacactgctacttctgcctgcatgttgt

SEQ ID NO: 37978 - DNA, 201 bp, Bos taurus
tatttacttttcctatctgcaacatgtctcttaattttatataaatttctatatttatgttttttatttatcaccaagcattcaatagacaatattgtgckcatccatgttgcttttcaaaataaaagcacttctctgcttttcaaaataatctcttcctcaattgccagtatatccaaatggtcagggacttatgctgat

SEQ ID NO: 37979 - DNA, 201 bp, Bos taurus
tgataatattctgtcatttattgatacctttaaagttacaaaagttaaaaattaataaacaacataaaatcattttataatacaaatatcatttattgtcrcactaagttttattacaaaatttcattctcaaggtccatttctgaaccactcactaatctactcaaggaaaagctttctaatgtcaaattgaatagatta

SEQ ID NO: 37980 - DNA, 201 bp, Bos taurus
tttttatgttttagaggatggggccaagataagcactcatataggaaggggcttgcttgtattatttgaatatacgacttaagctagagaaatagcccccrggccctttcatcagctttatatatgtgggacacaggaagaagagctaaaggtaaggtttaaagatgacagtgtcaaacataaaaaaatagaatcagcata

SEQ ID NO: 37981 - DNA, 201 bp, Bos taurus
ctaaactacttagtgtcttaattcaggccctcatcagtaatcattcagttgactatgtgactggctcaggtctctgtccctttagactcttgctcttctcrttctttacttctggtggagctgggcctttaagaatgaaaatattttatgttactttaaaaatattatgatatcaagactcaaacatcagcatgaaaaaaa

SEQ ID NO: 37982 - DNA, 201 bp, Bos taurus
ctttcatgttgctcagaaaagagttttacatgaccatagaaacaaataaataggtataaatataatcacttatttgtttgcatgtggataatatattattrtgaatactttaagttccttccagcctatggctattgtataataccagagggagtagtacttgactttatgaaattgctctttgagaggtaacaactctgt

SEQ ID NO: 37983 - DNA, 201 bp, Bos taurus
cttgagctgagatgcctaaagaagatcttggctgacaaccttagataaataatctaggaatgtaggtccttgaggcagtaatgcaaactacatgaatatgrtggccagagagccctgaatccttgcctgcagcccatccagaaactgaatgttgtgcatcaggtggagtgtgggtagggcagctttctcccacgtgtcctg

SEQ ID NO: 37984 - DNA, 201 bp, Bos taurus
gcttaatcacttaagaaaatgccaaatcactttttaaaaaagactctggagcctaaattatgattttgaatatttcattgatacatacagctaaacactgyaatactgtatacaccataatgcaaaacagatgcagaaaaacacatttttaatcttactgacaaagacagctacaatagcaaatcacttacatagtatgta

SEQ ID NO: 37985 - DNA, 201 bp, Bos taurus
tacttccaggatttaactggttggcccagagaaaatttactttaaaaaaattatagttatattcaggtcactattgatattattagatggaaccccctcayctggccaattaataatacctactctgactctatttctgctttattgactatgtcaaagcctttgacaatgtggatcacaataaactggaaaattctgaaa

SEQ ID NO: 37986 - DNA, 201 bp, Bos taurus
gttcatttgtgacaggtgtaactttattattttattgtaagcagctaacaatccttaatgtactaatgccaggtgatcaatattgattataaattgacacmttatcaatgactgcagtttggttcaacatttttttattgtattttatttttaaactttacaatattgtattggttttgccatatatcgaaatgaatccac

SEQ ID NO: 37987 - DNA, 201 bp, Bos taurus
tttcagtttttgctatccttggggccgtgtcatttggggccatctatttggcacttcaatgtagaaataattttgacaatttgtgcccgtgttctgaaatrtgtctggaagacaaaattttcagaggtccttactctaactgttccataagtcctgtctcccagacattttgatttcttaaaataatgacatgattgaagt

SEQ ID NO: 37988 - DNA, 201 bp, Bos taurus
ttggccactcctgaaccaatcactagtaaagaggaaaaagcaatcatgattggctcagatctatagtctggtaaagaacaaatactggagaaccaatcacyatgtccattacacgatttcacttgatcatcacactcactcacttggttacataggagagacataaaccacacagagaatagtttctcacagagaaagagg

SEQ ID NO: 37989 - DNA, 201 bp, Bos taurus
atgaactgtttatgatcctctttgctagcaagaatggaaaataacaaattcctcagatcagaagccatacacagagcacctgttattctactctagcaaargcaatcacatctggacgagcagctgcaacttggatgacgacgtggtggactttccagtagtcggcttcatcttccctccaggcagcagccagccagccct

SEQ ID NO: 37990 - DNA, 201 bp, Bos taurus
tcaacttctctccaccattcaaattaaatgcctcattttaatattgcacacacatcccaatgtctggagtatttaaaggaataattgtgaattttttcgarggcttcataatattaggaaaccagagaacttttggttcttaacaaaaagttatttttagtttctttttttgggaagagagtgttggaaaggtttttattt

SEQ ID NO: 37991 - DNA, 201 bp, Bos taurus
ttttcaggattttgtcattaaggaaactgacggctagcactggtacaaagaaacagaaaaataaagttggaaaacaagcataaggaggcaaattaaacttyatcgacagtctcctatgaagcatcaaaatgatgtagccgactggaataccaaagaagacccagagcatttttagtctgaaattatgcattttgtgcacaa

SEQ ID NO: 37992 - DNA, 201 bp, Bos taurus
tttcagtggctgatactagaaggggtgagcccagacccctctagcacatggatccacatacctaacatggcacacatcaagatgtgggcctgtgttttagmagtagatctcaaggcaggctggtgtcttcagcagttgagccctgcctttgaacttgcctgggggccatttaggtcccaggctcttccaggcaatagcctt

SEQ ID NO: 37993 - DNA, 201 bp, Bos taurus
tctatttttagttttctgagaaacttccacactgttctctgccccaacttatattcccaccaacagtgtaggagaagtcctttctctctacctgctccagyatgtcttatcttctacttttaaaacacgggacttgtattgctctttttcagctgtcctgtggtcttacttttacagaatcctgcactttccttccctgtg

SEQ ID NO: 37994 - DNA, 201 bp, Bos taurus
ggcaggggggatggaaggtaaggacaagacatcagacctcagaggacaagagtcggatactagagggccttgagtgcaacgtcagaggattcagatcctaytgccaagagggatgagccttgtcaaactttacatacttgtgttttagaatcatctggaagcagactggaaggatgaactgtagttggttacaactaaggc

SEQ ID NO: 37995 - DNA, 201 bp, Bos taurus
cttagcagaaacaggggctaaagattatttcatgtgttaattcagcagatacttttgatcacctactatgaatcagtgatgtgctgggccctcagatacartactgggaaaaataaacagttataaaccagcacccattctaggctagggtgagaaacagaaaatacacaagtaaaaatagaacatgtcaggtggtaagtg

SEQ ID NO: 37996 - DNA, 201 bp, Bos taurus
aaaacacctagatttccctgttcagggcttccatggctaattttattcaccattcttttagttcatctttgttatcttagatccatcactcagactaatgraaataaaaataaacaaatgggacctaattaaactcaaaagcttttgtacagcaaaggaaaccataaacaaaacaaaaagacaacttatggaatggctaaa

SEQ ID NO: 37997 - DNA, 201 bp, Bos taurus
gtctagggatatggcctagatggtgatgcttttccctggactataccaatctcagcaccaagagcactgcatcctgggaatctccctgatcctatgcaaaygaggccattagtctctttctcagagtatgtccatatcagcttcaaatggtaaaagcaggggacccagttgctgctttacaatggactccagtcaccccct

SEQ ID NO: 37998 - DNA, 201 bp, Bos taurus
tttttagaatcattcaatctaacttttattcttgggaaaatgaagatgtataaaaataatgaaaactgaaactgcattttataatttagtcaatcaggtgrtaagattagggatgaaaataggtgaattacagagaatttctgggtcactttgctgtaccctgagttgaaaacacttctccttgggttaacttggttccct

SEQ ID NO: 37999 - DNA, 201 bp, Bos taurus
ttttaaaaaatcacatatcaaataaaataatcaggaaaatctttgaaattaccaaaatgtgacacagacatgaaacgagtaaaaactgttggggaaatggytcagatggacttgcttgatgcagagttgtcacgaaacttcaagctgtagaaaaaaatgcaataaagggaagtgtaataaaaggaagtctgcttgtggtcc

SEQ ID NO: 38000 - DNA, 201 bp, Bos taurus
atgccagcattggcagctgaacaatagagaggctggcccatcaaatgcctgatacattgaactacagaataggaccccaaccggggtgaggggcccactakgtgcctgacacgtggaacaacaaagaaggaccccaggcaagggagccctctaagtgcctgaacaggctgagctacagagaaagactggccaaagaggcct

SEQ ID NO: 38001 - DNA, 201 bp, Bos taurus
gcaaagtcaccaccaaatccacaaccccatgaaggcacacaacgtaagtgataactgaacaaggactgctcacacaggtaaacctcagatgccccacaaaytccacgggggcccatctccccagatagagagcatgtgtgcacacagtgtggccatggtacagtgtggtgctccagcctgggcacatgggctgtgggaaca

SEQ ID NO: 38002 - DNA, 201 bp, Bos taurus
tcccttcactatgtggccaataagggtcaggggagaatctcaatggggtaaaccatttcactatcataaacagatcacagagcactattacagacaggccrtttgtgtgcagtagcagaaaatgaccgggtgcaaaaggatacccgataaatgacagggagcgtgctacactggatctatgctggcctctttaacagtcta

SEQ ID NO: 38003 - DNA, 201 bp, Bos taurus
cacacccatgtaggtgcatcagacacaagtgggaggattcagagtcaatggggtcactgagaattcttaagaaaacattcaagtaaaaggagccatcactyaccaacaaggccacacaggtgctggatgagaggggctaaagaacaaaagacaacatagttattgaacagaggtcacaatctgagagtcttgcctgagccc

SEQ ID NO: 38004 - DNA, 201 bp, Bos taurus
acacagctactaagtggaagctaggttctaacaggaagaaagtgagctaatcatgttaaagtatcatggaacacatgagttacagcacattttgtctgcayagcagtttgtgtgtcctttttatctcaagagttcagagtggcttgtccccagggaccagtaagaagtggaggcacccagatcacctgggctccaatatgt

SEQ ID NO: 38005 - DNA, 201 bp, Bos taurus
tgtgcaggcctcctgcacacaccaccacctcggggtagacaaaacacctaagccactcctccacccctgggcacacccctaccctcaccttacgaaacagrgatccccaaccctggggccacagatcactccgtggcctgttaggaaactgagccatacagcaggtgagcagcaagtgagccaataaagcttcatctgtat

SEQ ID NO: 38006 - DNA, 201 bp, Bos taurus
gctggtcctggggcctgcgtaactctcaccacaggtgaggaggctgaagctacagacatttacagtcctgcagttctggagataaggtatcacagggctgrttcccgctgaggcctctctccttggcatgcagacagctgtctcctccccatgccttcacatggtcgtccctgtgtgcctgtgtccttatctcctcctctt

SEQ ID NO: 38007 - DNA, 201 bp, Bos taurus
aggagttgatgaaacttcaaggggagaagaggtccgtggaggtggagcactcacgcctgcagaaggagatgtcacagatccagcagcaggtggtggatctygaagggcacctgcagtccgcacagagggagcgtgatgaaatggagacgcagttacaggtttgggggtgtctttgatgtgtgagggttcagctgaatgtgc

SEQ ID NO: 38008 - DNA, 201 bp, Bos taurus
gcacctgccccccatctcgccccggcacacacccatccccaaccttagtgtgcttttcttaccaccccaatggaggtcagcgctgtggccaggttaatgayggtgggaatcaagctgaacttcccagcctgggggcaaaggcactaccttagacagtcaggggtggggcccaagggaggtgtggggtgtggtaggggagac

SEQ ID NO: 38009 - DNA, 201 bp, Bos taurus
aaacaacactttgtgcaaatgattcttctgaagctatgcttcttcccctgacttgagaggaaccgtgatggtggtcttatgggacagccaccaaagatatmgcccctccgatacaggcatgcccagagaacagggctgccttcctgccagcctcctgtcgtttacactcacaacacactgtcttcacatctttcattcact

SEQ ID NO: 38010 - DNA, 201 bp, Bos taurus
tggttagtctttcctttcttcggtccatccagccaatatttgcgtcagagaggcacctgaagctggggatccagcagtacccacgacagacaaaccccacyctctgggaacttctgtatggcaagttagagtatgaaagtaaaccagggaataaacaaagtaagctccagttctgacaagggttatggaaacatagaacag

SEQ ID NO: 38011 - DNA, 201 bp, Bos taurus
cttgacttttctgagaatttgctgaattttccactttgcctttattttttgcttttagcagggtcactgagttactgttggcatacaatgaaaggggtgcrtgcatatgtggtcagccttgtctgactctttgtgatctcatggactgtagtctgccagactcctctgtccatgggattctctaggcaagaatactggagt

SEQ ID NO: 38012 - DNA, 201 bp, Bos taurus
aaggaaataaattgttggcaatattttgtgaggtcatttgggaacctcctctgtgtcttggtttaaaagttttgtgcttaagagtttgtgaaagtcagatkgatcagcttgggcaacagcttaaggctcttttcctgaatatagcagctggaagaaaaaagcaaaatcagtgagaagattctgtggtcgcctcaagtgcca

SEQ ID NO: 38013 - DNA, 201 bp, Bos taurus
agtggcaactggaaaggtgaccacagcttagtgagggcgccagcaacagacctagagcctggatccaaagagtctcagataaggaaatggagacatgagamatgacttcacatgtgtgatagctcctataacagaaaagagacgggagtttaggattaggtggtgtggcttttattcccagccccactgcaaaaatattaa

SEQ ID NO: 38014 - DNA, 201 bp, Bos taurus
ctaaggaggtatcccacatcagaggtttgtctccctttgcctggcctgtcttcttaattccccagctatgcttaccctggcattggatgtttcccttattmctcagacttgtttgctttggcctggattttccttaattatccaagtgtctgcactgacctggaatgtcccccttatttcccaggtgtatctactttgacc

SEQ ID NO: 38015 - DNA, 201 bp, Bos taurus
accacaggcccttctcttagctgagagcgaggctactggagccacctggggacaagaacatgcctgggaggtaactgccagctcaccatccactagtcagkggacacatggcccctgcagagccaggagaagcctgtgcttttgccagcatgaatgagagccacaggtggcagctggccagcccgtgtgttggggaagcaa

SEQ ID NO: 38016 - DNA, 201 bp, Bos taurus
ttcttttattttaacctgttatctggggagcagtaacacttggagactggattatctgtcactttggaattgactgtaccagggcttgggggccttcctgrataagaaaacaggctcattctagatgccaggggagaaatggcaaagaagacagtcccgggagtcggggccacatggttgcacccccctgtacaggccctg

SEQ ID NO: 38017 - DNA, 201 bp, Bos taurus
gacccttcatcaggagacttggtggtgactcatggctctggcatgagaaccacaatgacccacaagaagaaatttcgccagactttgacaccagttggccmcacagagagcctcacttcattgtgtagtgagtgttcagatgcagccagtgacctgctgctgaaataggccctttataggatgtataagcagttaccccag

SEQ ID NO: 38018 - DNA, 201 bp, Bos taurus
aaacatacgattgcctcaatttcgttctttctcaaatatacatacaggctcacattcacatgcactgctgaagggatcaaatttttcacagtgatttcacrtgcagtgattcaaagactgtggaaaccttcccagtctcatagcatcttcctctcaggagaatgcttctttctttaacctatattaaaaaaagcctcatat

SEQ ID NO: 38019 - DNA, 201 bp, Bos taurus
tgcaccagctccaggacctggcctcacccactggtgagtggacaccagcccacagccaccacagcccaacagcctgccacgccaggggctagtccaacctycagaggccagcaccagacccaggacaccctgggccccttaaccagcccccttgggatcctgggccacccatcagctttgggagactgaggatcctgtagc

SEQ ID NO: 38020 - DNA, 201 bp, Bos taurus
gaaaacttttgtgtaaggaaggtaaaatataaattacatagcacacactcaaatacaaccatacatatacatgggcttaatatatatatatatacacaaaygtgcatttttcttttctaaaaaaaacagtggaagggtaaaccaaaaacaaataaactgattacctgtgaggagggtgatcaacagaaataagtcttgacc

SEQ ID NO: 38021 - DNA, 201 bp, Bos taurus
tgggaagaaactaagaatttgaaatacagtgactttcattgactgaattgtgctggtctctcactgactgagttgttgccaggccaggagaaaaaactttytcttgttggcagtagtaatgtcacttcccagcaaggtaccatctcttcctgctgggatctgtattgacattgagtgagagctcctcctctggcctcttga

SEQ ID NO: 38022 - DNA, 201 bp, Bos taurus
gtgcccacaggctgttcgctggggcaggccctcccccgaaagccatgttttcacctggagacgcagtgtttacaggacggtctgccgggagggaagttggrtttgggggccagtgggggcgagggtgctgcttgctctcctgacgctgaggcctttgtagaggcaggtgcgctgctgtccccagggcgttcccacgggctg

SEQ ID NO: 38023 - DNA, 201 bp, Bos taurus
cagtgcacgaagcactgttcacgccattcaggggcctttaatttccagctaattgctacttaaaatcattttctaccatgtctgtgcggcacactgcacaytggctgtgttgtttttctctcctgagagctggggtgggtcccacagagcacagcttcgtaaacaaaaggagcctggggcaattgctggctttctagcctc

SEQ ID NO: 38024 - DNA, 201 bp, Bos taurus
atttttgacctggtgtttatggggttcctctgagctgggtcacaccctgcaagtggcctgcttacccccgcccctcacatgcaccgtgtgccactccaagmcctttagattgactatttgagcgaattccctgctctaagtctcccctgttcctatacacagagagaaaggagtggggctagactggacttcagcgtgagc

SEQ ID NO: 38025 - DNA, 201 bp, Bos taurus
caaaatggtattgacattggaattgacaaatagaccactgggaaagaatgatcaataagaaatagatctcagtataaatgaaatctgatagagcaaaggtkatttttcagttggataagaaaaaagatttttaaataaatgagtggcacaatcaatgtaatatctcattgcgtatttaatttacaatgtatacaaattcaa

SEQ ID NO: 38026 - DNA, 201 bp, Bos taurus
tctacaaaggtgaagagtgttaaaggaaagagggggagaggggagagagggggccctcaggggcaggacagagggggccctcaggggcaggaaacagtatrgagtgttaccaccccaattctgcagaggcaagagagggagagaggcagagcccgatggggcccggaaccttcaccgtgggcttgaacaaagggatcatgg

SEQ ID NO: 38027 - DNA, 201 bp, Bos taurus
tacctggccttgagtcttgctgtgtactgggggtgtgcttgcatgctagtcctttggtgttgtagcctttactgctgttgcgggatgtggatccaagggtyggcgtcactggccaagggaatactggagcagacggactgtgtggatgtgaggcaagagaccccgaaggggtggaatgtggggaaagagcgatctgccaag

SEQ ID NO: 38028 - DNA, 201 bp, Bos taurus
gatggtcatggaactcaaacctggccaattaaagcactgtatctttttggcctcgtgattggttcagggatagttgtggggcccaatcctggtcaataacyatcaggctgagaacttcaattcacactcgtgagggagagaaggttttgtttccactgggcctaaagcacagaggttgtcagctggggactctaagttagg

SEQ ID NO: 38029 - DNA, 201 bp, Bos taurus
aggcactcgtgtgatttcacgtgtctgtaatgggcaatgagatcacaaaggcatctcaggaacaatccaagcccaggattcttttatgcatcctgtgattkactgctcatatatttaagttgtctggtccacattgactttgaaggtcattttttgggcaacctgctttgattaaatttttccaaagcatgccaagtattt

SEQ ID NO: 38030 - DNA, 201 bp, Bos taurus
ggattcgtcatctttgggggcccataagcccctcactctccagctccttgaaacccatggggacttggctgacctgtgctggctctgactagggtacctcrcctgggactgctgtgatgggccagcaaaaggggtggaccgaggagggatagaggaacccaggttgcaacagcttcacgcagaagcaccagatctttctcc

SEQ ID NO: 38031 - DNA, 201 bp, Bos taurus
cttcagagcctgagacctgaaaggccagctccagccaaaaccctacgtgtgatctttcaggtccatcacaagtcattgtaaggctttgactgacaggcccrcaggggatgttgccctccccacaccagacttggtgaacagccaagaacagcctttctgagttttctgaaaggatttccatcaaggactcaggtcccctgg

SEQ ID NO: 38032 - DNA, 201 bp, Bos taurus
ttgagatggttaactaaaggtagtttcctaatgctgcatccaaagtagaggttgctgtgtgtgaattcaatggaccataatgactgtggcccaggaaatcmcatctctgtccccagtagagagtttttcttcctctcttatattagagagaactccaagggaactggatttctcagcatttcttctcctttttccggggag

SEQ ID NO: 38033 - DNA, 201 bp, Bos taurus
tctcttatcttctatctgggcagggccctcctcccctcagttgtcctgctgttttcatcttggaccatcaatccacagaggacaaatcccaactgtttgcrctggggccccataaatctcctgcctcattgcaatgaggcgagggtggctctccccaggggtgttcaggggagggggaaacaggtggctggatgttgggtc

SEQ ID NO: 38034 - DNA, 201 bp, Bos taurus
gtgggatcttcccaggccagactttgatctcgtgtctcctgcattggcacgtggattctttactactgaaccatcagggatgcccaggattaagattcttraagaaaagtattggcagggatgtgaaaagaaagctctctccacatttttcttggaagttgaaactggtacaatcagcttgaaaggcaatttgacctccct

SEQ ID NO: 38035 - DNA, 201 bp, Bos taurus
ggagtttaatctccaaatgatgttacatggcaacacgacctctctctaatctgtacgattagggaaaacggaaagtctgggcagctctgataaaacggccyattttgcaagtgttccaaacaagagtttctcgagaaagcaaacaaacaaacgagtaaagttggtagatttcctggcctgaaaaggtgccttttacatttg

SEQ ID NO: 38036 - DNA, 201 bp, Bos taurus
tggagaggacttataccaaaaagagtcagcctggctgagtttttgccccatttattgttgttacagctgaagtcacagcaggaagcagaagagatacagtkagagtggagagaaagttacagagagattattcatagaggtgtgggcagggagaaaggcccaataagtgactaaagcagcaggaagttcttacctccctgg

SEQ ID NO: 38037 - DNA, 201 bp, Bos taurus
tagtgtcctgagccataaacgtcaagatgcaagatcaatattttttattgcttttcaataagtcaattttttttcaagtttctgctaggctagttatcagraatctaatctcatccacctccccttttcttcttgggttgttgacataccaggaagtcccagaatatatattccagtcccagaatatatattccaaagtgt

SEQ ID NO: 38038 - DNA, 201 bp, Bos taurus
catgctgaaaccgggcccagtgccatcatctgagaaactctagacccaagaattctgctgcaggaacatctgttgcagaagcagactctgtcctttttttycccaacatttattttatattggcctggagttgattaatgaagtgttggtttcaggtatacaacaaagtaattcatttatacatacactatgttatctatt

SEQ ID NO: 38039 - DNA, 201 bp, Bos taurus
atgcatcagagctctcaccacagaggagagatgctggtgagacatgaacccttgcctggagttgccaggacatcattgagtatattccatggcctgtctcrttccagagcatctcacaaagattgtttttgatctccaaacagcagcacccaagtcaactctgctttgacgttcattgcaagcagcactgtttaatttcat

SEQ ID NO: 38040 - DNA, 201 bp, Bos taurus
ttttcactggcttgtggccacaccgctgctcctctccacgtgggctgctgttctgtccatgtccagcctcctctgcctctcccagttaaggactctgggaytgcattcagggcccataatccaggatgctctcatccccaaatcctgggcttaattacaccctttttccatagaaggtgacatttacagtttctaaggatc

SEQ ID NO: 38041 - DNA, 201 bp, Bos taurus
catttgggaacatctggagacagctttgattgtcacaactggggaacagagtggaatgggcatttaatggagactagaggccagggatgccattactcttyatcgaacgcacaggacaaaccgccaaaagaactatctgctcccagagccgataagagacaagatagacaacattccagggccgggaagccctttaacgag

SEQ ID NO: 38042 - DNA, 201 bp, Bos taurus
gtcagctcacatcatccttactctgctctccgtactctgccatgcatggaggcaagtcaccccacttattctctgtctggatgccaatttcaaaagggaayagaattggcccctttcttgaggaagactggagaccccttttctacttgggtcaacctgttctgctgctgctgctgctgctaagtcgcttcagtcgtgtcc

SEQ ID NO: 38043 - DNA, 201 bp, Bos taurus
aattacaaaatggccccattctcttcttatatctataccttttgtgtgtgactttgcaattttcccttcaaaagtagaagtctgttgccccactccttgartttagcttggccctgggttttctttggccagcagtatatggcagaagtgacaatgtgctaattccaaagccaggtctcaggagacattgcacacttgcac

SEQ ID NO: 38044 - DNA, 201 bp, Bos taurus
taattgtttagtgttatcaacatgccagttgctgtcactatttttgttcaggttgtttttacgaagattatcactcttcctcactctggcctggaaccaaracacaaaggcactaagcaattcttgcagactggaaaaatgagaaatatttatgtcagttatatttgtcctgttagcatttcttggcagtggggtatgtga

SEQ ID NO: 38045 - DNA, 201 bp, Bos taurus
tactggccattgcctattacttcccagagaaattacaataaaggctcttgtccacattttcctcccctttctctgcctcctgagtgacactgctgcttccrcaagtggtcctgggtggcctgacatgccccttcctcatgggaatggtaacaaactatgttttttctatctgagacttatggttataacttccttttactt

SEQ ID NO: 38046 - DNA, 201 bp, Bos taurus
ctgtaacttctcactggtgatttctggtctacaactgactctcaaaacatccacatttggtggtgaaagaacctatcactcctgtttctgcgtttaaccargtccagcccactggttgtaaacaggtccatctagcaaggctactgttaaaattgcacagccatgattgatatctcaactttccaaaagtaaacttaggga

SEQ ID NO: 38047 - DNA, 201 bp, Bos taurus
ccctatttttcaaataaggaaactgagactctttgaaaatggagcagaaacagagatggggcaagttgcactcagtggcaaggacaggatttgagagactrgctactgataaatccaaggtttggtgagataaattcttgtgcagaataagacacacaggagcactcacagctggtacccatgggattccccattaggaag

SEQ ID NO: 38048 - DNA, 201 bp, Bos taurus
caggcagtccactggtgagttcttttatgggaagatcagctttctgagacagagccaagaggtaaagccaagctccgtgcagaaggggcccccgagggctraccagctttccgtgccatggttaagatgaggctgagaggttggaagcaagcgactgcaggacagtctggccacagaattccaagtgtcactttgtgttag

SEQ ID NO: 38049 - DNA, 201 bp, Bos taurus
atacagactgcattttctgcctaaagctcagttgactggatgaattacaattaatcccaaggacttcaattgttaacacagtgcaatgttaattgaccccmtgttaaatagcaaatatttgcattgtctctagagattcatcttaacaggaaattagatcacatttgaatatggaaactgtccagggaattaactgttctt

SEQ ID NO: 38050 - DNA, 201 bp, Bos taurus
taacagctcacttgattgtgggaatgtgcacctgagcctgcaaaacacagtcttgcattttaaaactcggcaataaatacgagaaatccattcattgagayccatcttcattactgaaatggaaatagattcactgagacattattgactatctcacgagatagcacatacatctgcatcacatttccataacatgactgt

SEQ ID NO: 38051 - DNA, 201 bp, Bos taurus
catccaaccatctcatcccctgttgccctcttctcctggcctcaatctttcccagcatcagggtctttttcaatgagtcgactcttctcatcaggtggccrtatacactgagaaagtcttatttctctaggcaatcctcaggcgatcctgaggatttgatccctgatcagggaattaggatctcacatgacacagcatggc

SEQ ID NO: 38052 - DNA, 201 bp, Bos taurus
caggatgagtgccagagacattctaggatttctgtctccttggagtgagcaccgcctgactaagcaagtggaatctgatggacaggtggcctctcctaggrgcagttggattcccttcactcagaacagctttgggtctcccagaactcacctgtgttcttaggaggcccccggatacagggtgtctgggggcaaaaactc

SEQ ID NO: 38053 - DNA, 201 bp, Bos taurus
ttctttttctgaaaagtccaaagggtcagggccttgtccctgaccactggtctagagggtaggattcgacactctcactgccgtgacccaacccaatttcyggccgggaaccaaagccctgcctcaagtcactgcaggccgagaccactctttctcagttcttgtgtccctcctgatgaccctgttcaaagtgactgctag

SEQ ID NO: 38054 - DNA, 201 bp, Bos taurus
tggcagaggcctggatgctgattaagtagctaactcggggaaattaaagatgctccagaaccttcatcttggcggctagagcctagctccgcaggtgacamggatgtcgctccctggcccagagatggatggtaaacagatggaaggaactcactgatggggccactctcttgctcaccccacccatgatacaaaattcag

SEQ ID NO: 38055 - DNA, 201 bp, Bos taurus
ctatagcagcaagaggagactaatatagacacagagaactagacactggaagacccgtgaaatgtcacctgttacttccaaggcctggaaaagctgcccckggcttcctctccaagctcatctctttcctgtgcctttccccagctgtctgtatcccatggcttggcctttctttgagtccctcaagttaaacaagcttat

SEQ ID NO: 38056 - DNA, 201 bp, Bos taurus
gaaagaaactctgccgacacaccagtgagtatggaagaagagtcttccccagctgaacctcagatgagaatgctcgcgtttaacgctgggatccccaactyccaggccacaggccagtatcaggccattaggcagttttgttctatgggagcctaggattaattaggaactgggccacacagcaggaggtgagtggcagac

SEQ ID NO: 38057 - DNA, 201 bp, Bos taurus
ttaatataaatgataaagtatgtccaaaaaatcagagcagggcagggggccacaggaggaggtcagatcatgtcaggcctgtgggcccacaggagaacttyggtttttgctcaagacagcaagaggcaaaggtggaggctgggagacctgtcaggaggccaagataggaccctggcttgacacggagggagttcaattctg

SEQ ID NO: 38058 - DNA, 201 bp, Bos taurus
ctattgactcaaatccatcccaccatctggaaggggcttctgcaaacagcatggggcccagatggatttgttaggagagttgtgagcagagatcagctgaragggagggaacgacagagtgagaaagagaagcaaagtgacagacagagacagagggtgaggaagagaaacaaagtgggatccacttgccatttgcccatt

SEQ ID NO: 38059 - DNA, 201 bp, Bos taurus
caggggcaagagactaggaccagggaggaggccaagagcccaggccatggggcatctatgacagcacagatccgggcaaagtaggaagagtcagcacagcygtgatgaggggaaggggaggccttagggctctgagttcaagaaagaaagctggtgtcccagcaacgatgcctgcccgtcctccaaaccctgcaagagaac

SEQ ID NO: 38060 - DNA, 201 bp, Bos taurus
actgttccttgtgagcagacattcctagccaggcagccgtcaagctactgagaggggagggtgggggcagagagctgccccgtagcattttagggcctggmgatggtcacaatgcaagaacaaatgaatgtggcacatgcctggtggcgccccttgataagggtgaggggagagctgacgctattctatttcacacagggt

SEQ ID NO: 38061 - DNA, 201 bp, Bos taurus
tgcattgcagggcagattcttaaaccactggaccaccagggaagtccatttgtctccttatatttcttcttctcctcctccttctcatgtctcacccctcmctgcccctgcacccatcccctggggggtatgtctttaaataggacatgtatgtccttgtgccacaggtggtgctgggggtctgcttggaacagtggtccg

SEQ ID NO: 38062 - DNA, 201 bp, Bos taurus
gagagagcaatcactgttcagcgtacagcgaaaagtgggatgcacatccatgctgactgctccgcacccaacacgggccagaaacccacggcagaaagacragctcatggggatttccctggtccagtggctgagaatctgccttccaatgcaaggggcctgggttcgagccctggtctaggaacatcccacaagcctcgg

SEQ ID NO: 38063 - DNA, 201 bp, Bos taurus
cttgggtgagtcaggccagccacttgttttgtgaataaagttttattgacacagggccacacacacctgttgaggaattaccatggcagcttttctgttamaacagcagagttgaatagtcatgacaaaccgcaaagcttgacatattcaccatctggtcctttgtagaaaaagtctgctgaccactgagttagaggaaaa

SEQ ID NO: 38064 - DNA, 201 bp, Bos taurus
gggctacagtccataaggtcacaaagaatcagacataattgaagtgactgagtacacacataccctaagttacccatccagctttgcgcttgattccagarcttccaatgtggtaaccatcaggcatgtgtggctattgaggccttgaagtgtggctagttcaaactgagatgtggtgtattgtgctgtatgagtttaaag

SEQ ID NO: 38065 - DNA, 201 bp, Bos taurus
aatcttcgcagccatttaaaaaaaaaaaatgaaattttccctctcatactgaggtgtaatcatcaagtctatcattttgcctaaaagattgtttttaatayagccagaatgtttggtggtcaagaaaaacagaaaagtattatttttatgcacaaagtcaagttacagtgtccagagacacagctttcctatagtgtagtc

SEQ ID NO: 38066 - DNA, 201 bp, Bos taurus
tgtctttcaccattggctcccaaacacttgtccccctctttccagtgtggttaaattgattctaagaagcttattttttacatttgaacaactctgaaatyggaatacatttttacactatagtgtcttattttaattggcagcgttttttcctcttagcattttatgactgtgcagggtcttcactgctgcgtgggcttt

SEQ ID NO: 38067 - DNA, 201 bp, Bos taurus
acactggcccctgaagcggagctgagtgcatcaggcagcagatgggttcttccaaacagctggtctctgcagactctgacccaaagcgtgtgtgttgggargaggccgttaatctgatttggggtcacggtcagagccgacagctccaaggacagaaacccgggaacttgagatgttgctcatggtgggctctttgaggct

SEQ ID NO: 38068 - DNA, 201 bp, Bos taurus
gggtctaaacaatccttcattttcaaacctagtattatttttcccataaacatcctgttggaaaaaaatgggtccccattatactctaagtagtgtccctrgagcctggacttggccttgctggctaattgagggacctcagtgacattggctggagtcactgctttcccttaaccactcagtacaggaagtctacaatct

SEQ ID NO: 38069 - DNA, 201 bp, Bos taurus
cttaaaggccacacagccagtgaatagagagctagaaattgaaccttagtttatattattttaagcaatgcgcagactatattggcaatgaaaccttaagkaagtggctggcagaaaggccagaccagtacttgatgttcagacttgctgttgagaatatactttcctgtttgtatgcaggatttttgctcagtcctggga

SEQ ID NO: 38070 - DNA, 201 bp, Bos taurus
gctctggggtctcttggttttcaggcgtcctaatagattccagctcccctctctccacctcccctccaccccccagctgttgcagaaaaccacagtcaacytcttcttgctctcagctgccaagttttctctaagtaaacacagaatgtagcagtagatcagctcagttgcattcccagcactgtaggttgggtcaaggct

SEQ ID NO: 38071 - DNA, 201 bp, Bos taurus
cagtcactgaagggttcttagcaggtgagggtcacactgggactcgtgtttgggagggaacactgccccttgctcaccttcgtagtgtcatctagcatcaygccttccggccttccctgggctctggtccctctgatcttctctcattttcagtgatgaaaatgcttccatccttccaggcttctacagaagccattcctt

SEQ ID NO: 38072 - DNA, 201 bp, Bos taurus
gtggtctgcatctagctctctgactgtctcccactttacctccttgggcttaccatgctgcagtcgtatctgctctcctcctttttcttaaagagctgtayctgttcctacctcagggcctttgcctctgcggttccctctgcctgggactccctttctcaagttcctttcatggctgattcctttcattgcttaaggctt

SEQ ID NO: 38073 - DNA, 201 bp, Bos taurus
cagcaatggtggggaaatcatctctggggctggaacaaggctgtatcctctttgtgctcatttctccccgccccatctcccctgtgcacgtggccttgccmcccctttacaaagatggtgcagtggttaacagtgtgagcttgagtcagtacttgttgaaactgagttccaggcctgccagtaacttgctgggggatggtg

SEQ ID NO: 38074 - DNA, 201 bp, Bos taurus
ttagatatttttctttaaatagatcattttgaaaagatttatttctagctgttttctttggctcattactaatatgtattgttagtgtcctgataacccayttcagccttctttctgaggtaaaggcattaaagtatttttttaaaatgaccttctggaagcttaatttgcctcattctcaatgtgtgctcagtcgctgag

SEQ ID NO: 38075 - DNA, 201 bp, Bos taurus
aggtgaggcatcacatgaccttgctcatcaggtccaggggcagtcaccaataagagtctttcctggaaaccagtaactggtgagaggcaaggcatgacagyggtggcatggtggggtaaaggtccatgagcctccatgaagacccaagagctacccttttcccttcctttcctggatctttattgtccagctatatgctga

SEQ ID NO: 38076 - DNA, 201 bp, Bos taurus
ttacactattatttaacctggattctgtccagactcagcccttccagacagcggcagcgtccagtgcagtgggcgatgggaggctggcctcagaatcaacrccctgtgatttctggaattcggaggcagtctccactgtccttgcactcccttggtcggcagatcttgggtgccaggcagccttattacaacctggcacag

SEQ ID NO: 38077 - DNA, 201 bp, Bos taurus
taatggatgtgtctcctttccctccccactctctggagtcagggacagggacaggatcccgtggagcttctgctgtggcccctctgcatcatgccccaacratgctcttaggactttggcacggcagtgaccataactgtctatgatgatggccgagacggccaaagcctctctctgcagcccaaagggtccccagggccc

SEQ ID NO: 38078 - DNA, 201 bp, Bos taurus
tgttctttacaagcccccaagttcagcaaagctccaagcccttaaaaagaagtagaaaggcatcttgcaacacaattagagagattggttcaggggcctcrcacacagcactccatccggcaaagcctcaaagggtcccgggtggaccatttgctggctttcatttctcaggggctgcttcagcaggtggccactagcagg

SEQ ID NO: 38079 - DNA, 201 bp, Bos taurus
ggatacactcatgaggactctgggtgtaagtgacagaaaatcaactccaattgacattcatcaaagtagggaagtagagagataataattctcctgttgarctacagaaaaaggcaggcaggaaataggctctagggatgcccagaatcaaggactcagaccctgcagtcctctgtctccactctttttcaaagccagctc

SEQ ID NO: 38080 - DNA, 201 bp, Bos taurus
tgtactagatttaattttatagagcacacaagaggagtccagcaagcttacctgtgactctcagaaaacgaactttttttttccaccaccatctttgattmaaaaaaaagagcaatgtctagaatcatgcccttgggttgagagaccatatgggtagagaaacaacaactggaacagaagttaggagccatgcattctagg

SEQ ID NO: 38081 - DNA, 201 bp, Bos taurus
ctgactctgtgactacaaagatggtgcccttattgcatcaagcaccgaggctccaaggccaaccgggcatgagggctgggccgctcccccctccccaaccstgaccttacgggacgccctctgcagaggtaaacggcgggtgggagctggcaaagcaggcccagggcacagggttaggccctgataacccgagatcaaagc

SEQ ID NO: 38082 - DNA, 201 bp, Bos taurus
tgccttccgagtgcctggcaccgtgccaacctcgctcctgtgctacctcacccatcctccccatcatgctctgaggccagtaattactatcacggcattamcctcagagcctctgtgctctcagattcccatgatgtcacatcacagagcaggtctcagctgtcacttccagtcccctagcagaggccacagatacacggg

SEQ ID NO: 38083 - DNA, 201 bp, Bos taurus
ttttgacaagagaccctgtgacttgtagagtcaaaaattttctttctgtggcctcttgcagaaaaagtttgctggcctcatgtctaaagaaaaggttggckactaccccctgatttttcaaaatggaaaacagcgctacaaatccggagaaagtctggaggcctttgaagtgaagtgaaatgaaagtcgctcagttgtgtc

SEQ ID NO: 38084 - DNA, 201 bp, Bos taurus
ggtggtagtggcaaagaatctgcctgccaatgcaggagacataagaggtatgggttcgatcactgggtcaggaagatcccctgaaggagaaaatagcaatygataaaataataaaaccaagagcgatctgcacacatcagtgaattccatttggatgtgtgtggcaaactgtgttttccaaaggtggccatggcaatattt

SEQ ID NO: 38085 - DNA, 201 bp, Bos taurus
atgggattttccaggcaagagtactggattggggtgccattgccttctccagtaatgtgctcagtcatgtctaatctttgctaccctatggacagtagccyaccagtctcctctgtccatttttcatacaagaatactggactagcttgccattttctcctccaggggatcttcctgatccaggggtcgaacctgtgtctc

SEQ ID NO: 38086 - DNA, 201 bp, Bos taurus
atcagacacgtccctgaactgggggatgtggggaacagtgggaggaattaacatttttctccttgcagagcctgccagtgttccatctcctcctacacttrggccccatggggatcgcatccaattatagatggacttccaagtctgggatcgcctttccatcctgcatcagcactgaaggttttcaaatgagtgagctaa

SEQ ID NO: 38087 - DNA, 201 bp, Bos taurus
gtgcctgatttgaaggccccttcgagagagtccactttctcaccctcagcctcgtctgaaccagcctggggtccatatagcccttggggaggatacaagcraggcccttcaaagctgatgtctatccattttcatgctgtgtgaagatgagtcttggactcaaatataaatgctcaaacagctaacatttcttgagtatgt

SEQ ID NO: 38088 - DNA, 201 bp, Bos taurus
ggaatcttctcctcaatccccccatccgcatccaccccccactggcctcaaactccttaaacattttctcttctgttgaaagtacaaacgaaatgaagctrgaatcaggacctgcagggcctacccttgctgccccctcgggccctcaggcagatcacagagatcacttttctaagtctctgtttcctagctgagaaatgt

SEQ ID NO: 38089 - DNA, 201 bp, Bos taurus
aagccccctgctgcccctccccacagggccctgagcaccccaacccaggcaagaagttcactgcaagaggcttcccacgccactgctatctgcccaacaaygagaagggccggaaggtgggtgccgcaggggcaagggtgtgtgggagcaggccggggccccagcactgaccatagccatctagtgtgcgtgtgtctagcc

SEQ ID NO: 38090 - DNA, 201 bp, Bos taurus
atcgtgatcgtcttcaagatgtggaaactaaggcttggagggagctgagggatttgccagaggtttctgtgtgccttcatttcctttgcaggatgggtggrtgggtgtcctcctccttgcggggcccagaggagcttgggagcttgctcaaggtcacagagctggcatatagtgggaccccatgtctctgcccccagtgcc

SEQ ID NO: 38091 - DNA, 201 bp, Bos taurus
ttatgaacccctgggaaacccaatacagaacacgttcctttaaggacagtgtgtagtccccatgcacactgggaactttggaggtgtttttggaggctcgrctggccaccaggagtgttcctgccatcagcagatcaccttctcccagaccaggccatcaggctggtgctgagaccagaattataaggaagaggacttacc

SEQ ID NO: 38092 - DNA, 201 bp, Bos taurus
gttagccggcctggcgtcttaacccacaggccccactttcggtgcccggaatcacaaccaatgaaccactgccaagaatggacccccacacctaatccatyagtaagaggtggccgagctactgcagaagccaccccgaatctgaccaccttctttgcaccccctagtcccccaggctgtgtcactgctccccatcactgg

SEQ ID NO: 38093 - DNA, 201 bp, Bos taurus
tactcttcagagtcaggataaagaaaccagattgagtgctgtcatgccagatgacttgcctgagattttctcaggggcccagatcagagttgatggtagartgtaagctattaactttcagtgttgtctgtaactttagaccatactgccactgcagggttttttggggactttttccatcagccatgttcagtctgcccc

SEQ ID NO: 38094 - DNA, 201 bp, Bos taurus
gtttgtggtatgtttgtaggatagtttagttcccagacagctcatgtctcatttgatcttcctggacattttccttcgtggccatcgggttctgatgctaygtcacagaatcgcccagcaggaagctggtagtgagatgctctcagcctgcagggcaccctgttcatgtctccacaggcaagtctgtggccagccctgcct

SEQ ID NO: 38095 - DNA, 201 bp, Bos taurus
tcgatgatctgctccttgaaggagtaagctttgttctctcgcttcatgttggccttttttatgctgtcctgctgggcactgaaacaccagagtgggtgatyagccaggttccatccagccacgaggccctttagcctcccaccagccacgagatccctgctacctcttaagtcatgggcaccaggcaagtgctgggtcctc

SEQ ID NO: 38096 - DNA, 201 bp, Bos taurus
tgttcaacagtgaatatcccaggaatgtagcccagaggagagaggtgggttagagtttggggaaggttgtttagaaagagcaaagaaagcaaaaagaggcragagagagacctggctgtttatgggcaaacaatggaccctggcccagaaccaggttcttgctccatcctcctgggtgggggatggtactgccatggaggt

SEQ ID NO: 38097 - DNA, 201 bp, Bos taurus
cagatgaaaaaacgcctagagacaacaacatgttctacatcacatagtaggtagcagagccaggattcaaatccaggcccatcttcccctcaaacctggaytgagtttttcaagtagcctggtgactctattgtctagagctaagaagctgtggacagagtgtggaccctctggccccgttccatctttggttaaccgtct

SEQ ID NO: 38098 - DNA, 201 bp, Bos taurus
acgtaaagtcgttgaacttgtgaaagtctatttttttcccctgtaagtctatttttcacagaatataagaaacgtcaatgaccaaatctgtccttcctccytttccccttccttcacctaagatcctcgttccagtttctattgtctttgtgtccaaagtaaactaggtgacttatttgtataaaatgttattttgccaca

SEQ ID NO: 38099 - DNA, 201 bp, Bos taurus
gggacagctgccttctgctgcacccgtgtgagatgcagtcccgcgcaggcgcagtccctcggcgggagcgcagacaggaggcgggaggcaggtgggcctayttctcggtaagtgacaactggaggacttgctgcagctccgcctcctcctcgcgcagccgcagctcgcgctcctccagctctttggcggagagctccatgg

SEQ ID NO: 38100 - DNA, 201 bp, Bos taurus
tcccagctgtcctccctttcatcattcaagtggctgaagtctgaccacatttgcaatgtaggtaggagtattcttagagctcagctctgaattcgcagctytcctaattcatgtcttactcttcaccctcatttttatagaaaactctttactagaacttcatatagtactaagtactacataatacataaaatgaatttc

SEQ ID NO: 38101 - DNA, 201 bp, Bos taurus
gagcttcccttccgagggctgccattctccccaggtcacaccccactgctgatccagccctggggcagctccaagcctccgggcatgagaaggggccctcyggttttcctctgacctcccaggtccctgatcctggcttggacccagtcttaggtcccctctgaagcttcagttgagaagagcttgggactctggaggacc

SEQ ID NO: 38102 - DNA, 201 bp, Bos taurus
ggtggggtgacctttcctctccggcaaaagccccacccagggccctgccggagtcctcacaatcggcccccgatgtccactctggcaggcaggccggtctrgacaagttgtgtgcggagggggcggggggaagggaaggggcagacaaggatgcttcaggatcccccacagcccagggcctctttatttccaatccggctg

SEQ ID NO: 38103 - DNA, 201 bp, Bos taurus
gtatccgggggagtgatgttgacaataataataacaacaccataacagcactggcctgtcaccgaggttgacaaagtgcgggctctgggcctggcagcctytggggaatttcagctctacagtcagcggtgctgcctttgtgagccggttcagggaaaggcggggaggcctcgagctcactctaatacccctcttcctcac

SEQ ID NO: 38104 - DNA, 201 bp, Bos taurus
cgggcagttatgaacatgggatctgaaagcaggcgagcctgggtttgaattctggctaggacacttcttgattgcgtgtcttggaatgaggtctttcagcygagcttcagtttgtgtgctgagtgctgagtcgtatctgactccttgcgaccccgtggattgcagccctccaggctcctctctccatgggattccccaggc

SEQ ID NO: 38105 - DNA, 201 bp, Bos taurus
aggccgagttctaaagggggcagcacgtgaaattctagactcgggattgtggcaacaggggcagctcagctttccagttctgtcctggtggctcagaatgkaatcagatgcctccatgaggccaacctgtccctttgggggagggggacagggagggagggagggagaatgtgggcacgtgcaagcacgtgcgtgcacacg

SEQ ID NO: 38106 - DNA, 201 bp, Bos taurus
cacggggtgactaagggaagtgggccgtggagtgtcctgtttcagcaggagcctggtgtcatgcatcaggccagggtgggggaggagtttggaccagcccrtgctgtacacgagtgagctttctcccaagtcaggcacccttatctgccatctgtaaatataagccatttgccaaagtccttgcccttctccctcctgtgg

SEQ ID NO: 38107 - DNA, 201 bp, Bos taurus
tgccgtctctcccctgcacaggtgcgctggccagggtccaggtgttcgggaagtggcacagtgtcccaaggaagcaggcgacctacggcgacactgggctracctacacgttttcaggcctcactctgtctccgaagccctggatccccgttctggagcgtgtacgggatcgtgtttctctggtgactggacagaccttca

SEQ ID NO: 38108 - DNA, 201 bp, Bos taurus
ctgattggagcccacggctctaggacgtgcctggaggaatgcttttgggttcagcccacactaggcaatgctgttcctatctctgggcctcagttagttgmcttatctgaaaaatgggataataatagcacccacctcgtggggctcctggaaacatttggtaagacgtatgtaaaaagttccaatactttggccacctct

SEQ ID NO: 38109 - DNA, 201 bp, Bos taurus
catttggtaggaaaaggccatgtgtagttatttgctaacctgttgtgctacttccgaggatggtattattttgtttttgtttttgtttttttgacctggcrtggccttccttcattgcacctaatcgtgtttgtatccttccgagaggagcacaggtttttatgggtgttatgtttcaccagcaaaaacatgtgttgtgta

SEQ ID NO: 38110 - DNA, 201 bp, Bos taurus
gggacttgagctctcagcaatttgtaattccccagctccgcccttttaaagatacatactcatgggtgaaatatgttgttgtgctttgggtttgattttaytgcgggtaagaaactatttggatgtgtaagcccttggaatcaagggctgatgcctgaccgtgtgtggagagcatcctgcgtgtgaaaccaccagtgcaca

SEQ ID NO: 38111 - DNA, 201 bp, Bos taurus
ggtgatgggctctggtttgggatgacctggggtttgaggtggacatctggggcggagcctagcagagggactgtcccgcctccgatgggcttgtgaacccrggccagaagagatgtattaatatctgagatgcttatgattggggcatggccttcctcccctgggtgaggcgttcagagtttctcagcccctgcccgtgag

SEQ ID NO: 38112 - DNA, 201 bp, Bos taurus
gaccccgacaaacatcccacagtgcacaggccagtcccccgaggcaaagaagggtctggtccaaatgtcagtggtcctgaggtggagaaattctgctctcyccacttggcagtgagggccccttggagttccccttctcaaaagtgtttggaaacccgaactgtgtggccatgagcttgattgctgtgtctcctcttggtg

SEQ ID NO: 38113 - DNA, 201 bp, Bos taurus
caacatcagggctattgggccttctgctgtctctgcctcggatgccttcccccaccttgtgctacaagtggtttttcatccttcagccaccagttcaatcrtcacctcctcagagaggccctggtggctcagctggcaacgaacccgcctacaacgtgggagacctgggttcgatccctgtgttgggaagatcccctggag

SEQ ID NO: 38114 - DNA, 201 bp, Bos taurus
ttagaaggcagctgggtgggtgtcttgggccaaggaagcccagcacgactaagtactacagtcaccagccagaaaaaagagaaggggcagcacgtgagcaygcagcctgaggccgtccgtgggtgctagatgtccctgaggccttggcctggcacatagtaggtgcttgtggatgatttcctgtgaataaactgcaggagt

SEQ ID NO: 38115 - DNA, 201 bp, Bos taurus
tcacacacacacacacaacttgggctggaatcttggcttcatcacttactagcattgagaaggtgaggaagccacttaccttttctaagctgcgggttccrcactcataaaatgggatgaggatgacggtactcgctgctggagttgtttagggggttagttcacgtaatgcatgtagagcacttagccgggagtcaggcg

SEQ ID NO: 38116 - DNA, 201 bp, Bos taurus
tgagcaactgaactgaactgcagcacccagtggagggttgatgagaggctgagggtgaggcactgccaggccccatctgaagggtaccaggagctagctargcaatgggtaggctgtgtagcagcaggtcagagcctcaggcatcaggtgtaccaagctttcagattttgcttactactttaattttgtcaatgatggaaa

SEQ ID NO: 38117 - DNA, 201 bp, Bos taurus
tttcaataaaatggggtcacggcacctcctgggaggattatattactgtgagagtcttttcaggtggggattctgccaatgagactttggtactggccttyctcccttgtggaatcaaaaactaagacacctttccctgtctctccttgggggtgcactggaaacagtgtccctggaggccagcagacacacagtgtccac

SEQ ID NO: 38118 - DNA, 201 bp, Bos taurus
ctgttattgttatattcattatccactgtatactttttgtgttcaggaacatagacttacaatattcttgtagtgtcctttttaaccagatagaataaaayagtacatggtttatatggacttccctcatagctcagttggtagagaatccacctgcaatgcaggagaccccggttcgattcctggggcaggaggatcccc

SEQ ID NO: 38119 - DNA, 201 bp, Bos taurus
catgtgctctttttgcgccagtggccgcaggacggattcctctcctccgactgatcaagcctgggagggcagagtgtagagtcagccctgtgagagtaaargagggggcccagaggagagtcgaggcgaaacgtccagacagggaggtggaactccggccaggaaaccacaggcgtccaccttgacagcctgagggcgctg

SEQ ID NO: 38120 - DNA, 201 bp, Bos taurus
actgcgtgggccagcagctgccttcagaatcatcctgggtgtttgctaaaattcacattgctagaccccaccccatacctacagagtcagaggttggaacrgaggtgggccgaacttggctttttttttttttttttttttttttgcgctaatgcatttgagaatgccctgctcctgagccctcaaaactgcaatacattg

SEQ ID NO: 38121 - DNA, 201 bp, Bos taurus
gaatgagtgattaaatgagcaggggatggatatggaggtgtgtatatttccaagcacattgtggggaatgaaacagccttgccgcccgacacacagtggaractggagttgagagggcgtgcctctgcagggcttggggaaggccagtgaccccgacctgagtcctggaggatgagcagaaggcttccatgcgaggagagt

SEQ ID NO: 38122 - DNA, 201 bp, Bos taurus
tgtgaggttaggatgagtggcttttttagggcgggtcctgggttgtgttggggtctagtttgacacccctggagaggccagtcttcctcctgaactcattygtgcagccattctgatggggtacgtgtctctactgccagatggaagacttttccgggacccttctgtgccagcacttggtacccacatggccaaagaagt

SEQ ID NO: 38123 - DNA, 201 bp, Bos taurus
ccctttggcaaaatgtggcccatggaacaatcagccagcccccgtgggtgttgaatggcagcgaacagatgttctctggagcccacttgacaaggaggcargtgggaaggagggacatcctgggccctgcagggggcggaaccagcctgtgtgatttaacctgtgcctgtaaaatggtaaaactccatccaccttctccat

SEQ ID NO: 38124 - DNA, 201 bp, Bos taurus
ttctgccccctccatgctcgtgcctcctggcatcattgcttctgtaacgccatccgggaatgtgggctccagggcttccacccaacaaaacacactcctcrggccacagttctcagctctgatctgcatttgtttccagcctcctgggacacaccgcccttgaagacttcccgattccacgactgtccggagagagagaca

SEQ ID NO: 38125 - DNA, 201 bp, Bos taurus
tgtatcctttaccagtgtcaattatacttcatccaacccaacacacatgcatagttctgctaagtgcaagcaccaaatgcacgcactactaagctataacrctagtaagcactactagtagtactaagtgccagctcaagtaccaagtgctactacttgggagcactactgtgaatattaagtactgctacttagcagcac

SEQ ID NO: 38126 - DNA, 201 bp, Bos taurus
gtccccagggtcctgatatttgggcagaagaagaggcaggggccactaacacctccgaaagttgagatgcatcccagggaccctggcttcccagagaagcytcaaatcaacatggccctcaaccatagactagcaataacccagcaagttggctagacttgaggcagccactcagaactcccagggggtgcagtaaaatcc

SEQ ID NO: 38127 - DNA, 201 bp, Bos taurus
tttgaattcttacagcagggcaccatgcttcccacattggtgtgcgacttgcttttctacttcttgggtccctttgctgtaattggaacaaggcccagaaytaatccgagatagactgtcttttgctggctgcctccccactctcgataccctgtacccacttctggggtcctttctctgatgcctcctctctgccacctc

SEQ ID NO: 38128 - DNA, 201 bp, Bos taurus
tgatgtgggatacgcacgccaggagtttccctttgccggtgataatgtctgatgtgggatacgcacagaggagctgtaagggcctagcagagtgtcttatkattgttgttgtttagttactccatcgtgtccgactctttgtaaccccacggactgtagccctcctctctccatgggatttcccaggccaagaatactgga

SEQ ID NO: 38129 - DNA, 201 bp, Bos taurus
ctcccccgaggcccagatggaggcacacaggctccgttaatagcttggctggagggcagatgaaatctggttcttcccagagcccttccttagaggatacrgcaggtgtggccaggggagaggcggcactgggggaggagggtttgtgtgactagtttaggtaacaaggtggcgaagcccacctcaccccgtctccaggac

SEQ ID NO: 38130 - DNA, 201 bp, Bos taurus
cgtgtgggccgtggtgaaggctctggggaagagccagctgaagtcaggaaagacctcggtgctcaaaaggagatgctggggctgggctgtggctcaggcckaatggaggagtggtgtctgctgtggggcgggtggggtggtgggtggttagaagcatactcagccttccaagattttggccgctgctgctgctaagttgct

SEQ ID NO: 38131 - DNA, 201 bp, Bos taurus
aatacatgttagaatgctgtattaaaatatctttgggaaaattcacaaacatgctgatcttggttacttgggaggagggcccctgggtggctagtgcaaarggggggacttttcacagtttattgtttaataccttctggattttgaactatgcattgggttggccaaaaagttcattcggatgtttccagatgacgttac

SEQ ID NO: 38132 - DNA, 201 bp, Bos taurus
taagagagactgtaaaaagaaagagaacttagacaacgaaggctccttgtctcacagaaagccccatccctaccaaggaatgtttctggcagatgcaggamcgaaaagagattctctggttaaacaggtttggtgagcattgtaaagaaagaatgaagcgactgtctttcctgcagggcaggttgccgtccttagcgtgtg

SEQ ID NO: 38133 - DNA, 201 bp, Bos taurus
tctgagctcttaatctgagagaagggcaacggccacatcctgagccctcggtacctttatttcacttgataaggggcctgcttcacgctgtttgtgccccrgctgactgtccctgaaggggtggacacagagtggtacccagacatcatgagagggcccagcacttgggagctcaggctctgaagtgcggcagcctgggtt

SEQ ID NO: 38134 - DNA, 201 bp, Bos taurus
tacttatcatcattcagaagaactctagttcccccttctcttgctcaccaccctcacacacacatgcagtgaattatacccctaggcgagtgggggagtgraatggtggggtcctgcctgggtattaaaaaaaaaaaacctgtaatagaaaactccaccagtcatttttccctcctttttgtatccatgagcaggtgcaca

SEQ ID NO: 38135 - DNA, 201 bp, Bos taurus
tgtgaaatggggatggtggaccctagcacatagtagactcttcttaaatattagctcttgttgttacagcactgaggcctcagtcacctcttttcaatctrttaatatgaaaataaaattttaaatgtgcaaaaagatagccaccggggtccccctgtccctgaggccttccagggtggagggtccccctccatgtactcc

SEQ ID NO: 38136 - DNA, 201 bp, Bos taurus
ccaggttccctcagagcagaaaacttcatcacattcaggtagaagcagagagagtccagactctgtgaagagaagcatctgctaggagaggattaaggcayggccaatggggcagtattcgaacccaggcagccagccgcagagcctgggtttttactccaccatccacagccggagaggggcagggggcttccctgatgg

SEQ ID NO: 38137 - DNA, 201 bp, Bos taurus
aattccagctgtgccattcacacgttgggtgaccttggccaagtcttcctccagcccctcatctggaaagcagagatgaagctagtgcccttttccctggytgctgctggatcgccaaggccagaacacaccagggaaggttgtcagcccctgcagggttaaggccgtgcctcgtcacgtggctggttgcccttcttactg

SEQ ID NO: 38138 - DNA, 201 bp, Bos taurus
aaataaaaagaatgctatggtttgaaactcctactattgtggcaaattaaatctttaaatcattggaaaagctgaagtattactatcacgtatgcagtatrcccaagattacaagggcataaacttaaaagatattaataaaggagggctaattctctgagcacgtgctacttttgaaatcttgggaaattcacacaaagg

SEQ ID NO: 38139 - DNA, 201 bp, Bos taurus
tgccttttgcatctagacagttgtacagttttaactcagaagcacttgtgaatcctgagtatctcacagcctggaattatctagtctctacttaggaggargaacatgggtctcttcctagcttttcttccttcagtaaacacagtgatcaaacaaatgaggaggtttcacttccactagctcaacagcctgtgtgcacga

SEQ ID NO: 38140 - DNA, 201 bp, Bos taurus
aagcccataagccccttgcaactgcttctgcatcccagcactggctgagtgccacaactggccagggtgagcaccacagtatctaataaaccaccctgtcrtaactgactgaatcaggtgtggaaattttgactgaaagacagccaatcagctggataatcaatgacctgttttgtggtctggaatgaaaaaaagagcatc

SEQ ID NO: 38141 - DNA, 201 bp, Bos taurus
tatttttggaaacaaattatctgtgtttaggttagttcagtatacccaaaattttccaaagttcttctgagcggtaaattctttatgatggggccaagcarccaccaacacaggtacttactgcctctctctcagagccgatagcaaacttcctcttgctaatgatctttatggccactttcttacatgtcttcctctcga

SEQ ID NO: 38142 - DNA, 201 bp, Bos taurus
agacactttaccgtctgagccaccagggaagtaagtgctcaataaatgctcgttgctgatgtttgcttctttcgacttcttgtttttaacctcatgttctrctccatctgggttaatatacaatgaggtgcaatggacacaaacattcggtgcattgcatctcattgtattgaacatgtttattttaaaaacattgtcagc

SEQ ID NO: 38143 - DNA, 201 bp, Bos taurus
gggcctggactgtcctgaccatctgctccagggctccaaagccagatgctgagtggcattctgttgtctctagctatgcagcttatcagcctcctggcctycctttcctgggcaacatacctctgcatgggcggctatgataatgtgtaccgtctacaggcacagagataaaggcccagggctggctcaggagggggcagg

SEQ ID NO: 38144 - DNA, 201 bp, Bos taurus
cacgtggggcctgggtctggtcgtgcctcagtatcaggctcagcaccttgggagcttggcttgttaaataaaacccgcacagggagcccctcctgctgatygggctgcacaggccatgacacctcacccgccccaccctgcaactacgactctcgtctcattctctccttagacactcagacagctttcccaaatttacct

SEQ ID NO: 38145 - DNA, 201 bp, Bos taurus
actggctgggacatgggctctgtgctaatctatggcccctgtcatttgattctccagtaacccatttaaacatgaggatgagagatgctgacagaggagtracacatccagggccaaaacaagtgcacgtgcttaggagcctcaaggcagggtcttggcgggaaaggagcaggtgagcctgggcgggaaaggatgagattc

SEQ ID NO: 38146 - DNA, 201 bp, Bos taurus
agggcccaatctttcccttcatccgtgggagctccccttcaccttcccgggacagcatcaggagtgactcagcagacggctgatcctgctgctctgagccyggcaggcctctgggaactcggccaggagcgtggcagtctgcggctctgcactgggcctctgggaactcggcccagaaagtggcagagtgcggctctgcac

SEQ ID NO: 38147 - DNA, 201 bp, Bos taurus
catcagccagaggaggtggccctgaccagaaggggaagagcccgctgccttcctccgagatccccaggaacagacaccaagcttgggccaggacacccccrtgccagcttgaggtcggaggagaaatggagtctgccatccactggctgtgtgacctttggcaaattatttaacacatctgggcctcagttccttcatcta

SEQ ID NO: 38148 - DNA, 201 bp, Bos taurus
ccagccgtgagttaccacatccttcattcatcggataaacttgtaccaaggcccattatgcagccacgcagcaggctcctggccagacgtctggggcagcracaggtcttgctctcagtaggcttactgactagcgactccaaaaaggtccgggccacctgggtgggcagatacttagggtgttacccagaaggttctctg

SEQ ID NO: 38149 - DNA, 201 bp, Bos taurus
ccaaggcaagttgcttcgcatctctgggccgtggaggcccccaccacctataaaatgaggatttgaaaagtatctctcagctacctcactgggctgctgcyatcatggacataaaaggcaaaggcccttggaaggaaaaaggagcgatgaagcagtctgcttccaagtattggctgtcggggaggcggggtaggggggcgg

SEQ ID NO: 38150 - DNA, 201 bp, Bos taurus
gggcctctgggcagaggaggacggtcaccaaacaagccggcacggctcacggagcctcgcctacgaagggacctttgttgcctgagctggaaaaagggacrccttactcaggacccaggcctcctctcaggcgtcaagagggggctggcacactcactcagaggagcgcacccccttgcccttggctccaggaaagagtca

SEQ ID NO: 38151 - DNA, 201 bp, Bos taurus
tcaacgaacccagggtccggcgcttggccagtgcctattaaatcttaacagatactaactagcgccaccgccactttaactgctggctccgattgggaacrtctgtgaagttggagacactgctttgagcctataagtgagccatcttacatgagaacacacaggcacgacacacaacattaggtaattctctcctgccgg

SEQ ID NO: 38152 - DNA, 201 bp, Bos taurus
accccaggtttctttttcagatttcacagcgagtactgccgtcccggcccatcattggatcccttctggctgctgtctcctgtcgtgttgatcccagccgmttctgcacccacgagggtccaaggccggggaatccccaggctccatcgctcccgtcccccacctcctagggcagccccagccccctgccccggcctctcg

SEQ ID NO: 38153 - DNA, 201 bp, Bos taurus
cttgccattcggctgccccagtgatgctcagcttcatttccagcaccaccctcaatttcagccattgtcgatgcaggaactgctctgtgacagatgtccayacatagccctggcccttgactttcctcacaggctaccaccgttgaccatgtggtcactgacacggcagggaggaagtcttgggtgagaatgctgggacgt

SEQ ID NO: 38154 - DNA, 201 bp, Bos taurus
tccgagggccaccttgcgtgttggctctgctcagtgcatgacccgctccctccacgtttgccctctgagcaagctgctacagaccaggagagtcactgtamgtggccgcctgggtttgagcgagccctgaggatgctgtccctcaggcacagcggtcctgaatgacagtgcaggcatagtggcctgagagccctttgtcag

SEQ ID NO: 38155 - DNA, 201 bp, Bos taurus
ctatagcttgctgggccaccaaatcccccgccggggccgccgccaccgccacctcttccctgccctggcgcgtgtctgggctctcatactctggggacggrggcttcatcaaccgcacatcgtcgctgcctttctccaccctagggagaacccagtgtttgccacacgtgttccaggctcccaggcgggctgcctgcccct

SEQ ID NO: 38156 - DNA, 201 bp, Bos taurus
aaggaagaaggcaggtacccagatgccttacatcagaaggtgggagcatgaaggaaggccctgcccctgctgccggcccccgtgccgggcacgtcaccacygtccagaactgagttctgtcctcactgcctgcctaaaaataggtgatgttgccacttcagaaataaggagccgagcagctggcctgagatcacccggggg

SEQ ID NO: 38157 - DNA, 201 bp, Bos taurus
gcgactgaacaagagggagcccgcaaacaagccagcagagaaccaaaggccatttacaaaagcagcagagtatgtgcccagagccttgtgccaaggcccgmatttcaaaacctaaggggctggaggaagaaggaaagcaggaactcatgctttccaaggacccactaaggtgccaggaagtggccttcccaccttccaccc

SEQ ID NO: 38158 - DNA, 201 bp, Bos taurus
atagttctggggaccgcacaaggctctggagagaaaagggcagagtagtaacagagggggccagggaaggcttggggcccactcacgcccagggatgtgcycgatgtgtgtgattcagcctcaatacaacctcccaggtcagtgctgtggccccccttcacgtcaggaggccaaggcgtggagcatcgccacggctgtgga

SEQ ID NO: 38159 - DNA, 201 bp, Bos taurus
atcctgaaagccaattaaagaaagtgtttcagattggtagagtgatcggttttatcaaatgctccttctaagtcatataattgaggattgagaatttcctrtaacatctaatatgctagaggtccaaattatttgactggcatagacttaagctgtcctgccccaaagatctttcctattatcttctcataatgtttgagt

SEQ ID NO: 38160 - DNA, 201 bp, Bos taurus
ccttcctgtgagaagtgttcccaaaggcaccgtggaaggcctcccgccccgtggagctggggtcttgagcacgccgaggggcagtgcgggggccggggcaygtgcatgactctgtgtcctttctcagcgggtgacacgagctttcctcctccacgtcaatgggcttctgaggccccacggcagaggcgcccgtggccggct

SEQ ID NO: 38161 - DNA, 201 bp, Bos taurus
ggctctgggaggtgccggggtattggcggaacgggctgcccatgacacatcacgtccgggagactcggggacgtggtggggctgcagcaccaccctttgtyagtccccttccctgggcccgttgacacagacagcctggggtgtttttgccaaagatgttccccaggcccttgctttggcttccgctttaattcaaaacac

SEQ ID NO: 38162 - DNA, 201 bp, Bos taurus
tgcagacgcctgattcctgccgtggcagccacgtgcctgcaggtgagcggcaggggtgacgctgagcccgcagccccgggcctgaacgcagcaggaccgcrttatcctgcaagggtggaggcacctggaacccctctctcctgattcagggaaggaatctccttagagggggaaaggagctggcccggaggcatgcatgcc

SEQ ID NO: 38163 - DNA, 201 bp, Bos taurus
tgctgggtgccagtgccattgtgaaggcagagtcaggtataaatgattcagtgcaggtcctgtggcaatgggtgggagttcagatgaggccaaggtgaacractggagaacagtgatgaccatgatagaaatgaactgaacctggaccaacatccccagagctcccctggccgccactccatcaaacggtgcagactgccc

SEQ ID NO: 38164 - DNA, 201 bp, Bos taurus
agagaagggaggagaccccagagcccagcccccgtccctcagctcccccctgcctcctctggctcctcttcagcgctttcctccgggcccctctcctcctyttatgcttcatgactttcctacccaatcccgggctcctgtttagtatacaaccctccacgtgagatggcctccagacgccctgtcagtcctgacccctta

SEQ ID NO: 38165 - DNA, 201 bp, Bos taurus
gtgtggggaggttttggtgtggcttccttacctgcgtgaagccccagctgctggcttctgagccccctaagggaatgtgggctgcagtgacccatttgttytgttttatgaggcctggactacaaccaacaataaagttctcagggctcatcttcagagccctgctgaggcaggggacaggactacagggggtccgtcctg

SEQ ID NO: 38166 - DNA, 201 bp, Bos taurus
ggaggacctcttccgagaggcccatgcggtcctcatgaaggccaaggacctgcctccagcagacactgccatgaaggagaggctgaagcccttagcgcagmtgttcttgtagtgagtcccggccagcctgccacggcactcttaagaagtggtgctccctcccctcggctgtgggccaaaacacggctcccggctcagagt

SEQ ID NO: 38167 - DNA, 201 bp, Bos taurus
atgattgtataatctttttctcccagacatgctataattccatctttgatttctccttgagccacaatctaggagagagagtttcagtcttccagtggccrcattttcacattgctctgcgttgttgtggtttatactttgacgggtggttgctggttgtgtgtaatatcggcctgggatcggctggtgtgcaggatatga

SEQ ID NO: 38168 - DNA, 201 bp, Bos taurus
ccttgcagaaggtgactatctgtggaccggtccgctttcttggacgtctgatctgatgacaccaacacgaccctcaggccacgctgaccctgggcaacccmagctcccccaccatctgcaggaccaaccaaggtctccgcctgaccatgggccttaaagatcactgtgcgagggggcagtaaagaccctcccaattacctg

SEQ ID NO: 38169 - DNA, 201 bp, Bos taurus
acgaagccccagcaccgccagagcaagggacggattcgattataaaccagaataaacaagtacaagctcagccgagtcgcctctgtggtacgcccgggacygacacgacctcgtaaatcgacgacctgagagcgccagtcgctccgtcgccgctgactcttcccgaccccgggggctgcagcccgccaggctcctctgtcc

SEQ ID NO: 38170 - DNA, 201 bp, Bos taurus
gtcatcagggtggggccctaagccaattaagccaatgtggctgtgtccttataagcaggtttcagagatacacagagccatccgggtccatgggcacagarggcccaccctgtggaagggcatcaagggccgcccagctgccagccaaggagaggtccccgaggaagctgtgcctgctggcagcttcatcctggacttgca

SEQ ID NO: 38171 - DNA, 201 bp, Bos taurus
agcccttcaatgggcttacctgatagttaatgaacgtatgtcattataatgacaagcacaacaggcttatgtgggttttgagggatgggcctgccctggayggaggacaggtgtgtgtccggcaggtggagagaggctcagttagcccagcccagtgctcagggaggttggcctctggcttctgtcgcccggagtcctcca

SEQ ID NO: 38172 - DNA, 201 bp, Bos taurus
agcgtgtggggcgggtgcctgggctagccgtgggcgtcaccgccgggccccccaggtgctggacgcggtgctgcccgtcatgaaccaggcccgcagcggcragcagacagtgttccgggcgcgcttcagctccatcacggacacagacatctgcgctgccatggcccgcctgggtgagcccgaccacaacgaggcgctctc

SEQ ID NO: 38173 - DNA, 201 bp, Bos taurus
ctgccagtgaggaccccgcatctttgtcccccagtggaaaccgatgaaatagcacgagagggtctggacgtagcttcatcccacacggatgtcacgttacygctgtggccgccctgacacccgcctgcccccaccctgagccccgacagccccccatccctatgttcttatcattcgaggatgcagataagtgatgtcacg

SEQ ID NO: 38174 - DNA, 201 bp, Bos taurus
tatctgtggtctttaggacggcccttctgacgggtgtgaggagccaccactgcggctccgacgtgcttttctctgttgttccgtctttgtgggaaccgcgygcgtcagcgagtaatcacggccacgggtcttgctgctgccgcccagcctcttgcttctcctttcgtcctctctgagccttaatttaaggtgtgtgtcttg

SEQ ID NO: 38175 - DNA, 201 bp, Bos taurus
ggccatcccccccgggacgcatggatctctagcacacggtgcttttgtgaggagcagcattaatttacgggacaagaccccgagtggcccactttctgagratggaaagcgaccgggaggcaggaaggcttacctgtagccatggtccttgtagtccttggtggccgagtacacgaccgagctggccttcacgctgatctg

SEQ ID NO: 38176 - DNA, 201 bp, Bos taurus
aaggaaagaccagaaagtctaaacagagaaatgcctaagtacgcttcaccaatgcaaaaaaaccatgtcccaccatgaaaacaataactatcagctacttytgcaaaatacagtgaacatagctatacgtggttaaaggctaaaaagagctttaggaaatgactgtgctgatggcttcatgggatgggctgcgccgggtct

SEQ ID NO: 38177 - DNA, 201 bp, Bos taurus
ccacccagagggcatcgtggagcaggaaggggcctccgccagatcccgctgcacagtggggtctgctctgtgtgtttacaggggccctgggccgggccgtraagaagcgttttgtgagttaccttatcttctaaaactggtgcctgtcctgagccctcttgggacacgtacaatcaggccaccaggaaaagtggtaaaatt

SEQ ID NO: 38178 - DNA, 201 bp, Bos taurus
ccccgcagcctgcagtggggagtgggggcctgcgccatggacggcaccagatctgatcctgacaccggcacgcctgcagagacagggccgcccttcccggrgtctctggaagttctccatcaaacaacagtaggtctgagccacctggcacagggctggggggcgtttgcagtggccccaacttggaagcctgatagctgg

SEQ ID NO: 38179 - DNA, 201 bp, Bos taurus
tcggtcagctccctggctgctgggagaggcctgttgagttgcctgtcctgcttagagtcttgggggtacagctggttgggtccctacctcactgtggcagragggctggtgagggccctggctggggcaaggcagggcccctgacagctgtgcctccctcccccccagtggcccatcatgacctggacaacacactcaact

SEQ ID NO: 38180 - DNA, 201 bp, Bos taurus
tggcttccggtggacgtgtgaaccggccccaggaggtccttgcatatttcccggagtcggtattcaaaccctagttacagaaaacacagaaccaggcacaygtcacagaaggccagaaagccgagcccaagctaaatcaccacgaacgcagagcccaagggaccaccgctccgtgcaccacctcctgcggcctgctgtctc

SEQ ID NO: 38181 - DNA, 201 bp, Bos taurus
tcggcaccgcggctgccatgatcaaggctgcgtgaatgttcgtgtctgtgctctggggcacgtgctcacctctgtctgcagctgtttccaaactgcaggtmacaactagcgactcgtgaggcctgcggcgctgccagcagagcaggagggagactgggcactgcgcgccagctcacggcagcccaacagctccactcgact

SEQ ID NO: 38182 - DNA, 201 bp, Bos taurus
gccagctgtcacataatccaagtacccacagcagcagaacctgccctcgtgcccagtccagacgggcctcctctgaggcctgcagaaggcagtcagcaagycagcaaggactccttcaggctgatcataagaaggaggtggggctgagcacggagagctttttgagagcttactgtggcctgagcactgggaaacagactg

SEQ ID NO: 38183 - DNA, 201 bp, Bos taurus
aactgatttcagactttcagtcactcatgcctcctttcacaaatgctctctgctctgctgcgtcccagcgctgtggatgcacagaccctgacacgcctgtyggccttgcctcccgagctatccagtgaggaagaggagggaacactgcagtcacgcggttcctaacccagatgtattgaacagtcagtctctaacacaaaa

SEQ ID NO: 38184 - DNA, 201 bp, Bos taurus
ccagagttagcaccagccctggggagatccttccccttttagacgggcacaaacctcccaaacgaccaagggaatccggattccaattctagctctgagcstcccccttcctgctggtacttcggtggggcacaaggatcatgccagtctggcaggggtgctgagagtgccactccatggcacagcaacactcaagtgcac

SEQ ID NO: 38185 - DNA, 201 bp, Bos taurus
catctacgacagcctgaccagcctcatgaccagccttgtcgcagttgagttggagaaagtggtgctgaagtccaccttcaaccgggtaacgtgaagagagygcaggcctctgccctactgttttccctgaggaggaccagtctgtcccctccctactaccccaggccctgtgcacataggctcagtgctgccctgaagcag

SEQ ID NO: 38186 - DNA, 201 bp, Bos taurus
cacagtcaagtgcctataggggaacgtggcaagactagtagtccgtggttctctctgcagtgtctgtaaagtcagattagagaacacctgggggctagcaytggccgcttcccttcccaggagacaaatctggctctaaaacacagacatgcctataagaaaggcctgggattcaaatagttctcatcacggaaaattcct

SEQ ID NO: 38187 - DNA, 201 bp, Bos taurus
ttgagcagagttcactatattaaatctttgctgccaagtacaagatgataaggattgtatttaaggttgtctgataagacattgacaggggcagggtagayactaattaatgcgaggcaacttgattattgacaggcaggacctggtattgtgggcatcaagtcggccatctggtctgtacttcctgcctccatctctggt

SEQ ID NO: 38188 - DNA, 201 bp, Bos taurus
gacaaggttgcttttgttctacagagaagctgctctctcaagagtctagaaacagcggaactaagaaggaaagaaaggctgctgacagggcactttccttycacaagttgcaaactgcttacctcggactctaactcagtgaggttgccaactatatctctgcactccacagctaagtcatcgagatgatcctggaggcat

SEQ ID NO: 38189 - DNA, 201 bp, Bos taurus
ttatcagagtgacttaagtgcttttgtgccatttctaaaatgtgttggcaaagtcaagaatcagtcttctttattaaaactggcctctcatgagctgcctrgaagctgtatgccagtccacagagctctcaagatcgactcaggtgccctgggaaagggccagagccttgagctggtatgaagcaaagggtatttggtgac

SEQ ID NO: 38190 - DNA, 201 bp, Bos taurus
ccagtaagtcatttatggacgagaggtcggggcggtggggactgtgaagaactacaggggtgctgggctatgtggtgactcacacctggcctgcccctttyggggacactggaaggcatgcctgcggagttgctataaaagaatatcgaggacttccctgatggcccagtgcatcagaatccacagtggataagaatgcag

SEQ ID NO: 38191 - DNA, 201 bp, Bos taurus
ctccactctccctaccccacaatctcccttgcccgccacgctcccagcaaccccagagctgccctctggattccaaccctgacataccccagggcccttgyacttgctgttcctctgcctagaatgctttttacccagttactatgacagctccttttcatccctcagatcccagctccccagagaggccttccctgatta

SEQ ID NO: 38192 - DNA, 201 bp, Bos taurus
gctgccaccatgttagaacagttggggcctgaagcaggccagggggctctccaaggaggaaatgttctatttactgggagtgaggattatgcctgggggcrggaaatggaggcctctccccagaggtgctgctgttgctttaatttgcatgatcaggcgcagctggggagaataatgtactgaccaacacaaacagaccat

SEQ ID NO: 38193 - DNA, 201 bp, Bos taurus
ggtggcaggagccccattgcaccagcccactgcccaccccgagatgtttgcagctcaatgccaggacagagatgatcattttgcaacatttaaagatatcraatcactatgtcgtgcacctggaacttatatagcactgtaggtcaattatataattaaaagtacaataaaatttcggagagaagaggagaagaggtggag

SEQ ID NO: 38194 - DNA, 201 bp, Bos taurus
cagaacagaacctagatcctctgagccttatgaatgcgggaaaatcacttccgtcactctgaagtgaagctaggaacttaccgccgtccctcagggacttyagtagcaccaaactctgttccttgtaatgggtttgaaagatttgaagaccttaagcagaaatattaacctgttggcagtagcttcctaaggagtcattca

SEQ ID NO: 38195 - DNA, 201 bp, Bos taurus
gtgtaggtggcctggttaccacttctggagacacatctgcctgagtcacttctcctactttcctatccctggtcatacaccagacttttccccaaggcacrcccatgggcctggaagtatgaaaaaacagaatattctgtaacaggggtcagcaaacattttctgatgcaactactcaactattcaaggttgtagtgtgaa

SEQ ID NO: 38196 - DNA, 201 bp, Bos taurus
gacagcaatcaactgttcttttgcatggctcaagtcttacccttagcatttcacagcctgtgcatggcattgggagttgatggtgaaagtactgaccaccrtttatcgtttactaagtgtgtcttgaatgtcagcttacagaatataacattttaaacagctggaagttttttaagaaggtaataaaaatggttttctatt

SEQ ID NO: 38197 - DNA, 201 bp, Bos taurus
gatgtttgaactgttgtactttaaacatagagcctgtattataatcatcttaagaaaacatcatgcacctctaaaatgtcataatacagcttcttaagtaycataagatgtatgtgtgctaagtcgcttcagtcgtgtccagcccgccacattcctctgtccatgggattctccaagctagaatactagagtgggtttcca

SEQ ID NO: 38198 - DNA, 201 bp, Bos taurus
agtgactaaacaccaccaccacattcctttgatgccaaggcagtgcattcactttacattccaccactgagattcatttccatgaagttttaaaaatgcayagacaacagatgccatattcttcttctgtagatctggtgagcaaaggctcatagtggcagatacgaggttgccctccctggtttattcacttcagaagcc

SEQ ID NO: 38199 - DNA, 201 bp, Bos taurus
cttttaatttcatggctgcaacaccatctgcaatacagtttgatgagtctgaacatatgcaaacactcagggtaccatcaccacaaggaagtggttgtatycaacatctcccaaattttaaaaaagtcaacctggatagtaggagatccacaaatggaagcagatggtaacaagcaggtagtaagcagaattctaaaacag

SEQ ID NO: 38200 - DNA, 201 bp, Bos taurus
tacatgtggaagcagctctaattacaagaaataactgcaggtgaatacaaggtagctcccccacctgacaatgaattttacagagacaaagccactctatrcaaaacaccaatgttttaatctccacaatgttgcagggaagagccaagttcaagaaagtcaacccaaggaaaagcacatttgacaaagacctgctaatag

SEQ ID NO: 38201 - DNA, 201 bp, Bos taurus
taaatgggggtcgtcactagacacgcagcaagaggcagtgagagctgaataaagagaaggggcttacttcaaagaccagcgtctcattgatggggcccggkgcagacaggcattcggggcggttgaaggcacgctggtactcaaacacggtccccgcaaaggcaaactcccctggccagtcgacgctccagccccctgtga

SEQ ID NO: 38202 - DNA, 201 bp, Bos taurus
gcaaggccctgggggccctggccaggagtttgaacttgactccacgtggagctgggcagccactggaaaattttgaatgggagaagccgttaaacgcctcycaaaacaatccctctggccactggagaatggatctggaggagatcagagcagaagcagcagagaacagtgaggtgtctcacatggggggaggccgcccac

SEQ ID NO: 38203 - DNA, 201 bp, Bos taurus
ggccttcagttgagattttggtggctaggtacagtgcaaagtggaatttaggggaggaggtaaaaagttccatagagactgtgagtcagacaatcaaccaygaggcccagacaatcaacatgagttccaccgcccaagcccccagggcttcaaccggtcaaggttctgtgaatgtcctgccttcactttttccaagcacta

SEQ ID NO: 38204 - DNA, 201 bp, Bos taurus
aagtggccattaacaagcctgtctgtttggcttgtggtggaaaggctctaatggactggggacgtttattttcccagactgatttacagcaagaggccacrtgaagctgctggaatgagaccaatcggatgaaaaatagttgcagccagtcatggctccattggctgatctgaaaatgggccgagggcgggccacgctaga

SEQ ID NO: 38205 - DNA, 201 bp, Bos taurus
gccttgaaaagcgtgcattgggtggaacacagagatggggaggccaggaaggcaggccttgggagaaggtggggtagggagaaacccccaccaaccgcccrgctccccatcactccagcctccaggaccatagtgcttcttccgagacccaagtctctgttgcctccttgcttttatccctcctcttatctccacctgcca

SEQ ID NO: 38206 - DNA, 201 bp, Bos taurus
ggccccgcccagatctattcaattcagaattttgggcagtctctacgcgcactccatcttgagaaccccgccccagccccggtggcctctcagaggcagcrctgttctgtcacagaggtgggctttggaaagctccccgagctcaccatgccctccgccaaagtggggcctgaagacctccaggtcttcagcttccagagg

SEQ ID NO: 38207 - DNA, 201 bp, Bos taurus
ccaagcagtatttctacccaagaaccagcttccataggtgccgggctcctgaggaagaaagggggtctctagagtgggtgggcgggccctttcctcctctrttgttggttgtggtcacagactcgcttctgagctgtgtgacaggtgggggtttcactggggcctgggcagtgtgcttgtgggagccctgaaaggttcccc

SEQ ID NO: 38208 - DNA, 201 bp, Bos taurus
agacacgaaagggatccttcatccatgtgcttgcgatgccctggctctggtgaacccaaccaagaggtagttaaatggccccgcagattgcgagtgactcrgggaatgcctgggtttatgtatggattagcaccctgatagaccctgagtcgcagaagacgaagactaattacctgacaacgctcccctccgctcgcctgg

SEQ ID NO: 38209 - DNA, 201 bp, Bos taurus
tctgtgtccacgttcagtgacttcacagagtgagcttgaaattagccatgctggagcatttacaccacagaaattggccaaagctccccacgagggcccckgcacccaccgagaccttgtgaagaaacaccgtccagcccagccctgccattaacagtcagaaaacaaaggcccagattgcacgcaccaccttcaaaaact

SEQ ID NO: 38210 - DNA, 201 bp, Bos taurus
aacaatttgcccaaagtcatcaggacacaaaccctgctggtctgattctagagtctggtcttgactactgtgtaccatcccagggtatccactgttaataytgctggcctgtctcagcacgtcccctgggcctgtttacctctcccggcccctaacaatctcattcattcattcacctgtcagtctatccaatcatccata

SEQ ID NO: 38211 - DNA, 201 bp, Bos taurus
gctattcaggtcatcaggagttcaaatttaaggtgaggatcttctgcactttgagtaaggactgaacttaactgattctctgcccagcccttgccatggayggcaaagcccagcttagattacgctggccccgtccccagcgtggaaacctcccttccaggttgacactcctctgaaagcgatcctctgtggttccattcg

SEQ ID NO: 38212 - DNA, 201 bp, Bos taurus
ctgcttgagaaactaccctgaaatgagaactctctggcttcacccaagacctcctgagtcacagactctggggctgggacccaacaagtggtgctttaggrggccttaccgagattctcaggtgcaaatgagtgtgagaagggctcctccccaaggccttctcacgcccctgtctttcagccaggtttccccgaatggtcg

SEQ ID NO: 38213 - DNA, 201 bp, Bos taurus
tggcagctctagaagtggaggagggccgtggacgagctcgcctaacactcttgttctggggagcctgggaggatagattccattctgcaagcaggaggccrgggagttcgctcatggtgcaggagacagcaggtcatttacactgtgtttgcgatcaggggtcacagagaggggccaggagttgaattccaagaatggcac

SEQ ID NO: 38214 - DNA, 201 bp, Bos taurus
tgacatgagggaggaaatctgctttactctaattatttaaatgttaaactcctccaaaaacaccctcatagaaacacccaaaataatgttggaccaaatakctaagcatcccatggccctgtcaagttgacacataaaattagcttaccaaatgggttcattcatgcaaaacaatatcatacagccattttttaatgcaac

SEQ ID NO: 38215 - DNA, 201 bp, Bos taurus
tttcttaggcttagaaggattacatccatccatgagtaaacaacaaggatgagtccaagtggcttctgccccaccaacattccagggccccccgtcagagmgtatttttatcagtgaccaggaactgccttgtactgcctgggagccagttgagcggtgatctagggactagctctggagtcggcctgcttggatttctct

SEQ ID NO: 38216 - DNA, 201 bp, Bos taurus
ataatagtgacagaagtaaatgggataaatgccccccaaaagaggcaaagactcttaaattaggctgcaaaagcatgtcaggccaaaaaccacagatgagycttgaacagacaatgtggaggtttaggggtgctcaccctctgcatgcagtgggaaatctccctttggcctaaagttggatctctatatccatcatttctc

SEQ ID NO: 38217 - DNA, 201 bp, Bos taurus
cccccataggatgtgtaaagggagagtagatccctaagtaaagtggaggtttcgtcaggaaggacagaggggaacagaagatgggtgggcattaaagatamataataacagaataccgaagtggccaccatcccatccgccttaaaatagaaaatacagccacaggtgaagatccctgcagtctcatgcacaattacattc

SEQ ID NO: 38218 - DNA, 201 bp, Bos taurus
cgtggagtcccagcccaagagagggggtggcaccttcagagctttgaacagggagctgacaagtctccacaaatcctgcaagtcacccagtgggaacaggrtgtgagctacaggtaaggggacagcagagtactcaagagcactcaccctggggctggacagtctgggtctgatcccaggtctgcctactgagacgtgacc

SEQ ID NO: 38219 - DNA, 201 bp, Bos taurus
gctctcagtgtgtgtgaatgtgtgtgggtgtatgtgagttagtgtttgtgcatgtgtgtaagtgtgtgggtatgtgtttgagtgtgccttcgtggccaccrtgagaatgtgtgagttttttaatggaatggtggtagcacagagtaaagggctgtggagcagcaggagatgggttttgtgtctctgttctgtgatgtcctg

SEQ ID NO: 38220 - DNA, 201 bp, Bos taurus
gccacccacctaaaggaagggtctctcccgatgtagctgcaggctttgggtgcagaagcatcctgccctcggcgccagtggctgtagctcacacatgaggygtccatccagatcctgggccctgggatgggaacacgaccaccaggccttgccccagcgccactccttgtgtgcagtgggtgcttaatcagtgctgacgga

SEQ ID NO: 38221 - DNA, 201 bp, Bos taurus
caggccagctgctccaccatcgccctgcagtctagaaagttcttggaactcattacacgcagtcagaactttttaggacttgaagtgaagctcacataacrtgcaattagccatttggtggccttttgtaccgtcacggtgtcttagacaccccgtttatctggctccacagcagtctcgtcacctccaaaggcaccctgc

SEQ ID NO: 38222 - DNA, 201 bp, Bos taurus
cttgctctcacactcgccagctgtgtgagtttcctgtgacagagaaccacaaactgggtggcatcagcacaagtgtgccatctctcgggtgtcagggtgcrggcaggtgccttcctggcctcttgcagcttctgggggctgccgtgctgcttggcgtccctctgctggtgggagcctttctcctgtccctgctcccgtcct

SEQ ID NO: 38223 - DNA, 201 bp, Bos taurus
tgtcccttgcattgcaaggtggattcctaaccactggacccccaggggagccctggatgatgttcatgttatgtctagaccatgttttgcttatctcctcrttcatcagcggccacttgggttgcttctacatcttggctaactgtgaataatactgctaatgctgctgtgcaagtatctgttcttaatcccgttttgact

SEQ ID NO: 38224 - DNA, 201 bp, Bos taurus
cacacagtgcctgacaccctgttcctcctggggggctcttagcatcattcctggggtgctaacagacagtgggcacccctctcccggcctgcgttccatgygatagctgctttttaggaataatcctcaggtggagcaaccagggggtaaaggaatatttcctgacacacgattttcttttcctctttgagcagacctggc

SEQ ID NO: 38225 - DNA, 201 bp, Bos taurus
tgaggccctacagaggctgcagttacttggttaaaagaccatacaagatattcatggtggcagatcctctggtatcaagctgagcactttttccaacatgyccaggcaagatgcaccagggcctcttcatccagcaccctcctcctacaaatactctcagaccagatctaacacgactttccacagccatctgtccttaca

SEQ ID NO: 38226 - DNA, 201 bp, Bos taurus
cagggcagctggggatttatatcctacaggcagggtgagggataggatggaaagttactaagaggaattggttaggtatcaagggtgggtgaggaacttgrttgggtatcaggggggattcttgctcaactggcttagcagaattcctgctaaaatcaggccttttgcttaacaatagattgtcaaattgtgaacagtctc

SEQ ID NO: 38227 - DNA, 201 bp, Bos taurus
ttccttctctccagccctgctgaagatggccaagctgtctgctccaggtctcagatttgacagcagagggtcacaggcgtgtgtagcttggcccacatgtrttttgattttggaggtgggggaagagttgtcaccagttaaatctgagaaaatcacatacagttttggaatcctaacttctcctgcaaaatcaggaactat

SEQ ID NO: 38228 - DNA, 201 bp, Bos taurus
gtgatgagaagagatggaagatcagagcaccttggtacctctcgttaccaagtaaaacatgcagggagctgggccaggcccttccgatcgctgtgtgcccyctacgggctcctgccggatggcagggaagccagcacagccctttacctggacttggccgttgttttcctgatgcaggcgctccccaaggctgtcggggcg

SEQ ID NO: 38229 - DNA, 201 bp, Bos taurus
aagtactctcgggcgtgcagcctcaccagcactctgcggctctgtgcttctgtcacactggggagcaggagggctcagggcccctctcctggtgggtatgmggcttctgtgccttcaccaggaacctggcaacagacttgccctgagtggtgcctgctgccgccctggagctctggggcccaccctgctgtcccttggaat

SEQ ID NO: 38230 - DNA, 201 bp, Bos taurus
aatgaatactttgctgggtaaagtattactagttgcaggcttcccccccccgccccacccaccccgccccccgccccgaccctgcggcctttcatcacttkgactaagttgtgccaatactctctggcctgaaaagttcctgctgaaaagttaactgaacaaattattggagttcccttgtaggtaactagttgttttctc

SEQ ID NO: 38231 - DNA, 201 bp, Bos taurus
tggagttgtttagactggggaatgcaatgacccagggtgtctgtgtgaatgtgtgcttactctcacatttttgtgtagttgatggtggcaggaggatactrgggggaggttaagtgcagacaagggaaaggaggagggtcatgtcttgtcgcacacacatatctttgacagcaaatcaatctgtcccccaaagagccaggc

SEQ ID NO: 38232 - DNA, 201 bp, Bos taurus
aggctggggtaactgaggcacaaagagatgagtgagaacttgtactgcttagcgggactctcatgagtatgtgcgtctcaggatctgctttaatgtgctayttctaaccctcccaacagccctgtgaggctgctaatggtacccccttcccacagacgtgagaacttggccaatatccccttgcttgcagttggcagaaac

SEQ ID NO: 38233 - DNA, 201 bp, Bos taurus
ctgagctgttgtcagctgctgacttgcttagtctgaagatccaagaaagattcactcaaatgtctggcaccctggtgctgcttcgtgtggcctcttgtcartgctgccttgggcttcctcagagctaatcaggggtctgatgtggtcattggcttccagagggatcagtctaagcaagtgaaagtcaagctatgtctttgt

SEQ ID NO: 38234 - DNA, 201 bp, Bos taurus
tgtgctctggatatagaaggcaggccgccaggaacccctgcagcagaagagactgaagaaggctagaaggggtgctcgagctgagagtagatggctggatraaagggaagggccatccaggcagaagacgggagaggtgatgaggttcagcaccagggaaaagccctgaagtaggcctttgcacccgaggatgctgaggca

SEQ ID NO: 38235 - DNA, 201 bp, Bos taurus
gagcaggcccagggcaccatggggaacggattggcgctttcatgatcagccctccagtcccagctgggacgaagatagaggcagaaatgtatggagacagraagaggccaacagatagatttctgaacatggtgggggatgaatgtaaaacccacatctatttccttttctatcttgaaactaacactcattccaaattga

SEQ ID NO: 38236 - DNA, 201 bp, Bos taurus
gtctgtcagtgatagaagtttattagcatttactcaccttgcattagtaatacagcacggtacgttttccattttcattagcagtgtttgatagaatcatyagaaaggaagtaaattctctggttcaacaaaataaatgcagcttttgctttgtgacaggtaatataaaagctttcttttgtctctgtgtgtgtgtgggag

SEQ ID NO: 38237 - DNA, 201 bp, Bos taurus
ggttttggaaagaataaaatttttattagtgttcatttcttctctgtctcctccccagcatggcgtggcatctgcctggcccagaatcccactaaagggarcctgtggggcactgtctggacacatttttggttgtcacaactggtttgggagctctactggcatctgttgggtaggggccagagatgctgctgagtattc

SEQ ID NO: 38238 - DNA, 201 bp, Bos taurus
cctctgagggcagaggcccagagggtcttcttccctgaattgagtctcaggtaactgatcccaaacatcctcgtggccatagatatgcatatgttgctcgwgtctggtcctgccctgccctgccctgtccctgctgcctgcctccatctgcctcatgcgtggctgtacagcgtgggtccagcacgggctctgcggcctcag

SEQ ID NO: 38239 - DNA, 201 bp, Bos taurus
caatgatccccacctcctggtatccatgctcttatgtagcctcctcccaagttgaagagggatgacctgtgtagccaacagatctagcagaaatggcactrtatgtcctcaaggccttggtttttcgtattacttattgctgtgaggagagccaactaccatgttgcgagcaagtagccctatagagagagccacatgacg

SEQ ID NO: 38240 - DNA, 201 bp, Bos taurus
aggacaagacttttgttttctttgtcttagtagccccagaaccttggcatcctcatcacctcacagtgaatctgcaggtagcaagtggccacagatgaccrctcaactgacctaacttaacttaaagctttatttccaactgtaccagttattcatttgttggccatgccactgattttttttttaaccaagtaagaagaa

SEQ ID NO: 38241 - DNA, 201 bp, Bos taurus
tttagtgcctgtgggtgtggttcagctcagtgtggtgagaatttagtggatcagagcctgcaatggttcagcaagagaaccaggccagcgatctgtcagcrtggagatgaccaataaacttgtagagggtcagaaaaccacctggggaaggagactggctattgtgacggccaagcttttgctccccatcctgccctcagg

SEQ ID NO: 38242 - DNA, 201 bp, Bos taurus
tgagatgctgaactttgggtctctttcttccttagcaagtgttccgtcaattaaggcaaatgtgtgatgaacttttatcaaaagcaagactggccattgtkacagaagttctgtctgtccaacacttcctggacctgctcctgcatcctctttatcattaaacaaacttctagaagccagtgcaaacatctgaaagtgctt

SEQ ID NO: 38243 - DNA, 201 bp, Bos taurus
ccaggaggaactccgtgggcagccccagctacacgaatgttcttctttacgtggagtctgacttttgcctcccctagttggtcctagatgacttaaccccmaacttctcggccccatggggcctcttctgtgccccaggccttcagtgtttaaaggtggccctcacttcattctgaaaccctttctgagccaccaactcca

SEQ ID NO: 38244 - DNA, 201 bp, Bos taurus
cctttctctccctcacagatgacgggaagttgtccttggaggagttccagctcttctttgcagatggcgtcctcaacgagagggaactggaggatctcttycacaccatcgactctgacaacaccaagtgagctcagtcccggcggctggaactgggaggtggcatcccccagtctccagtgtccactgccctgcaccgct

SEQ ID NO: 38245 - DNA, 201 bp, Bos taurus
gaatagagtggcctgactttgtctcctgagctatgtgtgccctgaatggaataaaggaaaacagaacccagagctttcgatggccgtttttccttgggtcrgtatctgaatgttgatacactaggtgagtcggttctagaatcttcaggaaagtgaaggtggcgcagccagggtcgaggaggggtggggctctggagggac

SEQ ID NO: 38246 - DNA, 201 bp, Bos taurus
caaccactctatttccctttacctcattggtcagtctggatgtttgggatcccgtgaccacacttggatcccaactgctccgtcactggccaaagccactragaaagttacaaaccgtgtgtcccaagtaccagcctaagacctgtcacaggacagacgccttacccccagccccaaggacatggccgtaagatcttccag

SEQ ID NO: 38247 - DNA, 201 bp, Bos taurus
acaagtgacccgcgcactgtcctcggccgggcccgctcttggtagttctttttctggctgcatgaactcaggctgtgtgtgcagccaaagttaaactcaaragggctggacacgtggcctgggcggggagccggagcagatggcaggccacctgttgaggggcggctgcaaatcagcgctcctgctcctccagtggccccc

SEQ ID NO: 38248 - DNA, 201 bp, Bos taurus
ccttggacctgaacgccctcacctctgaagcagcccctccacttcatcaacatgactgatgagtggcttgtaagtagggcggcgttcttaggggtccagcygggctgggccccagcgctcagatggcccgtggcccggtgtctgggtgccaagttcttggctggaaaagtttccagggcggctcagaaggacggagccagg

SEQ ID NO: 38249 - DNA, 201 bp, Bos taurus
ggtgaagaagacacagcgtgtctgcagatggttgaactgcacaaagaaagggagagggacgttgagagtcctgttcagtggagaatgtggtggccctcccygtaccagttagctaactagcgctgcgtaacaaaccatcccgaatacagacgtgctgggctccgggagcagctgcgctgggtagctctggcccagcgcccc

SEQ ID NO: 38250 - DNA, 201 bp, Bos taurus
acactgtccccccttgctgaggcctggtcacctctttctggaaggaagtcagaggaaagcaagagtgcttatcggtcattttagttgctttcactcatttygttcattctgggccgatccggtggatgtggattcctgctctcccttaaagaggcagtgatgggaccaggacacgtccctgggaacgtgatgggttttgag

SEQ ID NO: 38251 - DNA, 201 bp, Bos taurus
ccgccgggagcgggagcccaccagaccgagccgggggcccggcggttctcaccccgatgaggtagatcttgtccaggctgaagttcgggatgatggtgacmagctccttctcggccagaaactccacctccgctgcatccatggcgtcgccaccggccgacccagggctcgccgccgccgcctcaggtccctcagtttccg

SEQ ID NO: 38252 - DNA, 201 bp, Bos taurus
tggatttccaaaggggccaaacatttacagaaatgacccaaactgtacaaataaaccataggtctggtggaggaggcagtttacattcctcggggtcagaygaagatgggagccggccctttgaaaaccactttgcatcaggttcgtgagctctgtgccccgtctgggatccctcaatcccatccaaatgcttcgggaaag

SEQ ID NO: 38253 - DNA, 201 bp, Bos taurus
cccttattgtccatctttgtctaagctggatttaaaaaaaaaaaaacaaaaaactaagacagcaggcacgactgtcccgtcccaggatacggggcggcccyagctgtgccttctctatcactaggcagtggttctccacacctctggcgagcactcagcatcctagcaacgcccctctctccccgtcctgtccgtggagac

SEQ ID NO: 38254 - DNA, 201 bp, Bos taurus
cgcgcgcgagtggagctgctgtgcttgtgcggccggctgtgcatgggcgaacgtgcagggcaggagtgtttgcgcgtaaccgaaagtgtgtcctccgtggrcaggcagggcctgagcgctcgtgcgagggctggggcgcctgagccgtgtgaggggtgttctttggaaagacggatggaggccgtgcgccttgctcaggat

SEQ ID NO: 38255 - DNA, 201 bp, Bos taurus
tggagagaagctaaggttccctcccacaaaggaattccctaaaactgtgtacaatatcccaacacctgtgaatgaacctccaaactgcaagagacacacasgtcccaggttgagaatcaatggattaggataagattgagaagaaacaagaacacccaagcatgtcaaataccctctcagagacctagaggcttctagccc

SEQ ID NO: 38256 - DNA, 201 bp, Bos taurus
cttctagaaacattcagacagcagatgaagttgctttgttatccataatagtgataataagtcatggtgataataagatatcatcaccaccatcaccatcygatcgttggatctgcccagcacacctgtgctaggaacttctactcggcagacaggaatctctgaagccctgagagtaacctatcctgagttctgcctcct

SEQ ID NO: 38257 - DNA, 201 bp, Bos taurus
ctcccagggcccggctctgagctcaggggcccgactcacagacaatcccagattgaccgggagcccaagagaggtgtggaacagagaaaggaagcagtggkcagcccaagacccaccccaagggcctcccaggctgtgaccacagcggccaggctgccctccccccaggctggcccacacaccacctctgcccaccctggg

SEQ ID NO: 38258 - DNA, 201 bp, Bos taurus
gccagcacatacaagcctctgaaagaacatgtgtttgctcccgtgggcatgacctgcatttgacttcagagctcctgattcagctcagctctaatgaaggytcccggggccaacacagaccaaaacacaagggactgcagccaacatggagcagtcaaactcccccgactcctctcgaatagtcagacttcctccccttcc

SEQ ID NO: 38259 - DNA, 201 bp, Bos taurus
catcaggaagcatacacagattaaaaccaagagacttctctcctggctaccaccaaggagcttatatcaaacagccgctcctgctgggaccagccataaargctgaaaaagggaagttaaaatgctgcttgaggaggcagagggcaggcttgcagaggagggacaggtgcctgccacgaccccacgcacgtgccacacata

SEQ ID NO: 38260 - DNA, 201 bp, Bos taurus
aacacagcacttgaacttagggacctgaggaattcacttatttacatttgttatgtgtattaaggcaagcgtttgttcagccttcatatgcatgaggcccygcagtgccatgactggtgcaagagtgactcagtccacagcagcacggtagggcaagactttaaaagggaagggaagggcccgctgagcagagccacacac

SEQ ID NO: 38261 - DNA, 201 bp, Bos taurus
tcctcagatggcagagaaccgagcagagccgtggcaatcagccccctagaagggccctaattccattcatgggggctctaccctttaggtttcatttaatyctaatcgcctcccaaaggttctacctcctaataccatcacattatgcgtagagcttcactataggaacttctggcaggacacgaacatctggtcactaac

SEQ ID NO: 38262 - DNA, 201 bp, Bos taurus
acagcacgtgcaaaggccggaggcagggcttggtctgcagcagagggggcagaggggaacagtgtcggggctcagcttccgggctgtgggaaggatgctgkattttgtccagaggccagggaagggctctgaacgatttaagcagggcagcgtgcgatctggtgtttgtgctttcgtaattaaatgtttgtttccagataa

SEQ ID NO: 38263 - DNA, 201 bp, Bos taurus
ggggaatggtgccctgaaggcaggtcacaggcagccgtgggcaaggggctcgggtcagagtcacatgatgagaggtgggcctgcttccgcaggaaggacamacggacatgcggaaggagcaagcggctccaccgtcggacacgattcctgccactcctcctgcactcaggcaccctgtctggggccctgcgcccacaggca

SEQ ID NO: 38264 - DNA, 201 bp, Bos taurus
ggtagcgaagccagagcatgccagcaatggccagggccacgcagagccagttgaagaagctgaagaagttgatgacggagaagatatctttggagaaggcrtagagcagggtcatgatgcactgcaagcagagggcaggccatgagcctcaggatgagccagggggagggatgaccgcacgcaccccttcttagcagaaga

SEQ ID NO: 38265 - DNA, 201 bp, Bos taurus
cttggcggcctgcacaaaccctgctgggcactggggtttgtactgttccccacgggtcaggcaggtggggctgcgggcatttctaggggcccagctgagcrcagggtccccatccttctgcctcagactttcacctcttctcaggaagaggcacctcaggcgatccagaggcccttctcctgcatgctggcttccgtgcag

SEQ ID NO: 38266 - DNA, 201 bp, Bos taurus
ttggataagctgattcaaaacctgaatagtgacctataaaagaatacatacaatttcacaatcaagtagtaccataaaagataatgtcatttaatacgaayatcttgaagagcttttgttactcttagaagttaccagaataattatgaaaaaaaaaaaaaaaaagagatgtgagaacatgatccctggcttcaggaaaaa

SEQ ID NO: 38267 - DNA, 201 bp, Bos taurus
aaggcatactctctcaacacacgtagttccccccccgcccgcccccagaggtccctcctcttaaaatcacactgcccagtaagcaggccaatttgccaaayaatcctttggctgagtgaccggtttgccagactgctgaggatgtttttgatgttttcctttcatctcacagccagaacccatgaacctgtgggcccagct

SEQ ID NO: 38268 - DNA, 201 bp, Bos taurus
tcagctcttcgcatcagatcagcttatttaataactgaagaccagcttatttaatcagaacatgtataaatccctagttaacctgctgtttttctaataargtctaatttgttcttcgtggaaaatgtcagggatcttatgtataggtatgtttagccatttaaagtttgctgtaagcaaacttaagtgatgacactcata

SEQ ID NO: 38269 - DNA, 201 bp, Bos taurus
acagcaacaaggcaaaagcaacagataacttacaggcaaactcccgtaaggatcagttgacttctcagcagaaactctgctggccagaaggcaactgcacraaatatttaaagtaatgaaagggaaaaacctacaagcaagaatattctacactgaaaggccttcattcagactcgatggagaaatcaaaagctttacaga

SEQ ID NO: 38270 - DNA, 201 bp, Bos taurus
atttctgggaaagtatttctttgtcttacaaaagggaaaagataatgttatcataagtatgagtacctatttccttgttttatttgaaaaaattcctgatytgtttgatttcaaaccgccctctctccctctcttttactgtaccagtacagcctaagtttagagtaggttttttgatatctattaaaaagtattttatat

SEQ ID NO: 38271 - DNA, 201 bp, Bos taurus
taaaactggcaatttttgagtcattagctagaaagaatttaaagtccctgcttcctattggaattcagggaggagcctgtctttttgagatgacaggggtrtgtataatggttattctcacagaacagaaacaaatatagagggtctaacctagtactctcaaacttcccttgattttcacacgtagcaaagggacttaag

SEQ ID NO: 38272 - DNA, 201 bp, Bos taurus
ggtcactcagtaattttaaatatatttgtctctgaaggttgctctcaccatattatatcattttggttttattttctctttggagggcccaagcctgagcmccatttctgttattgttgagctcaagtttgcactgtgtgttgaatgtggtctgtactgtaagaggcctgggaagtgcagagtggagcccctgccttaaca

SEQ ID NO: 38273 - DNA, 201 bp, Bos taurus
aaaggttgatatttataagatgacagtttcatatttttaatgaaatttgggtcttcccatttttcagcactattagatatctgagaggccaaagaagtatrcattttattacaaagagaagaatatagcaaaaaatcagaggtatgatgatcctttgatctgtgagcataaaataatgccatttcattgggccttaatcaa

SEQ ID NO: 38274 - DNA, 201 bp, Bos taurus
aatataatttgattaagacattttacatgcctggtagtggtggttcatttgtagaaatgatttcagatctgaggaaaacagctacattgaaagagtttctrggcagtcgaaaaggacaatgtgaacaaaacttaattaggagtacaggctaatggaatcgagagggaggcaggatgaattcattacattaataataacctg

SEQ ID NO: 38275 - DNA, 201 bp, Bos taurus
gtgggggcaggtggtgatagatgaataggaagaactcagaggatttttagggcagtgagaatactctgtgtatcacgatgacagcatatgttgtttgctcragcccatacaatatacaacaccaagagtgaatcctaaagtgaactatggactttgggttgttacgatatgttcatctttaataaaaatcatatagaataa

SEQ ID NO: 38276 - DNA, 201 bp, Bos taurus
gggaggaagggagagagcctctgtttgagggttcagctgtgtgtcaggccctgaagcaagtcttctcgatcaataacaaacgatcataaatgaagcttgcyaggtgatgaatatatgctaggccctgggttaagtactctgtgcccattgaattcatgccctattttacagaagaagaaaaaggtaagtaacctattcagt

SEQ ID NO: 38277 - DNA, 201 bp, Bos taurus
cgggcaacttggcactcagtctgttgggtttcagtggtcccaacatcatcatgcttggaagaagaacgaactggggaaagaggaggaggccgaggaaaacrtgcaagagcggcaggggctggaatgactagattctgcttcagcccagatgaggggagggcaccctggtcttctgcgggtgccaaggagggggccccccca

SEQ ID NO: 38278 - DNA, 201 bp, Bos taurus
gatggctgatagcaggctgctcttgccactccctgtgttgccacagacccctagcatggtaccctgcaaagccaaggagaacagacaggcgttgggacagrtgacttgcccaggacaggtctattgtctgttatgcaaaatgacaaacagaaaacagctacacgcaccccaaggcccctcagacaaagctcaagaggagct

SEQ ID NO: 38279 - DNA, 201 bp, Bos taurus
ctgcgtgtggactgaatccctgggtctaatcctgcactcccagttcctggtccccgctgaaggtttagaagcctctctgggccatcatgcctcaagacacytgcctcacacatctttggggggctttctcttctgggttccaagccagaacttggccaactaaacagaaacatgactcctctgcctctgggaaccctaaac

SEQ ID NO: 38280 - DNA, 201 bp, Bos taurus
aaggaggcctatgcctatttttggaggaagcctgctgtttctacaccaataaattaggcgttgtaaaggaaacaggaagaagtctgataaacagggcctcragaatacaccaatacctcagtaattcatgggaaaactggttaagcaattggaattggatgccttggttcataccttttctaggccctctccttctactta

SEQ ID NO: 38281 - DNA, 201 bp, Bos taurus
tgtcagacactgaaaactagcttcaaattaagaaagcgtctaaggaaaataaaaagcacattcttaattaaaatcacacacttgtaattcttcaggtccakgactatcacaatgtttttcacaatggagaaaaagtgaatctctaactcaaaaataaactccacatctcttgctttacacaaaaatttaaaaaagagcatg

SEQ ID NO: 38282 - DNA, 201 bp, Bos taurus
aatcagtcctaacagtaaggcttggctaggagtccagagcagaactccagctcagggcccgccatgctgaagacagacccggccctgggagggtagccccyggctcctggctctgaactaagctgcccttcgtcttagggaaatattcaagtgacctctgctgccaggcttcacccagcttcagggatgctgttgccggcc

SEQ ID NO: 38283 - DNA, 201 bp, Bos taurus
gagtatctcgaaatctttgaacccccgtaactgagcaatcaatatgctcagaaggtcccgccaacctagcatcagtaactgaaggtaacagctgggagagyggcatcggtggagaaaggggtggacagccgggcttagactgaggtgagctacaacacctcgagcggttttcacaggcagacttcatactatttggaagca

SEQ ID NO: 38284 - DNA, 201 bp, Bos taurus
ttgtgatctgagatgagagggcagcagcggctgaatcatgaactcctggggtacttgaactgattctctcgagcaccaccctccgtccaaagacccggccytgcaagaggaaatggatggaagagaattgagccaggaggtcagaactgctttgcttgcaaaggggagacgcccccaggctcgtgttggagcatccattgc

SEQ ID NO: 38285 - DNA, 201 bp, Bos taurus
acaggatcttgtggcctctcctccagtgtctggcagctttgggtgacagggaccgactgagccttctcccctaaacatcccctggatgcttcccctaaacrgattcagctgggtggcccttgattcagatgacttcagcatatttgcggggcttataccaaccccctgggttttcctggtgacttagctggtaaagaatcc

SEQ ID NO: 38286 - DNA, 201 bp, Bos taurus
attgattacagcttcctctctgtacccaccctatgacaactctggatggagttctggatttttgacgcatccattcattcactcattgatttcgttgaacraagtttgagggacttttatggatcaagccttgttccatatcttggagattctgcatcaactaagctggaaaagattcttgtcttttcaagttcagatttg

SEQ ID NO: 38287 - DNA, 201 bp, Bos taurus
accccatctggggaatttttttaagacaaatactctaactctcagttttatcatttctatctgataatttttcatagtttccatttctctggtgaaattcmtttccttgctattttatccatttgttcttttgagtgtttggatatatttataataatgatttggagtccttttgttaatttcaatacctctgccatttaa

SEQ ID NO: 38288 - DNA, 201 bp, Bos taurus
ggtgcctagtggcccacaagcactccggcccaaagggcacgcagaccagcggggatgccggccagcctcctcagcagagacggggagcccggaggccaccrgacagacacagagaagggcaggggggaagtgagagcggtgccagacccagaaagcagggtgctcccaagagggccaccctccacccccacactgcaggac

SEQ ID NO: 38289 - DNA, 201 bp, Bos taurus
gctgtcatgttttgtctccgacggccgctggggaggagaagatggagaagcgaaccagaggtaggcagtggagggcagccatggggtggcatggggagctygataaatccagctaatctgtggccagcactgaggcctggcgctcctaattgcccctggtccaggagcagcactcagggtgaggatgctggggcgcaaatc

SEQ ID NO: 38290 - DNA, 201 bp, Bos taurus
ggctgagctgctacacacgcccggcttggccagccagggccgggcgccccgcagcatccattgtcgcactctcaaccaggcccaaaggctcagagagcttkcaggtgacccatggtgcagctcctggggaggggaaccaaaattcacagccaggcccctccctgcccccaggccctgaggaaggtgagaaaaagatggagg

SEQ ID NO: 38291 - DNA, 201 bp, Bos taurus
tgaaaagggccctgtgagatgatctagtccaaccacccggctggaaagatgggggaactgatgtctggatgggaatagacttgcccaaggttatattcccragtaatgacagagctggcctgaaaccaaggctcccaattccgacttaggtagtgaagaaatgttcgttggggtgggggtgggggtggggggatgggggag

SEQ ID NO: 38292 - DNA, 201 bp, Bos taurus
tagaaggttcctgaggcccagccccctccccagcttgcgtccaccgcctgtctgacctgtcctccccaggctccgccagcggcagccagcatgcctcctaygtgttctctcgtgccagggccttgccccttgctgtttccccggtcctgaacacacacccccgaaacccatgcgggcagctcccttgctcccatccagagc

SEQ ID NO: 38293 - DNA, 201 bp, Bos taurus
catggccaaaggcacagagctgggactcgaacccaggcctcctccccgccgggcacagatcacctggggaaggtgtggcgtagcaggtgctgcctgttctkcgggaggcctttttgcctggtctcaccatcttatgccttagtgccaacccctacgaagccgccctgcctgctttctccagctttctgccgggctcagttt

SEQ ID NO: 38294 - DNA, 201 bp, Bos taurus
accatctcggggacaggaagtgactggctctctctcctgtgtctccttgagggaaatagaccatcggctagaaagacccctagcccatcccacaccccttyttgggcagaactgagagtaggccggctcaacaccagttatcggtgagagaaacagaattaccatgatggatttagattggttgatttgttctgaagctga

SEQ ID NO: 38295 - DNA, 201 bp, Bos taurus
tggcatcgagagcgcggggttgtaatcttaccatcggtgccttgggggtgtatcggttgatcggttttggagtgtgtggctcccgtccaggaagagcagtyggggttctggcctcgttaatggcgtgttatgctttttctttcagtttccccctttccagggtgagaatgcttttacacaacaacctggagttctttagtt

SEQ ID NO: 38296 - DNA, 201 bp, Bos taurus
taaatagtctaaagattttaagacacatgtgctacttttgttgcagcagattttagttataggaatgaagtatagagttatctgctttaaattgaaaaagmaatcagatttatatgggttctaaagacaccactgctctcaactatagcatgtcctcttagtactaggacaggggaatgtcttgccttgtctgtaacatag

SEQ ID NO: 38297 - DNA, 201 bp, Bos taurus
atgaaactgctgagctttgaagtcatgcattagcaaacttttcaaaagcctatttggaagaggtgctaatggcaggcatttggcagggccccaggaggccragaaggtccttccttcagttagactggatctttgtttctctgagtcccgacaggtggtgctccctcagggccgagggactgatatcttcatcctttccat

SEQ ID NO: 38298 - DNA, 201 bp, Bos taurus
gtaaaacaggagatccttgggggcaagtcctgtgttttgatgaccatttggcccccaagtactcacctagaatatagtaggcctggagtaaatgtttgatraaggaaggaaaggagaaaaggaaggaagggagagagggaaggaagaaggaaggagaaaagctcagggaacagtggagactatgtccttggcccagcgtgg

SEQ ID NO: 38299 - DNA, 201 bp, Bos taurus
ggcctgtgttagaagtggagaggcttgggatcatttccttatgcgacatcaggttcctctaggaatgctcagcccagaacgggcaggtggcagtctggagyaccctggaaactggctgcagggaaataaggaggatgtggatgctgatggtctgattcccctccacagcagggaccctttcccagcccctcccacaaaggc

SEQ ID NO: 38300 - DNA, 201 bp, Bos taurus
tgggcaggggcagagcaccatcacacccataactctgggagtcacctctaattcaagccagaagaatgaggctctagaaacccactaaccctctctcactyatcagtttagacaagcaaactcttctgatgcgtgcatgcgtgctcagtctctttcgtcatgtccaacactatgcgaccccgtggactgtagcccactagg

SEQ ID NO: 38301 - DNA, 201 bp, Bos taurus
aacaaatgcccaaaatgtactggcctcaaacaatgatgttacaaatttgtgtgcatagagcaagcaagaatctggaggcagcttagctagatgccactgaytcagggcctcttcagggcaaggccaaaatcaaggaatcagccaggactgctgtcatctcaaaagtggatgtgacaaagatcccacggcggcaggctctgg

SEQ ID NO: 38302 - DNA, 201 bp, Bos taurus
gcctgagaatcacacatgctaagtaagtttcaccctccatcctcacatggagatacttccttcatgactaacttgaaaaatccaaattttgttttataatsaaatgtggcaatttctattaggccttccgaacttttaaagttaactcctggcaaatacagacttgaagttttctcctacattgtcccagaagctgaattt

SEQ ID NO: 38303 - DNA, 201 bp, Bos taurus
tggccaaagtactggagtttcagctttagcatcattccttccaaaatgacttataatatttaatacatagcaaccattatgtaaataattgcaagtacaaygtaaatgctacataaatagttaccacaagaatggcaaattcaagttttgttttgaagaaatttctggaattttttcctattattttccatctgagggttg

SEQ ID NO: 38304 - DNA, 201 bp, Bos taurus
ctggttggacatactcaggccactctccagaaccactgaagcagaatctgcatttgaaggagattccaaggtggaccgagactaaataaaaatgctctccrcatctgtatcatggccatgcttaccccagcatccccagctctgaagagggaatatagaggaggaagaatgagctgtgcagatcagaaagggccttcaaaa

SEQ ID NO: 38305 - DNA, 201 bp, Bos taurus
gagggcctccttttcagaagaattctcctttggacaaaattccttccaggaatcttctatctagttttccatttcaccagccccctacattaagttacccyactccttccccatgatacatgaacttgagttgtgtactttaacttctgagagttaagtatcatgccaatggttcatcaacccactgatgtccactagcaa

SEQ ID NO: 38306 - DNA, 201 bp, Bos taurus
ttcttggcgctaccacttataaactccgtgattgagtgtgggtaggtaacaacctctggctcagtatccttgtctatgtatgcagagcccttgagatggtracaggcatatagtacatgtttaataagggctaacagttcttatgggaacagtctcaacaggcttggactaaggtaatgagagtcttcctgggtacagtgt

SEQ ID NO: 38307 - DNA, 201 bp, Bos taurus
ctctacttattttttcaattattataactagagctttcaagttaaagaaaacaatgctgttttcttcccaaagccagcctttccctgacacaaagtaacartgagatactaaacattgccagcaattgttatgaaaatgcatttctcttgtatcctgttgtcatggcagctaaagatcaagacatgcctgctacatacagc

SEQ ID NO: 38308 - DNA, 201 bp, Bos taurus
tttattccctgagacggtctgacccacagccgacactccgaaatggaaaagaccttccaggcagtcagcatttgagcacatttcccgcctgcggcctgtaytgacctcacctcaagtcaaaactcacaggaacgctagacttggatgatccgggacatggaaactttcaatcctaaagtgtgccccctcctcactgagact

SEQ ID NO: 38309 - DNA, 201 bp, Bos taurus
catggtgctttccaatgtggatacatcatttaatattcctgtttgaaggttacagttcttaacatccttgtcaacactcgtcactgtctttatgaaaccgkgtgtgaagtggtatctcagagcactcttacatttcctttttctgatgtccagtgatgtgaaactgcttcttgtgtaggttgaccaggtataaatcttctt

SEQ ID NO: 38310 - DNA, 201 bp, Bos taurus
agtgaacgggcctgactattcttgttaaacttcacagaagcaggtgatgggactgatttgcctatgggctagagtggggttcacggacttgaatgcctgtygggggccaggcaggtatcttaatggagtcacgtggctgacggaactgccacttgtgccttgtctgaaagatgcagctacttcttacttatggccacttgt

SEQ ID NO: 38311 - DNA, 201 bp, Bos taurus
tgctgatatcagtcatgacaatttctaatatctattgagcattttgtgtgtgccaggcgttgggcagaatacttgtgctggataatctcatgtaatcgtcycaagaagtctagatgctgttacatagaccccttgacagatgagaagacggatcaaagaaaggtttgccctgaattcttttctcacagacattcctgatta

SEQ ID NO: 38312 - DNA, 201 bp, Bos taurus
aggggttctgtccttaggttatcttttgagggatggccctgggtggtgacaggtcaaccttaaggtgacctttttttttttaaacagaggccgtagccccrtaaaagttttcttctcccctggcttcagctaggctggcatttctgacagacgtgtaaacagatgccagcattgtcgctaatgacaggtgattataagagg

SEQ ID NO: 38313 - DNA, 201 bp, Bos taurus
aatgtgacctcgaaaaatcaccatattgagtgaaatctgggaggtgcccaggatgtttagttcgcaattctgcatctggttaaagtacttagaagcttagkcatatactctcagtatctttagcatcaccttcatgtatgctatgtcactcttgatccattatcatactcttggggaatttcaggattcccatagtctata

SEQ ID NO: 38314 - DNA, 201 bp, Bos taurus
ttgcacctgggaagcctgttatctcggtatcaaatgtgatggtaacatatcgttctggaactaagtaggagatacagcgtgaaccactggggtgacaggayaggccaaccagttaggcgttacaaaaacaaagactggatcacagggagcccccagatcctcttcccatgattgcacacccctgctctgtatccagttacc

SEQ ID NO: 38315 - DNA, 201 bp, Bos taurus
tgtgcatggaaagactggcaacagttaagaggtggcaataattaggaggcaggagttaagctttcagctgtgaccatattcttgtaacctgctcctgatayaaatatccaggggaaaaggctctaactttacaggcacacgtcctctttagggttgactctgtccctctggcccaagacgatgccacctctagtggctcct

SEQ ID NO: 38316 - DNA, 201 bp, Bos taurus
tgatctccctgcgctatacagcaacttcccactagctagccactttgcatgtggtgatgtatatatttcaatgctcctctctctattcgtcccaccctctycttcctgcactgtgtctcagtggagcccttttggaagaacttgtcttagtccgtctccagacctggtgtagtgcagtggtgataagcacagattctagag

SEQ ID NO: 38317 - DNA, 201 bp, Bos taurus
ctgggatttactgtgctccggccaatcaaggagatgctgtttgcggggaaaaagcaccaaatctaatgggcaccctgcctcctgccatgcaggggtcacgmggcctctcgggggagcctgagagaatcaatcacccaggacccatcacaccagaacctggttcctgggaggcaggtctttacaactgagtcttccatgtgg

SEQ ID NO: 38318 - DNA, 201 bp, Bos taurus
ctccgtgagccagaatgcaagcataaaataaaataaatacctttggataaaggagatggcacagcctctctctctaaccgaggtctttgccaatgacaccytggcaaccggacatggcaaaatggagtttttaaagattaatttttaaagtgcaagacaaattccattatatgaagtcctcccatcattttgatttcacaa

SEQ ID NO: 38319 - DNA, 201 bp, Bos taurus
ctaattagagggatgggcagattttcatctagattgattttttaataaatattgacttaaaatgccataatctcatcatattctttcattttctttgtacyaaaaatcaaacaaatggaagaattagcaagcagaaggaatcgtgggacttcaaaagcttctgctggttcagacacacaaaactatgctgtacagaagccc

SEQ ID NO: 38320 - DNA, 201 bp, Bos taurus
gcactggcaggaggattctttaccactgagtcaccaaggaagcccaattagaggtttaattcagttcaaatcaagttaattattcatttgcaaaataaaaratgttttattggtgaagtactattgattggtaagcaccaaatgacaggaaaattttaaaattgatctgcaaattaaataggcaagactatggaagaagct

SEQ ID NO: 38321 - DNA, 201 bp, Bos taurus
cacagactgggcccaacctgcctttcacaattcctggggcacacactgctcttcttcacactgaagaagaccagaccctgccaaaatggctcatcttgacygtaggaggcccccctcaccctgcaaccttactttgattcaatgatacccaagtatctctcaccctagggcagaatgctaacacaggagtccatgtgcctc

SEQ ID NO: 38322 - DNA, 201 bp, Bos taurus
agtgtgtgtatgtatgtacatgtacacatgagtgttgcctggccaactcagttatgaacttgataacaataatcccagggattgtaattatagccggtgcyaactgggtgcttcctatgtgctaggcccagcacagagtgttttccaggcatttaccatttatgtcttatgatcatcttaagaagtagacactaatatgat

SEQ ID NO: 38323 - DNA, 201 bp, Bos taurus
tcctgatcttgactgtgttgtcttataatccaaccaaatttaactgacattgagcatttctgatctgaacagttaacatggaaatttggcccaaataactktatatacattctgaacatgaactcggttcaggcatcagaaatgatggggaagacccctcccactaccatccagggagccaggcagggggcccctggtggg

SEQ ID NO: 38324 - DNA, 201 bp, Bos taurus
atcaaatgactgaaggcattggacaaaaatagtttgctgtgcatccctcccagtaggaaagcaagtttcaaacatgccttgtgtcggctgccataccaatygcatacaagaacagcctgttgcttggttagctgcaatagaaacctaatatttcacctgaaaccctgatttatgtgtaaccactctactccttactaaaag

SEQ ID NO: 38325 - DNA, 201 bp, Bos taurus
ttgcctagagaatcctatggacagaggagcctggcaggctacagtccacagggttgcaaagagtcggacacgactcacatgaaacgacagagcacacacgygctaggcacctcacagaaaggcagtgggctgtagaattcgaccctgggtttgtcttttttcaaagcacgtgctcttaacttcccactaagcttcagaatg

SEQ ID NO: 38326 - DNA, 201 bp, Bos taurus
agaacaaaatccctgttgtaatggaggtctgtgtgataataaagcccacgttatttgccatttttctaagggcagaggaactgggaagcagaagggcccarttcttgccttaaagtggtcaggagtccaccttgggaagatgccacagcttagaatagacatcaccaggattcagactcaggttgtcccatctgggggcct

SEQ ID NO: 38327 - DNA, 201 bp, Bos taurus
acattttaatggagtagaatctgtaaaaacactgaatcactaagctgtacacctgaaactaatataattttgtaaacagattcaatttttaaaataatcarttaagccatgagaaagaagaaacgggggaggcaagtggattactcaacacctgctgattcatctgtcttatttttatctcagcatacaattattaattct

SEQ ID NO: 38328 - DNA, 201 bp, Bos taurus
actgcacgtgtgagtagaatgagtcgaaaatgtgaatcaactgctaaaggccgatggtgggcaagtatgggagtatacagtccttaggagcatggacccakaggggagtttacactcactgcaggcccttctccctggaccccaaaaagggacccatgagaaatgctggtaacaggtagtacttgttattcttatgtgact

SEQ ID NO: 38329 - DNA, 201 bp, Bos taurus
tgacttgtatgtcagcttcaggagaccagaggtttgttttacgtttactgccatatctctactactagaatagggcctgacacatagttcagttcagttcygtctctcagtcttgtccagctttttgtgaccccgtggattgcagcacaccaggcctccctgtccatcaccaagtcccagagtttactcaaactcatgtcc

SEQ ID NO: 38330 - DNA, 201 bp, Bos taurus
agggagcaaacctgggtctcccgtgttgcaggcagattctttactgtctgagccaccagagaaccctctggtacatcaaggctcagttcaaatgctctctyaggagacctttcctctcccatgtctgttctttaactcttattatattctatgtttatataaatcctctattaagtgagagcaaaggctgcatcttaacca

SEQ ID NO: 38331 - DNA, 201 bp, Bos taurus
acagcaaggggatgacttcatggaggatctggggaccctgatggcccaatccctctcctctgtctaattcctgcatgccgccagcgaggcccaagggaatytgcatccctcttctgggagaggacagggagccagtttaaggcttgtgagctgagcacagaggatgctgttcatgtcacaagggacactgggccatcactg

SEQ ID NO: 38332 - DNA, 201 bp, Bos taurus
aatatggctaaagttactacctgcctcacagatacacatcaaatagcctggcatatagtctaaatgctaggcatttattagatattggaattattcaagtrggaggacaggacttggtgtccaagtctgtacagcaaaagcctgcatgagtgctgtcattctgtggttgtttgagaccatagaaagcctccaaaaaccaat

SEQ ID NO: 38333 - DNA, 201 bp, Bos taurus
ggcccagtgaacttcgggcaagtttattagcttttctgttctttatctataaaatggcttaacaataatacctactttatagggtgagaattatgttagcrtgcctaagtatttagaagggtacctgcacttaagtgttctagtaattttctttttgtctgctgccaaattttcaaggaatgattatagtaccattgtaaa

SEQ ID NO: 38334 - DNA, 201 bp, Bos taurus
tgggatgataccctacaggacatctggggataccaacgcgaggctggtgcagatggaggtcctcatgaattaagtgtgatgttctgaggggctcacggggmtgcttgctgtcagtacttcagggccctccagggttggggggtgtttctggttttgtttctgttgtgtttgttttgtttcatttttctgtattatgtattt

SEQ ID NO: 38335 - DNA, 201 bp, Bos taurus
atgtgctgatggtggattctcaggccaccagccaggctgagggtagggggcacttgggaaggtagctctcccagagtccttcagtgataaccttatcagcyggccaggtacctcgagggtagaaaggatatcaggcccaagacccagctctgcttctaagtgctgtgtgactttcagcaactcactgacctctctgaattt

SEQ ID NO: 38336 - DNA, 201 bp, Bos taurus
gcccagggtaactgtagggagttgcttttccccaggcttgtcccctgcgtgttcagcatcagagggggagagaacactgggccggcacaccctatcccctygcagtgacattagtgagggctcaggttcctgccctgtggtgtaactggggccaccggggcccacagtgatgatgttcacaccactgtggccaggctgagg

SEQ ID NO: 38337 - DNA, 201 bp, Bos taurus
tctgggctctggtttccttatctgttaaaatgggtagttttgaggagaatgaaagctcttggcagtgtgcctggaagctgctaacaataatagaggccaargttataatcaccattgaacagataaggaaacagaatccttcccagacttcagacttccaggaggggtcaagccaagccggcttcacctgtgggtgttagg

SEQ ID NO: 38338 - DNA, 201 bp, Bos taurus
agctgtgtgatacagcacaggctggttaggcgaggaccactggctccagggaggggtgggcgctggtgccggagggctcagcaaggagcctcatgtggtgyccaaatgggccacggggtatccagaacagaccctgaatctgaacgcatctgcctcctccgacatctctcaccttctccctgattatcatccagcctccca

SEQ ID NO: 38339 - DNA, 201 bp, Bos taurus
ctggccctcccagttccctctgtgtggtcagaaggttgcctggggtaggggtaggggtggtctagtccaccctactggggctggagtttctgggagctccrtatgacagaggcccgtctggctggctacatctctgagtgacctggggaagtctaccccactacctggagcctcagtttcctgttctgtaaaatggggaca

SEQ ID NO: 38340 - DNA, 201 bp, Bos taurus
ggaacctgcggcccagagaagcctagagagcggcccccaaccccatcctgaggtctccagcttccttggagcaccgtggtttcctcccaagtggcacatcrccccagggcctgtggtctctccctttgcagaagttcgtgagcacaaccatccggcccacactgatgccctaccctgagctctacaactgggacacctgtg

SEQ ID NO: 38341 - DNA, 201 bp, Bos taurus
cttagggctggcacgtgcccaccagcaacccactacagagagcagcagaaggaagccgacgccaccccggctgtgctaatcctcacaggaggtgcaccccrgggccgtgacctcattaccaaagccgcctctaggtggcaatttctcccctgccttcataaagagcaaccccacactgggtggcctggtcctcacggcctt

SEQ ID NO: 38342 - DNA, 201 bp, Bos taurus
ggagcatccttgcctgacaatgtagattggcagtgtgatatgactttcagcgacctaggataatgtgttccctccatgccaggctcagagctgagggcccrtgtgcgtcatctcacagcagtttcataacgagtccatcattatctgaagtgggcactggtcactcttggccaacagcatcagacatgcccttcctatgag

SEQ ID NO: 38343 - DNA, 201 bp, Bos taurus
cgaaggctgagtggaggagcaggtagccccgcagcccctcccctgatgcatggatccccccgcccgcctccggcgccctgggccccctgctcctccctctrtgcagtgctgcagccaagccgcatcttgctgtggaaacttcttgtgccgcttttccgtgggctctatcccggttagggctccagagtggccgggcttcag

SEQ ID NO: 38344 - DNA, 201 bp, Bos taurus
aggggagtgcccaccctcgaggcccagagcaggtttcccagagtgagcttggatgtttccaggcagaggtccgaaagccgggaagggtttgaggaggattkggggaggctgggccagctcatggagctccagggcaggagggtatgctgagatgtgagcaggggtgggcggtgtgtggagctaacgataagctggtgtcct

SEQ ID NO: 38345 - DNA, 201 bp, Bos taurus
aatttcagaaaaatcaatgatataaccatagtgttcaaactacattttttcaagtattatatttttggtcacagaaaataggctctaatttttgttttcgkccaacttaaaactttttaaaattaatctgcaggcataaaaacatgacattagttttctgttctgtaggcataaaaacattagtttactgttctgaattaa

SEQ ID NO: 38346 - DNA, 201 bp, Bos taurus
aaacaaattttattacaatatgttatacaacttaattttcttcccctaccagcccacacctatatactttcccttacatcatcctctccatatttattgcrtatttatcactccaccatttttaatgttgtactcaagccctgcttagtcacaaaaaatatccctgacaagttcaggttcaggcagttttctctttaaact

SEQ ID NO: 38347 - DNA, 201 bp, Bos taurus
tctccggccaagagggatgggaactcatgcagccaagagaaacaacatgtggtgaacgaaacatatcctttagtcttcatgtgggattctagttgacctcytttggccttagttctcaaatatcttagaggatttacagtagaggaagcttaagaggtaagatatgggcctcttgttaataaggctcatgaaagttagaac

SEQ ID NO: 38348 - DNA, 201 bp, Bos taurus
aagagtcagacaagacagagcgactttcactgttcacttttacttttcattgtattcatcagtaataagagagtaattccaggggattttttagtggatgragtaaaatattattcacagtgcctagaaatcatagaaaacaaaaataagcaagcaaaacccaaaacctctggattgtattgaagtttcaagaaaccatca

SEQ ID NO: 38349 - DNA, 201 bp, Bos taurus
caccttttcctcctccacaggtgctcgggaaccacttctcaattgaattgtgctagatatattagatattggctgcaagtaacaaaacattcaactttgcrtagcttaaacaatgcattctttttcttggagaacaagaaatccctatgtgcatggtttgggtcagtgattgggcagcttacagatgtattcagtgatact

SEQ ID NO: 38350 - DNA, 201 bp, Bos taurus
tacaacatatacacttctaagtaaaaagtttatactaatacaaatctacagtaagggcaaagaaagatatcaagtaaactacataatgttacacctaaagraactagaaaaagactaaaataagcccaaagatagcaaagggaaataaatagcaaagatcaaagtgaaaatcaatgaaatagggaatagaaaaccagtaga

SEQ ID NO: 38351 - DNA, 201 bp, Bos taurus
tctggcccccaacagaggagcctggcgggctatggtccatggggtcccaaagagtcagacatgactgagcacgcatgcacaaatagagttcatgatcttcrgtggccctggcctgcatcatcttcaaggagggttttggttcctgggattgaggttgggtcatggcagtgagagcatgaaatcctagccacggatcagtgg

SEQ ID NO: 38352 - DNA, 201 bp, Bos taurus
atttatgctcaaacaatgaccaccaataagagtcattcagagaactgactttgggtataatgtaggtccattgctcgtactaattagtgaactagtgattyctgtcattctctctggtgttttaaagacaaggaagaaagactacattgtgcaaaatggagatttgtattctttttctttaaaataaagaaggtgtgtctc

SEQ ID NO: 38353 - DNA, 201 bp, Bos taurus
cgctcagtgtgatattcatagatgtaacacaaaaattgaagcagacatcctgaaactagcatctgttttcctgtcactgttttaggctattcattgatagkgttaacttttcacacaagcaatagctctgtaggggagtttttaaatctgtgcatcatagaagaggaagttgaaggcaaagggaaggaagtaattgtccat

SEQ ID NO: 38354 - DNA, 201 bp, Bos taurus
gaatatcagaattgccaatcattacttatgtatgatggtattattgaatcaataattataatagaaaaacactgtgaacaacttacatttaccagtattasatgcagactgtcatgaaatcattaaaaaggacataagcagacattttgccaaaggaaatatatcaacctttaacacacaaataaaaaaatgctcaacatc

SEQ ID NO: 38355 - DNA, 201 bp, Bos taurus
tatccttatgtaaatgcaatatggtttttctttctttgtcttcctccttcaagattttcttttgatctttggttttcagaagatttgaatatgatgtgtcyaggtgtgcatgttatatttattctacctaccattccaagtttcttgaatctataatttgacatcgttcattatgttaagaaaactgtcatcatttctcca

SEQ ID NO: 38356 - DNA, 201 bp, Bos taurus
ctggagccaaagaaccagccatacaaggtctgaggacccaaattagtgagaccactgaggaatctcatgtttaccagacaaagattagggtcagtgctaayacctgggtagtattggagttatcttggatagagaacataaaaaaaaaaatcagctgttggatgtacttctaccaattggtgttttgatatttgtgtcact

SEQ ID NO: 38357 - DNA, 201 bp, Bos taurus
ccagtttctggaacacccatcttaggcaggttggtgagatggcctcccaactctttgatttcacctgcttgtgccagtagtgactgctccagaagccacayctgtgggtgttgctcttggtggccggttggtgcggatccagcaggctcaggttcatgcacttctcccaatggaagacacaccccattgcccattgcctca

SEQ ID NO: 38358 - DNA, 201 bp, Bos taurus
aaaacccttatgatgagaagaacacagaccccatttgcaaagacttatttgcaatacattttcagagaataagcatttcaatagcaggtgaaaaataaaayagctgaaccttccacactagctgaaactcagaaaggtgtgcataactggccctcccaggaacatctcccaaatctgacttgccctttcagctatcctggg

SEQ ID NO: 38359 - DNA, 201 bp, Bos taurus
agtgatttctcattgtatgcctaaattggtgacttaacttttcagttttacaaggtaaaattagaggaaaataagtggttactctgatgttcacacctgtrtatacatagctgcaggaagaattgagaaaagagagtgatgtgggtgacatgtacaatgcagagatatagaacaaaggccggcatctcgtggcctgaaact

SEQ ID NO: 38360 - DNA, 201 bp, Bos taurus
tctatttctttattctgtgattgggccatactttgctgtctttgcatacttcataactagttgttgaaaacaaactttcaaatattataatgtgttaactrtgcaaaacatatacttctccttcctcagggtttgtctttttgtggcttactgttttattttgtgtgtgtgtgtgtgtatgatttttttaaaaatattttt

SEQ ID NO: 38361 - DNA, 201 bp, Bos taurus
aagaggactatggttagcctagtgtcctgtatgtggtaaatgcttagtgattgagtctacggtcatttaaaataagaggcaaacgagacttctggcccatrttctgttgcattttactttaagaggtcaacctcaatctttcacttctattgcaaagccatctgtatatcctcctgttgaataaatgcctctgttatccat

SEQ ID NO: 38362 - DNA, 201 bp, Bos taurus
gacattttaatctaatccacatcctttgcaagttttctttgcccaagtccagtttttcttcctttcacacagggccataagaaattatctatcatggtttrctcacttatttttcattactagagtcatgaaagagggataaaatccgtgtatggaaaggcacactcttacaaagatataaggcattttcaacttgacaca

SEQ ID NO: 38363 - DNA, 201 bp, Bos taurus
atacagaatatttgtaaatctgcctaacctcttatttttatttatttaaattaacagcagcagcattcattgccttttggcccccaggtacagtgaactaytttttaaggaacttcaaaatatcatttaaaccttttaaaataattcagccaatacaagtgttgagaaagcatcatttgaattggcaaaccaaagaactgg

SEQ ID NO: 38364 - DNA, 201 bp, Bos taurus
aagttcctaaaacgtccattatgtttttcttaaaataaaaatgcatattactttttctttcttactggtgagagaaactaaggtacaaaaacatgttctayttgttcaaggtcatgaagtaagcaaaaggcagtagagatagtaagcttaatctacctaccaaagggctttttttcttttacatttactctctttcttcgt

SEQ ID NO: 38365 - DNA, 201 bp, Bos taurus
gtttggcctaggggtcggccacatactatcttcagcagcctcttggcataagccccagccttcccaaagcagcaggcatccccaagcaggggcccaacctmgaaagcagagataggtttaacaaaaacataatgttgactttccccctccagtggggctattctgtaatgtgacttccatatgtttatataaaatgagtgt

SEQ ID NO: 38366 - DNA, 201 bp, Bos taurus
ccaagccatcagtgcaactgtttattgatttgttaaattcagttcttccaatagctgtttcaaatatcactgagtttcctttaaaaatatttccccacaargtaaaactttcagactcgctgagttatttcgtgctttagatgtgaagaaattctttatgataatatctaaaagtgtgttgccaaaaaaaccctaggtaaa

SEQ ID NO: 38367 - DNA, 201 bp, Bos taurus
aaaaaaaatgaattgtttaaactctacctgaaagccactacctagaggtcagctctgactgttgagatgggggattagcaagttttaaagagatgtgaacygctatcaccaaactgagaccatctactttctgtaatcagaaggactgaaatagcactagaaaaggaaactcattatgcaaataccattgttttgaacctt

SEQ ID NO: 38368 - DNA, 201 bp, Bos taurus
tagcatcaaggttgatttaaaaaaaaaaaaaagaaagtaagaaagaaaaagcttccaggatctcaccaaataaatacatttggaaaagaatccatctctcrgcttatgtgaaaataatgaaaagatgcacagtgatgacacatttcaggaataaatttgaagggaattgtttcatacaatttcacaaagggaccttaggga

SEQ ID NO: 38369 - DNA, 201 bp, Bos taurus
agaaggggtacatacaattgatataaagtgagacttgagacagtttcctaataattataattaatgctagaaattactgttaggctctataataatctgcractaatattaaatatagttattcctatcatctgcaacctcaaacctccagttttggtaaagcagctgaatcttgaggtttgttcatcatgatatgtgctc

SEQ ID NO: 38370 - DNA, 201 bp, Bos taurus
tctcttcaaaatgttcagcagttagatagacagggcttgctttctgagccccctgatcactgtctgggttctttggttaagtcactttgtcctgcagaacmctgtttttgtctcagcttaaggaataataattcctataaaataatgttgacaggataaattaatttatgtatctgattccccttagtgaagtaacgggaa

SEQ ID NO: 38371 - DNA, 201 bp, Bos taurus
cggcctgtcagttgtcttgacctcggggatcctggagccccagtgatttaggaatcactgaaaaagcatcactaggcaaagctattttaatgttaaataartaaaatttgcaggccaaattctcacctgtgacttctctcattctggctctgtgtttttaaaccagtctcaactgtatctaggcaaatgaaggatgcatag

SEQ ID NO: 38372 - DNA, 201 bp, Bos taurus
ttgctcacctcttctcaactctgtggtcagtgatgtctccttggcagcttgaaattggccacagtgggaatatttacactatggaattcagcaaaggtggmaaatcaccccatctgcaaggagtcagttgttgaataattccagcacaccactgctgtgaccactttctgaacagagccttggaataaataaccttctctt

SEQ ID NO: 38373 - DNA, 201 bp, Bos taurus
aatgacgtagttcccagggggccttttctgtcttttgcttgggcatttctttccttctgccctgtaaccagatctgattctgggataccgaccagatcctrggccctgccctcaccttccctcagccaccatcttcctgcccttccccatgctccttctaccccagggccttagctctacctgggaatctcatccgcccct

SEQ ID NO: 38374 - DNA, 201 bp, Bos taurus
ggcctcagtttccccctctgtcaaatgggcaccctgacaacaccactttacagggggtgggaggctttcatgagatggagatagagcgtgcctctgatgcyctgctgctgatcattacggcccacgtctcactctggtctttgaaaggaccactgagagcctgtattcctaacccgcagcccctgccttaactctggtgca

SEQ ID NO: 38375 - DNA, 201 bp, Bos taurus
tagccagtgccctgggcctgaaatgatcgaaactgtccttttattttctcctctctcaaaatgactacttttaattcccctactgaagtttctctggccarctcatccaattttccatcagaattacccacagaattaatctgcacacactggcataaaagaatgggctgacaggacaggccacatccaagtaaaaattta

SEQ ID NO: 38376 - DNA, 201 bp, Bos taurus
caaaggacaggagccatccgaagcaccctctggcagtggttttgcagtgaatgaacagtggaagaatggacaaggcacttggcgagggccgtggagctgamttactgcatcacatcctcacgataaaggtgggagcagacttttgtccccacatgcatacacatgagaaaatgaggccaagagcgttggttggaatgactg

SEQ ID NO: 38377 - DNA, 201 bp, Bos taurus
tgatgggagacgctgagtccccactctcttagagatgattgctttggtgaaaaaacaaaggctctcttcatcagaccttggccagtccacacccacaaacktgggactcttccagagaaatatccagattgtgaagcatgccaccacacggctagatgaccccacataacagagctgcacagagcccaccaccccaaccca

SEQ ID NO: 38378 - DNA, 201 bp, Bos taurus
atatggacacctggataattcacttaaaatgcaggtccccaggcccaactcacataaactgtgctacatgagatttggggtcaggctcagagttgcatctrttaacaacaccccaggccatctggataatggtagtcaaaagactgtgctccaagaaacaataccacatgttcaatgctgctcttttttctcttatataat

SEQ ID NO: 38379 - DNA, 201 bp, Bos taurus
gcagcgggcgtcttgaggataggaggagagaagtcaggaacttcttctccactgctctctgctctggttcctatttcctcctgtggctgcatctctccatyctgcgggcctctttactctcatcagtccctcactgggttctggaaacaccctcccctcttcttagtccccttggtcctgggatagcctgcttcctgtctc

SEQ ID NO: 38380 - DNA, 201 bp, Bos taurus
gtcaggccagcatggggttcacaccaggacaggctgagctggaagaagtcacctggagagggattccgaggtcagcagcagtgatggccactccctcccayccgcctcaggcagcagaatgaacattttgcagccacatacctcatgccagggactgtctgtacataaacccagtcctcacggcaggtaaagtgttcttac

SEQ ID NO: 38381 - DNA, 201 bp, Bos taurus
aaccctgccccatgaagaactttgatcttggcaggccgcctccccccacgccaaagacagccgctcacaggactgggctcttgctttcaccaccccaaagktccaggtgaggccccgaggaagccacaggggcaaaactcccagggaccaccaaacgctcccctgcccccagcgacatctgtgtgggggagtctgctctcg

SEQ ID NO: 38382 - DNA, 201 bp, Bos taurus
gtgggaattcaaggacagcaataaagagttctggagtgtggggcacgctgaggtcaagctcattagcttggtaagttgggcctgtatccctgggtgggagygggatgtccaaagatgggaggaaggagaaggagttggctccctggggctcctgtggcctgagccctttgccatggctcaaagggcatgtctcccggcagg

SEQ ID NO: 38383 - DNA, 201 bp, Bos taurus
ttcccagctctccagcacctagagaaaactgctaaagactggatgcaggaaggaaagaattggatcaacttttatttggttgttaaagaggcaatattttmattctttgtgaaggagtgagcagtaaagggtgtccctcccattcccattctgcaccctctcccacccttccaggctaccagactccacccaggaggcaaa

SEQ ID NO: 38384 - DNA, 201 bp, Bos taurus
tccctgtgccccatgtgggcattggatgggacccacttgagtcctaggtgctccagtcagaagcctggcctggcattactcccacttatatggcccaggtraaaggttgtttcttccccagggagaggtggcacgaatggagccagctgttggcaggaccggtccttaaggcccacacagagcgggccaagttgctgcaca

SEQ ID NO: 38385 - DNA, 201 bp, Bos taurus
caaacgcatcaatcacagccaattcccccgggcccaggtctttagattctgatttcacagaggcgaactttacaatgcctgaatgtatcatctctagcccstgtgacaggccagctctgaaggcatctgcttaatttttgcttggggatttacttatgggaggtggggaaggctgtgtctttcccagacattggggcattt

SEQ ID NO: 38386 - DNA, 201 bp, Bos taurus
caggggcctctgtcctggtaggagactccctccctgcagcttgacacacagcagctctcaggttgaaggcaggtagttcccaggcaatcaatttagaggamatgaagtatttggccatcttaacaacaaggaaaggcaggatgttgaaaagggaagagagagtcaaggcaggcagtgagaggcagggtaggatgggggaca

SEQ ID NO: 38387 - DNA, 201 bp, Bos taurus
agattaatcaggaggccatgaaaacagcccagtggagaagctatagaggctggaggtgcagtggaggaagaatagagaggaaggccagattaaagagatgyttaagagcagtagaaccatgggatgagggaaaaggaggaaggatcctacttaggggccagggtggacagtgactgtcaacagagactgggaacacatgag

SEQ ID NO: 38388 - DNA, 201 bp, Bos taurus
gaggccggcagtgctggagctgaaaacacgtcttgagacaaagctgagggaagaactgagtcatggcagcaaagcccaggcttctctcctcccttcttccyccagcacctctttgctgggcctccctcctctgccagggaaccttccccagagtcgtcatgggctggaaaagaacccgtggaggtcagaacatcaacacag

SEQ ID NO: 38389 - DNA, 201 bp, Bos taurus
cctggcagctcaggacagggaacacggactagggagggaagccagcaccttgtgactctctcctctcacagggtcgcccccctgagaaccttgacctcccytgccaggcccaggtgactcaccgccagttcttggtgtgaggagggccctcctctagccgcaacagggcatagcgggcggcactcagggacaggcctcgga

SEQ ID NO: 38390 - DNA, 201 bp, Bos taurus
gtatactaagggtcgtgttacatgtaatactaattggcagaccaaacatctgccggaggcagaaggctgtagtgtgatgtctggactctaaattccatacytaggccctcaaggttggagatcctctgaaggcaggactgcttattggaagggtctttcacccacttaatgctgtttgctccctctcctttactactgttg

SEQ ID NO: 38391 - DNA, 201 bp, Bos taurus
gttgctctgagggttaggatgtctagaagtacattggatgtatttctagaaatagaaatacagctggatgtctagaaatccagctgcatctctggccttayccccaggtcctgcccagcctgttagctatgccctgacatcttatctgatactcactgccttatagccatcttcacccctggcctatttcaaccccacttc

SEQ ID NO: 38392 - DNA, 201 bp, Bos taurus
gattctagtagtcagaaaaggccttgctgagaaggggtcatctgagcaaagaatgaagaatactggggaacaagtatgcagctatgtctaggaaaagttgygaatgctaaagccctgaggccagagtgctaggggaacttcagctgagtccctcagggaggctgctggagcagagggaggagccagaacgcagtgggagat

SEQ ID NO: 38393 - DNA, 201 bp, Bos taurus
caaatgtcagacgcagagggcccaagcttttccagcacagcccacagctggaaatggtacaagcctcatattcattctttgtgttggagaagaggtttccrgaccttgttcatgacttactgaatgattcaaaatctggagctccgtgctggtgtcagcatgtttccacatccattagtgctggggaaatgctgcccccag

SEQ ID NO: 38394 - DNA, 201 bp, Bos taurus
tttttttctcttgcctggcataaacatttttgttttaatttttggcttttgatttattttttcacaggacagctattgtatttggacttatcaattatatygtattttctaatgttaatttccatttttagtgttaacttttttcaaccctttgttctagatttgccttatttattcagtcagtcgtttatagctgtttga

SEQ ID NO: 38395 - DNA, 201 bp, Bos taurus
ctccctaatctatttccccacgatctgtcgtcacttctgctgaaaacctgcaaatttttttctttacactcaaaattcttacctggcctgtaagtcttttrtaacctgaccctgcttccctgaatctgcaatttcatcttgttcaccatgataaaactgtcttggccttctctatgttccttgaaactgctctattttctt

SEQ ID NO: 38396 - DNA, 201 bp, Bos taurus
tcaaaatattttttgttggacttagaatcaagaagagtaaataatgtagctaacatttttaaagaaataactcccagcaaagatacaagaacattttagtratccctactgtcatggcagattccatgttactggcttatattgttggctttcagaatttagtttctctttattgctgtttctttctcagctcacatttta

SEQ ID NO: 38397 - DNA, 201 bp, Bos taurus
tttatggggcctaggaaaaaaactgagtttaggaacagtggtcctcaaatgtttgtatgttcataaattacctgggagacttcttggggaaaaaaaaaaargcagattgtgcttcagcaggcctggaatttggcccaggaatctgtgatttatacaggtagcctgagagattctcatgtgtagccacactttgagtgggag

SEQ ID NO: 38398 - DNA, 201 bp, Bos taurus
ccacacgcacccacaaactggcttacacgattctagattaaatgggatgctacattttccctgcagtgggtcccaaccataagatgaatattatgtaaaayataaatcaacaaccccttttcttccttctcctccttagcagtaaatttccgttaggtcctgggatgccttttggtggaagaaagaaaaccaagagcacag

SEQ ID NO: 38399 - DNA, 201 bp, Bos taurus
ccaagatttcttgtttctccttcttgctacacagaattttttaatccagtgtgcacactgccatttcacagttgagtatatggcatcaagggtgacaaatyaggcagccgcaatcagaattacaggtatcgtgggactaattccattccttgccctgatttcaatgtgtttcccatatgatatgacggaagaggactgcgt

SEQ ID NO: 38400 - DNA, 201 bp, Bos taurus
atgcacccttctgagttttacaattaggcaacttgttccataatctattgtttcactttttgaatagggaggaaacaacccaaatcatcaccaggtacctsagcatgaacaatggatgttctctttaggtgtaaagtatgtctgccaaggactgacagcaaaatggggatagatggtcacattcttgtattattttagggg

SEQ ID NO: 38401 - DNA, 201 bp, Bos taurus
tttctcttaatacattgagatttcattctgagggtttctcaccttcattgtttctgaatagtagtcagctgtccacctgttcctcctctgaaggtaaactrtatgcttttcagatgttttcttgctctctcttttttgtttttgttttggctgttacacaattttagtgtgatatatcaagatacagatttactgtaattt

SEQ ID NO: 38402 - DNA, 201 bp, Bos taurus
tttggaaggacttgggcttggaccttgaatgaaaggattagccgttagaagatcttgagcagaagagagatggtggcttcggagttgagaacagaggccaraagtagacatcctactgctgtaatctgggttagtgatgacatcagctctgaccagcagccctgggggtgctaagaagtggcccaccctccagtagcactg

SEQ ID NO: 38403 - DNA, 201 bp, Bos taurus
cctcatctagctttttgtttattggggggatttttaatgaggggggtgtggttaggggctcatgatcctccattactttcttttgcattattacatgaacygtttcatcagggaaatagagaaactaattccagcagcttacaaagattgagtacaaaggggatagcttgggatccttagtccaccaccaacatacatagc

SEQ ID NO: 38404 - DNA, 201 bp, Bos taurus
tctcttgagaatgatcatattcctctggtctgtccatctgtgcaactcaatgcagtagaggtcagaggggagcccagagaggaccccaagacaaaatgacrttggttaccggcttaagagactcaaagaactgtcctagaagagagcaaattctattctgagaataggtttttcaagaagaagcagattttccagtttcgg

SEQ ID NO: 38405 - DNA, 201 bp, Bos taurus
caccaagttggggatcaataagaaatcagcaaaaactaatttcaaagcagctacttgcagtatgaaacgttaagtgaagatatgacccaaagaggccaagrtttagtttgaaagaatagttttataagaccatcatgtaaagtcctcttcctaaaggcaaagatgtctaacatgagtccattggcattttgctgaggccac

SEQ ID NO: 38406 - DNA, 201 bp, Bos taurus
caggtccggctaacctccagccaatcattaaccctgcccgaggccttcaggacactcacacactcgggaattttaggagcccggaaactcagagcaaagtytattttcagaacatggcctgaagaaggaagcaaaggataaacagggaccaaatgttttaattatttgaaatggtttccaccccaacaccattccccaagt

SEQ ID NO: 38407 - DNA, 201 bp, Bos taurus
ctctgcctacagcttctgtgtccatcacccagctgcttctcttcccccttgttctgtatgggtggagctcgatcccccaatgatgggatacaccagaattygagaccgtttcctctctgctcgagtagggttatcacaaaggaggggccagtcctcctcgcggtcagcctgaattgtcgctttgggaaagtcctgcatggg

SEQ ID NO: 38408 - DNA, 201 bp, Bos taurus
gagggcctcaagtgattctgcttgtccattcatttgaccatcattcactaaactttgtacaaggtccctatgccacttgcttgtgagacagagcgagaccrggtccctgggcccaagaagctcacatccagaataattaaccttttagatatcataaactcattaggaaatctgatgaaagtggcaggctcctagaaaaaa

SEQ ID NO: 38409 - DNA, 201 bp, Bos taurus
tgctgtacagcagagactgacacaacatgtaaatcaactatatttcaataaaaaaatttacctggcaccatcataaacaaaatcaaaagatgagtgacaakgtgagaaagatattaaccacatatattacagacaacagaacaaaccagtcaatcctaaacgatatcagtcctaaatattcattggaaggactgatgctga

SEQ ID NO: 38410 - DNA, 201 bp, Bos taurus
gaccgaagcattggaaatcaatccaaactaaatgtgcttcttaactgtaagtgaacagttgaaaacaatcctcttttatagccatggagataaatactctrtttttattaggaaaaaattgctttggactgaataaagtcatttgattaacaagtcaaagcagatggtttattgatatttcagaaaggagtttacaaggtc

SEQ ID NO: 38411 - DNA, 201 bp, Bos taurus
tgattatatagtagaaccaggtgagattgacaacacttgagccaccagaatctaaattctgtgtaggaaattgtgtgctagtcaactacactgatataacstgccatgctagcatatgtcttggttttaaaccccccacaaatctaccaaattattcatgttgtcctgatttttccactcttcatccttttctaccacttt

SEQ ID NO: 38412 - DNA, 201 bp, Bos taurus
gcttggagacagggcctttacacaaggaatgcagtgaaaacgaccagtgtccctcgatgaagagggcgggacccaaacacacagagggtggaccacgtgcrgacatggagaggacggccatccacaagccctatccttgcaacttttatctacatttgaaacattttcaaaacacagttaaaactttaaatatataggatg

SEQ ID NO: 38413 - DNA, 201 bp, Bos taurus
cagtagatccagttaagaggaatggtagtaattaaacagtctaaaaaattccattgttgcaaacaaatactgaatttgttgaaaggccttaactatttccrggcataactaatttaaaaagatacacaccaaaatggaggacaggagttctggagtggggcccaaggttctgaaatcagctagttgccaggtgatggctgc

SEQ ID NO: 38414 - DNA, 201 bp, Bos taurus
agggataaggaggctcactggaacctgatgagaggaacattttatgtgtattaccatgtagtctcaacatacatattgcaaaacttaacaaaattactccraagttgacaaattaacttctagtgggagatttacaaacctttctcagaatttgacattatgtgactatttttctgtgtcaaacatcccataaaaaatatt

SEQ ID NO: 38415 - DNA, 201 bp, Bos taurus
catttttagtgacccatctgagttttggcccctgccagaatatgagtgatggagaattaatgatagttttgcttattattttcctaacagatgtttctctrtttaagaacatgctgaggcctatacttaatgttagagcaaatatcttttgagatggaggtgccttttaaccacttaatttttattggttttaactcagtc

SEQ ID NO: 38416 - DNA, 201 bp, Bos taurus
tctatacctcaccccaaatttagttctcatgtcaagactgatgatgccaaaaatgcagcaggtgggtgtatttgttgcttacataatgaggctttctggtragagcagaacagattcccaagtagatttgagaatgacttgagaaagcaggaaggggtgactggccttggggttttattgtgattagggaatagatctggg

SEQ ID NO: 38417 - DNA, 201 bp, Bos taurus
gacaagaaaatcaagagcttaggattcgagaagcaaaagattgagggaacacgtgcccccaaccatttcctcttattctaagtaagaacacactctctctmttcaggtttgaagcccaactcttctggctcacttcaggtatacctcactgtatgtaatagtgctagaaggaaagaagttggggacacatgtatttagtta

SEQ ID NO: 38418 - DNA, 201 bp, Bos taurus
tttgtaagaaaaatcactacccatataatttgaaggaacatgaaacttagttatgaaaattctttggcttttgtggtaagtttctaaccaactcaagcaaygtcagatgtattatcatttgggtccagtatacaatgccccttgtttcatttaaagaacccagactgaactatgtgaaacacatcgtctgtcctcagttaa

SEQ ID NO: 38419 - DNA, 201 bp, Bos taurus
gaggtgtgaaattagaagggagacgtggttgtgtttcctccaacagtcctaatgtgtagacaaaggctcagagagggagaagtagatcagttcaaaatatycccagcagtactgcagcagttactccaggagaccagttgtacttcatcacagtaggtttcaacatagagagagaagtgtttacatccaatagaaatatgc

SEQ ID NO: 38420 - DNA, 201 bp, Bos taurus
aaagagcttggtcaacataaaaaagctggaagtccaccttagacagagattatgccaagaatgacaatgaagtccatctggagaagtgggcaggggccagrtgtgtgtggcatgactgggacgtgtgttgtgaactttgggatttgctccgggtgaccattggagggctttggggaagggagcgacatggtcagatgtatt

SEQ ID NO: 38421 - DNA, 201 bp, Bos taurus
tcagtcaatcatgccgtccaaacccaagccatgggcccaagtttcacaataatctgggcatctggttaaaagtgcagaattcccagcctttctctgccaartcaaggtccctaggcatgggcctgtgaatatgcattttaatagatttctcagtgaaaccagattagggtaactggtggcactgtcacctgatattggatt

SEQ ID NO: 38422 - DNA, 201 bp, Bos taurus
agatccttaatttaattacatttgcaaagttctttctgccatgtaatgtgacatattcacaggttctgggcattagcacgtggatctctttggggcctctrttcagcccaccacaggtggaaaccattgtgggaactgtatgagtgcaggaaagcccagcagagattaggaggccgcctgtggtacccactgcctctcgtt

SEQ ID NO: 38423 - DNA, 201 bp, Bos taurus
tttccgtattactattctttttatggaggagggctttccaggaagcatagaactggacaagcctaaggggtggcccctctggaaggaaaggacacttggaytgtacttggagaaaaactcagatcctcatcttggcctgtggacctgcaagactggcttctacagcacctttaaccttacttgttacacctcctgcctcca

SEQ ID NO: 38424 - DNA, 201 bp, Bos taurus
tcagcctctatgcatctgtgtttttcttcacgtaattgatttctaatctcatagtgttgtggtcagaaattccttgggccaggaattttctggtggtccarcgtcttggactcagtgccctttgcgtgccacagtcgatggcaccttgcttctgtagcggcctgtgtttctcctgaaaattttcctggttgtggagctcct

SEQ ID NO: 38425 - DNA, 201 bp, Bos taurus
gaaggttaaatattgcagcagtactgcttgactgagaggtggctcactcatgagttcacgctctgtcttgagatatgtgtacttggttagtcgctcagtcrtatccgactgtctgcagccccatggactgtggcccactaggctcctctgcccatgggattttccaggcaaggatactggagtgggtttccatttcctact

SEQ ID NO: 38426 - DNA, 201 bp, Bos taurus
tgaggctccttgcagcagacaagatagatctttaagagtttaagaaggagaagtcttaaaggtatttcactcagattaggccctgtttgatgatttcacaytcaaaatgaagctacccacaaaaaaaactttgtgttgacaccggagggatggtgaacaccctaccccaacagcatctaccgccttgccggcccaccggtg

SEQ ID NO: 38427 - DNA, 201 bp, Bos taurus
agctgactaagaaggtggctaatgtccgtgtgtgcatgtgtgtgtgcagctgcgtgagtgccatgtatgagtgggcatgctgagaatgttcccagggcctrgggggtgttccctcagtgtgctgaatacaggtccctcctctgaggagcttacaggggtctctgatcatgaccctgagcacattcccagggtgtggccaat

SEQ ID NO: 38428 - DNA, 201 bp, Bos taurus
gcgcaggcagcccgggcagagggctcaccggggagcgtctgttgtcggttccagaccgagcgaagcgcctcggagttcgggccgcgcgggctgggcgggargaaggtgaggggaaacaggacggatcagcgttcttagttcttaacaatttccaaagaaggtgggagtgacaaagggacgccggaggccgccgccgccgcc

SEQ ID NO: 38429 - DNA, 201 bp, Bos taurus
tgttgctggttacccttgttgccatctttgtggctgtcatccttactgctgctccctgaccttgaagtcctactatgtgaacttctaaggttgtggaaccraaaggaacttcaggaaaccatgacctagctcaagcttgataggctgataagcctgtgtgccactgcttttgagaaatcttcttgaagggcactggatcaa

SEQ ID NO: 38430 - DNA, 201 bp, Bos taurus
ggctgctcccgccttccagcacctcctaggtcattgtcaggaaccgccaccgggccaaggtcagcgcaacccttcccaggacaggaggttaggctggcctrggcaccacagggaggctcctttttattgctcacccagccacttgctgaaaaattaatctgcaaatgaatcacatttactgagaccttctggatcagataa

SEQ ID NO: 38431 - DNA, 201 bp, Bos taurus
caggaacagggagctttgaggggcccttaagtgccagagcattggtcccagggcagtccatggagttatcaatggggcaggccagaggcttctcagagtcyggctagatcattcctggatgcagcaggagcagagctcagactgtctcttggaggtgatgtcctggccagcaggagcgagcgtgtagtttcagagaggagc

SEQ ID NO: 38432 - DNA, 201 bp, Bos taurus
gtcatcccacccctgtatatggttctcagatgaccatcctccaaggctatgtaatcagttgcactcagagattagtagctagagagtgcagttcctgttgkctttgcctcccgcttccctcagttcccttggccctcactgctgcttcctgggtttgcatcttctaacaaggataggaggcatatgggcttttgctccaag

SEQ ID NO: 38433 - DNA, 201 bp, Bos taurus
agatccttagtggagatatttctggaaagaatgaatgtcctgagaagttatatacatataaagaagttttctttttttacttaggccaaatggagggctaygcaattatctctattttatagctgaaaaagttgaagcttagaggggtcccatggcctgcaggttagttcagatctgggatgagaaacacagactctgctt

SEQ ID NO: 38434 - DNA, 201 bp, Bos taurus
gaatattttatagcatttaaatatagctacagaagtcaagacagtgctattaacatatgaatagcctaatagatcaatggaacaggagcgagttcagaaayagacccaccatatatatagtcaattaatctttgaaaaaggtgccaatgccaagttaaatcaattctggaaaagatcgtcttttcaacacggtgctggaac

SEQ ID NO: 38435 - DNA, 201 bp, Bos taurus
tgcctggccacaagggtctctaatacaagacaggatcaacattaggtccaagggtgactggcatatgtctattgttgaaaatttggggtgtaaaggcatayaaaagagaagataaagaagaaaaaaacgacttcgatttggaggactataattcttttcctagtctaacaaattcatgtgtgtgagtgtgttgggtttgtg

SEQ ID NO: 38436 - DNA, 201 bp, Bos taurus
tccattattattatttcatatgcagcagtggtccgacagggcagccccaatgtgcagtctcatgcttgattcatatttgctgatgagctgttagccaaagmaagtgacgtggccaagcccagagtcaatgtgggagggcctggaactgggaggtctgactcatccgggccactgatcgaatcatttaccacaaatgtcttt

SEQ ID NO: 38437 - DNA, 201 bp, Bos taurus
gcctcagtcaaatcagaggaaaaaaacaccctgtcagtctggccatcgaccatcatttaagcatctcaaacacctcctcccctcaatgtgcacctcacatyggctccatccaaggacaaaggcccccagagcctctttagagcctggtgtttaatgactgtggctctcaacctggaggagcatgcaccaacattccctgga

SEQ ID NO: 38438 - DNA, 201 bp, Bos taurus
ttccctattaaattaaaatgccatctcccctcccccagctacctttgggcttttatcaaaggtgaaggtctggcgatggggagctggggaaggccgcctgragatcagggtagagctggcgtttgagaaggtcgttcccatcccctgtgcttggagctgggagccaggaacactgcccgcaaccccagtgagccctggttg

SEQ ID NO: 38439 - DNA, 201 bp, Bos taurus
ttggccccaagcacgatctggcagctctgatgacaacagcgctgcctcaaggtcagggtcatgatttcacctccttaagaaaactcagctatggagagtayctcctctcgtaggcctcagaatcatgtgttctttcaggagtgacccagtgtcaggctgtctgctgggcttggggcttcagagctggctagagaacactag

SEQ ID NO: 38440 - DNA, 201 bp, Bos taurus
attcagggaacattacaaagacatcctttccatcaggtttaagggacacaggcccagcacctgggagaagcccctgcacggctggagggtctgggaggacytaagactctgtcacttctaccttcggggaatagcctgggagctaagcagggtgagagagcacagagctgggacctgggggctttcacggaggaggggccg

SEQ ID NO: 38441 - DNA, 201 bp, Bos taurus
ccagggatcgaactgaggtcccacgcgttggggagtgcggagtcttagccactagaacaccggggaagtccctccctaggtttcttttggtgttgtgtttytaacgtattggctttaatgcttaatcaatttatgtttattctgtgttaataatgttggtctttaaagctggtatgtattttaccctgagtccatctttga

SEQ ID NO: 38442 - DNA, 201 bp, Bos taurus
cataggaagttttctaactcccctctttctcatccacctgggataaagcatggactctgtcacctcatgtctctcaggctggggcatattgtgacccagtkttggaaaatatccctaaaaaccaagccctaaatatattctttgatctataaaattgtgactctttgttcttttgaaggtgtttttgttcatgattcatca

SEQ ID NO: 38443 - DNA, 201 bp, Bos taurus
agcagggcccagtgggggagggggaggggcaacacgagcctggcagacccgccacagccctcatgtagcaatggacagcgtggaacagagcaagtggtaaygtcgtggccaggcctgtagttcattttacctctgtcaaggaaaatttagaatagtagctgaactgaagagcacttctttttccttcaaatgatccttttg

SEQ ID NO: 38444 - DNA, 201 bp, Bos taurus
caggagtgtgtcggcaggagtgaactccccgacacccgagcgaaagttacaggcgagacagggcgagtcctatcaactgaggccgccactagaacagaaarttaatgttctaaacagtaaacagctgggcttctcgaaaggaaaaccacttcctgttgggccgctatcttgcctccatcccaaatcccaaaccctctgcac

SEQ ID NO: 38445 - DNA, 201 bp, Bos taurus
gagtggggagcctggcacaggggccctcacgtatccgggctgcagaaaaagagccctttcttctctgtggcggcccctgccagaggccgctccgcaatctkggagctattccaagggctcccagtgttgtcaatgtcagagttaacagggagcctgggccaccatcattatgctggtctttaggctcagctgcagatggaa

SEQ ID NO: 38446 - DNA, 201 bp, Bos taurus
aggacaaataaatgccttcttctctaactggtcaggtatctccaagaaaccctataggttctctttaactcctgcaccttgctcaagcccgaaccaaatcmaagcggggctggctacccctggggcctgtctgtgtaccatccctgatgcaggcatttcccaaggctcagaaagtacctgacagaagcattgcccctactt

SEQ ID NO: 38447 - DNA, 201 bp, Bos taurus
aatttccagggagggagcctcaaatgggactccctgtgccaagtttagagccagcttctccgaggtgccttctgtgaggctgaatcctaaggcccggagcygcacaagtagatgattgtgggttctgaccccgagcaattgcatcggagtctctggaggggtcaatgaggccttggaaagaaaagaacaagttacccagga

SEQ ID NO: 38448 - DNA, 201 bp, Bos taurus
gaggttttaagagcagaagaaatattacagaagagtcagtgaagttgaaggtaaatcaatagaaattatccaacctgaaggacatacgcattgaaaaaaaygaacagtacttcaaggacaggcggggcaacatcaaaatgtctgcgttcgtgctaagttgcttcagtcgtgtctaactcttagcaaccccatggactgtag

SEQ ID NO: 38449 - DNA, 201 bp, Bos taurus
ggtgtgatcccacagaagagtagtaagaaagtttctccagggaaacagcatattgggtatgatcaaaggttgatgatgtcacgtgtgatttctgagcaccrctggggctgatcagcaggcctcccttcacgaggcaacttgccaggctggggcccagccccctaccccggggcacacccgtggctctacttggggccagag

SEQ ID NO: 38450 - DNA, 201 bp, Bos taurus
ttttctccctgtcactggccaagggaatcattctagaagcacacaaatggtcatcttactgtgtcagcctgtggctcccgagacgcctataaatttagaargtacgagggccactcaggacaagagacgtgcagcagtcttcttgcctagatactgcagcagcctgccttgtgtagagttgtttagtatttctttcctttt

SEQ ID NO: 38451 - DNA, 201 bp, Bos taurus
ccacgctctcaggggccacgtcgaacaccagcgcctcgttgtacgtggggttcagcgtgttcttcttgatggaggttttccgcttcttcagacgccgcccytcgctgatcagagaggccttcacataggggtctgggggcgggtgtgaagggagggcgctgaaccgggtcttcggccctcggaccccatcacggaccccag

SEQ ID NO: 38452 - DNA, 201 bp, Bos taurus
gacccagctcctggtgacacatgacctcatcttcagaaactcaggccccagggagacagactacaagacagatgtaactacacaacccaactgacactctraccctggcacgctcttcaaggcccacttaaaccatgtctcctgtgggaagacacccccctcctccacccccagactcagcttcccccagggcctagggtc

SEQ ID NO: 38453 - DNA, 201 bp, Bos taurus
tttccatcttattttttaccccaatagattcctgagttttgtttaccctcatgttgtgaacagtgactttcacctaatggccctcaaaaattcctctggcrtggatattagatgagtaatgatgcgtttactgcctttccaggatttctagtgtccctccagagcccctgggtcaggccacatcacggagactgcaggatc

SEQ ID NO: 38454 - DNA, 201 bp, Bos taurus
ttggggggagatagttctagcagcctgtatccagtaaagaagtgaataggctcagtggtcagcagagcaccactgggcctgggagatgaaggggaagaacsgaagggaagccagctcccaggtgtctgcctgggggagcaggcaggagcaggaactactgatggacttagcctgagtctgccaaatggacatgcctggggc

SEQ ID NO: 38455 - DNA, 201 bp, Bos taurus
gaagttgcagggcacgaggacgcccaggcctgcctgcacggtcagggattcctgcactcggagcctgtaccctggattctcctgcagggattctgcggacrcggaggctgagctgcagctgcaggcccctccccacctgagccgcccctcctccaccggtgacccccctcctcccacgccgctcacccccccacagcaggg

SEQ ID NO: 38456 - DNA, 201 bp, Bos taurus
atgtgactaatgtcagctactcataccccagccctccagagcagaaatagctcttcaccataaatagcattgttaggattaacttctctggtcccactggwcttatatggcccagtgcctcaagtatatcaaaacactcttaccaggaaaatattccagagttcagaggctatgtcccaggagtgaggcaatgctgaagac

SEQ ID NO: 38457 - DNA, 201 bp, Bos taurus
accacatataagtcgtatcatgcactgtttgtctttctgtgtctggcttacttcccttagtgtgatcatcactaggtgggactctcgttggaaagacacarcctaccttccttgctgccaggggagtggggattactgtctactggtcacatggtccctacccgcaccgacactttctttttttagagtcacaggcctctt

SEQ ID NO: 38458 - DNA, 201 bp, Bos taurus
tagcaggtactgtgcatgttaataccttacgtctagcgtgcagcttccttatcctggttgacagaaggcagacaaggaatcgagatggaccctaagcaatygctgctgcccaacagcactgaaactccatctccaacccgtgggtgagaagccctgcccaggacagcgcccaggggagcctcctcacaagggccaggtcac

SEQ ID NO: 38459 - DNA, 201 bp, Bos taurus
gctttaagataaaagcttgtatttgcatgggccgcttacatctgaaactgatatttcctcctaacaagctgaaaacaatttcaataaaagcaatagaactrttcttttctattaatgtgctgtgcttagttactcagttctgtcccactctttgagaccccatggactatagcctgccaggctcctctgtccatggggatt

SEQ ID NO: 38460 - DNA, 201 bp, Bos taurus
tattcttgggaaattcatagtggattgaaatttgcacatcataagagtggcaaaaccttgccattacataatctgtactaggccgaaactctagaaatatrttgaatgtctcaaagtctccagtccacaaagtctccaaccttaacatgaactgaagtttcatgttggagagaaacctgacaaatattatgatgagtttca

SEQ ID NO: 38461 - DNA, 201 bp, Bos taurus
actgaaggtgcccacatatttgggagcttttctcttaagctctgcccacctggagtcactgggaatgatgatcacctgaaaggcactcaagaggaagatgrtgccaatggacacatctctgccgactcttggaacatgaaaagcaagtgtgcatccaaggctgccagtgtttcaggaattcctttcaaatgaacaactaag

SEQ ID NO: 38462 - DNA, 201 bp, Bos taurus
catgaatgatttaagagacagaatggggcaggtgatacattcctatgacagtagcagacacaaacccaagttcctgaaaaccatttccactgaagcaaatmttccacaaccatgtgatgaaggatgagttcctcactgttccttggacctctcatctgattcatcatctccaaccattcatacctacctgggtaaatggct

SEQ ID NO: 38463 - DNA, 201 bp, Bos taurus
tcagaggccagtagtggaagaaacaacaattttgcgaaacaggagaaacacaaataacaaagctggtagaattcgtaagatcataagtgagaattaagccragaacttccattagatgtggcccaggtagatttcaggtcgtctgactcaatccattctgtatcagtccttatctctcagagaaattatttattggcaccg

SEQ ID NO: 38464 - DNA, 201 bp, Bos taurus
cttccagaaagggctgacaggtatgtactgagccagatggaggtggaacaagatgagactggaaatgtagacagggccagacggccccgggactttgtagkttaggtcaagagtttagattttttttttttttgatatttaaaaatgtattttaaaatatttatggaaaaggaatcttagaaagtgaattttttctcctgt

SEQ ID NO: 38465 - DNA, 201 bp, Bos taurus
tcgccgttaagatgcatttctcacactgcacttctttttccgcttagataaaaatgcaaatttcttagcgtggcttgccctggccctcttctcgggctaakctccttttttttaaaaatatttttgttgtagttgatttaccatgttgtgtcagtttctatgttgtagccacgcgttccgggaaacaaactcgctcagaag

SEQ ID NO: 38466 - DNA, 201 bp, Bos taurus
cacgaggctcccctgtccctgggattctccaggcaagaacactggagtgggttgccatttccttctccaatgcatgaaagtgaaaagtgaaagacactggygattggcttatgccccaaacagccatcccaccagggtgcccttctggaccccaaagcttcccagggaccaccagttcaggaccacccccaccccggagct

SEQ ID NO: 38467 - DNA, 201 bp, Bos taurus
ggcccccgccctcctcactctccaggctgtggccacctggacccaccctttggaaacacagatccccaccttgtcaccaacccccagctccttgtggcccygaggagggatcccaaatgtgagtgcctataggcacttcatgatgatgtgagtgaggaaggtggaggggtttcgaggagaaacaccaggaccagcgaggtg

SEQ ID NO: 38468 - DNA, 201 bp, Bos taurus
ggggtgagtgtggccaccgaagggcagaccccaggatggccccctcttagggaactcatgcccaccgcaacagggagcatcccttcagggagctgaccagkactcctcccgatggggccctcagaacgtcaagagctctgtgatcgcccaaggaaccggagctctagcccagagagtgggagaggcttgcctgaggttaca

SEQ ID NO: 38469 - DNA, 201 bp, Bos taurus
ccaaaggcctgtagaccccacgcctgtcaccctagcagtggtgctgagagctgggctagaggtttgggggcatttctgttaggtgtttgtgcgtgagagcrgggccagctctgggcagtatggagtccatctccaacccccagtcggtgtctaaaggggacaggccagagagggtgccacacccctagcctgcatgaccca

SEQ ID NO: 38470 - DNA, 201 bp, Bos taurus
tgagtggccctggagggttttgagcaggacggctggaacttacgtatattagaaaggacgctctctggctgaaggagaggtggagggggacgggtggatgytgggagaggagtgggacaggccgttgccatggtgaccgaggcacagggtgatggtggcttggaccagaggggtggggatgggagtacggaggagtagggc

SEQ ID NO: 38471 - DNA, 201 bp, Bos taurus
tgctggccgcgaagggaaccagcctcgcggaggctttaacccgttcccttccgtcttaaagggaccgacacccaagccttcttccccagactcgagggccragcacagaagggttgggtgtttgcggagaggcacccctccctccctctcgtcttcgcctgtcccttacttttctccttcatatacattcaaaggttgggg

SEQ ID NO: 38472 - DNA, 201 bp, Bos taurus
agagcacttttcctgaaaccgacgagaggaagcatgctggcccctccccagatggcgcagggggtggctggtgagggtgttgtcgccccagtggcctgggygtcctcagtggcttctgcttggtttgtcctcttgtgagtgatgaaggtgacaaaacacaggaagatgccgggctaagggccgtatcagtagtgaaagggg

SEQ ID NO: 38473 - DNA, 201 bp, Bos taurus
gccaggaaggctccctctgaccccaacgattccagacgtgaggccgagacccagcccgacctcagaccttagagttcatgtccagttgcagccctgggccrcagaacccagacttgcgacccaggctcagtcctaggatgccaggcttcatctcagccctggggctcacccgctcacctctccaactcctgaaagaagcca

SEQ ID NO: 38474 - DNA, 201 bp, Bos taurus
attcgagaaggttggtcaagggtcacagccaggccccaggcggtcttatcaataaagggaataaaaacacgggaatacaaacccaaggttcactcctgccygcctcggccatctgccaactgaaccccggctgaagctggaagacacagacctgtgggtgtcgggccagcctggggtctgtgtgcagaagggtagagagca

SEQ ID NO: 38475 - DNA, 201 bp, Bos taurus
cctacgtcttccttctccgcgccagagacctccaggggtccagggagaccagctttgcggagctcatctccaaggagtggccggacgccccggtcccggtrgagaaggtcctgtcccagcccgaaaggctcttgattgtggtagatggactcgaagagctggagctcaccttcagagaccaggactccagcctcctggccg

SEQ ID NO: 38476 - DNA, 201 bp, Bos taurus
tgtaaggcatgtggaaaggcctttagcggtaccacacaacttaatgaacaccaaagaatccacagtggtgggaagtcatataaatgtaatgaatatggaamggcctttggccatcgttcacatcttcctcaacatcagaggatccaaactggtgagaaaccctaaaaatgtaatgaatgtgggaaggcctttaggcagggc

SEQ ID NO: 38477 - DNA, 201 bp, Bos taurus
tctgtgtcgcagctgctcctcttttgcatgaaagcatcccagacggtacctaaggatgactgtggctgtatcaacacacccttatttacacaaacaggctyggggctggatggccatagtctgcccacctctgacctggagaattttctgtaccagctcctgcagtacataaagtcaagctgctctctcacaaaagggcag

SEQ ID NO: 38478 - DNA, 201 bp, Bos taurus
cccgcggcccctctctgtggcgtcagacggccaccttctcccagtaacctcgcacggtcttcaccgcgcgtgtccagactctgtcctcttatgagggtgcygatggttggattagggcccgccctaatgactgcaccttactttaactatctgcagactgaaaagactaaatctagactatctgaagactgagaagcctat

SEQ ID NO: 38479 - DNA, 201 bp, Bos taurus
tttctgttaatgaccaccgtgggcgtgcagttgttggcaaggctgtgcttgtcgctgctctgcggcggtgagtcagcgtatgcatgcgtgtacgtttacaygcaggccctctgttttggatttgcctcccattgaggtcgccagggagcactgagcagagctccccgtgctctgcagtctgctcatgttagtcacctgtgt

SEQ ID NO: 38480 - DNA, 201 bp, Bos taurus
cattgtggtgttggggaggccagggtcagagccagactctggtgtttagtccctgctttgcaccttaaaaactgtgtggtcctgggcagttacagactgcrtctgggcctcggggtgcgtctgggcctcggggtgctccttggtaaaccggagtaaggtggagtttacttcccggggctgcaacagggctaagtgggtaac

SEQ ID NO: 38481 - DNA, 201 bp, Bos taurus
aacattatcttgctgctcttcagtcacagggagccagaagcctgagggtcattctgtgaactccaacacctgtgatggaacacagtgaaaagactccaaaracaggaagacggagatattaggcagccttgaatcatgtggccaagatgctgtctctctctccctcagaaaacacattttccctgcctctatactcactga

SEQ ID NO: 38482 - DNA, 201 bp, Bos taurus
tcccacattccccacactcataaggcctttcagtagtgtgaactcgctggtgtcgaatgagagtggctctttggctaaaggatttcccacactggacacaracataaggccttgctgtggtgtgaattctccgatgttgaaccaaggtgaagctttgtctaaagaatttcccacattcgctgcattcataaggcttttctc

SEQ ID NO: 38483 - DNA, 201 bp, Bos taurus
cacagtaaggttaatgggaagagctgaaatgcaagagagagaataaaagaagacaaagaagcttaccaggaccaggagggtacgtgtggctctggcctcgytggaaggtctgggggaaagtctgctgctgtgaatgtgctaagctcattgcttgtgcctgatcaggacaatgaccatggagccaccagtccatacaaagag

SEQ ID NO: 38484 - DNA, 201 bp, Bos taurus
ccctcctgggacaccaccaactccagatgtctctgggagtctgtggtggccccattccagactctgtaccccacctggctcacctcctttctcatcatccsctctgagaggggaggggggccagggaggaaaagtcctcatcaagctccatgtggaagaggggagcaggaagagtttcagtggactaacccttgtagggtt

SEQ ID NO: 38485 - DNA, 201 bp, Bos taurus
ggcaggtagaaactggtttgaggggtatacacaaagtatcagaatattgacatttacttattaaatacgtaaaatttaagtctactgcacaaccataaaaygagttttaaaatatgcaaaacctgtcgccatatgatcattcaactatggtagcattcttaaaagttatttttggctactgaacctgtaagaggggaaagt

SEQ ID NO: 38486 - DNA, 201 bp, Bos taurus
ctacaaagttgttttagggcaaaatgtcatggcctggaagccactcagaagacagggagtgctgagagaaacccctctggccactctgtgaaaatagaagraaagtttacatccatcatcatcaagtaattatttccatccaaaagctgtcatcatctgggggacctctctgaaaaagagatccaagttgttgcctaaggc

SEQ ID NO: 38487 - DNA, 201 bp, Bos taurus
ataaccaacgtttttcctatttttaaaaagcatatattcttggtcttgtggctttttctctcctcaacttctggcttactttttcctcttaatttcatttytttatacttttcttccagttcttcattccgtatagcatatgttacttactatgacttttgtgaggcttccattcttcttccgtgtctagttatttccccc

SEQ ID NO: 38488 - DNA, 201 bp, Bos taurus
gggaatgtatatgttagccaaaaagtttgtctgggttttctgtaagatattacagcaaaaccccaatgaactttttgccaacctgataagactggtacagycactttgggaaacagtatggaggttccttacaacatgatccagcaatcccactcctgggcaagtacctggagaaaaccactgttctaaaggatacacgta

SEQ ID NO: 38489 - DNA, 201 bp, Bos taurus
gcaggcaggttcctccgcctgtcaccctgccatgctccatcacactgtcagacacagggccccacccacgaccgcctcagccgcctggaccccggggccgsgcttcaggcacgtgagcaggcgccacgcacttcgggctttagtgtctggtgggatgagaatggtaagggcccaggggaccagcgtttacctgaggcggat

SEQ ID NO: 38490 - DNA, 201 bp, Bos taurus
gagcaaggccttataagtgcaatgaatgtgggaaatcttttcttactaactcccatctccatcgtcatcagagagttcacactgaagaaaggccttatgcrtgtggtgagtgtggaaaatcttttgccagtagcactagtctccgtcttcatgaaggcactcacactgaaaggcctattgagtgcagtgaatgtgggaaat

SEQ ID NO: 38491 - DNA, 201 bp, Bos taurus
tgcagctcttggctgttttgactcatccacaacctcgaagggaccttgaaggactgagaaagctgggcagacccccaagatgccacttgggccttaaccartgtgcttctgtcagaaagggggacactgaaagggggatgtcttgagagccctcctgggggacacccaaggggtaaccccggccaaccccagttctttgtg

SEQ ID NO: 38492 - DNA, 201 bp, Bos taurus
tcgtggccccaaaagctgagtccccccagaacacataaaacagggccgttgtctggggaaacgtctctgtagatgtagttaaggatctcaaggtgaggtcrtctccggttaaggtggccctcaatccaactgaccagttccttatgagacaaatgaggaaagacagaggagaagccacgtgaagacagaggcagagacggg

SEQ ID NO: 38493 - DNA, 201 bp, Bos taurus
acactttcgttgcagtggcccaacttaaatccatatatctgagtcactttgctgtgcagcagaaattagtgtaatattgtaaatccaatataactcttgcrtcttgagtattggcctttgcagcagtgagcagctgaacttgggtttggtaccagccttgtccagttacactaaattcttttagtaaaaattttcattgcc

SEQ ID NO: 38494 - DNA, 201 bp, Bos taurus
agccaccatgataggaagcccatgcactgcaactagaggaaagctcgcacagcaatgaaaacccagcacagccagaaacaatttttttaagcaaagatgtygtcatgagtgagtttatgctaagttgcttcagtcgtgactgactctgtgaccccatagactgtagcttgccaggctcctttctccatgggattttccaga

SEQ ID NO: 38495 - DNA, 201 bp, Bos taurus
gacagctctgtgtccttggtggcttctctctcaggtcctttcttggggacagtgagaatatatttctgcccttcaataacatggggcagaaaagtgctcgytttatatacatgatctctagtgatgctcatttctacaggatgtcccatggagagggactctttccatatcttgggacgtgtaaacctggatcagcaagag

SEQ ID NO: 38496 - DNA, 201 bp, Bos taurus
actgaaagtgatgatgagtgtcagttgcagggtgtacacaatgagaatgaggcactcctgatgaaagggacatggactggagaaatggccaggaggtgagkgatgatggagatggagaggtggtagggaaatcaggtgggcttgcaggtttctgaggtggttgatagggccaggaactgagggaagaaacacaggaaaggg

SEQ ID NO: 38497 - DNA, 201 bp, Bos taurus
aggaagtactattgtgctcttgcctgtctcagggccctactgtgctaggataagcccatttttaccctgtttcatcatatcgtttccttcccaaggtcttkcaagggtctcggtggcccatggggatgcttttccagtggtcctatgctgacagtcgatgtagccacagaatgaacaaaatgcatcttcctgaaacaacat

SEQ ID NO: 38498 - DNA, 201 bp, Bos taurus
gtccctttgaggaaattttggttctcatttgggattgttcatttcaaaaaggagatcccgtctgtaaggctctgcttggactaaggtcacaggcttagtgrgacttggaagcagccactctgagctttgtgctgtctgttgttttctggaataaggcttccgtctgctggcaaattttgttttgttttcagtccactagtg

SEQ ID NO: 38499 - DNA, 201 bp, Bos taurus
attggcaggtggattcttaaccactggaccacagggaagtccaatatgtatttcaaactgtgataagaacatatttatccctgatggtccagcggttagcrcttggtattttcactgccatgccctgggttcaacccctggtcagagaactaagattctgcaagatgcaaggtatgatcaaaaaaaaaaacaaccatactt

SEQ ID NO: 38500 - DNA, 201 bp, Bos taurus
aacttgaggaagtgattcacagggaagggcaagggccacctagatgaataccttcgaggataacaacggaagaccatggggcgacagttaccgttccagcractgggccgctgctgatacactggctccacaatgccagctgcatctttgaactttagggctctttaaggaaatggcacctgttcatcttccaaatcctct

SEQ ID NO: 38501 - DNA, 201 bp, Bos taurus
atgacctcatttttataaccttccttattataaattatccctccatcacagcagggaccagcatggctttttacaaccatttagcggcagcgtactcctcygaggcccaagtcaccatggaaacttccccagtatacagttctagagacatccgtgtacaccaaatgggcaaccaacattttcaagaatgactgccctcag

SEQ ID NO: 38502 - DNA, 201 bp, Bos taurus
ctcgctccagcccagggtcttcaaaacaaagccatggagaaagaaaaaccagtctgtcaggaccttttggaagtcacatttcaggccaaagcaagctcccraggagtctgtgtgccccataccctccactaggaaagctgaaaagtaggaagggacagacaaggccttgcatatcaaggtcccagaggggagcggtcccca

SEQ ID NO: 38503 - DNA, 201 bp, Bos taurus
tacttcagtaagtggaagcaccagttactataatgatgggagtaggaataacaatgcaataatttttagttttattgaatattcgctatttcattgaatcyaatgccattagttatgatgtgtattttaaaaattaattcattttaaggatggatatttttaatgtactgtttaacgcacttaaaaatcacttaggttctt

SEQ ID NO: 38504 - DNA, 201 bp, Bos taurus
agaagagtccagtcacgggagggagaatgctacagaggctagctttgcaatcctccagcactctgctgcagcagcaggccaggagagcagagaagctgctyggagcctgtgtaaactcagctctgtgggtcagtttatcttggctattgtgttgtctgaagagattttttgttgggagcctgggccttggggcctggcaga

SEQ ID NO: 38505 - DNA, 201 bp, Bos taurus
gagggccaactccttaatgcaggtggtagatggcattgatgtcaacctagctgatgctaatttaggaaaacaaccctgagataaagagttacagcaagaaractctgtaatgagcctgctggcctagctggaatgatgagttttgatctattgcaggtcagagctatttggcttctggagcttcggggacaggcctgtggg

SEQ ID NO: 38506 - DNA, 201 bp, Bos taurus
cttataatcttatctggctaaccataaatcaaattatgaagcatttcgatgctatacatggtatcctcataaaatatatgagactagtagttggcaaattkgatttctaggttctttcaaaccaattacagagaaaatagagctagaccttttcctgaggcaaaacgctttaagtctctgagttctagtttccatcctgct

SEQ ID NO: 38507 - DNA, 201 bp, Bos taurus
tttaactgtcactggagggccctaacaggcccagggattctcaagtaggacctcgctctgaaactcgctgacagccaaggcgcagtcatccatgaccaccrgagggtgccagatcgtcagcatagggagcgggcccaggcaatttggctgacctcggagactattcttggagaatgaactgagagaaggaaagagggccga

SEQ ID NO: 38508 - DNA, 201 bp, Bos taurus
agtgaatttctctttactttccttgctgtcttactccctgaaaactatttcccacccccgaggccccagctatttccttttggtatgtggtttcacatatkctttgctacaggttgaaccatatgagattacaactattcaactatttttgacctctgaaaatgcagtttcatgtggttgaagctaatagaaacacacaca

SEQ ID NO: 38509 - DNA, 201 bp, Bos taurus
taaaattaacatccatttggtgaatgttgttgttaactagaattgtacagatcaagactgttttacaatagaggagtcatttgtggtcagtggggcataamatgtggttttagatgccaacgtgtaatgaaatgaaatttatgtcactcttttttgctttcttttctgtggactaatcatgaatctactatgtcactgaag

SEQ ID NO: 38510 - DNA, 201 bp, Bos taurus
atggcaacccactccagtattcttgcctgggaaagccctgggctacagtccgtggggtctcaaagagtcggacacaactgagtgactaagcacgcacaatrcaaaaacacaaagggcatgtttgaggagcagcataactgcagtggtagaaaatgaagcttcgtagaaaggtacagtttgggaacagccttgtaaaccctg

SEQ ID NO: 38511 - DNA, 201 bp, Bos taurus
cggcagccgcggccgcggccgcagcgctggtggctggcagagccgaggccgccgctgcagcggccgccatgtaggtgtagggataggggaagaggcctccraaagtgggcatggggattccctgaaagaaacaaaacaagacaagggttaggcatcccgcctggggtgttcctgggggtgatctgggtgctggtggccggg

SEQ ID NO: 38512 - DNA, 201 bp, Bos taurus
gttgatgtcattccatttcttctgaaggagtaagactacgctccactctcaccccagggttttttctcctttcttccacccagggccaagaccctggctcygagaaggctgtgggcagctaggactctggctcacttccaccatctctaggggtgtgggtccagcttggcctgggacagactggagagaggatgctttcag

SEQ ID NO: 38513 - DNA, 201 bp, Bos taurus
ctcacaataataatgccactaataatagctattaggaaactgaatctctttttaaaaagacagctttatcgagctttacctgacacattatacaaaccatycttttgaagtgtataaatcaatgtgcatcaagtcttctaatacataatttaacattatccagcaccctttaagggctgtgacgacgtaaggttctagggt

SEQ ID NO: 38514 - DNA, 201 bp, Bos taurus
attgaatccatatattgtatttacgttctctgtcaaggttgcttttccacatttgagagatcaaaggccaaaacagtcatcaaccctgtagccttcaataytgtgttcattacatttaatcaagtgccaactccatggtatcattcaccaaccttaacaatatttaaatgcatggcattgtttagcaacaaatgtaggcac

SEQ ID NO: 38515 - DNA, 201 bp, Bos taurus
ggccacctgatgcaaagagccgattcactggaaaagatctgactcactggaaaagatactaatgctgggaaagactgaatgcaaaagaagaagagagtgtsggaggaagagaaggttagaaagcaccactaactcaatggacaagaatttgagcaaagtctgggagacagcattggacagaggagcctggcttgctacagc

SEQ ID NO: 38516 - DNA, 201 bp, Bos taurus
cagtgagcatttgtttggaggaagtgtagggaatgagagaacattcacaggttccagcatttattgaactcttactatatcccaggccacgctgggctctkacatcatctgtctccagttcacaacgacctcaaaaggtaggtactcttattacctccttcttcagaaaaaggtgcccctcacaggtggccacaaagggag

SEQ ID NO: 38517 - DNA, 201 bp, Bos taurus
ctggaggtattagccatgggtcaagttcggaggtcagaggtcaaacaggttgtcatcagtttctcacagctatcagagcaagggcaggggaggggccaaayaaaacccaccaacaacacagctggttcttattagccaaatcctgcctccctgtaaagagagatgggtcagtcaggtccacacccaccccagggacacccc

SEQ ID NO: 38518 - DNA, 201 bp, Bos taurus
tttataaattatatttatttttaagtaggcattgcattcacatggctcaaaattcaaaagacactaatgacgctatagaaaaaatcgtcctttccaccccrtacccctgccacccagttccctgtcccataggcaaccagtattgtcagcgaaattccccccttgttaattacttagttgccttaggtgacaaatccgtga

SEQ ID NO: 38519 - DNA, 201 bp, Bos taurus
agtttgcacatgtgagttgctttgaatgtttgttatgcttggactgcacctgactttagtgtgaattctttggtaatttttaatgagctttcatgtaataytgattattttgcttggcgttgagtctcagatctaccaggttctgtttttcttgaggctgttgagtaaatctgcctccggctaaatccaaaatgctgctat

SEQ ID NO: 38520 - DNA, 201 bp, Bos taurus
ttttactcacactacaacagatcacatttatataaaattagaaagaagggaataaacatacgaaaacataaaatcaagactcactttaaagggagcagaayatcaagaactctgttggggctctcatcaactttttttttttttttaaagaaatgctctgcactgatgtggtataatgtaaacatatgcatatataggttt

SEQ ID NO: 38521 - DNA, 201 bp, Bos taurus
aaatggtggacaaatgctcctccctgaagtgtttttttttttttacactgggtgttcatgttttattttgagagagagggaggggaggggaggaagacackgggaatgctcacattgctactaacatttttaaaactaacattttggaatagtgtttatgaaaatcttgaactggcttttaaacagtttcaagtttcaaca

SEQ ID NO: 38522 - DNA, 201 bp, Bos taurus
tttagttggaggaggcagaaggccatggaatagtgccaagacataccgtgggacgtggtcatcattaaaaaaaacattaaatgcgcacagaagatggcaaktacaactggagccttcgggccacacaagggagagggcagcacccaggagaacctcctatgcatatcaccccatatacagtgaccctatacagccaacatt

SEQ ID NO: 38523 - DNA, 201 bp, Bos taurus
tggcctaaaacaacacagatgtattctcttacctttctggaggtcagaagtctgaaatgggtctctaccgggttgaaatcaaggaatctgccttccttttytggaggctcgaagggaagatccattttcttgtcttttttttgacttctagaggttgtgccacattccttatctgtagccagcaatggacagtcaaatctt

SEQ ID NO: 38524 - DNA, 201 bp, Bos taurus
tgttctggcctggagaattccatggacagaatactccatggggtcacagagagtcacacacgactgagccaacgttcactcactcactcaagcaatcagtyataaacccagactcactggccttgcaggagggtggactcagcttagagaagcaaatcaactgagttcctcagcaggatttccttgcgagtctacagacta

SEQ ID NO: 38525 - DNA, 201 bp, Bos taurus
ggtttacaggacctgaggggggtcctgagggtggtgaacatctccaaggaagttcaggaggggctgtgtgtccatagatggcctcttccagagatggactygattccacctggctgtcccaagagttggctcactacggggagaggggaagggtgctctgggatgcctcctgcaggcctcagaccctccttcttctgggag

SEQ ID NO: 38526 - DNA, 201 bp, Bos taurus
tctagggcctgagtctctgaaatctgccacacagaaggcaggaaaggtcaaggcaggcctgagtcattaccgtttttttgtgtgctttctgcctaataacraaataacacctgaaatatctagcaatgcctaatatatccagcacagtgccgaacagctagtggaaaatcactgacaacttccctcgcctgccccatgtct

SEQ ID NO: 38527 - DNA, 201 bp, Bos taurus
gatagcaacagcaactactaaaataactgagtagactattacaggcatagaatatttgccttgaatttatccctcatggagtgggcagagttgcaggttgycgatcgatggtgctctgatagtggagtaggtaggggcatactttccagtgtatgggctggtgtgtcttaatttggggtttcctgtactgcctaaagagga

SEQ ID NO: 38528 - DNA, 201 bp, Bos taurus
acttccagggaacagcgaggagagataagaaggcttcaatgaacaatgcgatcagaggaaaacaaaagaatggttaggactagcgatctcttcaagaaaaytggagattcaggggaacttacaattatgtccacgtcacctcggggagggaagaacaggcataggagaaagcactgttctacttttaacttctattattta

SEQ ID NO: 38529 - DNA, 201 bp, Bos taurus
ttctttcttgtcaagtgaacacacaggggaagcaaggacttcatcttttgttttctttgtctagcaccactgccagttctagcctgtcagggcaaattcartaataattaatagctgttgatgagccagttgttctagaatccatttttttttttaataagctgaccaataaatgagacttgccataaatttaaggattct

SEQ ID NO: 38530 - DNA, 201 bp, Bos taurus
cctgtgtctcctgcttgacaggcagattctttaccactgagcctcacctggaagcccagctaaaagcaacagagcacagttacaactgaaacagcagtggrtaacagcagggagacaagttctagccccactgccgatgctgtgtggcctagggagccctgtttcttccctgggcctcagctctctgtcagtgcaggaagg

SEQ ID NO: 38531 - DNA, 201 bp, Bos taurus
aaagccccctggcagcaatatagacccagcacagccaaaaacaaatacgtgcatgttaaaaaaaataaatattaagcttgattagagctccaaggaacccyttaatgatctttgactcagatgccagatacagttgaatgaagtgtgaaagctggcagttgcctgaccttggagaagtgggagctgccaccaaggagaagg

SEQ ID NO: 38532 - DNA, 201 bp, Bos taurus
gttcatggaattctgtaatctactgggttgcctaatagatttgggtgtttccataacatcttatgggaaaagctgaacaaaatttttagccagcccaatcrttggtggcttatagatcagtgtcttcccttacacggtgaatcctggaccatgtgtttctctttcctgtctgtccaacatacaccagggcctgcctcagtg

SEQ ID NO: 38533 - DNA, 201 bp, Bos taurus
ctccccaggacctaacgcagggcctagaacctacatagtgtccattgttcgttgcatgaatgagtccaaactcaaatcctggtgttcagacaagaaaaccraggctcatagaggggccgtgatttcccagggtcacacagcaagctggtagggaagctgagtgccttctgggctactgcctctctcactgaatcttctctg

SEQ ID NO: 38534 - DNA, 201 bp, Bos taurus
ccccctgattgaaatgtgtccctgtcgcactgaggccagctctggtggggagagggtgggagacttctggtcccccgtgcctggcctgtaggctccttccrtctgcggaagatagatgacgttattccaagccaagatgatgcaaccaaggtcagagtgaagtgtttaattggaatgtcaggggccggggcctggctctgc

SEQ ID NO: 38535 - DNA, 201 bp, Bos taurus
tgcaggccacaactgagacctgaagcagccatttaatattttaatatgcatattgaaaataagagaaaagagccaaggtaagggaagaggtgactgagacrggacaatggcccaagccacctgcctacaaacgtttcctgaagtcctagtgagtgccagagccccagagagacagtaatgagccgtgggaagctggagtgc

SEQ ID NO: 38536 - DNA, 201 bp, Bos taurus
cttgcgagataaatgcctaattgataacaatctgggagcccatagcttgaggatctatgggcatatagagtctgtaggcctcacaaagtctcttgtaaaayttggaaggtgactcgtttcccttctgaactattccagccagtttagacatggccgttggcctccgctccccttttaagtccttgtataatcgctgtcccg

SEQ ID NO: 38537 - DNA, 201 bp, Bos taurus
cctcatttccagtctcctctcatgatggcctgacccctgctatttctctcccgcatatacactcccatctcttcctgcagcggttccatgcacattgcagygtttggccagcctcacaggatgcttgctgcctgccagctcttataccacaggctgttgttgctccttcagacaggattctgcctgcttctgatgaaatcc

SEQ ID NO: 38538 - DNA, 201 bp, Bos taurus
tgagcaacgcgatagccttgagtacacgtgggacagagcgggatctaggatctgggcttagtctcctctcggggggccttctctctgagcagtgctgcccrtcccagggtctcctgcagcaagaacgaagtgctgcccatcggaagccccagaggcccctcgctggccagcttggtatggcttctattcagcaaaagacat

SEQ ID NO: 38539 - DNA, 201 bp, Bos taurus
gtggggggagtctgtgcacaccccacactgcttgacttgtgggcaatgactaaaggatcaggaaggtgagagggaggaggccccttccatcactggggctraaaccaaggctgagcagagatcatcacccagcatgcctccccgtaagccctgagcgaggttgatatccagggaggccaggccagctctctattgttgatt

SEQ ID NO: 38540 - DNA, 201 bp, Bos taurus
ggggagcaagtggaagatgattctgaaagcacttagcgccacggtagcatatggtataagcacatgatgaatgttggttaacagcattatctcacatcccrggtattggatagacttcagctgcaatagaagacactggcaaggcttgtgaggaaatgcagatgacatgcacagtttgagtgtttaccccagcatcatttg

SEQ ID NO: 38541 - DNA, 201 bp, Bos taurus
tgtgggatgtgtacattggtacagaaaggtggcaatttcactcctaggtatttacctgagaaagatctttatacgtgtaccaaaaggaatgcacaaagcayttctatatgtaatggccccaaactggagacggcctagaagttcatcagcattggaatggataaatcaattattatgtaattatacattggagcactatac

SEQ ID NO: 38542 - DNA, 201 bp, Bos taurus
agcccggctcctcatctacgtagctgctctctgttcccacacccctgtgcttccctgtgtaatgacatccaccatgctggactataatggccaacctaccygtccattctccccatagactgtgagcctagccctggctgtggcacttcacgagcactcaatatggtttctgtgcagtcgcttattcaatgaactgatgtc

SEQ ID NO: 38543 - DNA, 201 bp, Bos taurus
ttttcatttttctgaaggatgaatttaagtgccagtgtagagtgaaatataccctctgaataaccacatcgtgtaagaggttggccttcagggagctgccygctctcagcaggtgataacctgattctcccaggtatcggtctcttcatccagcaatacttccaggggccctgtagataagcagggcaccacgctgagtga

SEQ ID NO: 38544 - DNA, 201 bp, Bos taurus
ggtttggtggggcagaggtttttctgggaagaccaatccagcctctattctgccctgaccagcctatgtgactttggcctctgcagcttcctctgtgaaaygagagcaggagccaaatgactaatgggacttagctgcaaagttctccatccaagtgagcagtcaggggaaaataggacttaactactgcagatggcccat

SEQ ID NO: 38545 - DNA, 201 bp, Bos taurus
tctattttactgatgagaaaaccatggcagagaaagtaatttgctccaggtcaaacagccagtaagtggcagagcctaggtagaaacccaggccatctggmtttggagcacctcctctcagccacaaagtcacggctgtgaaatgcaacaggtgagcacctctccaacagaacttccattgtgttcagctgagctcctgca

SEQ ID NO: 38546 - DNA, 201 bp, Bos taurus
tcatcaacgggaaagtcttatatgtgatcttaaaaaaataaaaacagtatactacaggtatagtatgtgcctgataaaagaaattttagccctgtgctgargacaaggcctggctttaaaaaaaaaaaatcttgagttaaattgtcacgtaccatccttatgttgtatctgaatacaaattacagatagagctgtaagagg

SEQ ID NO: 38547 - DNA, 201 bp, Bos taurus
tattgacatctcacagtccacctagaattgatttttgtgtatgtgcaaggcaacagctcagggtttatttttttcccatataaacaattggcccaacatcrcatattgaaaagaccatctttccccacttgctcttcagcactacatttgttataaatcagagtggccatatgtctctttctagtttctctactccgttct

SEQ ID NO: 38548 - DNA, 201 bp, Bos taurus
cctaggaaactactgtttcgtgggtccgattgtgtaggtcacatgacgctgaggtgaggtttctttgtctctggtgtttgtaccagtggtttcccaggccrgtttgctttgcagaggtgatgaaagtggctgacctgacttttggtttgtatctcatgctcagcagtgactacctgctggtagtaagcttttctgcccact

SEQ ID NO: 38549 - DNA, 201 bp, Bos taurus
agtagaactggtcagattgcctacaaaatttaaatctctgatctttgttttcttgcccaagtattgaggaaatattttgtgatttcagcctgtcacatatytaacctaggatgaagatatcaataacttaaaggtaaatactaataaaaattctttaaacatagaaaatcaatagtttatcttctccatggctaaacaacc

SEQ ID NO: 38550 - DNA, 201 bp, Bos taurus
gctcaggtcaggagcagagataggaaagcccagaaagtcagatttgtttcttagcagacttcactttctgaactaagtggaaacatttcaaaaaacttaamattatatggccctcacactgacccagagaattgctggtgggagccctgatgaaaataccagcttctctggtgaaaatcatcacctgagaacacataagag

SEQ ID NO: 38551 - DNA, 201 bp, Bos taurus
tggcatctggaatcttcccagagcagagagagagccatggcctctgcactggcaggcaattcttaaccagtggaccaccaaggaagtctccatctcttatmtctgttctcggcccctctgaggggctcctaagaatcccaaattgctccttcaagtagttttgttattgcctgtttccttctctttcttcttctctggacc

SEQ ID NO: 38552 - DNA, 201 bp, Bos taurus
cttggtacagtcatgaaggccctggtgtcagatgggctagtcccagctctgcctctatcagcctcaagtttttcatctatatggtgcggataatgcaataygatctcctagagttgttgagagaacgaaaattaacgcacacaagcgtttaacacagggcctgatacaaagtaaagctcaacaaatatcagtagctacaag

SEQ ID NO: 38553 - DNA, 201 bp, Bos taurus
gctgtatctgctacagcctctgcttagcgagggctccctgccaagcacgttgcatggtaggaaatatgactcctattttaaagctaaggaaactgaggccyggatgaaagcaaatcccatccttaaggctgtactgggactcgaccctgggtgtgcccagtcctagacttgtattctgctgtcctggtgtgaatcaaacca

SEQ ID NO: 38554 - DNA, 201 bp, Bos taurus
aagtatttctatattatatgctaatataggaagtcaggcattgttatagcagttacaaattacataattttatacaaggctagtctttgtggttgttgttyagtcgctaagtcgtgtccgactcgttgcaaccccatggactgtagcccactaggctcctcagtccacgggatttcccagacaagaatactggagtgagtt

SEQ ID NO: 38555 - DNA, 201 bp, Bos taurus
ttggagaccagaagattttttttttaagttttcagaggtggggcatttgctgtgttttattaaagcaattcatgcttgaatagactaaaaacattttactmttttcatcattttctaccttcagtgtaagacgatttcaaaaagtaagactggtctagtatcacctaaacaaagaaggggctttgttttttatcattttaa

SEQ ID NO: 38556 - DNA, 201 bp, Bos taurus
cccgcctggcaccgtgatatgtgcaggagtccaggggcggtgttttcagtgttagccatgcgctcatgagtcaggtgggcctggagcagacagatgccagyggggtgttgataaggagctccagggggttcctgggcagcacggcagtggaggcctctggggggaccacctggtgctcgtccaggtaaagtgccacctagg

SEQ ID NO: 38557 - DNA, 201 bp, Bos taurus
gatatactaatttggaatatatttttgtaatgtaagattttttttcactaaacaagttttttaatagcttttaaaagtcactatagtttttttaaattaayatgttttgttttttttcccaagatatttatggtttaagattcaaaagctacaaaagggcttacaagattttttcttttatctgtttccctagtcactcag

SEQ ID NO: 38558 - DNA, 201 bp, Bos taurus
tcaacctgagaaacggaagcggggcctgccccagctccctgccacccctcacttaaacagaccagtgcctgaactgaaggggcttagcagaagctgagccratgctcagcacgccctggccaacgctccccaagcaggagcaagcaatagggtgtggtgaagagtcatcgtttatcttcctctctggatgcctctttaaaa

SEQ ID NO: 38559 - DNA, 201 bp, Bos taurus
gagagcaggagcctgggtgggctgtcaggggtccgggctccactcttcctgtgcagcttggataatcttcttcccttctctgtgtctcagtttccctctcytgagaggggttgggccaggtggtatctgagggtcactccatcctgagaccccagggagtgcctgtccttccagacctgggggcagcctcggccctccccc

SEQ ID NO: 38560 - DNA, 201 bp, Bos taurus
gttgtggcagtgaaagcgaggctgtgggatggaggagaagaggcgggagacagacagagacagaggggaagggaagacagccagaggcctgaacacgcagygcttctggtccctacagaataaggcaccagagtcagtgacgttcccgttgtccctgtggtattaaaacgggtgctgaaggtgggggcggtggctgctgaa

SEQ ID NO: 38561 - DNA, 201 bp, Bos taurus
aaagtgctgaatcccaggcactggagccccagggaattcccatgactggttttttataaagtctggagatgatcagttgggaggtttagcatgccttctgrccctcaagtccgcatcccatttgtcttccgcctcccttccctccaagaaagcaccatccaccaggccattgcttttttttttttttccaaaaacaccatt

SEQ ID NO: 38562 - DNA, 201 bp, Bos taurus
cccaatattcggttggccaggggagaagtggggctcttggaggtgtccggaggagttctctatgccgacaaggcactcagagccctccaggtgacatggtrcatcgttaggggccacacagctcctgctctgggcatcctgggtccccatcagccatcccctgacctccggccggatgagcgcctttgccctgctgcttct

SEQ ID NO: 38563 - DNA, 201 bp, Bos taurus
gatccatctcctagaagggagagggggcagtccataggagggctggcgtcttatccagctgccccagaaaaggctggcttcacatctttccaggccagcakcagctctgtgggtgctgcagagaacctgcagaactttctctgccctggtgtggctgggctgtgggggccgggcctcacctgaggcagagctggtgccacc

SEQ ID NO: 38564 - DNA, 201 bp, Bos taurus
gtatcaggaagaaaagccaacttcccctgggaggtgggggcacttgggcacattaagcacttgtcccagggggatggatactcattctctcagggcaccamccctgggccagagccttcccacagagagagggggaaaggaggtgggatccaagcagaggagggagatcagcaacctggcaaaattgccggttcttcaatc

SEQ ID NO: 38565 - DNA, 201 bp, Bos taurus
gatgcccgcccagcaggctgagccaccaaagctccgggatcagggggaacaaaagccaagggaaagcagagtgctgacagggccagaggccgctggccgcrgggctataaaaagcaggagccaccgaggaagcggcaccagatggagacccagactgtgcagcaggagctgggtgagtaaggccccaaggggtgctctggc

SEQ ID NO: 38566 - DNA, 201 bp, Bos taurus
agtggaggctgcagcgctgtgggcagggcaaggggaattcagggcctctgcttgcttgctccccagcttcgacttagctgtaacagttctctcttcctttygtagcccctcgtactggccgcatggggcttagcgctggagatggcgtgggtggagccggcccgggctgcccactggctgaagaggaggcagtggcggaag

SEQ ID NO: 38567 - DNA, 201 bp, Bos taurus
agagttgacaaagctatttctcaatttgagtggatgtgctggtaaataccaccatacataacgtatctgtaaaacgcagacattcaggagtttgcagttaytaacccaccgcctcttgtttgtcactcaaagtctcttggatcttattgcttcttgtaaattggcagagcggccttgagctccttctggctgctgtatggt

SEQ ID NO: 38568 - DNA, 201 bp, Bos taurus
ccaggttgtgctgttaggccttgaacaagtaccagcaggcatgcccatcaaaggtttgtgttccagacactcctttgtgagttgctggtttggaacttgcrgtgcattttcaacccacagaaggaaatgttgcaaatggtggttaacctcctaagctagtttacaaaacccttgtttaaccaaaagatactaaaacatcta

SEQ ID NO: 38569 - DNA, 201 bp, Bos taurus
tgcctggacaagcccatgcacagaggggcctggagggctacagtccatggagtcgtgaaaaagtaggacacatctgagcgtgcacacaccatctgccagcyctctcctgggcctcggtcattaactgtgtgccaggcagacttaagacagactctttcttgggcttctgtacaactcaacttgtgtacactctctagacac

SEQ ID NO: 38570 - DNA, 201 bp, Bos taurus
agcctctgggcagggacatcctaaatagcattaaaaatgagccaaggcatcactggattcgtgaaataagcactctgccctgctcacttctctggcatccrtttttactcatcctgaacagtgggtgagtggctgttgtcaaggctgcttcctccgctcaaaacatttcaaaacgctcctacaaggacttccctggtgatc

SEQ ID NO: 38571 - DNA, 201 bp, Bos taurus
tggggactgactcttaaccactgcatgcacctcccttttcaacactcagcagtgccctgagcacttgagagcttggaaatgcattatagggggtaaggggstatgaagagaaggacgctgtagggggagatgctctaggagaaggatgtgttgttttaatataggggccacctaagagaatcacggggcagggaggatgca

SEQ ID NO: 38572 - DNA, 201 bp, Bos taurus
acaggcgggggtgggtcaaggtcgcggcccagggccccctcgcctcctaggtgcgtggtcttctgagcagtggaccccgctgcagcccaagccctcagccwcccaaggggcccttggccccgcctcacctcccacgcaggccaatgcagccttgaaggcacagctttccatcgccctctcgatcatcttctgctcctcact

SEQ ID NO: 38573 - DNA, 201 bp, Bos taurus
taaatacccacatgtttgaaactttgtggatgagatgagtcaatacagtaagcgcgtgagccgatacgctttgaaacttaacttccacagcttcccaagcrttgaaatggacagcttgaacagaggtagagagagaggtgactagaggagtgggttagaagaagaaaaagtttgcatgtgaaatttcaagagtggccagac

SEQ ID NO: 38574 - DNA, 201 bp, Bos taurus
ctcaaaattctgtgagtttgctgtctgttatctaaccgatcgcacgagcaaagagccaccatgaaggagaggaggcaaatgtagcaactaggagaattggyactcaaggaactagaaataatactgagactgtgaaagaaatgtttgaatttttaatttactgttcatttttttgacggcaccatgcagcttatgggatct

SEQ ID NO: 38575 - DNA, 201 bp, Bos taurus
cagagagagtaaacaggattctgtctatggccagggctttctgggaacacacctgtataagcagcagccattcccaacagaaccgaattctcaggaaatcmggacagagccagggctgggcctttgtttggttttctgaccatgtgggaagcctgaggcctggtggccagccacgccctgcctctccgcctctgcatcctt

SEQ ID NO: 38576 - DNA, 201 bp, Bos taurus
aagcaaaatattactttcacaatcatcaaactagcatgagcaaaaaaaccaaaaaccatgtaaaagacaaagtaaattaagagcccagaacaagaggatcyagaatataaattgtatggaaccaaaatgccaagtataatttagtatggcttggaggcatctctctcatgtaagagaattaggcatgagcacctacccatt

SEQ ID NO: 38577 - DNA, 201 bp, Bos taurus
gcaccgaaataaaaatgcaatatttcattcttacaatgaaatgttctaagaatgcttatttcctgttttcaggggcctaaaatgagagattttatctaacrtttatagtgttcctcggatcaagccatcaccggctatctatgcacatacagtcaaggaacacaaaaacagaagctccggtcctgaatgatttctttttag

SEQ ID NO: 38578 - DNA, 201 bp, Bos taurus
acaatctacgtgcccttctcctgcctattgggtactgccgcatcatgtcccctcccagcctctgcagctaccattcttcccctgggagggccccacttccygtccctggagtcagtagtggttgttaggtgcagttttctgggtcagagccttagacctctgagtcccagtgacatataaacagagactgaattttggcca

SEQ ID NO: 38579 - DNA, 201 bp, Bos taurus
tattttcagatccttctgtaaatttttgttgactcaaggctcaaccctaggccctcttctcccaaaacaataaaattaccgtctctatgtcagttgctcamaagttttattttttgtccagggccagctttactctgaaagacaaacctctatcatctgtgtacttgatatctcaaagacatgttccaacatgttccaaag

SEQ ID NO: 38580 - DNA, 201 bp, Bos taurus
aaacccttcaggcattctcctggaagactccccttcagtagagcaggagtccccaactcctgggctacagaccagtactgatccacagcttgttaggaacygggccacacagccagaaatgggctgctccctgttgcttgcattgctgcctgaatcatcctgtctgtggaaaactagtcttctaccagaatggtccctggt

SEQ ID NO: 38581 - DNA, 201 bp, Bos taurus
ggaaaagcagtccagaagctcccagttaaggaaactctctaagtgtaactggtttcattgggctgctttccttgaatgggacagacttgtgctgggaagaytggaactccacttctgtacctagatttgggctaaaaaggcttgtaactcatccctctacacagggctcttgtaattcccctctctacacttcctctagta

SEQ ID NO: 38582 - DNA, 201 bp, Bos taurus
gaaacagtttagaaaaggggaaatggagaggtcaagaaaaattgcatcagtggtggcagggctgggttgcattaatcattcccaacactgtcccttggtgrtcctgcacccagtatccaacagtcagccctgaagtgggtgatggtggtggcggcggcaagtgacaggcagaatgtttttgaagaggtcattgcttacact

SEQ ID NO: 38583 - DNA, 201 bp, Bos taurus
gagcagagatggccttaccttctggggtaggtacccagagcgccagggaatcccttctctcctaacaaggactgccagctatgcagtgtgaaggaaggggyaggggcctgctcttccagcccggcggggtgagaggagaggcctttgagagctcatgcagctagcacaccctccatgcagtttctggatagtttccatcac

SEQ ID NO: 38584 - DNA, 201 bp, Bos taurus
taaaatattttttaaagacttatgatagagcaacgtatgggttttctcaaaaacacatgaagtacttagatctaatggcagatctaataatttcatacttytgaggtagtgatagatataaacaatatttcaacatattgcaataatcaccaaaagatctgaaaatagctcatttctctggtaatgaaggcaatttgttgc

SEQ ID NO: 38585 - DNA, 201 bp, Bos taurus
gagggccgccctcagccccgcccttgaccccgccctgcgccctgccctggcccacctgcgtcttgtagatggtgtagccttccttctcatgctgcagggckgagcggaactcggctttgctctcatagacccgggcgaccaggtggtggctgtagggaggcagggcgcagggtggggggcgagggagggcgtgaacgggcc

SEQ ID NO: 38586 - DNA, 201 bp, Bos taurus
caccaggcctagtctgggaggtgaccctcgcttagcctcctctgtccctctctttgctagtctgagggcagcctcctccaccccaaaccttcccctttccygaagacaacaaggaggcctgagtgcccgctgttgggggagcagaaagtcacgctcctgctttgtcccctggctctttgctttgcatccctcaaaacccca

SEQ ID NO: 38587 - DNA, 201 bp, Bos taurus
ggacagaagagcctggtgggcttcagtccatggggtcgagactgagtgactttcacttcatataccaacatatggcatgacacaagtcaggaggtggtggrcccgagacggcttcaaattctgccatgtttgcttgtgatgacacagacccccagatgtagctcgtgtcttccaaggagtcattcagcacccagaggtggg

SEQ ID NO: 38588 - DNA, 201 bp, Bos taurus
aaagagaagttgatatttaaccattcccataccaatctctcatagttttatttatacaatactaagaaaacattttaaaagggaaagatattctgaaaccrttttattctaaggaaaacaaaatttctgactctctccaactcgggaactgactatataacaaaaatataactgacaataattggccatctgaaattttct

SEQ ID NO: 38589 - DNA, 201 bp, Bos taurus
catttccatagtaaccaaagtcaggccagtgccctcactaagagtagctcccgcgtgtgaattagtaagcttaaattccaaagttgaactggcacctccaragagtgagataaaaaacactttgtatcaaagctgtgattaaaaaaatgtaaaagttaaacccacaggcatagagaaaaacgggcaatcctgaaaactgcc

SEQ ID NO: 38590 - DNA, 201 bp, Bos taurus
tttgaactgcaccttggaccaatggaaggccccctgcattgccacgcagcctttttcagacatggttcctcatctggaccactggatatggaaaatgaccragtggccactgttttcttaattctcccaaggatggtgggtctagttccattctaggtgcttaggagatcgtggcatgtaacgggtgctgtcctagctcaa

SEQ ID NO: 38591 - DNA, 201 bp, Bos taurus
tagctttgactagacggaactttgtcggccaagtaatgtctgctgcttgtccccaactccttcctctccaacttccactccagatgctccttgggaaagcycagcaaagatcctagaactcacattagcactagaagtaaacctggagacattcccgccaagcctgttacctgacagggacatggaggtcctgagaagtaa

SEQ ID NO: 38592 - DNA, 201 bp, Bos taurus
tgttgacactcagcaagggccagtatatttaaatcattcactctcctcaccacgcctcctggtctctctaccatgagactgaatagcgtgaccttgttccygtgggtctgcagtgaaacagtggccttgggcccagcaatggggctggccaagcagaaagccgtcggtcccatcatcgggcccagcacagagcaagtctca

SEQ ID NO: 38593 - DNA, 201 bp, Bos taurus
caggcatcagctgggtggggatgaaggtgatgcgcatgcgggataaaagcaataggaagttctatgggagaccacaaaagaatcaagccaggggcttgtgmacctggaaataattccgaatgtagagcacactatggagcagggctaaccggatacagttagaaaggttaaactgcaagaggctgggatggaagagtagca

SEQ ID NO: 38594 - DNA, 201 bp, Bos taurus
tgaactgaagggtcttgaggagcagtgtggccccgcagacactctcctccgtgctctttctgcagtgagcacagatgatgctctgttcggcttctgctctygcaggccggaggtacccactgatgctcaagccttgtactcccaagcgctctgccgactcctggcgggtgcagaggaacttcaccatcaaatactggaaag

SEQ ID NO: 38595 - DNA, 201 bp, Bos taurus
tactacaatccccttaggccatcctggaaggcagttgatgcagcatcaggcaacagcacaaaggtctgtgctacagcaacatgcaaagacttatccagcaytgatatccagaacggcccagccgaagctttccacagctctagtaaaggttagagagatcgacagctggctccccgagtgaacagactggaagctcccact

SEQ ID NO: 38596 - DNA, 201 bp, Bos taurus
ccaagaggactgagcagatggtgggaaggtcctgctgggcagcaaggtggagggcggtctggcggtgcttggttaattcattcactttggcacctgcaagragctgatgacgttgattacatgagcagctgctctaccaccaccaaccaaggtctggcataagggggcaagcctgccaatctcctgcccgccagggtttgc

SEQ ID NO: 38597 - DNA, 201 bp, Bos taurus
tatttaaccaatcccttcataatctggcctgtcacatacttttccaacctcagatcctgctattccttccactgagaattgtgacctcttcccaactcacrtccaaaagaggcctattttccaaagcccagcccagagaagcccagtttatctcctgcagtacaggcttcccgacaccccaaacactccccacaccccaaa

SEQ ID NO: 38598 - DNA, 201 bp, Bos taurus
aagtaaatcaacaaactttttccatttgatccattactctttcttttagaaggaatctaatccaagaccatgtatataacaaacacaataaacctatcatraaaattccaacacaatttcactgagaactacatcttatgaccttgaaaacgtcagtgacaggctgtcatacttgcaaatgtaaaaccagataaacttacc

SEQ ID NO: 38599 - DNA, 201 bp, Bos taurus
aagttcagcgactccagaaagaattgagcagttgtatccgtaaaattgaagaagtagctaaaagaggtgagacaaattggactcttgactttgaaaaaaaygctccaagagggtagaggccaaatacgttcttcaggacccctgcccctcatcagttccctttctgtccttctgtcactagaatgagcattcatggcaaga

SEQ ID NO: 38600 - DNA, 201 bp, Bos taurus
ctggagcatccttttgttttttaactttccaccttatgtcactgtttcttttgtctgctgcttacatatttccttacctgatggccagttccttgtcatgrgaaatttgtttcaagttgtgcttttccctagtatttagctaatgatgtgaatagagaaggtcctcaataaattggtcagtaataagcaaatgcgagtggg

SEQ ID NO: 38601 - DNA, 201 bp, Bos taurus
actgcttgtgggaatataattttgcacaaccattttagaaaagagtggcaacatctatcaaaggtgaaaagatacataccctgtaaccagcaatccggtcytggacatcagaccaacagaatatacatctatgtctgtaatgtataagagtggggacttttctggtggttctgtggtggttccaatgaaaagggtttgatc

SEQ ID NO: 38602 - DNA, 201 bp, Bos taurus
cttcctatcaccctggtgacacttctctaactggccctccaggagattgtgcaaattgttgcgtatcttgctaaaatcaagagacactgatgcacaccacrgaaagggccctgaagcagagatggaaacactaagttgcagtccacaccttgtccctgggctgtgcaagcctgggccgatcccatctcctctcttagtgtc

SEQ ID NO: 38603 - DNA, 201 bp, Bos taurus
cagccatggccggaaatgccctcctcagcccacagctgagagaaagggaaatgctctgacttctcgcttcccccccagtctccaaccttctgccaaaaatrgaaagcagtgccaaggggcctgagaaacagctgcaggagaaaagcaggtgtggatctgacagcaagagacaatgaccagcccagggaccaagggacagac

SEQ ID NO: 38604 - DNA, 201 bp, Bos taurus
atactacattttgtttacccattcatcagctgagggatatttccatacaacacttctgtaatatacatatataagttgtgtggcccatgttttcatttcayttgtctatccaactgtgagctgatggctcatatggtcactctatctctagaattttgaggaactaccaaactgttttccaaaatggccacaccgtttaat

SEQ ID NO: 38605 - DNA, 201 bp, Bos taurus
acaataacaacaatagcatcactaacacgggcccagagtgactgagcactactttatgttatgttctaagggatcactgtgcagtgtaacgacaaccttgracaggcaggcctagggggacagttatagttatcagggaagggcttcatcctcctccttccacctccttggccttgctgttccttgaaaaccactctgatg

SEQ ID NO: 38606 - DNA, 201 bp, Bos taurus
ctatccctcattgatctgcctaatatctttttggtacacttccaagtaagttgcaggctcgactatactttattcccagacatttcaccatgtatattatyaaggagagttctgtattttattgttcctttgaggtaaaattttaaaacaatgaaatgagtaaataagtgtatacagccacttttgaaaaacttaatggca

SEQ ID NO: 38607 - DNA, 201 bp, Bos taurus
cctactctacttgagccttagttttggatttctgagccacaaagcctgggattggaaaagactcccatgcatagataatggctgtgggaaaagacaagccrtgctgtccctttgattgtggccagtgtgtcacctgttgactgtttgccctaaaaccctgcttagcccctgtctgcattatctcaggtgggtgacccttct

SEQ ID NO: 38608 - DNA, 201 bp, Bos taurus
gatggatgcctacaccctaggggagaaggagcagtgttcttggctgaggggtccatgcgctgagcctttttgttctcccctgtcaggtggccttggggcakcacaaagaaaactatttctctgaccctggacctcaagctgtgctgaagcaattccaggaggagttggctgccctggacaaggagattgaggtccgaaatg

SEQ ID NO: 38609 - DNA, 201 bp, Bos taurus
gagagccacccccatccctccccgactcagactcctgttccagcttcgccgtacccccctatcgctccattccctgtagcatggaggccaagagtacccaytcctgccctgtcctcctagctgtaggacccctgagcatcactcacttcgggggagagtgaagtaggcctggggagagggatcccagcacttggccaccgt

SEQ ID NO: 38610 - DNA, 201 bp, Bos taurus
cactgccgaggaccctgggttcaatccctggtagggaactaaaattccacaagccatgtagtgaggcaaaaaaaaaaaaaaagtctatataagggtaactrgagagtttttcaagaatatttgaattctaaactcggttagtgggtgtaatcataagacagtgggaaaggaatgtgaatgtcattaagacaagatagaatc

SEQ ID NO: 38611 - DNA, 201 bp, Bos taurus
cggtaacccttcccccgactccactttccctgttggtactcctgcacacagacagatgcttccttcagaatcctatacagtgtggaaaacgcccacacacrctcctcagtgtggagtccccctgcctctgccataccccccagtagctctggatttctcccctacagcttctccctctcaggctgtggcccctctaacttg

SEQ ID NO: 38612 - DNA, 201 bp, Bos taurus
gggcccagagcccacaatacaaagggtgatgggcattgaaactagagcttggggaccctaagggacacaaaatctccaggaaggggtcagggatcggagargggttatctatggttttctatggggccacaatcagccaaagagggattgggattgaatacaaatgtagaagactgttggagtgaaatttggggcataaga

SEQ ID NO: 38613 - DNA, 201 bp, Bos taurus
gactgccaaatgccaactcctcttcccactggaccttctctgagccccacactggcactccacatggtctcctgggccctcccctgcctcgacccacatayccatctggggaccagctcaggtgatgctagcttctgagatgctccttagtcctgccggggcctctcagtgggtccttgtcctgaaacctgagcccccttg

SEQ ID NO: 38614 - DNA, 201 bp, Bos taurus
gagagcagccgtatcacaggtgtgccagctcacctgcagaaactgaactttcaagaacgcgagttcaaacatttcttcgggccgcacgcctgtcatcaccraggatgaaaaactgagcggtgctcagagctatctgagggctgttggggcaacaaggccgcccttgactgagggcttccagggctgagcctggggccttcg

SEQ ID NO: 38615 - DNA, 201 bp, Bos taurus
ctggtggccgaggtcagtccacggtcctgctgggactctgcccagcgacaaggttacttcctagcgggtaaacagctccctgcggggagcacctgagtgtrtcacagcatccagatggcccacccacatcttggaggattgtaactggataaccccccaggaactcagtgatgtactctagcatccaattttaggacgatc

SEQ ID NO: 38616 - DNA, 201 bp, Bos taurus
accactggactgccagggaagtccctatttctcctttttaagagtcactctccccaacttgaaatgccagcattcctcctcagtagggttggggccttgtygggttttcctcactcccttttcctttcttcccccccaccttccctccctccctttttttctccatgaagtatttattgtccgctgtaaacatttaggagg

SEQ ID NO: 38617 - DNA, 201 bp, Bos taurus
acacgactgagtgactatttcctttccttttaaagtaattctgttattttatttttggctttgccgggtcttcattcctgtgcggctctctctctagtgcyggcaggcaggggccattctctagttgtggcgcgcaggcttattgtgatggcttcgcttgtggagcccggggtctagggtgcaggggcttcagtagttgtg

SEQ ID NO: 38618 - DNA, 201 bp, Bos taurus
agctcatcaaaggtggcaagttcagcgcctgcctggaagtccacattcagaacgacgggcctgtgaccatggaactggaatctccggcccctggtgctgtygcctctgatccagaacacctgtcgaagcttgaaaagcaacaacagaggacagaaaaagccagagccaaagggccttccggatcaagcaagaagagaagtg

SEQ ID NO: 38619 - DNA, 201 bp, Bos taurus
tgaagtggaggctccaggtaacgccttgtttcttctttctggggagaatcggggcttcttccttcgctcctctttggtgtcgcacccgctggacccccaarcccatccttctgactgtaacacgtgctcaggttgccttctgtgcagaaggtaccactgtggggccggaaaacaaacgtgcctgtgtgcctgtgggggacg

SEQ ID NO: 38620 - DNA, 201 bp, Bos taurus
tttcaagctttttatgttgcacattataacaacacataatttcaggtgtcgaaatgaaccttgatacagatggcaggccaagttgacagtttcataggacktttgatacatgtgcaaggttaagagccaaagtccagaccagagttctgaaaatagacaggcttttatccatagcagatactttcagaggaatttgagatt

SEQ ID NO: 38621 - DNA, 201 bp, Bos taurus
ggtatttacagtataatttcatatttgtgactattttattggtattaatttgatggtatgatgcctttatatatgtgcctaggtagatgccactaactacrcataatctatcagctatacatagcttcaagcaaaaatcctgataatcataaactctgtgagatacacatcatttttctagcctatcctttttcatgtgaa

SEQ ID NO: 38622 - DNA, 201 bp, Bos taurus
cctttattcattctgcaagtacggactcttgttagctcagagaacatatgtgagaaagcatggcttctgtcctgagtagagtctagcaggaagactcacgygcagacacgcacagtgcgtggtgtaccccgtgcggcggtggagctgcgtgccagatacagcagagcctaaaggaaagaaccgctggccccatctgggggc

SEQ ID NO: 38623 - DNA, 201 bp, Bos taurus
cctaccagatgccccagcttcccgtggccgtgccccagcctgggctccggctccagccggccaaagcccagatcgtgaggagcaaccagcccagctcggcygtgcattcaagcaccgtcatctccacgggggcgtatggccaagtggcccattcaatggccagtaaataccagtcttcccaaggagacataggagtgagtc

SEQ ID NO: 38624 - DNA, 201 bp, Bos taurus
agtgctttctatcagtgaaactgtaaaatgacattgagcaaatagcgatgggccaaatctgattgaggagtgaggtttgggggaaagctgagaagctcatrcactgaaagcatgaaggtggctgagagcatggtgagttccagggaggggcgaggggacgtttctcagcctgcctccttagtaagctgcctttttcctctt

SEQ ID NO: 38625 - DNA, 201 bp, Bos taurus
atcctcccccacgtcccccaggcagctccactctgcacaacccaaactctctgggcaaagaatgttccggaagggccaggcaggcctctttctggaagacraagctgagaaagacagccttagagaagccagtgctgagcgcctgcttcgtgccggccatactcagggctctatggggattctgtgcagcagcctgtgggc

SEQ ID NO: 38626 - DNA, 201 bp, Bos taurus
tgggtggacacctacagcagggttgaggagccacgttttctcctaggcttaaggggacatgacctccaagaggggctccttctcattcactcataaaatarggcccctggaataaacatctgcagagctgcacgcatgtcacagcaagcagatgtggaacaatgaccttgttctgcatatttttcttcttaaagaatcatt

SEQ ID NO: 38627 - DNA, 201 bp, Bos taurus
tgatgacgcctctgaaaaacaactgtgcttggaaactgagttctagctgagcagcttttggggaccttctccttaagactctcaaagattgcgtcaggccratgggatgcctggcagaaattctcaggggacatggtgtgtttttgaagaggactgattgggtcacagggctgacaggccgtttcccgggtattccttggg

SEQ ID NO: 38628 - DNA, 201 bp, Bos taurus
ctaagggccttgccacttgctactcccttttgctcaacgcactgtcccacatcttcacacagctggctgcttcacatcattcagtttcagttgcaggtcayggcctcagaaacttccctgatcacccatgtaaagcacaccacccaaggcgtgatcaaacacaccatcctgtcctattttacaacactatcgctacccaga

SEQ ID NO: 38629 - DNA, 201 bp, Bos taurus
gcttaccttggagagaagagtagcagctgaacccaatgctctggtcccacgtgctgcccttttggaatgacagctgacagggtgggggctctaggcaggcrggagttccctggatagccaaattcagagcatcatgaggacagacatgcagggagctacaatatatatattgtgacagttagtgcaggtgaatggacagga

SEQ ID NO: 38630 - DNA, 201 bp, Bos taurus
atgcatctttggtcagctgctggtcagctagcagatcagctggggactggctgctctaagtggcctcaggtgggatggcttggctttgttctacgtggccrctcatcctccacaggctggcttgggcttgtttacagggaggatgggctgagcgccaagagggaagtggagctacacaaggcctattgagtcgtagctcag

SEQ ID NO: 38631 - DNA, 201 bp, Bos taurus
ggccctggggtgtttccgtatgctgccttcaccaggcggtgtgctgcgtgttctggaagtaagctcaggacttgaatttcaggttttagtctttctcactrgattcccaaaccagcctagtttggtataagagctcacagaatattccttaaaactctccccagctagaacagggaatgaatgaacctggtatactgaaat

SEQ ID NO: 38632 - DNA, 201 bp, Bos taurus
aattacggtttttgattctgtggccactgtggacgtcatggtggtgacttctgtgatgaccgtttttcttttaggttctccattgacattttcatctttgytggtgggcaggccattttcatcaataaaatcattactgaggttagattcctctccagaagtaacaggggacgaagtaactttcttaactttggagatgtc

SEQ ID NO: 38633 - DNA, 201 bp, Bos taurus
accctgtccctcacccccactgagctcaaccctctgcttccccagactttcccccactcttccccccgccctgcctggaagcaatctcttgaaaaccctcrggaaagcacaagccaagactatgaccatgagtttgctgggtttatcttccgggaggttgcaatcagtgtgaccgcaccgatctttcctgagacagcggtc

SEQ ID NO: 38634 - DNA, 201 bp, Bos taurus
ctgtctgtaaaagcaaaaagggcctaaaattccaaagggctagcttttcaaggcaaataaactttaacaccaattgcaattatgcactattagtaaagggraaaaaaaaggccacttcacatctttaattcacttggactctgcagcattcaagtttgtgacccctgccatacacaatctcccacggttaggtttctccta

SEQ ID NO: 38635 - DNA, 201 bp, Bos taurus
tccacctgcaagcgggggaagcacaccccgagggtagaaatgcacttatgtatctcctcccaacgtacccaagcagaatggagtagagacgagagatttgytgttgaatgtgcaggaggagaatcagttgtagtttaagagtgaaggattattacaggattgaagggactggaacatcttgatgggtgaggactggtggtc

SEQ ID NO: 38636 - DNA, 201 bp, Bos taurus
gataagggccctccacagtggagaaggagccagtcccgtggtggagctggcgacagagcaccggtggaggagcagcccgagcagagggtggaggcaggcayggcaaggctgcgcggagcaggcctgcaggcaaggctcacaatgtgagcacgggcagtcaggggtcaccatgcagggctttgtggactatggtaaggagtt

SEQ ID NO: 38637 - DNA, 201 bp, Bos taurus
gttgctactttggttaaattagaagctcataagtcattaacactcagggttgaacaattatctttcagctcctggcttttgaaatctctccaaggaaagcraaatcaagcaagtggcaacagattcgttgtgatttttgttttaaaaaaccattaaatcggagaatccggaggaatgtcctggctgcactgttttagatag

SEQ ID NO: 38638 - DNA, 201 bp, Bos taurus
cgtgcgatcattcattaacaccttctttgctgtctcctctcaaacctctcgctgcacaactgctgccctcacatccagacccagggagttctaaggaaggrccgcctgtcatgagccaagagccccaacacagagttctcaatagccttgtgaacttgagaacatgaacctgcagagacttttcaaaatatcaagcttcag

SEQ ID NO: 38639 - DNA, 201 bp, Bos taurus
tttggaccctgatacatgaatactgatttttttaggtggtcagtgcattgtggttttaatgacatagagaaaataatatagcccttgtgcctggatctgcrgtgaaaatgtttacacagaaataatcatataaatgttacttactggtgttcaagttttagaagcaacctaaagctactttaattgagacagaattcacag

SEQ ID NO: 38640 - DNA, 201 bp, Bos taurus
ggagatctgagagacacccaaggtggacactgaacccagtgatcaaaacactggcctggcttccatcctggaaccacaatccattagccctggccaccackcctaactcttttttttcctttgctcttaagcattctcaaagaaagatgcctgcaaggtgcatgggccgtgccttctccagatccacagaaaagactgtcc

SEQ ID NO: 38641 - DNA, 201 bp, Bos taurus
agagacctggggtccagctccccgccaagccccaacgccgaatggccgctgctcccggtcagagtggaggcgggacagcagggccttgggccgcaccgacmtttcgtgaaaccaagctccaggcagccttccggcgtctgtggctactcgcgcgacgctcccagaccgcttggcctgagggcacaagagccccagacaact

SEQ ID NO: 38642 - DNA, 201 bp, Bos taurus
ggtgctgccccaggtgggggtaaagccactcagcttgggccttccagaagcctcagaaccagagcccgcaggacactgataggctgaacgcctattctcartggggcacccaggtgcacctgcggccaggattccagggggcaggggtccccctgagtgtgggcgtttccctgcacccgggcccattgcctggggccccag

SEQ ID NO: 38643 - DNA, 201 bp, Bos taurus
acacacgacaaaagcacactggccctagggtggccaggggttcactcctcagttcacctggcacgcagctcactccctgctcatccatggttagtccagcrgagttcaggccacttcatcaggaacaagtgaacacgttttcatgtatgagaaaatgagtcgttcctctctatttaaaacagatgaaaagcaggcaggcag

SEQ ID NO: 38644 - DNA, 201 bp, Bos taurus
atgcaggtcagcctggggggcctgccctgtggtgccaaacggagatagttgggctttaagactatgtttacattgtaatcaagccaaaacagtactgaackcctgtgtcgaagggcccttcccagcttcatcatgtgtggattacctccttccagccacgggcaaggggctccatctacttcactctctttgcacctgctc

SEQ ID NO: 38645 - DNA, 201 bp, Bos taurus
actgcttaagttccccagagggatgcattccagtcaacttaacattcttttctggcctcctgctttcccactcccacgaaggcttcccagggtcaccctcrtgtaagctatttgcacttgtaccttatctgttcctgagggagcccacctctgagacagtggttgcagtcatgcaggagggagggtgttgtactggggagg

SEQ ID NO: 38646 - DNA, 201 bp, Bos taurus
ccagttctgtcctaaaagcaggacagccaaggccacgtcctcacattctccgtgggctctaactcctgattctgtccagggagcagagtacagaggcaccrctcccctcagcatggccatcacgctccttcctgcctccttgggaaaccagaagctcagggccccacctttgtggggtccttcagccccacccctgaaaac

SEQ ID NO: 38647 - DNA, 201 bp, Bos taurus
agagaggagactccctggcccctccagtgcccaggagaggttgacagaggaccctgtcagtgtgtctgccctctggaggcccccggtgagcttctcaggcrccaggtgcagtctccacagcttttaaggtggtgctgaataggaacaggtgacttgggatatggccttcatggtgggaggagcttggtaatggggattgga

SEQ ID NO: 38648 - DNA, 201 bp, Bos taurus
acctccccacccacccccaccagtcctggggtcaggctggtgcttgctcctccctcacacctttaaccttggcagcaggagtgttgccactgcggagaagrctggcccttgaaaggatagagggacagctctgacatgggagtcctaggcagcactcccagggtgtcaactggcccaagtgtggcccagaggagtgaggga

SEQ ID NO: 38649 - DNA, 201 bp, Bos taurus
tataaaagcaaatggttttgaatttccccagggactcctgtgactggcacagactaagatgttttctggtccaccctgcactgatgtttaccacagaacaygtggcacctgtatctattagaaagtcaatcaatttgttttgcactgtcaaagttacccgagactcctctggagaaattagaatccaacacaagtccaagg

SEQ ID NO: 38650 - DNA, 201 bp, Bos taurus
acagggtttcctcgaggcagagtaccgcctgggcccacctaccctccaaccaaaaggcagctggtgaaaactcggatgtttgctgtcagtcaccagagacyctcaaggccggcagcccgctgcgcccacatcccctcctgtccgctgcagtagccagaccatccccacctggtagcagttataaggggtgacccagccaca

SEQ ID NO: 38651 - DNA, 201 bp, Bos taurus
gagggccctgtcccacgagaagagtggatttccatggctggttggtaggacgcatcaccctgtcctaccaagtgaccaagggagaagccagggggcctcamacacctccacacagcctgtgcagtggagttatttccactgcaaagaggagagataccagcaaagggaagagggcctgacagctccacgtgggaggaagtg

SEQ ID NO: 38652 - DNA, 201 bp, Bos taurus
cagtgggggacactgcaaccctagaggcagcctgccaggcccagggataaatatttgttgaatgaatgaggactgacacctggatgcagaggtgcccctcygtgcctcccattggctgaggcctcaggcagggctgctgtcttccaccttattactctcctggcacggcccgggagccagtggggggtgggggactaacgg

SEQ ID NO: 38653 - DNA, 201 bp, Bos taurus
gtgccctggtactcatggccaggccttcctcactggtcttgatagaaccagctgtccttgcctcccaactagtctcagcccttaaactctagcaggcggcrggcagtggccacagacagaagtcaggcattgcagcccacaaatgggggacaagaaaaggggccacaagaggtggtgcctggggtatccagtgccagggta

SEQ ID NO: 38654 - DNA, 201 bp, Bos taurus
ttcatttgctaaaggtgccgctcccttaggaatgttcacttttcaccgaggagtgtgtaaaatgcttatgcttgtgtacaattgtttatttcagatatttrgctgtcctttttaaggagactagttagaaacatctgagttcacactctgatgtaaaactgagtgaaagttgtctctgcagtggagtgtgtaactgcatca

SEQ ID NO: 38655 - DNA, 201 bp, Bos taurus
agaagttaacctatatttcacgggtttcacgtggcctcccaaagtttccccgagaaggctacaggaggctgtgctgcagaccagccctgtgctcgtccgcwcacccacctgggccctgccctcaacaccccatgctctgacctcgggaccccgtgctctgcactcagtctgtcccaagtctcttgtgtgcattgctgtttt

SEQ ID NO: 38656 - DNA, 201 bp, Bos taurus
atgagggcagagtgggcatggtcacgctgctccaccttggccgggacattcccgtcccctggggacggggtctcccctgagcccagccacacctcctgtgyctaggggtcatcacgttaaggccacagaggagtgtgtttcctgggccacctgccacagcctgggtgggatctgagtggtgggtgtccccacgcctcggag

SEQ ID NO: 38657 - DNA, 201 bp, Bos taurus
gtctcaggacaaccaccttaggtggccccctactctgaggtggggacccaggagggcaagtggtacagctttgctgtgagctgccgctcatccaagatcckcggggcccagatgcattgaagtgaattcaccgcagaagcttctgggagggccctcttcctccatagggtctctgctctgtgactgcatcttgtgtcccag

SEQ ID NO: 38658 - DNA, 201 bp, Bos taurus
ccacttcctcctcactctcacctgcaggggtgggggtggggcactgcagacactgagtgcacactgcgggaggtacctcaattcagcaggagacatggtgrggtcgcaggactgggggcccccagcaccctccagacacgctggtcctcgagtcagactggccaggccgggagagccttcgtgggcatgctgccgcacctc

SEQ ID NO: 38659 - DNA, 201 bp, Bos taurus
tccagcctctaccgggcactttcggaggtaagtccggtgggtggctgcgagccctgggccggctcttccggggagggatggccctgaaacgggtctcaggrgagggaggaccctggggaagaccctagagaggggtggaccctggggaaagaccctgggaggggtgcatcgtgagggagggcccttggggctgggattcta

SEQ ID NO: 38660 - DNA, 201 bp, Bos taurus
agcgcattgaggcaatgggttcacatgactcccgaagcaccgggcaccctggagtcctgtcccaaaaaggacgcagggccatttacacgccttagcctctycttccctgtttcaggtcatttacgtttcttccaaattccgtcatttcaggtgacggtgacggtgagcacctgcaagcgtgtggcccttctccgacggaag

SEQ ID NO: 38661 - DNA, 201 bp, Bos taurus
gcctgtgctctttgtgccttattaaagaaactactgcctaacccaaggtcagaaagattttcttccagaattttcatggttccaagcttcacatttaaggmgtgagttattgtacaaggtgtgagtgagtgactgaatttctacttttggcaaatgggtgtccaattaccatggtgccactccgctggaaagacacattcc

SEQ ID NO: 38662 - DNA, 201 bp, Bos taurus
caactgcccacagttcttacccaaggttcaactgccccatcaccactgtacacaactttttccagggcctaaagtgaattatcaggccttggtgtctataytgacagtggttttaaatctcatttgacactaagagtaaaacagccctccttacatcacagtctggtccctacacctgccccataaatacacattaactga

SEQ ID NO: 38663 - DNA, 201 bp, Bos taurus
aatggtcacgaagagcgaaaaagcaacttagcattggtcacaggagaaatgtaaagcatttaattcacctgctttaaaaattaagaacaaataaccccctytatgaaaagagaagcaggcacagagcaaatacacccaaaaaacacatttccgtatcactagatagatgtgaaacgcagaggaaggtcggagaaagccagt

SEQ ID NO: 38664 - DNA, 201 bp, Bos taurus
ggcaggcatgactccaggtttccaggcctgggcagctgggaggacagtaacagtgcagagaggaaacacaagaggaggggcagatacggaagattaaacayggtacatttattctggacgtttactgacttcccacatgagccctaatccagaaacacatggtaaagtcacatccctctaggtcactgctccacgtctgtg

SEQ ID NO: 38665 - DNA, 201 bp, Bos taurus
gagtgcaggaaacaagcggacaggggaggccttccacatccggtgacaagagcaaggtcttccagaccgcagggtgggaggcaggggcagtgcagacaagracggggccaaacctttttgctttcttttgatttacaacctccttaaaagcactgaggagctgtcaggctagcaagaaactacaaggtcaaaatctgaggg

SEQ ID NO: 38666 - DNA, 201 bp, Bos taurus
ccgctgagtcactggcctggcgctggaatcctggcttcagggctccagtgcatccctgctgccccaaccctggagtgcacatactctatgggaaggagctycccttgataagggcccagccagatggttctaaacactctagtaatatgtctgctgtacaaaaaacaaagcctcaccattaataaagcttctagtccagtt

SEQ ID NO: 38667 - DNA, 201 bp, Bos taurus
ggaagctcggggggcgccatctcggggggcgccatctcggatggcccctgcttccccggatggtgggcactgttgggatcatcccctctccagcgggccckgatccttctcatggattctgaatcttaagatggctcggatgggaagtagggctgactggtcttgtggtggctgccctgtgcaaggcccgccctcctgaat

SEQ ID NO: 38668 - DNA, 201 bp, Bos taurus
cttccccttcatactggtcaaggtaggggctcaggccgcagcctagggcacacagcctcccgcaaagccaagcacgcagacgcacgtggggccagggcatyggattccatccgaattctgacgttcactctttttttaaaacgtccgtggagtcaagtcttagttcttagaggggaggcctgcagacagccaacaggcatt

SEQ ID NO: 38669 - DNA, 201 bp, Bos taurus
caaagtgctgcgctgggtgtggcctgaggagcccatgggctggctactctcagagcctttggtgtctcattcaatggaaagaagccagtggccagcagccygagagtcaggggaaatgtggcttgtccacctgtccgtcggcatgatggagcacctttgacagaactgatgtggccacaaggacgtgtttactgagctaca

SEQ ID NO: 38670 - DNA, 201 bp, Bos taurus
cagcttgcctggcccaatgactgagacgctcagcgagctgtcacctccaggacagggtttctaaaccacagtaccaccaacacctggaactggagaatctycccttgggggcctgtcctgtgtgctataggatgttcagcaacatccttggcctccaccccctggatgtcagtagtgtcccccagttgtgaccactagcag

SEQ ID NO: 38671 - DNA, 201 bp, Bos taurus
taggagggtctggtggtctgggttggttttggttttggtctctttttgtattccatctgcaggtgacatttccaggcagctctgcctcccctgtttgtttktttttttaattggcagagccttttgaggaaatgcccaaatttcccttttcttggagtggaagaaagattgggcggaggtggcttgattatctggcttcag

SEQ ID NO: 38672 - DNA, 201 bp, Bos taurus
aaaaaaaaagctaacaaatcagaagtcaaagccagcagtcatgcttggggagagttcatcagccctgtgatgggtcagaggccaaggccaaccagaatgaygaccctccaccccactggatcaaggtctcttaggttcccagaggagtcatagaccacgcccatcttggaattccctaggagcccgcacctcctacacaag

SEQ ID NO: 38673 - DNA, 201 bp, Bos taurus
aggccctggtccccagtgccctggctaccaacagctccaggagcacttccctcttcccctgcccgtcaggggtcttcagcaggttccaagtcgtcatccgycccttctacctgaccaactccacggacatggactagactcgaggctggagttcaggatgggcaggagttcatagaggctgggcacctcccctccttcacc

SEQ ID NO: 38674 - DNA, 201 bp, Bos taurus
tatgtggttgggagatctcctgacctccagaatgagaatgacacagcagagcccagcctcctctcttaattatcctgctgttctccacttggttttcagtycgcagggaacgaatctccaatcaatttactctgggggtgcccatctactggctcaaaagcatgcataaacagaaggcagccatttttaaaatttctttca

SEQ ID NO: 38675 - DNA, 201 bp, Bos taurus
tcttttccctttggcttttttggtttcctcccacccatacttcagtctgctggccccgttcacatgtgaggtcagccttgggtgctttctgtcacctgtcygtgagtgggaaccaggcactttgggcagtctgtgcaggaaagcttagagcacattcctatttaattaggaataaagaggtttatctgaatgtcttaatgt

SEQ ID NO: 38676 - DNA, 201 bp, Bos taurus
cttctcatcttcatggactagaaatttttctggtttgttaagtccagaaaaagcagaataaactccctttaggcttgctttctctagaatggggtgtgaaycagtagaatttgtgttgtttctcagagtggtttttgctcagactagatctaagctgtttttagttaactttctcctgaagtagctgttggaatgttcacc

SEQ ID NO: 38677 - DNA, 201 bp, Bos taurus
ggtcagatactgctttccctaggcaggctccttccaggcctgatggggcgaaatgcccaggggtctctctgtggtcccgcaaggcccctgttagttttgartcacatcattgaagactgtctaacagtgcttggtggtccctcagcctctgtgaggcccacctcagggcagggacacttactcctaaaggtgtattgggaa

SEQ ID NO: 38678 - DNA, 201 bp, Bos taurus
tgccctcccgcatcggggctcgtcagcttcccggtatggtcaggtcagcctgagtgggggtatggcacagaggtgagcgggaccccagccctgtccttcgrgggcccgcagtctggtggggcacacagaagggtcagacacagcaaacttgtcactgaatgcagattgggggatagtcagttttgcctagggtccagaaca

SEQ ID NO: 38679 - DNA, 201 bp, Bos taurus
agctgtatgaccacagccctgttagggtggccggaaatgtgcctgacatctcaaaattagcaagtgatacagccaggatccgagccagggcccacacctgygccttgaaccctgggacctgccttttgatactcacatgcagcttaatgtctgggcgcccacccctctccaaccccggatcccaaaagggcccacccagac

SEQ ID NO: 38680 - DNA, 201 bp, Bos taurus
ctggcctttttacaacacttcaaactccccagcacatgttgctgccttaggatctgtcctccacctcccaccccggagcttgtccaaaggtcacttccctkagaagtaagtgcccggccccccccaccctataacaggacttttttttttctttctattaagaactgtgatctaatcctatttattggtggattgctgtgt

SEQ ID NO: 38681 - DNA, 201 bp, Bos taurus
aggggggggtcggggaacttccgatgaactctggccgaggtgatggtaatccctgaagccaggatgttctgtgggaaagagctagaagggcaagctgagcrgcagtggtcctggggtcagggcctgcaagtccagaggaggggcccgtaccttcctgcctccaacctcacaaacctcccgagactcccatgatgggaaggg

SEQ ID NO: 38682 - DNA, 201 bp, Bos taurus
tggggtggaaggcggtcagagggttgactgaggggcccctgaacccagatgtgcagccaccaagaccacagactgcagctggaagacgggctggcgtcccractggccactcaccacagccttgggcaagatgtccttatgcggacaaggggctcatggggtcagttaggagaggactttgaaaagtgccattgttaatgg

SEQ ID NO: 38683 - DNA, 201 bp, Bos taurus
acttcactagatgggcacaatgaaagaatgggtgagagaagagaatttgtgaacttaatttgagcacaagaaatgatctatctgaagaacagacagaaaaragataagaaagtggagtctcaggaagctgtgggataataccaaaagacccaacactcacgtcattagggttcagaagtagaggagaaaaagactggcgaa

SEQ ID NO: 38684 - DNA, 201 bp, Bos taurus
gtgacccctgtcctgcactcactttggttcttcagcccagctctgcctctgtcatggtaggggggtacctggagtggagcggccaggccccccctggaagkttgggcttcccattctccatactcctgtcctgtccgtggtgatggaggaggggtaccagcctggcagggagaggaggacccattcagggcctggctgggt

SEQ ID NO: 38685 - DNA, 201 bp, Bos taurus
tttgattcctccagatggctttggaggggcctgccccgtggggctgggggtcaggaggaaggcatgctcatctcaagccttggctgccctgtctggcactyggccctctgacagtgtgccctctgcaggaattcagacatggctctgtctgcttgataagaatgtactggattcattgactttgagcccgtggaaggctga

SEQ ID NO: 38686 - DNA, 201 bp, Bos taurus
accgatccatcacccagagccctgaatgagctccgcacaggcaatgcgagggcagggcagggctgggcaggaaggccccttggccggcagggccagctgcytcctccagctccatggctggaaaaataccagccaggctaactgcctccagtctgctaggagatgacaggagccctcgaaggccggtgggcccacctccct

SEQ ID NO: 38687 - DNA, 201 bp, Bos taurus
gggtggcggccctgttggtctgctccatacccactgtccccttctccttgctaccagaacctggttctgtacagtgctagacacgcatatgctccaggagsgggggcctccactcgagagggagcttgcttatgtgcatgatacggagcttccctcgtgtcctactctttgcaaccccatgggctgcagcacgccaggctt

SEQ ID NO: 38688 - DNA, 201 bp, Bos taurus
agcgcccatccgtcatccctgggaggcccggaagctggtcagcaggacgaccttcctggagcagctacacgtggcgggtcatgaggactcacatagggcaygcctggcccaaccagccatccagcagcttagcaggcacctgttagtggcagcaaactgtttggggtctttacaggtaaagctaaaccttagcaggcccca

SEQ ID NO: 38689 - DNA, 201 bp, Bos taurus
gtttccccgtctatttgccgtgaagtgatgggaccggatggaaggacacacacaaaagatggcaccttcgggcagtggctgtggctggcctgaatgccttraaagtgcaagtcgctcagtcgtgtccgactctttgtgaccccacagactgtccatggaattctccaggccagaatactggagtgggtagccattcccttc

SEQ ID NO: 38690 - DNA, 201 bp, Bos taurus
atgctcagtgaagaagccaaatgtaaaaggccacacgtggtacgagtccattgaaatgaaatgtccagaagaggcaaatccattaggacagagagcagacrgggcagccggggctgggccatcacacctatgggattccttttgggggacaaataagaccctgatgctgggaaagactgacggcaaaaggagaagggggtg

SEQ ID NO: 38691 - DNA, 201 bp, Bos taurus
cagaggggaaccaagcacctcagccaaggtcatgctgccgcaggaagggccgtggcccagggtcggggtcagggcactgtgaccgtgctctcattcacacygtctcagagataaccccacggaataacatgagaaagcgtccaagggccccctccctgcccaccacccctggccgggatctaccctttgctgaagctctcc

SEQ ID NO: 38692 - DNA, 201 bp, Bos taurus
accacccctctccctgctacttgggccagcagggcccactcctctctcatttgacagatcaagaaattgagactgggaagtagtggggtaggggtgacgcraagcggtggctcagaaccagtaggccggtggactcgagccaggacacgcccaagtactcagcagggcgccagtctggggacactccactcgtcactctgt

SEQ ID NO: 38693 - DNA, 201 bp, Bos taurus
tgctcaagcctggccgctccctggccgcctgcacaagccgggtgtcacggctctgtgcctgtcctgctctattccctccacccggcaagcccttcccaccytccttggcctaggtcactctcaatccttctgcaggtgcctccctgagcccctgggtggggcaactctcttctgggcacccccatgggttttcccagtggc

SEQ ID NO: 38694 - DNA, 201 bp, Bos taurus
agggtcagcttagccagcttcagcccggcgggatcccacgaccctgagccacagacctcggcccggagcccaggatgggccgagcccactcagtgcactamgaccactcagtgcagagacactcatgacaccagagcgcacgcgtgtgtgaaaacaggcacggccttgctcaggcaccaccacaggcagcaaggagagaac

SEQ ID NO: 38695 - DNA, 201 bp, Bos taurus
acggggagtgggaaggccgtggtccttcgcccgattccaggtgtgacctttgaaaggaggcggtgagcaggcaccacttgactgcagaatcacaccacccrgctcccaagcacctgccctgggactggggttggaggaaggggtgctggcccactgggtggcttctctggcctttccccactgacccaacaccccgtcggc

SEQ ID NO: 38696 - DNA, 201 bp, Bos taurus
gccgtgaggctctgatgccttctcaggcgggtcctgcttggtcagccatgggatgtggtgcgcccgagtgcccgggagctgtgggtgtaactcgtggcagygttccaggcccaaagacgactcaggtactaagagagacggccttcacctggtgcaccaccccagagcactgttcaggctcggctccgtgttagaactgct

SEQ ID NO: 38697 - DNA, 201 bp, Bos taurus
cttcccaaccccccggcgaagctgtgtgggcgcgcgggcggcctttttccgccccgtgggaccgcctgacgagggagggccgggttgctgagagcgtctcsgttccccccgcaccaccaccaccacctgggcaattccttgaccttcttccggggtccgcttgtcaaggggctgctctgaggcgccactggccgagaacag

SEQ ID NO: 38698 - DNA, 201 bp, Bos taurus
tcagggagcatagaaggtggtactcctcggaaggagtttctgaggccctgcacttttccatgtagggcctcagaaactctggccctgtgaggattcattgyggattttgggtggtcacccacccatcccactctacccacttctggagtggctggccccgtgaatgactcagttccaagagatgtgaccagttctgcacca

SEQ ID NO: 38699 - DNA, 201 bp, Bos taurus
gagtaccaggtaaggccagcacctctgcctagactcctggctggagggaagaaagcctccaggggcaaaaaggaggaagagaaaagcaaagggtgaccagrggtctgtccagggccaaggggctggccccggagggggatgcctgcccctctcgtcccggaaaaccccggaagaagagagtctgggaggcccgcctgtcct

SEQ ID NO: 38700 - DNA, 201 bp, Bos taurus
gcaccgggcgctcattccgtgagtcagtctgactcggcaccgggaggctgggggttcacggtggttgcgaatgtggtaatggatgcttcttcaacctgctyggccaccacgtcaccatctccgggtgtttgggggccgaattttgggagaaaacccaccactcctattaaatcctgtgagcgaggacgtttgctatcggag

SEQ ID NO: 38701 - DNA, 201 bp, Bos taurus
cacctgctgggttggttttaagaagtatttttgctttaacacccatgatgggagggcgaggctcccgtttcttcatttagcagatgttcatagagcatctytggatgccagtggggaccttgaggactcagcagagagcagatgggtggggccttgcttgagctaatgttgaaggcagagagcatgatggtggtgggccat

SEQ ID NO: 38702 - DNA, 201 bp, Bos taurus
tgtgggttctgagaaagctggagccggcccacaggtttaagacgacgctccccagtattctggacagtccaggggacccccggaaggtctggcccagtaaygtttggggtgagggagagcgtctgatgtccacgcaggcgcaccctcagaccagaggcgtggctcgggcaccgccacgcccggtcgggagcgctggggaag

SEQ ID NO: 38703 - DNA, 201 bp, Bos taurus
atgtggagtaccttctcccctcccccattccctccagccaccaccaaagtcttgcatcactagatatttggcttctggaggagaggggcctgtcctccccmacctctaccctgagctgctttctcatcagtgcagacccagagtagaagtgagccagtcctggcaggctgctccttgacacctcagagggccccattcgcc

SEQ ID NO: 38704 - DNA, 201 bp, Bos taurus
ggaggccacggggctgtccccagtcccagggggatcgccagcctggttctgagccccttctcccttgacaatggggacgggaggatcggcctgttttccgrgatccccaggacctcccgggacccctgggtggtcgtcgctggtgaagtccaggcagcgagtcaggaggcggattcgccgcccgcccctccaccccgggcc

SEQ ID NO: 38705 - DNA, 201 bp, Bos taurus
tcaatgtaaaaagaggtcttgataattttgcaggtccagaaaaaactctacctccaaagctgagctgtgtctcttcccaaaggaggatgagaacaacgggrctcctccaagaccctctcagactagaggaggtgactggaggctccctgcttatatttaaaaagctttgcttcctgtgcacctgagcctgctaaaaatctc

SEQ ID NO: 38706 - DNA, 201 bp, Bos taurus
ggtcagaaaaaggggaaccaaaggagcggatgcccagaatgccccagaatgccgggagatggacaagaaagatgctggagaggaccggctttgaaactgtyggcctagtgatggagtggggaccgagggtgaggatggggggcaggggacggaggctggaaaggttgcgggcccgggggatgggggtggcgctgagtgtaa

SEQ ID NO: 38707 - DNA, 201 bp, Bos taurus
ggcggggggttggagtgccaggctgggctggggtggggtgactggtgcccttctggcataccccggcgtggggtccagcctgacttggccctccccacgcygaccttctccactcactctatcctcggatgtgtagcctggttacccaacctgttaccccctgcctaagaccccagagggtcagggccgtggatccaaggt

SEQ ID NO: 38708 - DNA, 201 bp, Bos taurus
ctgagcgactcaacagcgattcaacacaccaggacattgactttgtgcgtgtgtgtctgtgcgattttatcacgtatgcagatttgtaaaatgtacttgcraggggtcgtctggcagttcccacaccggtgggtctctaaaagcttggcccccgtgggcttgcacatgggcccccagaggctgaggatgctggaggaggat

SEQ ID NO: 38709 - DNA, 201 bp, Bos taurus
aacagcatgatgtgtgtggcggggctgggaggagagcgctgcagagccggggagacgagtgatggagcaatggtggtctgtgatcaggaagaatgtagcgmtcagggctcaggcccagtagttgaggtgcatgggcttagctgctccgcagcacgtgggatcttcccgggtcggggatcaaacccgtgtctcctgcactgg

SEQ ID NO: 38710 - DNA, 201 bp, Bos taurus
tgccgctggtgtgaggaccgtggcccgtgacgcagagagcccgaatcccagagcgtccttgacgcaagtgaggcgcttcaaagaggccgctgtccctcagrcattttaaattattatgatgattttaaagaacataactttttttttaactgttgagccgcacagcatgtgggatcctagtttcccaaccagggatggaac

SEQ ID NO: 38711 - DNA, 201 bp, Bos taurus
ttttggcggggtttaaaactgtggatcccggcaggagcgccacctccgcggcggggaagggcgcaggaaagcccctgggtgggggaggggcgggccaaggraaaggttctagaagccacgatgccaaaagccgcgagtttaacgacggaccgaaatcccgaacttggcgcaggaagactccgagcgctcccctccccgtct

SEQ ID NO: 38712 - DNA, 201 bp, Bos taurus
tgaaattcatctacagttggcattccatggccttgagtaattcatgtgtcacagcatcggatttctcctaaatatgttgtactgagattaacatgaaaatyaatctgaattcctggggccacagcagccggcgggaagaagcaggagccaagaggcttcttctggtttacagagaagccagcttgggatttcaaaggggcc

SEQ ID NO: 38713 - DNA, 201 bp, Bos taurus
tctgttctttctggaaactaccaaacctccctccttgtgttctaggagagttgatttccctctgggttttcaactagtctgtgagtgtttctgttacttgyggccaagagtcctcggtcatgtgagctttgtattgttattccattttcctaaatgaggggtctgagttttagagatgccgagtaacttgcctgtggtcac

SEQ ID NO: 38714 - DNA, 201 bp, Bos taurus
tttggtgtcttcttttcaggacagaagagggcccagctgggtcctctaccttctctcttaggttctttgttcttaggtcaagaaatgggttctcctcttgyccccaggaggagagtaaagggcaagggtgctccagacaaaatcctgaagtgaagcatccagacaagaggtcaggctgctagagtgggtcctaaattccgt

SEQ ID NO: 38715 - DNA, 201 bp, Bos taurus
cccctccagcttgttgatgccccagctcaggggctgcctgctgacctgagccacttgatcatctccgtgacagcagcgcctgtggccactggcacccgagmgccagaaccagtgtgtgtgtgtgtgggtgggtgtgagtgtttgtgagtgtgactgggcctgtgtatttccatgtgtgtgtgtctgggtgtgtctgtgtta

SEQ ID NO: 38716 - DNA, 201 bp, Bos taurus
aacaagtgcccaggtggtgctgatgttgctggtccagggaccacattttgagaaccattgcaccaaaggatggatgtggccaggtgatgcagaaagcctcycactcccagctcgctaacctgttaacactgtgtacagaccaggcaactctccatgggcccccacgttccttccctacatctccccctggatgaggctgag

SEQ ID NO: 38717 - DNA, 201 bp, Bos taurus
caggccctcacttcgtttaggacttgaaatcctaagcgatcagatccagtgattaataccatccttggtagatctttcctggtcaggctctgctacaaccmgcaggatggggaggggccacctggggttcccctctgccttcagatcagaactctaagacgtcatagttgttcagtcgctcagtcgtgtccagttctttgc

SEQ ID NO: 38718 - DNA, 201 bp, Bos taurus
cagcatctgctcatctcctggtaccctgacctccggccccttaaaagccactccctgttgcccaagcgcaccacacaccttcccgtcctttgccggccttycccttctcctttaagatcacgctgggtaacttcctccatggggtgctccttgcatccccccgacactcttcccacctgcagtttgaggtgctcgtgtgtg

SEQ ID NO: 38719 - DNA, 201 bp, Bos taurus
ggggtcgcaaagagtcagacacgactgagcgactgaacaacaagaacagtactatttcctgggtgactcacctgccgtccaggcctggggatagttcgagyggaggtgtgctgcgaccctgggatcaggcaggggaagggggaagctgggtcatggcctccctcactctgccacctctgtgcccacagatctatttctggg

SEQ ID NO: 38720 - DNA, 201 bp, Bos taurus
aacctccaagcaccctcagcccaggttcaaacgctgcttgaactaaaggaggagacgtgagcccgtggagaggcctccacccttccagcagccacaggccrggcaggaaacattatttcaggataacgacgtccgtctgcagggctgagcaaagattctctgtcaaggaccagatagtaaatatttcaggattttgggggc

SEQ ID NO: 38721 - DNA, 201 bp, Bos taurus
cttcctgaggcggtctgtctctgcccccaccttcccttgctaaagaagatccgtctggcctccgttttctctttgccagcaggtccactgtgttaagtacygacatgtccgcaggacaaagtgtactaactacttaaagctggcttctgcccggaaggacccaggtaccaatttgcacagtaagtgtgagagaccaacccg

SEQ ID NO: 38722 - DNA, 201 bp, Bos taurus
tgtcatccttgcattttaaaagcagtcgctaaaaaaaaaaaaaataaaagcagtcgctgagctgaaagacaaagcaggatagatgaggccaactgacacaygtctgtccgccaccacatcctgccccttcccttcttcctttttctcatctctgattctggactctcctgaggctcggtcccctgcaccagctcctaccta

SEQ ID NO: 38723 - DNA, 201 bp, Bos taurus
ccaacccctcagtggtggagtcggaaaacggatggccatcttcccctgggctcctcccagcacgcgtgtcctcctgcacggatcctgtaggacgccctgcrggagagagcaggaggccggggcgcatacctgccccttctcttgacgatccccccaggcttgtcagtaacacccatgggtaacatttattaagggcccatt

SEQ ID NO: 38724 - DNA, 201 bp, Bos taurus
accaggcaagtcccaagcaagcgtccttcaaaggtggcgcctttaggacacacatctctgctgcttccccaaatcccactaaaaaatgggtgcagggcctygtgaacagcccactccttctgatagtcaaaaggatggtcaattgtaactggaccaggtgtctctcctgatatctgtgctttaaagggctgatggccagag

SEQ ID NO: 38725 - DNA, 201 bp, Bos taurus
tttcggtcacatatggagaataatcctacccttcttatatcacagaggtctttaggaaaaaagacggttcaaagcccagaaacgtgtaaaacgtatttccyagtggtttgaatgaaactcctgacccctcccgagtcccgtgatctttgtaacagagtgtgtgctcctctctgtacacccatttatccgtctcatcgtcct

SEQ ID NO: 38726 - DNA, 201 bp, Bos taurus
acgggcaggctcccggagggcagggggcatgttttattctagagcagtggttcgcaaaggggatgaggttgccctcagggacctttggccgtgtccagagrcaattttggttgtcacaactttggggaaagttgctactagcaactagtgggtaaaagctaaggatggagctaaccatcctctaacgcacgagctaggcgc

SEQ ID NO: 38727 - DNA, 201 bp, Bos taurus
cagtaatgctcggctgggtgaggacggaagctgcaaagacaatcttaaatgtaatttattgggcaggaaaataggttaggcaaggcctggcctcttcctcygtggatatcttgagcgggatgactgcatttgcttgcagacagagacttacttgggcagtatcttttgacatctggcctgggactaggaggaagttgacat

SEQ ID NO: 38728 - DNA, 201 bp, Bos taurus
cacttggtccggccttgcagatgagtccagagtctggatgaaaacaggatgtgggcccctgagaattgtcctaaagactgaaagcatttgcctgggccccrggcctcctgggtgaggttctgcctctgtcgcccagcgtcccttccccatgacgtagacagagaggactcttacccccgctggcagacattcactgacact

SEQ ID NO: 38729 - DNA, 201 bp, Bos taurus
agtatctcctaagcctcagcagatgaagcagatgcagttgatacagtcatcagtcttgcatttagagggaagacacacacacaaaagtacatgagcctgtrcaaatttgcttatgattgatgccataaggaaacatgcatcagagtaaggagggtctcaaggaaggacaggatgatgtttggggaggagtatgatgctggg

SEQ ID NO: 38730 - DNA, 201 bp, Bos taurus
cagctagttaacgagggggctgagcatggcatttggacagttctgagagcgcccccctgccgcgcgaggctgggtgacatcctggcctcgctgtcacgtcrtttacatgcacttctcttggctcagcctcggcacgccgcgtaaatctacagctgcagaggccgaaatagcatataaaattgaaggatttattttgaggta

SEQ ID NO: 38731 - DNA, 201 bp, Bos taurus
gcacttgggataccttcatatgcaaaacacgttcgaccccatccttgcgtggtgtatattctcctatctaagatcacagcgctggtaatgtggcagaggcrggtttgaactgggcacttaagaccactgcagggtagtgccacttgaagttaatttccacttcccctatgactgtttcagcataggttgtgatattgtgtg

SEQ ID NO: 38732 - DNA, 201 bp, Bos taurus
aaagctcttggtggggttgagagaccctagtgaagatgacaagcagtgggcaagactttgaggactggactgaagtcaccacagtggcgatcttttgcgtygcatctgtgacccactggtgactcctctgctttccccaggttgcatgtggagatgatgcatttgaaacctcatggagccagtggctttctgtggctctgg

SEQ ID NO: 38733 - DNA, 201 bp, Bos taurus
tgctccaccagtctgcagctcacccatctctctccctctcctcagagctccctattcccctgagacacagtgatcctgaactcggccagttaataacccckcagtggtagtgttgttgttgaaagttaaagtcactcaattgtgtctgactctttttgaccccatggactatagagcccatggaattctccaggccagaat

SEQ ID NO: 38734 - DNA, 201 bp, Bos taurus
cacttttggtcggaaacaaaacttgcttccgatcagaagtaaagccgtcacagcttgtgaaatgccaggggattctggatactgcctgttggcaaatgccmctgacaggaaaggcatctcattcataaagtgcagggtgggcttcggggagaatagactgtgcaataggagggggggtggcatttttaccaaaagtcctag

SEQ ID NO: 38735 - DNA, 201 bp, Bos taurus
cccaggcccctctcagctttgccagtgccgtctcagtgggtcaggcacactcacaccagagcttagctaacaagaacccaagtctgtgttgttgacttggragccttggaggcccaccgttccaagaaggaagggtgggcttttcagtggtgtgtgtgtgtgtgtgtgtgtgtgtgtgtgtgtgtacgcaatgcgcttggt

SEQ ID NO: 38736 - DNA, 201 bp, Bos taurus
tccccagtgagcctccctcccttatccctatcccacccttctggcctgggcttcctgtgttagacagcaacttctcaccatctgtccataaaattcttttkaatttttttattttttggccttaccatgtggcttgcaggatcttagttcccagaccaggggttgaacctgggcccctggcactgagagcacagtcctaac

SEQ ID NO: 38737 - DNA, 201 bp, Bos taurus
gcaaacagtgcagcaaaggtaataggaagtcttggaaagtggcaggcaagaagagattaaaatagggaaattcataggaattctaggaaagctctgttctrtttaagaagatattaagctagaattggcttatgtcataacctgttcatgataagaggaaatctttttaaaattcaatcctctaagcataggccttgcaga

SEQ ID NO: 38738 - DNA, 201 bp, Bos taurus
tgggatttcactaactcctctgccgctctgggtattttacaattaactgcctttcagttcactcatgctcttgggccagaagtgatcttgcccttttctcygtatcttagccacggtcagccaatcaaacatactccattcccactctagctcttggaacacgagacagggccaagttctcagcccaccgttgttttaagg

SEQ ID NO: 38739 - DNA, 201 bp, Bos taurus
tcaaccgtcttctgcaggtgagacagtccaggccacgaaaaaaaaatcatttctgaaattattcctcctttagggaaagccttctctgtgagttgacttayaggccatgacgtcaaatcacaaacagaaagaaaacaagaaagaaccctaggccctgatggatgctctgtcctttctcgggtctcttgagcccgcttcccc

SEQ ID NO: 38740 - DNA, 201 bp, Bos taurus
tttcagtgttgtattaggttctgccatacgacaacttgaatcggccataagtacacgtgggttccccctgctcttgggcctcccccacccatcccaccackccgtcacagggctggtttgtattctaaatggcaggtgtcggggtggtaggtttggattgtatcagtttagcaaaactggggccacacattccagaactga

SEQ ID NO: 38741 - DNA, 201 bp, Bos taurus
ctgcactagtggaatcaaatatacgatctgccctttgagactgcgggtgcagtcctaatcctgactcttacccccggggccctcctatacggcctggcccygccagccccctggcgtgagacagaagtcctcacgtaacgtccaatggcaacacctgccccttccgagaccgcccagtgctgtgctctggtggccggggca

SEQ ID NO: 38742 - DNA, 201 bp, Bos taurus
tgtttttcacacaaactaattttgttcgctctaatcataatgaaaactaaagccaaagtttcatgccacaaaaaaaatggggccagacatttttcttcttytttattggaatgtaactgttttaaaatgctctgtcagtttctgctgtacaacacagaggatcagctacctgcagacacaggcccctccctcctggctctc

SEQ ID NO: 38743 - DNA, 201 bp, Bos taurus
ggtcattttattcatctcattccttaacaaccacctacaaactcccaccctgaagggacgagtcctgtgacacttccctctctctttactctttgtctggytgctatcaatattcactttattcaccttatttcttaagaactctttaaagattgccaccttgctgagaagagtcatttgactcttcccatcctcttgtta

SEQ ID NO: 38744 - DNA, 201 bp, Bos taurus
tttctgaaaagagaaagcaaacaacctgtttttatgcacatctactcaggtttcattgctgtttcagatcctcctggaacccttgagggaaaattccagakttctacagaaggactcaggcgcttatctcacctctactaacaaatattgcttcgggcggggccaaaactcggggtgtcaaagaagtggagtgctctagtc

SEQ ID NO: 38745 - DNA, 201 bp, Bos taurus
taagaggaaaattctcacaaaaactgctttatatattagaacatgtgtttagttaatgtataaagaagaaaaaatgtgattacttcatataagagattatycacattggctggatagacttctatttgcaggacttgaattgtttgtgaatatcaagtttaacggatgcgaattatttgagacctcaaagctggtgttgca

SEQ ID NO: 38746 - DNA, 201 bp, Bos taurus
ggtggcttctctggtggaggcacacgggctggctgtggccacgggcttggttggaacaagaccagggactgagctcatgtccccggcggtgactggcagamgaagcactgggccaccacggaagtcctcaattatcctgaagtgagaaattacctttgaaactatcggcttctttcttatctatacgttcttttaaaattt

SEQ ID NO: 38747 - DNA, 201 bp, Bos taurus
tccctattgttttcgaccctttaagtggctctgtttctccattcatttgccacacttaatacgctatcatgctctatcacgggccccactcttgcagtctraaattgtgtctggttagaaattacagccagctccctaagacatagaacctgaaagggccaagatcctaaaggacatggagacgtctaaaatgacagagaa

SEQ ID NO: 38748 - DNA, 201 bp, Bos taurus
actgaagcgacttagcagcagcagcagcaggttatgtgtgagtaggagtgactaatggaagacagcagaagagacagatctttggagtaatgaatgcactygtgtgggaggggcagagtcttcctttgtttcaccgctgcttgtcgcgtgcacacacacacacacacacacacacacacgcgcgcgcgcgcgcgcggctct

SEQ ID NO: 38749 - DNA, 201 bp, Bos taurus
acgtgctgtggcccagcctgaccacgcgcgagcatctggaggtgtttgctgccgtgaaagggctgcggcgagcggacgcccacatggccatctcacggtartgtgcgcccatgaggctcctctgtgctgtcgctgacaaggagtggggagtagggggacatctccatcttccgggagcagcaggggttgagtggggatggg

SEQ ID NO: 38750 - DNA, 201 bp, Bos taurus
taatctacaaccagtatagtcaacccaggaaaatgctcttcaattatagtccgttaaatattcgaactccagtgggctgcgggaggaggtgactgcatgtrgacaaagcgcatgtgctacgaagcagcacagttccagcagggtgtgaagaaacgaaatctaccatcctaacagactcaattacccatcccatgcctcaga

SEQ ID NO: 38751 - DNA, 201 bp, Bos taurus
aaatcactatggccttgggtgacaaaggtgggattacagactgagaatttcacacgttgctttctgatttctctggggggaacctgttgaggtgaaaaacraaggaaacagaaaggaggccacaaggtacagggaagacaaagaaatgcaagtgagtgaaaagaataacattaaaaagatgaaataaaaaagaaaaaagat

SEQ ID NO: 38752 - DNA, 201 bp, Bos taurus
tctggattccttgcaacatttgcggtcacacctcggtgagccggaatctgggagtggtagcgccagggctgcctgaggggtcagacaggccaatgatgacrtcttgttacagctgggaagctgtggtctggtcatctctgtgtgtctgcctgtctgtatgttgtggaaggggtcttcaggagggatggcacagggcacaaa

SEQ ID NO: 38753 - DNA, 201 bp, Bos taurus
cccgatgaggagactgagtcttcatgaagctggattcctggtccgaagttcctcgtttagagactgacagagctggatgctgaactcaggcctgctgaatrtagcacacagatccttcacgggcttccctggtggctcaggcggtaaaaaatccgcctgcaatgcagtgacccaggttcgatccctgggttgggaagatcc

SEQ ID NO: 38754 - DNA, 201 bp, Bos taurus
cggcctgctgtcggtcacaaacagaagggactgccctgcggcctcattggaagaggagctccaggtggtggagtccaggcggtctgcacagcaagcaggtkgtctgaagaaagggccacggagcctcccctgtggttcagaaggtaaagagtcggcctgcaatgcaggagaaacgggttcaatccctgggtcgggaagatc

SEQ ID NO: 38755 - DNA, 201 bp, Bos taurus
aattataaacttaaaatggaagttgcattttataaagtttaatttccaaaggctgattaaagatttcagaactcgccaaagcatcaacagaattaaatcayttattaaatgcagacatactctgtaacctacagaggacttcacgtcactcaattctttccacacttactgcattctttaacttaagcgctcaacctccta

SEQ ID NO: 38756 - DNA, 201 bp, Bos taurus
ttttaattaaaaaaccgctagttatttttatttaaaatgcaaaaaaaaaaaaagttctttcattacaaaagacaaagctggccacagatctagcctcccaygtttcccagcccaaacactggacgtgaactttgccaccgtgtccaggtcgtgctgccctccgtgcgtctcagaccagcattggcactgactgtcctgcac

SEQ ID NO: 38757 - DNA, 201 bp, Bos taurus
ctgctcaagcacacttttcttgcatcaccaactggacttgcttcattctgctattaagaaagactgaatcttgcctaaaagcagtcacatccatgatattragtctggccctaggatccgagttagtgaacggcgatcatctaacataccctgacactcctccgctgactccagtctagacgtgcatcagtcagggctgcg

SEQ ID NO: 38758 - DNA, 201 bp, Bos taurus
gccccgtggcaggcctcgttagctgtccggggcagcttgggtctggcagctgaccagccctgctctggggagagggcgggaccacaagcctgggaagctcyggcctccttgagaggatggtacccttccttttaaagagactcctgaccatccaagcaaagggcccttcactttgaccttcctgccgggctcaggggtggg

SEQ ID NO: 38759 - DNA, 201 bp, Bos taurus
agattggccaaagtacgagcttagagctttaccacagagccttgaaatgggggtgctttctccctgggtaactgtgtgcttggcgcctcatccgaggaccrctgacggcccgctagagcacactccagagccagacgcaccaggtgtgtgggcgcggggtcttcccaccagatcagaagtctggcggtttattcagaattt

SEQ ID NO: 38760 - DNA, 201 bp, Bos taurus
gtgcccctcagcacctggaagcaaattagccacccaagccctgctgggcctgcccagctgtcctcttatgcccgtggcctctggatcgtccagtggagtcrgttatctgagctctgtccccttctttcagtccatctgtccatccgctcagccatccctccttcagcaaacatgtatgaaggcccaaccctgggctccatt

SEQ ID NO: 38761 - DNA, 201 bp, Bos taurus
atgtcttacatcacaaaaacaagttttcataggactaattcttccacttaccaattccatcattctggaaatgatcattctgggtatgatggaggcttttyccctttacagaaaaacacaaatgtataataatttaaacatacctaatatgaaagaacaataaccattttcctagtcccatgcaaaagaaatgtacagaac

SEQ ID NO: 38762 - DNA, 201 bp, Bos taurus
aagacaaagtaacagccactgaaatgtctgaagcagggatgggtaatgctttctgtgtgaaggccaacagtgacgtctcaggccccagccgtgcatctgtygcgactattcagctccgctgctgaagcacagaggcgtccgaagaaaatatagggagtgagtgggcacgactgtgttccatccgataaaactttattcact

SEQ ID NO: 38763 - DNA, 201 bp, Bos taurus
cagtaagaatgaaggggagggacttgcctggtggtcaaatgttaagaatccacgggccaatgcaggaggcacgggtttgatccctggcccatgtggaagaycccatgtgccttgcaacaactcagcctgcacaccccagctactaaagcctgcatactctagagcctgtgctctgaaacacaataagccatggccatgaga

SEQ ID NO: 38764 - DNA, 201 bp, Bos taurus
aaggtgagagtggcctcgaaatatggcgtggttagtttttatgggttgcgtaatttcataggttagtgagagggaggattattccaactgtttggggaaaragcagagactgggccactgcccacattttaggttggtctcagaactgttgcagagcctcggtatgtcatttagcttgctgatgtgttgaaagtgaaactg

SEQ ID NO: 38765 - DNA, 201 bp, Bos taurus
agagtcggacacgactgagcaactgaacgggactggactggaggccccagacagtatacagagcggcacacagtaggtgttcaagaaatcatttgttgaayaaagcacgcacattgtacctggccctcacaatacccttacgtggcagggatttacagattctgacagaagttcagagaggtcacaacgtgagcaatggct

SEQ ID NO: 38766 - DNA, 201 bp, Bos taurus
acacaggaaccacagccttcaggggctttccccctccccaagacacagagtagatcaggaagggaactgggtctgagggcaaaggggccctaagaccagargtctctaattctcctaggaaccctctcttgcccccattctaggctggactagggagtttggtaggccaaaaaattccctccctgaaaatatatttatttc

SEQ ID NO: 38767 - DNA, 201 bp, Bos taurus
gggctcccggggtgtgagacttgcagtgtccaaacatggaggacaaggatgaaaaagcaggatgagctgctcccactgcagaggcctaaattttgggctcrccccttgggctcctctcatcttctttccaggtctcctgagctcatctgtcacctttctccagtttactggttcctccccggcccttgcttggacacatga

SEQ ID NO: 38768 - DNA, 201 bp, Bos taurus
tacagcctggccaagcctggccaaccccaccacatgccacagggtgctgagaacagcacatgttcttctgcagaaagtttccaactgtgcaggtgggtccyggccaaggaagcctgagaggagccaggtggcgaacagcccgtgctcataccctcagggctaagatgagacatgtctgcattctggactcagcatcccaac

SEQ ID NO: 38769 - DNA, 201 bp, Bos taurus
agaatgaaggatgatgccaaggttttggcctgtgcatctgaaggtttgatctgttgttacccgagagagaggggaagactgtgggtagggcaggtgtggcraggggccagatttggacatgttaaatttgataggcttataaatatccatgtggagaaacccaatagacaattggatatgtaaatctgggcttcggggata

SEQ ID NO: 38770 - DNA, 201 bp, Bos taurus
cctcaaacaaagatatacatgtatttaatcttcaataagatttgagcccaagaagcaatttccatattaagagaatggccttaaacaccagtcttttcagytgtgggcacagaaacaggtgttttgaagtcagtctctctctgtctctctctctctctgtggaatggccagtgaggaatgggcagaaatcaggatatggag

SEQ ID NO: 38771 - DNA, 201 bp, Bos taurus
gtttgggcatgtggtgtcagttccagcctgccgggagtcagagtaattcctttactggagctgcatctcctgggctgacggtggcccctggggtcagcatmatcacaggatgagtcagacagttgccgcccaccagtcctgctgctcctctgagtttgagtcagtaaaaaccctctgattaatactaggtgacagaaggcc

SEQ ID NO: 38772 - DNA, 201 bp, Bos taurus
cctcagctaaaatcttgctgactctcagaaccaagggccctcatcttgtggggatgctgggtttgataacctgtaaagtaggtgactttctgattgaaaarccactgattctgttgtggcctggtctggagctcccacaacttcagtggttcgtaaacaaggcaaacatccactgtctttccacctagcaaatataccttc

SEQ ID NO: 38773 - DNA, 201 bp, Bos taurus
aaactgaggccttgggagatcaagaaacgtagtcaagattacccagttaacaaacagcaagtcggggatttgaacctggccccacccaacttcagagtccrtgtttttcatgtcctattgccttgtcccaggtatctcaatctggggttcagaatacatggcctccctctggatatgtaacatgcaaatatgtcacaacat

SEQ ID NO: 38774 - DNA, 201 bp, Bos taurus
taacggcagggacacctggaacctatgcccggaagaggggaatccaccggcttgcatttagtcagcgcgtgggttgccttgagccatctgactgtgctccrttgagggaaacttggaaaggaagctagggaaatgatgaccctccctgggtccttacagggagcccctttgatgagataaccctgcagggtccctcttcct

SEQ ID NO: 38775 - DNA, 201 bp, Bos taurus
cagacaaccaaacagacataattaaccaaacagaaccaaacagacgtaagtagtggtttactactcctcattctttctttgtatttttatgcctggcatcrgagtgatggtttctgaagccatacttagcatatcttctcctgtcatgaatagcaaagctggagcctcactgcacaagggttgaatttctgctctgcaaat

SEQ ID NO: 38776 - DNA, 201 bp, Bos taurus
gagtcacctctcacagcgggagagtccttctgtctgggtggcaaagatgcttgggtcactctgctctcagtcaaagctggccttgaacttgcttggacctkcccttccttagtcatctacgtgtgtgtgtgtgtgagaaagagagagatgtgtgtgtgtgcatgctctgtcagttgggcccgcccatttgcagtcccacgc

SEQ ID NO: 38777 - DNA, 201 bp, Bos taurus
ctctccacccagaacgatcacacttgagaaggaaccataatggaggtggcctgggtgtcatttcccaccccagctcccctgtctcccaccaaccttctctstccacccagaatgtacatgaggccagctaatgaggatttcagccccagtctccagagtttctcctatagaagacagggaactggagtactatcagagtta

SEQ ID NO: 38778 - DNA, 201 bp, Bos taurus
agtttattcagtaacacatgtgtttctcacttcatagttgtacatataattttgactaatgcagtagcacccctctcttgtcatttactaagattgtacayagttcttcagcagtcattagtgtaaacaagaatagactttacatttcttttaaaataaagaatgaactgaatgaaattaaatcattcttgttggctagca

SEQ ID NO: 38779 - DNA, 201 bp, Bos taurus
taaattacttgatcagggtagtgttctgtttttacattgctaatataaaggctgcatacttagccaattatgatttcatagttttgtgatagattaagagkatatggatacttatcttaccaggtaagattttttttttaatttctttttgaaaaataattgatttgttgttaattgctcataaagatttcaaaaatcttg

SEQ ID NO: 38780 - DNA, 201 bp, Bos taurus
gattctcctccacccacggctgcagatgggcctccccctgcctggccttctccaatgggtgccccagcaggcgacgcagcacctggtatataggatgtgtrcagcaaatacttactgctcgtcggctttgtacttgctgctgtgttaagggcatcgtgtgtattcttctcatttaatctttacttcggggacatccctggt

SEQ ID NO: 38781 - DNA, 201 bp, Bos taurus
ttcatcatggcccttcagagcctgctgatgatgcccctgccctctttctgattaatctccttacgtgccttctgtgcagaaggagtgtgcttacctctaaygtatcagttagatttgccctggcctcagggcctttgcacttgttgcctggagtgctctttttccaggtctttgcattttattcttcttaccgctccagtc

SEQ ID NO: 38782 - DNA, 201 bp, Bos taurus
tggatcaggtcactgttcagcataaaagcctctggtggcctcccatggttcctaaataaagcagaaacatggcaccaggccctataaaaattgggcccccrttggcttcactggtggctcagctggtaaagcatctgcttgcaatgggggatccctgggttgggaagatggcctggagaagggaaaggctaccaacgccag

SEQ ID NO: 38783 - DNA, 201 bp, Bos taurus
aagcagggatccatgacttcccccatatgttgtcccctgagcccagtgcagggtataactcacaggctgcatctgcaagatggcctggaaatgcttccaargagaagaacacggtggaagcaggagctctctaaatcacttaggaacagctcattcccaagtaatacaaaactaatgaattaagagagcatgtcggcccct

SEQ ID NO: 38784 - DNA, 201 bp, Bos taurus
gggcacaggcccctcagacgcctgtcagcaacctttgagacacacccgtccgtcccatacgggggtccaatttgccacctaacttcagagcgcagagtctkggccactgaaccaccatggaagtccccataattctatatttcttatccacaaaacttgtataaaactctgctacttgtttttttaggcaatctttatttc

SEQ ID NO: 38785 - DNA, 201 bp, Bos taurus
tggtagccgggtgaagggtcactgcattttgactctctgaccacgctctggccattcaccctcccaggctgagggtcacaaagcaaaatggcagggccccmgggtaacctcgctacacactccctgggtggagaaagcgtgagggcagagaaagaggggaaaaaagagatggaagatgtggaatgaaggttcagaagattg

SEQ ID NO: 38786 - DNA, 201 bp, Bos taurus
aggtgccttcgtgtctcctggggtgtgacacagcagtgtctctcctttccctgtgtggcctcagtgggaccagtctctgggctcatgtcagggcccctgcmcaacacaggaggcaggaagccccatggcaggattagcatgtgccggggagacacacagaggctctggggtgacgagcaaggcccccccgggccaatccca

SEQ ID NO: 38787 - DNA, 201 bp, Bos taurus
agggcgcctgaggccagagaatggcctgcaactggcaggaagcccaagtcaaagatggctctgcgcactcagctgttcgagtcctagaaggtggcaaaaayaccagtggccatgcaggaatcccagtctctgccagggtggccaagagtggcaggaccgttgagagggatgtgcggttctggaaccctcacccagcgtcca

SEQ ID NO: 38788 - DNA, 201 bp, Bos taurus
atgaacctgcacaaacatatttgtctctttaactggcaggggggaaaccagaccccctccaaggtataagtagtattaggccccaggtatgcctgctcccrcagagggtagaggagactggcaggctgcagtccctgaggtcgcaaagagctggacacaacttggcgacaacaacaaatgcctgctccagagtaaaggcca

SEQ ID NO: 38789 - DNA, 201 bp, Bos taurus
tcaagattgttggatattaagacatgatgttttgatagtacctggtgcaatgtctgacgtagagtagtcatttgataagatcatagctgttgatactgctyttggtatgttttcgttagagtccagacaacaggaagagctcgctgggtgtctgtgaaaccctttccccagatgcccagtaggtggcggcagagactcctt

SEQ ID NO: 38790 - DNA, 201 bp, Bos taurus
ccatgggacgctccactctgcctcctctctcctggcctcagagctcctggctggcaaagtagagagatgctggcttccattgccttcccaaaaaaggctgsggtcacccctggccaccaaaaggcccagtcgactgaagaaaaccttcagaagtgggtgcccttgctgggggctgggaggacaagagagacttcattttcc

SEQ ID NO: 38791 - DNA, 201 bp, Bos taurus
gcactggccggtggattctctaccactgatccccaccatcatgttcaaattggtaatttcatgtaagaccccagatttctttctggttttctctgatctgrctgcccttcttctggccacaggccgagctaggaggctttctcccctctttaggtgggctgtggatcctctggttgccacaggctccaccggtccacctct

SEQ ID NO: 38792 - DNA, 201 bp, Bos taurus
agcaaagtgagcacacagggagagcagaacgtggagccagtggccgctgtgcactgccgtaggttcgtgcggatcacccttggtcctgaccccggaagtcrggtcagatctgcctgactcactcctgtgctgcacgctcaagaggagccaaagatgcacgcactgacacagacggtcagcaggcaaaaaaaatggaatgtg

SEQ ID NO: 38793 - DNA, 201 bp, Bos taurus
ggctgacctggtttcccactggcctcagaggagagtaggaggtggccttcagcccctgcctggggggacacagccaggccggccaccaggaggaggcgtgkcttcacagctcatgtgtgtttctcactgcagacagggtgggctcctgcagccctgggccctctctgagggggaggtggggtctcaggaggagtgtgctga

SEQ ID NO: 38794 - DNA, 201 bp, Bos taurus
cctacagaatgttccgcaatcggctactttctttcctcttctttttttgaaaaatttattttattgaggtatttgagcttgatttactacgctgtgttaayctgatctacttactttccagttgcatagcctcagttcaggtccttaacctcaaggcactgttgcagaaattaaatctatagtttgtgcaaataaattata

SEQ ID NO: 38795 - DNA, 201 bp, Bos taurus
atatattttttcacacctgaaaacttgaagttccctttcaatctagagattcttgctcttcaagtttgggaaatattattttattttgttgatgaagcgcycctcctcttctttatttgtggtactcttgtttgcaagtcagacttcttggactggtctccaagttattttctcttttcttccctgttttctttctttttg

SEQ ID NO: 38796 - DNA, 201 bp, Bos taurus
cacaggggcagacaccccaaagcacaccccagttctgggccctgtgactttgtcaccgcgtgtaaagtccccttggtggggtggagtgctgagtctgtgtyttccggggtgcccttcatcctcatctcttctagtctctaggggaatacaggtgggacaggaacagtctctctcactcccaagctccctgagtcccactct

SEQ ID NO: 38797 - DNA, 201 bp, Bos taurus
gcctctgctgactgtgtgtggggggaccagcccaggcaaaataggtcagttccagggtctaagcaaagctgcagggctagcacggagtcactggtctccamgcacaggcccagtgccctgggtcaccgccttactctgccaccgtacgagataagaatggacacagaggcgtccctgcctcctcaggtccagccttggcat

SEQ ID NO: 38798 - DNA, 201 bp, Bos taurus
aggatctatgattcaaggcagagtgtcttcagggcctgtggactcctttgttctttatgttcccaagcatcccgtttccttccgtctcactgctttgacaygctaggcctatcagtcctgccttaggctgcttccctcatggtgcccaggtggctgccacagcccagtcatcacactcagttgcaacaattttttgacata

SEQ ID NO: 38799 - DNA, 201 bp, Bos taurus
tctgttctctatgtctgtgtctctattcctgccctgcaaattggtgccaggagagttgaaggagacatccttatctccaaaattcttcccttttacatagwatcaatatttcctcttttttaaccccaatatcttaaattagggaggaaaaaaaaatctgtctaaaaccttgtctaagactcttataaggactcttgtggc

SEQ ID NO: 38800 - DNA, 201 bp, Bos taurus
tttatattttaaatactttctaggccaacactgtatatgtcaaacagttctgtctgttggaagatgcaggccttaggccccacttgtttgcaacttctctrttcgttataaaggactaatagtttagacttcattctatcagtaaataggcaaccattggccattttatacttggtagtgacaggatcagatttgaacatt

SEQ ID NO: 38801 - DNA, 201 bp, Bos taurus
aaaattttatgtcaaaccacgtgttttaatcccaccaggccagaatggaaaggaaggggacaaggtcagtgttggagtttcatcaacaagcttagcccccytctctaccacccactcccccagctccatttcttcaatcaatctttattaagaacataggtttgagtccacaggaacaaattcttctggctctttaaggaa

SEQ ID NO: 38802 - DNA, 201 bp, Bos taurus
attatgctttcttctgctcctcgccagggttccctgaggatggggtttaccaaactctgtcagttatcaaccaggctcctctagaggagtgtgaatcatcrccaacttctctgacttttaggctgatgctcatcctattctggtgaataattttgctgttataattatgtgaatgtagggctaagctagaggggtgtctta

SEQ ID NO: 38803 - DNA, 201 bp, Bos taurus
agactttctcagagagtaataatagtctgctttgaaatgggcgtcccctatttcaaagtcagacagggcacaaggccgagggccgtggggagcctcctgcyaatgctgggacttggaaaccaggcgagagagagcggatccgagaggatgggatttcactcgcccttgtaactatggatgaaatgtgggccagtgtatgga

SEQ ID NO: 38804 - DNA, 201 bp, Bos taurus
gggccgggggagggctgggaggtgtagcatgtcacctccggctgggtgttcacttccagagagaatctgacactcggggaggaagagcacaaacctctgtmagggccccaggccacactgacttcacaagcctatctcacaaaccacacgaggaaggaaagccatgccatcctcctttcacacactccaaaagaggagtga

SEQ ID NO: 38805 - DNA, 201 bp, Bos taurus
agatgcccccaggaaggggtttgaccctgggcaaggccgtccctcaacagctgagatgcattttgatgctgttaatatccctagcagttggggatggactrcttgcgtactgaagtggggccatctggggaccccaccacagcagtcagcacagatattagtcccctttttaagaattaatgatttgcccaaggtcacaca

SEQ ID NO: 38806 - DNA, 201 bp, Bos taurus
gttttgctgacattttgtagacacttcttggctgtaatccctcaattagctgggcatctatcaagtagttttgtgttctgaatatttttctaattaatctytgctgtacaagacgaaatcaaaaaaattttcttcgatcgagatatattacatcgctgacttctcttccatttactgggtctattactctgtcatagaaat

SEQ ID NO: 38807 - DNA, 201 bp, Bos taurus
ggcaggggcccgtggctggctgctagccaagagaatagtgaaggtgatggatggcgtcacccccgcggttacgttgcaggagagagtctcccattggcctkaaaggtggaagctgccatttgtgagaaggctcaagagaggaccacgtgcaaggaccctaacgacagccagcaagaaagtggggccctcagccctacagct

SEQ ID NO: 38808 - DNA, 201 bp, Bos taurus
caactaaccatgtgattctttttccattttcattccatagcaccagtccctctatagcccacagaaagagattgggaagagagttgttggaaatctaaatktgggggcagagaggaatgggtatttgacagggagggtatttaaggaagggtatatttcctttccttaattcaaatggggagtagggaaactcccaaagga

SEQ ID NO: 38809 - DNA, 201 bp, Bos taurus
tggaagtgcccctggcttatgtaactgtggggactccagctcggctacaggacaaacaccaggcatctggagccccgaggtacaaggccatgtggccccayagaggtcagtttcttaaaagggaaaggaatctatacacagatactagcaagaaactcggttgagtgaggacatggcccatgttgggaaggaatggaccat

SEQ ID NO: 38810 - DNA, 201 bp, Bos taurus
acctcttatgctaatgctgcggccagcctcatcatcttaccgccagcttgaacccaatgttccttggtggatgggtgatgctggtagtaaagcaaatccakatctgatggaaagtcctaggaggccacatttttacctaacatgggttcttgaacttatcttctgtaaagatgttggtgacaatggcacatcttccaggac

SEQ ID NO: 38811 - DNA, 201 bp, Bos taurus
atactggcctttcccaaagagataggaacgtagaacctaaaaagcctatgttgacagggagggtttgcacgcccttttgaacagaccacgtagaggcccamggaggctacagcttctctggacaccatgaacatttattcaggttcaaggtcccaggagacaccacactggacaaggaagcaagtctccactcacagaggc

SEQ ID NO: 38812 - DNA, 201 bp, Bos taurus
gggcgtggattcgggggtagaaggggagtcggttgggaaccctaactcattagtcctagaaatcagttatagatggaaactgctgggccccacccagtcaktcagttcagtcgctcagtcgtgtctgactctttgcaaccccatgaatcacagcacaccaggcctccctgtccatcaccagctcccggagttcactcagac

SEQ ID NO: 38813 - DNA, 201 bp, Bos taurus
gcaattgtcctgcaataattgtgttttttctattaaaaaaaaaagaatcccacccatctaaatgactggtctaaactgaacccttacagactcctaaaccracaccccaaaccgtctttgagagacagcaatcaaaattcagaacctacaagggagtactgaggcttctgaggacatgttagaaaacagagcattaaaatc

SEQ ID NO: 38814 - DNA, 201 bp, Bos taurus
gcataatcccatcagacggaaataggaacaaagtctaaaacttggctgattaaatcacttttcctatcaacatttattgtgatccttcagggcctccttckaagcattggggattcaaagatgaataaaaaaacatggataatgctaattttggtaggtagcgatagttgaacaaatggccaaaagaatgcctacataatg

SEQ ID NO: 38815 - DNA, 201 bp, Bos taurus
tgattacgtcagctgaaactacgcgtgacacacacttccgtttctgcctgagaactcatgcagttctccacaccctttactcatcagggacctcttacatytggcaactgcccactcacacactgggggaaatgcctatgaggacggaaagaaaggaaaacgcactacaatcctagaaaaaaaaatgcactgtccggctct

SEQ ID NO: 38816 - DNA, 201 bp, Bos taurus
atgtccctaagatttcacacttggattatatttcaattcagaaaaaataaataaataaaaactccttaattataccttcaacttgagcttatttcaaccayagcagactcctcagttaatatgcttagtaaatgcttgtccttccccgactcctgctaatctgacctagctagagcagaatgaggcaaaattggctgtact

SEQ ID NO: 38817 - DNA, 201 bp, Bos taurus
tttctcagagtatgcttttggcagcaaaaaaattagaataactcaaaatgatcattatccaaaaaacagttacaagccaccccccacccccggcccccgcrcttttcaaattcttaggttctctgcaaggttgaagacatctgagtggaaataatgttcagattataaaaagcagcagcacatgagtgaaatcaggcagaa

SEQ ID NO: 38818 - DNA, 201 bp, Bos taurus
aaacaaaccatgcacacacttacctccattttctgatttttccgaaataccagacagtttccaaaaggctttcatctgttctgcattcctgtaagaacaamtatcttcagctaatgtgtctagtatgatgccttccttgtacatggatgagcacttcagtaaatacattttaaatatttcactagaactagtgctaaattt

SEQ ID NO: 38819 - DNA, 201 bp, Bos taurus
tcagtcatgatgggattatttaaaccaggaaagtcaacaaatcttacaaatcgggctttggcttttttttctagagagccagtttaccagcacatctctgratacacttgtcaaacttcatcaacacaagattcagaaagtttcctatagttctagcagtgataaaggtggaggataaaatagtgtcttcaattactgatc

SEQ ID NO: 38820 - DNA, 201 bp, Bos taurus
ggcaacaataaggatcagagctctaaaaagctgctaaccattggcctagtcccatggtttccaatccactttggctatggcatccttcctccaaagtccaraatgcaaaaaaagataaaggcccaggtgctttggttggaacaaggggaagaaagtaaatttaacccaatgtattcccctttccctgtcttcccgcagcac

SEQ ID NO: 38821 - DNA, 201 bp, Bos taurus
tggccactcccaccccaccactgatcacctgatgcggtgggaggggaggacaggcagtcctgggaggacacgtcacgtgaacaccaaccaatccatcactyggcagggtgtcctctgtgggccgcagcctgggctctgggcttcccgggactgagcctgcctttccctcccttctctttttttagtcactaaaagggatcc

SEQ ID NO: 38822 - DNA, 201 bp, Bos taurus
tggtgttcccacacccatgccaccccagctgctgaaggctttgaagtttctagaaaagccatctcctccatagtgacttgttagggatgggcaggcctgarccagactgggtctcttctgcagtaggaccaactgtcctcaaacagtagggcagaatgacagaaggaatcttgggtctcggctgatatcatggcgcctctg

SEQ ID NO: 38823 - DNA, 201 bp, Bos taurus
gagactggtattggtgggcagaagatttcctttggaaaattcttggaaacaacacttttggaagggaaaagaggatgcaggattgggcccaaggagcccayaggctggaaaccacatcagagaaggtttcagcagctccactgggaagctcagaagataaaatggcctttcagaggggtcattggttggggcagaggttgc

SEQ ID NO: 38824 - DNA, 201 bp, Bos taurus
cttcagatagactctgaagatgaggtaaaaggaactacttggttttggtcttttgtttattggctgttgtacatgacaataccgatatatattaccctaartggaaacttgttcactaatcatttgagtaacctacttgatcatggcaagttccaagattcaccaaatgtaggtttttggtgtgtaaatgccatatgcaca

SEQ ID NO: 38825 - DNA, 201 bp, Bos taurus
ccatgtgcagcacctggcttctgcagtacctggtggccagcatcacttagcacccccatatagaaggcttcctctggcacccccaaagtttctaagcaaartgctccaagcttacaccttcttgggttgcagctctttaatttagccaacctttgttgtccagggccgtgccttctctcttgaggtccagacctcagtcct

SEQ ID NO: 38826 - DNA, 201 bp, Bos taurus
ctatcccttctccagcaggtcttcccaacccaggaattgaaccagggtctcttgcattgcaggaggattctttaccaactgagctatcaggaaaggcccarcttcctcttaaaataactttattcccataaaataatgtttttgaaaccacatctggggataaaaagcataattgggtggttagttttaattttaaaatcc

SEQ ID NO: 38827 - DNA, 201 bp, Bos taurus
aaagacaagctggaaagtggtcactgtactgacttacctttctggcgttcgtgggaacattacggggagggagggaaaggggaatttttccttttcactcyatgaatttctgtactgtttgaactttttgacaatgcgcacgcatttcttatttaaggataaaacaaaataggcgaagaaaggaaaagaaaaactagaggg

SEQ ID NO: 38828 - DNA, 201 bp, Bos taurus
gaaaggtgacaatgattactttaagctggatttgcctgctgtaactcaactggtgaattaactgatcagggaaaactgaaagaaggccaaattctcaaccycagtatcattgccattttgtgcaggataactctgtgtcgtgggaaggctgccctgtacattgaaggacgtttagcagggcctctgtatactaggtgccag

SEQ ID NO: 38829 - DNA, 201 bp, Bos taurus
accagacctgtccatggcccaaccctgtttcctttgagtccccgtaacaaagaaggatgtgctttcaagatcatagatcatctccccatctagggtctgcytggcccaatgggaagctaagaaaatacttctgggctacttcactcaggggaaactttctgtttgtggaggacagcctccttggactctgctgatatagct

SEQ ID NO: 38830 - DNA, 201 bp, Bos taurus
aggactctgatgagtagacatcttcagtgattacagtaaatgatctttaaccaaaatgaagcaattaagttggtgataaaaatccaaacaaccagctccaytgggatgaagaatagaagaaatgggaagtttcccacaagggaaacttgtatgtgtgtggtgatgaagaaaggcaagagtccagaggaagtgttcattttc

SEQ ID NO: 38831 - DNA, 201 bp, Bos taurus
gattaattttctgttcctccaactgggcttgctgaaaaggagcttgagtaatcccagtctctcttactgctccccaaaatgataaaacttttctataaaartatttgattccctttctactgtcacttctgaatttgatttactgtttttttgttttgcctccagacctaatttttggagtgcaactgcagaatttaaccc

SEQ ID NO: 38832 - DNA, 201 bp, Bos taurus
atgtatttgtctgtttcccaatagtctcaccaatacatgcaattttggggtattttccactaaagtgcaaaatgtgatcactgtactaattcaactttgtyttatgatgaatgagttagcaccttttcagttgtttagagccattcatatctcttcttttgtgtatgtgaactgatcatgcccatttattttactatcact

SEQ ID NO: 38833 - DNA, 201 bp, Bos taurus
acatccatctgcctacatgaaatgctctcttgaattcctagagacatttcaacttcattatgtataaacctggtcttatgaactccacttccaacattccygattaaagccagtcttctttcacagctccataatgacatcatcgcctatttggtaatgcaagcaacaacttagggaggaacctacacacatcactttcac

SEQ ID NO: 38834 - DNA, 201 bp, Bos taurus
cagattttggttgaaagtctataatcaaaggataaagggggatgctgaagtttcaaagagtacttttgtctggaaatcaagcctttgaactctgcttccarctgggccatagagatagagttcagaagcctgtagagagtagggagacttgtaaaagaacttctctccatggagatggatcataagaacctatttcctcag

SEQ ID NO: 38835 - DNA, 201 bp, Bos taurus
tctttcaggcaagttggcttcactccctgcaggcctggcctctgataagagtatctagaattttaaaagttcaaggagctaaggatatgctccagtgaaartcccttgggaacagaaacggggcccttcaaatcttggccttttctgcctttcctctcccctccaacctaagaatcaccagaggaagtctaaacatcacaa

SEQ ID NO: 38836 - DNA, 201 bp, Bos taurus
agtggctcagttagaataaagtagttaccaccctaggcctcactaaacagaaatgtctagtttgagacatttttaataatcatctcagcctcagttatccrtgataaagttttcgagcacagctccaatatcagcaattgatgaccttctggtttcaagggcttcaaagaagagattcaagctttgtcactctagtacaac

SEQ ID NO: 38837 - DNA, 201 bp, Bos taurus
ataaacaaatatgaggcagtcttctgagtttgactaaacaattgaatatttgagtatatggtgtaaatgtcaacagcataaaggaaaacagaaggagcatytggttgaaggggaaaggttatgacttgcgtcctagatatgtcctgctgctgctgctactgctgctaagtcgcttcagtcgtgtccgactctctgcgaccc

SEQ ID NO: 38838 - DNA, 201 bp, Bos taurus
ttcatttatattctgaaaatgagtgattggtttactaagcatagaaagcataaagttaaagcctttgtccatcgaaatcctccttgagcatctgtgctcartgatgaagataaaagatgaaatggatatattttctctcctctcagtgctaaaatctactggaaaagacagatacataaacagataattaaactaagtgct

SEQ ID NO: 38839 - DNA, 201 bp, Bos taurus
agttcccctaaccttggtgccagttcccaaaccatagatatagccagtgattctacatgagcggggattttcaaaggcctttcaaaaacgccttacagctytcaaattaatctgaccacccccaatttgcaaagaaaggagctgagtcatagagggtttggctgaccaactcggagggccaaaggggccagggtctgttag

SEQ ID NO: 38840 - DNA, 201 bp, Bos taurus
ctaaaatgaaactcactttaacagtgtcacctcatcattatttggttctctgtctgccagctagatgtcagcatggtcctggccctatgaagggactgggrtcttccatcttcctattcagagtcttgggcaaaagactaggtgtttaataaatttggaccgtttggtctaaggagctactttgccctgggcagagctatt

SEQ ID NO: 38841 - DNA, 201 bp, Bos taurus
gcagctccactgtaactgctgtggttctgagccactggaactggcgttaaaaaaaaaaaaaaatgctgttcatttcccaagtcagctgtaaaccagagtayagtacacaggggagggatcttcaaaggctggtatgccagaacgaaagcatcacagactactacaaacgcgcaccaacagattgttacaagggggccacgc

SEQ ID NO: 38842 - DNA, 201 bp, Bos taurus
tagaaacaatctcattttactcaaattacttttcctaacagctcgtcaaggcagtatgttctggatgaaatacaattggcctgaatataagtcttcttttwaaaaaatacagagacctacatatgccaatgacatcaacctgagtctatccaattatatagaaggccacttcctttcttgtatcaaaataaggaatttcaa

SEQ ID NO: 38843 - DNA, 201 bp, Bos taurus
gccacactaatgcacatttccattttatattcattgcccaagtaaccaatccacatggcaaatgtgtttcccctcatcagttcctaaggttagaaaaaaawtttaggcctttcttaaatttctagtactgcagtatttggcggaagaaaggatttgacctttaaagcctatttgtgaatattggctgaacctattcacaca

SEQ ID NO: 38844 - DNA, 201 bp, Bos taurus
atgacttctttgataaactacccatgtgtgtggggagggacagaaagatggaggaagcaaatggggaaatgagttttcccctcttcagattaatgtatacraggtatacatctgacacttcatcagcactcccggctggtgccccagcaggcggacactggctgagcatgtattctgccagctaccacgttgcttaggatg

SEQ ID NO: 38845 - DNA, 201 bp, Bos taurus
gagcataagctatgactctgtattattaaaaatattttgtcctttgcccagatcattatttaaagagaaaatgtttaaaagaccataggacaaaatcatgsggggaggaggtgaagagcaggaatgttggccttctttctatcttaatagcagtgtttttactagaagtaaatccttcctttccatcttcctcacctgatg

SEQ ID NO: 38846 - DNA, 201 bp, Bos taurus
ttttcaaatgctgacgccaagtgacccaggccaaaagtataattccttcctctatgctccctgctgaactagctcactcattccagaaacagttcccctasgcgttggcagagctccccaggcccttttctccattctgggtgctgtggataatcgcttcaaacaccctctgcagctcacagggtcaagtgcacactctcc

SEQ ID NO: 38847 - DNA, 201 bp, Bos taurus
gatcttctagtcagtaagatcatatgggagcttcagtgacaagcttctactttgctagtgatttcatgatcctgttacccactgtaattgcttaaatggcrttttaattaactgccttaaatgactttccttttttcctaaaagcagtatgtgttttagtttaaaatatgggccactggtgtttccgtttccaagatggtt

SEQ ID NO: 38848 - DNA, 201 bp, Bos taurus
ggaaggcttctgtttggagggccctctggaaggtggagaggagtcagggtgaagcctgggggaagagagcaaaaagtggctgttccagtcccacactggcygagtctttgggaaacgaggggaattgcttaactcccacattatcagcccacgtccctgccggagaagagataaggtgtaggcagatgacccaggagaaag

SEQ ID NO: 38849 - DNA, 201 bp, Bos taurus
cctatggtgatggttgaaaatttggacatctatctattgaacaaattatgaaatcttttcctttgtcttccaatatatgaacttctaatctccttgtcatyccttaaatcacttttattaggtttgcatacgcatcatttcagagaaggcaatggcaacccactccagtactcttgcctggaaaatcccatggacggagga

SEQ ID NO: 38850 - DNA, 201 bp, Bos taurus
ctctggggtactctctccacacagttaccttctggattcctgaagctgccctccctccttgccccttcacgttcatatgttcaaagggctccttgctgctkcaaggcccagacccaggtatcatctctgtgcaccagaatctttcccacatactttgaaataatccttctattaaactgttataaaaacatctgctttgga

SEQ ID NO: 38851 - DNA, 201 bp, Bos taurus
aagtgtatattagataaaaggaaagtttctcgggaattccctggcaatccagtggttaggacagggtacttccactgaagaggcctgggttcaatccctgsttaagaaactaaggttctgcaaaccatgtggcatggtcagaaagaagcaaagttttggtcaaacaattcagtgatgatggttatggttatgtctgcagca

SEQ ID NO: 38852 - DNA, 201 bp, Bos taurus
taaaacacagtggaattgatgttgttggacccgatatcacaagtgaacaatatttttggttgattcaaaacagtctcaaaaactcaaaatagtctgtaccrtcaaaaagagaatattgacaattctgcaatattttaaaaattattctagcatatcatgtaatcagaacatagaaacaaagttcttctgcttaatagcaat

SEQ ID NO: 38853 - DNA, 201 bp, Bos taurus
tgatcaaatttttcccttgaattaatactgaacctaccataacatcttatttatctcacttcatgggcccaaaagagcttcatccattactaattgtcaaytcaggtttgtagaaaacaactataaatcgattgccccagtggaagaccttggaatacatatgaaaaatatttaagaaactcattgcattttgtgtctctt

SEQ ID NO: 38854 - DNA, 201 bp, Bos taurus
gacagaccatataccaattctaaacaggatacaaagattttctgggataacaaagattagagtgaattttccaaatagttgactcagttaatggcctattycaaagtcctagacaaattcagtacaaatcagggttatttcatatgacaaagctagagaagcatttcagaataaagcatatttcccatgaactgaatgtgg

SEQ ID NO: 38855 - DNA, 201 bp, Bos taurus
tttccacctccaggggaccttcccaactgtacataaaggttgccatcatctccattacatacaagaggaacctaggtcttgagcagattaagtcaactttyccaggccatcaatcatgagcaaaagtctgtgatgtttccctggagaccacttcattcccaactggcagggaagtaacaagcacactacaagactcagttg

SEQ ID NO: 38856 - DNA, 201 bp, Bos taurus
tgcatgaaaattcagtgctcaaaataatcctcttcaaaatgaaacaaactggcactccctcctttttacttcagccatatattttcactttttattttgcwtctatgtattagaacacccttaataggctttatgtaatgctcaaaatcttttccaatacattttgaggatttggtattaagaaaaacttactcttcataa

SEQ ID NO: 38857 - DNA, 201 bp, Bos taurus
ggataacaaccttcttgtaatgcaagtctcagccaaaattccaccttctaaaagagaatttctacctatctcttgccaagtcatgatctcatcatctggtkttttttttttttttccagaaaactcactgtttacttgttgattgtcttccccaaacacccacacacacagagggagatctgaatgcaatccacaagagtg

SEQ ID NO: 38858 - DNA, 201 bp, Bos taurus
ttctgggaaaattgtacttccctgatatagataacaccccttttatacatttccttcttattccttcctggaatatggatttcatgatttagcagtcagtytgcaactatgaaagtaaagccagagaatcacagagaggttttagcactgacatccttgtgggctcagtcactcagttatgttcgaatctttgtgacccaa

SEQ ID NO: 38859 - DNA, 201 bp, Bos taurus
tgaaaattgatgccatactttcaggtgacacaaacttagaaggaacagtcaatgctctgaatggcagactgaaattcctgatccccgaggatagaaagtargcccaaaaaagtcaagttttaaaaaaagaaactatagagtataagtggaagagaaattaatcatcaactgcccttgcgagaaaagagctaagaattttag

SEQ ID NO: 38860 - DNA, 201 bp, Bos taurus
attatttaaaatgctggaaactaataaaggtgatagtggttttaaaaaaaaaaaaaaaactttattgggagtatagttgatttacagtgttgttagtttcmacaaagtggaacctgttgtacctatatctacttttttagattgttttctcatatagctctttacagagtgttgagtagagttgcttttgcaatacaggag

SEQ ID NO: 38861 - DNA, 201 bp, Bos taurus
atctatagttgtagtctatcccccttattaataactactgtttaatgagaatctataataaataacaagtgctcaataagtagggagacatagaatttgtyattcaaatcaagacacttttgagagttgcagggggtgatagtaataaccactctgggacaggaggtgcaaaccagggcttcccatgaccacctgggacat

SEQ ID NO: 38862 - DNA, 201 bp, Bos taurus
gattttacccccagatcacagcagttgagagattctcagaatgactgtgttaacatttattaagctcttacacttggcctgccattgttctcttagcgccycatttcaaccccaggtttgggggaaatagagttctgctgtgattggtaatgagaagttaggagccttggcaagtcgtggagttggagttaggatgtgaag

SEQ ID NO: 38863 - DNA, 201 bp, Bos taurus
atatagttagtttttgttgaggttatactggagtagcccctaatccaacatgactggtgtacacacgaggagaacgtcatgtgaacatgaaggcagaaatygggttgatgcagcgtaagtcaaggaatgtcagagatagccagcaaaccaccagctgctaggagagaggctttgagtgggttttcctttgcactgtcgggg

SEQ ID NO: 38864 - DNA, 201 bp, Bos taurus
aggccaggaggggagcagttcttgtattgatggagtcagagcctgaattctaaggtcaggatatagatattaaaactgcacactcatgggcacatcaaacyttagccatatgggcctttttgttctgaaggttcacaggtgaaattgacttgatacattttctttgatgtttattaaaccataattttgtagaatttgaaa

SEQ ID NO: 38865 - DNA, 201 bp, Bos taurus
aattgcctacttttctgtaacaagaatagctctatgctcttttcttacgttattggcctttgatgctcatccctctgccatgatgtgaatgttctaccggkgaagagtttctctatctatgatatcagtagaaacagttacaccttctttagagatctgaggtgagcatctctcaaatcagatagtccagttacacttttt

SEQ ID NO: 38866 - DNA, 201 bp, Bos taurus
acactaagcaatgggaaagaaaatatatctgcaagtataatttttgcagagtacaatctgcaaaaaattttttacttttaaaaagaactcatgaatttggrtggaatttgatgtcttttccacgtaaggttaaagtggagtctacttttgttctctccataaaattgaagcattttaaagaaattcaattaagaatctgtg

SEQ ID NO: 38867 - DNA, 201 bp, Bos taurus
caaagctactaatctttaagatttgagaatacagatttttatgtaagattgaccaactttatgtgcaagtttaaatgattttaaatgttgctgtgatagasatttccttgttgttctgaattacacacccactgccttgacgtgtgtgaaattcctggcccctctgaggaagggcttggccatgtgacttgctccaatgag

SEQ ID NO: 38868 - DNA, 201 bp, Bos taurus
agagcctgagcaaaactgacgtcatggtaatctatggagccgtggccctccatgcacctaagagtcaactcctaaccaggcttgatcaggacattgtatcycaagtcctatttctctacggccagtgctctcgggtaatagccaacacggggctacttcaatttccaagactggggttcccaaacattacaggggctcagc

SEQ ID NO: 38869 - DNA, 201 bp, Bos taurus
aaaaggcctcatactgcataaagaccaaacagaaacgagtgggaaggaaagctgtgtgggcgctgaaggggtgatgctggaatacaccggccaggcatccyctgaaggagggtaaccagatcagccagcagactgtgatgactgccaaaccgaaagtgtcgcagacacggatggccatagagttttatgtgtcactgcctc

SEQ ID NO: 38870 - DNA, 201 bp, Bos taurus
ttcatcatggatcccttcacatggatactttcttcacatgatcttctccaaaagacaaagctcttcattaatgtaaaacaacagtgattctcactaagacsaggcctatatgactgtaaagaatagagttcattataataattacttagtcccttattataacaattagtgcattattagaattactccttgtcaaccagg

SEQ ID NO: 38871 - DNA, 201 bp, Bos taurus
ttttgctcaaactcaggctggcttagccgtgttggggaaagggagcaattttgcctgaaagctacttctgggactacaggctgaggagggccgaggacaargggctcctgacctggaacagcttgttagcttctggctggtggtttgtagaggaaggtgggggtggtgaggaggtacgtgattaatcatgtagtcagtggg

SEQ ID NO: 38872 - DNA, 201 bp, Bos taurus
ttttgtaaaatgaaggtaagtagtatgttggaaaagtcctactattgtgtgaggacagagtatttggagctttgataactatctttttgacctctagggaraatgttaaatatataccaaggatggctgagcagaaaatttaaaagagtctgcatccttgtgatataattaagttattgattcagtcttaggatggcctct

SEQ ID NO: 38873 - DNA, 201 bp, Bos taurus
atcaatggagttatcattatcatcctcattaaatatttgtgaaacatctccatatgcatagtggcaggtatttaagcatgatgagaaaatgaaaagaaatrtataattatgatgtgtgtcctcaggggccttgaacctgagttgtgcagacagatacattatttatgaaactgtgaatagctgtccacataggatactgtg

SEQ ID NO: 38874 - DNA, 201 bp, Bos taurus
gcagatgcacagaattattctttctgtgactattgataccttcagtgtaatcgctttcacttataatgtactgtttttgatgatgtctctttctcaatacyggtgtagactcttatcttggatttgtatccagaacttgtgttttttcattgagtagttcccattatgatgaatattttgaaatattttgaaattatgatg

SEQ ID NO: 38875 - DNA, 201 bp, Bos taurus
ttcaggtcaatgattctgtgataaagatattatttagtgtcctaaatattcatggcattccccataactgaccccagctcttcacagttcttcatacttayggctaggataaaattcttttgtttccaagtgaaggatgtgggttaagcaggtttggaattctggagctggaagaacaaggagtgggtttagaacaaagga

SEQ ID NO: 38876 - DNA, 201 bp, Bos taurus
acagaaagatcaggtggcaagcaaggattgaatctttattgacagcattgttagaattgaatgtagggcattctatggggataaaccttttgttctatacrtggtaactattttgagtctgatttttctcatcatgatcagacatgatatcatatcagatatcatgaaaagacatgataataatatcagtttctctctatg

SEQ ID NO: 38877 - DNA, 201 bp, Bos taurus
tttaggggcagtacatgcacaaggtaagataacattgtaggtattaagtacttgaaaatgtacttaataaaggtgaagagagataaaggtaaagaaggaaytctggaaagagggaatatcatggtcaaaggcaaaaggatatagaaagcatgaaggtgagcagacattacaggcattttcatgttgaaagcactaatcgtg

SEQ ID NO: 38878 - DNA, 201 bp, Bos taurus
actcacatatctcccaggttagataattaaactctaaacccaaagatgtatgtgcttattgaacatccacatttgaatgacccatagaaatccaaatacarcatgtccaaactactccctcattcttattgatttctaaatcggtttttctctcggtagataatacaaccaatacacttctccaagccagagagctagctg

SEQ ID NO: 38879 - DNA, 201 bp, Bos taurus
cactattccagtgagtttctcagtgctgatattctcaaattcctcacattcagtcctacctaccttggaaaaggcctcttgtttataaaaatagtaatcgycttgtgatgattgtcaaagttaaattttaaaaatgtttaaaaattaattgtcattcatatatgtatttatgtgagtgctatgtcacttcagtcatgtctc

SEQ ID NO: 38880 - DNA, 201 bp, Bos taurus
agtccctctaatctttgactccttgctttactattgtacttgtgaactatatgatcctctgaatctcaattcctttactagaaaaatagggctgtccgttrtgcttcttccacagggttaggtatcagtgcttgaaagtacttagcacagcacctagcatctactacaagctcagtgaaaggttatgccttcttataccaa

SEQ ID NO: 38881 - DNA, 201 bp, Bos taurus
gttggtccccagtactgactgcactctaggcttgccaaacaaacgactgtaggtcactctacagtatttgcagtgagttttaccttccattcataatcccyaagtctgtaccacactctctgaactagttattcactgaagctggtctcaatggcaggtgagaaagattaaggtgtcatgttgttcagtctcccagttgtg

SEQ ID NO: 38882 - DNA, 201 bp, Bos taurus
gatctggaccccaagcccctcttccccaaacctgtctttggccagaagccacccatgaatacagaggatccccaggaagatgagagccccaccaagactgyggctccacagagagggcccctggtccccctggcagccaaggccaagtctggccctttgaaaccagccagggaagagccagagaataaagagcacggaggt

SEQ ID NO: 38883 - DNA, 201 bp, Bos taurus
ttgaatgcatcaattcagtgacttttaaaaatgtgatgacttgtgtttgggctgttttcattcattgaagtggcaagtttaatttggccctggcagacatyagtaagtcatgaaaagctggcatttacatgatgcccaagtgaagtcactgatccattcccaagaagcgagcttattcctccctgattcaagctccaggcc

SEQ ID NO: 38884 - DNA, 201 bp, Bos taurus
ctgtatctagagaactgagttattaaaactgttttcttcatgacccattatcaacctcagtccttatgagtcccctcttgctattttggtactttttcctyttcattttctgtaccacctctttcctcctatgtggactcactctattatactttatgtctttgcaatttgtttttcctttgtttatttagataagtatat

SEQ ID NO: 38885 - DNA, 201 bp, Bos taurus
ataacaactgaagtattttctgccttaatgaaaatttggaaattatgttgctgttaaaaggaaaaatttggacattttatatcattgtataatttcagaakgtagtgtccgtatcttttgggaaacatggtcatagcaagaacatagaattataagtaacctattactaagacacttaaatataaaactagtatgcttggc

SEQ ID NO: 38886 - DNA, 201 bp, Bos taurus
agtggtttataaatgggatggactgcagaatctgagagataaaagcaaactatgaggttgcctgctcctgcgggagattcacaactaagaagctgaatttytcaaggtttttctggtagactttttgtttaagccatggagacagtcacatgaaacatgacaaacccactcttcaaacaaactctttgccctgtaagaaca

SEQ ID NO: 38887 - DNA, 201 bp, Bos taurus
ggataagggcaagatatctaaagaggttacaagcagccttcaagaaaatctgcaattaaagatgggtcttaattcttaaggagggccagaggagtattcckgtttctttgcatgcaccgctgtgtaagtaagaacagagctagaaggaatgactgttttgtgcagtcttcctgagcaatagacaaatggtcatttaaccca

SEQ ID NO: 38888 - DNA, 201 bp, Bos taurus
ggcaacgtggaatcttccttgtggcatgcagagtctttcctggcagcgcccgggcttctctagctgcggagtgtggccttcttcctagttgtggcatgggrgctctagaatgtgggctcagtaactgaggtgtttgggcttagttggcccacagcatgtgggacctaccccaaccagggatcccaaccagggatcaaactc

SEQ ID NO: 38889 - DNA, 201 bp, Bos taurus
tactaccctggggctataactttttataggtctttggccctcctcttccctctcttgtcccaagaagctagtctaatcttataacctttcacccagatcaraatcgtgggcctgatgagcaagatcttttctaagtgaaataaaaaaataatgaccatctgtgtcatggtacacaaggtttagagattgcagaaaacacat

SEQ ID NO: 38890 - DNA, 201 bp, Bos taurus
cctccaaattctcattacacaggcttcatccaatttgaagaaaaattaacatacctggtagcaaacttctgactgcaaagacatgcttcccaggtcccatmtgaaccaccaacatctgttggccttatctgcttcagggcctggttatgtctatctgtaacaacagatactgtccttgtccttctatgcttattctctgaa

SEQ ID NO: 38891 - DNA, 201 bp, Bos taurus
accacatagtaaaaagaggtttctgtaaaagccttttcccaagcacgccaatgactccttgccccatcacataaagtcatttcttcccagctgccaggctscttctgaaagagctagagccctgccagttacagtagctggtataaaagctaatcttataaaacacacatcacttctccaaccccataattaagaccagaa

SEQ ID NO: 38892 - DNA, 201 bp, Bos taurus
gagctatcattacttcatgaaaaactcagtgaaggtctgatttcatgtgtgctgaattccaaccacactctggtgaaggccatatgatgagaagggacccragtgagtgagtgacatcatgacccaaatagagtcgctattcaaacgcgcaccgtggcctccttacaccatcacctaattatagctcccgaggaagcgttg

SEQ ID NO: 38893 - DNA, 201 bp, Bos taurus
gggaaactgatagactaagcacttctcagtgcaagaaatacagcactgaacaaaacagacaaacatcattgtctttgtgaagctattagtctagttatatrcattgattcattttttaattttctcatttcaatatctctttattgtgtgccctcaaggaacataggtttgaagaaacacaccaggaattagagaaacaaa

SEQ ID NO: 38894 - DNA, 201 bp, Bos taurus
agtcagagaaagttcatggaaaacaggtgctcacaactaaaaagtcactgttacatctagcctttagttacagtcataaaaaagtaactttcagttttctstagtaatgggaaacaggatagcagggatactgaaaatcctcaataatcccaaagtttccatttgattatgttacaaacttctttacctttaaaataaaaa

SEQ ID NO: 38895 - DNA, 201 bp, Bos taurus
gcatttcgttgtatttatttccctaatacggtattacatgaggactaaaatgtgtcatgtttttagaagtactcttaaagatgacagagctcatattcatyagtttcatgctttgaaatgaattaactataataacatgactctgtgttgagatgcttttaactaataatactttcaaataaataaaaggagttttttaaa

SEQ ID NO: 38896 - DNA, 201 bp, Bos taurus
tttgtatataacacaacaaaaagctctatgaagaaagatgtttagatcacttttatctattttaacattaaaatgtccaacaataggggaccacagtaaaycacattagatataattatgaatgatgctagtacagagagatagtgaatgtaaagaaaagagaatgcaaaatgacaattatacacactgtacgtttgtaaa

SEQ ID NO: 38897 - DNA, 201 bp, Bos taurus
tgtccattcagttggtgaacccttttttcttttttctgagcagtaggtctcaacagtgggcttaaagtattcaataaaccatgttataaacaaatatgctyattatcctggtttcttgttccatttatacagcacaggcagagttgatttagcataactcttaagggccctagaattttcagaatggtcaacgagcactgg

SEQ ID NO: 38898 - DNA, 201 bp, Bos taurus
cattattagtcattgagaatatgctaactgaaaacacaatgagatattacaacacattcactaaactggtcatgatcaaaaagagatcgtatcaaatgctrtgtaaaatatggagaaattagaacccttaacattggtggtaggaaggtatagccactttgcaacacagtttggcagtttcttaaaaagttaatttatcat

SEQ ID NO: 38899 - DNA, 201 bp, Bos taurus
atctgagagggaggctgggaaaaaaaaaaagtcctagcataaaatgcctagaattcactgctgagagcatagtagttattaaattaattattgcagaagaytaaaaagcctaaaggactaactaatagagaaacttataaaacttaccctacatctccataaaagggttatatcaaaagtttgaaaaagtttcctagatga

SEQ ID NO: 38900 - DNA, 201 bp, Bos taurus
caatatgatacctaatcaattttaacataaattaactagactgaatcactgtactactattttcagaacatcagtcttgcagaatgatccagaaataaagrattcttgggacttccctggtggtccagtggttaagatgccacacttacaaggcaggggttgcaggttcaaacccgggtcagggaactaagatcccacatg

SEQ ID NO: 38901 - DNA, 201 bp, Bos taurus
tctttttagctcctaaatcttctgaacattcagggggtgtagaacaatggagataagctggtgaagtccttcaggtgtctaagtctcagatgcagctcagmcaatttccttgattgcctggagttttagaggacattttggctaatgatctgagaaaattccttttgcttgctagatccttggaaataataggtcattttg

SEQ ID NO: 38902 - DNA, 201 bp, Bos taurus
gcaaagatatcatgtaaaactaatttttttctttattgaaaatacatctacaaagtaacgcttctcagtccacactgggtacaagtgatatgcagagcctrtgatgggctggcgagagggtcatctcagaggatctgctttccctaagagatggttagtattaaaaaagatcacactgtgtaaccgagttaatttgacatg

SEQ ID NO: 38903 - DNA, 201 bp, Bos taurus
tgtcttgtagaggctgggggtgggggggtcttcctacctggaagctgtgctccctggagtcaaattcctaaggactagacttaggataatgtagaaggtgmgagtggggacatttgctgggacattcaaggttataaaactcctggagaactggaggatcttacttcttttgtatggttgtttagtatatcaccacagcca

SEQ ID NO: 38904 - DNA, 201 bp, Bos taurus
tgttgcttatcaaattttgtgaaatgctttaagtaatataatttgcgtgtggtctcacattggtgtatctgaggcctctgatacgcaggaaggggcctggyattgatttactggttggctcagtttctgttgcactcatccactgggtccaagagtcgagctttgacttacagctcggcctggatctggtcattctttatc

SEQ ID NO: 38905 - DNA, 201 bp, Bos taurus
gtccatcttcacctgcacaactcctactcatccttcagacctcagctgaactatctctcccttggaggggcattcccaggtgaccagcacagcccccatamctagacaggcacatggagacccagcacaatgcctggcacaccacagacattatcaaaaccattgctcaatgcagtataccttttactgccccttcacaca

SEQ ID NO: 38906 - DNA, 201 bp, Bos taurus
agcatcaaacatcagaaacgaactcagacttttgattacacctgggtaattgggagagaaaccaagttagtaagtagaagtacagaagactactgaatcayaaaactatttgtatatatcactttaaatcatgaagatgaatttttctaaaacagaatgagcagagactctggaaccaatcttgacacattatcttaaact

SEQ ID NO: 38907 - DNA, 201 bp, Bos taurus
aatctcaagcattttggctctaagtggtggctccacatcttttcttccaatggctgtttcttagaaccaaattcaagcttccatatttctggctcctactytagcattcatgtccaaagagaagaatttcagaaatagcttggattgactgcctattaggaacactccacactcacatgcatggcactgggccagaatatc

SEQ ID NO: 38908 - DNA, 201 bp, Bos taurus
cctgaatgaccatgtctgcctggatctagaatgagggttgaggatgactctggtactggggtcatgttttcaatgaagaaagagattcccaccacttcaaytttcctcttccataaaacattgtgatacacgaaagctctgggttgagacatgggtgctgcagtcttaagtacctcatgtgcaatgtgcaccattatggtg

SEQ ID NO: 38909 - DNA, 201 bp, Bos taurus
ctattgcaaaagaagaataaaggtgtgtttctctagctgattattcccataagaaaaaacattctgtaatggcaaaagtatcagctaaaggcagctctttrtggacagattagccttatctctagactgacacctccatgtatgtatttaccagtctctccagtttggagtaaacaataccatgtgtgaattcagtagggt

SEQ ID NO: 38910 - DNA, 201 bp, Bos taurus
aagagttttctggaacactcttagatgcattaccttaatagaaaaaattatcacagcaggtagagagtggggcccatatttaagtttgaatatttttaagrttaaattttaacaaaaaagtatgatctttcttaatttccatttaaagtcaattccaaagaccatactaatacactgttaaaggtcagttaagatctttcc

SEQ ID NO: 38911 - DNA, 201 bp, Bos taurus
aacagtgtttaagaaagggctgtgttaaagtgtgtgtcttcttgggaatgcaaaggcctttgtgggaggaacttaatttccagtgtagtaaaacagtgtgygcacggcaaggggatgtatgttatgaagaaagtaactatactcaaaaacacagttacaaacctgtattgcaaatgatttctttgcatgtctgtttcccac

SEQ ID NO: 38912 - DNA, 201 bp, Bos taurus
acactttcgtagtctactcataggataagatttttaaatgcaacatgaaaatttttaattaaaaaaaattttaaactgttaaaaaaatttacaggcccaarctctgtcactgcaaatacatttaggtttcaactgaaggtctttacatgctgacaggttaaatatgaaggccatgtttctcagttttcaaatgagtagtct

SEQ ID NO: 38913 - DNA, 201 bp, Bos taurus
gaatataggtgccttcggccagagctgtaagcagaaaccctgctcctgggtgccaagcttaaagcactcttggaatcagctgagggacagcggcagctacyaggaggaagcctagcagtctgtggccagaccaccggataaaccagtatatatgtcctcctgccacagcagaacactgctcactactaatactgtggatac

SEQ ID NO: 38914 - DNA, 201 bp, Bos taurus
aacaaatgagaagactgaagggagttttctcatgggagtggcagggcaagaggtcaaggaagtcagatgaccaacgctgtcactccagccaaaggttaccyggacaacttcggccaagtcacattctctgagtcttagataacttacctgaagaatgaggaagtcaagtccgcttttctccaaaaaccctttctccttaga

SEQ ID NO: 38915 - DNA, 201 bp, Bos taurus
ttttgtgtggggggaggggcggtgggaaaggcatacagaatccagtccataacagttggctaaacttcactctttgcaactgagcagtttcaaataaaaakaaaaagaaaaccaaggctcagagaggtgatctgacttccctgaaaaggaatacatcttctgaacttcagcctgcatttggctaactacctccactcctca

SEQ ID NO: 38916 - DNA, 201 bp, Bos taurus
agatcacaggcagaagcagttgtggatctgagacaaacctggacttctgacttgaccacagatacagttgttcaaaccgttctgtggggcctggttgaacyggtggagctgcgggagaaaagataaactctatacacaatcctgtttgtttatttatttattttggccatgctgtgtggcaagtgagatcttagttcccca

SEQ ID NO: 38917 - DNA, 201 bp, Bos taurus
agtagagggcctgcacatgatgagagagaagacagttctaattaatgctaatacagctccttctttctttgcaggtttgggaggtgctctcggttaccttytgggtgccattgactgggcccacttggaactgggaagactgctgggcacggaattccaggtcatgttcttcttctcctcgctggtgctcactttgtgttt

SEQ ID NO: 38918 - DNA, 201 bp, Bos taurus
acatgtaattaattggtgcgctaacctcacaggcattagatgcttagctcttagcccacagctcttcaatagattgtttactcacattcaaccacactctytttaatctgatgcagttggaaaagaggttttcatagggctgttttttggcaccagtacccacactactattataatcagaactcttaaccaggtgttgtt

SEQ ID NO: 38919 - DNA, 201 bp, Bos taurus
tcaactcagggccgtgtttaagaaaaaaaaatcattgaacttcagggagtactgagacattctgtcctcagtgttgttactgtgttcccccaattctgaarcctatttcctggcccttcatttaactccctggagaaaatagatcatttctttaagccctagtaaaaggagtaagtccttattagaccacatttttgcctc

SEQ ID NO: 38920 - DNA, 201 bp, Bos taurus
gttagcttatctcatctggattcatctcttggtctaagagggactcagtaggtccaagaggagtgaggtttcagttgagaggccaaactagttcatctttrctagtttattacataaatcatcacagcttctcattgaccttcagtgatcttggccttggctttgcattgtcaaacctcatggattcttttccatacccct

SEQ ID NO: 38921 - DNA, 201 bp, Bos taurus
aaactgacacttgaagatacatctgtgtgtactttctttggttcaggaagggaaaataacaacatggggttgtttgtattgcagagaagaactcttcaagrtcagaactggcttcaatctgactgaagctcattggcctgtgatttctgagactgaacaggcacaaaaacacacagtctggattcattatgaagacactat

SEQ ID NO: 38922 - DNA, 201 bp, Bos taurus
aaacaatctaaagactttggaaggacaatctaaattttgaccattgccagcatctttcctctaggtctcctcactgaaagcttcatctaaaaatgacacayggtcacccagccctggagtttggcaaccgagcaccttcgatctctggccttcagtacccagaggacagttcttaaatctacaaactgtctcgtgcagcag

SEQ ID NO: 38923 - DNA, 201 bp, Bos taurus
ctgagaactcagggtcatccaaagacgccagggatttatgttggaggaggccatgttaccagcttcttttgagccagaaccactggaaggggaccatgttyggagcaaatgttcccacgtgactgccgctttccctgtgcatgaatataagtctgggctataaaggaggtagggacagtgggaagccaaaactggttcccc

SEQ ID NO: 38924 - DNA, 201 bp, Bos taurus
tcaagatcatcaagggagaagaaggcctctggacacgtgttcctttgaaatgtgagacagagaaaagcactgttagattcattgccttataataaccatgyaactggaattttaggccctcaagaattacagcactgcaggaataagaagtaggtttatccctttccattcacacttattttttaaggagatcaaaccagt

SEQ ID NO: 38925 - DNA, 201 bp, Bos taurus
gtgcaggcgcgtcatcagcggccatccgtgcgctcggaaatcccaacgcttctccccggtgctccggatcctgcaatgcggaggaaggacctgcggccaasactcagtcgcttgtcacttgtcacaggcaggcacagcagcgggggaaacgaggatggacacggtcgtggagaagttggtggccggaggagcttccccagg

SEQ ID NO: 38926 - DNA, 201 bp, Bos taurus
ttccatcacctccactagctttgttcatagtgatgcttcttaaggcccacttgacttcacattccaggatgtctggttctaggtgagtgatgacaccatcrtggttatctggataaggcctataccctaggctaagaggcctagcaagtgtgagtattgcactgactctttaacacttcatccttcaccccgcagttggac

SEQ ID NO: 38927 - DNA, 201 bp, Bos taurus
aaggatgccctcgtagccacagcaggtgcaaaagagaactggactgtttcagcgtaagagcaatgaaccgtctccagaataaatacagtaccgtgattaaycttttgaaacaatgaaccaagcagagtaacacaaatactaaattgggctgtcttccaggatgacctttctttaagaatgtaaagtaggcaaagatgtatc

SEQ ID NO: 38928 - DNA, 201 bp, Bos taurus
ggtttcccagcaaactgagctggccctggtcaagaaaggagatgcagtgaaaaacctgagccataagagaagggatgtggaatcccgccatggctgccacrggcctatatttgctctgcttctcaaacccactgcccacagggaggccccatcctccaagcctctgggctctgcctccatttcccactccttgtctagacc

SEQ ID NO: 38929 - DNA, 201 bp, Bos taurus
gcagttactattaatttgacaataaactaggatttggggggtgttttgtagtttgggtttttttatttttattttcagtggccatatttgaagctgacttrttcaggaacatcacatgtttgtgtatatatattatattccataaggctgcagattaactttgctttaaataatggaatatgtgtttaaagctttgtgtat

SEQ ID NO: 38930 - DNA, 201 bp, Bos taurus
gtctgaggtacacaaaagaagaggaagtcaaaagggtaactagtcgcatgtgtttttaggttttatttcccatcaggttttccccacttactcagttcttkcttccactgcgcgaaggttgaggggagcctttcactctgtaaagttgaaattggttataacctcatgtgctttgattagaattgagagataacttggtag

SEQ ID NO: 38931 - DNA, 201 bp, Bos taurus
agaaggccctgtttgtgccttgggttccagtgtaaccaggtattgtgcaagggcttatatgggaatgtactaacaatcaggccggccatgggtaataacamataactggttaagggtcatttatatattgaacaggaaagttatttgttagaatgatggttctgtatctctaaaaacagacaagttggtctattttgtggt

SEQ ID NO: 38932 - DNA, 201 bp, Bos taurus
agcatggggtgtgttagttaaccgggctgccagaagccctgataaaatcaggattatccaagtgtgtgccgtttgtcctggggtctggcctctttacagcrcattaggaataggaaactagaaccacaagtctccatgggtccctccccacttgtaatcactatggacaggtccatgcagaggaggccagaagagagggga

SEQ ID NO: 38933 - DNA, 201 bp, Bos taurus
atataagtacagataatacctggagagacccagatacaattcagaaagccattttggacttcaagatcagccagtttgaagggaaaaggtaatagtatgcrtgccagattatttgtgcttaggctaaacaaaacaaacatatttctgtgggaacttaaaacagaaaatctttcagagtttcatgttctgtaagtttgttga

SEQ ID NO: 38934 - DNA, 201 bp, Bos taurus
aataaggtttcaaggactttattctacaagtagactgtaattactatgagaacaagaactatttcaaaattctgagtataatctaatgttatgggttctcratatacgtctctcaatgataatgatgtggttaaatcagcttcataaaaacacttcacctgaaagtattattgagaagtagctttggttgtcttaagagta

SEQ ID NO: 38935 - DNA, 201 bp, Bos taurus
ctctcacttctgggtgaggtgagaagccatgggcctctctagcagtatctcctacagtgggagaatccaggggctcattcacaaactctcactttttcccmgtgggagaaaccattggcccagaaggtcttggcactcagcttctcaccttgaagggggctgacatgaataaagtgaaattattcctcaatctcagatttg

SEQ ID NO: 38936 - DNA, 201 bp, Bos taurus
tttctaaattaagtccttgtaaaaatatcctcttctgtttatcttaaactgagctttgtacataataaatgttcaataattcaagggtaattgaatgaatyccatgtcacactgtagaatgccaatttaattttgtaacctgtccttatgagacagatactgatcacattaatagaaccgcttgtgtggcaattaacataa

SEQ ID NO: 38937 - DNA, 201 bp, Bos taurus
taaaggcacttgcattgaatttcaagcactacattgccctctgttcttttattaaaacaaatgttggatgaaaaatattaaataatatttaatagtcttaygctacatgaaaaactatgtacacttgaatacaattaatataatctttcattttacattgggtccttgtatagtagcacgtttactcaactgaaaatagaa

SEQ ID NO: 38938 - DNA, 201 bp, Bos taurus
tactaattgctttcttaaaaaggcctttcttaaccattcacatttctaattttttgtttcttcattacaatttaagttctgggagagcagaaactttcacmtccatatgataccttcagtgaatgtccagaaaaatgtttgttacaaaatgtgtgctcagcattgatttggtgaatggaagaatcatctgaactacatttt

SEQ ID NO: 38939 - DNA, 201 bp, Bos taurus
cagtcatgctcatcaccagggctaagttaattacataataatgagtgatatcaagatgtcaaaaatcactagaactcctaaggatacttgcacataaaacrgatcaaatatgttcataatggtcctctatggcacaactgggggctttcctggtggctcagatggtaaagaatccacctgcaatgcaagagatagaggttc

SEQ ID NO: 38940 - DNA, 201 bp, Bos taurus
cctgtgaattataatggtttcccaggtgaaagaaatcagtggtaaagaaccagcctcccaatgcaagagacaggtttgatccctgagttgtggaaaattcyctcagtaggaaatgacaggagaaggcaatggcaacccactcaagtactcttgcctggaaaatcccatggatggaggagcctggtgggctgctgtctatgg

SEQ ID NO: 38941 - DNA, 201 bp, Bos taurus
tgaatgtgattagtgcttttattaaagagactaacagaacggcccagccccatctgccccttgaggctattacttgaagtctgtgacccagaaaagagccmttgctgaccatgctggccctgattgcaacttcaaggctcaagaaatgtgagaaagaaatgtttactgtttataggccacccagtctgtggtattaatatt

SEQ ID NO: 38942 - DNA, 201 bp, Bos taurus
gtgtatgttaatatattttataataatgaatcaatctatttcagcaatatgatcaatgtgattgatttgtaacttctttgaaaatctatctttatatgtaytgataaaattttgcttataatttttgcaaatacatttaagctgtgagataaacttataattttgcaaaatttctgtagtcgttaagtatttagggcattc

SEQ ID NO: 38943 - DNA, 201 bp, Bos taurus
tggctctttattaagtagttagtcattcctgccaatatgatttttccatattgattcaatacagcagtcctttccataaagcctatatttcagaacttctratggacttggaagatcatagagagctgtattatatttactatatagattatatttcattattttgtataagtgattttaaacagttatgtatcttttaca

SEQ ID NO: 38944 - DNA, 201 bp, Bos taurus
gaaacataatgcaaaattagtacaaaatatacaatgttatttaacatttactaaaattattgttatgtttaaaaacaattgcttagtaaatataaccaggygtaaagaacagtgttctggagaatttcaccttttgttttaccatcacacagtacttctataaaattgaatcatatatttgatacggaataaaagtaaatt

SEQ ID NO: 38945 - DNA, 201 bp, Bos taurus
tagcttttcctgaaaatttcctcaaaacagtaattcacccataatgtctctgactgctgtaatatcagaagtttctctttcacttctcctaaatcataaaktgatgtgcaccatttttattaactccagtgactaaaaatctttaagaggtgatggatgtgactattcccaaatgaagcagctaccagcattcagacctat

SEQ ID NO: 38946 - DNA, 201 bp, Bos taurus
tagtcaaaatgatgtattacatgggtactttaattgaggagcataaatatagagttctgggaatgggtttaatttgatcacataattttaaatgatgcacrttaataattaacacattatgctcaaatataacttgagttatacaaattcccacagaaattaaatgaccataattagcattaccttaataaatatcaaata

SEQ ID NO: 38947 - DNA, 201 bp, Bos taurus
tgaacatagatgaaaaaatcctcaacaaaattctagcaaatagaatctgacaacattttgcaagaatcatacaccatgattgagtgtggtttattaaaggratgcaaggattcttcagtatacacaaaacaatcaatgtgatatattataccatattaacaaattgaatgatgaaaaccatatgatcatctcaatagatga

SEQ ID NO: 38948 - DNA, 201 bp, Bos taurus
ttttttaaattgttgttgctgtttttgttactaagtgtaagacctacagttgttcctcaatgtgtcattcaacaaacctaaggcctcattgaatctgaatwctgtaaacctgagataccaaaactctagaatcagaatcctgtcaaaagcttctagattattgtacctgcccccagagtttcaaattcattacaggcccaa

SEQ ID NO: 38949 - DNA, 201 bp, Bos taurus
atgatctaatcataaaataatcagtctaagaaaagagtatcttaccaataatattcactctcaattatattctcctcattctatcatgcttttcatcagamccttgtaagaaagctgagatatacatcagcaatccaatcaaaaaatgaataccctagaaatgatgtgttgctaagttacaaatggggcaaacaataccac

SEQ ID NO: 38950 - DNA, 201 bp, Bos taurus
ttctttaaatcactaggatgaatcaccagttggcattcattgcagttatataccagtgagagcagatggaatataaaatggtatgaaacatgtctactgargaaacaagcattttaaaagttaatgaaagacaaaacaacgtaagtataaagtaggctgggtgaatgttaacatagcaactatagcataaagagaacccct

SEQ ID NO: 38951 - DNA, 201 bp, Bos taurus
gaaacagagaaaccatgctttggttagaagcatggttagaagctttggttagaagcatatcagaagtgccttttccctgaaaggctgaaataatttgtacrtgaatataattaaatgtatctctttgggctggagtctgaagaatagtactctgctgactgtccccaattcttccactgttaggatcagttgaggatttgg

SEQ ID NO: 38952 - DNA, 201 bp, Bos taurus
gaaacaaacatttctatattattgtaaagatgattctattactgcagtgcttggattgtatcaatattctactatcgtttgatattactctctgatgtatrtatttataaactatatgtgttgttgacatgtgattattattattattttatgtgcatctatgtgtttgttttatatgacacagtcacttaaagagcaaag

SEQ ID NO: 38953 - DNA, 201 bp, Bos taurus
ggaagtctgccaaaaacagggcaataaaaaggaaagacaattatctaaagaaccatagcaacaatatgcacttgtgacaagagggaggaaaatgactggawgcttgtctcaaataaagagataacattgtaaattcaaggggagaagtggtaatatattgctttatatcttatatatatgcaccataaagtgaaaatagtg

SEQ ID NO: 38954 - DNA, 201 bp, Bos taurus
catttaacttataatgtgagccctctataattaacatgcaaaattctaataccatatgtattttcaattcattccctctttcaattccttttacttgatartatcagagcagaatttgagcagtccattaggctaaaaaataaagtgttcagagaaaatgaatatatcattctgttcactttcagtaagtttcttcactcc

SEQ ID NO: 38955 - DNA, 201 bp, Bos taurus
accctgggtgcagcagacctgggtatggcataagccctcttggaggaggtcaccattaaccacaccgtagagctgctggaactacccaagactgtggaaayagactcctggtgggcataaacaaaaccttgtgcacaccaggacccaggtgaaaggaacagtgaccccacaagaaactgacccagacttgcccatgtgtgt

SEQ ID NO: 38956 - DNA, 201 bp, Bos taurus
aaattaaatgcaaattattttattactttctgaagttcattgtacttataacaaaatctattgttccatagctaaaggattctgttctgccattattagtkgagttcatatcaaaaggccttgtacaagatatttctggaggtaaaatatgttagatattattcctattatggaacaaccagacaagtaagcaggtatttc

SEQ ID NO: 38957 - DNA, 201 bp, Bos taurus
ctgagaatgacaaagggtggctgtcacccttgatggacagagtgtttgggtcctgcagcagccttggcagtaagactttttcaaaggctcttgttttggtrgaagcaatatcagtgagtgtttttaagttttcctaccaggatagcataatatataatgtgggtacttgggtttttggaaagctgtgagggtgtggtaggt

SEQ ID NO: 38958 - DNA, 201 bp, Bos taurus
atcaaggtggatgtgctgccacctaaaacctggaaggcttccattgatagaactcttcaggacctgtctaccccagatcagctccaaactaggaggagacktaggcaggactggagcacttcttctggggaaggaactactgcttacttctcttcagaggctatccattaggtactatgattctctgacactgcccacgac

SEQ ID NO: 38959 - DNA, 201 bp, Bos taurus
gcaggaaatttttagtgttttttttaactttatattttcattaaaattctaaaagtttattaactgtatcttttaaaccctggcctaattttattctgacrtagtaatttcaaggggatagtggtccacctaactgataatcatctaacttattaaacaagtggtcagttaactagttctggccactgcatagaatcacaa

SEQ ID NO: 38960 - DNA, 201 bp, Bos taurus
tatagtctgtgactagttcttagtctttccgtgattctgtgcctctggactgaacttcacaaatgtttctcaaggttttctcgctccttaggtgggccagratgtatttcctccttccctatgtaaggtggtactagtggtacagaacttgcctgctagttcaggagacataagagacatgggttcgatccttaggttgag

SEQ ID NO: 38961 - DNA, 201 bp, Bos taurus
ttaattcagtgcagttttaattacaaaatgacaagaagaatcgaaaggaaataccccaaaatggaagtgacagcataagtagtaattacatgttgaccatrtgctgtgttgcttgttgggtattcttcccaacatactttcctactgacctgtttaatatgctggaaacatggaaaccaaaagaaatgtgaagagtattga

SEQ ID NO: 38962 - DNA, 201 bp, Bos taurus
tgtgataatgtaacagtttatttacctattttcaggctgttttacattcgggttctcttcttatttttttttaaactttacaaacaataattccatatggwatttctgcagctattcttctcagaacatcggtggattttattaatgataatatttaacttcacatcagagtatcctattatgggttgaaatatgttccat

SEQ ID NO: 38963 - DNA, 201 bp, Bos taurus
ttacaacccatattatgatctaaccgagtttgtttagaaaaatctataatcattttataaatgccaatggttttagtttatcctttgcataggtatgttarttaaagatatgcttgtttttttcgttttgttttattttcatcaatgtgaaaaatgaactctgatacaagtacaaaattagaataagacagattacaaggc

SEQ ID NO: 38964 - DNA, 201 bp, Bos taurus
actacacagaaaggaagtgagagagacattttagtattagggtcagcggtgtgagagaatgtgcagacttttcaaatgaaaagtcattgaaagggaaaatkcaaatttaatgtaatttgatataataatgcctacttcaaaggaggtaaaattactttctgtctagactgagctacctgtagagtgctgtattaattttag

SEQ ID NO: 38965 - DNA, 201 bp, Bos taurus
catctaatttactgtctctactttccaggtctctcactttcctgcaaaatttgttgcaatttgggcagttcttaaaaaggatctgagtaatcctctatggyattttatcttctgttggactcagttccattacattctgttttactgtgttatgttctagtccagtctgttctttatttaagaaataatattcttatgtga

SEQ ID NO: 38966 - DNA, 201 bp, Bos taurus
attttagaggcctcaggcaggagggttgctattttagactccccaaaaggcaaaagcgaggtcacagcacagaaagaattaaaggacaaactgtgtgatayctgcattttcacggctagcggtggcaaggtagatggcatgcagctatggcagtggaactaatcaaacatgtacatctgattaattttgatgtgttagagg

SEQ ID NO: 38967 - DNA, 201 bp, Bos taurus
acacatattttgatgaatcatgagaaagatgattgctaatattctgtcattttattcgtattattttcccagttttttcctgatcaaaactgaaagtaggygcccttgagattttaagcaaccctcacattcctttttattaataaattcactccaggtagttaattttttaacttaagtttgttctctgtctctatgcag

SEQ ID NO: 38968 - DNA, 201 bp, Bos taurus
ctgaggtgactgttcaaaattgtatctggagttcatactaatctttttatcaaagagtggttcaaccatacccttcaacctactctcttcagtactaagckctctctctctctttttgcaatacggataggatgagaattttccaaatctttaagttgtggttacttttttgctaaataattctttttcaggccatctctc

SEQ ID NO: 38969 - DNA, 201 bp, Bos taurus
tcccattttgctgcattcctgatgtataaatgataaagcgacttagattcttagagaaaaaatgattccccataaacttgttgaagcaaatttctattcarcagttagcacatcaatagtgaaattgttggagtaggtcaaaagtgcatgactgcgtgctgacctacctgctaataataatcagaagccccttacacccct

SEQ ID NO: 38970 - DNA, 201 bp, Bos taurus
tcatatctagaatttcttttctgttttactgttttacttcatggaaacaatcagaagtcttaatatatagctgagaactatcttaaagagcacaaaatctyaacagactaaaattaagctgataatggtttatattactgagaatatactgagttgagtattataagcttctgataaaaatggtaaagttctattggaaag

SEQ ID NO: 38971 - DNA, 201 bp, Bos taurus
atgatgtacctacatgtaggaagagtttactaggccaaagcaagaaatagtgtaaacgtccccagaggaacacttggcaaatgtgagggacaaaagaaaaygccagtgtggccagattgagtaaacattgtgactgagtgagaggataaagtccaggaaattgtcaggagcaagatattgcaggtcttgttggccatgatg

SEQ ID NO: 38972 - DNA, 201 bp, Bos taurus
ttgatcttggcagggcccagcctcctcccttgcttatccaaccattcttgtcttgggattttggtccacaggtgaaagatttccacttgctttgccctacrggaccaactgaggagggcccgacaacccactccaatattcttgtctggagaatcccatggacagaggagcctggagggctatatattccacagagttgca

SEQ ID NO: 38973 - DNA, 201 bp, Bos taurus
attgtcttttgacataaattatacttaagattgtagactaaaagtattatgctggaatgatttttatacagtcttatgtgatgctttatatgcaagtaagktttgcccttgtgttcttggccatgattctgtctttcccgctgttaaaattgcaactgtcaaaccagcttctctcttaaacctagaggatgccatttttta

SEQ ID NO: 38974 - DNA, 201 bp, Bos taurus
aaattttactgaatgctgtgggatatgctaaagtcccaacttcatgcaggattggagagagatgatgtattaattcataatgttactcaagtctctaatgyacattgtggagtttctgagtgttctatagaagttctgataggtttacaatataatactaagtagaacagttctcctcttttctctccccaactcctgctc

SEQ ID NO: 38975 - DNA, 201 bp, Bos taurus
ccatctaccttagcttaaatatatatatatatgttgatatatattaatgcacatatggattttgaaatgtgagattataacctttcaagctattatcatgytcagtacctatgcacttcgataagattaagctgtaagttttagctaattttcttgggatttaattttctgaaaaaattatgaattttcaaatgagtagaa

SEQ ID NO: 38976 - DNA, 201 bp, Bos taurus
acctcttggttccatattgactcctgtttttttattcatttgatggtaatttattccttctatgagataagaaaacataggataacctcacttagaatagrcagtttcaaaattttaaaaacaacaacaacaaaatctgttaagactttataaaacttgtcttatgatttataacctgctcctcggtaggtgatattttca

SEQ ID NO: 38977 - DNA, 201 bp, Bos taurus
atcaaggccctagtgattcacagaactggcaaatcagactcaggtctctctaatccttgattttgtgtttttaaatccctaggctatttaatagttccttytcaaactggccgtacttcatatactgttgctgttgttcagtcactcagtggtgtccaacactgcaagcccatgggctgcagcatgccaggcttccctgtt

SEQ ID NO: 38978 - DNA, 201 bp, Bos taurus
ctgagatttttccccttgatttcctaggggtgcaaaaataatcaataagaagcaacaaggcaagttggttacattttagctttgctctcaaaaagagcagyctttatctttgtgaaatatagcttttctgttcaaatgcaaatttgtctcccctttaatggaatttttattagtaccctttattttgaaaatagtaccaat

SEQ ID NO: 38979 - DNA, 201 bp, Bos taurus
caattatcaggtaagaacgtacaagggagcttaggtttcaatggaaatgaagagctttggagcagtaagacttgtaaggtgctacttcagatatttctagrcaaatcagagggctacttcagatattctccttcaattatctgggatgattttttctttatgaaagtctcagtgtccttaagtgaaaacctgtaaaacata

SEQ ID NO: 38980 - DNA, 201 bp, Bos taurus
ggatgggtcaaggagcttcagagaagcaccaagatcttaaaccataatgggaagtgcatcttggctggttagtgtggaaccactagaggttccacactatygtctccccaacagagccattaaagcatgttgattaagcaaagcttaatgagacagcaatatgactgtaagggagaactctgctttgacagggtgttttag

SEQ ID NO: 38981 - DNA, 201 bp, Bos taurus
gttaatatggaagcaaggcagagatgcatatccgaagataaaggatgtgcacatccccattaatgttgaggagtataggaaagaggtggttaaatcatttyatagggcagttcttccaggcctttgtttacctttggccaattatctggcttctttttccaatctgacctgtgctaggatcctctctgatatgtgtgcaca

SEQ ID NO: 38982 - DNA, 201 bp, Bos taurus
aggcagattttctaccatctgagccaccagggatcattctagaaaccctacctcaatacctgtcttttaatgtgaatacttcaccttgggggccccaagtycatgcaggagaatatttttctctacaagcttatatatataattttaaattctgaagcatcaaaactaatatattcacactttcttggaatcaaatttttt

SEQ ID NO: 38983 - DNA, 201 bp, Bos taurus
atcaatttaatgactttgtatgaatgcacttttaataaactagaaatgacaagtgaggttaaaacaacagtgcattgcacattatgaaattttgttttgartatgtctgtgttgtacacctcattctgagcaagcaagtcagaagacctggttcagggggtctccaaaatcattttacaatcaggagcctacaataaccag

SEQ ID NO: 38984 - DNA, 201 bp, Bos taurus
tttccttccaaatagcaagtgtcttttaattttatgactggattcaccatcctcagtgattttggagtccaagaaaatacaacatgtcattgctttcactytttatttgccatgaagtgaggggaccagatgatcttagttttgtaaatgctgagttttgaatggtatcagctgaatatctggggttgtttatatttctcc

SEQ ID NO: 38985 - DNA, 201 bp, Bos taurus
ttggagtcaacagcaatttttaaagattttatgtatatttcatccctaaaatatattgtgaagatgcacttctagatcattcatcaacatctatttatcawatttgctttcatttactaacataagcatgtatgttagagttgacccaggaatcaaatggattcaataactgtatgtatcatacatcgaacctggactggc

SEQ ID NO: 38986 - DNA, 201 bp, Bos taurus
cacatgtgtaattccatgaacaatagccatactttttgtattacgttaggtgtttgctctgctttatccccatctatgccaatgcctggcctagtagtagytatgaaagaaatgttcaatgaaagaatgaatgtgcacttaaaaggtatgctttgacttactgtaaattaacctttgtttctgttaatattgttggcccta

SEQ ID NO: 38987 - DNA, 201 bp, Bos taurus
cttcctgatccagagatcgaacctgggtcctctgcactgcaagtgaactctttgccatctgagccacaaagaaaaatcaaattaagaaatgtaaactggtyaggtttggccaaggactaaaataaatgctgtttgccttgctagttaaccagatgattaaactgtggtcatttttgcacccactagtttgaaaattcatga

SEQ ID NO: 38988 - DNA, 201 bp, Bos taurus
tgatttctctgctctatctaaatactcaactcagagcctgaccttcagatgtttatcagagtacacattctcctggaaaatccacagtttgcttttctgcmtattaagttttcatctaataccaagccaggcttcccaggtagtcctagtggtaaagaatccgtctgccagtgcaggagacacaagagatgtgggttctat

SEQ ID NO: 38989 - DNA, 201 bp, Bos taurus
ctctgtgatccctatacaaggggcccaagttgattcctggtcagggaactagatcccacatgactcaactaaagcccccacaggctgcaacaaagattgamgatctgtgtgcctcaattaaggcccagcacatctaaatacatagaaaataagaaatgaacaagcaaataaattaatgcataaacaataaataaatattag

SEQ ID NO: 38990 - DNA, 201 bp, Bos taurus
cttacaagatgaagaaggaatgctgcatttgaggagttgtcttgttgatgctgggagaatgttgcttttcatttaaagtgggtattcttgctgatggggargtttggatgatgcataaagcagacacgcaatgcagggagaggggggagaggatgccaaagggcagagatttttatgtttaaatttttcttggctttctat

SEQ ID NO: 38991 - DNA, 201 bp, Bos taurus
gttccagttctaactgttgcttcctgacctgcatacaggtttctcagagacaggtctgataactctccttctcagtagcaatgatatcatcatatcctatygacatgaataaaattaataacatctgttcagatgaattgctttgtgtatagttctcttgaaaaaagtcatagattagtgttctgtgttagtcagctgaac

SEQ ID NO: 38992 - DNA, 201 bp, Bos taurus
tggtataggtttatttaagttgttataagcactcagataaaagagggccaattctttaaaggtggagaacagtagggaaatattttcatgcgagatttgtkttaagcatgcgtgaatacttcccatatactcaggaaagtaaacgtgagtcccaggctctatacccaattgaagtgcccttcatatatggagatcacagac

SEQ ID NO: 38993 - DNA, 201 bp, Bos taurus
aatggtaagactgcactttagaaatattttaaaatagtagctctaatatattgatatttatcagggttttatatgaattctatgctgttccaatttaaatkattctttttatttttccccaagtatgacttgacactgcagactgcatatattgtcctataagaattttatccttgtgtaaagaactttattttctccaag

SEQ ID NO: 38994 - DNA, 201 bp, Bos taurus
gactgtaattatatcattttgagtttgggtttatgtcatttaaaataaaaagcaggacacaagtggaagcttactcttgtatctctcatgtccttctttgyacttgttagtctgagaaatagtctgtcatgatgtttttaaatacttctaactcacatgtgtagacaactataatgattttgagtgatggaggaactgatc

SEQ ID NO: 38995 - DNA, 201 bp, Bos taurus
tagacaaggatatatttgaaacaaacatagggctttttcctgcaccttacctttcttgttaaatacttccaataattgacactaaaacgctttaaaaaaawatatagtagttcatagcagcaaatcttctaaatagactatcaacaaacatcacaaaaagtcaccccaaatttgaaaatatgacttacagtaatatgagta

SEQ ID NO: 38996 - DNA, 201 bp, Bos taurus
gtgcattcatattcttgtctgaataaatattttgttccttttattgcaaagtagtattttactgactaagcttatcacaggttatccatttgcatgtacarataaatctttaattttttctgatcattagtaaataactatatataagattttgtataaataatgtgcttagcataatttacataatgccattgatatttt

SEQ ID NO: 38997 - DNA, 201 bp, Bos taurus
aaattgcttacatgtaagaacacaggtggtgggaggtggcctattagcagcacataatgaactagcttctgcacttcctgtttgattcccctccaagtccygaggtggctagaaaggaaaaaaaagtcattctctacctattaagaataaaatctaggaggtaatggttgagtgttcaggtcaaggaaagcatgcatgaat

SEQ ID NO: 38998 - DNA, 201 bp, Bos taurus
acccaggataatctcccctttggttaactttaaaatctactgattagagaccttaattgcactttaaaagtactgtcaccttggccatattatgttactgrtatggaagtgacttccaccatcttcacagtaccagtctatactaaaatgagaggagaggggttataggccatgtacaccaggacatgggagtcctagaga

SEQ ID NO: 38999 - DNA, 201 bp, Bos taurus
tcagcctggtctgaacacctgccccagagaggttctccggaagaagcttgtcatcccatctcttctgtccccttgagccgctccaatgtccagcccacagytgctccctggccagaaggtggtggagaatagcctggggacccccacttctcaacgtgtttcttcgcaatccatgactgagactggacgtcctctgggcaa

SEQ ID NO: 39000 - DNA, 201 bp, Bos taurus
agttaatactgaaaaggtttgacaccaacatatagcaagttatgagtccagtttaagcagctgaatttatttttccaggagaaaatacttttgtttttttyctccacttggaattatcaagatgcaattttcaagatgcaagtggttaaaaaaagaagcaattggatgcatgaataaaagttagaagaatggacaatttgg

SEQ ID NO: 39001 - DNA, 201 bp, Bos taurus
tgtgtatatttaactctaagatgtaatgtcagttttctagtttgacttctccaaaacaaattcccacaaattatgtatgagagagtttcttttgccacacrtcttttctgacattctaatctaatgcaactaggattggctttagtatatagatgttaaagttaatttttatccatatagctattcacttggcacagaata

SEQ ID NO: 39002 - DNA, 201 bp, Bos taurus
catcatgagtgccccctggctttctggccagctttctggagtatcactggctctgcagaaggctagtgagaaactggggcttgctgccatcccatcagggkacttagacatggatcctttggccctagtcaagttctgagatgactgcagccctgaccaatacagtggctgcaactttgtaagccttcctgagccagaacc

SEQ ID NO: 39003 - DNA, 201 bp, Bos taurus
ggatctcctgcactgcaggcagattactatatgagccaccagagagtcaggggatctaggtaaaaggcaaaattcagaaatcgtgcaggtagcatctagtsttcggcaagcctctgttggctgcagctggatcttgccactagcagtgagctcaggacctggcctcccagtcacaaggaggactggcaagatctaggaagg

SEQ ID NO: 39004 - DNA, 201 bp, Bos taurus
gcaggtaacttagcacctcccttccaggggtcttgccagcattaaattagttagcattaaattattaaattagtatgtgtaaactgcttggccagggcctratgtatgataaacactatgtgaatgttagaggttttgtttgtttttgtctacacagcatgtgggatcttagctccctgatcagggattgaacccaggccc

SEQ ID NO: 39005 - DNA, 201 bp, Bos taurus
cttgtgggcaagaaccatttttgccctgccatttatttatctttgtatccttcgtgggattagccatacacacttactaaaaatgaatgcacgcatgcacycataacgtatatatacaagtatttatagttgaaggcaatggcaccccactccagtactcttgtctggaaaatcccatggacggaagagcctggtaggctg

SEQ ID NO: 39006 - DNA, 201 bp, Bos taurus
agggtgggtgaggttgatgaccaggctagaagggtgtagtggtttttcctggtagggcagcaggcaggaactcagtgcaagctggatgggacctgagaaamatccaaatgaggccgaagcagggaagaaggggctggggcatatactggctgcaagagagacttttgtctgaaagcaagaggctttaagcaacggtgggag

SEQ ID NO: 39007 - DNA, 201 bp, Bos taurus
tggtacctatctgttataaatgaatatttcagaattcatatccttctgtctttagatgtatgtttttgttatacatttaatagtcatgaaaaagtcgattraggggagaactgctgaagaagattaaaggacagagcttttaaagctcccctacaccatgatgatattgtaaacctgaataagccatatgaataggatctt

SEQ ID NO: 39008 - DNA, 201 bp, Bos taurus
ctctggttaccgggatggcacagcccaggccttcagcccagggctgaagtccagagatgcagtggggctcagaggagaggctggagcctcagggatacatyagaggcattataggggcccctgaccagcccaagtgtcacttgatacgaagcctctgaggattgcggcaaagaaaatgactaatgtgtgattaagtgataa

SEQ ID NO: 39009 - DNA, 201 bp, Bos taurus
acacctcatttgccctgactctgaaggagtgaggttgatcagcttatgttccttcttgttctaaattataattcatggcctcttccaagatgtcattgaayggattcttcccttgaagagggcacatgttttaaagggaagagaactataggaaatcaggctctgccctgaactagctgagaaaatagggatctccctttc

SEQ ID NO: 39010 - DNA, 201 bp, Bos taurus
taaaccactgatacttcattgccttcattatctagaattctttcaggaacagcagttacagtcacagcgtttagttgaacccagggcttctcccaagatcygtagtaactagtgtatgacagtaaacctaggctcatggatgcctatctggtttcgttaccatggatagacatattcaacaattcaattatgtgttgtagt

SEQ ID NO: 39011 - DNA, 201 bp, Bos taurus
taggtgcttaatgatatttgttgaagtggaaaaagcaggtgggagggtggcacagccactggaaattacagaaatacctgggcagccgtgagtcgtccctrttgccagagtcccctgcagtggccagctttcctctgtccttgaggatttttctttgcctttttctgcctccctagtgataccaatgaaagcctttttgtt

SEQ ID NO: 39012 - DNA, 201 bp, Bos taurus
attacttactactgcctaaatatttttcatcttagtctctacaactgatactttcaatttaattctatttgttgattgagtatctgctatgaagtagatgytatgtaaagctctgggggctacagtgattgcaaaatcttccaggattttggaggaatctggcaggtaatgatgactataatataaaaaatggtgtggtaa

SEQ ID NO: 39013 - DNA, 201 bp, Bos taurus
tttcctttgcccttttttctttagtttctcaacatgggcaagtccgtttgttgtgtgctggtttcagcacattggtaaccagtgttgtggcaggactactrtggttgcaagatgcccttaacgatgaactatcagggcactttgcaaaagaaaagtttattaattccaggtcctagaagttacacaggacacttaaggcca

SEQ ID NO: 39014 - DNA, 201 bp, Bos taurus
ggagtactgatatctaaaacttcagttatagcatttcctatttctcctttctgttacattagtttatttctttgtgcattttgaatttctctgattaggtrtatacacatttattattttaatgtcttcttgatgaccatgttttttattatagcatgtccctctttatctctaaaaacatttttgtcctgaagtataatt

SEQ ID NO: 39015 - DNA, 201 bp, Bos taurus
agctcttggtgcccatggaggttatggagaacagtttgtttgcttgtattgaatcttgtattgtccttcccttaggaggactcctgtgaggccttttgtgytgggctgagaccaatctgagagaaagactcagtgctgtgctcagaaccagcccttctacctgggccttttgtcctttcaccaaatctctgagccttcagt

SEQ ID NO: 39016 - DNA, 201 bp, Bos taurus
acaagtggtggtgcaaagacaagtggaatgtcatgtagcagagaaggacaaggatgttatggactcagaatgcgctttctgagcaaggatttcggcacagycctctttgatataaccccaccttagtgggacgctacttgggaatgttctctgtctctttctctgtctgttccctcccctaacccattttggtgatcagca

SEQ ID NO: 39017 - DNA, 201 bp, Bos taurus
cataggaatttcttgcaacttcttgatggacttgctgggcaacttcaaacaactcttgttaacaacttaatcagtagttcgtaagtataaaacagaaatamagcacgcaggttaagaacaggaatttttgccaggggtccccaacctccaggatctaatacctgctgatctgaggtggagctcatgtaacaataatagaaa

SEQ ID NO: 39018 - DNA, 201 bp, Bos taurus
aaactagcatttgccatggtggattcaggagagcagtgtgccctcctcaatgcgggtgggccgtcatccaacccattgaggacctgaacagaacaaaaggrcagaagaaagcaaaatttggcctttcctgcctcattttttgagctgggatgtagccagctgcaactcctggttctcaggtctttagacctggactgacct

SEQ ID NO: 39019 - DNA, 201 bp, Bos taurus
tggagactgaatgaagactatttcctataatcaagaaatgggggacaagaaaaccttttgtgccccaggagccccatgggggtcctgcttggtatcaatakgaatcctgatgatctagtattttatcttcctggtgaaaaagtttttatctcaagacattatctgaaaatgtgggtaagacgtctcatgaaaacaaattat

SEQ ID NO: 39020 - DNA, 201 bp, Bos taurus
tttggaacaagtgtcctgtaccagtgttcagagtccacatcgccctggtaagggccttccttatcatatctgctcattgttctctgacaaagagaccaacrgggccactgtttatagacactttttttctaggttttttatgtatttgcacatctgctttgctgtcagatgcctgcctcaaatcccactctggtgactgca

SEQ ID NO: 39021 - DNA, 201 bp, Bos taurus
aatttaagctgcagagactttaatctttctctacttaaagatttgcatggatccagaacattccaaggcaagttagcaaactagtgttttatcacaacatrtccttaaaagttgaccacagccatgtcataggcgagacccaggcagactttggagccactatcaggaaaaagatttagcaactgatgaaggtcaagtttg

SEQ ID NO: 39022 - DNA, 201 bp, Bos taurus
ggtagaggccagggaagctgctcaatgtcttacaatgtgcatgacagcaccccacagttttaaaaaaataatccagaccagagcatcagctgggctgaacktgagaaatcctggcctaaataacctaacctcagctgacaactaactttctgctcttctaactttaaatctgaacatatgccaatacattaatactgctga

SEQ ID NO: 39023 - DNA, 201 bp, Bos taurus
gcggccctgcacacaacaggaacatgtagtgattacagccctggctcctacctgccttcccgcaaggtctctgcattaaacctacctgcatcccatcagtycaataagcctgagtttcccaggcctcccatggtcccccggacctctgtacatgtgagcccgatccatcttcccaaccgcccttattttggcccttgaatt

SEQ ID NO: 39024 - DNA, 201 bp, Bos taurus
ccatccaatcacaccagtccagtgatactctctcattcagatcaccctcttgccacagagcattgaacctaagtgtgatagggattcggcaaagaaagagrtaaaataggtgcaaaaaaccatcatgctggggagagacttgaactgaacccagtcatagggaggaacccaacccctaaggaggattgaccgccctagaaa

SEQ ID NO: 39025 - DNA, 201 bp, Bos taurus
gtctcccttgcctgagcacgaagtctaacgttctttgcaagttctgaggtgcacctcttccccttcaacccccactttccacacaaggccaaaagcattcrtgtttccctcagcaagccctgtcctgcctccacacccttacctgtgctgtggcattcacctggagccctaacacgtacctgtccagctctgctgaattca

SEQ ID NO: 39026 - DNA, 201 bp, Bos taurus
gaatcgaaggacgcagttggggagctgaatggcccaggagatgggctcctaccacctcagggcaggcagttaccatcctcaaggtgttctaatcacccagygctctggccactgctcagtagccccttaccatgaagctccctaagactctgctgtcctgcagcggaaccacatgagaacggaggaggtggtgggaaggac

SEQ ID NO: 39027 - DNA, 201 bp, Bos taurus
gactcatggctaatcccctcagagtcatattctgaatgtataaaggctgccaaagttgggtttgtattcataatttctatccactgaatgaattacaatgrctctgcacgatgtccccaaacatctgcatcttatggtgtttcgtattggcaggtgcaagcactttactcaatttctgtgcagatcaaacttaactctctg

SEQ ID NO: 39028 - DNA, 201 bp, Bos taurus
gagagcgctcctaggagaaacaaatttgaccactaggccatcatcaaattccctcttcaccaccaagtcagtcgtgaagaaagcagacgacaacaacccaygtgttcgctgtggatatcagggccaacaagcacccagttcgacaggctgcgacactgaggtggctaaggtcaacacccagaccaggcctgatggacagaa

SEQ ID NO: 39029 - DNA, 201 bp, Bos taurus
acacaagaaacgctccgtcaacagtctggatgggagcctggggttaacactcagatgattaccccgggccaaaagtgccacgcgaccttggcctttctcgmgcagtgcctgtgctcctggctcctgaatgtcactcgagctgtgggggtggttttatgtgacagagagattacaatgtccggctggaccgggccgtagaca

SEQ ID NO: 39030 - DNA, 201 bp, Bos taurus
gatcagaggccacatgtggatcccgggccccagcacactgctgaatgcattttgtggggctctgacaccggttctttccggaaacacccggaaaaccaccrgaggagggttattcgctgggcccagggctcgcaggggagacgccgcagaccctgacctcttccacggtctcgtcctgcggggtggccgcgctgtcgtccg

SEQ ID NO: 39031 - DNA, 201 bp, Bos taurus
tgtaaaatgactaatttctgcaaacccatgcttctgtgagtggttgattccttccctctcataaggtactagaacttgctgccttaaaagcaacagttccyaggataatgccgtattttttctacaggagctgtgcaggctcgattctgagttcctagaacaagtgaacaagttccaagcagaacaagtgaacccttccca

SEQ ID NO: 39032 - DNA, 201 bp, Bos taurus
caggctgcaagagaaggatacagtctaactcctattcactccttcatgtttttagatggaagcagtttttccccttcttccccttctacgggcctacatcrcaaatgaaatcaaacttgcttaaacatacgaatctaaaaaaggaacactatagaaaaaacatatgaaagcaaaaatgctttcatatcggccctcataatc

SEQ ID NO: 39033 - DNA, 201 bp, Bos taurus
ggcggccaacaggcagatgaaaaaatgctcaacgctgctcactattggagaaacgcaatcaaaactacaatgaggcagcagcacctcataccagtcagcayggccgtcatcagaaagtctaccaacaaatgctggagaggctgtggagcaaagggagccctcccacactgctgatgggaatgctggtgcagccactgtgga

SEQ ID NO: 39034 - DNA, 201 bp, Bos taurus
agaacacggcagcatcagtggcaggtgccctctaagatgccacatcaccagacagaaacaaaacgagaaaaaacgacgcattctatggggccatcaacccragctcactttccttcccgggttttgcccaccccttcttgtgcttctccaacgggcaccagcctgcgcccggccccctcttaccacccgctacggagagtc

SEQ ID NO: 39035 - DNA, 201 bp, Bos taurus
tcgtttaaagatggtaccagcagaaatcataggggatggtgagggagaatgcgtccccacctgtcactgagcccgacgaggatgaggacacagcaaacagygacggccacatattcacggctgggcccctctccatggagcttcaccagcagcttaggtaaaaaggcaagtctgggttaccaaatcctcagaactcatcgg

SEQ ID NO: 39036 - DNA, 201 bp, Bos taurus
gcatcagctgaatggatgtaccacagttcatctgttcacatctactcttgtaaatgccagcaagagcagcaaacagtgaaggaagggccttaactcttccyagcagtgggacagggacagagcaatataccaagtacttggaaggaaaagagaaggccatgcagtgggcaggaccttacagaaacccctcctaaagagaaa

SEQ ID NO: 39037 - DNA, 201 bp, Bos taurus
aaactctcacagctgtagtgctccctggagacccggccaccagactcagggaagtccaagtcacgcggagaggctcggggtcagtagcccagctgagccayggtcgcggtggcctgtgtgagtggacctcagaagacatccggcccagcgatgtcttctgggcaactcaactgtagaccccagctaacatggtatgaggct

SEQ ID NO: 39038 - DNA, 201 bp, Bos taurus
ggaattctcagttactgcctggcctctgcagggctacgggaatgtctctggctggccactgtggtgggcacagtgtgggtggctgtctcaggccattctcrctccagccctgccctctcaccgttccttgaccacagcccattcccttcccacctccttcttcctactctgaggctgcctcttgccgggactccaggagag

SEQ ID NO: 39039 - DNA, 201 bp, Bos taurus
gtagtagaattatgattcggttcccgtgggccaacatttccaccccaggagagttactgtgaatagtcagaattctttctttcttgacgcagcctcctggytgggccaatagcatgtgggatgtgggcaacccaccctcacccacctcatacccatcacgaagggagtgggcaacccaccctcacccacctcatacccatc

SEQ ID NO: 39040 - DNA, 201 bp, Bos taurus
ctgaagaccaggacccccatggccatctcctcgcaggggtcctcaggcgtgcacacagagcccagccctgccccacctggaggctccatgacataagctgycaatttttgagaactggcctcaagaaatagaaacaaaccagccttgaaaccaaagattaactgtacttaaaatgatgctggtcagaccaccagtgaccaa

SEQ ID NO: 39041 - DNA, 201 bp, Bos taurus
tgtcctcactatgctgactcacattctcactgtcaggtcctctcctgccagttctgccactgcagtctgactgtctccttgccttatgcttctgcttattrgtgcattctcttgcctcacttcttctatttaccacctttcccatgtatcatccctttatcttttaccccaaccaccattggattcttctgctatgtctca

SEQ ID NO: 39042 - DNA, 201 bp, Bos taurus
atgtgtatgaagcactgacaattgttcttcagaagctgcattgtagattaggaattagaatctagggagtctgcggaggccatatgccaagaacttaagcrcccaaactaggtttttgaatatgttaccagtagatgtggagttagcacttaaacttgaagagtggtaaaaaactgaatcatgggccacctggagcttccc

SEQ ID NO: 39043 - DNA, 201 bp, Bos taurus
tactgtacaaaacttttcatccatgaaggacaatcacagttcaactcatagcaaaagaaaaaacaaacaaataacaacaaaaaaagcattgatagcattgrtactgcatcacataaagaaacctagctgcattttgaaagaagagttatagtgaccatttagagtgagagaaaccaacacataactctgagcaacatttat

SEQ ID NO: 39044 - DNA, 201 bp, Bos taurus
atgtcaggaatcagcattagggactgaaaaatcaggattattagtagaatctaataataaaatatctgaactagagaactgagtgatattcaagtaggggrgatggccagagagatgaggtgggttcctcaccgttttatgaaaaaactgataggatctgacaagagccagtgagcagtattttaggtctacagcctctgc

SEQ ID NO: 39045 - DNA, 201 bp, Bos taurus
agccactgcattcttgaaacatttatatatgatatattccaaattagtcaatagcctgaaactttgaggtattttgatttttttgtgtcatgattagaaayaagaaataatacagtatgcacatatttccttgccctcaatacactacataacatctttcatgtaatttagttatggttccaaatttaattccatatacat

SEQ ID NO: 39046 - DNA, 201 bp, Bos taurus
cttattcctagtagctgtattaacttgcacacaacaggtacacaagttttgagagagaacattttcatatttgctgtttggatgactatgcatttatttaytctatgtgacttaagaaaaagtaatatacatgtgcaagttggttttagaaaaggcagaggaaccagagatcaaattgccaacatttgctcgatcatcaaa

SEQ ID NO: 39047 - DNA, 201 bp, Bos taurus
acagaaaaaccatgtacaagggtaaaccaatctaagaggttttgatacttcatgcatagtgaaataagatattcaaagaaataaaaaagaaagctttatgyagtatagtttgaagcaatatggaacaggattagaaagctgaatgactcaggacttttatctgtgaatagtgacaatcttttttagattaatcctggatgt

SEQ ID NO: 39048 - DNA, 201 bp, Bos taurus
tttattgtctacattttcttttatgagttatttctataactatagtatatatctgaatcacaaacattcttacgtaaccccagtatcattctggtcaagaytgattttaatttgaaactttctcaaataatttatttgtttctacaaatcttcaacaattcctacagacacttcatttaaatcagaccgttttagctatca

SEQ ID NO: 39049 - DNA, 201 bp, Bos taurus
acatctgatggttgtagtttatctttcttttgtcaattgctttacaatatacttaatgatgtcttctcttaaaaaatgttgttaggccaatctgggctgayaaaatacaagatacgttcaatagctttctgtgtccacacaagacaagtcatgcataagacagaactctccaaggaaatttagggtgtttagaaaccagaa

SEQ ID NO: 39050 - DNA, 201 bp, Bos taurus
tctaacaaaacctgttagatatgttcttcctctactacttttgtaatattgctttattatgaagatttgcatttaaaatagaatttttctactttacaatrtgccagtcctttacatatcaaaatatataatagttaggctaaaagagaagcaaattatatcccctagcaccattacttaaaaagattccaatcttaattt

SEQ ID NO: 39051 - DNA, 201 bp, Bos taurus
aaggttgaaaatatcaacataaatcattggtacatatgcattcttttatatatgggatcatatagtttaattttttcaaaagtgaaaatatcaacttaatyacaaacatcataggaatgaaaaaatgttatcattaaaggttgctgttttcacatagaactaggagagagcctcagtgtatggttaatgagttcaaagttt

SEQ ID NO: 39052 - DNA, 201 bp, Bos taurus
tttctcctagttctggaggccgcaaatccaagatcaaggcgccaccatggtcattcggggaccatcttccctgtctggtgcagacttcttattgtggcctygctctgtgtcagaggacccttttctacttttataaaggcatcaatctgtttacgatggctccacactcatgacctaattcccttccagaggccccatctc

SEQ ID NO: 39053 - DNA, 201 bp, Bos taurus
gtgattccaggcaaaacaaatactcatacaatgaaaagaccaactgaatagtcacataacagacagaataagttaaactttatcagttcacttggtactcyattcattaattcattcaacaaataaatattgagacaaacactgaatattgagacaaacaagtaatggttggtatcttaaccaagagattgggaccagtca

SEQ ID NO: 39054 - DNA, 201 bp, Bos taurus
gaagttttcacatatttattagacatttgttttgttttgttttgttttttcctgtgctgggtcatcattgctactcaagctttctctagttgcaaagagtrgggctacccttcactgaggtgcttggtcttcccattgcagcggcttcccttgttgaggagcacaggctctgggtgtgagggccgcagtacttgcagcacg

SEQ ID NO: 39055 - DNA, 201 bp, Bos taurus
cccaaattcagcagctgcaaaactgtaacattcttggaagttatttcaaccccaaactgcttgaaatccaaatgcagaaacttaacaaatgtgataaaagygtaatctgttgagagactttgtgtaaatactgcacattgaaaagatgtaagttcttccacggcacgcttacaaattgaatacagttccatgtaaaaaaca

SEQ ID NO: 39056 - DNA, 201 bp, Bos taurus
taggaaaatttagggttttatgaaagagatgaaatgggggggcattcttagctttccagaacagacttatcatagaatcaatttatatcatcaggtggccyattacactaaaattattaatcttcaatgcagtttcatcattgaatacaaatgaattaataatttcccttccaataaatatggttcatggcctatatgtag

SEQ ID NO: 39057 - DNA, 201 bp, Bos taurus
ggaaggccagagaagtgtcagagtcaggagagagacaagggtagttcacgggctgacattggtcgaagaaaagctcatccgtgttgcagaaaggttgaatygaatggccaggccacagtagatctgggtttgcacatccctggagaacgaccactggtagtgatgtccaggtgtaatggcaccaggaagactgagctggtg

SEQ ID NO: 39058 - DNA, 201 bp, Bos taurus
ggcgaagagtcagacatgactgaagtgacttagtacgcatgcatgcaatgcttgtgcagagtagcatttgccagacagatgggaaatgggccagcttagcmgtggaagaagcaacactgccaggcgtgagtaggaatcgcaaacagtacagcagggggaggagacaggggccactatctggggacttttctggagcaaaat

SEQ ID NO: 39059 - DNA, 201 bp, Bos taurus
ctggctaggtgacatgacagcaggtgttagcacagctcttaaagaagacttccagtcttatataggtgatcaaaatctattttataatggacagtcaatcratacttctttctctattaactcaatagaagtttgaggaaagtacccagataaaggcggtataccctggctttgagatagttctttttcctctgtattgat

SEQ ID NO: 39060 - DNA, 201 bp, Bos taurus
attcacagctgactcatgactggacgtggttggccacataattatgaagtctgggttcctaaatgataaattagatgcagtgccttcgttttgtgtaagtsctacttagagccacatggcctgaaatagagcccctttgaaatgaatcacactgtacaccagagactggaaaaatagattacattgaaaatgaatccaaaa

SEQ ID NO: 39061 - DNA, 201 bp, Bos taurus
aatgtctccctctagccctgcgatggttctgagaggtctagggggtgagggtgggcatggagggcccaaacacccggcctccggcagccatgggctttcgrttcatttcactgatgcccacacagtgcccaccgatgacacacatccagggcctcacgtggccctgcccaccaggcacctgggacattgctgtatctcttc

SEQ ID NO: 39062 - DNA, 201 bp, Bos taurus
acggccccaccatccacacaggctcgccaggaaatcaaggcgaaccttcattttttcagtgatcacctcgagaaccgctttggagttcttggagtgatccmtgaccaggtggaggaatagacacatggctaatcctggaacgctagagcaaaagcattgaccacagggaaagatggaagggatgaaaacctgcctttcctc

SEQ ID NO: 39063 - DNA, 201 bp, Bos taurus
aaccccttggggaggctcacaggggtcaaaaggtagaccgtgaacagctgccgggtcattctagaagccagctctcctgacgtatctaaaggccctcttcyctgagccccactttcttctactaaaaaatgatagggaccaccaagctccaaaatccatcccggcttcaagaccccctgataatgcttctcctaggtttct

SEQ ID NO: 39064 - DNA, 201 bp, Bos taurus
tatctatgtataaattatactagataattattgttgtatctacaaaaattatactatcatatgagtctataaattatatttgtgatgtgtaaatggtttgrcacttcaatgagctgacttagaaaaagaaaatatcagaggcgggggagggttgttcgtagcgaagctgccacctgcccaccccatccacaggacgctgtt

SEQ ID NO: 39065 - DNA, 201 bp, Bos taurus
tcttccaaattaagacattcccatcctcaaagttcattcccctaattaatgtgtttgctgctaggaattaactgatcctttgtttctctctcagaaaaaakggtttcagcaaacctcatttcctgccaggacccctgcttcaggtgctttgaagccagaatgagtctaaagcagtgatgggaactgaaggaagcagacatt

SEQ ID NO: 39066 - DNA, 201 bp, Bos taurus
tctccttcagcgaggagaggtaggcctcggtgtccgactcagggatgtccgagtcgagccccgacagatagcggtagacgtaggagaaggtcccgaaaggratgcgcgcgggcccgccctcaggatccgtggtcaggatctcgcagaggtgcttcatcgcagtgttcagtgactggagacggcagagagcaggcggggaaa

SEQ ID NO: 39067 - DNA, 201 bp, Bos taurus
ctacaagaagagacacagaaatgcccaacagaagtagagctggcagtaacagcagtcagtgctgctcaggaaagaaaatatctgtatacctagggccttcytatgccagatgactatctaaaactcctttcatatactccatataaattccattcaaatattccattcttatatttcatataaggttaaaacaaaacaaaa

SEQ ID NO: 39068 - DNA, 201 bp, Bos taurus
ggagatgctgcaggctgccctgggagctcccctcttgccggagcgtatcagcaagtagcaacaacctcagagtctcactgcgggggagaccagggccagcrgctccctttggaattgcctctagggtgtgaagcaccttgtcttgcgtcccatcctggggaatctcactgcaggggtagggaggcccggctccttcacccc

SEQ ID NO: 39069 - DNA, 201 bp, Bos taurus
ctccttttagcccctaagatcacagtgtcctttatgaaaacaaatcccaaagccaagaataaactgatcccccctaccccagtgacttattgaccatctaktttattgtaacttaagcatcctctctagggaatctcctcctacaacacacacacaaaccaataggggtaataaggttttaagacaacaaaaatcaatctt

SEQ ID NO: 39070 - DNA, 201 bp, Bos taurus
atggactatttcatggaattctccaggccagagtactggagtgggtagcctttcccttctccaggggatatagttgggtagacttagatacaaatatatamgtacgttatgagatagcatagtattataatgctggtgctgctggtgctgctgctaaaccgctttagttgtgtctgactctgtgcgaccccatagacggca

SEQ ID NO: 39071 - DNA, 201 bp, Bos taurus
agctgcacaggtctccctcctgctgtaggagacataagtgaccaatggcctgctttgttcactccccttattattcactcatcattataccaaggccatcrtttctgcaggttgcagccagcagatgactgggcatggctggacaccaaagcacaaggcagactcctccaatgggcaactttggctcagggttgcccatgg

SEQ ID NO: 39072 - DNA, 201 bp, Bos taurus
ccatttccaacctattgcagggcagctcaggcatcataagagagacttaatctctaccgattaagcattaagtgctttctaacatttaaatgttaggctcrttttatgattgtgaaagcagcagtaaagcaagagggagagaagtttactgcatcttaacgtgtgtggcaaattgaatttctatcgacaagaagagcttct

SEQ ID NO: 39073 - DNA, 201 bp, Bos taurus
agtattcttgcctggagaatcccatggacagaggagcctggagggctacagtccatagcatcccaaggagttaggcaggactgaagggacttagcactcaygcagcctgtgtactagataatactatcccctcttctttacagatgaggaaagggtcacagggagatgaatcaaccctccccctcaagccacatagcaggc

SEQ ID NO: 39074 - DNA, 201 bp, Bos taurus
tccttttacatcattatttctggaagaaacaagagagaattagttttcctatcaaaatttcttacaaaaatgacaaaaatactaccaattgtgttgttttyctttcttaactgatatatagttacagggtataatttccagaacactgagagaattctgggtacttccaagtatttgagatatgtgtgtggaactaagaga

SEQ ID NO: 39075 - DNA, 201 bp, Bos taurus
gacgaacagttgttctggccgtggcatctgttaactgcacttgggtaccattgctgctggcaatgtgtcggcatccacaattggcagaggaagagcctgcygggccgtagccgccacccatccgtcttcattcagcctccctcctaaaggccaaggttattgatgctctaacaagtgcactgacaggctttatcaaacttc

SEQ ID NO: 39076 - DNA, 201 bp, Bos taurus
gaaaagcaaatgtttggtaaacaagagtttgctgggcctgcagagactgatggacacagagtgggctctggtctctgggccctgctgagttttccccactrcagtctgcccttattcagtgcagacatctctggaaatagctctattccaggaacaggccatctatctaaattttgtaagcgtttaggggaaggtcacagt

SEQ ID NO: 39077 - DNA, 201 bp, Bos taurus
cagtacatttcattgattcccaggcctccttgctcccatagccttcgtagcccgcggtcagtggtccccgtggggggaacccccgtgcgagcttgggggcrggtgcagatagaagttgggcctcaggcaagttgaccccagtgaccctgttgcttcttcccccaggaacggaggctggaccccctggacctcgtggtctcc

SEQ ID NO: 39078 - DNA, 201 bp, Bos taurus
gaacgttagtgatagccaacaatgtggaaatataggtaagtctttcacatgcactgactcatttctctgcagccgccttatgaaactagagctgccatccycactagacactgagagtttggttaactacttgtccaggaccacatagatgctgacaggagccacaccctacatctcaaaaaaaataaataaataaaataa

SEQ ID NO: 39079 - DNA, 201 bp, Bos taurus
attggtagtctctagctaaatatctgaaaatagcccaaaagaaatcctacagctggaaccaaaactggaaagtcacaagagaggaaatcatacaacatcarcagatgatttgaaagtcttgatgccaaaagcatgtgttatgctaggttataaactgcaaaccaaaaaagagatgatagtatataaaaagaacatagaaga

SEQ ID NO: 39080 - DNA, 201 bp, Bos taurus
cccaggggatgagaggttcctttctcacaagggaggtgggggtaggatgggggtaccaaggtcacctccatttgagtcctccacagggttattttgggcargacaggcctcctgtcctgataaaaataaatttatattaaatttataaaaaataaatttttatttatttttagtctgatcttaactatgaaaccattcatt

SEQ ID NO: 39081 - DNA, 201 bp, Bos taurus
tctaatgatttgtaaacttcccccagcctgctgtgtgctgtgctgtttctccttgaaactgtcaccgttttatttacttgtgctggtgaatatactccctygcaaagaatgaagctatcaattcagggttctgggcaagagatgaacttaatttctcatgtaaatataaacttggcagaaagatggcagctgttcccctag

SEQ ID NO: 39082 - DNA, 201 bp, Bos taurus
tcttactatctctttatagaaattggagacatttatttctcatcatgttctctccagggttattgcaaattttgacagtatcattaaagctactctgatcyttctatttttatgtaattacttatttcatagactttagtgttctcagaactaaattttttcactattttttcaaccttttattatccatataaaggattt

SEQ ID NO: 39083 - DNA, 201 bp, Bos taurus
ataaaatagttttgggtcaatctagggccaaatctgtgggtccactaactttgactttcagatttgtcatgtctgaaagcatccagattagtcatgtgtgraaacattgcccgtttgttgaatgttaactcccaggatggaaaccgtgggctgcagagttagagaatcctgggtttagcaactgacttggcaatttcccag

SEQ ID NO: 39084 - DNA, 201 bp, Bos taurus
tgttattgtctgttgggttcaacacaccctgaaccctccagataatagagttaaacatctctcaaagctctgggttcacacaaagacagtaactccaaggraatattttaggctggatggccttgtccactgtctggccactttcctagcattttcctacagaagatgctagagtcacccggacttccaagaatacacatg

SEQ ID NO: 39085 - DNA, 201 bp, Bos taurus
ccaggagagaaggaaggacaggggaagcctggcgagctgcagtccatggggtcgcaaagagtcagttatgacgtagtgactgaacagcaacaatgaacaaygcaaagtcgagtatctgttaactcagatttccgatgttttggtggcagcttctactcccagaatctgtgttttaaaaacactaagtgacattctgcatct

SEQ ID NO: 39086 - DNA, 201 bp, Bos taurus
tgcctggaaaataccatggacagaggagtctggcgggccacagtccatggggttgctaagaatcagacacaaataagcacgcatgctcgcactatgagctrcagaagacaatgggccgtccaaggaagaatcaacagaaataacagaaaatagaataagtatcataagattcgcaaatcaatctgaaatagtttataaaat

SEQ ID NO: 39087 - DNA, 201 bp, Bos taurus
atctggttaatggaagaggtcacggagtaacacagtagtaaccagggcagcagaagtcaccgagcactgagcagtcagctctcagcctgcggacctcggaycctaagcccagggcctgctggatgagaggaagcccatgtcctgccttacccagggacccctccagcttccatgtggttggccagggtgacgtcatgtgac

SEQ ID NO: 39088 - DNA, 201 bp, Bos taurus
agtcagcgtgcttgttacacagtgtagggaggccgaaatgctttgagcagatgaaaatcaatatgccctttgacaagtcactgttcccttttacaaaaccrtcaaggcctttcgttgcattcctatattgttgtctcattttataaaccctggctatattaaattctatttaaatttaaacacttttgaccaaaaaggggc

SEQ ID NO: 39089 - DNA, 201 bp, Bos taurus
gattttacttttggaagcagagacagaggccagcctctgaggaaggcagtgctgtccagatgagaaggtgtctcaccagtggagtccagtacctggcccamctggctgctggacccctctatgaaagtgttagtcactcactcgtgtctgactctttgccaccccatagactgtagcccaccaggatcctctgtccatggg

SEQ ID NO: 39090 - DNA, 201 bp, Bos taurus
ggaccagaccaccacgtccccagggtcctgggccagcgttcactcctctgtccccatcttcctgttctcactgtccctgctgggaagggtgatcctgtacrcagaggcctgatttacagatacaatgggccatcaacagtggggctagttcacccttaggctttgaaaagacctgttcttctcatgatgctttcactgtcc

SEQ ID NO: 39091 - DNA, 201 bp, Bos taurus
agccacggaggccacactctcaggctggggtcagatggcaagagacgtgacgctgaagaagcaggcagcccacagcctgcctccctgacttccaggtgagraaggcagtctgagacaggagggccattctctgctctgtcctggggtggctggttgatcattcccgactgatgaggatgcccagagcggggaaactctgcc

SEQ ID NO: 39092 - DNA, 201 bp, Bos taurus
tcagagagaaattataaagctttctgcaggaatgaactacagaacggagggacggaattccttagccaataagtagctatcatggaacctgggcccctgcrttggtgatggactatctgcccattgtcatcccttgcctgatcttctctccttgagggtttgactttgcatcccttcccgtgaagaactgaagtccttccc

SEQ ID NO: 39093 - DNA, 201 bp, Bos taurus
tcatggggtcgcaaagagtcggacacgactgagccactgaactgaactgaacatgtatcaattcaatagtcataaaaatatgacatatttgcgttgccatmgtaagtaggccctttagtcttaaaaagaaaaaaactttatttcagactcacagacactctgaaggtggcagggtctccacaggttgtcaggaggctgact

SEQ ID NO: 39094 - DNA, 201 bp, Bos taurus
ttttctagcatttagtataaagcaaagaagagaatactgtgataattacagctgaaccagttcacattgacttgattttatcagaaaacaaacaaacaaayaaagagcctatcaaattgactttgtttacagagaagattaaattcagtttttttctttttaaaatttttaattggaggataattgctttacagtgttgtg

SEQ ID NO: 39095 - DNA, 201 bp, Bos taurus
cagtctcagtctctggctgggaacccaagccctgcttcaggctgctgcaggccagggccaccagagatcagacttcctatagaattctctttatcctgctytggatgaaccagctgagccaatacatcctccttgctctgatatgatgctggtgatttgacccacttcttgccaaatccagggcagatttgcttttccacc

SEQ ID NO: 39096 - DNA, 201 bp, Bos taurus
gaccttggggccaggccaggagtggtctgcatcactgccatcctcaagcccttggcgggactcaggactgggctccaaccactggaaaggaaacagaaacmgtctcctgcgtggccaagaagaagaaaggaagcaggttttccttttcagcaagcatgctctctctgttaggggtcttaactcttctgtgtctgcgcacca

SEQ ID NO: 39097 - DNA, 201 bp, Bos taurus
ttacgttttggtttttggccgtgaggtatgtgggatcctagcaccccaaccagggaccaaattcacactccctgcactggaatgggaagtgttagccactrggccaccagggaagcccatccatatgcatttttaaaggaattgttggactttccgatcacagaggtggagaggaggtgatggaagatcaactttccacac

SEQ ID NO: 39098 - DNA, 201 bp, Bos taurus
agtgcccttataagaagagacacaacagaggtgagctctctctctctatcaccctctgccatttgaaggcacaagaggagaaggccatctgcaacagggamgtggagctccacccaagaggatgtggggcgggcagcactgcagaagaaaaggctcctctcctttggggcaactctgaattcaaggcaagcccacactagg

SEQ ID NO: 39099 - DNA, 201 bp, Bos taurus
gaggagccaggcaactggctggaagacttggaagaacagcagagccgatgtggtcaaatccgagctcacgttccacacattcagcacgtgaaagcatcagragacaggccactccaaccccccagacgccaccacagagtggaaaggacagtcgtgcgagacacagccacacaccgccacccctcagcctcccgaggcctg

SEQ ID NO: 39100 - DNA, 201 bp, Bos taurus
aaagtcagaatgagggcttctacctacctacctcagttgcagggaaggtcctgcccccatgagcaaaaggtcaaggcttggaagcaggtgctaaaagttckgggcagaaagtctgcataggaccaaccgtgggccatgaaccatgagccagctcagagcgcagtgaccttggtgacatccccgtctcctgccccggggccg

SEQ ID NO: 39101 - DNA, 201 bp, Bos taurus
cggttgatataccagccctaaatgattttctcctttaccctcaatcagtcccttctaggatacctaccggactttttgggcctttgcccccacaaactttyggtcttttacttggccgatctagtttgatttctaaaggaattactgttcaccctggaataattgattcagactataaaggaacaattcaaattatgatgt

SEQ ID NO: 39102 - DNA, 201 bp, Bos taurus
gtgggattcccatgactattaatcacaccatagctcctcgcccagcaaagactcagcaggggctgcatcagctgtcctgtctgtctctgtctccagggccmatgctcaccctccttttatcctcgctgtcctgtcggtgtctcgtggctcatttgtgtgtcttgatccagtttaggcgtgtgaaagcagtcccgtctgtct

SEQ ID NO: 39103 - DNA, 201 bp, Bos taurus
aatcacgtcctgcaagggaggaaggttggggtgtcctgaggacctgtcctgcttgggagagaggtcacagttccatcaactctaaggccgattcggcaaaygcgtggtgtagtcaggtcccctgggaaacagagcctggggggagattttcactcagggaagtttggacccaaggcccaaggaaggaagcagggctggact

SEQ ID NO: 39104 - DNA, 201 bp, Bos taurus
tgtcccgagtcaaggctcctctcattctccaggccaccactacctcttccaggctcaggatcacaggagagggcaggaagtccctgaagctccaggcctcmtttcccccaattcttgactgtcccatcaggggctcagaccctttcccatgatagcctccctgcctgcagtgggagatgttactgttggaaaagtactgta

SEQ ID NO: 39105 - DNA, 201 bp, Bos taurus
cctggggcaaaattctacaaggaaagttttggagtcgttcttcttggagaagaagcactggaaagagtacctgattgatgcctatgacagggccatttccrgtgacaattctaaatgcaaaacgtgatacagcaaatggcaacaaaaacagggctggataaggagaaaccgagagtcttctcttcgtgcacagaagcaaga

SEQ ID NO: 39106 - DNA, 201 bp, Bos taurus
tctttaccatctaagccaccagggaatccccaaagcccattcaagtgtcttctaatttttccttcatcttaaggatgtggctgtgtgccaggccttgttayataaactcaatctgaagagcaaccctaagaagtaggtactacccagacccccattttgcaggtgagaaaactgaaacaaatgggaattaagtaactggcc

SEQ ID NO: 39107 - DNA, 201 bp, Bos taurus
cagggaggacacaggaaggatccgtgacactgcaggagcagcccttgggagcccaaagagtggaaaggtggccgggtacgtggccctgcgggtggcctccrtccccaagacagaaagtataccccactgggcacatcctgagaccactcctgccttaaccctacatctgcccccgggcccatctgaatgtcagctcttcac

SEQ ID NO: 39108 - DNA, 201 bp, Bos taurus
tggggtacaaattaattgcacggttcctcattttaaccccttgggacccagcccaaggtccttcctcaggcatttattgctgatatggaggagaaaggccmgtgtgttgccatggaaaccattatgggaagaacagacaacacttctatctgagccagagaaaatgcatccaggcataaacactggtgggagttggaagtc

SEQ ID NO: 39109 - DNA, 201 bp, Bos taurus
actttcccgttgagaaggggacacaagactaaaacaaaaggcctaacagaggagtcacacagggtgtgaaagccactgtgatgagcaggagtgcgtgcacrgctgtggctctggcctcaggcctggctgtgagctggcagcactatccagctcgaggtttctcctggggcgtcagcttcctgagcataatgcagtcagcgc

SEQ ID NO: 39110 - DNA, 201 bp, Bos taurus
agaatgcgatctgtctccaagctcccttcctttcaagcagcctttttcctacttttaaaaaatatttatttatttggccccacctggttttacttgtggcrctctggttcttttttttattttactttttaaattttggcacgtgggatatttagctttggcacgtggaacctagttccccaaccagggactgaccccagg

SEQ ID NO: 39111 - DNA, 201 bp, Bos taurus
gctcaatctctggtcagggagctaaatcccacaggccacaactaaagaaccctgcacgctgcaatgaaggtcggggatcctgagcatctcaactaagaccwgtgcggccaaataaacaaatatattttaaagttacttttcctttccattttcttattagccaagcaaatgagtatgctttacttctctgcacaaaaatca

SEQ ID NO: 39112 - DNA, 201 bp, Bos taurus
gtttctctgtaggctttattgggtcagatgcaagatttgatcagagggggaaaaattaatcctggagagaagcctcgctggattcaaggccctggggcccygcagggctctgccaggtgcatttggaaaggaagcccaaccttgaccatgaattagcaaagaagcagcatgaaggacaccaagcaagctcaaagacccagg

SEQ ID NO: 39113 - DNA, 201 bp, Bos taurus
tgaggtatcttcccaagagcaggtgaggacaggtggtaactgtctctctgttgatgccaactcggcgttttccctctctgtcctggccgttcttcatactycagcgaagacctcatgacacacacgttccaaccagccctggtggtaaatctcagctgccttgcccatcggccttccctcacacctgtggtggaaacagct

SEQ ID NO: 39114 - DNA, 201 bp, Bos taurus
acatgggtgctgcacacagaaaacagtactctcacagggtgctgtacacagagcacagtaccccttcagagtgctgcacacaaagcacagtgctcccacaygggtgctggacatggaaaacagtactcctacagtattctcacagggtgctacacacagaacacagtccctctgcagagtgctccacacagaacacagtac

SEQ ID NO: 39115 - DNA, 201 bp, Bos taurus
tgtggcttatatcctttggtttgccacatttttcagattcaacagttttattttttctttcctttttctagatacattttggcaaactttgcttaactttwaaaaaaaatgatcagggttgagttttattaattcttggattttttgctttaatttttgctctgtattttcttttctttatgtttacatgtaaattgggtt

SEQ ID NO: 39116 - DNA, 201 bp, Bos taurus
ggctacaatccatagggtcacaaagagtcagacacgactgaagcaactgggcatgcacaccggcacagtgtcaggagactgggccaccacgtttgaagttyagttcagttcagtcactcagtcatgtccaactctttgcaaccccatggactgcagcacgccaggcctccctgtccctcaccaactcctggagttcactca

SEQ ID NO: 39117 - DNA, 201 bp, Bos taurus
tgaaattcaaagacataaaatgtatttctggaatgaagacttttgagtgtatgcgtgaaaaccaaccccctgagcgtctgccctcagaatgacaacatctmgccttcatttcaggagcctctgcttggggcaaacaggtctgttctgccgtcggcttgtattttcctcagcgacacaggaatgagcagtgggccactctga

SEQ ID NO: 39118 - DNA, 201 bp, Bos taurus
acaaaaccactgcagctgcctgtgagtcatggctggcccaacagagcatccagagctggtctatctcatagcaagtggtcagctgtcctgcacggggctgyctgccttagtccccgggcccacggatgtatactgggatcccatccatcccgctgcaagccagttctttgtttcagtcaaattcaatgtattaggttgttc

SEQ ID NO: 39119 - DNA, 201 bp, Bos taurus
gccacatccctgagaactctgcctgggggttatcttcttatggggagaaaagccagggtacaaaacacgtattactgcacagaacaccacgatggcctggrcttctctgtgtggattcagagtcaatatgagtccatcaggctgccactgaaagcagcaggtttgatgaataaggaccaactctggcactggcctacaggc

SEQ ID NO: 39120 - DNA, 201 bp, Bos taurus
actgcagaactcagggcctcctcctgcctgccccaccttgggtgttttccgtcccaggggaaacgtccatgcatccctgtttccatctgggagctcaggaygcagcccctcgggccctctggctttctgtatttccggtcccagatcacaggtagctgtttccagtacttacctcaccacgcctggactgaccagactatc

SEQ ID NO: 39121 - DNA, 201 bp, Bos taurus
ggaaagcagcggtggggtgttaattgcgtataattactcgggatgccgaagtattttacaattgagataatttgcctgaaagtgttggtatttagcaaagrgaatttatggtaattccctgattttcccccaactgcctggtaatctttgaaacgaggaagtagcagcacagtgagaattctgaactgaaacaaagccata

SEQ ID NO: 39122 - DNA, 201 bp, Bos taurus
tgggcctttacagagcaagactgcctgcttctcattcggcagatcgggggtcatgacttaaaagatgtacaaaggtggacgaaagggcggggtcatccagygaggcatgctaggggccgcgggtgacctgccaaccagcatcccagctcagtgtcctccagatgacggtcaccacctgggaaaggcagcctagctcagctg

SEQ ID NO: 39123 - DNA, 201 bp, Bos taurus
gtgaatatagaggttatttatgcaaaatggtcagtggtgagggtgggagaagtcacgtgaccttgcccttccagctgccacactgctgaatctacccgatrtgaggcctcatatcgcatcgtatttttcagcccatttgccaatcacaatttcctcagctttccaaatactgcaggcagttcctaggcacccaaatgctgt

SEQ ID NO: 39124 - DNA, 201 bp, Bos taurus
cccaagacgtcttcctccagaaggcccggctggctcacccacgccgtctctgccgggtggagttaagcctgccccctgagcccccagtgtctctgggctcygctgtgtctaccaagggactagggctgtcccgggaatgcttgttgcgtgaccgtctgtgggccctgcaggggttgctgagagactgctggccgggtaccc

SEQ ID NO: 39125 - DNA, 201 bp, Bos taurus
gtgtccttagaagaaccactgcaaccctctgaaatgcgagtcatgctgtcttccttttaccgaaggggaagcgaggcccagaggtgccaggcaccgtgtcrtaactgtgagagccgggaagtcaccctggaaccgggtctggcaggtgtgcagctcagcaggaacggagctggccccgttaagggagggtctgagcacctc

SEQ ID NO: 39126 - DNA, 201 bp, Bos taurus
gcccccacacgagccacacgagcgtctgcgaccacggcgaagtgagaaagggcaccaggggagtgcccagggtgctggccttccgccaaggcagaccacaygggcaagttcagggagatttctacagtgacaactttcccttctcaatgtccaagggctttgggtcgttgctttcctgaacttcagagcggcctggccaga

SEQ ID NO: 39127 - DNA, 201 bp, Bos taurus
aatgttcttttaaaataatggctctgcttgacaaagagcaaccatgtcaataccacgtggactgctgtgtaatcttttaaacgtgatgcactaggcgttcyggagcttcttccgatggagactgtcgttcaaagtgtttgatagttgatggaggaacagaaggtcgagggagtgagttttagcgtctgcggatgtttcggt

SEQ ID NO: 39128 - DNA, 201 bp, Bos taurus
gggcagcccagcataaagcacagatggacaaatgaccgcaggctgctggccatgcacgcaggcgtccgggtggtttacactcacagtcgtccttccggccrgcggcagagccaaaggcgccgcctttgccgtgggaacttggggtccagcgagctgcctggctagcggtccagttactgctcagatgctctgagcctgcca

SEQ ID NO: 39129 - DNA, 201 bp, Bos taurus
gtcacagctcaggggcttggacccacagcctcagctgctccatgcactggccgagcgagggcagtctcagaactcggggccactgtcttttctcctgtaaygtgtgggagaccatggtgtctccccaaagggtggggtggaggtggctcagagggccccagttctggcacccaggacatttttcagttgctcagtcgtgtc

SEQ ID NO: 39130 - DNA, 201 bp, Bos taurus
cgacagtgcagcctctgagcccgccaccacgtcagctcaagggccactcggctgcttctcacagtgaccccgagaggaaggctccgtttgaaggatcccaygccgcagatgaggacatggaggctcagtgggtccgagagtcacacgggactcagggccaggatgcagtggccccaggtccagactcagccaccagccaag

SEQ ID NO: 39131 - DNA, 201 bp, Bos taurus
cccttgctcttctttcagcttgatcggcatcgtgtccgccgcagcagtttgcacttggagagagtagagtgctgctcatgcttgcctggccaggggccctkccagcagctccctgaggagatcagggggcttgcagacccctgactctgccaggaccccagcatgagcactgaccctccgcaagtacagaccagggagggc

SEQ ID NO: 39132 - DNA, 201 bp, Bos taurus
tttgaaggggctgagaagggacatcaggccaggcagccagcggtctctgtgccacggagctgaccgttcagtgatcatatggtggtcaagcagagcactgygcaggccagggagctggccctgcacctgtaacgtgaggcagcagcattgatcaaagcacggggtggcttcacctgcaaaggaggagctgctggcaccccg

SEQ ID NO: 39133 - DNA, 201 bp, Bos taurus
cccagctgacgaagcccccagatccgaagtgacccgccgctgagccccagtccctcaccccgagtgaggagtgagtctggcctctagagctgagttgttgmgcagaggctgatgccgagctggaggcggagggcccgagagcagccccccagcactcatgtgcggcggccttctagccacttcctgagcgtggagagcgtc

SEQ ID NO: 39134 - DNA, 201 bp, Bos taurus
agcagcagtgatggtcaggacgcagtgtccatctcctcattggagcagagaaggccggttccctgctgcactcctacagggatttcaaggccggaaaaccygatcatttcattaaactgacacaagagagttcacgaattcaaacaggctcatctgctccacagagcgactcactgatggtccttaaattataaggagctc

SEQ ID NO: 39135 - DNA, 201 bp, Bos taurus
atgtgtgggttggagaaagtagaaacaccgcagtgagctgggcgcccgggcatttcacggtcggatgcgtatggaaaactcttccaaagggatcaccgagkgaagcaaagaaggagagggtgtttgggggtggggtgaagccgcggtgaccccaggccccagagcaggaggggcccccaggcccacggcagagctcgtcca

SEQ ID NO: 39136 - DNA, 201 bp, Bos taurus
ctcgtgtcttcgctgggacccgccgggcgggaaccggagcagccgccagctttgtggcggaggtgagtctgtgtctgcggaggctccggggtagtgggggsgtgtcccagggccgtttctccgtggctcagttctcttccctgtcccaggcacaagccaccttccccctctgcacccctgccgcccctgctgctgtcctac

SEQ ID NO: 39137 - DNA, 201 bp, Bos taurus
actcggaggggaggacccctctgaggccctccgctggcctctgctgttgtggtgtgagcagcgtttgtggggcctggggcctgcgttcctggcaggcattkccctgcaggggacattcccacagccatggtggctcctgagtctccgctgggaagacaggcccagctccggcgcagggtccccatcaggaaccgtgtcccc

SEQ ID NO: 39138 - DNA, 201 bp, Bos taurus
tgtgagtccagggtgtgtgatgcagggagcttggggggatcttgggcgtctgacacgggtcaggcagcacccgcaggacgccctccaggccccctcctccracaggcagcaggctcacctgtctaaccttgtgatacatgcaagcaagctctccctcccgtccggtttcgggtgtctggggccgttgtggcggcctctgat

SEQ ID NO: 39139 - DNA, 201 bp, Bos taurus
ctatcaccatccgaagtgtggatgcagagtcagaaccctgagggcagccaggccatggagctcttgggccgtgtcggcctgacgggccgccggggccagcrtgtgggcagacgatgcgtctcagtgtctcccatgcagcagcaaaaaggcaaagtacattagagacttaagttccaggtggagccccagaggccctgggat

SEQ ID NO: 39140 - DNA, 201 bp, Bos taurus
accccccatcccggccccgcttggacagtccttggcaccaaccgcctccgactctgctgagggacatggctctgtccccaaggcacctggggctcctctayctgccagcaggggcctgcgggtggcccagcccaccacccagcctgctcagacccaggcctggcctcctgccgaccccgggggcccccagcaggggaagat

SEQ ID NO: 39141 - DNA, 201 bp, Bos taurus
cgcgggcacgtttccgaggaaagcctctgcggaggacgttacaaagtgtccctgtggtggtggcggtgccgtttctaagagagtttcttctggcctgtttygtctgttctgaaatgttaagtgggtaggatgagaatatgaacaaggattacggtctcacacgcgaagacacaccggcaggcatcttctcatggtttcctt

SEQ ID NO: 39142 - DNA, 201 bp, Bos taurus
ggagaatcacagcacacacagctgggaccgcgttcacgacagccctgggggagcaccaaccacgggacgagaggcagtgtggctggaaggcccgagcggayacctcaaggcgccccacaccagaagacagctggaagtgcattttctaatggcagcggtgaccacactacggagacgtgcacgtgagggccgtgtccaccc

SEQ ID NO: 39143 - DNA, 201 bp, Bos taurus
gcccggcgtcattttcaccgcaagccctctggtggccccctcacccagacctgcctgtgacctgccacccctgcctggcctcttccccactctctcctcaycttctcactccagcttcctccacgcgcgatccgtgtttctgtcaagtcttggctggaggccgcctcacccacaaaaccaccacctgggtcatcagacccc

SEQ ID NO: 39144 - DNA, 201 bp, Bos taurus
ctgtgtggcccagggcagcaagggcatttgttgacctgtggcaagcaaggcagtgtctccaaatggctgtctgtttgacctgggtgagaggcatgagctcrtgttggcccactggggtgtgttgctgggttatctgtgtgacttcctacatgatcagggggttgttggggctggtgcagcctgctggttgacagctaagcc

SEQ ID NO: 39145 - DNA, 201 bp, Bos taurus
tggtatgaaggccacatccacacatagtttcagtggaggtcacaggagggtcagtaacaagatgtccctctccttcccagctagggacgtatgagtagaarcctgctggcctctggtactcccacaaatagcctacagtaaggggtagtcatttccttaggcatcagtggaggccaggtaataaatctggatttttctcca

SEQ ID NO: 39146 - DNA, 201 bp, Bos taurus
gtcatactgcctgcccccggcccctgcaaaactgggaagagcaaaaagctacctccaaacacaaagacagtccttgtggagtcctcaccacatagtgtcasttttccccagaagtgggctgagttttcttggatggttcaggagactgactgtgctcatctcagcccaaacccatcttcagggacctcctgttgtagcttg

SEQ ID NO: 39147 - DNA, 201 bp, Bos taurus
tgatgaggctgtgggctggaaggaaccaaaagtgactgtgtttgttgtcaggttgctctcctttgcctcaagagaacggtcatgggtccctgggtgatgcrtggtgtggactggtcgtgttcctgcagcatcctagttgcactaggagtagttggatgtgcttgtgaaacatgtcagatacagaaataaaagcatgaggat

SEQ ID NO: 39148 - DNA, 201 bp, Bos taurus
taagtgcaggccccctcccctgcacacacagtccagcctctctagccttccggctgtggttcagaccagcatgctgtgtgcagagcttacacgccctctgrgggtacatccaaatcttcaagtggcccactcttccatacatttgcatcttgactttaataacacgtgtgtagtcaggtcaccagaaaattgggagaatcc

SEQ ID NO: 39149 - DNA, 201 bp, Bos taurus
cagcagggaccatgaaggcagagactggggatgcttctgcaggccagagagcaccagccagccagcaaccatgcggagccgggggcagggcctggaacackttctccctaatagtccccggaaggaaccaaccctcctgacaccttattcttggacttccggcctctggaactatgagacaagagagataatacactactg

SEQ ID NO: 39150 - DNA, 201 bp, Bos taurus
aactgaagaaaaagcagaagtggacggaattcccaggggcataaaccccacggaaagctgtgctctcagggctccaggagctgtcggcatactgggactcrtacacttctgtccacggatgttctcccacaactctggacatggggaaggctctctccatctgcagactgtcctagtattcaggaactgcctccttcctgg

SEQ ID NO: 39151 - DNA, 201 bp, Bos taurus
cacatatccagaaaaagtctgttaattcataaagatacaagtatacctatgttcacagcagcactattcacagtagccaagatatggaagcaacctaagcrttcacagacagataaagatgtggtatgtatgtgcaatggaatactactcggccatgaaaaagagtgaaataatgccatctgaagcaacatggagtgacct

SEQ ID NO: 39152 - DNA, 201 bp, Bos taurus
tcaattttctatgtagagctaagccctttgtgctatcacccaggcatttttgtgccacgggcatctgagaagccagagactgcattactgagtattaaggyacttgcctaaggctagatgttcccataaatctagaaacaacctgaaactcccaatcccattaggctctttgcagcacaacagctggattcctgggactca

SEQ ID NO: 39153 - DNA, 201 bp, Bos taurus
ctttctgagctttgggattcacagttcccagctggctcacatcttccaggggtcatgggggcctgcatacttctttgggccaggggacagactcacagccygtggtgtgtggattgggaatggaatgaggggtgctggtgggacatgagcagccctcctccctgtgaacatggccggagtggggccagcctcacagagcag

SEQ ID NO: 39154 - DNA, 201 bp, Bos taurus
atgccacctgggaagcccacaggtggcccctacagaagatttgtttctgcgctttggcattgtgcccttgaccttcttcatgtcttcacttggactaatcmaggtcatcactgacggccaggtcatttttttagatttatgtggcaaaattgtccacttcaaataaatggaaaattttaaaaagtgggtaaagcaaataaa

SEQ ID NO: 39155 - DNA, 201 bp, Bos taurus
ccactgggtctcaaagccagccatgctggggccctgccctgaccagcagtttgccctcatcagtcatgagcaaataggcctctctgctaacttgctgggaygtgccttacctgccaacacatccacagcaactacataactcagggtcttgagccggcgaggccaagggtcagccttcaataccagcatgcgcacagcagt

SEQ ID NO: 39156 - DNA, 201 bp, Bos taurus
gtgtgtgcattcaaaacaaagagagggacagagactgagagagagagtgctctgatgacagagtgctcttcttataaggacactagccctagcagataagrggcccgccctttatgacctcattttaccatattagcttctgtagaggcttcataggcacatgcagccactctgggtattagggtttcagcatacagattt

SEQ ID NO: 39157 - DNA, 201 bp, Bos taurus
gtaaacattgtctgtagaatataaagccctgtataaatataatgtcatatcttatattttctgtcttctttccatccagttgcatagtgagaagttagggrtggtcctaaaaaattcctatgatcaatgaaaggtgagccaaagcaggacacatgcagaagatttaaaatccagttagtgattctttaccccttttaatct

SEQ ID NO: 39158 - DNA, 201 bp, Bos taurus
tagaaaagacattattttgttgtaatagattttttgtccccctctttcttgctttcagccccctgcagtgagttttttaatgcctgtctattctgctataycttttgtagtttcaacttcaataccttgaatttcactttttttcatcattctgggtgcacagatatcttcagggacagcagtttctccactctttgagct

SEQ ID NO: 39159 - DNA, 201 bp, Bos taurus
aagcagttcatgacattggagtttaattatgggcaccattagcatgaaattttgtaaatattttcaaggatattttaaaacataattcatctttttgaaakcttctgcttttctattgcttctctaaccaattcaagatggaaaaaagatagaagactgaacctatttatatcttatttgcattatgtactgcgtaactct

SEQ ID NO: 39160 - DNA, 201 bp, Bos taurus
taacttgcaatgaacataatttaaatgtacataagaagatttggatggcaaacttcaaaaatgagggattgggtgcaaatctgcaccagtcttttactctyagcagaatctctaaggcttgacatgcgaggttatccttcgttggttttgagaatggctgatggtagtaagaatgtgatttcccttctttatcattgattc

SEQ ID NO: 39161 - DNA, 201 bp, Bos taurus
acaatataaagacatttcaggcagcagatttactgtagatgataattttcaacatttcccagaaaactgtgaccacaggccactctgattgatggggtcargctctgacagagaatctgattggagttcctcttggctttgacaaggatgcctgcactcttccaaattagacgaggcctctgctccctgttggacacagtc

SEQ ID NO: 39162 - DNA, 201 bp, Bos taurus
ataaagactgaaaaaaaaaatgaacagaacctcagaaacctgtgggggcaatataaaaatgtctaacagatgcacaattggattcccagaaggaaaagatrggcagaattgaacagtgaaaaatatattagaagaaatagtgaccaaaatttcccaaagtcatacaattataagttctacaagttcagtgatctatgtgta

SEQ ID NO: 39163 - DNA, 201 bp, Bos taurus
tatttttttttccactctgtctcacaaggaaacaaggggtgtgaccttcctcctttcctatttctatctactggaggccttgctaactttctttctccagygcattttcaccatcttccatgtatttccaagggatgacaatcctggaaatgacctgccaaggagaggaagcagtttggaccagacctgtcaggcccagga

SEQ ID NO: 39164 - DNA, 201 bp, Bos taurus
gtacggcaccaggttccttctggacagctccgcgctgctctcctgctctgaagacacatccatcaggtattgggacctgggcggcttcaccaacactgtgyagtaccagggccacacctgccccttgtgggacctggacatcggcccgcacagcctgtatttcgccagcgggtgccacgactgcacggcccacctctggtc

SEQ ID NO: 39165 - DNA, 201 bp, Bos taurus
gtgggggtgatgaagataatgatgacctccttcaaagggtccacgcaggcagtactacactcgtgccctcttccctgagcaggccaccactaactcacgcytccaccagagactcccggacactcacacccaagtctgggtcagtctcttgtggggtcaattctcctttctccttggtcctggtgtgcacaagattctttt

SEQ ID NO: 39166 - DNA, 201 bp, Bos taurus
aaccttacaatgtgtgatttttctgaaagatacatacctcctccctaaatgtacttgctccgcatgtccaaacttgaccttctaatcccctgactacatcktcaaactattagccagatcagtgagtcactagaaaatccagtgtagaggtaaaactgtgtatttttgtgaaatttatgtgaaatttatcttcaaatttgg

SEQ ID NO: 39167 - DNA, 201 bp, Bos taurus
tgctaattagcatctagagatatcatattatagatgcttctttaaaagctatcagccctccaactctgcgtagtgacatggtatctatcaatgtctcaagrtgcctgcaattctgacaaaaggcactttgaagaactggcacgcacctccatatttgcatttttgcatctcattatggacataattgcataccaacacagc

SEQ ID NO: 39168 - DNA, 201 bp, Bos taurus
acttcaggatttcttagtgtcaattattcattcttttattaaaaacaaaacatctgtttgtgttacatgccatgctgtatactggagtttaccggccaacrcccattgggggcatgaagtttattggcagagaatttaaattatgcagctactaagaaactttatttaactctgctggtttttttctgcacatgacaagga

SEQ ID NO: 39169 - DNA, 201 bp, Bos taurus
taaaatgcactagagcaacctgggaatgaatccgttctggttcacctgcagaggcctcatgtctggagaaagtgccgagtttacaggagatgtcatagatmaagactaggcaggtctctcgagtggccaccaccttcctgcatttctcagaaaaaacctgaaaccgtctcagttgttttctgttcatgtccttcaaggggg

SEQ ID NO: 39170 - DNA, 201 bp, Bos taurus
aaaagcaaaacggccctttgttcagctaattaacgaaggcccaactccgaaagcagatgtgtttgcttagctaatcacaagcatgtttctttcaaggaacrtcatttcgagggggccgctcaggggaatgggaaagggggacacagcaacccccccacccacgtcctctctgcctcaggggtctctcacccccagactgag

SEQ ID NO: 39171 - DNA, 201 bp, Bos taurus
tatgtatatagccatgcaacttgtgcccgttaggagaggaacgtgtgcatgattcaagggtggtaaatggcaaggaggaggccttcttgcagtgagcttgkagatttctcttattttgctggagagtcttaccggaggggcattccagaacttgttaaactttcaaacgaggtggcccagtctgctagatatgcagtaggt

SEQ ID NO: 39172 - DNA, 201 bp, Bos taurus
agctttaaaatttccttcgagtgtgctctcactgtcatttctaagtttgcaagaaattaaaaacattattatttatatgataatgtatcttataagtgaaytgagctgcagtgcattattggattaattttgacaatcactttagtttcaaaatgatcttcaactctgatatttgttcttgttgtgccatttaaagatttt

SEQ ID NO: 39173 - DNA, 201 bp, Bos taurus
atgactaagagaaacccatctgttggatgaggagtcagggaaggccttcctaggggattgacatttgagtcaagacaagaatgatacaaaagagctgtctycagatttctgtcgggccatcaggatgaggttcatcccctcctagagagggtccaaacaggaatttgtgttttgagaatatgaataaacacttacggaata

SEQ ID NO: 39174 - DNA, 201 bp, Bos taurus
taggtatggggccccctcacaccttgctgaggctggggacccctgacattccatactagatcagggacccctgacatacgtttgaagagcctcacaaatcygccttctcaggcctcttcagttgtaagtatcttaatcctttatctaattgggtgatgatagattaagattggtctttccaccagcctgtcatctccatcc

SEQ ID NO: 39175 - DNA, 201 bp, Bos taurus
attagagcagggattgcaagagggaataatggcagagaactgggctgtcaggaatacaagaggtaatttctagctacttctttggaaaaatagatttctgytaccttcagaaatctgctctcagaatatgaagcaaatagcttcacaataaaatatatttttttcttagactattcaccactgagacccccattcttcact

SEQ ID NO: 39176 - DNA, 201 bp, Bos taurus
caatctggtttatgttttggcatgtggcaatcattggcttgatagccgagaaaccttcatttccagaactttatggcctgtgtttcaactgcagacccagmcagagcccctcacctctcctgcgtgtttgatcttctaattgcctcaagacacagccacgggcttgctgtgcgatgctgcaggcctcagcctgagctgagg

SEQ ID NO: 39177 - DNA, 201 bp, Bos taurus
tcttgatccttatggaagccagttaaaattaattggaaaaagcttttaaagacctaagacgcagaccaaatgtatcgccaacccgcggcctcatcccgcayggaacatgaaggtcaccgcgaagctgcagatttatgcagaagggttgggtgatggaaaatgagacaaaagcatttggattttattattccatttactctg

SEQ ID NO: 39178 - DNA, 201 bp, Bos taurus
tattggcctcacattaagatatcacctagaatataaaggagctgggtagctattttctaagaccagttttaaaattaaaatcccatgattcttactattaygacttcataatctacataattaggcctgtagctgatcatctatgatcatttttgagctctgatcacaaatttctatattcctattagatagatctgcttg

SEQ ID NO: 39179 - DNA, 201 bp, Bos taurus
gaccctcctggtcccccttcctcagttatacaatcagccttataacacctgttatctgcttggagcagccggggtctggcttaatgaccacctcttcctcytcccaccactctccaccttcaaaataaaaaggaatactaacactgatagaaatagtaaaaatgctgtcaatatagagcgccactaacagtgataatacat

SEQ ID NO: 39180 - DNA, 201 bp, Bos taurus
taaactatgacttcagatccttgtttacttatttgatgcaatctacttacacttccatcaaagtgtgcctctaatgtataagttacatttctaacaacaamaaaaaatgatccaaagctgtgctaattaaaacaaaataggataaataactttaagagataacagcagtatgattcagaagcatgcaaaaagtgtgcagac

SEQ ID NO: 39181 - DNA, 201 bp, Bos taurus
aaattgaaaaatgctccatttataaaaaaattgtctttaagaatgtgtgtaagagtgatgttatttttacttcattagagaatttgctagggaaaccatgygggcctgggttttgcagggaggaggtttttgtttgtttgtttgtttgtttgtttgtttaacaatattgcttctatcttatgcttcggtatgtggtatctt

SEQ ID NO: 39182 - DNA, 201 bp, Bos taurus
tttggcctcccctgcaatctggctcctctccagtgaaagataacccatcttcgtcaagggcattcccagagcccagctagtctcatccggtgcaccttgcrggccgttgttatgtagaacaggctcccactgtattgagccaaagagctgcctgctcaggctcctggcagagtattcacctgggaggtggtaagtcttcag

SEQ ID NO: 39183 - DNA, 201 bp, Bos taurus
ttaccaaagatgactgtggaaataattcaaggtcatgtaagtctaagtcaatatcagcatatctgttatgcctggcccaggtttgaaatgttttagaagtrtattaattctagcaaatctcatgaaaaccaatgcaaataaaagtaagaaaatgtataaaaaaaatgttaggccaaaaagttaacgaagcacaaatacttt

SEQ ID NO: 39184 - DNA, 201 bp, Bos taurus
gttgaattgttccatttataaggcctttgtttttccttactgtgaaactcttaaggacactccatcgcccggtgcaattcaatatgactggagctctcagrggtcttgatctccacgtacagtacaccacaggagtgatttataaaccacaatcccagagcatcccaggaacaggaatgaattgaggcttctaagtgaaca

SEQ ID NO: 39185 - DNA, 201 bp, Bos taurus
caataaatctcttcatagatgtgcctatcatacaggccctgcatctctgatggaactccatctgatacaataagcatcaaattaactttattgttaggttktattgtggccttgaattttttatatcattcaacatcatttttgtttcttcctccctccttccattcttccactccctcctcctcctctttctcggtctct

SEQ ID NO: 39186 - DNA, 201 bp, Bos taurus
agagcaattgggccatacacatacatgcatctattctcgccaaactcccttcccatccaggctgccacctaacattgagcagagctctctgtgctagacaktgtgaccagcactattttaataggccgatctgaaaacaaacgtccattgtagtcatttgtaccaaagcaaattcaatctgaatcctgtgggcgacagaag

SEQ ID NO: 39187 - DNA, 201 bp, Bos taurus
tctggtggtaaccttaaataggagagtgtttatttatttatttatttacagcttccttgaacagagcagtttactaatttaaacaagtgtgaatcacatcraactaaacatttggttttgtctcagaaattacacattttcacaaacttttcagtcatttctacccactatgaaacttttgcacctatctcatatttaaag

SEQ ID NO: 39188 - DNA, 201 bp, Bos taurus
tgcctgcacctaccattgcaagatttttctaacatgtgcctatctgaaattgtgaaaggggattgatccattattctcttagcatgatagcttcagagttkttttcttatttattggaaatggtactttaaacaatctaataataatgctttctttgtatttttgttgtaaatctcttcacccagtatctagccttaaaaa

SEQ ID NO: 39189 - DNA, 201 bp, Bos taurus
tcaaaagtgctgctgatagaaatgctaaatggtattgccaccctggaataccactgtcagtggatcggaggtagggtggggagagtctgaatacagtgggkgcagagcgagagaattctctgggatattagaattgttctgcatcttctctctagtacagactgatacatactgatacgtgtgtaaaaacacatgtggttc

SEQ ID NO: 39190 - DNA, 201 bp, Bos taurus
atcttcccagcccagggatcaaacccacatatcttatgtctcctttattggcagatgggctctttaccactagtgctatctgggaggccatagaaatgatkttattgtgtctcaaaacagtaacttttttttactgggctatgtcctagaattgatcattcttggccaatttcccgtatatgataaatcctttccgtatgt

SEQ ID NO: 39191 - DNA, 201 bp, Bos taurus
tacccatcctgggaagtcagggagatcccaaagctcagcaagatgggtcagaagccagtagccaaggtccctgaaaataaagcatgggagacagtcaccawgtgagccaataaaccttctggccaatatttctcaatcagagcaactgcttatccatagtgtctgaaggggctccctcaactatgacattctgaaagctaa

SEQ ID NO: 39192 - DNA, 201 bp, Bos taurus
tccctgatatgtagacttctccctgtgtcttcatgttgccttcagtctatacctgtctgcctctgggtccagatttccccatttcataaagacatcagtcmcactgtcttagggcctgctgctgctgctgctaagtcacttttgtcatgtccgactctgtgcgacctcatagacggcagcccaccaggctccccagtccct

SEQ ID NO: 39193 - DNA, 201 bp, Bos taurus
ccccagcctctggcaagcagggctgtttctgggctcacttataatggaagctttcccaggacacagcctgcttcaggctcacgtccatatggctgggaagkggccacttcagcgacccggccgcagcactgcttatccacacagtgagcagaaggcttcaagcatcatcacagcctttcctgaactcacttcaccctagcc

SEQ ID NO: 39194 - DNA, 201 bp, Bos taurus
aaccccatggactgcagcctaccaggctcctccgtccatgggattttccaggcaagagtactggagtggggtgccagtcaggcagatgtaaattcaaatcygagttctactgtttactaggtatgtccctctagctttgcgtcgctctgacctcctccccttcctttgacagtgtgtcccagttaggtattactgcctaac

SEQ ID NO: 39195 - DNA, 201 bp, Bos taurus
agggggctctctcctcctgcctcgtcttatctatcatgtctgaaacccgccctgtgtccacggaagtttggggttggccaaaaagtccgtttctggttttytgtatcattgttcagaaatacccgaatgaactttctggctgacccagggtgttggctgaatgctgcacccaagcccagtggttcttatgcagggcctgag

SEQ ID NO: 39196 - DNA, 201 bp, Bos taurus
caggctgcaggaggaaggggacatgggatccacccttccttcggcccaagccctctcacctgcagtccaggtgaagttgggcccagcaccccgcttccagsgacaggaagctgaggactgactcatgagccacagggcttcctgaggctggcacagcagaggagccagttggccactctggtctcagtccctgagacccac

SEQ ID NO: 39197 - DNA, 201 bp, Bos taurus
accaaaacatcaggtgggtgaaaatgtctgtggatcttaaaaaggatggttgtaagcagcagataggtcacagagggtcaaggccccaaggcttacaggaygcaatcaagcatccagggcatgttgctacagtacaagctccctgggtactgactttggggaacagtgggtggcccctagaaggcattcagtggctattta

SEQ ID NO: 39198 - DNA, 201 bp, Bos taurus
ccacattttaaatcatacactaaagtgcagctcagaatagaccctacctctctcctgcatgtgcagccaggacattccttatgaagtgttctgagcagccygggccaaggtgctatatttcaatgccaatgcctttttttttttaatggccccaagattttttttttttttcctgattggagttaaatgtttttccatgtg

SEQ ID NO: 39199 - DNA, 201 bp, Bos taurus
agcccccacagatctctggttgactgaaaggccacgcacaagtggagaagagagcagagaggatccactttctctcctcactcctgcctgcgagcctgtgkgcacaggtgaaggagaggccagagggcccagaggaaagtaaaggctgggaagatgaaaagctgccttaagtctgaataacagcgtagcgcttgaggcatc

SEQ ID NO: 39200 - DNA, 201 bp, Bos taurus
gcagtctttggcctgtcttacctcgtagaacctctgccttcaccatcacatggtattttccctgtatgtgtgtgtcttaaatttaccattttaataaagamatgattcatatttgactggggcccaccctcatgaccatgtcttgacttattacatttgcaatgacactatttacaaataaagtccattttgaggtgctga

SEQ ID NO: 39201 - DNA, 201 bp, Bos taurus
tagagtatcactatattgcttttgttctcattgttgtggtaaccagggctcccctctttcctcttcatctctaattttagttgtcacggaatttgaggttkttctgtatcttaaagaaagacagcttcttgagtggaagaatcatagaacatgttatgggttcaggcctgacagagagagcttccacaaaaatttataaat

SEQ ID NO: 39202 - DNA, 201 bp, Bos taurus
aaggaaatgtactaaaaaatgtaaagtctacaaggagtcagagcccaagataatattagtaatgactgataatcattcaagatgatattgataaaaccccracagcatatgaaagagagactgaatgagcagctcagaatttttcaggacattaaatcaagggaattttccagtctctgcttctgacaaagagatttagaa

SEQ ID NO: 39203 - DNA, 201 bp, Bos taurus
atggcaacctactccagtattcttgcctggagaatcccatggacagaggagcctagtggctacagtccacagggtcacaaagagtcagacacgactgagcrtgcttgcacacacacgtacctgtggtaggtaatcgggtaaccaggaaagatgcgtgatcctcctctagagtgcagagtctgagggggaaatggctgccca

SEQ ID NO: 39204 - DNA, 201 bp, Bos taurus
tgcgaagtgactggcacagagactctggcaagtgaacagagtcgtaatgcgtgctaatttctgggaaaaattcttttccttttcactcctggcttaggagrtaataactctgtaactaaagaccttgctagtctcctcacttgtcacacgattccttctcctcccccaataaaatggcatttaacccggcaaagttgtata

SEQ ID NO: 39205 - DNA, 201 bp, Bos taurus
cttgcctccagaagacctgtcctagaggttacattgtccatcaccacttttccagacgaaatctggtctggatgtctgcctttctcccctcctccttcctyttctatcatcaagctgctggtaattttagtaaaatttaacatttgtgtgcttgttccatgagacctattttcctgtgaggtgcacaggttggtgaagaga

SEQ ID NO: 39206 - DNA, 201 bp, Bos taurus
catcctgtaatacgctcctagggctggacggataatgctgctcgcgtctaggtcaggagcttcattatcatggaaaaatcatctgttgcccagatgtcagyatgattgcctgacccgaaatcagagctccagtgtccgctttgggcgtgtgcaatggccatgaacttgggcaagctccgggagatggtgagggacagggag

SEQ ID NO: 39207 - DNA, 201 bp, Bos taurus
cacccacacccaaagtcaggaagggaaagggggtcccagaggagcgggcagacacctcagggccttctccacgtgctctggccttttcacttgatgcacaygattgttatgcacacttgaagtgcagccattgagctctcatgattgatatagccaggcccagacggacacggtctctggttgtcagggctattattctga

SEQ ID NO: 39208 - DNA, 201 bp, Bos taurus
gcaaggaaaccagaggtcggaaaactgatagcgtttgcctgatgttgttcagtacaaggtaggtcagacgcccaggatggatgacggaatgaaaagccccrgagtttccctctaatgtgtactgagtgcctaggtcacatcttcagcgggctttctcttattctgtctgtctccttctctctcctgtgacgggctgaagaa

SEQ ID NO: 39209 - DNA, 201 bp, Bos taurus
tttttttttttaaattttggccattctgtgagggatcttggttccctaaccaaggtttgaacccctgccccctgcactggaagcatggagtctaaacaacyggaccaccagggagtccagcaatggactttttttatcttagcgattagacgaaacattaacagataggattttgctagcagaaaatgatatcttggctca

SEQ ID NO: 39210 - DNA, 201 bp, Bos taurus
cagtgggctacaggccatagggtcacagagagtcaaacataactaagtgacttagcatgcacgcagatactgaaagcccctccaggtcgaagaagttaatrattggtgatgacaggtggcccacaagcatgtagaccccagactggttggacccgaaggctgctgatgctgactcctgcttacctcactgtcagcccatca

SEQ ID NO: 39211 - DNA, 201 bp, Bos taurus
ctacctgggacctcagaatgtgaccttatttggaaatggtctttgcagatataatgaactaattaagaatatttagattaactcatcctggacttaggackggccctgactccaatgatgctgtccttatctatagaggagagggcaccaagagacacaaaccaaaaaccctcgtgaagacagagctggattttggggtta

SEQ ID NO: 39212 - DNA, 201 bp, Bos taurus
gtaggcatcgggagttggtgatggacagggaggcctggcatgccacagtccacggtgtcgcagagtcagacacgactgagctgaactgactgacatctatygaagggccttgagtcatttcaaagtcattatcatttttttttataacttgtggactatctgacagtagcacttatatatcttttggatgtcacatctgac

SEQ ID NO: 39213 - DNA, 201 bp, Bos taurus
aacagctcgggccaattttatcccaagttccggaagtgtcagaaatggcacaggttatgtcagacttagtgtctaggatcccttgggaccattagccccartaactccgaggccaaatcctcatcccaggaaagcaaagcttccgctaccttaacaagaccatgtctgccttacaagtggagtagtaagttagcgacatga

SEQ ID NO: 39214 - DNA, 201 bp, Bos taurus
attttcatcattcaaaccacagtaaatctcagtttctttattgcactatctttgacatatgatgttgtgcaaatttaaggtgtagaacatgttaatttgayacatttatatattgtcatgtgattcaaacacctccttcagcactttcctacctaatcatttaaagccactatttccctcgagcgttccattctgctgttt

SEQ ID NO: 39215 - DNA, 201 bp, Bos taurus
tcagatacccagcagtggtagctcatgttatgactaaatgaaacttgtatcctttcaaatgtcaaacattattcatgatgaatctttggtcctgttgtttmccttccagatctagcaactatttaaaacttattttaaatagttatttaaaatacttattttaaaactgtattttaaacttagaatttaaaaatatggtca

SEQ ID NO: 39216 - DNA, 201 bp, Bos taurus
tattttgcaactaaaagtaacaagtatacatttgaacccaggcaggatttttggtttctgttcaaattgtccataagacatttggtgcataccaaacggtycttgaaatttggccccatctaaaacactcatgagtatacttggtctatgccaagtggttttggatggaacgaaatatcaaggacctttctggtgtggacc

SEQ ID NO: 39217 - DNA, 201 bp, Bos taurus
tgatctagagtgggtgaattctcttgggcactcctcccacttgaactgaaacctttatctaccatcagatagttgtgtgtcatcagtttttctgtagttgkagaaaatccgggaggaaagaacgactgcccagcagggaccgaagttgtgaaggactcagcaaatgtactttgacagaatatctgaccgatatctcagaca

SEQ ID NO: 39218 - DNA, 201 bp, Bos taurus
tgtgtgtgtgtttacacatttgaagtgtttcagttaattataatttctctttttgatgctcactgttcaatctttggccagtagcagcctcttcaagctgrcacatctcaccaaaccccagtggtctttgatagcattcttgctttctgacatgaaaaaaaaaaaaatcctaggctcattttgtccacttgctgtcctggc

SEQ ID NO: 39219 - DNA, 201 bp, Bos taurus
tggcactcactctggggcagagttgtttgtttttctctccctaaatgtataacaggaaattaggcagttcacctttgtgtatcactttcatacgtgtacaygagccagatggcacctctttgtgttaagaaatttaaaaggaaagactagaaggagaagtttatctccacttcctctgccctcctaaacacatcctggaat

SEQ ID NO: 39220 - DNA, 201 bp, Bos taurus
aacagcaggcccttgacccacttgggctttaccaggcacacatatgtagtgcagcccacccttaggagaaaagacagataaagaggtctgcgcatgtcctrgaagtggactaagggccatttgggtaaggaattctggagcaggcaactgagactttacgtagaagtggcgtaagatggaggttgtggttccatagccctt

SEQ ID NO: 39221 - DNA, 201 bp, Bos taurus
tctcactatagtcaatgaattcaatgccttaggggccctgtttcctcttctaatgagaatgagactatcttgcttgtttagaggagcacagagaaaggtgkaattggccgaattgtttaacatagcaacatggtaaagggaaaaagcaaagtttaagtttcagctctcattctgccatcaaccacatgtgggtcacacgca

SEQ ID NO: 39222 - DNA, 201 bp, Bos taurus
tgtttagcctctgcccataaaataggaatttccatctccttgaaaacacaggaagtaaccgccagctcttccctcaacatgtgtacctggccccccacccygtaagaagtgagagatgtacccaatgggtgaggtgggcagagtccgtcatctgccatcatattctcttccaggtggggccagtgcagacaagggagactc

SEQ ID NO: 39223 - DNA, 201 bp, Bos taurus
cacaccatccccgggccatgacagtagctcatggaggggcctgagagtaaacaaacttgtcaaaggcatgacattagcctattgttaccaagggtccaccrtgtggagagggcctgactgagagagaaatcaacaaatgcaaaagaaatcagagtatgagagagaaagatagagtgagttcatgacattatttgaacccct

SEQ ID NO: 39224 - DNA, 201 bp, Bos taurus
tccagcccctcacttgtccagtgttccagacacagagcccagcctctctccctgccatctgtgcttccctccctattcccagataggggtaggcagggagyagggcaagtggtcaggacttcagcctctcctcttgtaccttcctcattcctgctcaggtctgtggctctctgcatccctgccctaacctctgcatttccc

SEQ ID NO: 39225 - DNA, 201 bp, Bos taurus
ctggccagcacagagggctggaagggaagaaataacatctcctccagggtgacgggggctgcgtgcagcagatgatgcagagcttgtgagggaggctgccrccggcccccctcccttcaccgtcctcccgttctgcctccctgccccctcccacctcctactcagaaccagtgactaattgcatcgcgtttctctttgact

SEQ ID NO: 39226 - DNA, 201 bp, Bos taurus
ccccgccaggcacagaagccaccagcagtgccaggcagcgtccgcgggctgaacctggaggtgctgggtgcagcagaaagccagctcccagggactctgcyggccccttgcccagcaaatgcgtggccatcgactgcgagatggtgggcacaggaccccgagggcgcgtgagtgagctggcccgctgctccgtggtgagct

SEQ ID NO: 39227 - DNA, 201 bp, Bos taurus
ttcctgactctcggccccttcctccacttccacagccagcggcagactgtcaagttctcaagtcagatctctctgaccttcacataaaaggaccttgggaytgattatgctgggcccctctgaatcatcccaaaactctccctacctttatttttggttgctctgggtctttgttgctgcatgtgggctttctcttagtac

SEQ ID NO: 39228 - DNA, 201 bp, Bos taurus
gtgagttatgtccatctgccagatctgacttggcttcaggccacggggattaactcccaaggcttctgttggagatgtggttatcacaaccatctggcatktaggataaggccatacaatctgtttagcttaagcccaagggatatgaaacttggtttttaaatattttaattacaatgtgacagatcatgaagggctgat

SEQ ID NO: 39229 - DNA, 201 bp, Bos taurus
tgttttaagacttctgcccgctggaaataattaacctcttgagattttttttttttaattgaagggagggcacactgtacacccgccttccactcagatamttgaggcccaatgcctagttaccccggagaaggcaatggcaccccactccagtactcttgcttggaaaatcccatggacggaggagcctggtaggctgca

SEQ ID NO: 39230 - DNA, 201 bp, Bos taurus
ccgtcgctgccactgcattctcctgcatcgcgtcagtgctttatgccatagaaatggcgggcgtgtggaacttctacaagctcaaagagatcccctgctaygtgcacactgtgccaggcctgctgaacgtgctggagaccttcgttgctggtgtcatctttgccttcctcagcaacacctccctatacctgcaccagccgg

SEQ ID NO: 39231 - DNA, 201 bp, Bos taurus
gacgggctacaacccatagggtctcaaagagtcagacacgacttggcaagtgagtgcacacacactctgtcagaagttagggggctcctttctatggccayagcacctcacctgacccaccagcctctccctttcactgtctccctcctgcatggcaacgagtcaggacaatcagttatcttacatgtaacaaaagccctg

SEQ ID NO: 39232 - DNA, 201 bp, Bos taurus
cttcctgctcataaacttttagtatgccctgggtcctcttggccctctccccatctgactcaagactacccagggtggcctctctaggcattctactctgyctcctttcttttgctcatgttgggccatgtgtcagtcatgccaatcccttatttattgttcaacaatgaagcctcaacaacaaaacatgaccttcaataa

SEQ ID NO: 39233 - DNA, 201 bp, Bos taurus
ctaaacacattgcccagactttacacagaggcagcactgggtatgacaataaagtgacagtgttggagtccttagagcctgagctatctcaggccttgagsggaatctcatggacacccaggttgcagccacagctttcacctttccctcagaggggttatgctgatgaggtctagtctcaaaaatcttaactcatggtgg

SEQ ID NO: 39234 - DNA, 201 bp, Bos taurus
agtttgttttccctgttttttaacgcgcagaatcgtcaattaacagccttgtttcattttgctgcaacagcgccatctgctgttggccaagcccatgactygcacaattgaggatcccaggtatgggtttaagctaggaagctaaccaacatctgtgaggtgctctatgcactttgcagacgtggtccacaccacttctct

SEQ ID NO: 39235 - DNA, 201 bp, Bos taurus
tgagtttgcccaaacttagaatggttcagaggaaccacagtcaccccaggaagccctttttcacagcattctgggtccagggcagttgaggagaggcctarggatgctaactacaggtcagatggcaggagatgttctcagaaggctgtgttctcagtttggtcccgaggaccaaagagctgctcagcaacggccttgcca

SEQ ID NO: 39236 - DNA, 201 bp, Bos taurus
cttctgggagtggccacctttgcctagtgggaaggttctccttctaggaaagagtcagaaaagctctttacctttgtttgatttgttgtctctcggtctgycccctggcctccaaagaaaggatcaccctgtgcacatgtgcacgtcctgagcacactctggaggaaataatagcttgcctatgggccagtggctcttagt

SEQ ID NO: 39237 - DNA, 201 bp, Bos taurus
gcctcacctggtaggatctcacctggctgggcctcacccagctgggcctcacccggcaggatctcacctggctggaccgaagccgcttgctctccagcccygtcttctcctgcatcagggcctccttcttggccaggatggcctcccgcttgtggagctcctcccccagctcctccagtgcccgccgctgctgcaggacct

SEQ ID NO: 39238 - DNA, 201 bp, Bos taurus
gtcggtgcctcagtgggccttgcccacaagcaaccaactgtcaatgagccacaattagtgttcctgcccagctattggtcagcactgcagtgggccctgcmcactggtaactgtcaagagggaccattggagaagagattgagtcaggggttggtggtgtggtggtcatcaggtggagagtgaggtaagaggcagattcag

SEQ ID NO: 39239 - DNA, 201 bp, Bos taurus
ttccctccttctctctagagacatgcccccggggccctggtctgggcagtgtggactttccattgcagtgacctgcagccacccctattaggcctgggctratgaccaaggagcaagagtggggaaaccaagtccccgggggagggctccagcttggtcactgtgactaagggaacagaggcccctgaggatgatcgagag

SEQ ID NO: 39240 - DNA, 201 bp, Bos taurus
aaaaaagagtttgacgttacaaacatgatgatgtcagtttgacaagcgctgtgagaaacagggaaggagagcagggaaggtctgagagcaacatttgtgcraagactctcctgaagtgagggagtgaggaaggcctgaagacaggcagaggggatggccaggaccaaagcctgccctggcctggactctgaggcctctggg

SEQ ID NO: 39241 - DNA, 201 bp, Bos taurus
actgggtggagacttgtgaaacaatagatcttgaattggacaggttgtggggaggataataataaccataggtcttgggccaggcttgtgtaagtgctctrtgtgtattgtctccctaagagtcctcacaggtgctagttgttgcttgcaggctgagttgctcagtcgtgtctgactcttggccaccccatggaccgtagc

SEQ ID NO: 39242 - DNA, 201 bp, Bos taurus
ttagaccacgagtgggagagtatggaagggatcctggggggtgtagttggaaatcacccctgctctcttccttccctcccaagacccccacaaggacaccrtgtgccttccctcctctgtgtgcaacacagacctggtccccagtccttcctgcaggaaatcctgctcggaataaagcccagcgccctcagtgtggcctcc

SEQ ID NO: 39243 - DNA, 201 bp, Bos taurus
tcgtggagacctggaactttgcacgtcagtcctggggagttattcctgccgtagcgtccacgatgaggctccttcttcacctaccctattgatcactactkcgctacccgaagcactattatttattctccctctgcctgtaccctactactgtcagcacagtaaatggttcttggaagcttacaggtgtggatttggtct

SEQ ID NO: 39244 - DNA, 201 bp, Bos taurus
ggcccacagcagtgcctggggactgaagtaggaaccctcgcggcacaagaaagacatgcagattttgttcctggcacctgagagcaaagaaaacagttccygcagaaacagcactgcggcctgggagtctatctgaaaccatcaccgaggctccactgtaagctccaatttccaggtcagaccccagcagcagaaaaggtg

SEQ ID NO: 39245 - DNA, 201 bp, Bos taurus
cctgccccctgcaatggaagcgtggagtcttaaccactgaacttccggggaaatcccaaggcaatcactttttaaatggcttgttttcagctcttctggtrgttaccattcatggaacccacacttctgctgtcatttcaagccatctgtatactccccttttatttttatctgtttattggttttgcgaaggcgttctct

SEQ ID NO: 39246 - DNA, 201 bp, Bos taurus
tgctgattccatcgttctttcgttgttcattgactgtctcctctcgcaagaagccaaggccggggagaaagagcaggtggcccacagtttagggtcatgaraagactgctgtgttgatggtaccctgtaagcatcagcagagtgagaaagggctctctctttcgaggtgtcctttagtctctgtgttttgccaatggcccg

SEQ ID NO: 39247 - DNA, 201 bp, Bos taurus
caactctgaggaacagcccagcaaggaatgaccagagctttgtatatgtggcataactggccagaatgttgaagaatgttcagggcccatagatcaaaatyatagaaggcgatcttgatgtaggtcatttatgggtcaaaccttaagaaatgctgccattaagaatgaaatcacagggacttcactggtggtccagtggct

SEQ ID NO: 39248 - DNA, 201 bp, Bos taurus
aatcctaaccactaggcaatcagagaatccccagccctttatcttggtcaagctgagtactgagctatggaacaccttgccactccccacttaatcagaayagaaataaaacaaaccgatacatacacctctgtgcttcttgggtgtctttgttggactgccagattccaccttgaatttcatccaaccataacacagctg

SEQ ID NO: 39249 - DNA, 201 bp, Bos taurus
aaaaaaatgtcattaggatgcgaacactgtcatgagcctgagcaaacattttatttctacatccgttacagacccacagcagggcccccctgcaagagacrgcgggatggagaactcttagggttagacaaacgctgtttcccacccagtgtgttgccccctgtacaggtgacctcaggtgacctcaaaggccctagagcc

SEQ ID NO: 39250 - DNA, 201 bp, Bos taurus
agggcctcggtgttttgggttgcccacctgggtgggtggctgagggggcatcttttgtcttattcttccttgctgctgctgctgctaagtcgcttcagtcrtgtccgactcttccttgaggcctgtacaattcccttctgtgtgtattaaatcattttagtcatgtcgatctctgtgaccctatggactacagcccaccag

SEQ ID NO: 39251 - DNA, 201 bp, Bos taurus
atgcttgcttgtatttaaaatcctttggagcctttttgccactgggccatcattgatcagttatctacagttgcttttgtaaggcccaccctgggcccagyccagagagaactggatgctccgtggagcatgaaagtatcatgtgagatgaacttcgccctcaaggagtttccccactgaaagcaattagagaacaatttg

SEQ ID NO: 39252 - DNA, 201 bp, Bos taurus
aatttttaaagaggccatgatggttgtttttttttttaagtgagaaatgatatttagaggctacattctgggcaccagatgtgcttattttgctgaatatrtttctaggccttttcagtggccagagctaagaaatacaaagttttaaaataaggaaagagagatcttgagtttatactgctactgaaatgtaagattata

SEQ ID NO: 39253 - DNA, 201 bp, Bos taurus
ctgtccttctcgaggtgcccacctctgtctagcttggtgatccccttcccctactctccttacctctgttgtcaattctctgttagcttgtgcgtgtgtgyggccagctggacagagggagttagcctttagacttagacagaagcaagttcctgaagatattctttttagagaaataaatctaagatgatgactgctggg

SEQ ID NO: 39254 - DNA, 201 bp, Bos taurus
agtgcaaggccgcactctgagccatcacaccggcctgcttccctagagaatggtgcaagtcagagaggggcttcttggccagccagggctctggggtgaaracacatggaacagaacaacccccaagctgacttaacagttagtgagataaaaatatacatttttaaaaattgtgaatggcctgtataagaggaaaagttc

SEQ ID NO: 39255 - DNA, 201 bp, Bos taurus
gtctcctgcattgcaggcagatactttactgagtcaccagggaagtctcttccttaaacgtcagagtacatgatcacaggacatcctgaagaaaggccccrcaggatggtggggctcaagtaggacctgagcctacagagaggtgagtctcggtcgaaggtaagaggagggccacaaaagtgagtagtttgtctgactggg

SEQ ID NO: 39256 - DNA, 201 bp, Bos taurus
cgtcagtagctgtaagcatacataatggcctgcctcagggaaccctgccctccgcctgatattaaactgaagtgcctttgttcagctcacagggagacacygtggccttgcccacctgtgagtgcctgcaggaggaagaaatgaacacatccccttccagtggttggctaaattaggcgatacttagcaagactcatggcc

SEQ ID NO: 39257 - DNA, 201 bp, Bos taurus
gtttaatggctattattattttgtctggctgaaatgttttcttttgtttctgcattttctcacttctctgattttttttaacttggggaaggcctaggcgrctagagtttttctaaaaacaagaggcaggtggagtacatggtggggagcgggtgtctgtcctccttatggggaaaggcccataaggccttataacagtgg

SEQ ID NO: 39258 - DNA, 201 bp, Bos taurus
gtggaggctggggctgtggagctaaggaattcagccatgggttgggaggaggaaggtgcataagactgggtggtggccatcgccatgctggggtccttctmcatgtctcacctgatgtgtggagcagctggaggtgcaggagctgacctagaactggccgagcagctccaggaaaggtccggcagggccgaggcggcctgg

SEQ ID NO: 39259 - DNA, 201 bp, Bos taurus
agttggccctttttaatctattgctcttatttgataattctagttatatattccattataattttttgcaaaaggctatggttaaatcgatcaacttcacrttaaatcttttcctttttttgtctcattttgggagtattaattttactttttatttttaatcaattgttattggcatatagtttctttacaatgtttttt

SEQ ID NO: 39260 - DNA, 201 bp, Bos taurus
aatggctcagtgattcagccatatcaagaatattcaaaggtgtcagagagggtttggggaagaccttttccgccccctcccctgtggagacaccgtgaatmctccttgacttctgatctgaagcttagtgatagaggaatctctgggcttcctgtgtctgggttggcggtaaggataatgtatggggaacgaattacagac

SEQ ID NO: 39261 - DNA, 201 bp, Bos taurus
actctcttatgggaaaaacggatctacagcgagtatctctatctgtgtctatgtctacacaacactgcacagaaaagatgcacatcagacagtacaggagmtcactcacctgctaagacatccaggtgagtggatcctcagtgtggatgcttatacattcactaccaaagtctcagcgaatgtgacggaaatgaatacttt

SEQ ID NO: 39262 - DNA, 201 bp, Bos taurus
tcatgttgctccttgccaggcctcagctaacctccagtccttgagggagtgaaaaacgggggtaaacactgcctgggaactttccagagctgaagatgatrccagaaaattcccaagcagggcctctcctttttctcctcccaccccaaaggctgtctcttacctttgtacagaatcattcaaaccaaacatatcaggagc

SEQ ID NO: 39263 - DNA, 201 bp, Bos taurus
cagccagacccggggcccacagcagaggcacttatttgaaaataggaagaacttctcccccaacagactggtactggtacaatttaacggtttaaaatgayttggtcataattaagttaggaggccggaacaacacagagctgggtttaagtcacagcccgttcctaaactccccatcactagaaatggcttaacatgtta

SEQ ID NO: 39264 - DNA, 201 bp, Bos taurus
ctgtaaacattttgaggcctgaggggcaggcatctaatttaagacacacttgtaggagcctgctggaacactccagggacaaggcccggtgggtgacaccrtcatactctccctttgccgtgctccggaggtccagaatctcccaggagaaagcttatactcaagttggccctgactttgcgggtgtcatctagaggacac

SEQ ID NO: 39265 - DNA, 201 bp, Bos taurus
agcttggggcttaaagtcttaacagatggggccatgatgccttcaaaagcaggctggggagtctgcaggtgacaggtggtgtttagccttgggaaaggacwggcccatggctgggtgagccacacaagtagcccagccgctccctctggctgcatgtccatctgctggaaggcagacccattcccaaccaggcctggttag

SEQ ID NO: 39266 - DNA, 201 bp, Bos taurus
gctctcaggtccccagcactgtaggtgcaggcatctttggatcacgaagcaagtttcccttataaaagagtgcctgacctgggaatcactgaaggcagctyccttcagaggagtgggcgacatgccccatccccatggacaggggagccactgactattgaactagtgtggcctatttcagtgaggacattggaagcactg

SEQ ID NO: 39267 - DNA, 201 bp, Bos taurus
agcactgggctaaccctcgaatgtccacatcaacttctcccatgtagtgggattgcaagtgtgttcttatttttgactcaaatctgttttctaattgtaayggaattacaacactctattttcttccttttgctcatttatatctcccagtttaatacaatgaacatgtatactttatgcaataaaacacccaataaaagt

SEQ ID NO: 39268 - DNA, 201 bp, Bos taurus
cccacttcagcgactccagctcatacagcatcgtcacgaagctcgaaaggacacagctgtccccagaggccaaagtgaagcccgagaggaacagcctgggygcaaagaagggccgggtgttctgtacagcatgtgagaagaccttctacgacaagggcacgctgaagatccactacaacgccgtccatctgaagatcaagc

SEQ ID NO: 39269 - DNA, 201 bp, Bos taurus
aaatgcctttactttgccaattttaatagtagttttccaatttgggtaatttaaacatgtattttctttctcctttctaaatcaatccagtcataaatctrtgttattctttttccttcaatttgtttatcaataacactagttcacttttctacttgtgaatatactacttttatccttattaattccttactcctggtt

SEQ ID NO: 39270 - DNA, 201 bp, Bos taurus
atttgacttctgtgtacctcgtataagtggaatcctataatatatgtcttttttgtgactggattatttctcttagcataatgtccttagagttcatccaygttgtagcatgtgttagagtttcttcctttttgaggctaaataatgttttattgtatgtatattttgtttcttcattcattcattaatgaaaacctagaa

SEQ ID NO: 39271 - DNA, 201 bp, Bos taurus
ttccccaggccactcctaccagctgactctgttccaggaagtttttgacgatccacagagggagacagcgctgaggactactcaccctgacctaccagtcrtacaggccccttacagcccaaggaccccaaacaatgaatcagctgcatcagcttacatttaccattctgccccccaactgctgttcaatgccatcaggct

SEQ ID NO: 39272 - DNA, 201 bp, Bos taurus
taaactgttttattcttctgaacccctgtactctagtctttggtcataatactaattctgggataataaggaaaggttaaaagatgcccagaataagaagrtaccatcatcaggaaataaatggatgttttgacatttagagatgtgaacttaagctgtctgtaagtttgtttaagtgaacattttttgatgaagaagaga

SEQ ID NO: 39273 - DNA, 201 bp, Bos taurus
atattctggcatgtggaggctgtcggcaacgtccattcccaccaaccttgtattggggttcaatcagctcctggctctctcccacatttactgtttgtagrcttttgtggatgtcaactcttactggtgggatttggtttcgtgctatcgttttgattgtctttcctcctgtagtaattagggatgctgaacatcttctcc

SEQ ID NO: 39274 - DNA, 201 bp, Bos taurus
aagaaacattccactgagagattaaatcttaaagaaatgtagtacatgtataccttaggctcttactcagacatgaaaaactgtcatgaaattatgaaatyatgccactgattcaaacaaagttggatgttagaggatcatatatttagtgtactcagcaacatagaaaaaacatagcagatgatgtcccttctccacaaa

SEQ ID NO: 39275 - DNA, 201 bp, Bos taurus
acagcagatgaatctgaaaaagaaacatatgctttacatacatgacataggtcaatcaggtggctggatactgacaacaggcgcaacactgcacaccgacyatactgcagcataccacaggcatgaaatgaaagaagaaagaagaaaagccttgcccagtttattcctgctgacatcctgacccaggctgctatcccatca

SEQ ID NO: 39276 - DNA, 201 bp, Bos taurus
cctggtaggccacagtccatgggattgtaagaatcggacaagacttaatgactgagcatgcacatcctaaattttgcatctggggtgtatgtctcacttcyttcacccttgtcctggccctgtgagggagtaccagtttctggacttttctgtaagccactcctatgtggtggatgctcatccttgttcagttggcttcac

SEQ ID NO: 39277 - DNA, 201 bp, Bos taurus
agcaaggacgccaacaatagacacacaagtgtaatatcattctatgaacgaatacctgtaaagctgttagaacaccggaaatctagtaagcccacatgttygatatcattaatgcagtgcaatgatcattaccttcatggaggtaagaaaaaagggtccagggaaagtcacccgctgattcagcccaagaaaagcaggagg

SEQ ID NO: 39278 - DNA, 201 bp, Bos taurus
tgagatgcctgtggaagaggttctccaccattcacagcacgtttggggaccagcctcccttggacacgaaggtggggctacacatggagaagggcttcttrtactgcctgtcccactagatttatttggtgactcagtggtaaagaatccacctgccaagcaggagatgtgggttccatccttgggccagaaagatccctt

SEQ ID NO: 39279 - DNA, 201 bp, Bos taurus
aaggtaattttcaacggtctttcaaagcaaaggctggttgggcatgccaggggagggtacaggtggtccatgcctccacaggcatggcctagcttcatccytccatatgggtcttttctgcttcctgacttcaaagtgagcatgtgatccaaacctggccactctggcctggctagctcatcctcctgttcatcatggtta

SEQ ID NO: 39280 - DNA, 201 bp, Bos taurus
ccttgtgaatggaggtaccagtaagcacaggtgtacaagttgtagttacaggaaatgtccacaaggcggcagcacttcttcatgcccaactccaaccagarccttaaggagcgccggcctcttaggctgtgaattagagtggaacgtgcctgagcaaatactcaagggcttgtgtctcactacttctaagcttctcccctc

SEQ ID NO: 39281 - DNA, 201 bp, Bos taurus
agaaacagaaaacataggcccctgactttttgctcctctcttgaaactgagctagaatgcaattgatattcatatgaacaagtaagtttttgaggtttgamatgcaataccagggaaacaggaccttgagaaaagggagggctcctatgctgctggagggaaaccacaccctaaaactaaggctaaaattcaaattggatt

SEQ ID NO: 39282 - DNA, 201 bp, Bos taurus
cccacatcctctgcattggaaggcaaattcttaaccactggaccaccagggaagtcccttgtgctcatctttatttggttaggaaactctcctccgtcagktgctggtgaatgcagctcttcctataaccagccccaaggaaaggggcgtggtctacttctgatgtggagctctggttttgttttgtggttgtggggagac

SEQ ID NO: 39283 - DNA, 201 bp, Bos taurus
cattattggctacctgtcttctccctgggggtctgggttttgccctttttataaagttcaaggtgggctcggacagagcagcaatacaagtgctgataccstagtagactctggtgcaatgtccgcattccaaagggcacagcacggcccaggcgggccagggagcagggctctgcataagcaagcatcattagctgagtg

SEQ ID NO: 39284 - DNA, 201 bp, Bos taurus
tttaaggctagacttttttaaaaaattttttgttgaaatatagatagttgacttaaaatgggttggtttcaggtataaggcaatatatattgctccaataygttggccacctaatgcaaagagttgactcattggaaaagaccctgatgctgggaaatatggcaggaggagaagggggcaacagaggatgagatggttgga

SEQ ID NO: 39285 - DNA, 201 bp, Bos taurus
actcattatcatggtcccatcaaggggcaatatttctaactagagctgatgcgtccaatccaggctgcttcaccattctcagaactcacattcactctgarctcctgccttcattagccactgcagggttctctcagctctgtttagggcagctctacctctctgggtctcactgttacatacctatattgagctgaggct

SEQ ID NO: 39286 - DNA, 201 bp, Bos taurus
ccatcagtcccatcaaataaaatggcagtgagcttactgaatgatgaaacatccaaaggcagattccatgacctaccccctttctggccagattgctgccyctgaagcttccctgtgcagaagctgctcaaaatgctattgacaaggggcttcagaagctgctatttctctctggccattcccaagcccacatcgttgcag

SEQ ID NO: 39287 - DNA, 201 bp, Bos taurus
tcctctgaggtctgtggctttgtaattagtgttggcttggttactgggtgctttcaattttgagattagagtgctggtaataaatgcggctagaagcatcrtgaaaaaattctaacaggctctgggaagaataaaatagtcatagaatcaaggtcctccaaaatggaccactgaggatctcaagctgtggtcctgataaac

SEQ ID NO: 39288 - DNA, 201 bp, Bos taurus
cctcagttgccagtatctaaataaagtaaactttcttttccaccaacctgggctgtttattggcttttgagtggcgagggcccagaccccacacaactttyggaaacggaaatacacctaatcttcgtcaactccacctcacagatgaggcccaggtaggctaaggtcacttgtcacagtcagacagctggagacttgctg

SEQ ID NO: 39289 - DNA, 201 bp, Bos taurus
gcagctcccacggctggcccgccctcacccactcctctgtcctctgggccttcaccctccgtgttccctgtgctcaagagggttcccgccctggccgcatyggaggactctcacctctcctctgggtgcagcttggccatcacgtcctccggccagctgcttttcctcctgggtgtcatgtgcacggagaggcaccctcac

SEQ ID NO: 39290 - DNA, 201 bp, Bos taurus
gggaggagacacacaactggaaagccctggggacacccgaggctggtgggaaccctgggggtggtgatggggattctggggggcggggaggggatggcctscagggcagaggagagctgggtggttctgtttctgtctctgccccattcatctgagacagagaccagcagctcaggcagcagcctcaaatcaggcagggtt

SEQ ID NO: 39291 - DNA, 201 bp, Bos taurus
gccaccttcctcccccctcccttgcctggctctcagctgcacgtggtatgctctttctgggtctaggatgtggagcatctgtcttcaaggagtggcacctyggggccggccggcctggagcacgtttgtgttcacacagtacacatacacttctacagcgtctgtgttcacaggtagcggtcagatgcctcccagcctgtg

SEQ ID NO: 39292 - DNA, 201 bp, Bos taurus
cagggcagctccatgacctctggggcccatctcatggatgggtgtggagcgggggtgtgggctgggtccagaggaggaaaggccctactgtgagggacacrgggacacaccttttgctcacactggtgggagggctgcttcagtagataaatgaagtcaggtctaattgtgaccagtgtgtctgacgggcccacttcttcc

SEQ ID NO: 39293 - DNA, 201 bp, Bos taurus
cctggggtgactggggcaggtggagagtaacctgaaggtaagacccccactcccaatgaaagacatgcttgtgggatggactctggattgtctggtttgcsgaaggaagacatcctaggggcctcctgtaccatctccaagaactggccagcctgggagtgtgggggttcagtccctgcagggtcagcaaggcctgaagca

SEQ ID NO: 39294 - DNA, 201 bp, Bos taurus
ctctagtcaattgctattgatgggggaacaccaagaaccctgttcaatatcaataccatatatatctattagatggccaaaatctggaagatggacccacmaaatactgtcaaggaagagaagaaacaggaactgtctttcattatcagtgggaatgcaaaatggtatggccactttggaaggcgatttctttcaaaacta

SEQ ID NO: 39295 - DNA, 201 bp, Bos taurus
ctcccagggctacatgtggggaaagcactggcctctgcccttctgggctgcccagagcccctgcagttcctctaacacagaggtggggcagcctactttaygaatgtgaatgaggccatgaagtaaaagtgaattctccatttctaagctgtgtaacctgtgacaccctttctttccagggccatgaaaccaagggagcaa

SEQ ID NO: 39296 - DNA, 201 bp, Bos taurus
taggcttggtagggactccagggaacagactacagcgaaaacttggggcacccaaccctgaagagtccccagggcctttccgctcccagcgggccactccrctcacagcactcagggaagcaggctttcctctggaccatgtttattccctactcaatctcaacctgcacagaagagcttggaagcaatttgccaaagcga

SEQ ID NO: 39297 - DNA, 201 bp, Bos taurus
gacagtcagcggcagtctggttccagagtccagctgcctggactacatcatgacgtggctgtgggcccctttttagggcccacgagggctgtgaaggcagmaactccagatcgaggatcaagagactcgggctgggacacagctcaggcttgggacagtcaggctggacgcaacaccaaggggccggggtttgcctcctgc

SEQ ID NO: 39298 - DNA, 201 bp, Bos taurus
ctcgaggccgccccctaactgttgtcagcccacgcaggggaccggcaccggcttcgctccctcccttctgcacatcacatcacttaccctacggctaccamggcgcacccggggcctccctacagtagggtactttctccgagccctcttcctcagaaaagcaacaaacaccgaaccaagactatgccatgcggcaacggc

SEQ ID NO: 39299 - DNA, 201 bp, Bos taurus
tcagtattagatgataggaaagaattctttgactagtgtaaataaaggcgataaagttgctgtgatgaagaaactgtcttatattttataaatattgagcwatttagggggtgaaatgctgtgatgtcagacatttgccttcaaatacttcctactgatgggtgtgatgaaaaaacactgatgattattaaatctggatga

SEQ ID NO: 39300 - DNA, 201 bp, Bos taurus
tccctatgttccttagtggccctaaggtcgaggaaaggcccaccatcttcttctccccgccctcccccgcccccatttgtaagagatgaggatgggggccrgtgtctcatcgcttgggtctcacgcagctagttgtttattccgctgtccagactcaagcccctccctctctctttgcctctagtagcagggtcgggggtg

SEQ ID NO: 39301 - DNA, 201 bp, Bos taurus
gtttatggtaacaatatgcccagctcctaaaggatgaatcacgactggtccaggatctcatatcaccccttactcccttggccagctgtgtattgtccttrgttctttttcagccatatgacctagctatgcccaagagacattagatgttgactagaggccttggaaagataataccagctaaataaaagaccaaacttc

SEQ ID NO: 39302 - DNA, 201 bp, Bos taurus
atataaaaaaatgaatatggcaaaatactgggagtgctactcaaattaaatttgagaactccaggctacaggaaaacaatggccaagcagaaaatagagtrcacacacacacacacaaaagttagtaagcagggaatgaacactaggactaactgggcccaaggtttctgaacaagttgctgcctgtgatgaactgaagtc

SEQ ID NO: 39303 - DNA, 201 bp, Bos taurus
ttctgactgctatgaaattttttacaactgatatcattgagtagctcagctacttaagggcatgcagaatagctactaaaatgtctcagttttatttgggraaaaaaaaaattcaagtacaaaggaaaacgcactttcacagtgcatgttcaccatatcttaattgcaaatttattgcaacctggagttcaccatatcttt

SEQ ID NO: 39304 - DNA, 201 bp, Bos taurus
aaacacctgtctgcatcctcagcaaagggctggtgagtgggctgtgtgtttggtcaatgttaatagaataagtggacgaacagtaagggcctccacagtcytactgccttcctgaacccaccttctccttcattttgctttagttacattcaacagatatttgttgagaagtgttctctactaggtagtctaagctgggcc

SEQ ID NO: 39305 - DNA, 201 bp, Bos taurus
ctgggccttcccccaagtgggcaaatatatctaatgtcccatcagatgtgcttgaattcagccaacgtttatttagaagggctggaggcttaaccgtctcraggaggcatctgcagggccagagcctgcacaggcagaccctgccacgtgtctgcgcccgtctgagggtgagctttggccagcagccatggacaagaccgg

SEQ ID NO: 39306 - DNA, 201 bp, Bos taurus
gtacccaatgacaggtgggccagaagggtcatagagcaggtggggagaagccctgtggggttggagaggaggcaggcagactgaggcctagaagggtgaayggaatcccaacaggcagagtcagggtggtgagtgaagagggaaggtgtgtgctgctggggctcctggccaaccaactactgaaggattgctgaagggtgg

SEQ ID NO: 39307 - DNA, 201 bp, Bos taurus
tcactccccatgggaaccactcccagacttaccctcccctcactcctcaggacttactgcatcccatgaaagaggggccccgctgggtatggctcaggagytctagttctgctgattgctcttactgtcctgccgcctccatcagatcatgtcattccaatcagttgtgatgtcatggatgtctcgctatccattaatggc

SEQ ID NO: 39308 - DNA, 201 bp, Bos taurus
ctctcaagagtcttctccaacaccacattttgaaagcatcaattttttggtgctcagccttcttaatggtccaccccgaggcccttccaaggcatttctamccttcagcggtctgagggcatgcagcggggtacccactcacaccagcctggaaggcaagagggccagaagccagccccaacttcagctccagtcaaacaa

SEQ ID NO: 39309 - DNA, 201 bp, Bos taurus
gctacaagtctgagcctgagtgaaggaaagagggaagaaggaaatttggtggaagcatcctagacttcagtacagttttaaggaaagttcagcaacactaytggggagttttccagccaaagccacccattatccttctatctccaaggaatgggcctgccttattatcccatctgtgctcattcattagccaggaacagc

SEQ ID NO: 39310 - DNA, 201 bp, Bos taurus
gcggcctcccggtacttgcctacattgcggatgatcttcagggcaacctgagacttccctctggaccgggacagaagcagcagtcctcatgaaaagctatrcggcccttcccccaccctccaccccaacccagcagctcctggcaaatgctacgtaggactccaggaacagggctgccctgaagacagcagattcctgacg

SEQ ID NO: 39311 - DNA, 201 bp, Bos taurus
cagggttgggaaagccagctgcttcaggatccatgtggggggctggaaaacagtctatcagagttggaaggaccgagaccttctggaggaaagagtggccytgaaggggttgcgctgggatgttggctgctgagaacctggggatgatgggcagtcagcctccggcaggtgaacttagagtgctgccctttctctgggtgg

SEQ ID NO: 39312 - DNA, 201 bp, Bos taurus
ggagacacaggctttgggaacctcctgtcctccctacagcacgcctgcatggtatgtgaggagcagaggttagggcagggccgcatgcctggaaagtgctrgaaaagatcagggatcatcatcatcatcatcatttttattcccatgattcctaccatcccagggcaggttctatacaaactacctcggctatttttgaaa

SEQ ID NO: 39313 - DNA, 201 bp, Bos taurus
tggagggggtggcctgatgcctgcgcccctcctcccgctgctggcaggactcctggtacagcagatcctcttcttcctggggaccttgaccctggccttcytggtgttcatgcccatgcttcacggcaggaacctcctgctcctccattacctgaagtcctcgtggtgagtgaggaaggggctgagggttctgagacccct

SEQ ID NO: 39314 - DNA, 201 bp, Bos taurus
tcccaagagtgtaataacttgtgaagagtcagtggtcttggtgggactgtcagctgaggaatggaagatgggcacagaccatagcgatcttgggcaaacckggcctgagaagtaaaggggctgggccaggggagtggccttgagtcttgccattgactacccgaggtttcactcttcactgccctgcaggcattgccatga

SEQ ID NO: 39315 - DNA, 201 bp, Bos taurus
ggcaccggggcgcagcttcccgaggaggccgtggagagttataaataacagtgacgcttttctacgtagaagttgcaccatggggtggggagggaggggarggcaaattgggagaggagacgtgacatatatacactaccccgtgtaaagcagatagtagcaggaggctgctgcatagcacagggagctcagatctgtgct

SEQ ID NO: 39316 - DNA, 201 bp, Bos taurus
ccccctgtcttgggcacaccctacattgtcttaccaggaaagtggacttcccctctcttgggtcccctacacagatctgcttttggccagtgtagaaatcraagcgactgtgacactctccatccctctgaattgtcagctgcacctcctggagtgtgattgctctcctgtgcagtctggtgaggccccagccggccacgg

SEQ ID NO: 39317 - DNA, 201 bp, Bos taurus
gttgcttttttcccaaatccacgctgagcagcagcaccaacattttatttgctgtggcagatcaccactgctgttcacaggggtgccaaggaaacacgtarcactccctacacagcccaccgagcactgtgcttttactcctcccacagtgggcttgttggcgcaggtgtccagggcgggtggtgctctatggtattcctt

SEQ ID NO: 39318 - DNA, 201 bp, Bos taurus
atctgccaacagggctctggagctccttttgcaatcagcattcgctcagaaaatgggtagacagagcctgtaggtgaatctgtcactaacaacaaggcctrgttaaggtaggggcaggcaaggaagacagctagccagatatcaagcctggacctagcatgatcatgatctttgggggccaaaaatgaaaaagagtatgct

SEQ ID NO: 39319 - DNA, 201 bp, Bos taurus
gatttttttcaaaacacaacagaggaagccacagaacacttttaactccagaactgttttcagcaccatgttgcagatttgctgggtagcagagcaggccratttcaagcccacaggtgtgttgggagtttatatgatccctcagaactttagagagaaccttcctcactgcagcacccatctctgccttctcagcactgt

SEQ ID NO: 39320 - DNA, 201 bp, Bos taurus
gcgtcagctttattccaagcaatatttcctggattaactttccatagctttatggattaactaatattataatctctactgtatagaggatgagcttgaarcataaaagattgaacaatgtaaccaaaatcacaaagctaggaaatcttcaagtaaggtttggaatccaagtagcttacctccagcccatgcccttgacct

SEQ ID NO: 39321 - DNA, 201 bp, Bos taurus
caccctttatgcaaaatgtaatagctattaaatacagtgttcaccatgaccttcaaaaatgaagacctactatttgaaagttttggacagtagctactttmtttttaaaatcaaaactcaaccagtgtcctgataatcaaagaagacttgtcttagggtagaaataactaaatgaaaaacacacttactcattttcatccc

SEQ ID NO: 39322 - DNA, 201 bp, Bos taurus
ttaaagtggtagaagctgaagaaatgttaattaaccatctcaaatagggcagcagaaagcaagataagctggtatcataaatcaccctgtctgcccagtamatctctgctttctacttattgtgggcatgtagaagctatgctgctgctgctgctaagtcacttcagttgtgtccgactctgtgcgaccccatagcagccc

SEQ ID NO: 39323 - DNA, 201 bp, Bos taurus
acatatacaatgtgataccagcaagaataatccaagagatttgttttgatttacttttcatttcagggcttttaggattggcttgtaaaaaagacgctgarctataaagactacaaacactgatttccacaaaaccaaagactttggagttattttctaaactttttctgccatcctccatccacctaaatcttcactaag

SEQ ID NO: 39324 - DNA, 201 bp, Bos taurus
gatcctcaagtcctggatgctttgacagctctgaaatccaaccttccagccccacgtggttgccaaagctttgccactcatttgttgcttggtaagaactytccccagattcttaaccgcacacctagcaccaagaatcagctgatttccagaagggatatgcaaagtagatgatactgccttcctggtttctgtaatcac

SEQ ID NO: 39325 - DNA, 201 bp, Bos taurus
gatctgatgttccagtttgctgcggaagtcccagtcctgtgtttcgtagcattgctacaaaattttactcatagccaatttttactcatacaaaaattackcatagccaaccctgtgacttgtggaattggactgctttggacaataaattatacaagctttgattaacgtagtctcttccctctcctacagtgtgatggc

SEQ ID NO: 39326 - DNA, 201 bp, Bos taurus
aaatgactattttgattacgtagataattctctttttggcagcaatagctacatttttaaaaatagaccttacaaccatattgccaaagattaattaaaamttactgcagtcacatgaatagtcacaatgattcactgtgaccatacgaagtataggcactttagctaatttgaaccaaaacatccagccacaaaactcag

SEQ ID NO: 39327 - DNA, 201 bp, Bos taurus
aaagaatcttttaaaattcagaaaatgtttgtttttgagctaatatgacctcccaagtactaaatacgtatccatttctataccacagtttcaaaattctrtaaaacattttaaagtgcattttgagggaaaaacatgtgaaattacacatttaaaaaattgcaaggagtttatactgttttaagggttgattaccatata

SEQ ID NO: 39328 - DNA, 201 bp, Bos taurus
aacaaaaattttatttatttgtaatcttgcaaacaaatcttgtatttctattcttcctaaaatttttaaacaaaaattttaatcagatcaactaaaacttrtcagtcctctgattttatttaattatacttaatgtgtagaacactgtgccctagttcagacagtaaatagcatttaaaacttttacttaggagaatggca

SEQ ID NO: 39329 - DNA, 201 bp, Bos taurus
ataatttacgacttggtgatggagatttggtttgtttttagaacaaataaaaaatgctgcttagtatgtgaagaaaattcatactggctacattaatatcmagtcctggtctctcaagcagttctgtggttctgatagaaaatgccatcattccctgctggaacctgtctgaatcttgtcagctcttctgacagtcagaag

SEQ ID NO: 39330 - DNA, 201 bp, Bos taurus
ataaatatcacaattcatttattgactttgcatcctaggaaatatcaagaagaattgtctgatatgagtttagaccttgggcttgctaaaaatcaatattyatctcttaggtcaatcaatttattgatattcatctcaatgagaagtcagtatgtatataatataactgtgggctaaatttctacacagaaatattataaa

SEQ ID NO: 39331 - DNA, 201 bp, Bos taurus
tgtagaacttcctagaattattaatacttgagagaaagaaattgaaaatttggtgtaattttaaaaaacaattcaaacttcattaacttcaaaagacatcmatcctaacacactttgatcaagtaagtgttggatgatttgggggagaaagggagcaaaatatactctagtggtaagcctcatcttaacttaaacaaaatt

SEQ ID NO: 39332 - DNA, 201 bp, Bos taurus
aaacagatacatcttccaaacagtttgaatgttgagataggtttctttggtttatatgcaaacccttgggtattgttcttttaggaaccatgagggaaagkttcatgtggctacttgtctagtacgttgtcttggaggagaaatcttccattttcttgggtttgtcaaatttaaatgtcaaatgaaacaaaaaacataaac

SEQ ID NO: 39333 - DNA, 201 bp, Bos taurus
gaaagaaagaacttcaacaacaacaacaaaatggccatctcttctaagaaggtgtggtctaatctgaacaatgcatgatattaatggactttcttaaaaarttatttttgaagtcatctctgtgggccatctggtgttgaaaatgggagagacagtatcttatgtatctttttattttgtttttaaataatttattttttt

SEQ ID NO: 39334 - DNA, 201 bp, Bos taurus
ctttcggaactgaccacttatatgtacctttatatatataccacactctcttgatcactctacctttgtagtaagttttaaagtcagatagaatgactctyccagttttgtttttccaaatgatttgggctattctgggtctcttgaatttccatataaatattaggatcactttgccaattcttgcagaaatgcaactga

SEQ ID NO: 39335 - DNA, 201 bp, Bos taurus
ggtatttggtgggttatcaagtcagatattcaggtaaaagaacttgacacatcagaagagggtttttttcagtgtgtgtccggagctttaagtcagggtcrgattagctccaaggagacggtctttcagttttgaaacagagctaaagaaattcatccatattataaacatgacctggtgtgtgaatatatgtttgagatc

SEQ ID NO: 39336 - DNA, 201 bp, Bos taurus
gatacacatctaaggggcctattctcccaaaacacagttctcctcatcctgtttctcttcccaaattcctctcaaagtacactgtgggtcagtaactacamtggccaatgacagagctgggtgctgagcaatactatttattcttggtttacactgtcttcctaatgtttgagtagttctcaatcatggatagcctcagcc

SEQ ID NO: 39337 - DNA, 201 bp, Bos taurus
ggagtgagaatgacagtactgagtactgtgtgtgatgttttaagttttggttgctagtgttttaatgagttggagatgtcccaatccagtcattggatccrcagctcgagagagaacaaaagaagagataaatatctgagagtcactagccatgttttggtagaagcaatcttataagattatcccaggaagtgtgtacac

SEQ ID NO: 39338 - DNA, 201 bp, Bos taurus
ttcttgaactttgccagtcaatttttaaaagtcagaaatcttataaagaatctaaagaaaggtttgtcaaatgcagttatgttctagaaaaatggaaacartacgaagtaagacaaaacaaaagacaagctgaacttcaggtcacaattagtggtaaagaggaacttgttttatgtttttggttttttactttccattttg

SEQ ID NO: 39339 - DNA, 201 bp, Bos taurus
agttcttggtgacacgaagtccttagtagttggcaaaagacttctactataaagcatctagctatatgcttaaaatgcattaaaaatcactgggtgacagrttgcaatgtagtcagtctaacagttaatgcaccctcaccctttattaaacttttaaattctatgagtactatatactcactagtgtatggctccatgttg

SEQ ID NO: 39340 - DNA, 201 bp, Bos taurus
ctcaccatattttttccactcgtcatcaacattgagcccctggacagtgtctcctttgagctttttgaatacagagttccaaagacaggagaaattttttrtgcttttagcactgggagtgaaggttataaagattcctgctttcacagaagtattctgggctttatatgctaggctgaatacttcctattccataatgac

SEQ ID NO: 39341 - DNA, 201 bp, Bos taurus
tacaaggaaacatgtctcaaaagtctttgtgtttctgttcttttgtttccccaacaaatgtaaaaccctgagttaaatatctattgactttcctgactccycaagttgtttcaatttgcacaaatgaggaatgttttctttggagtaaagctactaatttggatgcagaacttctctgggcttagtgcagatgtactttta

SEQ ID NO: 39342 - DNA, 201 bp, Bos taurus
tctgtcttgagttttatgtattttgggaaaaaaataattaaacacaattcaatcagtattttgacttaaaaaacaaaaataaacaaagaattctaaactgyacttctgctgtaagcacactacccaaatattagcaatctgacttaaattgcatcttcatctctctatataataaaatactgtaatctcctgtgcaaaaga

SEQ ID NO: 39343 - DNA, 201 bp, Bos taurus
catgaattcttgtttttaaccaaaactaaaaattactgagttctttccatccatacccaccaccagtgagacctactacaggaataaaccttccttgaacmatatttcttttatcatcctattcttaataagaacatgcatctcacacttccatatgcatgttaataatcctaggatcttgttaagatgcagattctgatt

SEQ ID NO: 39344 - DNA, 201 bp, Bos taurus
gaatagaatagttttacctttgtcctgctctccagctgcccggagagtagataacagcggtcagagatagccccattatccaaatggaggcaatagaggcrctgctcaactgctattcccagcacacagaagccctctcatttgcctctctaattctccatcttcctccccaggtttatcaaaagaattgctcattattat

SEQ ID NO: 39345 - DNA, 201 bp, Bos taurus
gacattgagctttatcagttgtttgtatattttggaaattattcccttgtaggattttcttccattctgtaggtcatctttttgtcttctttatggtttcmtttgtcatgccaaagcttttgagtttaatttagtcccatttgtttatttttgtttttattttcattaccttaggagatggttgcaaaaagatactactgg

SEQ ID NO: 39346 - DNA, 201 bp, Bos taurus
ttgtcatgttagaaagcagatttttttttttaaaccaagtgttagacaccataatgtttggatcacataacctgaccttattccaggcaacttaaactccrtttccaattagcaagcatgcttatagtggagatgaagtttatctgcctattaagtctttcctattatatcaatttgaccagacatttgtattctctattc

SEQ ID NO: 39347 - DNA, 201 bp, Bos taurus
gagtgaggaagagcaacaaccctcctccctgtaagaaggtctgaactctacctccttctcgaaagtactgcaccatccaacatcaagaattaaatttaaaygcattaaaattaaaatgctaaatttgaagtaccatatatccagtgaccataatatacttctctctaaattttaatcagcaaggggatatagatttttcaa

SEQ ID NO: 39348 - DNA, 201 bp, Bos taurus
cactacgttctatagagtgctgtaatatttgtcaattaatattattgatactataaaactttaaacatattttggttcctcaaaattacttggaaaagttyagagtcacaaatgagcgtcacttcttgagagtcttgtccatccctgggtttcagaaaggcccaggtaacttggtaggtggagaagggacaggtctttatg

SEQ ID NO: 39349 - DNA, 201 bp, Bos taurus
atataatacttaggtaattgactagggctactcatactactaaaagacatttaatctatgaaaggtaccccttatttggtttgatcaaaataactgaatcrcaagggttgactaacaagcttcttgatgaaggtgaaagaggagagtgaaaaagctgacttaaaactcaacattcaaaaaactaagatcatggcatccagt

SEQ ID NO: 39350 - DNA, 201 bp, Bos taurus
tgcctgtcagtttataaatggtaatgagaattcagaaaagagtcaatagtggtggggaggggacttgctaagactaagacactaagctccaaagcaggatytgttagagagaggtgagataaggctagtaggacatggaagcagactttcactagaaataaaggtggggcatgtgaatgtaaaaattattcataaagtaat

SEQ ID NO: 39351 - DNA, 201 bp, Bos taurus
tattaaatatcatatgatccaacagagatgaaataaaaatatacagggtcgattttactggctttgactattataaggcatttaaagtactttgaatttayagtgtaacttgagggttgtattaacgacttccttatgctagaattttgttcccagccgaatatcataagcttaatgcagatggcatacttttccaaggac

SEQ ID NO: 39352 - DNA, 201 bp, Bos taurus
tctgtgcttctgttcaacataagaaatatctgagtgtttaccatgttcaaaacatcagtaaaatatgacccctgtgttcaaagagtttataagctgtgtayaatttattttattgacctggacttaaaatgaattagtcagcacattttgaaagctagcctccatagtgttataattaacctccaaagtcagattgactct

SEQ ID NO: 39353 - DNA, 201 bp, Bos taurus
gtatttgggagctgatagaattgataacaaataaacatgcatatggacagtattacagtttctggactgtattaagaaataggatctttatgaatcactgmaatttttatctttatgtttaagacatttcctatttgtctatctgctacttcttgggaaaaaaactctaaaattaaatctaatagaaatattctatccact

SEQ ID NO: 39354 - DNA, 201 bp, Bos taurus
tgaagccggaaggacacaaacataaagagtggttacatgaaggatattcaaaactttgtgagacctaaactactgagctcaagaatagtccccgtctcatmcaggatagcagtatggatcccccatcctcagcaattagccaacataattaggctaagtgaaaaaaattcaaatatacaagaacctgtattcaagtcaggg

SEQ ID NO: 39355 - DNA, 201 bp, Bos taurus
attatatgaaaatgcatttgtagaaaagttcaacaagataatgaaatattgaaaggacaatggcattatgtttaatgtgttttttttctttatgtgcaccygtactctctaatttaccaacaataaaaatacaatatttatggtagagcttgtcaggttttgcaatatatccacgtttatatgcaattcttagctcccacg

SEQ ID NO: 39356 - DNA, 201 bp, Bos taurus
tgctgtgaggccaggcgcagtgagccaatgtccaaagagtcaaagaaaaggaaaagggaggacacaagcaagtgattccccctcaaatttaaaaaagggaraacctttccttttttggtttgtttagcaactggcaaaactataagcaacaggaaaattattatttttatctagtgaaaccagctgttttacaggctctat

SEQ ID NO: 39357 - DNA, 201 bp, Bos taurus
ttaaatcaaatcatgtcacttatacaagcaattacatttctgtaaagcctaaagacagtaccattagtctacacaggaagtgctggccttagccctgtacrcagacaatgcaaaggagcaattcacaatccagactgaactaaagtggaaaggaaaactttattgtggcctgcaattgattatgtataagtgcgagtttac

SEQ ID NO: 39358 - DNA, 201 bp, Bos taurus
agataattaggataatagactctttaatttttctctttttttagttgaatgagagactctttaaattctacagtgcttaacaattttcaaaggtttcacayacatgatttaatgtaatcccgtaataactctgttttcccctacctccatattgcctgtcttccatttctctccccattggtaattccagtttgttctctg

SEQ ID NO: 39359 - DNA, 201 bp, Bos taurus
tctgaagaatgtgtttgtgttgtgttgtgatggtcccctgggaggttagagccccagtctcatctacatattgtggccaactcttgagcttcagtcttccyggggaactgacagcttggagaaggggaagtcctggctgacttccttgggttccattgagaaccacttctcagtatgcctttggagagatggctggccctg

SEQ ID NO: 39360 - DNA, 201 bp, Bos taurus
ggcatttagttgtcctgcacttagataataatctccttgttctatatttctacttcatggaatgacacacactccataaggggtctttgctgaccccaagrgtgagctacatgctcaaggggctatcatagtgccctgtgtttacttctatgtggcactgcccattctgctgtgtaatcagcacctcaaggcaagaaccaa

SEQ ID NO: 39361 - DNA, 201 bp, Bos taurus
taaaatgtttgtctaggctcctttttgtttactcccattttccatactggaaaaaaaaaaaaaaattcccaaccagcttcttgccagaaccctagtacagrgcaagaattaagacatgagcagggcccagacaactttccgggcccacgtttgcaatttgtcagcattatttctgcaacaagccagtattattgcaaaagg

SEQ ID NO: 39362 - DNA, 201 bp, Bos taurus
tttggggtccattgtaaaaaaattcaaatacacacacaatcataaaagaaaaaattgtcaatgattctatctctgagaaattattttgttattgattttakatctcgttattccaggcttcttctgtgcatgtttgaaaaagttaatctggcacacactgatttttaagttcctttttttttcacacaacttcccatgtgt

SEQ ID NO: 39363 - DNA, 201 bp, Bos taurus
ggacccctataatgcaaatgttagtgggtttaatgttgtcccaaaggtctgtcaggctgtctttctttttcacacttttttcctatattctgttctgtggyggtgatttccaccagtctgtcctccaggtcattaatcagttctgcctcagttattctgctattgattccttctagtgtattagtctggagaaggcgatgg

SEQ ID NO: 39364 - DNA, 201 bp, Bos taurus
gctcaagctaaatgagtcacagtgggcatccagagaggccagaactgctgcaagcagcctgccccatctcattcgctttggcaaagattagccctacctayccccgtcatggggcctcaggacagcccccaggggcaagagaggccatcccatttacccagctcccaacaaccattcctaagaactttcagagccaaacat

SEQ ID NO: 39365 - DNA, 201 bp, Bos taurus
agacgattttcacgtggctgttcttaagcctgattcataaaatggaaatgaattacttcgttgagaggtgctgtagctaaatatatactttcaaaatacaytggtcaagatattaattgtgaaaaatataacaaggcacccaaagctacttagctattaaccaaacaaaccctactgccaccactagcttactccccagac

SEQ ID NO: 39366 - DNA, 201 bp, Bos taurus
aatgacttttaaaaaccagtattaggaaggccgttctgggaaaaaatggaaatgaaaatgaattttaagaaaagggccaggacttccctggcgatcccacrgataagaattctcctgtcaatgtacgggacacatttaatccctggcttgagaaaattccacatgatgtcacagggcaacgaggcccatgggccacaaaca

SEQ ID NO: 39367 - DNA, 201 bp, Bos taurus
agggattgaacccacaccccctggattagaaggtgaagtcttaaccactggacggccagggaagttcctaaagttactagtttccattcccatcttctgtkttttgaaagtgaatcactgggttcagctcactcaaatggatgggagatggggtggggaattaagctccacctcctgcaatcagatcagatcaatcgttca

SEQ ID NO: 39368 - DNA, 201 bp, Bos taurus
tttggagtataacccataaaatctattctggccattttctttgcccccactgaaaaataataactgtggtaaaatgagatttaaaataattcctgtatatmtaggggccacaagtgaaattcttcatcacagatatttaaggattgaattttagcaggagcaccaatcacacctagaacaataaggtagttattggcgatt

SEQ ID NO: 39369 - DNA, 201 bp, Bos taurus
ccaccacaagtcaccagcagcccgggcaaggcgccaggagtgagaaggctttttgctcttttgaagcaagaggtctgagactactaggcctgaagtacacygagctcaggtagatcgtttgagaggaagctcaaatccccggggtccctcttaatctcctctggaagtccgagggagaaggggccggggccagtgatgcaa

SEQ ID NO: 39370 - DNA, 201 bp, Bos taurus
gactaaagttagaatcacttggagatctttaaaaaatgcaaaatattcttgagatttaattgatttatttaatatttatcaagcaatgtttttgtcactgrggttatagaataaataagagttttgttctaatggagcttacattctagttgggagagatgtacaataaaccaacaatccaatgtcagctagcacctacag

SEQ ID NO: 39371 - DNA, 201 bp, Bos taurus
cctggtgggctgccgtctatggggtcgcacagagctgaacacgactgaagcgacttagcagcagcagcagcagtaaatgccaggagacagggatcatttgrggtatcttagttggaaaagaactgattagtttgacatatgacaatctaccaagagagatacccattaagaaatcttgctcaggggaattccctggaggtt

SEQ ID NO: 39372 - DNA, 201 bp, Bos taurus
cttacaccacttttttccatttttcggaaaagagaaaggacctatatggttagtaatttgacatttgagaattatgttacatggagtgaaatggccgttcmcattgtttcagtgtgtaggacactgccactcttgcctcatgttttaacttaaatgttgagtatggctctggttagctataagaggtggaggattgtgggg

SEQ ID NO: 39373 - DNA, 201 bp, Bos taurus
taaataaagtcaaagccacaatgaaatagtgcctcacacctgtcagaatgactgttccaaaaaaagacgagaaataagaagcattggcgagtatgtggacmacagggaactcctgtgcagtgttgttggagatgtaaaatggtgcagtcaccatggaaaacagtatgaggattcttttaaaaattcagaatagaactctca

SEQ ID NO: 39374 - DNA, 201 bp, Bos taurus
tgcttctggaagaaggcagtggcatggctatgtcagctctccttcctccctgcctggcaggtcgtgtgccctccctgggtcagtgaaggaccgtctactckccaggctctgcagtttctctgtgcaggtgctggacatccttggaaatccaagtgctgtcctgcttggggccattgctgacagctggggctccttgtgagt

SEQ ID NO: 39375 - DNA, 201 bp, Bos taurus
atatgttgaagctgtagcccatattgtgatggtcctgggaggtggaatcttcggaaggtgattaagattagatgaggtcctaaggatggagccttcatgartgagattaacatgcttagaagaatcacaggagagattgctttgtctgctctctgccatgcaggataccatgagaaagcagctgtctgcaacaagggagag

SEQ ID NO: 39376 - DNA, 201 bp, Bos taurus
gtctcctctgttacattctctgggttccatgtttgtcctgacttatgcgcctcatccccattaagttgaatgagttttactcgttatcaacagaccatccyttgtatatggggagctaccatattctatatttctcaggaaacaagatgccacgggagtaatcttacacgggaagataaccacagtcttccataaggcctc

SEQ ID NO: 39377 - DNA, 201 bp, Bos taurus
aggggcagcatagtgatatattagatcattttccattcttgcccactattttaatagttttctagaagatggaagggccctgaggagtattaataagaagrgtatggggaggacagccagaggtcagattgtaatgaagcttaggtagttaatgtacagaatgacagataaaatgatctcgatagattgggaagatgggcc

SEQ ID NO: 39378 - DNA, 201 bp, Bos taurus
aaagcaaataccttcctggttaactcagtaggaatgtttcagtcctgtgtcagtttggtttctgcagatccttagctggagctccaggctttatatggtgrtttagcaccaccatgaggctgcatccagtcagtgcagctgattttgagcttctgaagtgtattataaggaaggtgcagttttttgtttgcagttttaaat

SEQ ID NO: 39379 - DNA, 201 bp, Bos taurus
aaaagcaattgcccctggagaagctctaacattagaagcattcaggctgctttggaggagacagaactgtgtttctttggagatttacttgaaatcatatkatcagggatgcaggagtggacctctgcagactagctgtggacatttttatcctacttctgttgtataggtaagctttagctttgaaatattggctacttc

SEQ ID NO: 39380 - DNA, 201 bp, Bos taurus
catgggagagtaactttttcctacagtagatgcttaatgaatagtgatttatatagtaattaatttgttttaaaaaataacttgatgcaaggcatttgtcrgttgctacctagctttaaaacaccaacgctgaggttactacacctaagagttatgtcaacattttgacagtatctaagtttctttaacttactggcacaa

SEQ ID NO: 39381 - DNA, 201 bp, Bos taurus
gtgtgtatacgtcagtcccagtcatccgatttatccctcttcccttcttatcctttttccagccttcagcctccaccatggcctgccctgtgctgccttayctcatcagggctctctgttctgtctgcttggggagtccctcagagatccagggtcgaaggcctctgactgcagcatgcagcctaatccctacttctgttc

SEQ ID NO: 39382 - DNA, 201 bp, Bos taurus
atgtctattacatgtgtaaagaaacatttctacacaagtttaaataatcagaattgatctacagcaattctttcatttccaagttcttgattttcgaagayttattaggaataatagaaaatagaaatttctgaatgccgcaaagtcaaatgggtattctaaaataatgaataaaagaaaatcaaataaaaactgttgcct

SEQ ID NO: 39383 - DNA, 201 bp, Bos taurus
ttcatcagcaaatctttcttgtagccacggttcacttatgcctgcacagaaggtcctcctgccatacatgggctacctctgtgcagagccctagagttggrcttaaaggatttcagccttcctccatataatcccatcaagtttatctctaatctttatctctaaatagaagctttctcattctctgttaactgcgttgag

SEQ ID NO: 39384 - DNA, 201 bp, Bos taurus
acttagatcatcaggtgggcagatagtccaagatccagaaatgtcctcaaaagtgtcaggatcctcaggtcatagcccaacctaatcccacagaattttcrcaacatctgcttaaacgttctgctgggagcaggcacgtgtttccaactccctcaccttcaatactgaaactcctctctattattagtatttttcttttta

SEQ ID NO: 39385 - DNA, 201 bp, Bos taurus
aacaaaaagcaaacaacccaactgaaaaataggcagaagaccttaatcgacatttcttcaaagaagacagacacatggccagtgggcacaggaaaacatgytcaacatcactaattgttagagaaatgcaaatcaaaactacgagtaggttccacctcacaccagtcagaatggccattattaaaatgtctgcaaataaca

SEQ ID NO: 39386 - DNA, 201 bp, Bos taurus
cttaaagttttgaaaaataaaagattggggaaattttaagtaaggtttattcattgaaaagacaaatattggtatactaggtaaagggagaaaatccagayagatatgcagtgcataaaagctacctttaaaccaaaggatattaaaagattgaaaataaagaagattaaaaaaagaaagctcagatggctccatcagaca

SEQ ID NO: 39387 - DNA, 201 bp, Bos taurus
gcagaatccaattttatttgagaagcatctccacagtttatagtggccttctcatagggaagaaaaatgcacttttgaagttctgttccctttctttgtaytgcttttactacctttaataggccaaattcaaagctcaaaatcagaggtgattttaaaactgaaagccaaccaatcataagagtaagaggacacaagctt

SEQ ID NO: 39388 - DNA, 201 bp, Bos taurus
gactttgtgtactgttgatatctgagatgtgagttctcagacagaacagaaaaagccgtccaatgcatttctcataactaacagtgatgagtcaactatgyaatgaagcaacaatgaaactaaatgaaagggacaagaaaaaaattataatcaaacatgaatttttttaagaagctatagtaaagcaggcagaacacaagc

SEQ ID NO: 39389 - DNA, 201 bp, Bos taurus
ttttctcctctaaaattctttaagtctgggcactgacgaccacgggctttgggggcttgctggtcccatttctgggacctggattgtgcttgcttctaacytcaaaaaacttgagagcaggagccaatgaattctcaaaggcatggaacagtcttattctccaaagtcagagctgaggatcagttcaaaatctggaggaag

SEQ ID NO: 39390 - DNA, 201 bp, Bos taurus
ccaaatcatcaaaacagctggtggcttctatttggcagctgttttaagaaaaggttttcttttacagagacaatggattttttcatccatgtttggatggmtttgggcctctcttccactgctgaattttgtccagttaaaaaaaccagtgaacaagaacacataattctccatctctctgtaacttctgattctaagtct

SEQ ID NO: 39391 - DNA, 201 bp, Bos taurus
tcctgatttggtggatgtgcagtggagcctgagattctcagtttctaaccagctgctggtgctatgggtctgtggagggccggttggcaagactcctcccytgcctatgtggtcagggtcagggctgccaaccagagagggtggcacattgcattccgttcactctgcactggagtggtcttgaggtccaggtgcggccaa

SEQ ID NO: 39392 - DNA, 201 bp, Bos taurus
aaaacctttacagtagtctacaaggtcctatacaatctggacactgtccccacataccattccagctatctgacctttttctgttattcaactaggccaartactcttacaacttcagcactcgtggttctctctacctctgtattcacaaggctaactcttgccaacttcaggtcttggctcaaaagttaccgtatcagt

SEQ ID NO: 39393 - DNA, 201 bp, Bos taurus
tttgtgaagctcatagtccagaaaagaaatttccagtcttaatagatgctatgggacagggtatgaaagtttaggggaaggcacctactgaaaaaagtcaracctgcaggggagaaagagttgagttggaagacctgacagctttatgaaagccaccacctaaactagttggaagaatggctactagttccaataaaagcc

SEQ ID NO: 39394 - DNA, 201 bp, Bos taurus
cagaagacacaacctgatttttctttccaacatgcaccagatttgggatcagagagacagaccaaacctgggtttgaggtctggctctcccagtaataccygagtgacctaggtcaagcttcatgatttctcggagcttcactttcctcacctgtaaaatggaagtgaccatttctttaggtgttgagatgactgagatat

SEQ ID NO: 39395 - DNA, 201 bp, Bos taurus
tacttctttatcccctaattatgccttcccatcaagtttgaatatctacccttaagacgatttcatgagctagataaaatagaacaagcttcttatacagktcacagtctccacacatcagttagtatacctagcgttctaccacatatatgacaggtgagtttatatatgggatacttatattttataatgtaacagcat

SEQ ID NO: 39396 - DNA, 201 bp, Bos taurus
ccacatttgtgggaaagtgctataggttaaatatataatcttgatgctgctctgtacctatagaacccaacaaaggaggctgggattgggatgggggtggrggtagcggggatggagtttcagctattgtaatagatgtggtacccaaagatcatatagtcttctgcatcaactggaaccatgtcaatataaaggccccac

SEQ ID NO: 39397 - DNA, 201 bp, Bos taurus
gttgaggccacactgacatgtaatctttggacttcaccaaagttggggctgagggtacaatgtgcatccttgattcttctattcctgaccttccccaggaygcacttctcagtctttgctttgtgagtccacctaaaaccctgctggggcaaacatcagagactgcttaactcgggaggaccctgttctcatttctctttc

SEQ ID NO: 39398 - DNA, 201 bp, Bos taurus
attatatgtagtgctctctcatcatacatacctcatgctcaccggtataacacctttatgaatatttctcttaatttcccttctaaagcttgtattttttrtatattacaagccttcagtaaatatttgccaagcaaatgaatagacagtcaaatttaacactagattgaaagtctcttcagattaaaactttcttctgta

SEQ ID NO: 39399 - DNA, 201 bp, Bos taurus
atattttctctgaagatggcctaaaaaaagtcagttacaaccagcattcaccccagcgatgattgcacaagcacaaccatgaaagaaagaaaggccaggcraatcagttgagcagtaagtacttaggcaatctttcctagtgactgttgtcattgccgctggactttagaactgaacatgtttacatttaattagaaagga

SEQ ID NO: 39400 - DNA, 201 bp, Bos taurus
cagaaggcaagcctcattggaagccgtgtcagaagccaccttcctcaaagttttcagaaggttatttttattgggccttagggagctaagataatcacaayggtatgatcactcacctatagccagacatcctggaatgtgaagtcaagtgggccttagaaagcatcactacaaacaaagctagtggaggtgatggaattc

SEQ ID NO: 39401 - DNA, 201 bp, Bos taurus
tcttttcttgccccctggagtaaatgtcaagcagcaatagaagtttagcttttgcagatgctctgcttcttcagatttctctctttcttggtattgtgttyttgctttttccggttcctgcatggtcagtcagtcagttcagttgctcagtcgtgtctgactctttgcgaccccatgaactgcagcacaccaggcctccct

SEQ ID NO: 39402 - DNA, 201 bp, Bos taurus
aaaaaaataataattgtggtcctagatgaaagcaatttttttttcttttttggaaaagatggttttctgaacagagctttcctttttgtgatgtaggccaytagtgttgcccaaataggacagaaaaatgcagaagttaggaagtaaatgctgacagactcacaacctcaggggccaaatagcactacaatgatttctcac

SEQ ID NO: 39403 - DNA, 201 bp, Bos taurus
cccctagagtctcctattactgctgttcatggacatttaggatttacactctttgggaaatagacaattcatacattttaacactcaaatcaaccttgagygcccttctatccttcttcaagtaataaagacacgatgatcaattttgcacattttctcactggcatcttacatggtctgtgaaagtttaatagggttcta

SEQ ID NO: 39404 - DNA, 201 bp, Bos taurus
caagacttaagcagctgacctcatgcctccctctgctccgggttctattggagaggaaattgtagcactgggagaggggaaaaggaggagctactaaacgyaccagtaacataacagacaaatccaagaggaaggcatgattcaaagggaaaagtgaagatctgaagtgggccgacagagcagtcggttgtccacactgcc

SEQ ID NO: 39405 - DNA, 201 bp, Bos taurus
gtttatttatcaataacatactgtacctctctggacacactgacagacaactgatttttttttctacaatctcccctgggctctaaattttagaagacacrcatgaggaggaggaatcatgcctgaatctccttcccaaatatatctaaactacctgcccacggtgaaagctggagaagcagtacttgcacccttcaaagt

SEQ ID NO: 39406 - DNA, 201 bp, Bos taurus
ggctgaagcagctggaaacatggaaggtatagctcagtgcacagttctagattgtcttctcccagaaatgattcctctgggctacaactcaggcctaacaytaggtctgccctgtcatgtgtcatgtgtcctgtcaagttaattaaagcctccctacagtatattctctatcatcctcctttcctctatcatcatcttttt

SEQ ID NO: 39407 - DNA, 201 bp, Bos taurus
caagttttaggcaataatatttatttggtgaaatgcaatgaatttcttaagtggaatagtctaaaattttaagtatagttcacactccttttatagatggyactttggacccatctgttttaattacagtcagagggaaaagtctttaaaatatgttaaaattttacataatttaaaattttttaatcataataacttgct

SEQ ID NO: 39408 - DNA, 201 bp, Bos taurus
cacttgtatttgtcctcagtaattttttaaaaatcttttttaaataagttatacatcatacattacaaaattcagaaagcacaaatgggtacacagtaacmtatgtgttggaagtgagagttggactataaagaaagctgagtgcagaagaattgatgcttttgaactgtggtgttggagaagactcgagagtcccttgga

SEQ ID NO: 39409 - DNA, 201 bp, Bos taurus
gtacagaatcaggtgccaagcagacaaaatcttgagttcagtagtcaccaaaaaagggagcgcttttaagcctcccatgccccaggctttgaattggaacyccaagttactatatactctaggaataggttgaaccagaagtattaattgccagttttcaaagggactgaatgaaccttactggattgttatctgagattc

SEQ ID NO: 39410 - DNA, 201 bp, Bos taurus
actgatcctcaagaagaaagctcatttctaagtagacaaatagcagtggaagatgagaatgacccagaggaattaaacagtggtgagccccaaacagaacrtaagcaagaacttgaattagagtttgattcagtgccaaaggaacagtctgaactgttagtatctgagttagagcatagtctcaatcctcaagacactggt

SEQ ID NO: 39411 - DNA, 201 bp, Bos taurus
cggaggccgaatccttctctttcagcctagagcacctcgatttccaaggatgggtggcctctctaggtagagggccggcccctttaagagagaaagacagrgacacgtctacgaacctcgcgcgaagaaggaagggaaattaactgagtccccgcgaccccgcctccccgccgcggcccggccgaaaccaaacctcggggt

SEQ ID NO: 39412 - DNA, 201 bp, Bos taurus
cccagatgcttgatgcagtgttataggacatactgaactcttccataaccttaatcttgttaattctatgaacaagatatcaaaatatggtaccacacccrgaattcttggagaaatatcacagcaatagaaagcatgaatttaaggcatttaccttgaaaagtacccttgaagctaagaagtttaggagagctcaacaaa

SEQ ID NO: 39413 - DNA, 201 bp, Bos taurus
agtaattgaattactgaagcaatgtaggtaaactgaatgaagataacaaagaaaacgtggaagaactctaaaggacacaagttaaaaaagcatgtgtgagyaatgtaactaatagcatcagtcaacaacaatcccaccagttttctaaaaacaatttctagttatttataaatatttataaataatctaagtgcaatgtat

SEQ ID NO: 39414 - DNA, 201 bp, Bos taurus
atctcagaatctgcttcccaagaccctggcctgtggcagcagggagttgatcagcaatccgctggcttccccataaaagggatgggactttcaagaggatktgtattttgtttcctagtgttgatgggttcctccagtcactcacagtctcttagaagggtcctctgagagcaatgacttgaaggataaaattcaaaagta

SEQ ID NO: 39415 - DNA, 201 bp, Bos taurus
attggttcattaagcaattcaatcccaaactgtaaaaagtttaagtttaatcctgcctgaagcctgactgatcctgtcataaacacttttgataaaccttrcacttaaacctggtcttgcagttttattaatctaacaataattcaaagtgacatcccatgtagcaatataaatctataagatggatgtcataaaacttac

SEQ ID NO: 39416 - DNA, 201 bp, Bos taurus
atgtgggactctttggtttgtaaactctttcctattttacctaagttttaaagtgtgcagatttatcatcagtaattaaagggggtaagactattctttgytgaatatggccagctttttgaattctgggagcaaattttgcatctttcctgaattttctcccatgaccaagaagtctaataacatttgtgttaatgatat

SEQ ID NO: 39417 - DNA, 201 bp, Bos taurus
agttgtggttaggcaggtattctgtgggttgttttttcctcctggttatgttgccctctgagattccaaaactcccaaaagcgtttcctgctgtgagaggktttcttgctgtttggaatcttctccttcacaactccctctgcagaatgggactccatccctaactcttttgtctctctttttgtgttttatattttgtgc

SEQ ID NO: 39418 - DNA, 201 bp, Bos taurus
taagggatctcctgtatttgagacacacttttccttacctccattttagaggagtcatcccattccttcttggttgtcaggcccagtcaccccagctggarctgtaagtcccttttcttgcctgttgattgagaggcagaaggaacccaaagtggccaggtgactgtcttaactcctactttagtgggatcattcttgtgt

SEQ ID NO: 39419 - DNA, 201 bp, Bos taurus
ttcttggtatttgataaatgattcctgcaacagcaggcctatcatttctgcagctgtcagcacaaccaagcagcaatgtccctgtgaagagactgtgaccygtgggctctgagtcttctcacggcctttcacactgtcggcgccacttcaccttgtgaatgaaacgaggtagagagctggcagagattccttgtgctcgta

SEQ ID NO: 39420 - DNA, 201 bp, Bos taurus
ttcctttgctctttttctctgtgcaatagtaatacataacaagacgacatgagaacatttgtagaaatttcttttgagaaaatgttgtgttatttgagttrttttcatttacaacgtatagaggaacacgggcttcccttgtggctcagctggtagagaatctgcctgcagtgcaggagacctgagtttgatccctgggtt

SEQ ID NO: 39421 - DNA, 201 bp, Bos taurus
aaatcctctttatagaatcctatttttaaataaatataggcccacaagtactgtaaacagaccttattgttttagagaaaaaattgcaaactacctataaytgtagagaagccaggccaaacaatcagtagctaaactgtgtacagtttttattttatattttaagagttgactcaagtattttttaaaaagaaaaaatat

SEQ ID NO: 39422 - DNA, 201 bp, Bos taurus
atggacaggaaggcctggcgtgctgcgattcatggggtcgcaaagattcggacatgactgagcaactgaactgaactgaaggactgatgaacctactctgsaacaaggtaattatattcataggccttacaattacttatacataattcagagtattcaattaaaaaaacactcacaatttagattacagaccacacttaa

SEQ ID NO: 39423 - DNA, 201 bp, Bos taurus
aggaaagcccacatctcataagagggcttctgggaaacttaagccctcccttctggaaagagatattatttttcacttttctatagattataaagaaatcktcagagaaggggggaagggaaagttctttatctttactagccttgaatatctctaagaatggagttgttctctttctggtaagcctgagcaaactgactg

SEQ ID NO: 39424 - DNA, 201 bp, Bos taurus
tttggatgtaaagcactatgaagaaaataaatgacagtgaagagatacagagaactaaagcacttggttttcctcttattgggacataatctcaccatgtktctctgctcatagaatgattcatgtagaacaaaaaaataaagcaatagagagagtgttaaataccgtatcaacatccttgtgttgatgatagggaatgga

SEQ ID NO: 39425 - DNA, 201 bp, Bos taurus
taggttatggatgtttttctccagccttttgagataatttacatataacattgttcattgtttaaggtgcacaatatgttgatttgatggacatagagggmaaaatgactactaccatagcatttattaatacctgcatcaaaattcataattaccattttctttttttgtgtgtgagaatatttaagatctactctgtag

SEQ ID NO: 39426 - DNA, 201 bp, Bos taurus
gccacatgggaagcccagataagccttaggaagggactaagactgaaactgtgacatacatcagatatttaggcaacttctcttatagagaagttgttgckgtttctgatgtttagtcagtaactcacgtccaactctttttcgacctcatggactatagcccaccaggctcctctgtctatgggacttcccagacaagaa

SEQ ID NO: 39427 - DNA, 201 bp, Bos taurus
tgcttctggccttgacctccactactagatatgtgttttccgctgaccctcaccccacatgggtaactgcaattggtccccacagaagaatgtgtgcatamcacctactctagccattactgtggcctgatatggtccctagctgccgaaactggggggcactgctgagaaagcccacagctttgcagccactaaggacct

SEQ ID NO: 39428 - DNA, 201 bp, Bos taurus
gctcatgggccccctgaagagctgtaggaaaagcctgcagcttgatatggaaagctgctcatgcttcctgtcttacggacccttcaaacccaaacaccacrgtccccaggcctttgtcccctttcagggtccagctcaccattggtctcagatgctgtccccatgtccattgctggacatttgaatattcctcccacagct

SEQ ID NO: 39429 - DNA, 201 bp, Bos taurus
tccagagtagatcagatgctaactgttttaaggtcacagcccctctctccaaaacaagacaaggaaaaaaatatattctctgctctgagtgtcttgggagygtatggttagtagttacatgccctttgtttcagaggaaagaagtttatgaaaaaaaataattttacaccaatgggagagaatagagctagtatctagagg

SEQ ID NO: 39430 - DNA, 201 bp, Bos taurus
gctgagtgccctagacagcccttgtaagtatggacccttggcacaagtgctttgagaaagatgaagtctagaaattggggtgaatggaacccaggaggccygaaaacacacatgagtcatcccaggaggagactgaagggagcagggtggcgcatgtggtgggaggctggggacccgagcatatgcacagtggtgcccttc

SEQ ID NO: 39431 - DNA, 201 bp, Bos taurus
ggggagtaagaggaaatggggccagaatcagtgccccctgctgctgagatgaggctgcagagagaggtctggggtcacagtgtcagattctgaaccacacrgacaggaagcctcatcaggggcctggtttccagtttctgggagtttttaaagagcatgatagacccatgctgagaaaaatagagcatgctaaagacttcg

SEQ ID NO: 39432 - DNA, 201 bp, Bos taurus
gacaaagggtccctgacctctgagaacaagaggcaggtgagagagtagggaagcgtctagtgccaggtggctctgggggagggaaggtggtcccagaagasagcctggtagagggccgtgcagggtccagcggggagcaggcagggggcggggctgggagaggagctgagcaccagcactggacaggggtcaggggtcaga

SEQ ID NO: 39433 - DNA, 201 bp, Bos taurus
gactgctaggaatcagtggtagtgatgacaaaagaaaccaagccctagtgaggacaagagtcagggcccagcgaggaacagaatcagggcccattaaggaycagggtcaggatgtagtagggacaaggatcaggtcctcgtgagcatgaaagtcaggctctaatgatgatgagagtcatgccgtagtgaggaccagattca

SEQ ID NO: 39434 - DNA, 201 bp, Bos taurus
atgctgcggttcatggggtcgcaaagagtcagacacaactgagtgactgaactgaactgaactgaggatgcccttgcatggcctcacatgtcctctcacamccttgtttgccctcaaatgctcttacacagtctcacacagccacaaacgtactcccaagccctcacacaaccacacacgccctcacacacccttgcaggc

SEQ ID NO: 39435 - DNA, 201 bp, Bos taurus
ttagtctatatcgttggtgacaaacacattttgatataaacattcctcaaaggacattgctggttagaatatcagtactgaatctaaagtatacaaacacrtaaacacacatgcacatacacacttgaaagctacagaaaatgtaccacacttgtggccctgagaaattcttacaacttgaaaatctaagatggtggctca

SEQ ID NO: 39436 - DNA, 201 bp, Bos taurus
cagccaaagaaatgaataaatattaaaacgaacaagcaaaatgccttcaaattccagccacttctagctgtttgcatctggaatcccagcgtgtaggccaygctcacaagagacagcgtcttagactaacagaatgaattaactccacgtggggaggagttaccttgagctcctggtctccaaagagtaacaggctgagct

SEQ ID NO: 39437 - DNA, 201 bp, Bos taurus
ctatatatagcagtgtgtatgctgatattttttaggactagatttcacagcatcggttgaatctctggcaactgcaaaggccacaaggccaggtagcagtrgtcctgctgggatgagcatgcctcctccagtgtgagtttttgttatactcagaagcttacccacctggccctggcaggcccttgaatttgagacccgtaa

SEQ ID NO: 39438 - DNA, 201 bp, Bos taurus
ccaagccctctggacaccttgatgcaaatacagacgggagagtgcaaaagattttcttctttcttcttcaactccttccttggagttgtccaaggaaggcyggacaactcatgttttattgctaaaccaaagttgctatcttggggtttggggattttttgtggttttgttttgctttgacatctagtgacagaaaatgag

SEQ ID NO: 39439 - DNA, 201 bp, Bos taurus
tcactgacagttgctatctaagggagttatctttgtttttggtctcatccaaacattttcccttttttcatccacgagcagctgatcctcttcactgttgyacctttttgttttactttttatagactgtacatcagtctgtacttctacagctattttttcttgcataagttccttattaccaagagcagaatgtcttca

SEQ ID NO: 39440 - DNA, 201 bp, Bos taurus
atggccctctgcaagttgctgtcattgttttcaaatgctttgtagttgggctgcccagatctggtcttcgcgatgggatggtgacaaaaagggttgcggakgctacagggtggcctgcctgtcacacaagtgcagccccagtgaaactgatgggagattaataggaaataatgggaccctgagtagagcactcgtgtggct

SEQ ID NO: 39441 - DNA, 201 bp, Bos taurus
ttaactcatcttccttctcaggtctgtgtaaaaaggagagtaacatcaatctagacatgaaacgtgagctctgttcccaatgtcactggccgatcatgagygtctcatgactagactgtcccaagtcagcctgtactttcctaagaatcctcgtagaagggccaggcgtattctaatctggatatctcttaactatctcaa

SEQ ID NO: 39442 - DNA, 201 bp, Bos taurus
aggactcttctagcccagcacccaacagtggccaagagcatgtcccaacaaaaatggtctcagtgctatcaatggcttattgatgtcatgttaatatcacrtatggatgtgagagttgggccataatttgtaaagtaattagcctccaattaagatacattaatttaaaaaattcaaaaagaagagagagagctgagtgcc

SEQ ID NO: 39443 - DNA, 201 bp, Bos taurus
acagtgggacaaaggtcagggtctcagagacagggactttccgaatgcagaagaagaatctggagtcaatggctacggcaagagaaagagacccctggccrccttgggtcactggaaacctcaccccttcttccctccttcttgtttagtcactcagtcttgtcagactcttttgtggccccgtggactgtggcccctcca

SEQ ID NO: 39444 - DNA, 201 bp, Bos taurus
agaaatcatcattttgacacataaatcagcataaaatatcaatgagatagtttacgtatcttttttattccccactaaatcttgtggtattttacactcamggcacatctcagtttgatctacctgcatagtttgatctactgggaagtgcttaacagtgacacatgctaccgcctactgccacgcacagtttcagtctgg

SEQ ID NO: 39445 - DNA, 201 bp, Bos taurus
aggggcccaggaataatgaaaagaagagtgagattacctttcattgacaaagacgactatacttactctaagtgacaacagaaggaggccaagaagataaytgaaggatcctgaagatcaaagggctagaggatttgctctctctttggcacaagggtctagaattgcaaaaaccagaacaaatgtaggatgctaaaatgc

SEQ ID NO: 39446 - DNA, 201 bp, Bos taurus
agttacacacctcccagcaggtcttcctccctgcttggccccagacggttcataatcacttctcttgacatccttggactactgatgttgagaaagcctargaaccacggccctgtctcaagatgggtcccaagagaacagtgtaccagccaggatttttcttttatattgacctgggttcaagtcccagtatcccacttg

SEQ ID NO: 39447 - DNA, 201 bp, Bos taurus
cactgaaagcctcacaggccaacagctaatggctgaggaacctggtcaaggctattcacctccattaccagacacctccaccctttccaaagcccctgctytcctttcttctggccttccttggcctgctcagtgtggattagacccggggtggctccttcctgctctcccatgaccttaggtcttattatattagaccca

SEQ ID NO: 39448 - DNA, 201 bp, Bos taurus
gctcagttggtaaagaatctacctgtaaagcacgagaccctggttcaatttctgggtagggaagatctgctagagaaaagaaaaagctaccatctggcctmgagtactagtcccttggactgcaaggagatcaaaccagtccatcctaaaggaaatcagtcctgaatattcattggaaggactaatgctgaagctaaaact

SEQ ID NO: 39449 - DNA, 201 bp, Bos taurus
tgcatatatatatatatatatatatatatatatatatatatcatacatatgatatatacatatctctcagattcttaaatatatacatacaaaatgtgtgygtgtgtgtaactgaaccactgcacacctgaaattaatacagcactgtaaatcaagtacacttcaaataagaaaacaattttttttttaatttctgctaaa

SEQ ID NO: 39450 - DNA, 201 bp, Bos taurus
tcacctagagaagacacttgcagagaaagcccgaggtctaaagcctccttctagtcatctgtaactggatatctgtgacgaggagccaagctttcgtctcragcagtgagccgtgagcccaggccttgattgagagggaaggatgtagcccatccgtggcaccatgcctgctgtcatcctgagctgttctcaggccggggg

SEQ ID NO: 39451 - DNA, 201 bp, Bos taurus
aagggatttccaaagtcacccaaggagtaccaacagatccgagtctggaaacaaaggtctgtccaatcatgatgataataataccagctaacgatgggagytgtctgctcagcccttggtgggtgttactcctttaaccctcatgggccccaggggagtcacacccaggccctgcatgtctccagcatactcgcctgcctg

SEQ ID NO: 39452 - DNA, 201 bp, Bos taurus
tctaaaaatatctttgccatccttgcccttaaagtatagtttggctgggtatagaatcataggttcacaattaatctctttcaacttcaaaaatatttttygatttccttctggcgtatgttgttgttcatgacaagttggctaacaatctgatttgtgctctgatttgttgagagaaatttatgcttcattctctggtga

SEQ ID NO: 39453 - DNA, 201 bp, Bos taurus
taaaagatgtggtccaccttgtctaacccaccagggctagaatgacgcactgaattctcacatcagactgtctgccagcatcagtcccaggcagagtcagygcgcagagcaaaagcaggaagcacgcaaccccaacggcaccaacagcaaaaccccacccacaccccggctctcagatccaaggaggccaggcagcctgga

SEQ ID NO: 39454 - DNA, 201 bp, Bos taurus
ctgcaaggcatggtcctacatgggacatgctcagtatatctttaatccaattttctgctgatgggtgtggctgtgttccctcccggtagtttggcctgagktcaaactgtggtagcagtaattggaaaactgctaatggaaacctccttcaaaaggacttaggccagcaccctgcagttcccaggactgttgtattcagtg

SEQ ID NO: 39455 - DNA, 201 bp, Bos taurus
ccaacagccacatgtgggagtgtctgagagttgtgctgtctcacaattcaagttgttatttaacctgtggtagctctgaagctcatgctcccaggggttcygctagacatgggtgtgcatcttcctaccacccgcgctgctgctaagttcagaggaggcccaaactgggaacctgccttcccaagcctctcacctgctgat

SEQ ID NO: 39456 - DNA, 201 bp, Bos taurus
tgtaacagcttttgtcacaacatcaattcaccatcccttggttttaatccagctgtactaggcagtgaaggagaaactaaaaacatggacagatggtgctmtgaagttgggatttggcaacacagctttggtgaaaagacaagaaggtgagaaaagtgcagtgttgatgtactgttgtaaaatgatctgtcattctgctca

SEQ ID NO: 39457 - DNA, 201 bp, Bos taurus
ttactggagctctgttaatagtgaagaggccacactccatacagaggccttgagtggccttgagataaatcctgaagagacctaacataagaattcaggayttctgcaacccagcaaatgtgaaccttgagtgattgttgggttttagagagacctgagatgatagttatttgaggtagaatgacaatgtagaggaaagaa

SEQ ID NO: 39458 - DNA, 201 bp, Bos taurus
cctgctgaaagccttcagttaacggcaactttgtcccattggagaatataactggttgtttcttgccataggtaataaccactttgcactttgttttctgmaagtgtggaaggtatactggaagtttgaagtacatagtatttattttggagatctacagttctgctatgtctagaggaagttgaaagctgcatgaagatc

SEQ ID NO: 39459 - DNA, 201 bp, Bos taurus
tcaccagataaaaataaacactggaaattctgcagtgctgagaaaagagagcaagagagccctgggcctgcagctatacctgtacccgaggccaccacaarggtgactagcgtctgctgaattcaagtctggaatcatctcataaaatcagtgacctaaatatagaagggtcgcaaacaaaacggcctgggaaagtcaggc

SEQ ID NO: 39460 - DNA, 201 bp, Bos taurus
ttttgccaaatatcaaaatgaatcccctcggatagctgattattttactcacttcacccagactgcctttcctatagattctaccgcagaatggccagccygtttcccaagagccatcccctcccctctgatgctcttcctccccaggagcccctcagccagcacacgcaccactcctccaggatgagcgtctcgaccagc

SEQ ID NO: 39461 - DNA, 201 bp, Bos taurus
ctaacctgtctgcttacagaattgtcacttgtctgcctagaactcttctgatctccccattacccttgagcaagagttcctgtttctttatatggcttacrtgagaactttctccaatctcatctcctgccatagcttccttaagcggtctccacagggttctgcttcattacaactgcctggagcccatctttggagatg

SEQ ID NO: 39462 - DNA, 201 bp, Bos taurus
atattcaaccttcagaaggatgtgaatgccatgaaggctgaggccttctgcttggttggctgctgcatctcaggtgtccggaccacacccggcacacagcrgctcccgcagacaacagtggccacgtgcgagaaaggactactgaaaatctcacgctcagatttccttccttcttgcccttcctccctccctttcatcttc

SEQ ID NO: 39463 - DNA, 201 bp, Bos taurus
accagccctactgaatcagagtctgaatgtcacatgatctctcaagtgactactaagtaaactaaactttgagaaacacaggtgtaggtcacacatcaaarttgtcccagttaggtgcaaagatgcagaaatacctgtgttccctgaggtattaacccctgagtaagggctggtcttggtttctttaatcctcttaataaa

SEQ ID NO: 39464 - DNA, 201 bp, Bos taurus
ttattagatgaatggaggctaaatgcagtgcgttttccccatttggaagcttgagcatggctagtcccatattcatcccacactccccaatcccaggcccytccagcctccccgccaaatttggtttaatccttcccatgttaaagttgcaccccaccaaattatctgctccctaaagagcccctctcctgttgccttcac

SEQ ID NO: 39465 - DNA, 201 bp, Bos taurus
caacttcacttcacttcatttcacttccaacctgtagtcttctgcacaatggcttgacttcctctggttgggcaggggtgtcaccagtgagtgaaagtaayttgtgtcacttacaggctagagcattaaactactgtgcaaggcctccagagctccagtccctctgctgtgagcccagcgattttgggaatgatgggtatc

SEQ ID NO: 39466 - DNA, 201 bp, Bos taurus
attttctcccaaatattgctgttggaaggttgccaaatcaccggtgatgctgccagagctgaagttagatgttgcctggttaactcaggcctccaagaagrtcaaaatcagcttgagaacaagagtgtcctgtatctaagggggacatggtgataaatgatggccattctgattttcacaatggcaagtgcattggtgtgg

SEQ ID NO: 39467 - DNA, 201 bp, Bos taurus
ctctcctgggcagctgcaggccgctcatcttccatcctgtgtgagctgtcttctccagagggcgcttctggatgagaacgttgctctgttccctaggactyggcccttgggtggttgaggtctgaactctcccactctgcccctcaggttttcagggagtcacatccctgctctgcttacaaattaggttcctttctagca

SEQ ID NO: 39468 - DNA, 201 bp, Bos taurus
gactcctctgtccgtggaattttccaggcaagaatattggagcgggtcaccctttccttctgcagggaatcttgatgaatacctaggaaacgctacctccraagcgtttataaacatatacttgttacaaaatggccattttgaactgagttcagcactcttgacacaagacacttttttcaaaggtcttgtttacaggct

SEQ ID NO: 39469 - DNA, 201 bp, Bos taurus
ggtgatttttcattatctataaattatttttaaaatcttttaaattaatttatttttggctggactgggtcttcgctgctttgcacaggctttctatagtygtggtgagcaaaggctactcttcgctgagttgtggggccttctcattgaggtggcttttctttctgcgcagcacaggctctagacgcagccttcagcggt

SEQ ID NO: 39470 - DNA, 201 bp, Bos taurus
gaaaacttagaagggtggtggaaaaagacatgttttctccccgcactcactgttggttatcccaacaccatttatactaataaataatctttccctacttygctgctcttcttttgttttcttctctataatagatagtatggggtttcccaggtgcatcagtaaaggacccacctaccaatgcaggagacaagagtttga

SEQ ID NO: 39471 - DNA, 201 bp, Bos taurus
tagtcctgcctcctgggtggacccggaatgctggcctgaggcctcctgcccgtgaccttccagcaatacccggacctggcccagactggcccctcaactgrgagggctcagcctaccccccgcactgcccacggtgcttgtcatagccacgcgttccaggaaacaactcactcagaaggacaatgcagatagtggagtgca

SEQ ID NO: 39472 - DNA, 201 bp, Bos taurus
ttctccctgagccatcatttgagcctgcctttgtccttatgctagaagctgacttaaacgtaattggctgtgcacaactggcttccttttagtattagctrtggtaagatttgctatttccttccccagatctctgtgagatagaaagaaaacaagtttcagacagcattcttccatacatctaaaatctaaggcaagcaa

SEQ ID NO: 39473 - DNA, 201 bp, Bos taurus
gaggagagagcctcgagaatgaggagtatagcggccgaccgaccgattgagagtgatcatcaaagctgatcctcttacacttacagcagaagttaccaaarcactcagggccaaacaatctacagtcattcagcatttgaagcaaactggaaaggtgaaaaagctcagtgagtgtctcgtgagctgaccacaaatccaaaa

SEQ ID NO: 39474 - DNA, 201 bp, Bos taurus
atctttgtgtgcttgtgttgcacagcgaggccaaacaaatcaaaacacggcagtgtggagcagagaaaggtttactgcagggccaagcaaggggaatgggyggcttgtgttcaaaaacctggaactctcccctgggtttcagcaaagcatttgtaaaggccaggtaaggtagggggactgcaggatatgtgattagccctt

SEQ ID NO: 39475 - DNA, 201 bp, Bos taurus
tcttcctccagcccacgggccagggtagcatgagactagtgcacatgtgcagatggcatcagcaagctcactgcagagtcaaaattaggatgcaagtcagyttgagtcattacgaaggcttggggcctctaagctaatttacggtgacctgcggaggctaaaatgaggcagaatctggactgttctaccattatgagactc

SEQ ID NO: 39476 - DNA, 201 bp, Bos taurus
agctaggagatgggttgggtactaggcccatcttttggtctatttttttgtcttattcaagacagatgaggacatccctggtggtccagtggttaatactycatactctcatctcaaggggcctgggttcgattcctcgtcaggaaactaagatcctgcatgccacccagtgtggccaaaacaaaacaaaatgagagagat

SEQ ID NO: 39477 - DNA, 201 bp, Bos taurus
acagaaggaagttttgctgtcgaggacagtcttttgatgccttttaaccatgttaacatacaagtgtgattctgtgcctgtgtctggagtctaagtgggamagtttggaaggagatgggcatttcagaggttagtaaaggctaactgtagttagccagtggggagtctccatccctggctgctcagcatcaccatcctgct

SEQ ID NO: 39478 - DNA, 201 bp, Bos taurus
tttgttgggtcgcaaagagtcagaggagactgagcatgcacacacatcgttagtaaaataataggcacagaggatagagggtatatctataaagagcctayagtgttttgtattaaactctttagtaaatttgactagcattttatctccatttattgagaaagacaaagtgtaacctatcagaaaagtcttctggcaact

SEQ ID NO: 39479 - DNA, 201 bp, Bos taurus
tggactgtctctggtccatggttaaccctctccaccatcttccctctgatcgagtcacactgggttctcggcggttttggttgctccataaatacaggctrgtatcaggccctgagtgcatggcatttcttcttcctgaacccatattctcccacatatccatttgccttcctcatctctttcaagtgtttgttcaaatgt

SEQ ID NO: 39480 - DNA, 201 bp, Bos taurus
gtaaccataccagttactacaagagagaaaaatcacagacttagttaacttgggtttaacccaaagcattcccccaaagttctggttgatctctaattcaktcctcaactttcaccacttggatttatttccaagatgggatcacttgagaatttgaggttagaaccaatgacagaaaaaaggaagtcttagcaatcatgc

SEQ ID NO: 39481 - DNA, 201 bp, Bos taurus
taagttagtcaattaaggcagaaaagaaggagagaggaaattgagagaaggcggtatggcctggctctgcgcttcacgggccatgtgacactttatgtatkgacagaagctttttaaaacgtctattacttctcgcattgccgacagttatgataaatcaaaaagcacattctagatgcaggcccttcctaacacctgatg

SEQ ID NO: 39482 - DNA, 201 bp, Bos taurus
gaacaaaatataaaacaccttgggagaaggaaatagagtgaacaagggaggaagctggaaggcaccacgtttcagaagggaagaagtgggctcggaaagcraagctgggaatggaccaaagtgacttcaacttcttcacagatttgctcaaactttcctggcgaccctgccgcagacatgagcatgttgacttcaagatca

SEQ ID NO: 39483 - DNA, 201 bp, Bos taurus
ttcgcgactccatggactgcaacccagcaggctccactgtccctgggattctccaagcaagaacactggaccctagaggcctggaaaagaaactgaggatyagcactcctgtgagggtctgaaagccgctccgctcctccccacctcccccaccgtcccctgatccctgcagcctcacaaaggcagaggagactccctggc

SEQ ID NO: 39484 - DNA, 201 bp, Bos taurus
cactgtctacaatgcttactacccggctctatacagagaaagttggccaagccctaatctggcaatataggcaaagcacttttaatacagtaatctagcayggagtaagtactggtaatttatagatatttttatttttacctctgaaggccaaatctgcatcactaatgcctttgttattggcaatttgatgttagatgc

SEQ ID NO: 39485 - DNA, 201 bp, Bos taurus
tgaactgtaggcagaaatttcgctggggggtcggggggcagcattgcaggaagaggcaggaccatatcccaagatattcaacagctggtgtaaagaggagyggtgggatctgaaaatagcccagcttccagctcccatcagggcagagacagtgcacaacagcctcaacaggactggaaggacacagcgccttggcagcca

SEQ ID NO: 39486 - DNA, 201 bp, Bos taurus
ttggtcccttgggaaaccaaagcagttgtatacgatggcacgcttctctttgttgctcagataattttcatcgccattggcccagactaagccttgcagaygaagcacatcctcaggacagtccagcagaattgggctctgctctgtctacggtgacagcagagtcatctcaagtggaaccgggccattgttccctcccag

SEQ ID NO: 39487 - DNA, 201 bp, Bos taurus
acacaccaactggggccaaacctaagggtgagtatcttaagacagtgccgaaatagtatatcacatcaatgtgttgtctttggcctcatatataagaaacrtatatatgtgtacacacaggtacgtgtatgtggtatgtcaggaagatggggccacgggtgcagtgagattctagggaaaggggccaccagaactgaggta

SEQ ID NO: 39488 - DNA, 201 bp, Bos taurus
gtttcaggacctccatggttgtggttcaagaaaggaactgatggagagtctgttttatctcaaaagcatctctatactgttttgctttgagttcgtaggcmcgagtgtatgatggaacactttggcttcaaattataatatgactgaaagtcatttgactgccattgcttttctgtctttaaaaagtggaaaacttaaata

SEQ ID NO: 39489 - DNA, 201 bp, Bos taurus
attccacgtaaaataatcaggatttatagttcttgaaaaaaatttagcacacacgtctgtcctggactaatattcacaggggccaataatcgaatgatacraggggcagccacctgcagcagagagggaaggaaggtccagagggcacagttcctttggccacagttcccacacctccaattactccccattctgaggttc

SEQ ID NO: 39490 - DNA, 201 bp, Bos taurus
ctatccttgctgaaaccctcttaagatacaggtcaaaataatgcacatttcattcacccacaggaggtgcaagaaaggccccagtgccctcgttatcactkgtctccctttgttctctgtctccctgacaccccagcctgttccgccgatacactgcgctacttccggccaaggacctctgcacatgcgctgttagcagtc

SEQ ID NO: 39491 - DNA, 201 bp, Bos taurus
cctgtaccccaacccagagcatccaggaaccagcgctgtgttcagagctggttctagagctgtcacggcccatggagcaggccgtctgccctgcagagacsgagggaaagcaggcgtgccgagctgggagctccggagctgcacaccccaggcgctcttatctgaagccttctggaggccacgctgcagacagtgctgtgg

SEQ ID NO: 39492 - DNA, 201 bp, Bos taurus
tgatgtttgggtcaaaaaaataaccctactgccaagaaccctaagatttagaactcaaaagtttcattgtacagtgttcttctatgtaagggtatttgccratgttttcttgtgcgacattgaactgttgtggtatgcgcgcatgctaagtcacttcagtcaggtctgactctttgtgaccttatggactgtagccagcca

SEQ ID NO: 39493 - DNA, 201 bp, Bos taurus
catttaagaatgcacagattttctcttttttagatggcctcttagaggcgtgatggccgttaacacaaagagtgaaatcaattacaaagaaccagcaccayccaatgttcagttttctggccccccaggaaaatcttaagctttcaaagcttaaaatgaaggaaacattcttgagagagaccatcaaagttcatttgtccc

SEQ ID NO: 39494 - DNA, 201 bp, Bos taurus
actcagctctttcagctacagtcacggtatctcatactcagtagctaacactaagagtaccaatgaaaaacaacagccagcacgaggccatttgctgaatmaagtgggaaagaacttatctgtctgtccgtgtccgatccaacccatcacgaatgacctgacgaaagggctgaatgaaagcggcagcggccctgccagaga

SEQ ID NO: 39495 - DNA, 201 bp, Bos taurus
ttcaattctgtgagcaaatgtggttggaaaaaaacttattagcttaatgtataagaaaaagcatcctttttggtgcccaaattctgcctgtgtagaacaamcaaccaaaggatacataaaactccagatgatgctgggaaacacaattttggagaaaattcaggcaagtcttcagatctcagtgtttgaaaagaagcccat

SEQ ID NO: 39496 - DNA, 201 bp, Bos taurus
ccttctctgttggctgtctcctttcccctctccattctgtgtattttctcttgattcacttctctcgtcagttataactaatctgatgttaaggctagccrtccattgagttattattttcaattttagaatttttccccatgccacatctactgtttctttttatggtttatagcctactactgacagtctttgatctag

SEQ ID NO: 39497 - DNA, 201 bp, Bos taurus
ctgcagatctcagggccagggaaggacaggaccagcctggcaactagtctcaggcactcatgcaaaaagaggctcatgtgaccaacgggcagatcagatcyggctgccgccaagggccctggaaaaacacacattcccaaagggaaatcgcacgctggctagctctacctggcatgtcattgaactaacgtgaaagggtcc

SEQ ID NO: 39498 - DNA, 201 bp, Bos taurus
agctctagagtaccacagtatagcaaatatctcaataaatcagatgacaaaaaatttttttatttccaagtgcatataaaaattatgtttatactatgctrtagtctatcatcaatgtacagtggcattatgtcttaaaaaaaaacaatgtgtatactttaatcaaaaacactttattgctaaaaaatgctaatcatcatc

SEQ ID NO: 39499 - DNA, 201 bp, Bos taurus
agcctccaagccccatagacgtttggccagtagatctttcagagaggcttttattcatctcactcaccgaaaccctcggtgagattattttgtgtgtgagraacctcagagctgcattctaaacatggtgacttctacgtgaccgataaatatgcctgcctgtctgaggctaaaattggtctcagtgggtataattgaaat

SEQ ID NO: 39500 - DNA, 201 bp, Bos taurus
tatccatcaataaatgcaattgtaatagattctctaaaaagagaatagtggagaatgagagatctttctaaaaggcccaaatgatgagaataaaaactagkgatgagacttccctggcgatccaatggctaaatctctgcaatcccaatgcaagaggcctgggtttgaatcctgatcagggaactagatcctacatactac

SEQ ID NO: 39501 - DNA, 201 bp, Bos taurus
gtgtacttcccattgaccagacacaacctgaaatcagacaacaaggaagtaagtgttgggtcagactcccaggtcacagaatatagtgtgaacgtaggaayggtagaacaagtaactgaaagttactgagagtaaattctaaaagttctcatcgcaagaagaaaaaattgttaactatgtaagttgatggatgctaactaa

SEQ ID NO: 39502 - DNA, 201 bp, Bos taurus
acttgcggacatgggctgtacctaaatctattaacagaacgaaggtcatgtgctatggagagaggaaaggcacctgtacgttgagtcggcagaagtcattytgaaacttccaccatcaaatagactataatttaatatttgatcattaaataaagagcaggttaaacagtttgcaaatctgtgtgtaccccatgatataac

SEQ ID NO: 39503 - DNA, 201 bp, Bos taurus
ccttaagttaaaggaagtgttttcttttctaatgttatactctttacctatcagtgtattgctgcaacttgaatcattcttttcctgttgttggagataamgttatcctgtactgatgtatttaacacttgtattttattattgagcatatcaataaaaatattaaaaaagaacagattgttttttaccaactctatagca

SEQ ID NO: 39504 - DNA, 201 bp, Bos taurus
caaatgcacatctggacacatccagtgtacagtccagtgtctaggccagtccagtatacaccagtgtgtatctagtatacaggccaatatacagtccagtrtacaccagtgtacatctagtacacagtttagtatacactccagtgtacaatccagtgtacgtccagtatacactccagtgtatatccagtgtatgtccag

SEQ ID NO: 39505 - DNA, 201 bp, Bos taurus
agaatgttgtcagtctaaagagtgacagaggcaacgtttaagggtatcagagacagaagaaggagttaaatagaagttagagagactgggggaattagatkaggtcaaagggtagaggatatgggagaaactccctgagcaggctgaaatgcctggaaattgtggtcagcaactggaaaatctaaatttatggcttagagg

SEQ ID NO: 39506 - DNA, 201 bp, Bos taurus
ctttgtggccagctagcccattacatacatatgaagctattattgataggaatttaacttctaacttctactcagggggaagatgaaagaaaatggaaccmtggccttgcattcaaatcccctggcgagtccagaacataggctagacctgctaaatggaaatctgtgagtgaaggtcccaggaatcagtatttttgtaaa

SEQ ID NO: 39507 - DNA, 201 bp, Bos taurus
cctcagagcctcatcagccctgatttcacacagaccacactgttccccctgcattgggcattttccagagagtttggccaagagttcagactctgtgatargaattcaggtaaatggacagaatgtctggacttgggctacttagtgaggtacgtaaaagagcagaaatgtgacccataggaagagccgagaaagtgggat

SEQ ID NO: 39508 - DNA, 201 bp, Bos taurus
atctgctgcctcagcatcaccatcccaggtgctggcaactgctcttctccatttctataatttgtcatcttaagaatgttttataaagcaatggcaccccrctccagtactcttgcctggaaaaccctatggacggaagaacctggtaggctgcagtccatgggatcgcgaagagtcggacacgactgagcgacttcactt

SEQ ID NO: 39509 - DNA, 201 bp, Bos taurus
aagcactcagagacacagagagatcaccacaaagtaagagaacacaggactgacagggaatcctctggcagtccagtgattaggactccaaactttcatgkccaagggcaccagttcatcaattcctagatctctgcaagctgcacagcgaggccaaaaaaaaaaaagactgacacttgaattttcacaatagaaggagcc

SEQ ID NO: 39510 - DNA, 201 bp, Bos taurus
agctggggagaaggaagaaggcaacccagggccaaaaagtgaggagccagggcaagaaggtgttctgaagaccgcaggggagcggggacagtctgagtatrgagaccttcacccagaacagtgcaccgacagacagaggcgggtcctctgatccagaaacccaccttccttctaaagacacacgtgtcagaacccacacgg

SEQ ID NO: 39511 - DNA, 201 bp, Bos taurus
agcttcatgtaaataattctgtgtactcttgctcagcattgtatctgtgagttatccatgttgtgattcatttattaatacctctctgtagtgttctgtcrtgtgacttagaccacagtttatgaatccattctactgttggtggaaatttgggttgtgtccagtttgtagttgttatgaataaagttcctacgaacattt

SEQ ID NO: 39512 - DNA, 201 bp, Bos taurus
tctctgcccccgagtgtgagcttcatgagggcagcagagacgtgggtctctgcacatgtcctggcatctagcagagggcctggcacacagaaggtgctcartgcttgctgactggctgaggaaagaggaagtccagtcatagaggtgactccggccgtgttgagcgttaaagaagctgaaggtgagggttagggaattggc

SEQ ID NO: 39513 - DNA, 201 bp, Bos taurus
gttcatagttatcagggaaaccaatagaggagcatgtccatcatcttccctttgataaactatcttagcggtgaggttctgatctagagatgagaacaatygctagctgggccccgggacaagtatgcaggtatttactgatcaaatcaatgattaagaggggaggtcagtcatgtgagtagggtgtaggtgtgatagaga

SEQ ID NO: 39514 - DNA, 201 bp, Bos taurus
tacaaagggaaatgttgtgaggtaagggcatgatttttttttgctagtgtgaaaatttcctcctcatgttctctaattcatgttacggcctggtctttacrcctgtcgttggctgaactgttgattccctagctccgctggatcctggtggtgagtagtgtgtggcagtatctagttaaagaccttcaccggtgctgaggc

SEQ ID NO: 39515 - DNA, 201 bp, Bos taurus
ttggaaggtaaattacgtaggccttcagaacatacctctttagtactcaatgttaaaatcctagtgtagattccttttggaaaggggagggggaattcacrtttagaatattacaggccatggactccacttactgtatctggtggtcgcaggatcagaaggtgagatgtttctggttagtaagtaggctctcagcatatc

SEQ ID NO: 39516 - DNA, 201 bp, Bos taurus
gtcagaacgtaagaattgtcaaagggcagtggtggtgcggcgtgggcaactaccacagtaactaggaaacgctggccttggggtctggatgcagaaggaarccagtcaggtcaggaagtagaagaggatgaccagaagacacgcccttctcggcctcttatgcccactggttgtgggttcagtggtgccttctgcctctcg

SEQ ID NO: 39517 - DNA, 201 bp, Bos taurus
tcaggttcgaacctcacctccatcagtgccactactgtgaagccctggccaagtcacttaacctctctgagcctcatctgcaggctttcaggaaacagaarctgctacggtaggtcaagtcggccaaagcacttccaccctcaccctcctccccatatggcccaccccaaggccagacaggatatggagggtgcccttcca

SEQ ID NO: 39518 - DNA, 201 bp, Bos taurus
tgccggcctcgttgatggaagggatttagtcataggtaactactttgtgctctgcccttgtgcccttgtctctctgcctatatccttaggatctagaaaaycaggccttgattctactgagtaggtcgaatgattctaggaatggttcttggctttgttgaaataggaggtattggggatagttccttttttacaaaaaag

SEQ ID NO: 39519 - DNA, 201 bp, Bos taurus
aaatgggtggatctatcctgaaatgaagaggcggtcgctgataaatgaggtatgccttgtcctgagttgtctgaagctaccccagggccccagagatgtgmcttcaccctcactgaacagtggggggaaaactgagacccacgaaggtgaagcatttggccagggcagaaacaggattctttctgcccagccctaggctta

SEQ ID NO: 39520 - DNA, 201 bp, Bos taurus
catcatcttccctgttcaatctagagttcccccacgaggctggggacggggtgcttctccttctgcgggagggatccaggatctgccattgccgggccccmacctgaggctctgtcccacattatctcttctacttgtaggactcagggtggagttcatgttcacaaggatggcctgacagtgacctctccggtcctgatg

SEQ ID NO: 39521 - DNA, 201 bp, Bos taurus
ttgctgaaggcctggcttcagctgctgggttcaaaggtgcgctggtcaggacggtgtttcaggagagtctctgatgtgtcttgttaaacctgctgtgcttytcttcggtctggccgagagtttttacgccaccccttttatacttgaatgaactgagtttcgcggatccaggagcactctgggcatcgcccctcggcgcgt

SEQ ID NO: 39522 - DNA, 201 bp, Bos taurus
gtgctggtgtgaggcatacagcctagagcaagaaggtgccggagccttccctgcctggtcacgcgggcttctgtggccctgatcccgcataacctgatgaygacaggtatgtaccactgccctaggagcacctgtgtgtgtcacatgtgggcacctgtacaggtgtgctatagttctgcccagttcccctctttgggccag

SEQ ID NO: 39523 - DNA, 201 bp, Bos taurus
ctggtatgtcaaaatcagaaaattgttacctaaaagtcccagatttcttggttcttttgaaaaacgagatgagctggcttcactgggcctgcacttcctcrtgcagagatctgctcggtgtctttggtggctcacacagtagatctcacctgtggtggtctcatggctgaaggactggagaattggaagcctcagtccagg

SEQ ID NO: 39524 - DNA, 201 bp, Bos taurus
cctcttctcctgcaggatggggcaggggacaggcactggctggggctccgaacccagcccccatcctcccccaacagccccctccccaggggccaggaaayactactttgagtttccattttgcagtcaaagacatcccatccatgatgaatgatgtcaagtgcttacttttgctggccaaggtttacaagagtcataaaa

SEQ ID NO: 39525 - DNA, 201 bp, Bos taurus
cctcgaccaagtggtccggctttgtggagtggaggaaacaggcaggatagaggccagcccactccccaacgccccttggcccctgctcagttaccctgcayaaagcaaggatgtctgtgccaagtcccgtgccatcattctagccctacgtggaagctggtcttgggggaattccacccagtccctgaggcctgcgtggcc

SEQ ID NO: 39526 - DNA, 201 bp, Bos taurus
tattgcaagtctttctccatcaggctcaatctacactactcatgtcctgcctgtttgtcctggtaattcaccctcccttaataatcctgtctcacagaacygggcttgtggcttagtggatggatgaactctcctggatatgtcattgtatcggagttcagtctcccctttcggtctgcaatgcccttccgttctgtgtgc

SEQ ID NO: 39527 - DNA, 201 bp, Bos taurus
gcagattggcgagcaggcattctagaattgttctgccttcagggaacaggccagctcttggcactgaccaaggtagaaggaaaagaaagctagagagtcaytgttttttaattaagttttgttggagtattattgacttacaatgttgtgttagttcctgttgtatagcaaagtgaatcagttatacatgaacatatattc

SEQ ID NO: 39528 - DNA, 201 bp, Bos taurus
tctgatgacaaaggaataagttaccacttcttgatttgaggcagttgggattctgctcccctggcctccactttgtctttgattgccggggaaaatggttrtcttggctaatgttaaaagacagatctaagtgtggttggaaagtctgttccaggcattgtcagagctggactgtaatagtgtatgtaactctggaccaca

SEQ ID NO: 39529 - DNA, 201 bp, Bos taurus
ggaccagtacacgggtgagtgtgactttctggccactggagtcacacccacttagagggtcacttgaacactagcaacctttgtctgggaaaagtagtgaytgggctcccttaaaggcctgacatcttcagcgatgccactgccttaggcctaaagaacccaggacacgactcacttggcagattaaccattagtaatatg

SEQ ID NO: 39530 - DNA, 201 bp, Bos taurus
acggtctccttagaatttgctgctgtgaagggagttttagatggtcagacactgggacactcatgtgcatgctttattttacttaaaaagtattgattttyctgctctgggtcatagttgtggcacatgggatctttagctgggacaggcaaactcttagttgtgggttgtgggatctagttccctggtcagggatcaaac

SEQ ID NO: 39531 - DNA, 201 bp, Bos taurus
agcatcttcacatctgcctcgccttaggtgggaccccagcacatgcggcacctgagccagccaggggcataaaagcctggccatttgggccacacgtggaygctgccaggcgttccttgttgtggaaccctttgcaagataaaacaagtctttggacagcaaagacagtccttggagagacggaggccacatctaggggct

SEQ ID NO: 39532 - DNA, 201 bp, Bos taurus
agggaagtcattttctagggtcacccagctgtcctgtgaaggacatggaaatccccaatgttcattattctttggattcatagacaaggccaagccattarcagcatcactgaaaatggtcctgttcactcagcaacacacgattgccctggtaacactgaatgtggccctttgcccaaaggaggaggatccctacaaaga

SEQ ID NO: 39533 - DNA, 201 bp, Bos taurus
ggccttggcctgcggtgctcaggtgtgtgtgtgtgtctataggtgggcactggtgtggtggtgaaaaagagacagccaagggagagctgcgcctcccatgytgtcggggagggtggccagctgatgaaggtgctgtgctgaaagccagggaagggtttctgaaaggtgctggcgcctcaggaacgccctcctgctgctctc

SEQ ID NO: 39534 - DNA, 201 bp, Bos taurus
tcttggtttaagtgggagagtctcccaggagactttgtgctcctggaagtcggggcctgccgacccccagtgcacagccagctcctggccctagagcaaaygctagcacatgttttccaagtccatcattttccttacagagaagctggagaaagaggtcgcttgtggccaagggacgtcctcgggtaatccgcagagacg

SEQ ID NO: 39535 - DNA, 201 bp, Bos taurus
ctcagaaattccctcacaaactcagaagttgcagcaacatttgttcacaaggacgcaaagggatgcagtttgtaggctctcccaagagaaggctgtggcarggcaggggtgaggtaggggaggcgactggctttcccctggtgaatgtgcccagcgcagtctgtggtccaaggccccatccacctctgggttgactgagac

SEQ ID NO: 39536 - DNA, 201 bp, Bos taurus
aggcagagagagacgcatgcacacacacgcatatggggtgtgagggaggcagctctgttatctgttggtcctttgatagctcatcacagtcacacctcccrgtacactgtggactctggccacagcaagagcaggcgaggagctactctgaagctcaagttccaaagcaggagatacggggagaacaatcagctgtctgga

SEQ ID NO: 39537 - DNA, 201 bp, Bos taurus
tgaattcagatcttgctgatgggaaagtgaaagcacagacttttatgctgccttttatatattgtaaccagcaggatcctcttgcttatttgtatcaccaytggtatcattattagcaccatccccaaaccccattcccattctccccggagtgtggctgaggagtcctctggcccgtgtatcctctggacaagagcctgg

SEQ ID NO: 39538 - DNA, 201 bp, Bos taurus
ttcaggctgatcccctggagcgcaggggccctctgcattcactttactgcctgggcttctaagacccactcgagaaggtgcccagggtggggcaccttccrcgatttgagtagtcgcctgcggcctacatgaacagagcaagtcccgtgctggggctttattggctttctgcgtaaaccaaggaatatcagcctcttttct

SEQ ID NO: 39539 - DNA, 201 bp, Bos taurus
ctagcataggcccccactgagataagccaagtaagttctcccatctaagtcactacatgagagagtgttcagagaccagcaatccaggccaagtcagtcartgcacagcttctccctggctatggggccaatttagagccggcgtaagacttcagatggtgagtagagcaacacgtggactgtgactcaccatggttagag

SEQ ID NO: 39540 - DNA, 201 bp, Bos taurus
tggacttttgctgttgttcaccagcagttggtgggcctagcagggaggttgccgaagaagttacaacaaggaaactgaaacgtgagaacaagattagaaayggagttgggatgcttggacccgggccggaagggacacattccgccagaaacacctgtgttctccctggcctttgagtcacctcctggggggacaggcccc

SEQ ID NO: 39541 - DNA, 201 bp, Bos taurus
tttacacctatgggtgattgggcgcccaaggacatctgtcagtgtctgggggcatgttcagcgctcacagtgggacagacactcctggtgtctgttgggtraaggccaggggtgtggctcagtaccctacaacgtacgttacggccacacacagcgaagaatcagctcttcctcaatgtcacgggcaccgaggttgaggaa

SEQ ID NO: 39542 - DNA, 201 bp, Bos taurus
ctgattggttctactgatgtttttaaatcgggccacttgggtcattgaatagtgtaatgctggactttccttgggtcagtttactcaacatccaggcagcygtggccagagagatggggccagatggaaaaaatatggcaaatgcccaacttctcctcagtgagttatggtcagagcttcccatcaataggaagaggggca

SEQ ID NO: 39543 - DNA, 201 bp, Bos taurus
ttagtttctcaatggtccaacttctgcaacaagactatttcttgagaaactcgcaaatgtgcccacgttgtgttcctataccaggctttgagtaggaaaamactgttactgtaaatcactgacttttaatttttgctgctcaatataatctcctggcttggaaaagatcagtttgctttccaatccaaagaaaggcaatgc

SEQ ID NO: 39544 - DNA, 201 bp, Bos taurus
cagaggaactgtttggccagggaagctgttggtgaaacaacacaaatttgattcacggaaaatgaacttaattcttgttttgcagtctttgggggatgatrattgatcaaaaacgttattcttttatatttactatgaagttcctagactaacagacaattttgggggcgggggggaagctttcatgagttcctgctctat

SEQ ID NO: 39545 - DNA, 201 bp, Bos taurus
gagaaatccttgagggatgccaaccacatgcttgtcttgatgcagagcactaggtaccagctcgccctctcccacaagcctgccaagatcgatgtggcccragtaactttcgacctatacaaggtgaacccacaggacttcattggctgcctgaacgtgaaggcaactctctatggcacatactccgtctcctatgatctc

SEQ ID NO: 39546 - DNA, 201 bp, Bos taurus
ctctccaagatgaaccttggggccctcccacaccaaagcatggggctgacctgctgcccaccagggttcctagaggcctcagaaaatatttatgcacagtkggcaccatttccccaccagatgctaagttctcagcacaacctttaggtctttctacttctgtaaggaaaccaggaaggccactccacttacattcttaag

SEQ ID NO: 39547 - DNA, 201 bp, Bos taurus
ctccaacaccacagttcaaaagcatcaattcttcggcactcagccttcttcttttatacttctgtttatactaaagtaaaagtaaattttagctgtcataktttaaatcccaatggtattccaggcacttcacattcatcagctcatagaattctcgggagaactctgagtcagtcatcactattcccatattccaaatga

SEQ ID NO: 39548 - DNA, 201 bp, Bos taurus
gaaaagcaaactccacgcagtcctcctctggaaacagaaccccctggtggatgcaaatctttcagtgagtcatgttcagaaagctttgactttctgggccragagcaaatcaggagagtcagagagactagcagctcctcctttcctaggctgtcagaggttggaggcgagccaggccttcagacctctgcctgaggggct

SEQ ID NO: 39549 - DNA, 201 bp, Bos taurus
actgttgttctcacactgccttgttgaacttccaagtgagtgttcatttggagtctgagacctagccgacatgccactgcttcctctggaagagaacatgrtaacatcaaagtcctgtgctttcttcgttttgcgctgatggggatatgtaggcttcttataatataaacttgtccaaggttctgttttgctatcatgact

SEQ ID NO: 39550 - DNA, 201 bp, Bos taurus
cacccctgctggtgacccggagcttatcacctcacctctgtgtctcagtcacatcttacagtgactgactacaacactttgtaggtgtgctgtaaactgtragctctgtggagggagtactgctaattcttatcccctcacttcattctttcagttacttcatgaggtaggtacagcagcagttcttatacccattttaca

SEQ ID NO: 39551 - DNA, 201 bp, Bos taurus
tttaactttactgtttacggaactctttcatgtatgtgtatattttctaacttgacttttaccacaattcataggtaagtctcataaatcccagtttatakataaggttaataccttgagacagagctggaattaactcagaatctattttttttaagtccatgtttgagtaagaaatagtcttaccagaccacagcatgt

SEQ ID NO: 39552 - DNA, 201 bp, Bos taurus
aagagggtgctatttttttaaataactttagaccttaaaaaaaaatagaaaaaagctctacatcccaaacacctagccccagcgtcaggcccagaaagtcracaccttccattcttggaaaagctttgacggttcctgtatatgcttcctccaagttccagtcctgctcaggttgaactgatttaccaggctgcaggctgg

SEQ ID NO: 39553 - DNA, 201 bp, Bos taurus
gaggaaagggtatcaaagaagaaaatagtcattgtgtcctttacactggaggaagtgttttgggctctcccatgtagacattttctaggccatcggtagcrtgtttgtaaggaaagcaacaactttaggcaagtaagtttataatcagataggaaaaaaatgagatttttgtttatttcattattacccgtgtgctaacta

SEQ ID NO: 39554 - DNA, 201 bp, Bos taurus
ctgggggcagtgaaccggccagagcaaggggctgagacacaacaggtgccggcagccagattagggagcatctgtacactgggggttgcaaactctggccytcaccctgctttatataaataaagttttattggagcacagctcatttgtttgtgtactgtctgtggctgcttttatacttcaagggcagagttaagcagt

SEQ ID NO: 39555 - DNA, 201 bp, Bos taurus
agtaaatgtgtcagattttaacaagggtggtggaagcacagcgtggtaggctgaattgcgagtcccccaaagagatccacatcctggccctggaatctgtygcagacagaaacggactttgcagatgtggcaaagttaaggatcttcaggtgggaagatgaccctggattgtctgggtgggccctgagtgccactccacgt

SEQ ID NO: 39556 - DNA, 201 bp, Bos taurus
gcaagctggtcccaagatacatcctgtgcagaggcctggtggaggaggaagcatgtcaggaaggaggaattgacagggcaagtatggagcatcacaggaartgaggggaagccgaggccagaagggtagagtacccgcagcatcagcatcacttataacaaattgtagaatctaaatttaacaagagccccaggtgatccg

SEQ ID NO: 39557 - DNA, 201 bp, Bos taurus
tttagtctggatattaaatagtctgatacagatggtagaaggattctggctttaaatttaaattttagatactttaataagcatggcccaggtatatagcrctgtgattaatggagcatctgaaattatgcattatgttcatgaaatttagattggcctgtttgcttggatctatgctcagttatacccaagggagagaat

SEQ ID NO: 39558 - DNA, 201 bp, Bos taurus
tgctgacagccctgctacagagcacatccagatctttagcttagattcccttacccaggaatatggaggtctggaggataagtagctgtgggactgggccygagattgtgtacgtctgacaagtttccaggtgatgccattaacaccactcatgaatcactttcaggggccaaatgcaacattgtgctttacgttattttg

SEQ ID NO: 39559 - DNA, 201 bp, Bos taurus
gagtttagtatatgcaggattaaccctgtgttttcactgctggagggagcatcatacactttattctccatggtgcaaaaatgaccccatcatacatgtayaggccatctgctctccatataccaggatttagaaaattatggtccatgattgtataaacctcagtcacaagagccttaatctttcccgcctgtcctcaca

SEQ ID NO: 39560 - DNA, 201 bp, Bos taurus
ctttctatgtgttctcaagacaaagaatttggtgtctattttgtaagaaaccacatgacccttgcatatctcagaacctccctgaaatgcatctcgtacargggtcaaattcagattacagcattcatcatgggagaccatggccaagtgtaaacgagtcatctttgtaaatacgttaagtagagagtgtgtacctagtga

SEQ ID NO: 39561 - DNA, 201 bp, Bos taurus
ttgtatccattgtatggaagtactgcatttatttaacaattcatttgtccatggacacttgggttgttttcagtgtggggctactataaataaggcccttrtgaacatcatacataagacttcataagggcatatgttcatttgattttgcatgaacacctaggagaagggcttctcaggtggccctactggtaaagaatc

SEQ ID NO: 39562 - DNA, 201 bp, Bos taurus
ctggatatcagaatgaagagaaaagtaacaggccacatgcctccaccagcatataacagtcatttcaggaccaaagtcacatacatacagggatggggagyatttataatactggtgctgggcccacatgacagtatgctgcctgctctgatacagacatcaatcttgaggaagccctccgcacactcagtgctgcctacg

SEQ ID NO: 39563 - DNA, 201 bp, Bos taurus
aagccaagcattcaactggaacatacagctgaatggaatgcacagacacattagagacacaattttcaattttaggtatctgaggacccgttacagatacygatgcttccgtatcaggcaaaccgattgccaacatcaccattaaaaaatcattttcttacattttctttttgtagtgtgaaactggatttctatgacaaa

SEQ ID NO: 39564 - DNA, 201 bp, Bos taurus
aaaaaaaacaactaactttctatttttccaagggcataaaaacaaataagacagcctattatcaccatcattaccatcatcatttcttaagaaacaagaaratgtcacaaataaaacaggaaaaaaaactaataaagttaaccagatactctaaaatcaatgaaaatcttatgtattacttgtatttcattagagcagagt

SEQ ID NO: 39565 - DNA, 201 bp, Bos taurus
tatcaaggcacagagaccatcagtgatagaaaatgcattatgagaatgttcctccctcaactacggtcgccgtcgtttaattcaaatagaacataatgaargtctttgctgcatattgctatgtgtatgaatggctagattagtggctaaccgataattagtagctttcgcgaaatgtggtcaatctacttgtgggagagg

SEQ ID NO: 39566 - DNA, 201 bp, Bos taurus
ataagccaaactctgtggtaagctcaccagtaggctccagcctatcctatctcacaccattcctaccaggcagttccacctctcctctccctgttctcatkaggagaaaagagagactcacagaaacatagagagcctgttgtgaatcagcagaagacaaggactgattttacttacagactctggaaaagtctgaagact

SEQ ID NO: 39567 - DNA, 201 bp, Bos taurus
agtttcaagaaatgcctgaatttcgattccagagatagacgttcagttcccatattaccaaggatgcagtccatgaacaccaagtaattttctaaagctcrtacttaagtagtcatcaaaagaaatgaaaagtacacaggaatatgttagcatgttataaaagtttaggttcttcaactcttccattttcctattacatct

SEQ ID NO: 39568 - DNA, 201 bp, Bos taurus
gttctctgtacaagcctgattcaggtctgtatcctccggctccttcctttctctggatgcctcatacttcctaaacatcggagaggcctccctccatacckccatgctgtctcagccatgttacaatattatctcctaccttaggagagggtaggagatcaacgcagacatcaactgtccacctgaaatggacttggccag

SEQ ID NO: 39569 - DNA, 201 bp, Bos taurus
ctaccaacccacaaagattcctaaccacagaaaccctcaaagttttccttggtgggtttatgtcagatcctgttctactccagtatggtaatgccagattwaatgtgccatgaaaatgaaactattatcctgaaaatgaactattcataacttatcatttcccctttttattaattaacttggcaacttttcttcccaaat

SEQ ID NO: 39570 - DNA, 201 bp, Bos taurus
atttgtgtttcctcttaaatgttccccaggtgtctttttttttttttattattgcttctcttatttatataatatcatggaaaatgaccatggaaagatcrgttcttttgaaatctatgcttaaaggtttcagaattcttaagcaagttacaaagaaagtcttgaattatgtatagaaaaacataaatttaaaaaatcagg

SEQ ID NO: 39571 - DNA, 201 bp, Bos taurus
cagctccttcagaaaatggccaagtgggggaattcatcagaaatccagcacaaggtgtcgttacattgccacatcttgacaagtcagagctacacaacttyagaggacattggtatatccactgggatatagaaatagacgacataactgcaaagttaatttctgcctttgcataagtgctgaacaattgaaaatgcaaat

SEQ ID NO: 39572 - DNA, 201 bp, Bos taurus
ttctacacagcgattcccagtagtgaatggagttttagggcaacactatgtaaataatggtcaactgccattatcacctttgtagaaagaactggtcatakgagtttatgtgtaatgagcaatgtgcagagggaataaagtcagtaggcttgtatattccttcattgctgagaaccttctatatgaaaagcattacgaaaa

SEQ ID NO: 39573 - DNA, 201 bp, Bos taurus
tacatgatttatgacagaacatatcggttcagccagtgatttgggcaagaatggtgagtgctgaagatcaaacatggtatctcatccgtgtctcacatgcmtgctttgtttcctggcacacagtagggggctgacaaaattcttagagtggatcaatgagcatctgtaaagagaagagactattgcaagctgtatgtagtt

SEQ ID NO: 39574 - DNA, 201 bp, Bos taurus
gaaaccacttcattgatctaaggctatcaataattcacagagaatgatcaaaaactggccaccctacttgatctgtaaatcaaagctgtaccacatagcaygacattgctcctcatcagcatttttatacattacaatgcaaattttactctgtgcttccaataataaaatctactgatatgggatctggttgcagtttct

SEQ ID NO: 39575 - DNA, 201 bp, Bos taurus
ctcctcattactgctttcagatgcctccctccctttgacctaaaaacatccacagattgaagcttcatccatcaaatcacaccaccaatcaccagcctttkctttatcattctacagtgttatctcctggagtttttccacttgccatactgtcattctctaaagttaccctctcacttctttgtgagttatgtatacttg

SEQ ID NO: 39576 - DNA, 201 bp, Bos taurus
aaagtctgtgacattatgattagactagatggggaaaattagtaggtgctctgatgaacttgtaatacaaagggtacacttaagatgaatttcaaatttgyttgacatgtatctttaaaaaattttctaactctttccactatcaaggcttagaatcaatggtcaactgagaaaactcttgacacctggaatatggtctct

SEQ ID NO: 39577 - DNA, 201 bp, Bos taurus
acaaagtgtgatctgagcaatgggatacttggaagttaacttcaatcaaatattattaaaaggaaagataagaataaagcaaaacttaaaaattaatcgayttctatttcaacattgggcaaatgaaaactgaacctcggatttgctaatgcttgtacagttaaataatagtgaaagtatttaagaaaaataaaataagaa

SEQ ID NO: 39578 - DNA, 201 bp, Bos taurus
tcccagcattctgggctccatctttcatttccaaataaccatgatttgctgccatgtgatctaattaaagtccaggccctcctcacatgctttgaatgatmcctataaaagttttcattgtcccagttgtttctcacctcttgtgactaacttctacatccaactttttctctcatcactctggccatctgataattgtca

SEQ ID NO: 39579 - DNA, 201 bp, Bos taurus
gacctagcaactaaaccaccaccaccaccaccgccatggtcttctaagcaacattaatcatggtttgatgaaaaggtgagggatggtggaagccaaggtcytgttttaagtgaagtattactttttgagaatttttaatatttactctctaatcaattttcaaatgtgtaatagagtatttctaactatagtcaccagaga

SEQ ID NO: 39580 - DNA, 201 bp, Bos taurus
cttgtgattgattttttccaccaagtatcactcacacagagaaaaactggacctcaagcttttcccccagcatcctggtgtaaaaatgtcaaaagataaartaatctaaatatcaatataaattgctcaagaatccagaaatacattcaacatcaaatgatgacggccaattcaactgcttagaaacactgtcagtttcaa

SEQ ID NO: 39581 - DNA, 201 bp, Bos taurus
ggtgcacactgctgacctgcagcttctaggcatggcagctgtggccgttcacccctgacacccttgctgcaaactaccccctggctgcagggaactgcctyacccagggtcacaggccttctcaatggctgcctttcacttgggcacaaagccctagcctctcatctaaaatacagcacaaatgtatacatgcaaaacaga

SEQ ID NO: 39582 - DNA, 201 bp, Bos taurus
aaagcaataacctctctaaatattattttcactctagctttaatctcaatggccattttgagttcaaagccccaaactgtgtatattcataggtaagttaytgaattcacaatctgatgtgagtcactgtcttaagtgaaatgctagctctggccccttctgaaattatggtgaaaggtaaaatttacttgcaagcgtgtc

SEQ ID NO: 39583 - DNA, 201 bp, Bos taurus
cctgtcactttgacttgtcactgaaactctgcttcatataataacatccccaatccatctgggattctgctttgattgttctactgaacagcaccacatcrctctaactgtgcctcttacaactccacactgtttaagcattccaacagatttggaagccaaaaaacagaaaacaaccaaacagaaatacatgaaaacaaa

SEQ ID NO: 39584 - DNA, 201 bp, Bos taurus
gacaaaaaaaatgcatccacctaaattaaaaaaattcacgtatttacaaagttcagtaactgttaagtttcacatgcagaagttagtgcacaggaaaatgktggtagtagtgtctggatgtcttgaaacgctggaagcaatgaagagacacacaaacacattacggtttagctgtaggtcaattaaacgaacctatgcggt

SEQ ID NO: 39585 - DNA, 201 bp, Bos taurus
ccgacagatcacctggatcaacacagatgcaaaggaagacatttcagaaggctctgtggttcacatggatacctaagttccaaagatcctggggctttccyttttgttaatagcatttgctgattgtatttctaactccaaaagtaatatgatcaggggaaatttgaattacaccaaaaagtataaagaataaactaaaaa

SEQ ID NO: 39586 - DNA, 201 bp, Bos taurus
tgatgacagaaagaaacttctaaacgaaagccatcactcagtcacagtattttattctgcatcatttattaaatatttttatatatgcatttacaaacttkactcatttcagaactctgctttcaatacatttttaaactttttttggtagagtctctcgtaaaatgagatccatgtacaaaactaggcaacagatataaa

SEQ ID NO: 39587 - DNA, 201 bp, Bos taurus
actgaacatcaaataaacaacccaaccttatacctaaagcaacaagaaaaagaacagcaacaaaagaaacaagactgtatgatggaccgaattctcagcamagcaaagagaatttatcatctccaacgccatgaatcagtcttcagtcccttttcacccactccatctcagaggagggaaaaaataaacaaacaaacagca

SEQ ID NO: 39588 - DNA, 201 bp, Bos taurus
gcagtgaacaaagtgctggacgacccgctcgttgatctcgctgcacagttggaagttgttcatgaagatgtgctgcatcgtgacggcttccaggatctgaygcgagagcaagggcacagagacaggatcaaaggaagggcgaggcgagaaagagtctatcccaacacaggcaggggcattcagccccgcgagagcatcttt

SEQ ID NO: 39589 - DNA, 201 bp, Bos taurus
aacagcaagacatagacaattaccagttgccaacagtaccaattcagaaattcaaagtatctaaacacttataatgatcaaagctgccagtattatttcargccaagtttttcacttacacccccatccttcccactgtatccccatcacgcccacttcactttccggtccctccgtggtggatgcaggggatttggacag

SEQ ID NO: 39590 - DNA, 201 bp, Bos taurus
tgtgacaggtaagccataaaaccaattggtctcaatcaaaaattctatattttacatgacggattgcagcatttggcctcagttcttcacttatccctgarccatgccctctgccttgtaacctttcagtgcacatcttccatgggtggcctggcccctgggttgcctcttgactttggggtcagcccggagtgatgtgct

SEQ ID NO: 39591 - DNA, 201 bp, Bos taurus
ttggacttctggcctctagacctgtgagagacaaatatttgttgtcgtaagccactcatcttgtaataatgagttgttttcatgacaaaaaaaattaatgyatggcctgtgtcatttttaaactatagactggctcatactatatctttaaaaacttaaaatgctcactacctcatcttattattatggtcattggtcatt

SEQ ID NO: 39592 - DNA, 201 bp, Bos taurus
ccttatctggggccttttccagttggtaacagacaaggccatttatctcaaaatttgaagaatccttagcaagaaaataacatcgcaagatgagatcaccrgagaggcatggccaagagttcttcttctgccccttttcataatattccccactgtttatttactgattgaattgttgtggtgggagacacagtgtttgct

SEQ ID NO: 39593 - DNA, 201 bp, Bos taurus
actacagagatagaaagcaaacaccaagtaaagggctgatcatggtgtccttagcaaataaatgaatgaataaatagaaaaccacatgagagaagataatwgattttagtattgtttgtttgtgaaagaatgaatgtaataccttttggccaatcacacaggcaaattagaaaatttgataatcaagcattgcatttgttt

SEQ ID NO: 39594 - DNA, 201 bp, Bos taurus
ttacctggaaggagagagtttaatacaaagaattattagctagatacccaactgtcgtctctgtaagtaaatatcaggccaaaagaaaccactaaggtctyctggagtagcagctgcaggaaatagttacccggacccgcctccagggactggagggaagaagggaaatgtaaactcagaagcccagagaaggggcctgcg

SEQ ID NO: 39595 - DNA, 201 bp, Bos taurus
taagtaaaaacatctttgtcaaatatagtcatctcttatgggattctctgcaaactttttcatcttttttgaaattagaatgtctttgtgggccaagatcrgtttttaaatgtggttccttctaccctaagatcttgattctatgctgtttaagtgacttttgttttcttttcagagaaagtttcattgtgcaaatttgac

SEQ ID NO: 39596 - DNA, 201 bp, Bos taurus
ttgttacccgctgttgcagatacttccgagcttaaaattagaacacagactctgccaagttttctggggaaatatatgagtttaaaaaatagggtacaggrtaaaataacttgatgaggaagtctgaattaataagaaagttacaaatgcagaaacaaaaagaggagatggctgccctggctctaactgaaggcattctgc

SEQ ID NO: 39597 - DNA, 201 bp, Bos taurus
tgaggcctagagatgttcagcaatgtgcccaaggtcttacagccagtaagtgggggacacaggcagggtgggttcatagcctatattcttaactgagaccmgcttggccaccactgtggacaaacagctttcattttctggtctctgtttccatgaacacaaaacaaagggggttagagagcagaaagctcatggcccata

SEQ ID NO: 39598 - DNA, 201 bp, Bos taurus
tacttctgttctcaggaaagccattaagttacattaaacaacagaaaacaagaaaatgttgaattaaagttgtaataagtttcccaaattgtaatagtaayataatactgtaaccattttcaatgctgtagataaaggaacaaaccatagttccaaacacaagtatcaaatggattgtgctaaggatcctaactaacatca

SEQ ID NO: 39599 - DNA, 201 bp, Bos taurus
cttgatgacagctcttcgggggaaatataatattatttctttctttatactttacctttgcacatattgaatatgtacttctgaggtgacagaaaatatgytcagtgctactgatgatacaaagacaaaaagatgtggtccctatcattaaggttgctattattacagaaagacagtgaactggatagacactgcaggcaa

SEQ ID NO: 39600 - DNA, 201 bp, Bos taurus
agtgagaagtgggaagcataaagctagccacttgccatcttccctttctcatgatagactgatgtacatttttctccaaatgctatctggctaattaacayattcatgttctgcatgccctcctacctcaatttaggactggctttcatttcttcctgaatacatctagtctgatagtttctaggaacaagtcctggttct

SEQ ID NO: 39601 - DNA, 201 bp, Bos taurus
atattcatgcctattaaatatgattttcccaagtaacttctagatttcaattaggtttataaatatattttcatataatttttttgcctagtcaaatcatyctaatgattttgcatattaaccaaactacaactcacctttgttatagttttggctattttgcaatactaaccttcaagtcacacatacttatctatttct

SEQ ID NO: 39602 - DNA, 201 bp, Bos taurus
cagtaagtaaggatattttttaatattaggaagtgcttgcagggttaaacctcctacatagcattttacttagtatataagagctatgatacatagaaacracagaaaagaaaggaaactgttgggcaccccaatgcaatcttaatgtttccacttcagtaattttaatatgtgttattaatgatattatgctgtgacaaa

SEQ ID NO: 39603 - DNA, 201 bp, Bos taurus
tctaaagctcatttattctagcagcaatgtcccgaagagactgttgaacagtagttataaataagacccatcccctcccccagttaccttctaggcctcaygctctggctgcctgatgtctttctcataaattccctttgtgctaatgtaagccagaatctatggcctgcaggtcacatacactgtagtggttgcgataga

SEQ ID NO: 39604 - DNA, 201 bp, Bos taurus
agagggagagtttgaagatacatgaaaggagaacagaggaggaggaaatacctgtagttataaagcaatttccacacaaaggagttgtcagagggaaatgytgacgcatgtaaagactcgacctgcacacatatccactcttggaagcacactgaggaagtaagcgatagaaaatgagttaggccaagtgaaaagttcaat

SEQ ID NO: 39605 - DNA, 201 bp, Bos taurus
cttccttgtttgaagggaaagaacttcttgtgcaagaaatgtttagggggcaaatagtgaagtttcttcttaactcattaatttttgaccctagaagtaarcatattaagtggttaatagcttctccaacttgattgacaacaaagcttttatggaaatactattggatagtatgttagtgactttgtatgtaatgtggag

SEQ ID NO: 39606 - DNA, 201 bp, Bos taurus
gaacagcagaaagaataagcaaaatattaaacagagctagttctaaagaactacttcctagcctctctactaggaggtgaacagaagctttgcccatacarttatgagcaaaccctatttataccacgagttcttcctcaaagcatcctttttttttttttttcctgttgaaatcacaccaaataacttagttttccttga

SEQ ID NO: 39607 - DNA, 201 bp, Bos taurus
acaaaagtaatagatgccttaacttgttgccttctacttttacatcctttgctgtctacttttgagctattgtgaataaaacatcaggaacatagactatkatgtcacgtgaacgcgtaggagtcttttatctggaacacatgtcaaatgttttgttattctgaggaattagtctaaagactagtgttgaatgtttttcct

SEQ ID NO: 39608 - DNA, 201 bp, Bos taurus
ttatgtgaatatttgtaaaatcttctatgtaagctagcagtcgctttattaatgtgagagaaagtactttattattgatttccagtttatagagacctcarttttatggttaagttttttatctatatatttgtccgtttagtagaaaaatgacatacctattagccaaagctggtgtaatattgtgctgctcctaaaaaa

SEQ ID NO: 39609 - DNA, 201 bp, Bos taurus
ccactactaaaaatctatttttacattgtcgagaaacgtaaatcttgataggttatgcgacctacccaaggttccaaggctaaaaatggtaaagttaaatmttgaggctctatttctgatgtcaaaagtctgtattcttgacaaccaaggcttattacttccattcagtcattgttttgattaagttaggctagtttaatt

SEQ ID NO: 39610 - DNA, 201 bp, Bos taurus
tgtgcttaattaagaaaaactggactgtggggaaagttttcttttttcctgctttactaaactaaacttgtcaaattaaagaaaaacaagcaaaacagatkggtatagttcaaaactatatctaatctaataagatggtatttaagaaaatatatattaagtcttaggttttaaaactgatatacttattcagaataggaa

SEQ ID NO: 39611 - DNA, 201 bp, Bos taurus
gctgtacagcagattggcaaacattgcaaatcaactcttcttcagtttaaaaactgtgaagatctatggaattatcttttttaaaatggtgttgacttttrtaaatcatagcaccttatatctgtacatggctggcattatgcagtatatgccctatgcatcataggcattacacacaatacctttccattatttttcatt

SEQ ID NO: 39612 - DNA, 201 bp, Bos taurus
tcttatatatttaaagataaacatatataattaaaccttgcctgtgtgtgtgcatgcttagtggcttcagtagtgtccacactttgtgaacccttggactrtagcccattagactcctctgtccatggaatccttcaggtaagaatactgaagggggttgctatgccagcctccagggcatcatcctgatctaggaatcaa

SEQ ID NO: 39613 - DNA, 201 bp, Bos taurus
ttaacaagttttagggattaggaattgagtttgattctaaaatttaggagcacggatgtcagctttgaatattttccaaacatcccatgaccatagatttrtagaatggaagtgctattcctcatgcactattccccactgtcagtcagtcccagtcatgcttgtctttaagaaaaaaagcatcccagtcatttagaactc

SEQ ID NO: 39614 - DNA, 201 bp, Bos taurus
accaggagtgtggggttgggggtgagggaagatcaccagcattccttcccctcatgcagctgctcataagaaaggcatctctataaaagaggctcttaatktgatgtctaggcatctctagatggggtccgtggatgcccttcaaaggatctgaaaatcaacggaactgctagtaaaactttctatgtctgatttcgtaga

SEQ ID NO: 39615 - DNA, 201 bp, Bos taurus
gatgaaggatgcatgactggacccatagaaatgtacaagattttttttcaagtgtgctatctccctgtgggtggttttgaaggggccagaaataacagccrtcttccccacgagtttgaaaaacaccataaactaagacccagcactcagcagagggtagccgtgacacccctcttaatccttatgaggctgctattgcag

SEQ ID NO: 39616 - DNA, 201 bp, Bos taurus
gaatctgcctgcaatgcaggagacctgggtttgatccctgggttgggaagatcccctggagaagggaaaagctactcactccagtattatggcctggagarttagatggactgtatagtaaaagaggtctgaaagagtcagacacaactgagcgactttcatttcacttcacaactgatataatccccagtgcccagaatg

SEQ ID NO: 39617 - DNA, 201 bp, Bos taurus
agtttactctcttggggatccaacttctgttgggtccatgacgcagcatttctctttctcaggctttatctgctcatggtttatgaatgtaaatatgactyattaaaatcctggtttgagatcatacagaaacaggtcatttctggcccctgaataatcttctctattttaaaattagcttctgtatgaaaaagttatctc

SEQ ID NO: 39618 - DNA, 201 bp, Bos taurus
gtatcaaacctacgtcccctataccggcaggccaatatttagccactggaccaccaggaaagtcctaaaatagtctttttttaaataacttagtcttttayttgctggccttaggccctaagacttccagaagggatgaagggaggggcggcgagccatcctgcctcccagatgctgcatgccccatcttgcttcctgcag

SEQ ID NO: 39619 - DNA, 201 bp, Bos taurus
tgttattttcagttactaagtttggggtaatttgggtagcagtggaaagttagtgtatttacattctgatattacactatgaaaatgatatttattggctktgagtactttcctatcaggtatcatagctatgcagatgtttcacaatataatttatcattttccacttaagccactgaagcactcattcactatctcagt

SEQ ID NO: 39620 - DNA, 201 bp, Bos taurus
taaagtatgaagagttgctgtccctcgtgtgcttgttcattccaccgctacttatggagtgcttgcccacagcatgcacaggcctggaggccagggcacckcagtaagcgacgcagagccttatgcaatggacattctaatgagacagacagcaagcatgggagcacgtagatggtaaggccgttccgaactatgataggg

SEQ ID NO: 39621 - DNA, 201 bp, Bos taurus
agctgggcgctgggggagcgtgtgcaggggccacctggccctccagcccatcaggtccctgcttgggagccctgggggcagccgtgacaagaagcaaaagrcaaaagggatcctggattgtggcctggaaacggagctttttacagaggcttaggcattgatgttttaacattcaggagaattaaatgctttcgtgatgac

SEQ ID NO: 39622 - DNA, 201 bp, Bos taurus
aggtactgttgcagtgaaacattttctcatggccccaagagattaccattcagagacaggaggggagctgcctgagttccctaccctgggctcttttttarattaaaaacaagagttggccctctttctgtccatctgcccgccagctggacagcactttgcttgccctgctgctctcacacacagcttcccaaaagctct

SEQ ID NO: 39623 - DNA, 201 bp, Bos taurus
cccggcctggactgccttggattgtgcaaacctgggagccatgaattctcttgtctcttccagctcacaattcagcagctgaaacctcaggtttgtcttgyagggccagaagttttgtctccctgcctcagggggttaagtgactgcttttgaaaggacaaagcaagagatgccacgataagataaggagctctgttttca

SEQ ID NO: 39624 - DNA, 201 bp, Bos taurus
gcattaaggagctcgaaaaccatttgaaagaatgtttatcaagcccctactctatagccaagacgctgtcctagtgaatttaccctcaggttcgttgaatycccacagcccccaattcaaaaccgtgtttctttcaccccaagggtcatgttttaaagggagactctagtcagtatgtgtctcacacttaatgagcatgtt

SEQ ID NO: 39625 - DNA, 201 bp, Bos taurus
atagattaactattgttagtggtacaacttcagaaggtcctttccttgtcaggtatctgtctccccaccattaaaagaagatggccaacaaaatccgtgaktctcaaagaacaggcttgcaaaacactggtattaaaatcgagacaatgtaacttggtgacaggccacaatgctggatataaatttgaatctcaatctgaa

SEQ ID NO: 39626 - DNA, 201 bp, Bos taurus
attaaatgcctatgtgactaactagatacagagcacagcattagaggaaagggaggagcttacagtctaacacaattggcaagaatatgcataggcagccrtggcccatggctggttgactctctcaatatggctgcaaactcattaaacacactaggagggatttggtttatactaaacaaagtgaacacatttccactg

SEQ ID NO: 39627 - DNA, 201 bp, Bos taurus
gtcagcagaacactgcatttagcttggtagaaaacaggctgaacggaagattacaagcagaatctagggaggaggtcaaatatggaggccaacagcatgaygcagacgcagaggtaaaaggacatgggaaaatcccatgaaaaacggttcagggagaaaagatttttaagttcaaaagtctgagtcctgagtactaaaggc

SEQ ID NO: 39628 - DNA, 201 bp, Bos taurus
ggccacatggctaagaaatggtgcggccaggaggcaagtatacacagtctagctcaagagttattaaccatcgtgttttattctcccctaaaagggacacrggcctaagaaagagctgtttaagctcatgtgatgtcttttgtgatgcctggagcatacataaagaatgtatgaatggatcaattaatgaaggtatacata

SEQ ID NO: 39629 - DNA, 201 bp, Bos taurus
ttttgttttgctttccaccatcagttttaagaaaaggagatgcttgattcctccaccagtctgggctgtggctggatcttattcatttcaataccatcctytctgggccagcgttgattggaatgatggtggaataaatgatgagtgactccgtctgccccaaatgtgatttcccttagcaccactctctggaatagggga

SEQ ID NO: 39630 - DNA, 201 bp, Bos taurus
ctaaccctttcccctcccatccctcaaatccaggatccctcttgccatagagcccttgttcttaacagctcattccaccttggccggatatttgtgtcccytccctcgtcaccaagctctcccctcctcagcctccagttctcagctgcagcaacatgtcctcagggaggcattccctggccctccctctgtccccgacat

SEQ ID NO: 39631 - DNA, 201 bp, Bos taurus
atattttctaaacatatatgactcacatactacagtaatgtaaaattttacagaggtgagatcattctatacatcttagtttgaaatgtatttacttacayattttagatactgatctatctcattatttttttataaccattgtgtattcaatggtatgaatgtacctcaattaatttcaccaatcccctattaataaac

SEQ ID NO: 39632 - DNA, 201 bp, Bos taurus
cggcagacttcgccccatactgggagatgcgccaccaggctacacccacccttttgctcccaagctcagctttctcgtacaatgtggcaggcgctaggccragaaacccataaagagcatcgcttctctgatgtcctttttacactaacaccccagaaggcaagttcggatccacaccccggggccccaaaccttccagga

SEQ ID NO: 39633 - DNA, 201 bp, Bos taurus
cttggctgcgattatgtgggccctctttttggacggtaatgcacattttaaccatgaggtggcagtcaagcccttccaaatggcctctctgcactctgaamccctgggtataataatctcattgtagattccagacacctgagtgccaggagtaaggccatgcttctgtgtgtgatgtattttttccatccctgatttgag

SEQ ID NO: 39634 - DNA, 201 bp, Bos taurus
ttgtgtaaggccttaaatctactgtacttttgaaatagtaatgagcataaatggtatttcagcatatctgcaaaaactgaaatgtgagatgaaaatattcrtgatttcttttggtgataaaacctcaggtacctctgatactattacatttcattgccttatcattgggggaactgctagattgcagttcaagattagtgg

SEQ ID NO: 39635 - DNA, 201 bp, Bos taurus
agtgcacgaaaacagggtgctaaatagactgtataaaaggcgcttatttatagtatgagagctgaagcaagaaggcagcgtgtctccacgctcagcctcckctgtgaacatttacattgagcaactaaaatttttcatcgctctgtgcagacacgtgtccaaatgactgtggaaggactgaggttgttgattttggtttta

SEQ ID NO: 39636 - DNA, 201 bp, Bos taurus
tgggaactgggtctcaaagatcctgtaaaaactgcaaattcaatgactctgcacatgattactaagttatggtctctggaggtgggccctgagaatctggytggttcttacacacaattattccttctaagtgatgcttccaagaaggctaaggagccagagttagttccaggattccgaatggctattttgtagcaaacc

SEQ ID NO: 39637 - DNA, 201 bp, Bos taurus
ttgttctcctgggtcactctgcaggaagccagccactacggtgtgaagacacctagcttcctttggaagggtgcatgtggaagggaacagagaccacctgycaacagctctgtgaagggccgtcttaaaaccagcctccagcatcagtcgagtcctcagatcttggctgcaacagaagggaccccaagccagaaccaccca

SEQ ID NO: 39638 - DNA, 201 bp, Bos taurus
ttaaaaagtatgaaaatattgaccagaaaaaaattttcacatacttttaaaacaggatattgttaacttggtaaatatttgtcactgttcaataatatgawtcctcaaagcgaacactacttatagtctccactatcactagaaagatggtgaagtctatgatttgttggtacagatagcctttgaaacaactctattttg

SEQ ID NO: 39639 - DNA, 201 bp, Bos taurus
aaaacaggtcagatgctctggctgttactattggcatgttgttgctgttcggttgttaggtcgtgtctgactctttgtgaccccatggtctacagcatgcmtctgtccttcaccatctcccagtgagcataacaaagagtattgttaaaaactgatactagatgaagggacaatttcgttttctaaaatggttatatttaa

SEQ ID NO: 39640 - DNA, 201 bp, Bos taurus
tgccagaagtgaccaggttacatcatcaatcttatttatcatttagaagatatttactgcaattctactctgcatagggcttcatggcagatgtacttccyttggcctttatacaaccctgtaagagcatttcaggactcacaaatgggcaattaaacctacagcctcttcctgagagttctgccctctatttgatatgca

SEQ ID NO: 39641 - DNA, 201 bp, Bos taurus
cagtgtccaagagttcgagggtccatagggatcttgggaggtcacttagtccattcctctgtctctaggaaggactcacctttccccattaaattggaccrccataggacaaattcattctcttttagaaaatactgggaagcagatttttctgtggatcaacacatgaaaacttctccactcttatgcatttacctttgg

SEQ ID NO: 39642 - DNA, 201 bp, Bos taurus
tggcatgctgcattccatggggttgcaaagagtcagatgcaactgagtgactgaacaacaaccaaagtgcacccttttgagatgctccacaggatataatyggccacatgacatagtcaaaaggtaactccttcaggctgatccaccttcccagaacccagcatggtatataatggattgtctatgatatgggaaagattt

SEQ ID NO: 39643 - DNA, 201 bp, Bos taurus
acatccagaagatggctgaacctgcaggaataccagagtaagaaattaatgtctgacaacggagtgaaagttcaaagattctttgttgccgacactgccartgaagctctggaggctgctaagagactaagtaagctaactcataatgggtggaatatgcttgccaaattagtgaattcacaggtagtggtttcccactag

SEQ ID NO: 39644 - DNA, 201 bp, Bos taurus
tgaggccatgaagtatattagctacagactatattaactgatcatttgacatttattaagtaacttcttatgtattggtggtggtcacagagagctatagytgctgtgttctaaccataccatcctacactcagctccagaatatgccctgtaactttgtttatatcctctgtcccttgcacatctgtgtttctcttgggc

SEQ ID NO: 39645 - DNA, 201 bp, Bos taurus
gacagcagaaaatcactaactggtctgggaattaagttaggactccatagttcttgccacatacatctcagtctgggcatctgatggagattttaaatatmtaagtatttaaaactagtctacttctgaaatgtgtgattaagtgcttgatttgtattcacttaatacttttgagtgtgctgcatgtcaaggactcttcta

SEQ ID NO: 39646 - DNA, 201 bp, Bos taurus
gtaggatcacagctactgtgcttatacttgtcaggcctagaattccctaaaaggcaaaaagagaccgtggatttgcacaagggtctttgaggtagggccaygggatgtgatcatggtagttgttagcctatgggttaaagattcattcccagatcgggctgacacttgcccccgagcccttccatgtgacagtgcgttctc

SEQ ID NO: 39647 - DNA, 201 bp, Bos taurus
acccggctgagaagcctcctcccgcccccctttcgatttcccgcttttctcctgcgaacgcgctataggggcgatgttgaggccgtgtgcccagtgatggygaaatacaccaagttgttgagaggctgtggattgtttgcccacctgcgttgggaagaggggcttgggttagctcggggaagcgcagagatttttccctgg

SEQ ID NO: 39648 - DNA, 201 bp, Bos taurus
caactcagctgcatgagggccagtgactttctgtttatttgtttattgcctgctctgcatcttcattgctgcgaggggactttctctagttgtgacaactkggggccactctccagttgcattatggtggcttcttttgttgtggagcactgactctagggcacaggcttcagtatttgcagaacatgggctttgttgccc

SEQ ID NO: 39649 - DNA, 201 bp, Bos taurus
cctggagtatcccatggacaaaggaacctggtgggctacagtccatagggttgcaaagagttgggcatgatgtaatcctagtaggcctcttggaggaagtratgtttgagttgcaatattgagccaagctaggcacatggatattggggaaagagagttccctgcagagagaatggcaagtgtcaagggcctcaggcagga

SEQ ID NO: 39650 - DNA, 201 bp, Bos taurus
aagtggaatctgatggcctcaatttttgaagcctttcattgattctaatttgacaggacttacttggcttttggtgacctggccctggccacctgctcatygaaagtctttatttcctgcttgcagcagagttggaggggctgatagtaggtggtggcggttggtcgtcagtgagaagtggctgaagcccttagaccaagc

SEQ ID NO: 39651 - DNA, 201 bp, Bos taurus
agtagaaaacctttgttttttgtctgacaatagatgagaaagaagtgcacacctctgtctcctggaacacagatacacatgcgagcacacacacacagacrcacacaacactccctttccacacaacaacgaataaggcatggtttgtagagtcttcccacagttggcatggttgtaaatatactacatgttgaagggtta

SEQ ID NO: 39652 - DNA, 201 bp, Bos taurus
acagtggttcagtgtttgagattcttttttcctatcacaaacagtgttaaggttaatacctctgtaaccaaacctttgaacacgtgcctccctggttttgyacagttttggtgtcatttcttgtgagagataatcaacatacagaaaagcacagaaaacatttttacagttagttgagtccacgcaaaaaggaacagcagt

SEQ ID NO: 39653 - DNA, 201 bp, Bos taurus
aataagccaaaatattttttcataacctaagattgggcagtatatcctcaagtttccaaaatcagctgaactctatgcagctaatttgcctttacattttytttgaagcttatgtcaattatagcttatgtggtatggatggcaccagccatgtaatttgtgaagcttgccgcaaaataaaaatgtaggcctccttattca

SEQ ID NO: 39654 - DNA, 201 bp, Bos taurus
cttggaaaggaaggagcagataggggaataaatagttataataagaattattaaatacttgctgtatatctaccactatactgaggcctttatctagatcygtggttctcacagaagcaattttgcctcccatgggacctttgacaacagagacatttctgattgtcaggtctgggggtatggggtattgcactagcgtct

SEQ ID NO: 39655 - DNA, 201 bp, Bos taurus
aaagttctttgaagaccttctttgtagcaggcttccacataagctcacagggaattcaaatcctgaaccactttataactagaaggcaggccttctggccrtatgctattttaatagcaaggaccatagtacagcctgaataacataaaggtactgagctgaactgagggccgtgagagtttataaggatgattgttgcta

SEQ ID NO: 39656 - DNA, 201 bp, Bos taurus
tttcagagcctggtttgccttatctgatggtggtactggcctccctcttacagtttctcttctgttttcttcactccttcccgtcaacacagtgaggatcrtgatggactggacactgaattagggcctgggaatgctgaaaggaagtagatggtatatagatgctgccttggaagaaactcaggcatgcgggggagggga

SEQ ID NO: 39657 - DNA, 201 bp, Bos taurus
agttggggagaagatagagatactaagagccttgcttttgtttgactgtctcttgacagttcccgatatagtgttacgttttatcctcatggcaacccgakggttgatagggccgcaaggatcgtcatcacctccattccacaggctaggaaattgagactctgcaggcttttgacttgattgttgtaactagtattcaga

SEQ ID NO: 39658 - DNA, 201 bp, Bos taurus
tctccgatgctttcacagctgtgtgctcctttgtcttggaggacaaagagcagatatgtttacccccatgtttcagatgaaaaaaatgaggccttggtgaytaagcatgttgcctaatgtcatacaaaggtgcaattagcacagagtgatgactgcctggcttccagcccagtttgtactgttctcaaaagatttatatgc

SEQ ID NO: 39659 - DNA, 201 bp, Bos taurus
tttaaaaactagggttaaatgctaaaatgagattccaaagccacgaagagtcttgtgatttatcagtttacaagatccggccaaacaaaaaccaccatatygccattatgatcatgttaatggttcagatgacaatgaaactttaatgctgaggggaaagggcctaacatacagccggactgttaacagaacacagtctgg

SEQ ID NO: 39660 - DNA, 201 bp, Bos taurus
tcgagctgtttaaccaccaggtccctgctggccgtcggtggagggctgcttccaggagcatgaactctctggccctctgtgtcaccctgaatttgggccaygctgacaacctggcagaactagaaatgctctcagtaagtagccctgtgcatggagaagtgggtatggaccgaacggaggcagggcccttagcatctgtga

SEQ ID NO: 39661 - DNA, 201 bp, Bos taurus
tgcaaatcaaaatcatgtaaccaaacactaacatgctgcaaggatacattcttgcttaaggacatgtatccattatagggcagaaggaagaaaatagaggrttcaaagaaagcctttctttcatgactttcttctattaaaatagttccatcaactattcactatctcctttttttttagaagtcaattaaataaatcaag

SEQ ID NO: 39662 - DNA, 201 bp, Bos taurus
agccaaacaaggtaattaattaatcacacaggatgtcctgctcctaggcagccgtatttctatcttccttgtgccaatggcctccaaccaggcaggcctasagtgttccttttttcagctacaaagttttcattccttttgcctgcctttcagtttctaccacatgcaaatgatggtggccaactcctttgcagagcaagc

SEQ ID NO: 39663 - DNA, 201 bp, Bos taurus
tgtaaagataatgagaataatgttaaggccaatggtgctaaaaaaaagaaaaagagaaaagaaatcacaaacgcttgaattcatttatatgataaattctyctcttttccaggccacatcccacctgggagaacactggctcatgtttggcttgctaagtggtagccatgtttccctttcatgttgataatgaaaatagaa

SEQ ID NO: 39664 - DNA, 201 bp, Bos taurus
tttcactttagcatgaaaggatggcttcagggatctcatgatatcatgaactgtgggccacctcaagaagggctttaagtatcataaagggataaaatttkggaggtttagaagtatgatctgggttcagcccactgccttttccctcagcatgcctccccagtcccctgctgtggcagacagcagatggctttattgaac

SEQ ID NO: 39665 - DNA, 201 bp, Bos taurus
caggaattatttttaattcagccctatagctgccaaaagactcttgcattgatggcatttactggatagatcatctgttagtgttttataggcccatactsaagtagtactcatgaagcagtcaggtcagttcagtcgctcagtcatgtctgactctttgtgatccctgaattgcagcatgccaggcctccctgtccatcg

SEQ ID NO: 39666 - DNA, 201 bp, Bos taurus
ttccaaatcgacttcattccgtgttgccaaaaatagctcactcttgtaacttcagattattttcttattgcctttgaattcatcagttaataatgcagccragcaatacgtactttttaattcctctacatatgccaacatggtgtgtctttttcaatatgatacccccctccccaaataatgttctctggaaaggaaaaa

SEQ ID NO: 39667 - DNA, 201 bp, Bos taurus
gctggggagaggatatgactaatagtcatttgatgagtttatttattggggtcttcagccatcaggatgccgtctttgtctctggggcctcagagaattcmtggcagtttttaaacttgaaagtgaaagttgctcagtcttgtctgactctttgcgaccccatggactatataatccatgggattcttcaggccagagtac

SEQ ID NO: 39668 - DNA, 201 bp, Bos taurus
aatgctaatgaagctatgtctatacagtatgtactgaacccacaagaagagaatgattgttacaagcagtgcgactggaacacaggcgttttagggcattygcaccaagccttctaccagaagaagttaagaatcacccagtagctacaaagcaggctctgagctcacttctgaaaatcatgaaaggacattggaggcccg

SEQ ID NO: 39669 - DNA, 201 bp, Bos taurus
ttaaatcagtgcggtgtcttgttttataagacccagatcaacacactgccagaccatttgttaagccacccctgcatcctatttgtaaatgtgtgtggctrcacatatcaaagccagcaaaagctttgggtaaggaacaacgcgtctggtcattttttttttttaagagcttctgatctttcttcatcaaagacatggagt

SEQ ID NO: 39670 - DNA, 201 bp, Bos taurus
cttgaaggggttgcccagggaggtggggggaagagagggaggaagagaaagcagagtgtcagtcactgggattgggaaccaggccctggatgcgacccccyaaaggcttccactcatcttcacctttattctcagagtctcccaaaggctggtgccaaagctgacaacaggccatctgtggctgaccatcaccgctcttca

SEQ ID NO: 39671 - DNA, 201 bp, Bos taurus
aactaaagagttcacactaagactagtgcagccaaataaatagatacgtttttttttctttttaagcgagagaaaaaaatgattccagaggcctcatcgtrggctcccgccctgtgcctttacatacagtctcaggcgctggggcgtgacagcactgcttaagccctgaaaaagccaagggttcgggccacgttccttgta

SEQ ID NO: 39672 - DNA, 201 bp, Bos taurus
gacattaactgtggtaacaagctattagatcatcaactctgtgcttcttccagggcgggcaaagtatctaaaataacacagttatcatgactgcctcctcraaggtaaatacattaactctcactcccaattaacaaaggggctctttacacacttaagctaaatccctctgtgctgtataaaatacttgaggtatccaat

SEQ ID NO: 39673 - DNA, 201 bp, Bos taurus
cagggcggggctggttgcgctactggcctctggggagtggcagccacggatgagctgcacactctgcagggtaagagcagcccccacaaaccaagaataaygggggccaaatgttattggtgctgaggttaaactccttgacatagagggatacttgaactgggtctaaccagaggaatactcacatacaatgtaaaatat

SEQ ID NO: 39674 - DNA, 201 bp, Bos taurus
tttcatggaaaaaagagttaaagagaatgtttcaaacacatctgagatctgaatgcaaattcctgaattcattggtggcaagggccaagatttgagagaarcatggcatgtgcccaaaggaggtcagtaaggggaggctcaaggctgagcgaagccacaaagtctcaagagctgaggacggggttagggctcagcacccct

SEQ ID NO: 39675 - DNA, 201 bp, Bos taurus
actaatggcaccctgctcaaaggaagagtgctgtcctaacacatggaactagggggaagggggggacagagacactggttccaggagggaaagaggccaayaataatggggacagagcaactaaatgataccttgggagcagcagattttcatgcagtttcaagaagcagctcgttttcctcccagggaatggccatcaga

SEQ ID NO: 39676 - DNA, 201 bp, Bos taurus
acagagctggggttcggcacgtgccccatccaagagaacacggagtggcactggggagaaaattccaactgcaaagccaggcacacggagacttgaagatyggccctgacaacaactaacacaccctgtatctgcaaaatgaggatcagagcactattcatttaattcttatatgacttccaggggataatgtttatgaag

SEQ ID NO: 39677 - DNA, 201 bp, Bos taurus
tctaacagacacatcaatggcattacaaaggcagaagacatctgatactccagtttctctatttcagggtacagatgctcatatttaagggaaaaaatttkggccataccctgtggcatgggagattttagttttccaaggatccaacccatattccctgcaatggaagtgcaggataaccactgggctgccagggagtcc

SEQ ID NO: 39678 - DNA, 201 bp, Bos taurus
aaccaactgttctcattggttgagggttccctttggaggcattaaatttctggcatctctgaatgtctcactcagggctacgtaagcacccctgttgtggkagagaagcctcagatagagaaggagagaggccgggcacctgaggtggggagttgtcagcacgtctgaaccctgtgcactgtagttggggtggaccaagag

SEQ ID NO: 39679 - DNA, 201 bp, Bos taurus
tccggcggcccagtggggcggagtctaactgggtcctcgcagctagttgggacgtggtgggggtctgtccagaggaccttcccacgtcaccgagcctttayatggcttgttcctgagcattggccctaatcctaacctgctcctcttctgctgtattttataaatgggtaaactgaggcatggggtcacgccagcggttcc

SEQ ID NO: 39680 - DNA, 201 bp, Bos taurus
tgaaatttaagatttactctcttaattttcctgtgttttgtacagcagtgttatctgtgttcctcatgttgtacgttgtatctctagtactaacttataaytggaagtttgtacctttgaccatcatcctccaattcctcctctcccctaatccgtcacccctaatagtcacaagtccggtccctatttctatgagtttta

SEQ ID NO: 39681 - DNA, 201 bp, Bos taurus
caggatccttgcggttttcactttttatccaaagcctcctgctaagggcacaaaagcctcagtttagaatatatacttcctagcttcggaggtcaggggcrgcggccgggaggagataccccacgccccaagccagaggccaggggaggcaggccggaggagataccccacgcctctaagcccgaggccaggagcgacggg

SEQ ID NO: 39682 - DNA, 201 bp, Bos taurus
ataaattattaaaccactctgtgcctcattttcctcatctgtaaaaatgaggattatgacagtattcatgttcaccttgcagaactgttgtgaagatgaayagattccatgtaatacccttggcaacatacgggtggtgctcctttgtcctattcttggaaacttgcacaccaagctaaagtcatttttattatttgtttt

SEQ ID NO: 39683 - DNA, 201 bp, Bos taurus
aatctacaactatagcaactgagagctagctaaagttctgaatatccagagtcagattattttaaaattcttgactaggagttgactttctgagcaatgayatcatagtagatcttaagaactaagaaagacgctaaatctttgcagatcttcatgtaagtgtcagacattttcctctataagagaagaccttctaagttc

SEQ ID NO: 39684 - DNA, 201 bp, Bos taurus
tgatgctctctgtctagacttcttgatggtgtatgtatgatgttccttagaatatgacccccaactttcacatccttgagcctggcatggcctgctcatgyaactcattttaagagacggattgttggttaatcaccttcatgaattaagccaatgtgggcagtaaccagggccagacagtgtcctaaaccaatgcaaaga

SEQ ID NO: 39685 - DNA, 201 bp, Bos taurus
agtctggaaagttgatgtcctcctcctcctcttggcctctcctcagttctcccagttactttcagtggcagcaccctgttccttaccaggatctcctgctrttagacacctcaggcaagtgggcctggccaaggtgggtggtttctatcaatagttccctaacacagccgccctccacctcccatggttcaggcagtaatg

SEQ ID NO: 39686 - DNA, 201 bp, Bos taurus
tgactctatcgtgttctgtttaactccctcatcccctaggattgtaggggataatggtggctttttaaaacatattttgcacaagtattttgcttacagtyctgattgatgatgaatatttgcttggtgatgtctgcagaacctttggttagagtctgtatatagagttaagtgattagggtcagacagttattgggacta

SEQ ID NO: 39687 - DNA, 201 bp, Bos taurus
aagttatctgtttaaggcctttcaggccccaaatccaggattgaaacccaaatctgggcgaagctttgctatagtgtagatttttggatcacggtgaaggratacctagcaccctcaccttccaaacaggttggaaagtcatgttttcttgacttcttttgccagatatggccaggctttagatttaaaaacaagaatcaa

SEQ ID NO: 39688 - DNA, 201 bp, Bos taurus
aagctccaggagatagtgatggacagggaggcctggcgtgctgcagtccacggggttgcaaagagtcagacataactgagtgaacagcaacacagattttsccaagggcatcacctcctatagtaagagagagagacccggtgtcgttctctttagagacaaaggggaaaggaaacgttcctttcaggaaacctgatcatg

SEQ ID NO: 39689 - DNA, 201 bp, Bos taurus
atctatatagaatacagatgcaaatttaggctcagaggggttagagaacttgctcaaggtcacaaagttaatagtaggtggatttgggatccactcaggcytgattcccaaaacctatgtatgctctgtggagaaaaactgaaaaccaaggacttgcagcaaatgtaataaataccacttccaatttctttcctgtattgg

SEQ ID NO: 39690 - DNA, 201 bp, Bos taurus
agggtagtcacatatctatgtatttatatccacctctatcactatttatagtaagagtgagtcctgtttttgttaattggaatggcatcacactgaatacrctgtttgatcatctgtttctgtcatctaacagtagaacacggacttttttcaatgtcattaaatataagccaacattttcttttatgatataccataatt

SEQ ID NO: 39691 - DNA, 201 bp, Bos taurus
cgttgggctctgacctaactagacttgttgatcccgatacagggatggggacctggcaggagccagtttagtgtgaaattagactgaatccaggaccaagmggcccttcctccctgggcatttcacaatttcttggccgtccttgcaggcgcctgatgcatttaactggatgtttacatagcagagtttactcttgcagag

SEQ ID NO: 39692 - DNA, 201 bp, Bos taurus
caagaccctgagtctcagggagccaacagtgggtaagaccaagaaccaacaaagcttctatagagagccggagagtaaatatctgaggttgtacaggccaygtgaagactcgataacatatttccctttgccaaatttttgtccggtctttaaaactgtacaaatcattcttatctcaaggaactttcaaatttggccatg

SEQ ID NO: 39693 - DNA, 201 bp, Bos taurus
aagatgtcaaattcctgattaggagaactttttgttaaaatattacatatatatgcatgtatagtttatatactatttcttaaaacatgccttctctatartagtttttcaatctaccaaatacatttggaagatattcagatggcttgtggttcgaaccacaccaatggtttgcagttccatataattagtagataatta

SEQ ID NO: 39694 - DNA, 201 bp, Bos taurus
tggacagctttggaatacactcagggtcctccctagggggggcacgccttttctcccctgtgtcctcactccaggcccagtgagattgtgtgaagaagccygggcttgtggacaggggagggcagagtccgcggaggacactcccgcggctggccggctgctcaggggaaaggttcagacgctttttgaccgggcactgtt

SEQ ID NO: 39695 - DNA, 201 bp, Bos taurus
gaaatccagcactccggccgaggcatctcggcagcactgcatggttcttaattgtactttcttttcacaatgtgtaaagatgtttgttttcagatcctcamctctcaaggcaaaacagaacttcaaagatttcaaacttcaaagaacacaagaaaattaacgtgatatttgggagctgtaacctgtgtttcctcttgccaa

SEQ ID NO: 39696 - DNA, 201 bp, Bos taurus
cagccttacagctagaaccgaggccctgggcacatgaccccagctgagtattccagatgagacttcaattatcaagatgcagagataagcctttctcactrtacccaggccaaatttctgacccacaaaatcatgagcataataaaatggttgttgtcttctgccactaagttttggggtggtttcttagacaaaagtgaa

SEQ ID NO: 39697 - DNA, 201 bp, Bos taurus
cctccaaaaatttttcatccacgcctatagtctctctgcactctctgtccttgtgaaagaaaaacttaattttattctttttttgccattttctaagaagygttgaagagagagagcatttttactcttcaagtggtggcacgcgccactgaggcctcccccactgctctggtccattgtccctttctttctcaggtccca

SEQ ID NO: 39698 - DNA, 201 bp, Bos taurus
gaatgacaacacaggctagaaaacacgtccacgtttcaagtgagccgattgtgaaactaggagaatgcctctgttatctgtaaacacccacactggccttyggtatctacatatgctctttattttcacactcatacactgactccctgagacgagatctacccagcacagaccccgccaggcacagcactgcatgccagg

SEQ ID NO: 39699 - DNA, 201 bp, Bos taurus
cctgaggaaagcatttgcctgatcagtatctatcattttggagctcctgagaggtgctggcaaagccaggccactcagttgggccttgtctgcgtgctcayctctgtgacccaggacttattagcacagtgccaagcatacttcaggctctggataaatgcatcgaaagtaactgaatgaataaactccctgtgggtggct

SEQ ID NO: 39700 - DNA, 201 bp, Bos taurus
gaactgtaaaatgaacttaccagtaatagattcttatcagggctgaaggccacaggagaaaagaggctacgaatgccaggatcggaagggccagtgttccrcccgcaatcacaaacatgttaaccacgtcaagatccatcctgctctttaggtctggcttatacctagaggggctgaaaagacagacagcactgaaactct

SEQ ID NO: 39701 - DNA, 201 bp, Bos taurus
gttgtcatgtccattttatagaggaggaaactcaggcccagacaagttaaacaacttgcccattgtcgcacagctggtgagtaatggaggtagtgcctctygcatgagacagtaggctcagggcccagggccacaatacctttagaagccacaggaatgttgtaatttgtttcagaataaggaggaaaagaaattcaaaat

SEQ ID NO: 39702 - DNA, 201 bp, Bos taurus
agtatttgcaaagcagggccacagaacacccatgtgttccatttgacaataacaaggaagggactttgcatcaaaacaaaagcactgggagcccagggccyctagcacaacccatggaagtcctgactggggcaatacagggcacgccaagatgaatggtgtcaagccacaaacaaagaggcctcagagatccacatccca

SEQ ID NO: 39703 - DNA, 201 bp, Bos taurus
aaaattttatggggcattcattctctgtataatatagtttctttatcatttatttaaagttgatttttcatattctacctttccagtcaggaggataatayatgtaattctgtatatcccattatctgatgatgtatgtcacttggtctccttcaatttacacttttacaatatttgaaataatttctctattcttctccc

SEQ ID NO: 39704 - DNA, 201 bp, Bos taurus
ttgctgattcttatctacttactgttatatatttttaaatgcctattatgaactactcattatttactttcatccaaaggaaatatgtcagcttttacaawcttttaattatcactggtaatgggatgtgggttaaatggcaactgatttatactataaattaaaaccattaccaaattttccatcaacaactattcagca

SEQ ID NO: 39705 - DNA, 201 bp, Bos taurus
gtgccaaaagaaataacattttaaatgatgaagaaatttgtcttaatttccttaaagttggaataaaagatatgtaaattttcaaagaagcctgtaagaaytgatgttgctgaaataatactgtactaacacttagtctcagttttcctcttagctttctacagtattttctaaagtgtcctacacagcaagatggggaag

SEQ ID NO: 39706 - DNA, 201 bp, Bos taurus
tagtcagaaatggtttgtttgctaatgaattataaactaccagtttgtatgtctgagtggcaactgtttaagaatccatttaacaggaataatgtattctrtagtgttcttaagtattatagtttgtaatccataatataaaatttcaaaacattaattcctatagcaaaacaagttcttgctagtacattgtactttgct

SEQ ID NO: 39707 - DNA, 201 bp, Bos taurus
attatagaagagatgctgaaaatgagaatgaatatgattaagccaaggaatagaagtttcatattctgagtgtcttttccagttcttattctcacacaatragctaagccatatgggtaaacttaacatatttttggacttaacatagtatatattattgctgcattttacatatttataattaatgcttttttttttgct

SEQ ID NO: 39708 - DNA, 201 bp, Bos taurus
acttcagggcagtgtggtaagtgttctaccacatgcctttattcatttctttattcactcaacaaacctggccttggggccttgctaaagattttggctgyaattctccaggaagtggaggttttggaaaagggatgtgacctgattggaatggtcttttcagaaggtcaagaactgagagagcaggttagcgaagtcagg

SEQ ID NO: 39709 - DNA, 201 bp, Bos taurus
gactaacactttcacttttccctattgactaaaactccaagacaagaatagcaggtctattaagggagaagattgggccctgcccagaccacatatttcaygttcccaaagttaagagacctccctgaccacacatgcatagaaaagaatccttggtggccaaaggggagtgatgccaagggatgttccctatccagatgt

SEQ ID NO: 39710 - DNA, 201 bp, Bos taurus
tgtaccctctgtgtgttctgtcctcaccgacctccctgtaatgtcctctgcctggaaaaaccttccttcaatctgcctgtccatctctctttaagtccttyaagttttagcttaagagttacttcctctataagccctttctgaatttcccagatgcacttagatgtttctttcttaatgttctctttgttctttgtacac

SEQ ID NO: 39711 - DNA, 201 bp, Bos taurus
gacacagggatgagaatttggagatggtcttaatagggaaaatttccacagtagttgtaagtattgtcatacacaattatggaacacagtctcctacttgytctaatcgagtatttagttatctgtggacagaaaaataaaatctgagagaatatgacctgattactatatttccctggtaatttcttcagttaagaagat

SEQ ID NO: 39712 - DNA, 201 bp, Bos taurus
gtctggacttggggttattttgatggatcataatgcctttgaggttcatccgtgctttggtgggtgttagtctgttgaaaatcaatagtgttccattgcayggatgaactgcagtcatttgcccgttcacctgttgaagttgtccagtcactatcacagtggataccccttcagagggatcttgcctgaatgactgtgggg

SEQ ID NO: 39713 - DNA, 201 bp, Bos taurus
caccttctcctagtgaagaagaggttgtcatcttaagaattttatttggtgatgctgggatccagttttggttgaatagtggatggcagcaggcacatagkttcttctttcaacttgcattagggaagcaggagagcaagccaggttgatggtgggagggagggggcaggaagagagctagttggaggaggcctttgaact

SEQ ID NO: 39714 - DNA, 201 bp, Bos taurus
taataatttctgaatgaggcacaccacaattcattttgctccaggccccccaaattatgtagtctgggctggttagacccactgcgtattcctatatgctkcctctagctcctctccaggccccctccctattggctcattccccactcctgttttcttatggctggaatttaccttccgcctgccttatttttctggttt

SEQ ID NO: 39715 - DNA, 201 bp, Bos taurus
tgatgtcggaaactgggaaggcccttttgggagcttgctttctcagaataagtcctcaggaccatggaaaacatttgggcctttctttctgtgaaaacagygttgcttcacccttacatgatggatttagccctcagcccttgtagggttacaagagaatcagggcaaccttcagggctggcctcctggggccccggctcc

SEQ ID NO: 39716 - DNA, 201 bp, Bos taurus
cattctgttttgtaaattagtgaatggaggagaggatgaagtgaactgcctaaattcatccagtgagtatgtggcagggccaaaatttgaacttggactayctggttcccacacatatatatttaactactgtatgaagtttggccagtgagagaaaggaagaaagatctctggggggcaggctgagataggcagcacacg

SEQ ID NO: 39717 - DNA, 201 bp, Bos taurus
tctcctcctgtcctcaatctttcccagaatcagggtcttttcaaaatcctgttggacgctgattattcatcaggcctcgagccaggcccaggtgagccttyggaaagcactcagtcagaagctgtgtgtgaaggatcaccttctgccctccaattgcaggtcacaattcaccaggccagttaggagaacagggaaaagtca

SEQ ID NO: 39718 - DNA, 201 bp, Bos taurus
ttggaaccaaggactggggtaaaggcataggcctctagggttccaggtcccaaggtcaacgtgatgtgctatactttctgatgtcagaaagggccttctaraataagatacacattgctactatcctgtctgctgtttcaccccaatgcaactgcccccagaacctcaggccatgttcctatttggaaatagggtctttgt

SEQ ID NO: 39719 - DNA, 201 bp, Bos taurus
cgggaaaagagctaccacaatctacaacagctacaaagctattttataaactagaagcttcgagagtcccatctcttgctcctgatgtcagagggccaaaygttcattcctagatcaagattactttcactggattgttttttgaagggctagttccccttgaaagtatatttttttgttgttgtttttaatgagaagagt

SEQ ID NO: 39720 - DNA, 201 bp, Bos taurus
gtgaaagggcagtacatttgatgagtttctaaaatctaggacagaactattgcaagtgatcactgtgagggaggtgggtgtgccaggcacctgcccagcarcaggccttacctctttgtttgtcctgtcagcttgcaccaatgtcccattcaggcaaggttccacgtagtgaagctcctcattatactgcgaagggaagaa

SEQ ID NO: 39721 - DNA, 201 bp, Bos taurus
aaatagtatcttttccatgtaagttagccagggtatgtctctgctgctggcagatgccatgagaacatggcagcctcgggggcattccctccctcgcccaytgaggaaactccaccatgtagagagcacagtgctcagggcaagggagggcaccaggcaggccaaatcagtaaggcccctgccctcagagaagtccacatg

SEQ ID NO: 39722 - DNA, 201 bp, Bos taurus
gcatattttgtttggcccaagtagtgaggtatgcacaatgttttgaattttaattcatcaccaacatttctttttaatgggatgtttacggcaaaacaccratttccagctctgacaacagtgggcctacctttccacatggcagtagcaactggataagagcagtggagacctaatgaggggctatgtgttgtacttctc

SEQ ID NO: 39723 - DNA, 201 bp, Bos taurus
gctaagagcccaaaacaaaagctaaaattaatgttaaaggtgaagaaaatctcagaagcagtcccatccagtcgatcacaaacttgaaaaagaaaatcttygtctccttatagggctttcttatcctctttcctctgaacaatctttcttttgcctccagccaagaatttttttattaatccaaaacaaaactgtaatatt

SEQ ID NO: 39724 - DNA, 201 bp, Bos taurus
atggttggaaaatatctctagaatgttgtatttataatcctatataatcttacaaggagcattagaagaaagagattcactttccctggaagaaaaatggyttactgccagtgccgtcattgtgaaagagaagatgagaaagcacaccagagggatcgctttgagcttcacattcaaaggtttctatagacagaaactctg

SEQ ID NO: 39725 - DNA, 201 bp, Bos taurus
ggccagaacatcaaaatagaatgagaggatgagctacccagcagggaaaagaaaaagccaaaatgagcacgacctgtcctgcagggagcttcacccgagtyccaatgggccccctccttgctgtgatgcccggctatcatcatcttgaaattcttcataactttttaacaaatggaactacattttgctttcccactgggt

SEQ ID NO: 39726 - DNA, 201 bp, Bos taurus
gtgttcccttcagtggccccaggacctcctcaaagacagctgggagtcatcctcgttaatggaacgtctcagaggcccattttgggcccttggggaatacrcatacaccaaacttggaaagaagtattttgaggctcacagacttccacaatgacacagcccaaggggcccacctcaagggcagtccacaaacgtgcactt

SEQ ID NO: 39727 - DNA, 201 bp, Bos taurus
ggccagggcccccatcacagcccaagttgatggggtaacattattgactgcatgtctctgtcacccacttggacagagagggctcctcaagggcacagatyagcttccaacccagccctgtctccccagggcctggcacccagtctttgaaagtcagatcctatataattaatgatgttaaagcctgtgcaagtggatttt

SEQ ID NO: 39728 - DNA, 201 bp, Bos taurus
tttgagtaagctccaggagttggtgatggacagggaggcctggcctgctgcagttcatggggtcgcaaagagtcggacacgactgagtgactaaactgaaytaaggagtaaaaacaggccccataaaaagggtctggagtccaaatggtcttcaacttcttaacaacaactatggaagctggaagacaagttttctgaaga

SEQ ID NO: 39729 - DNA, 201 bp, Bos taurus
aagcctggaggtaaacgggaatctaaaggagctcaaacactgcacgtggcccaacaagactgaaacccacagcggacaaatgtcgcagaataaacaagtcrtatttgtgggactaacatacacaatcctaggtgcggccagcaggggtgctgtttctacggtttagtagctaagtcatgtccgagtcttgcgaccccatgg

SEQ ID NO: 39730 - DNA, 201 bp, Bos taurus
cagccacacagagtggggccaccagaaaagcccacacaggctgttacagctaagcaatgggttcttctggggttgatgagggttcagtactcagaaggatkcaaactgagtagggccatccccatcttccatgagggatggaggcggctcacaaacccagggagctggcgaagggtataaacggaccctgagcaagacacc

SEQ ID NO: 39731 - DNA, 201 bp, Bos taurus
aggccaactcggtcaggcacgggctccaccctgggtctcagcctctgctcacccattctccctgcacatgcctgggctccagccataggaatagcccttcrtggcctccctgagctttcgtttgcccactttcatgtcctcctcacaccactgcctcaactcggaatgttctgcctgacacatctcaggtccatccatcct

SEQ ID NO: 39732 - DNA, 201 bp, Bos taurus
tgctgttccttctggctcgatatcgtttctctggatgtgcacaagcctttctccctcacttgattcaggtccctgctgacatatcgcctcagcaaagaagyctttcctggcccctcaaaacgtgtaacagcgtcaccctgccgtcttctcctcccttcactctgcccatatgccacacccttgccagaatgtctcagggac

SEQ ID NO: 39733 - DNA, 201 bp, Bos taurus
acaaattacggagcacaaagagaaacagcaccaggcctcccacctcactccgcatgaaattaatgaccccactgagaggtctctgcttactcagagtcacrtcaagccaacctgagggggaggagacctttgtgactaagtacgatctgactaagtgctcctaccatgtcgctgagagaccacccctcctgagggacaccc

SEQ ID NO: 39734 - DNA, 201 bp, Bos taurus
tttattttgtttggaactttaccaagaaatgctcaccattttggaaaatcacatcgctgacagcgatgccacgagttgtatttgatggccaataaaaatgmtaaatgaacgccaacaccacatactcctggttgtagcatttgtagctgtcacatttatagtgatgctatgtatagctgcaaatatctgatgactttacat

SEQ ID NO: 39735 - DNA, 201 bp, Bos taurus
gtccatttatggttgtgggacagtacctaagatgtctgggagtcttgctgctgacagttgctagcagatcagactgcctcctggcccaaggtgtgaaacayggattgtgactccacactgggtctctgttgggcttcccttctcctgatcctttggccacagaaggcaggcttttcttggttcttctgtctatggctgctg

SEQ ID NO: 39736 - DNA, 201 bp, Bos taurus
tcagggctgtgcatttctttatttttgttgtattactgaccattctaatgcccactaaaaccacagaattaagatattaatatctcatgtgatcatagccraagtctttttgctttgggttttgttgtaggtcaagttaccttggaagcagagcctgagattgatatttgcatgtaggagtttcaggggagtgcttttggg

SEQ ID NO: 39737 - DNA, 201 bp, Bos taurus
tgtggccctgggtgtgaggtgcgattctcatcagggctctgagggaagtgtcttagcaaagcctcctctcagggcctcatgggccatttccctaccgctcyccacccccctggaaactatctttgtggtcttcccccaacctcactaagtctgcttctctttacaggtggccctgttgaatcccattgaaaacccagactt

SEQ ID NO: 39738 - DNA, 201 bp, Bos taurus
cccctagagccttctgatgaagattgacgccttccattatgtgcagctggggacggcctacaggtcagtgctgccccggccttgccccgtacccccggctyacactagagcgccactttggactggtggtctctgtgcatccatccaggggcctccagcctgtgccagacgaagaggtgattgagctctacgggggcaccc

SEQ ID NO: 39739 - DNA, 201 bp, Bos taurus
aggacccccagttcacccaagcccagcagctctgggcagccccagatgtggtccctcccttgggggcagccgagtcaggtggccaagctgtgcattaaatragccagatgaaggagcatgccagtgggcgggggcgtgaggagcagggctgggcacccccataccatagcactgggacccccagtagcccgggcagcaggc

SEQ ID NO: 39740 - DNA, 201 bp, Bos taurus
atgcatgcactcagccagagtcctggtggcctctaggctccttcatgtctctataagtcatctatcctggttagtgacatgtgaccaacatctgacctgtycctagcctgtgtggccaggcctggaacagggaggatgggaggttgaacacacagcattcactcattagcactctgtggagtaggcagcatcacacccatt

SEQ ID NO: 39741 - DNA, 201 bp, Bos taurus
tgatacgtccctcccttgtcctcaggaggagtgctggcatctccatgactacctactgggcaccctgggtccctatgtgatcaacgtgaccagggcagccrtggcctgcagtcaccagcggtgccatggccatggccgttgtgcttggcaaaacccaggacaactagaagtctttctgcatctgcagccagatggcagccc

SEQ ID NO: 39742 - DNA, 201 bp, Bos taurus
gtcacagagtcagacacagctgagcgcacacacaaaggataccagtgtatgtataactgaatcatgtcgctggacgccttgaccaacgctacgtgatcaakcaagcatatgccaaaatacaagtctaacaaaaagaaaataaatccctattgtattttttttcaggcttctggcaccttggcctgtgtcacagccctggag

SEQ ID NO: 39743 - DNA, 201 bp, Bos taurus
ttatcttgccgggcagcctcctcccgccccttgcagccactgcagacctttccctgctccttttcccagcatcctctaggccttgctttgtctgcagttgyctttttttcctgcctctccctgtctgtcttctctctctagggcattgaggggggcatcccccaggcccaacacatcagctggagcatgtcatcctgtccc

SEQ ID NO: 39744 - DNA, 201 bp, Bos taurus
tgttcatagtaatgaacttgggttgctcaaaaagcaacatatttttaagcagatttagtttgttctattaaagaatacaggaagattattgatatttttartagggacttaaacttctggctttttaagagttgttaaattctgcttggtaaacaaaacgttaaagcttggtagatcaaatactactgccttgagtatgac

SEQ ID NO: 39745 - DNA, 201 bp, Bos taurus
cactgcctgtcgcggccccccaggagcactcggggcggggcttcgctgagccgaaaaccctgctgcctgtgggcgctggccctgagagctgaactgccccygtcgcccctgccatacagaagttgttccccagccccgggtccttatagggcgctgggacagggcctgtgggctggtgagcaccaccaggtacatactcag

SEQ ID NO: 39746 - DNA, 201 bp, Bos taurus
agcagcagtaaaggcaggcatgagggggtttttgccggcttttatgtttttcaggtcagggccgggattagaaagcctgggagactaggcctaacgtggaraagcctgtataatgttctcttggctttccttccagtgctaaattccaatgactccctaaactaaaagggttcactgggacacccactagccctccaggga

SEQ ID NO: 39747 - DNA, 201 bp, Bos taurus
ggaagcagccaccgagaggagaagggaggttctttctcagatgaaagcaagggcttcgggactgcacagtgatgaggagaacacccccaccccatgctctygggttacagaaagggagatggaagatggaatactcgggggaaatttcccacagaatatattctgtgtggatacggcagtccacgttcaaactatgaaaac

SEQ ID NO: 39748 - DNA, 201 bp, Bos taurus
acactgaggccccgacagcccatgaagagacggagtgcctggccagccgcctgctgcttcagcctggctctccgggctctggccactgtctgatcacaacyacatacgagacgcaagctgcaaccgcccagatgaacctttcccaagctcccaacccacagaaatcatggcaggttacacagtggttactgtcctaaggcc

SEQ ID NO: 39749 - DNA, 201 bp, Bos taurus
actccttttggatgtgaatgtgggaaattaactatttccaggccggaagatggctgatcttcctgccgttggtgagactttccccttggtttgccagtccrtgaacagacctggccaaggccacgccaaagagatttagggtggctacaccagttcttcctccacagcctgcaggctgtgcagccccaggtccactggatt

SEQ ID NO: 39750 - DNA, 201 bp, Bos taurus
ttttggggtgaggttcacgaaatcagcccggggtggggagagatttcgtctagctgtgtgatctttcagaaaagtaagtggaacatgctgcctcttttcarttctgtcagtgcttccacatggaaaccaaacgcaataaaatttttccaaaacctgttctggctgagccccctgtctctcacggagtcaccccttgggtag

SEQ ID NO: 39751 - DNA, 201 bp, Bos taurus
ttaggcaacaggattgcagttacagtgtggtctcaagtccatacaggaagctgaccaaccccagggtctcctgcacctgccggggcctgctgggtgggccrggaaacatgagaatcaacagcacagtgcagacggatggaggcggcggcttcgggcagaacactgccgagctgtacttcccctgacagaagctggagctgt

SEQ ID NO: 39752 - DNA, 201 bp, Bos taurus
tgggatggtcggtgtgaggtctggacccaggcgtcccgttggcccaaccaacagggcaggtctctctgtcagtgaggattctatgaagctgcgggagggcrctggctgaccatcacggccagagggacccatggccaggagtcgattcggcacgggtgcagtaatagcactgaccgttccgaatgggcatttgttgtgatg

SEQ ID NO: 39753 - DNA, 201 bp, Bos taurus
ctgtggagcacacggtcaggtccgcgtcttcggccacgcccagtgttacatcccaccagggatcctcgcggtctggccctcatactgtcctccacccccaygcgtctctgttctctacccaaagctggagggcaggggtaaggtcagggcagggcactcagaatccgtcaggaggtagatccaggctcaggcccagggacc

SEQ ID NO: 39754 - DNA, 201 bp, Bos taurus
gggctgcccatccccactgcccactccatagagtcacagaggctggcttgtggaccccctgtcttggcctgcttgctcccctggtcccgggccagtccctyagcccaggatcagctctcagagcctgggagttggacaatcagtctgcaaggctgctgtgtgccagtggcgggggaaggcctttgcagaagtttctggcag

SEQ ID NO: 39755 - DNA, 201 bp, Bos taurus
aggccagggagggcttaagggactcccttagtttttaactgctgcctctttagctttcccaagagctagaactagtaaagaaaagtacgaaggtctgacargtcaccaataaccagcttggccacaggtcaaggtacaatatttagaataatggtcaataataaaataatacaaacaacaatacccaaaagaaatagagta

SEQ ID NO: 39756 - DNA, 201 bp, Bos taurus
gaggctgcatgctgcaattactgaagaccatgcaccatacagcctgtgctacaccacaggagaagcctcgcaatgcaaagccggtgtaccacaacagagcrtggcccccactcgctgccactagagaaagcccgtgtgcagtaacgaagacccagcacagccaaaaataaaataagtgcattttttaaaaagggaatatcc

SEQ ID NO: 39757 - DNA, 201 bp, Bos taurus
tccagctgagccagatgttgtgtgtgaggcgagcaggctctgatctgctgtgatgacagatggagattgaggctggccccccagtgtgtattgtggccccrcagctggtggcacaaggggttcatgagtggctttaattcaggctcaggcagagagtcacacagaagggcctgctcccaaattttagtgcattatctcaat

SEQ ID NO: 39758 - DNA, 201 bp, Bos taurus
accactggcccaccagggaagccctgtacaacgactcttaaacagcctgcctcctctgcatgatgctaatggtaaagaagatgcttaagtggcactttgayctgggccttgttccaaggcccttgctacattaaccactgagcattccctggtgactcagacggtaaagaatctgcctgcaatgtgggagacctgggtttg

SEQ ID NO: 39759 - DNA, 201 bp, Bos taurus
gttggcaggacctgatgctactcctgggatgtggaggaagcagagggaagtgacaaggctgactccagcctgagcaccaggggacaacctggaggggcctrcacgtcccgggggaccagatctgtgcttgcatccacatcatcagctggttccataccttccccacccgactggcctctcccgttctcccgaacctcagag

SEQ ID NO: 39760 - DNA, 201 bp, Bos taurus
tgatggatgtgagtttgagtgagctccgggagttggtgatggacagggaggcctggcgtgctggagtccatggggtcgcaaagagtcggacacgactgggygactgaactggctgactgacttggtaccccgctgtgtactttgcatgcattgtgtctctcttttgtggacaaggaagttggggctcagaaaagtgaagca

SEQ ID NO: 39761 - DNA, 201 bp, Bos taurus
ccccatccacttaccaccattctgccaacagggccattcctctgggttgggggcatggtttgtcttcagctgccctcgtctctccaaaagtcatagcatcrttagcccatcttatagggccccggacaccctgggttcaaatcctgacccctagcgtataccagctgtgcagcttcaggaaagagactgaacctctctgag

SEQ ID NO: 39762 - DNA, 201 bp, Bos taurus
attgccccactgggggcagtatcttcatgacggagccctagcacacacagtgcaacggacgaagcccaggtgtcattttaggcttctggccttggagcaaytgcagcttgatggacctttgtttacaatcccttcagagtactctgctacagccataagtccagtcagatcagtggcctcccattctattttctgcttttt

SEQ ID NO: 39763 - DNA, 201 bp, Bos taurus
ttggttgcgggcctgcagtgaccttgcctcctgctattcaagtcctggtgtagcccttacccgtacaacgaggctctccctgtgattggctttaaccagtrgaaggtgccaaaagccacactgggccagttccaggcctaggccttaaggaggcctggcagcttttgcacttctggaaccaggccactatactctaaaacg

SEQ ID NO: 39764 - DNA, 201 bp, Bos taurus
ccctggcctcctgatgtgggccaggcagggttgaggcagttctctggaaccagaccacctgggttcaaatctcgctcttccactcattggctgtgtgtctytgggcaagttttaacttctctgggcctcagtttcctcctctgtgaagtgaaacgctgatagcatcagcttataaggctgctgtgaagatgaaatgagatc

SEQ ID NO: 39765 - DNA, 201 bp, Bos taurus
ctgcagaagtctctgtgtccacatctctaaaatgagggcatgaaggattactttcttgtgtggttctcagcactgcgaagattaaataaggaaaccacccyacccctagcccagtgtgtatgtagaaagtctttgaaatatgacttttctttttctccattgcatttctagaccagagaatacacagagcaggattgtttg

SEQ ID NO: 39766 - DNA, 201 bp, Bos taurus
cttgctttcacataattccactttctctttcatgttccttgagtcatgaactttccttgaaattttttatcctattcttcgagaaataggcattcttttcracatgaattcttcgcttttgtgctccagcttcctgttttgctctatttcctgcctcctcctcttagcagggactttgaccctcaagaagcccctgctcct

SEQ ID NO: 39767 - DNA, 201 bp, Bos taurus
ggttatttactctttctctgtttctgctcattttgtcagactgggatcagacgaaaggtaaatagccgcagtatttgtgtcaatacatagttgttcagtcrcttcgtcgtgtccagctctttgcaaccccatggactgcagcactccaggctcccctgtccttcagtatctccctggagtttgctcagactcatgtccatc

SEQ ID NO: 39768 - DNA, 201 bp, Bos taurus
tgtgttgctcgtgaaaatgagaactgcctcgcctgccctgtgctccccggtgagcacccccttgctgcagggcagggctggcttcaccttcccgggccagygctctcaactgctgggttacagcctgtctagactagaaccgggtcatcctggcgcccagggaccaggggctgtgcgagggacccgttcagtgcagtgggg

SEQ ID NO: 39769 - DNA, 201 bp, Bos taurus
ggggaataatgtaagcatttgaaacagaactaaataaacaaagaccgtccatccattgccggctcacccgagcccacggccccagggacacacacacacarggactgcagtcggggttgagtgtttggagactcacaaaatactctatttgtggttctcgtttttcactacgggcctttaaaaatgacttcaagtcatcca

SEQ ID NO: 39770 - DNA, 201 bp, Bos taurus
gttaccaggggaggagccctgcgaggggtggatggtgggagggaaccacgggttagatacaagtcattgtcaaagtcttagtttttggttggtgagttcaygggttcactattaaaattaactacttaaaaaaaataactaagtgacagttgcacagcaacatagatgccactgcacttaaaatggttaaaatggcaaatt

SEQ ID NO: 39771 - DNA, 201 bp, Bos taurus
aggagatggggagggcccggtcacgggattgagtagggggctgggaggcagtgaggaatgagctatgtggatcccctggggaaaagcagtctaggcagagrgaacaggccgtgcgaagtccccaaggcagagtgtgcctggaggctgggaaaaacagtgatgaggccgacacctgtgttcacagcaggattgtgcccagaa

SEQ ID NO: 39772 - DNA, 201 bp, Bos taurus
gaaaatgttctaaaattgattaatgatgatggttgtatcactatgtaaatttactaaaaatcactgaagtatattcctgcaataaataaatctcaggataygtaaaatataccaccaacaaagttgtttataagggaaaagaacatactatgatagctgcgaagctggcctgaaagatgctttcaacaactgactctagat

SEQ ID NO: 39773 - DNA, 201 bp, Bos taurus
aatcactaacagatactgctgtgcttcctcctgcccccgagcccaagacaaccatcaatccactctgcatctgttgattggcctattctgggcattttgtraaatgaaatgatgtaatatctagacttccgtatctgacatttcactgagtgtgatgtttttgaggttcgtccgcgtcgtagcaggcctcaggacttcatt

SEQ ID NO: 39774 - DNA, 201 bp, Bos taurus
aggacccggaggacagaggagactgcagggcggccgctccacgaaggcgagtttggacccaggcttagggagtccccctgaccgcctggcccgcatcgccrgctcagcagctgggctgggagctttgggctatttatatccactccagcaaatcttctgatctcaaggatcctttccaaagcctgcgtcgtgctggcctct

SEQ ID NO: 39775 - DNA, 201 bp, Bos taurus
tgccctcagggccccccgaggacacgcccctccccccttcatccccagcctgctgtgttccaggtttgcgcccccgccccagactggccacgtgcgctgtkcttcaaggaaagcagagagcacaaacacgtctacatggagagcacgtgtcatgaagttacacggggcacaggacacactgccggcccttcaggtgggtgc

SEQ ID NO: 39776 - DNA, 201 bp, Bos taurus
tgcagtgatgagggctgccctctggacggggaggtcactgctgcccctcagtccgccctccagatcccagtgcctttcccctggcaatggccaggaccctycccttgggtgacctttactcctgtcccgcaaggttgggggattcgcccatttaacagatgaggagaccgaggctcggcgaggggctgtggtccagctggg

SEQ ID NO: 39777 - DNA, 201 bp, Bos taurus
gtgtagccttggccagggctggagatggggccagggctggggctgctcgggagactgaggaaacatcaaggatcgctttcccaaggaaaaccaaagctgtrtggccccagttgtgagagtcccaccccctgctcggtgaaaagtgcccatgggactctgggtggattgagggcccagttggcggccttgacccacgccctg

SEQ ID NO: 39778 - DNA, 201 bp, Bos taurus
gcagcccagggagaggaaggaggcagcctcgcaggagagagggctgtacacccagaggtggtggaaaacctgagaccctggccagagggtcagatatccckgctcagcagatgagtgagcaaaacaaatctctttcggctctgtttatagatgaggacactgaggcttggagagagcagtcttggcccagacatcagacca

SEQ ID NO: 39779 - DNA, 201 bp, Bos taurus
ggctcctgagtggcagagtgagaccccaggcctcgcggcgtctgacgcctgttcactgagctgcaggcgctgagcctggccgccaacctggttgggttggygcagcccgagaatccagggaatgtggctggaaacagggatctattccagctgggagagccctgggtcccgggcctccgtgcggactcaggcttgaccccc

SEQ ID NO: 39780 - DNA, 201 bp, Bos taurus
atgtgcatccctgtgctgaggagtgccttctcttctgcactttgcaaatgctcacatcacacggtttccatggcaaccggcatccctcagggaggggagcrtggaggggccctcagaaaggactcggggaaaggaccagcttggatccaggaggagggaaacgcccaggagggaggcagcacggcctagtcccgctgctgc

SEQ ID NO: 39781 - DNA, 201 bp, Bos taurus
aacacagaatgtaaagggaggcgtcctgactcacactcagtttggctttatcacagcacgtaagccgcatccaggcctttccccttaatctcacgacggtrctttccctaaaaagatcatgccgcgtgattttcccccgaatgcttcaccccagctgtgcaggcctctttcctgtttatcacggctgcactgaactttatt

SEQ ID NO: 39782 - DNA, 201 bp, Bos taurus
tgaaacccttacggcttcagtcccccagcacagcgccctccttcaccccgggtcctgaacacaggcaccttgaaggaggtaaggcaaacctcctgcaggtrggggccgctggtgggaggcgggtgctgaaaatgcagccctagaagatgagtccccagaagacagagcagaataaacaaacacctgggccgacgccggcgg

SEQ ID NO: 39783 - DNA, 201 bp, Bos taurus
ttgctctgcagaggtgtggccaggtaagggatggtgggggctgccctcaaggacccggagtggagaggtgcagggggtaaagcaaacccagcctaaccccrtgcagggtgagtaagcaaggcggccaagagctggtcagttcaattcagttcagtcgctcagtcgtgtccgactctttgtgaccccatggactgcaacaca

SEQ ID NO: 39784 - DNA, 201 bp, Bos taurus
tccacaggctgcacagtccgttggatcgcaaagagtcggacacgaccgagtgactttcactttcacacagaagtccagctgtgagccccaaactgagacgracaaatcacgggaggaaggacacagtgtccagcctgggctgcaaagataactgcaggagaggggaagggccccaagggagactagggacggcgacccccg

SEQ ID NO: 39785 - DNA, 201 bp, Bos taurus
aatgaggcccatcagagctttcaaacgggctcagctgaattcccttttctgccaggaaagggacacaggctaccttccccaagcacaccccactctccgcrgatggccacgtgctcacacaccaggaagctctccgcagcctttccttgtggctttcttgggggcccggttgagcaagtgacagcccacgtggaactgatg

SEQ ID NO: 39786 - DNA, 201 bp, Bos taurus
tccaggccagaatactggagtgggtagccgttcccttctccaggggatcttcctaacccagggatcaaacccaggtctcctgtgttgcaaattctttaccmgatgagctacatgggaacctggaagcaggtgtgcctgcctgctgttagcgctcacttctgggaagttagatgtcttatacatttctgcatttgaccattt

SEQ ID NO: 39787 - DNA, 201 bp, Bos taurus
gagggtcctcccagagccagaggcagcctggggtgcagacagcactcgaactggagtttagcaccttggtcctgggcagctccagccctcagctggcctcrgtctagcagggagtaactgcctggaaggtttaaagccaaggctcccagcccaccccactcagagaagctgccggatctcagggccacattcgtcaggggt

SEQ ID NO: 39788 - DNA, 201 bp, Bos taurus
ctacaaccagactctttgcttcacaacagcctcactttttacttcactgtgacctgactctatgaccttagctcactaggccccagatctgttcctcattrggctcggacgtgagtccacactacggactgactggtttttcacttctgcctgacactggtcctcaatagggcccgattctcatcctcacttgtgcctgaa

SEQ ID NO: 39789 - DNA, 201 bp, Bos taurus
tagaatcttaaaattactagtaaaaaaagaaatgctccacgattgcattgcaaatgtgatattataaaaaatatactacaacctgaattggagacaagatrtttgagtagaaggacttgagctcatctcctctgaaaaataagataaaataaaataaaatttaaaaactccaccaaaatcacaactaaatattgaccaagc

SEQ ID NO: 39790 - DNA, 201 bp, Bos taurus
ttactggggtgaatggaaagctctgaggaagaacttaaaggaagtagagagagggaaggcagggggatatgtggtgggaatatgtctgtcctgcttatggrtatcagtaaggcctgtgtggcttgagtagcctttggtctttactctcagcacactagaagtcattgaagatttttaaacagagaagtgccaagatatgac

SEQ ID NO: 39791 - DNA, 201 bp, Bos taurus
aacttggaaacctcagaatacattaccctagctaaaatcaggtcacctgaatctcctttctacaactagaaaatacaaaaatgaataaaagagaaaactckctggaggttccatctttgtattgctgatcctgttcatagcgccaattgtttcactgtgtctcactgtgtgcactgttcactgaacacatggcatgcacgt

SEQ ID NO: 39792 - DNA, 201 bp, Bos taurus
gtcctttgtaattatgctaaatctattctgcctatgctctataaagggaaatacatagtctagatgacagcacatctgtttacaacatgatttactcaatrttttgagcctgtcgctgagacctacttgggggtgggggtggcaggtggtgggaagagctctttcaaaatggtaccgctcattgacagtgaacctgggaac

SEQ ID NO: 39793 - DNA, 201 bp, Bos taurus
catgaaggctgggagaaaccttcattcacactggcccacagctctgttcccatgactccagctctacttcccaccaaggcagtgcctgtcagtacatcctrgaagaacaagtggcctacgatcacctcagatccagctctcccaccaaagccatggggcacagcagaatgcattgggacactcccccacaaaagatgtacc

SEQ ID NO: 39794 - DNA, 201 bp, Bos taurus
attcaatgatgagcttgttaaaaattcatctccttacttgctatttgacttccctcatcctacgagaggacttccatggtggttcagctgtaaagtacatktttccaatgagggagacaccagactgatccttgagtctggaagatctcctgaagaaataaatggcaacccactccagtattcttgcctaggaaatctcat

SEQ ID NO: 39795 - DNA, 201 bp, Bos taurus
tgtcattgctgtgaaggctttaggccccacatcaggcttcccagcccagggatccggcaaaagactgggaatccccagtgagcctgactgtgaaggccaaygtgatttgattacatgacctccacaggactaggggaaacagaaactccactctaggagggcacaaacagacctgctgtgcaccaggacccaggggaaagg

SEQ ID NO: 39796 - DNA, 201 bp, Bos taurus
ataaagttagaaaaatgaataataatttaatatcctgtcattctaattagtatgttgatgtctcagtaactttgctaacatgatccatgtaaaaatcaatyatctggttatttcattaatgcccttttctttaatagcataggcacatctggaatacactaaaatttataccaaaaaggaaagattaatcacttacactta

SEQ ID NO: 39797 - DNA, 201 bp, Bos taurus
gacatcatacagtggcattgtataggggcccgacagcgtacttccctctggtcaccagagctatatgctctgtggctgcccctactgagccctgttgtagyagggccaactatgtgagagagctggtaaggggctggcctctggcccagtaagctgtgagatcatgtcttgtgctgtcctggaaggtggggtgctggtgcc

SEQ ID NO: 39798 - DNA, 201 bp, Bos taurus
aatgtgcaaaactgaaaccatggagagtaggactgaggggtggaaacggagctttcttgcgatttctggagcttacttggctaactggttaccaggcccargcaaagtgagcttacaggtgcgctttcagagaggaccgatacagcagtctgtaacaggaggtcagcagactgggcctcgtgtgtgagactcgggctgtgc

SEQ ID NO: 39799 - DNA, 201 bp, Bos taurus
acaacagtcctgacttcctgctgagaaaatattctgaggaaggagaaaagtagcattttggatgtcatgacacctctgccagcactttggtaagtcctccrgcatacactctgaggccacttgaccttgtctgtctggcgaaccttatgttccctttggaggatttttttcatcctgtttgtaaggtgccacttggactaa

SEQ ID NO: 39800 - DNA, 201 bp, Bos taurus
ggcagatgctttaacccctgagccaccagggaagccaccttattgagctataattgacaaataaaaattgtgtacatttaggtgttcaacacgatgttttratattattaaacattgtgaaaagattcccacaaactaattaacacatgtgtgtggtgagaacacttaagatccactcttagcaaatttcaagtatgcaaa

SEQ ID NO: 39801 - DNA, 201 bp, Bos taurus
gattttgttagcttattattagtatccttgaaattttgatgcaaagaacagaaatgaacagctctaaaacgaagtatctataatcttaactgcagggcggkaaagtatttgcctgccaaaagagataaatgatgttcttgtgtgcacttgaaacttacaaatggctgcagtaagactcaggatgataacagttgtgctcaa

SEQ ID NO: 39802 - DNA, 201 bp, Bos taurus
acctcagtatcgacctgctaaatgtctaacacccaccttacattttcaatagtgcttttgagctactatcaaccacaacaaaatgtcagtgatcgaaaaarcctttatatggttgtattatgtgaataagtctcattatttgatttgatgtaattagctttcttgatctgtcacatggctaagaaattaaccaatacatga

SEQ ID NO: 39803 - DNA, 201 bp, Bos taurus
tcaccggccagctgagggaccggtgtgaccgcatcgaccaggccgttgggaaaagcacccagtatcaaagcctgctgagaagcctgtccgagaagctggcygacctggacgatcagctcagcagcagcgtggccggcagtgcacaccccgacgccatgagccagcagctggaaacggcccagaagctgaagcaggcggtgg

SEQ ID NO: 39804 - DNA, 201 bp, Bos taurus
cttaaaaaatataaattgacaaactgtttctgaaatgtatatggaagcagaaaagacctagcatggccaaaatgatcttgggaaaaggagaaacaaagacrgaaagcttgtattattcaattcagagtttagtgtgaagttacaatgatcagggctatgtggtattggaagaagaactaagaaatagagtaaaggaacaac

SEQ ID NO: 39805 - DNA, 201 bp, Bos taurus
tatttgcaaaatttcagtatgaaattcatcctgtgtcttacctcatcaattctcttcccagcatctaggctgatggtgacctgttattatgccagccctaragagtattccctgaattgtgttttggggagcaacaaattgggataaaattttcctccaaaattgaaaagacaaagtatctggcaatgaatcacactttta

SEQ ID NO: 39806 - DNA, 201 bp, Bos taurus
ttctcctgtgctcagtgttggcatgtaggtgcttactaaatgtagttagtgcatgaatgattgtatgcatgcatgaacaaagtgtcagagtttccttgctygagttttctatgttttgtttgactgatgtgtttttatgataggaattttttaaaatttatttttaattgaaggataactgttttacaatattgtattggt

SEQ ID NO: 39807 - DNA, 201 bp, Bos taurus
tttaggtagagatgaggaagggaaaaaaacaatgtttattatggaattcattgtcttgtctaacgacttgttaaatagtaagagatgacttctaaagaaayaaggacagtgtagggaaattaacaagatagtgcccgtcaggctctcaccccagctctcatgccctcttgccccatattgtgtaaaaaatgactttgcatg

SEQ ID NO: 39808 - DNA, 201 bp, Bos taurus
tggccccactcctggctgctcgggaggtttgcgttcctgtggcctgctccctgcaggacccctctcaccacctcccagccccctggcctggttagcatcayggctgccttccagccagggagcctctcttctgtattaacatcagttctcaagaatgagggcccctgccacgatttctttgcttggaatatgatgttttta

SEQ ID NO: 39809 - DNA, 201 bp, Bos taurus
gtagttgcggggagtaggcctagttgctcttaggcatgtggatcttagttccctgaccaggaatctcatccacgtcccctccattgcaaggccaattcttractactggaccactgggcaagtcctggtccttgccatttagaggggggcggagagagaccaaggaaaggcccagggacttcttaccactttggagtgaag

SEQ ID NO: 39810 - DNA, 201 bp, Bos taurus
ataaatcacgcttattaatcatgttaataaatcatgtcatcctgttcgtgacgccagttgtctcgctgtatctcactgtgcacactgttcgttgaacgcgrggtagacgaggtgccagctcagaggcttgaagatgagcggagccataggaatgcagacaggtttattctctgctggccggcacagcagccatagcaatat

SEQ ID NO: 39811 - DNA, 201 bp, Bos taurus
gggaaagggagggaaataaaataaaggatagagatacatttttggagagtcttcacagttatttggaatgatgagatgattcagaaagctttgtaagttaytgagttttaaaatggaaaaaaaagtttaattgcagtatttcttcactgcacatacatttgtaagtcttcagggagaagttgacgaccaaagtatgataaa

SEQ ID NO: 39812 - DNA, 201 bp, Bos taurus
ttacataagcaaagtcaagggtcacccaaggcctaggtcgcaaccacctggctccagtgctgccctgcaggacggaccacttacaggcttaggtaccacarggccagaagaacttcagcccctgaagggcacctcagggcacagttagtactgtcataaatcaagagccagctcgggtcagagaagaaggggctttctccc

SEQ ID NO: 39813 - DNA, 201 bp, Bos taurus
gctgtaggattcacttctaagatcatgcttgtggttgttgttagcagaccacgtttcctctatggctgttggctggatatttcagtttcttaacacatgartttctctcaacaaagcagcttactttacccagagcaagaaatccaagagcaagaaagtgaatgcccaagatgaagctatgatcttttataatgtaatctt

SEQ ID NO: 39814 - DNA, 201 bp, Bos taurus
aaacttgcaacatatgagaaatacagcctgcctatatatttgtatgtatatttcctgaaagtaacaagcatagtctatatatgtagagattcttattaatrtatgtatctattataccatgcgtccccaacccgtgggtcacgggctgctaccagtctgaggtctgttaggaactgggctgtacagcagggggtgagtgaa

SEQ ID NO: 39815 - DNA, 201 bp, Bos taurus
ctttgagtacctgctgtgccaagcaacaaagaaggccagccagacaagcccttgaacgccagccgccagaaactcaaagaggactctacgggcaccgtatmtgctgtgcctgtggccgccggcttccctgcacacctggtgctgctgggttccccacgacccaagcggctacaccacctccatgcctggtcctcactgggg

SEQ ID NO: 39816 - DNA, 201 bp, Bos taurus
caactgtatctaactcgagcccagggccacctgcaatgacttagtcttcagactgttgatagtaaacagagaaacaagagccagtctcagcagtatcggtkatgtgaaggaagcagcagaaaggccctaagggaagagcttccatatatatatatacatatatatatgtatatatatatatttagaacttacttttcaagc

SEQ ID NO: 39817 - DNA, 201 bp, Bos taurus
gtgataattttaaagagccatcctggttctagaacttgttatggggcagcctgaggtccctgctgtaactgcatcacagcccacttctctggcaacccagscccacctccttctttctccttgacagtgctgtcaactgaacacacttcccagtaactttctatagtgacacctcagtcttagactccatttctgggggaa

SEQ ID NO: 39818 - DNA, 201 bp, Bos taurus
tcattctatttgtatcctttagtgaagattaacttgtagagtactatacagacttctctagtatccacaagtaaggccctagataagtctctttttttccytcccaaagcttaacttttgaaggcatggttagaaatcatatgcatgtgatttgcacaattattttcctgcctgatccattttataggcctgaaggaacag

SEQ ID NO: 39819 - DNA, 201 bp, Bos taurus
acacatcccgagctgtgttctccccagtggccagccccgaagagacaagtttgccatcaatgtccacttcctgcttccctaggagtcaccatcagtggccragacaccctgtccaacttcacccggctctttctctccttcctatggcaggtgctcagcacctctgggagcctctgtggccttgagggaggcagaaatggg

SEQ ID NO: 39820 - DNA, 201 bp, Bos taurus
ttggaagagggtcaggccaggacctgaggatggggccttcggaaccaacagaaggatttcgatttgatggggaggaaattgggggccccttgttgtcttgragggcagatgacaagcgtgtggtggttgaggagcactcagtgttggggtgtaggcgctggagtggggagaggcaggactgggaggccaatggcgaggtgg

SEQ ID NO: 39821 - DNA, 201 bp, Bos taurus
accatgaaggaaaccaaggcatggatgcaatcagtaactgcacacccactcagtgatggcagcgttggaagtaggatctaggccctgcctccttcccactycactaagatgagaacatccatttcctgacccacagtctcctaataccttgttgggctgtgcacacgaatgtgcccggccccccgaattcacgtaacgcct

SEQ ID NO: 39822 - DNA, 201 bp, Bos taurus
gcccctcacttcatcactctgccccaagtctgcctggggcccttctcctccaggaagatatcctggtccattccagcttatcaccaccctccagtctgttractgcagagggcttttattatctgcatctcttattttatttagtgcttcattatactccattgatgtctcagctttgttttaatctctaagagttccttg

SEQ ID NO: 39823 - DNA, 201 bp, Bos taurus
cagcctctcttaccctacctccaaatgcttacctccctaggctgtcatctcttccacttcataccatctgtcaccccagccgctgtctctgtgaggactgygtgtcctgggttgagcacattgctggtattcaggccacagaacacagagcctcgtggctgcatccgcagatgctgaggtacctccttagctgggtgtcac

SEQ ID NO: 39824 - DNA, 201 bp, Bos taurus
ggtaaaatttaatttcctgcaaaattttcagtgcacattaagctatataatcttctgccttgggtactccacataagtgtttaactttcttgttttatgamctggaatttttgactcaccttgaagatgccactagggcaagagatcactgagatacctgagaaagaaaaacttaaggaatcagcatttaccaagcgaatt

SEQ ID NO: 39825 - DNA, 201 bp, Bos taurus
tggtgtctgcagaacagtcttttcctttactatgcctggaaaagcagctccaagggtatgtcccgtgaatagtaataccagtatcagcactgattgaacaktcactgatactggattagtaacagtaatctggaggacattagtaagtgcttgtccttactaagattaagaaagtaaaattttttattattgtccctcctt

SEQ ID NO: 39826 - DNA, 201 bp, Bos taurus
atacattgtcaatagtagtaaaagaaagagcaatgattaacattttgcttctggtgattgataaagcacaaacttgtcctgttttatctcaggttctgcckttagtctgaaacaaaattggcatgtggctgtgaatttgaattaatggcagtgttccaatcttgaatattttgcacctctcacacaaaatattccagtgtc

SEQ ID NO: 39827 - DNA, 201 bp, Bos taurus
agatgtatgtcctgaacaaattcctaagaacctgttaaggtgcaaccactttaaaactccttgtgtgttttccacggggtattgactcagcccggccagcrctcagtacttgctaggagcacccatgggaaatacaagagaagcggaagaggtgtggtaggcttatgtcaaaggaccaggaacctccttggaccatattta

SEQ ID NO: 39828 - DNA, 201 bp, Bos taurus
ggcaaatgtatccccaaatattaacaggttttgtagttcttctcagagaatggggtaaagacacctcaaccatcttggctggacccaagctgagaggacaygagccctggggtggaggcctccacagatctcctcattgtctgttggaacatgaattttatacccccactaagaataaacaggattaggaatttaatgctg

SEQ ID NO: 39829 - DNA, 201 bp, Bos taurus
agtggcaagactggtgaggggcctgtaatatagccatacccgtgatggtaacagtcgtattgaagcaatcctgcaagataggctgggtgagcaatcaggtstgtctccttaatttgggcctgagtcactgggtagaaggaccagttggaagcaaggccagagaatgcagagtgttatttcagccacgatgtttgaggagac

SEQ ID NO: 39830 - DNA, 201 bp, Bos taurus
tagcaagatatgggctgccgaagcctggagcgaggggcgcaaaaaggaactcctggaggaattaaagttgggcagaaagtgccacaggggtcaggacctgygggcctacaggtgggagtattcccacaggggatatttttggacatagagtagggtgagagacttggcagcagaagaacccagagttccttcccctgtctg

SEQ ID NO: 39831 - DNA, 201 bp, Bos taurus
tggacgtgccagggcctcacaactgtgcctctggtgaactgaaccgcgtaccctcccggctcgtcctctagatccaagcagccttgatcagctctgaagtmctcttccctcctcgtggcctctcgggttgtcttcctgggcctgtgtcctacggaaacctccttaggatggaagtcagaggtccggtcggtccgtcctccc

SEQ ID NO: 39832 - DNA, 201 bp, Bos taurus
agaagagattgatgtttgtgaatatgtgaagaaagctttcacgtaagcaagattagccaaaacaaactaaaagaaaaaatctcatttgctactgataacayaggttatattaaaactcagcttactgataatatttaaatagttcaatcttttcagcaaaaaaattaaccttacaaaacctgaatacatcacaacagtgta

SEQ ID NO: 39833 - DNA, 201 bp, Bos taurus
ttttcagtggccattccaacctgcctcactcttggtactttctgtccctcagaggatacacaagtagttacaaaactgcatgattcaattcttagtgaaarcatgtctttgggaaacttacctggcctactttcctaagtgggaaagagtctgaatgaacatttccaaatttattaagacaggtttctaaaacaaattctc

SEQ ID NO: 39834 - DNA, 201 bp, Bos taurus
tttcctctttaaggcaaaaggcttgtaggttttgcctctttactttgtatttacctttaaagttccatttgttcacctaccagtgtttaccaagtccttayatttgggatgctttttctataataaaatgttaccatttgtgtccatgttgttttgttgttgctggttttagagtaggtttggagccagggcggcacacag

SEQ ID NO: 39835 - DNA, 201 bp, Bos taurus
ctctgagtcactattagaagccgtcctgggcccctgggagagcaggggtggaacagctctacccgagatggtttcctgaacctggcgttccagcatccacmtcccttagccaggccacttctctcagtgacacacctatcttttgacacacctatctttcctgggccaaggactgtctgaaacccatgctgcaaacctgct

SEQ ID NO: 39836 - DNA, 201 bp, Bos taurus
ttggacatttggtctttctcatttcttttacagtctgaaaccaaaatgtaagctccataatgtcaaggctttgtcttctttgttccctggtataactctarcgctcagaagtgtgcctggcccatagtcaggtgttcatgtagtatttttttggaatgaactaacgaataaatgtatttctcagaggagagtttccatagc

SEQ ID NO: 39837 - DNA, 201 bp, Bos taurus
gatcctggttctgctcaaaatgtcagttcccatctggccagaaccacgtgatttactcccacccacttcctcaggtaggactgaatgtcaagaattccccrttgttgacttagaattaagaagggccaatcaggattgaagtgaataagcttttatctttcctttactttactcagggtaagaaacaaccacttgtgttgg

SEQ ID NO: 39838 - DNA, 201 bp, Bos taurus
acacccctgcccctgtgtgtacagcctcctccattagcaacatctgtctctggagtgctgtatttgttaaaattgatgaacctatgctgatacaacattayggttcactcttgatgttgcacactctgtgtatttggacaaatactagattggtgcaaacataattgcagtttttgtattgttgaaatttgccatttgata

SEQ ID NO: 39839 - DNA, 201 bp, Bos taurus
gcccttgtcaggccccagagtccagaggcaggccagagtcggggagggctcatccaggaatgagagacccgaggtcccatctcccagtttccatgtttttrcctgatggggcattcctggcccaacctccgtgaacccagccaccaggagataacaggtaagagtaggggagaggaagatggaagggagcagggtcgggga

SEQ ID NO: 39840 - DNA, 201 bp, Bos taurus
ggtttaaggggacagatcattctagttttgcattcattgcgggatgttggattttagtctgagcaagatgggagctatggcagggttattaacaaaggagkggcaggatttgattgtagtgtatcaggcttgttctggctctgtgtgaggaattgattgaagtggggagggttccacagcatccctagcacctggcactgt

SEQ ID NO: 39841 - DNA, 201 bp, Bos taurus
gggacagggcgtttacgtgccaggagtgtgagtccagtgcgtgcacacagggacatccccgtgctcggggtcagggccccaggaggccaggcctgggaacygatttggactatcatgccccaccatgtggcagtgtgtgtcttgttagagatcatggcttaactcgctgtgctccagccagcctgcaggctcctagtggcc

SEQ ID NO: 39842 - DNA, 201 bp, Bos taurus
acacacacacaccatggtcaaattagagaaaaacttcaaatcagcccaaagacttggcacacatgcaaccaggtccagatccccaggccttggtaaattartgggtccagcagccatgggtgaaataaacatcctacagacatgaagctggctggtggccatcttccagataaggaacgtacttttgaactgtgcctttta

SEQ ID NO: 39843 - DNA, 201 bp, Bos taurus
agttctttattctgtatagaatggtggggaggacctggaggggagttttaactccaggctattttgagccgtgtagctttccttcacacttggtactaacytaccggggaatattgagtaaaaactcattgtactagaattacagtacttagacatggagtacttagaccttaaagctgctaaacccagggattgaggcaa

SEQ ID NO: 39844 - DNA, 201 bp, Bos taurus
caataaatatgtaaaacatctagaaataaatgtgataaaactttacttggttaaatggcaacacattgttttccataagttaacgtatagatttaatgacrcttgaagcaagactccaaagagattttttttaaacagggtcacaaagagtaattttgaaatgcatgttggtcaaagaattaaatggggagcaaccatttg

SEQ ID NO: 39845 - DNA, 201 bp, Bos taurus
tgactgaactgaactaaactgagggtcttccctagggtccccctctttccagggaccttggtacatttctgtctcctgctcagttcagaagctacaccttyctttggtcattttctcaacctctgagtgagctttgttctagagttgatgtttcttccctctggtctctgaaatgtgtgatgactgtattcctggcctccc

SEQ ID NO: 39846 - DNA, 201 bp, Bos taurus
gaagcccactcttgctgagtgacctgtgtccaccacatcatcttttcaaatgtattcaccagaaatatggaaagtcacataagccttgtaaaggccgatayagtgggacttccctggcagtgtagtggttaagacttcaccttccaatgcaggggctgctggttcaatccctgatcggggggatgtaaaatcccacatccc

SEQ ID NO: 39847 - DNA, 201 bp, Bos taurus
aggagccctggtttgttttagtggagggtggtgtttagaaactgtgatctgggggcttcctgggctgctgttactggggtgtcattacttctaggccttargaaggagctaggacatgtttgtataaacagccacttttctttatttgcagtggttgtgttttataaagaaactacaaacaccaaatggacgatttagggg

SEQ ID NO: 39848 - DNA, 201 bp, Bos taurus
tggttttcttattaaggtgagttaaaaattctcaagaagtcttctaataaaatcctagtttataattattatttttatgtccatcagatatgttttttgayctttcttcttttacaacatcacttttccttccattgactccttaggtttggaattacattcacttattaaaactcctcaagagacattttggtgccaata

SEQ ID NO: 39849 - DNA, 201 bp, Bos taurus
agaaggagaagatgggaaaagaatcacggcctgcaaatccaaatctggaatcctggtcctggcaactctgagctgctaccaggtcaggcctctgttccacwcccgctgaagtgaggaagttggataaggactgtgtgttctttaggttaaaattaatatgattctctggccctaaaatggcccaaactatccacataaaga

SEQ ID NO: 39850 - DNA, 201 bp, Bos taurus
aagatatatttaccctacaacccaggaatttcattcttaggtaagtctagagaaactctaatacacgtgaaaaaagaaatatccaagaatattcatgatarcatgttttttaagagctagaaaactacccaaatatctatcatcaaccagaaaactggtcacataatttgatatttctgtgtgatgaaatggggtgaaaaa

SEQ ID NO: 39851 - DNA, 201 bp, Bos taurus
taccagcagcggctgcaggctctcttcttcaagaagaagttccaggagcggctggctgaggccaagcccaaagtggaaggtatggcccagggctggggagyaagcccggtggggtgggtgggagtcaatggacaggcacagagggaaactccttccttattcttgatgcacccccaaaaccaaggccaggatgtgaatcca

SEQ ID NO: 39852 - DNA, 201 bp, Bos taurus
accacagtgggggactgtctggcctcaggcatccattcctccacttccctcctccagcgcccactgagggtcattgcttccttccaacctgcttctccccragggcagaaggcctgctggaccaccatattacatcactccaggattatatcactccaggagctgccgttctcatcatgctctaggtggatagcatctcct

SEQ ID NO: 39853 - DNA, 201 bp, Bos taurus
ttccaggagcagaagctctgcgaggctggggagagagcccagggaggcatgaaaacacagcggtctggactgcaggccaggctctgccagcagttcacttygaagattgccctggggcaaactgccaaaccctttctggatgccagcttcctcaaccataaaatggaaccgctggtgcttctggccctccctctttccagg

SEQ ID NO: 39854 - DNA, 201 bp, Bos taurus
gtgtgactagtgacagacccctcggatctctgaccacaggtcctgacacacctacctgactagtcctttttgtggtctaaatacttgtctgcatcttgatsggagaagaagtggtcacaggccaccatctgcttggaacttctctcctcttctctgccctctggtgctttcagtctgtatccccatttatagattccagga

SEQ ID NO: 39855 - DNA, 201 bp, Bos taurus
atcttcagcagtgagagaagggaggagcctggctttgctctctcttttctctacaaatgccctccaggtgatcccactgtgcggctggggctgagaacccyaggaaggcccactgcaattttaaagttccgattcttactctaaaatccctcggttttttagaagtactgtgtgttcttatcctctcccacagcccccaag

SEQ ID NO: 39856 - DNA, 201 bp, Bos taurus
cagaaccaacctcatctcctgcccatgtggccatgtccaccccattttgttcctgactagatctggggagcctggatccctctttgagacagactgggacytggggcccttcgctgcagtgcttgcacctggacaaatgtctcctcgagcaacggcatacaaagaagattcccttctccaggggatcttcctgacccaggg

SEQ ID NO: 39857 - DNA, 201 bp, Bos taurus
gatgcagatacatccaatctggatacccctgggcacctcgatatacaaagacatctattctcacccatctctttcactcactatgcccatgctcaggccarccaagaccccacacagacatgcagatacacacagccctgcggtatgagcttggatatgttggtgaatgaagctgaccaagatccctgccctcagggaggt

SEQ ID NO: 39858 - DNA, 201 bp, Bos taurus
ggccatggcaggattttgagcagaaaagagatttaaattttaataggatccctccctctattgtgtctagaatagactgtgggggtgaggagtaagtggaraggcctgagaggtgataaagcaaagagtggtgaagagcccctgaccagcgatggcagagtggctggtgagaagggacccactgagtatgggagcagcttg

SEQ ID NO: 39859 - DNA, 201 bp, Bos taurus
tttttgacatctcagttgattttgaccatttgggccgcttgtttttcctcttcctgtgctttagattcctgctcttaagctttaaattcaccaatagtgtkcctgcacaaccctaggcccccaccctcaaccccaaaagaagccaaacctcaggccccacgtgtgttctccacccctgcccctcccatgacctcactgtgt

SEQ ID NO: 39860 - DNA, 201 bp, Bos taurus
catcactcagaaaatttccaccacacgttcatccccacgctacaggtctttgggagcagccctgattccacattttcatccctttggccatcctggaataygagcaataactcagcctttgtcacaggcggggacactgaggaccatccagagatgctaagtgatttggccaacatcatcacacagtgaatcgaggtctga

SEQ ID NO: 39861 - DNA, 201 bp, Bos taurus
ctggagaattcccgaggattctggggggctacaatccatggggtcacgaagagttggacatgactgagcgactaagcacagcacacacatcagtagctgcraggtcatatgtaagtcatttaacgtcccagagcttcaatttcttcatctataaaagggaggtaattttgcctacctgaatggcagggtttttatggaata

SEQ ID NO: 39862 - DNA, 201 bp, Bos taurus
agggcatgtgggagacaacctctaggagcctaactggtgagagctggtcaccaccacccctgcccctcatgtgatacaaggaagaggcacttagatagagygggctccctgttgttctggtctatatggctttgaggcgcttggtcttcagtaaaggagctctagttttcgtcccttccagtaagtggtgatgcacttctc

SEQ ID NO: 39863 - DNA, 201 bp, Bos taurus
agcgtcaaggaaagtttccttcccagatcctgggtgagacctgtcagctgagacaggtgatcatgtgaggagcatctgcaaaagggcctagagaggaggcrtcctcttctgggagggactgggcaacctctgggagggtctttccatagaatctgggaggcaggaacaatgaaggagaatagcagtgttcctgccctgtgc

SEQ ID NO: 39864 - DNA, 201 bp, Bos taurus
tactaagatcccagtgcctctgttttctcatcacaagtggtcacaagatgtatctcaaagctttgaggggcagagtaatgagaacatgtatgcaacccccyggcccatgtccataagcggcaaagattcattcctctttctttttttttttttaattttatttatttacttagttggctgcaccatgtcttcattgcaaca

SEQ ID NO: 39865 - DNA, 201 bp, Bos taurus
acaaatagggacgggggagaccgcagcccaactcgccgcgctttggatgaggaggggactcggtttgctggggtcgcatctcggaggttccggggccagtrgtctcctttccttcatccctgggtcggctgggtcatacgagaggaaaacttcttggggacttgagagcgtctagaaacggcctcctgtgattttgtgcgc

SEQ ID NO: 39866 - DNA, 201 bp, Bos taurus
gccaggatttgaacccaaacaactagctccagaacacactctttcctgcctacattgtgatgttgtcccgtgcttagcacagtagtgaaccacagtccccrgtacagaggcctggcctgatggttctctgggctccgggagatgggggttcttagggccatgtctgaacttctccaggagcctggggtcccagccagtgac

SEQ ID NO: 39867 - DNA, 201 bp, Bos taurus
agacctcatataaaatttaagaacaacacagtactttttttttaagattttttttaaaatgtggaccattttcaaagtccctattcaatttgttaaagcaytgtttccgttctttgttttggtccactggccacaaggcatgtgggatcctagaaccccgaccatagatggaacctgcacccctggcattggaaagccaag

SEQ ID NO: 39868 - DNA, 201 bp, Bos taurus
actgtcccgtcgggagcttgactagctctctctgcctcatccaccgccgagacgagttaggacgggtcctctcacttcttcccttccaggccatccgagcmattaacccctgcagcgactcgaccatgaccgccgaggagttcaccgatacagtgttctccaagattgacgtcaatggggatggtgaggccgcgctggggc

SEQ ID NO: 39869 - DNA, 201 bp, Bos taurus
ttttttctgtgtctggtagagatgcagacttgaaagtggatgaacattagaagtgttttcagtgatctttggagtttgggtgttatttttccttcctcacwggattgttaggataaaaagaggtatagtatagaaaaacacttagggaactataaggaatttttatatgtaagattttttaagccgaatactcagtcttaa

SEQ ID NO: 39870 - DNA, 201 bp, Bos taurus
gcctctgtcctctcgcaccaatgaggacagggcacaactcttaccctaacactcgccctgaccatgctcctcgtgtttgctggatcttgtatccttctctktcttcatttactctctcacgttgcatgcctcagcagattcctgaggaaaggtgcctggatgttaaattttccatgtctgaaaatacattgcttgtatccc

SEQ ID NO: 39871 - DNA, 201 bp, Bos taurus
ctgatcttatcctttaggacgctggcttagcgggagtaagggatgtatttcccgagacgctcaagaatgaggtagcatgtccaccaccttctcaagtgctygtgtctagctggttccccaaccctaggacagatgcagtaggaacggggatcctattcccaaagctggaacagatcctggattctcatctcatttcagccc

SEQ ID NO: 39872 - DNA, 201 bp, Bos taurus
gggacttgggcctccttgggttttagaatccatggagatcctggaaccaatgccctgcagatgacagggatgattgtatatgtttctgtcgtgggcaagcrtgattacaaacaggatattttggcccatgatgaggtgttctaaattcagatatgttgtggagtgtggttgcacagatggtaatttttacccacccatctc

SEQ ID NO: 39873 - DNA, 201 bp, Bos taurus
tttttattatactcacttttttcttctgattttacagaagaaaaattaaattaaaatattttgtgggcccctgaaagtattgcaggcctttggcactgtgyctcctgtggatacgactcaagccacttagcagcagcagcagctcctgtggataagctggccctgtctctcatccattgatctcaccttcttttcagcagc

SEQ ID NO: 39874 - DNA, 201 bp, Bos taurus
ggagagcctgcccgggccccacccgtgttctgctggctgcttgcctgccacgcgcccaggatcgctcagggctttgctcaggtatctcgggaacagctgcrccggaaactgggggccagggctgggaggactgaacccaggctgcctcagtaggatcagctctctgtgcggctgttcactgacagtcaagggggagaggag

SEQ ID NO: 39875 - DNA, 201 bp, Bos taurus
ccaagcgagcctttgtaaagcctgattgaaccataggctaagacaccgggtctgccctgtagagttacttccgtgaggccaaatatcccttctggaattcrccctgctatctccactgcagttgcatggtggctgctggcagtgactgttggcagtattgtccttgtgccatccctgccctcctgcctgtggccattcctc

SEQ ID NO: 39876 - DNA, 201 bp, Bos taurus
tggccattcataaagacccattactccaaacaaccaacctgagagcccttcaactgcgactccacacacacaagggagtgacaactggccagaaaggcccygaggctttctccagagaacactacagtttctaatcaactcaaagacaaactaagctctccctaagagaaaatgcgtcaccccatgcacggatctacttgt

SEQ ID NO: 39877 - DNA, 201 bp, Bos taurus
cttccagatgtgccagggcacgagagagccgaaggagcctccggcccagtggtctcctgccgtggctgggaggctgggaagagctggcctctgtgtcccaracttcaggactgccaaggcagctgggcagatccctactcaagagcttcatgcaaatccatgtgagcagggcaagaaagacttctgtgctgcacctgcagg

SEQ ID NO: 39878 - DNA, 201 bp, Bos taurus
aaagcaaaaacctcctgttctttctgctcggccagaacccaccggcagtgaggctcttggacaccaggtggcgcccaagtaaggccgaacgaggagcttckggacaggctcgctctgaggggaaacagcgaccacaaactcagatggagaggattaaggtgatggacggccaaagagacgtgtcctggctctggtagggtg

SEQ ID NO: 39879 - DNA, 201 bp, Bos taurus
cttgcttgctaatcaatgtggtaccatctgtgattgtcattaacaatatccaccaccacagattcagaaggaggggaaatcgcaatgccttctgtgtctcrggagaggcctgtggcttctacctgatgtgcccagagcatccatctgaaggcctggacaaacccagtctaatgaggttgttaacaagggtggtcacaaggg

SEQ ID NO: 39880 - DNA, 201 bp, Bos taurus
cattaaaaaggaattttacattattaaggcttgaaagcaagtcctgttgttttatcaccacagctaaaagtcttgaggaaagtcaagtgaccatcactggragtgtttttataaagtgaaatgtttgatcttttataaaagctaggcttctttgctaaattagttaactctccagcttataaaatgggatagccaggtggt

SEQ ID NO: 39881 - DNA, 201 bp, Bos taurus
atagtgaggagaaatgtctgcttctctctgtacccctgaccccagctcagagtcgacgcctctaccgtctacttagagaggccctgacagcactgtgcagmttaccacctgtgcagagagaaaaactcaggtgtgtgcacagacggacagaaggcatcccagcaaaggcctagaaatgtcggtctacatgggaccttcagt

SEQ ID NO: 39882 - DNA, 201 bp, Bos taurus
cagtgaatacagttgaccgtctgggttttccattcatgactggttggattcatgcatgtaaaaacctgtgaatatggagggccagctgttaagtctttgayggtagaaaggaagtctaaaagggatgtggtgatgaaatgcatttcaacagctgttgcttttcttccgaagttactgtggcatccaagggcctagactttg

SEQ ID NO: 39883 - DNA, 201 bp, Bos taurus
aggctctctgctcagggccacacagtaagcagccaaggggccaaatagagaattccaaccaggatgtctgacttggagactgggcttgcttccttctcgtrtgcctccgttaacaaaggagacctctctataagtcaaaacagcgtcatcctgtctgggaaaaatgaaactgtgtggaataaaggccaacactgcataacg

SEQ ID NO: 39884 - DNA, 201 bp, Bos taurus
gtgagttggggaggtcggtgaagtccgtgatggcttgaaaggcctcctccgtgaaacactgagtcacagcccagtctctgtctatgcagcagagcaagaaragtcctccatcttccgggatgtggccctgctgccccaggctcctcatcccaatgaagtaagaatctcccctcattcctgaggatacagaaacagacgtga

SEQ ID NO: 39885 - DNA, 201 bp, Bos taurus
ttaaatccaggcactctcaagctgtgtataaacaaagctaatataaatggagggctgactaaatacaacctatctggataattcaggccccaagtcaatcrtctaaaaaagattattttgttctgcctggttggttcactgtatatggaactaaacatctgccatatgtacataccttttctggtgcacttgagaaaattc

SEQ ID NO: 39886 - DNA, 201 bp, Bos taurus
agagagtagaatatgatccaggcaccagggaagcacaggccccataatccacacctctggcagggcttttggaggctctccaggccacggtgggagattayagaagctgggaacagcagtagctactctcaccctagggcatctgagaggtcaagttttggaagccaaggcagttcattattagttggccactgaacaaaa

SEQ ID NO: 39887 - DNA, 201 bp, Bos taurus
caataataagagcaacaaagacatccaggccaagggaaaatgaattttttttaagctcaccttcagctgttccacatcaaactctaaatctagtacattcrtcactggcctcccgtgatcaatgtccagaatcaaactgagagcttgagaacattcctttgctcgttgccgtaactaataggatgattgtaagaaggacat

SEQ ID NO: 39888 - DNA, 201 bp, Bos taurus
tttgtgatgcttccagtttgaggtcatcatggttaaaactgcagagaagttttattcatagtaaacaaagatatggaaacagttgaacagataaagaaaaygtagtggatacacacaggggcatattaaccagccttagaaaggaaggaaatactgtaatatacaacgacatgatgaaaatgaaggatattacctggtgtg

SEQ ID NO: 39889 - DNA, 201 bp, Bos taurus
gtcaataaaaacttaaccaaaaaaccctaatccattaccaggtaggaaataatagatcaaaaacatatgcttgtctcccaggcctaattgctttatatctrggtctgtgtagaggggacagagagggcaggtcaaaagtcaaagaaacaaatctctgactatgaggctcagggggtttgtagactttgtgtttgctagagg

SEQ ID NO: 39890 - DNA, 201 bp, Bos taurus
gctggctgatgtaaacaccgaggtggaatgattgaagtttggctctgcctgtccctttgtgtgctgtcttcagccaaaggcctgcaggctttcatctgctragcccagccgtgttcaacaacatttttcttcctgcctgccttgactcccaccccttcctctggccgatgtctcaaaggaaatacctagcaaggtctgaac

SEQ ID NO: 39891 - DNA, 201 bp, Bos taurus
tgcagaatcttgaatttgcacttaacaggggcctttgataacacatgtaccactgccacatatggtggagaccacaaggttctggtcatgtccctgggttkggccaggtccctccatgaaggacaaaatcaagttgcatctcaggactaagagtgagttagaggtgactctgtagttttgaacctgaatgactgaggtgtc

SEQ ID NO: 39892 - DNA, 201 bp, Bos taurus
gtgttcactttacagttttaggagagtcataattttaccattttgaaatgctttatcattggaaaggtataaaaattattgaaagctagtcctgtactttraagaatgagcaaaaaattagagcatgacttccttaatacatgtcagtggatagatgtactgatgataattcctatcaagtcctcccaaagaactgtaaaa

SEQ ID NO: 39893 - DNA, 201 bp, Bos taurus
cacacagcctgtcagatacgcatcgtacatcaactttaactagtcaagaagagaacacattgaaaactcaaaacggactaactggttcaggcaaaatggakccgcatggccattgtgcatgtgatttcagacacattcctgcgtcgccaagaacttaaattttctgaactgtatcagactcaaggacaccaccagctgttc

SEQ ID NO: 39894 - DNA, 201 bp, Bos taurus
gtgattaaaagatttgaaaggtgttcttgggctggacacgaatagaggatggaggtgctggcttaaaccttggttattcaatacaatatacttttactaargtgataagaaaaggggcctcctgctgagggcaggtttctgcaaagagctccttacaacactatctctattgagcctttttttggtacctttttaaggtag

SEQ ID NO: 39895 - DNA, 201 bp, Bos taurus
acaagtctcaaaaaatggatgtgcccagtagacaccaacaatataggtaagcatccatttgcccttacattccaccaaggccaggtattaccatcttagaycttccctttttccctgtggacacagaagttcagaactctatgatgagagcagagatgagtgatgggggcaggggtatggatggacagacgtatggccgat

SEQ ID NO: 39896 - DNA, 201 bp, Bos taurus
gaactgaataaagggtagatgggagtgagagggagaaactaagatttcaaatttcactctaacagggagtgggagaggaggaaggccaagaatcaagagtyctttagtcccagattcaagctcgaaacttgaattcaagctccaggcttctaaggaaacaaattatggtggttcattcattctcatgaaggactgtggttc

SEQ ID NO: 39897 - DNA, 201 bp, Bos taurus
aagttgggcctctctgctctttgacaataaggcttttctttgtttctgaatccgactccagctcctcctactgagtcaagcaacaccaggcaggagaaccrtttgctggggcctgactcagaagggtaagtattattttcactgccctaaaaatcctctctgctctacatatttattcatcccacctcccacaacccctgg

SEQ ID NO: 39898 - DNA, 201 bp, Bos taurus
tcaaacatggctgtaaattctttgctagtttttgcattaagaagttgagtctaattttcatttctttgtatctgggccggcttagagacatgcttgactartagtatgtgacagaagtgatattcttgtactgctgaggtcaggctttaagaggttccagattccacccaggcctctgagtttactctttctgagagtcct

SEQ ID NO: 39899 - DNA, 201 bp, Bos taurus
tgcctgaactcccctgaactctagtaagcagtatttctaccatctaaggaaaagctggaacactctagaatacatgttgaagaggccaattcatataaatratatctattctctcatgcaaaacagaagcctccagtttgttttgaagtaactagaggcccaacaaactatgctgattaggaagttatctctactaaaatg

SEQ ID NO: 39900 - DNA, 201 bp, Bos taurus
taaaaaaaaaaataggtcttgaaaaaagacacaaatgattgcacacaaaaacatgtgaggactttgttgctataacattttataaattcttttctctagakggtttagcctataaaagaaaactcctaagattcaatctattgatagctaggagtgttaagagtagctggaaagttggtttatttattaaaagtgtactat

SEQ ID NO: 39901 - DNA, 201 bp, Bos taurus
ctacatatgctacaggaagatcttccaagttttgaaatcttatgaaatactttcaaggtaaatgaacattttgatagtaataaataggcacttgaaacccyggatgaagaattaggggcaggtgtcatggtccaagactaaaattaaaaacctaaaacccaagtccctgagttaaaagctcaaaaccagcatgaaacatta

SEQ ID NO: 39902 - DNA, 201 bp, Bos taurus
tgttgtaagcactgtatagccggctaaaaaggtttcttccccttcagatattaacatcatatctcagatactgatcacccttaaaagttgacataaggagkggtcaggccttttccttataatttatagagtaaaggaccagaaggaagtacctcctagtcttaaagagagaactccacatttatcatgagacattggccc

SEQ ID NO: 39903 - DNA, 201 bp, Bos taurus
aaaaataatgaccatgtactctgaggtttctaatgtgtaaagtcaaatgtataagagcagtagcataaataccgggaaggaagaaatgggcatacactgtkgtaagttatagtttttatactataaagagtggtgtaatgtcactagacaatatagactgataaaggctcatgctggggatgggggtgggctaaagttcag

SEQ ID NO: 39904 - DNA, 201 bp, Bos taurus
ctgttgtgagttgggcatcttagtcacaaactagtactacttgcaagggatatgccatcacccctttggcctaggagccagccagacaatgcgcctcttgratgcccaatcctcattgtgattctgctggagcactgcctgttccctcgcctctctccaaaggtcagcccgaggtctgcactccaccgctaatgggtgcac

SEQ ID NO: 39905 - DNA, 201 bp, Bos taurus
agggattagagacctttaagaaaaagaaaagctaacatctaactctatccaatgactagataatactgtaagtttattaaaattggaaaaccagcaagctkgaggaagaacttgcaaaatattcatagtaaaaatcactgccttcaatttgcagtgaattttaataattgagactcattatgtttgacccataaaggataa

SEQ ID NO: 39906 - DNA, 201 bp, Bos taurus
ctttcagcaaccaggaagtggaaccaataggaatgaacacttacttggaaaaggaagctttaattaatatatatttctatctctaatatacacacagcagsgctagatctttatcttcacaataaaatgtgtgcaaatgctctctgcagagatgagtccccacctcagtcggtatagaaaagcatgataaaggttggaaaa

SEQ ID NO: 39907 - DNA, 201 bp, Bos taurus
ttaaaaatcttgctaattttttttgcttttttgagacatatctagtatttattatttttcaacttgaaataatacatagggcaaatgattttgggtgacamtctctaaattgataacagtttttggagcaaaaattgaatttttggtggtaacattatagagatggatggatagatggaaggatggaaggataatggatgg

SEQ ID NO: 39908 - DNA, 201 bp, Bos taurus
gccaccgcctggccactgccccattgttcgtcaagcctccagcagcaggaggcaggggacatgtggagtctctctcaccctccggccccacatccaggccytttcatcataccacagacagaccctttccaagaacttgaatggggatccacaacctcccctctgatcgctcattaatctgccccttcagacattcctctg

SEQ ID NO: 39909 - DNA, 201 bp, Bos taurus
tgattttatccttgtttaaaaaacatattcaggtacttggagaattaccaactcctccataaatttggcttactataaataccaaaactggtacctggttkgcaaaggaggaaagtggaacttgtttttatctttgatctttagcatactggtcctctctgccattattggaggcacgattccagtgttctctgcattggg

SEQ ID NO: 39910 - DNA, 201 bp, Bos taurus
aaaggtgaaccctggacatctctgactctcatgataggctgtctcactttcctttgtccactaaagccctcacccaggccctgttgctagtaaaccaaggmtccctggagcagcgagctatcacgcctgcacctctgtaccagtggcttccaagctgggcagattctggctttgttcagcctctacaggtatacagatggc

SEQ ID NO: 39911 - DNA, 201 bp, Bos taurus
ggccattttccaactgtctcaaagaaatttatataatcctcctttctactataagctatgcttataaggaaaaaaaaaagttctattttatacatggaacyatacagaaggcacagctaagttcagaattctcaagggccatatgtataagtgttagttttcctgacggagaagcctggtccctgtatatattaggattct

SEQ ID NO: 39912 - DNA, 201 bp, Bos taurus
actcctccaggagtcaccccagaatcatttcagctcgtcttatgcgtctcagattctgcctctggcaatctaagaccaccaaggctcctcacattgctgartggccagttcttctgtacgacccctggacgagcaagtattttaattaatgagtgggtttccctatgggaccactgcacagtatgaagacaaggcctccac

SEQ ID NO: 39913 - DNA, 201 bp, Bos taurus
cgagtggccggatcccgagcgagtgaccaggtgtggccgccgcctgagatgctacagcgccggcactgcaggtggtacagccaagtaacaatctccgctgyaccgggagggcaccggccggataccagccgggtaagacaccggccggataggaccccggccggataggaccgagcttcggaggaagggatgctgagcatg

SEQ ID NO: 39914 - DNA, 201 bp, Bos taurus
agtgtgcttatagaagaagagaaaatacacagacacacacatatgggtgatgtgaagatggaggcagagaatgaagtgatgtggccatgagtcatggaaargaaggatgcaaaaagccaccagaagccagaagaggcagggaagacttctcccaagagtgtccagaggcaatgcagcaccttaactttggacttcaggcct

SEQ ID NO: 39915 - DNA, 201 bp, Bos taurus
caggcaagagtactggagtgggtagccattcccctctccagggaagctttctgacccaggaagattgctggatcgaacccacatctgtgagaatcacacgrctgaacgactaacacccttatacattgtcgtaatccacacaatcttcttggaaatttgatagtgatgatcaagacaatttgggtggtgaagtgctggagt

SEQ ID NO: 39916 - DNA, 201 bp, Bos taurus
gcttttgtctttattttcactaatcctccaattcagcacagacccaacttcctcactggttgtcttctccaagagccagccttgagggcccccttgtgtcygagagaattaaaatccccagagcactgtttgcacaatggcttctgatctgctcgaataatattatcaggcaatggccctgggtattgaaatcccacccag

SEQ ID NO: 39917 - DNA, 201 bp, Bos taurus
actccctcacttctcaggctgccttgatctcagctgcaagacaaaccactgcccccctacccccggaccacccacttcccatggccatcaggcatcacagycatctttcagaacagaaagactgaatccattctttatccttcttcttcctctagagtcaagaagaaataggtctcccttcaggccaatctcctaaggcca

SEQ ID NO: 39918 - DNA, 201 bp, Bos taurus
aaacacaagtctgatctctatgtctccctcacccgctcctgaagagtctctgcatctcactcatgccgtgagcttggaggtacccaactggccaccaagayagtcatctttcaaccaagccccgatgtccaggtccagtttacctttgacctctactggtagggctggttgacaaaagaaagcaatgactgataaaacatt

SEQ ID NO: 39919 - DNA, 201 bp, Bos taurus
gccattctaacatatatctgcaagattaatggccttttaacttcatttcctcacctctcttcaactctgttctgtagaagaatctagtatccagaccttgmgaagatggctattttgaggcctttgtctgactagtaagccatcttcttaatctgctgtctttcctaataaagtcacatcccttgcctcaacctgggaggc

SEQ ID NO: 39920 - DNA, 201 bp, Bos taurus
tttaacattttttgtttgacattggccatggagctaacaatttgtccagtaaaaagagagttattagcaatcactagacaggctcaaagagacgaggtagmcacaggtgctgcacaggcgcaggccataccatccttcaagtccatgaaattctccaaagcgggggagaggttttgaaaggtgtttgcatttctggtgtcc

SEQ ID NO: 39921 - DNA, 201 bp, Bos taurus
aatggttggtgtaaggaaccaatataagcatacaaagttggtgttttaatctgtagggtttattattatttatgtgtgataaggccaatagataagtagaygactacagtgaaaacatggtttgtaactcacaggtccccagaggacaggacataccatattaggcaaggtcacatggggaatcatgagggtctgggagaa

SEQ ID NO: 39922 - DNA, 201 bp, Bos taurus
tctggcctattctctctaataagccaagagttatccaatcatctgcaaatcaaacagttcatagcattatggaagaataacaactcttatatgccacttamtatgtgccaggccttgctctaagcattttatagtattatttaatcctcccaacaaaccctatgaggcaagtactattattactcctattttacagttgag

SEQ ID NO: 39923 - DNA, 201 bp, Bos taurus
cccaggtaagataccctttgtgattccctcatcctttgagaaaccctcaccgtcccattgtttcccagaaactgtgcagttcctcttatcctcaagcctcytccacctgagtgcctgtgtactcctctccccctttgacccctgatatgtgctccttctcccttgcccagtgaggggtttttaccccatgtccttgggcgc

SEQ ID NO: 39924 - DNA, 201 bp, Bos taurus
gcttttaacatgaagagtgctgtgagtgatgaaggcctacagggcaagattagtgagtctgataaaaagaaaatactgagtaaatgcaatgaggtcctttygtggctggaggccaatcaactggctgagaaagatgagtttgatcataagagaaaggaattggagcaagtgtgtaacccaatcatcacaaaactctatcag

SEQ ID NO: 39925 - DNA, 201 bp, Bos taurus
cgttaggcatactattttgtgtaagagccaacctgtggagacactggggcctaaggatgtatatctcacactgagtctatggccacttattcttggttagraaaccctaggttagaatgaaatggaggactcatttggattcgagagtgggtttcaggcaactctggttcctgggcacaggggagcagaggtgcctgaggc

SEQ ID NO: 39926 - DNA, 201 bp, Bos taurus
cccgaaggcagctttaggtgctgataaaggcctttatgctaacttggcgagtggtataacacaggtgtttaagtttacaaaaacccatctaaaagtgtgcmaacaactctatggccaaaatggtttaaaactaaatacggcaaaaccagtgtgctttgtctctaaggcatatctgttttcaagcccataacttctatttgt

SEQ ID NO: 39927 - DNA, 201 bp, Bos taurus
ctgcaacccagctcttttaagagtacactaccataagacaaacagcccctccactccccagagagccctaaactcactggccctcaggtccctcctcatcrgagtctcgtccatcttcctcatcgctgaacttgagcttctcagtgtagtcgacctcctcgtgggcccctaaggggaaaagtgaagcatggtaacccaagc

SEQ ID NO: 39928 - DNA, 201 bp, Bos taurus
agaaccagaagggctttcaaatgagggtgaaatgtgagtgaccagagggcaactgaggacatttccaacgtctccatttaggagggaagggagggcccttrggtacaggagcagagagccttgcccgggtctggatgagattcacccccaccctcacccatcctctgacaatacctcatcccacatcacactgaggggccc

SEQ ID NO: 39929 - DNA, 201 bp, Bos taurus
caggacactggagagccttccatagcacccctcagtcgggtcccgcctagttccaggtattccccagatcaaatctctccatctgctctaacttctcatgmtcactttggcctccttgattgtcctactgtttgttctccactctagggatatggagacacctctaattcccttggggaactaataaataccagatcctat

SEQ ID NO: 39930 - DNA, 201 bp, Bos taurus
ggtatttccagctcactggtaacttcctggaggcagcaatatctttggcaggaagccatctcttctgtcaccttggccacaaggccctgctccaggccttraattgataatccacaggagtggacccttctcctgagtcattccctcctggagaggcaaggatagaagagggcagctcttaggacccattggcaccctcac

SEQ ID NO: 39931 - DNA, 201 bp, Bos taurus
tacccttggggtccacactaatttgttggattgtataaatattctgaccaaaaatgttttgaaaatcgctgccagaagcccttgggccaggactcagggartgtgacaaaaagctctcggtgcaggagaggagggatcaggacaacgtcccaggttccccggcgggcaagggtctcagggtctcagaatcaagggccgtgt

SEQ ID NO: 39932 - DNA, 201 bp, Bos taurus
catttcagggccaaatgcttaccactaggaagccaaatccaacaaagagtgcaacagtgacagtggtagcagccagggaaatgaggatgattttgctgggygtcaggggccccgggggtttcgctgctgttactgaatctgttccctccagttgagtgtctggatgtttagtggtgtagtcctctgtggtccccaggtctg

SEQ ID NO: 39933 - DNA, 201 bp, Bos taurus
gatggtactgcggatggtggaggcagaagattgaggaaatgtgaccatggctgatggagaagtgggagatctattcaattatggaagtggccacccacagrgaagagggtgtgcaggaacagggtctgatactcttgtgatctagtcactgggtataaggatagtgctggaggaagagatgacagaataagatttacccat

SEQ ID NO: 39934 - DNA, 201 bp, Bos taurus
ccttgccctgtcagccacctctgaatccccaccaggtgccttcctgggtggattcgataagatgacctgccctctcccagtcctctccttcacccgtctcrgcatcagttgttttctatgaaaacagtggattggttaggttttgtgcagggtcttgggttagagccacaatggatttgaggatgagtattttctttttct

SEQ ID NO: 39935 - DNA, 201 bp, Bos taurus
atctgagtgtttgctatgctgactctgttgcaggtggggcaggagaaggctgtgaggagctgagtgtggacggggcctgggcccagtcagagcatcatggsctttgatatggtcgctgctgttatcatcctctcaacatctttgtccttgtctcttcagtagaaccttgtctcaccaggacctgtgatcacaaggactgag

SEQ ID NO: 39936 - DNA, 201 bp, Bos taurus
gagttttcctctctcatggaaggacgtagtgtctgtctttcaagactctttcatgttgcagctgatatcacagaaatacaaaggagtatgaaagaggactmtgaatgattatacagcaaacaaactggaggaactagaagaaatgggtttatacaacctgccaagacaatcatgaagaaacagaatagctgaacagatcaa

SEQ ID NO: 39937 - DNA, 201 bp, Bos taurus
agtcctcatccttggggcttatgtactcctaagcctccgcttcaggcttctgaatcttttcttcattcagggcaattttattttggcccagagcctccacrtgtgcatatccacagccctctgtctgctggtccaccctaaaagaagtactagaggcctggaaatacagtgtaagtcgttcatttgtttttttctatttca

SEQ ID NO: 39938 - DNA, 201 bp, Bos taurus
gttcagagcgtttgacttgccccgggccactcagccaacaaaccccaagacagagcccagcacccatgtttccagcctccaggcactccccttgcagcagrctgctccagacagacagatggccagactggagtccttcctgagactctaagaaacccacctgcatttcctgcagtatctcctcctgaattctgagctgtc

SEQ ID NO: 39939 - DNA, 201 bp, Bos taurus
aggccaattcaaaccctttgcaaaggcctttgccaggtctccccatctcctcagttgctggaaggtagatagccccaggatggagcctagtcacccttggkggccagaccaggcatggataaagcttaaaagagacagcatggaagagaaggtgtctgaccagccaaagccagtggaacctgtacagaagctgctccctca

SEQ ID NO: 39940 - DNA, 201 bp, Bos taurus
gctctctctctctgctttcatttcattctctctgctgttcattatgcagagtatctatttattaaacttctctgcttgcagttctgagcttgcagctgtgyacactaaggccatcggaaccagttaacccctgctctagtctagtagcttctgatctttgacgcgcatgtatagttaaagatgttgaatgtacagaggctc

SEQ ID NO: 39941 - DNA, 201 bp, Bos taurus
aggtggcccccttttgaagaggtcccctgaaatattttcacctcctaaatgacctgagccctgcagcccaagtgtcctcatttgtaccaccccatggtcaycttgctcctcctccctcacccaaatctttggttttcagagttctgaattttggtgttacagggttgtgttgttttctttgaaattgtactctgcttcact

SEQ ID NO: 39942 - DNA, 201 bp, Bos taurus
tctttaacgctctggtacattctgtcatgactgcacgcctgaacttttgccactctcaagagctcaatcacttcttctgtgatgtcaagcccctcttggarctggcctgcagtaacacgctgctcaaccagtggctgctttttgttgtcacaggcagcgtatctatgggagctttcttcctgacgcttctctcctacttct

SEQ ID NO: 39943 - DNA, 201 bp, Bos taurus
aaaaaaggccctgggttttgtctgacttgatcttactcaagcctgttctgcctcttggaatgtctggttctaaacggctgtttaaggagatggagctgacraggatttctaagtgacacttggccccaggacagactggagttaggaggagtttctgcaaaggtgttggaggaggtaatggaaatggtgagctagcagttg

SEQ ID NO: 39944 - DNA, 201 bp, Bos taurus
aagaagtaatacatgggggaatggaggcgatggtccaaggtagttatggtgataatgaggaggttgcctgtcaaggccagcaggtatgtcatcaaaaacarcagtgcgtgtaaaatctgaagcttacggtcagcagaaaaccccacgaggaggaatccactcactgaggtcaggttggccatgtcactctgaagatagcaa

SEQ ID NO: 39945 - DNA, 201 bp, Bos taurus
agtatgagtggtcctgtatcttaacagttagaacgttttttcctcctcctaacactctgattttttaaatacatattcattggcagttcagtaattgtccrtgtctgcaaaaatggagtttgtatatcttgatatgccaccctctcttacatgtatttttggctttgtgtgtaatgtgctcagtcgtgtctgattctttgc

SEQ ID NO: 39946 - DNA, 201 bp, Bos taurus
tgggactttcttcttttttcctatgactcccagttctacattttcaaagcctctttcattactcatctgctgtgccgattccctgaacgccgaggcggccrcagctcccgaggcattcacggcttctccctcctcacagctcgctggctcccgctccatcgctgtcgacgccacaggactgctggcgcggcaggtcccgcc

SEQ ID NO: 39947 - DNA, 201 bp, Bos taurus
cttaacagagtgaaccaagctactttcagtttctgtacttttaatttttgataggttcggccagtgagaaagggcatgagactacgatcccaatagcccgmgagctcaggacagtctgtaatcaccgagtctgtgtacatgtctttccgtttccatcaggctccttttgctgccaggacgcccctaggttaataagcgttc

SEQ ID NO: 39948 - DNA, 201 bp, Bos taurus
gcttttattcctaattgcagactacaagacttttttgatcttatctttcccaagacactatgctgacatagtccagagctccttgttttcaccccaggccrttctcttttgggctagtcttgggaacgatcagcaagtgcgtaggcagcattcatgtctgatgccaatctggtgttccaaggtccattctttcatgatcca

SEQ ID NO: 39949 - DNA, 201 bp, Bos taurus
tgggcaattagcagctcaaggttggaaaaaagttactttcaggcagaacccatcctccttatagcaacacagaactaaaggcccctgctaagtagttgaartgggagcaaaggaatgcaggggaaaaaagtttggcggcttgccagtttgtctcctcctggggcttggggaccacaggcctccctaggcagacttgcctag

SEQ ID NO: 39950 - DNA, 201 bp, Bos taurus
catcaaaaatggtgcctgaaagcaggcataacatactttcttactgagatcatggggaatgaacactcttttgggtaattagctgggccaccaaagggaakagagtatattcttaggggaaatcttgcagtaacatcaaatgattgagaatcaaaactcttaggttcttttcttgctttctgactggggccacaattgtcc

SEQ ID NO: 39951 - DNA, 201 bp, Bos taurus
atcgaggtcaaccttggcccgtacggggatcgaacccgcgaccttggcgttattagcaccacgctctaaccaactgagctaaccggccaggacgacacctytgcccttcacattacaaacgacacttaaacagcatggttttgcagtttactgtgggaagcataagttgcttccattctttttctcgtctttcttcattgg

SEQ ID NO: 39952 - DNA, 201 bp, Bos taurus
agtttttcttcctgtatagcttttaaatcatttcacagcaatcttcctcctaggaatgtacctcagtgaaattccagctcaactccatggttggccttgtytaagtgcaggattttgcagtaccagattattacaggcaagctagatatccaccaggtatacgtcagtggccacccatgaatttcatactatgtagcagct

SEQ ID NO: 39953 - DNA, 201 bp, Bos taurus
tcccatacagcatctagtagggtcaagatctcttccttgtttttgatgtctttactgttagctgttaagagccctttctccttgtatagggccccatgtayattgcaaagtagcaaaagcatacctggagtcagtgtaaacgttggtcttcttaccttttgacaactggagggcccgaatgagagcccataattcagtccg

SEQ ID NO: 39954 - DNA, 201 bp, Bos taurus
tgatcttgatgttacttggatcttccctgggtctccattcattgcctgcccagccaggccactatttggggctggaagatggagaaagaccactaagatcytcttttatggagtcctgggtctgagaccataagaattagtcactcaccagcataggaccgagcttttttccaatctgcaatagaaaaaagagacgtgagt

SEQ ID NO: 39955 - DNA, 201 bp, Bos taurus
ggtggccctgaaaagggccgttgtttaataagcagaagcttcgtaactacttggcaacttagccgccgaagccataaagggtgcgcccctggcgcttgagygcgtagaccacgtccatagcggtaacagtcttgcgcttggcgtgctcggtgtaggtgactgcgtcccggatcacgttctccaagaacaccttcagcaccc

SEQ ID NO: 39956 - DNA, 201 bp, Bos taurus
aaaatgatacgtaaagccaacaatatcaaagttgcttcttttaaaattaataaaataagatcaagaaaaaattatcaatataagaaatgaaaaagggttcrttgtagttttagcccataataaagcaacagaatattgtaaacaatattatatgtattataaattataataaatattataaatatttaaatattataaatt

SEQ ID NO: 39957 - DNA, 201 bp, Bos taurus
cttgagttcttgctcctgaaaaatggagatgatgctggcagcttgaaggattcttgtgaggtttcagtgaattaattcatataaagtgctcagtacttgayagacatgccttcattatgcagtgatctctcttttatgtatttgtttccttttctatgtgtgtgtgctaaagtactaggttgaccaaagatgttttggaaa

SEQ ID NO: 39958 - DNA, 201 bp, Bos taurus
gcgaagtcttttgtcatctgaacccccagggaatgccaagaattcgggagtgggtagccttcgctttcaccagaggaacattccggacccaggaattgaaycggggtattccacagatctttactagctagctactgtaaagtgagcccagctttttcaagtgtattaggtggctctgaaaagagcctttgggttgttgaa

SEQ ID NO: 39959 - DNA, 201 bp, Bos taurus
gcttgtcctctgagcacaagcctgacggggaggctgagctgtaaatatcagggctttgctgcatcaacattcatatcacaatgcaaggagccaagcttccrctctgagagtttccaaataaggccctgagaggatggttcaggtgcaaaaatcaaattctacttggtacttaaattcctcagcattctaggctgccaaacc

SEQ ID NO: 39960 - DNA, 201 bp, Bos taurus
ggtgggacactgcttaaggaggaggccagtcccttaaatttatttactttaaatagtgtaaactatatacagtagccaccccccttattcttggggaaacrttccaaggcccccagtggaagcctgaaagcaggcagtactgaagcctatatatatatgctatattttttcctatatatacatgcccataatagagtttaa

SEQ ID NO: 39961 - DNA, 201 bp, Bos taurus
actctgactacctgggggccaggctggtgggtcctgccgggcagagagacagaccgcaatgagtgaagaccatggggtcagacagacgatcaacgctgtcrgcttctggcctccgtggagtacccttggaaaggggttgaaggattttaagggggaaacgatccacttggatctgcatttcagaaaaccatgggggcaact

SEQ ID NO: 39962 - DNA, 201 bp, Bos taurus
cacaaaaagcctaagggaagactttggaactaggattgaactagcaaattctgcttttctgagactgttgagggacagtttgttctttaatttcccccagrgataattaagtacacagtccaaccaaaatgctaaaaaaatatgttaattatatttgtaagaaactctcacatatttcatgaaagtatattattcttttct

SEQ ID NO: 39963 - DNA, 201 bp, Bos taurus
ggtgtgacagaaaacaacaaaattctgtaaagtaattatccttcaataaaaaaaaaaaaaaagaatcttggacgtaagtcaggatttcctttaatgtcaayagataacatcttcaccagaaagtcacttcagaaaaattccttattacactgcatatgtttgatatcttcaaaatcaagatttacatttttcctactcctg

SEQ ID NO: 39964 - DNA, 201 bp, Bos taurus
ttcatttccatcaaggtacggggtcggcactgctgtgtgctgtctttgctgctgccacagctgaatagtctgtcatggagacctgtccctgagacgtctgyctgctgcccctgcaccccccagaccgctgtctgtgcttgtagcacatccccagacccaccctttgtgtcagagcgggcagtgcaaatgtgagacgggctt

SEQ ID NO: 39965 - DNA, 201 bp, Bos taurus
aacacagctggtatactagttaggatttttcagagaattagaaccaaaaggataaaaggagatttattatgaggaattgtcccacacaataatgaggcctragaagtctcatgaaccgccatctgcaggctggagaccctggaaagctggggagacagttcagtctgagtctgaggcctgagaacgggggagccaatgcta

SEQ ID NO: 39966 - DNA, 201 bp, Bos taurus
tcctgcatttccagtattggcaggtgggttctttcctgctgagccacctgggagtcccttttagttctattgttcagctccaagtcagaaagaactgctayccaaagttgattcttcctacctttacaacttctgccccctagtgaaattttctcctgctattctttctagctccaagctttcaaatatctgaatcttccc

SEQ ID NO: 39967 - DNA, 201 bp, Bos taurus
acaatatttttttcagttttctttcaattttctgataaaagctgagtaactttgcttttcacgtttagttttagtgccacctaaattacaatttttgtacrgttgaggtaggaatcaatttttaattgctccatctataggaccaattgtcttggcaacatgtatctttttcctattattttcaaatttcacctccactat

SEQ ID NO: 39968 - DNA, 201 bp, Bos taurus
tgaggcgcaaggcccttgagggaagaattttcacacctaagttgttactggcaatgaatgcctaatacttcatcaccaccatcttttctattgctctctayacctctggccagatacagtgacaacaaacttgacccaagtctctgctagcttatacagtcataagaggcccctttcctcaaataaaacagttttaagtta

SEQ ID NO: 39969 - DNA, 201 bp, Bos taurus
aaaaaaaaagtgacttgcccaagaatacatacatatgggacagcaccactgaaatatgttctttggcagttcagtttcagaggccatattcttaaccactrtaatattgtattaatattagaagagtgtccttcataagttttgacattctatgaagagcaatacagtaacattcagttactggcctcaataagcagacct

SEQ ID NO: 39970 - DNA, 201 bp, Bos taurus
tctaaattccatatatatgcgttagtatactgtatttatgtttttccttctggcttacttcactctgtataataggctcatactttaatttggccctactstatatgttttgcctccaatgtccacaactgctaaatctagagcatttccttaatggaacattcatggcccttttatatattccatgggctaagagtcctc

SEQ ID NO: 39971 - DNA, 201 bp, Bos taurus
gggactttcaaggtaagcattctatttttagttctatttgagattagctgaatatcttaacaccattctttgaaccacgttaaagggccaaaatctattamaaataatttttggtttctctttcttcaagataagggatttggccttttccttacctctctttctttctctgtgttagttaatttattctgggtttgtaaa

SEQ ID NO: 39972 - DNA, 201 bp, Bos taurus
agtctcgaactttgttcttctttcccaagatcactttcactctttggtattttgtgatttaatacagcagaatatgttggagatatgtctctgggacttgraaacggcgaacctgaaagaacaacacttggagagtcactgcaaggactgacaagtttatttctgcagtcaagcctttttataggagcaaggaacaaagag

SEQ ID NO: 39973 - DNA, 201 bp, Bos taurus
tttgtccttagatattttctttgctctaaagtctaatttatctaatattaacatatgttgttatcctattttccaaatatccatgccattattgagtttcytggactttcctggtaattcagacagtaaggaatccacttgccttgtaaagacctggattcaacccctgggttgggaagatacccaggaggaagacatggg

SEQ ID NO: 39974 - DNA, 201 bp, Bos taurus
tgtttccattcagtaaccaccgctgctattcttgacatagcaaggccatttcttcaaatgtaatcttacatggaaatctgtaaaagaggggaaaatcgacrcattctggatagcaaaggagttattgttaaatcctgtcaaaatatcccctctttggctgttcctggatgactctatagaatatatatggctctgttcaat

SEQ ID NO: 39975 - DNA, 201 bp, Bos taurus
ttcacaaagagacagagttctgactgaactcaccccagtccacccaataaacctttctctagagagctggtgtaaaagctgaaggtcaagaaacagagggsgtcaagaatccgcctgccaatgcaggagatggaagggatgcgggtttgatccctgggtctagaagataccgtggagtaggaaatagcaacccactccagt

SEQ ID NO: 39976 - DNA, 201 bp, Bos taurus
caagatctttgctcatataattagttaagtgaataagtgggtgagtatataaatacatagtaagctgcattgtggttcagaaagcttctttaaaattgggyttaaacagtccatttaacctgacagcaaacttccatactgtttcctcaatggctgtattattgaactttatcatcagctttgtatatttccagttgttct

SEQ ID NO: 39977 - DNA, 201 bp, Bos taurus
taaggcttggactgtttcttctatttaattcaaagttggagactgacactaaatagagaaactttggatgctgatgcaattctggtggtctccacactaaygatgcctcttgtctgaataaataatacaatcaacgacacactaattgttcatttctctcctgtttcttctacatgatacaaaaggattcctttcacttga

SEQ ID NO: 39978 - DNA, 201 bp, Bos taurus
gcaggttcaggaagctgaccccagacttgctgaatgaggatcctttagtgtgaaggaccggaaatcagacttttaacaactttcccaactgagtctcccarccactaaaatttaatcactgttgtccataaatagtggctctgcttacagttcctaatgcatagaataacaacgttacttaaaatattgactttatcaagt

SEQ ID NO: 39979 - DNA, 201 bp, Bos taurus
ttgataactaaaggccaacacaatataacagagaaagctcttggcttgagagtcaagagaccaagattctcgtctaaacatttactcactagttgtgggartttgcgtggccatttgacctctttgagctaaagtatgatctgtaaaacatcaagactggatatgattattaagacctatacttgttttaaaagtctatca

SEQ ID NO: 39980 - DNA, 201 bp, Bos taurus
tacagatacaagagcattatctttattcaccacgtgccaaatacttagcacaatgcacagcacacaacagaaactcaataaatacgaactgaattcaagarttcaatttgaggaatttaggcacaccgcacggagaaggcaatggcaccccactccagtactcttacctggaaaatcccatggatgggggagcctggtagg

SEQ ID NO: 39981 - DNA, 201 bp, Bos taurus
tgactcagtcaaaagaaaaccaagttgtctacctaaaatgagctaaattgtaagatttttctctcttcagataatgccacccctaagaactcagtttctayaatgttactgccctagagacactgtaaattctgtattgaagacaaaaacagaaatatgagaagcccagacacaagtcctctcattgtcctgagtaataga

SEQ ID NO: 39982 - DNA, 201 bp, Bos taurus
tagagctctttagaatatatgtcctgacacaaggttaaagtacggcagccaatgctatttatacagactacagcaaaggacatagtccacagctgcttaarcgcaacgagacctatctccccatgtctgcaaagcacactattcacaccagaacttcttctggcaacaagatctggctaccttttatggagataatccagt

SEQ ID NO: 39983 - DNA, 201 bp, Bos taurus
cgcaagtggtgtacactaataaatcccttgctcctaaagaatgttctatgtgtaactttcttcctgatgtcgaatcgtgcgcttggcccttcagacaccayagtcaactgctgagcaagtctaagtagcctaaaggagtcgaagcaccactccaggcggccaactccatcctaaggaattatttatgcctgatgagcctct

SEQ ID NO: 39984 - DNA, 201 bp, Bos taurus
agcttctggcgctcgcggtcccctttctactcaaacgcattaaattggggcgggggtgggggccgcgtgaagtgagagaggtgatgctggatggccaggaycgcataggttatcctgggtgggtcgtgaaactgaaaggggcggacgggatggcggactcctaactagtggtccaggcccatccctgcatccctgcatctc

SEQ ID NO: 39985 - DNA, 201 bp, Bos taurus
ggagggccaacttcaaacttgttttaaattcgtggaaaagcagattttcggttggaattgtgactcatttaagtgatcatgaaagactgaaaagtcacctktccagtgggccttccttcttgatcaacaaaatcaagaagagggcttccctaggctttctttcttaaaggtaaagcttagtcaagtgacttaactttgtaa

SEQ ID NO: 39986 - DNA, 201 bp, Bos taurus
ccagattcactatgtcaaagccctaacccttagtgtggctgtatttggaaatggggtccctaaggaagtaaagttaaattaagtcataagaccggggcccygatccgagaggattagtgttcttattaaaattggcaccagagtccactctctacccataaacatgtgcttaacaagaaaaggccatgtgaggacctagag

SEQ ID NO: 39987 - DNA, 201 bp, Bos taurus
gcggcttctgggccaggaaatctcgcggtgagcaacgtgaggtcacaaaccggaaatgcatagcttttcttgacctaggacccctggcgaacgttaaagamtggccggaggtctcacctgagagttcatctagcgattcctataacttgtgttaaacttttccacagttattataaatgtgaaataagtacctggttacta

SEQ ID NO: 39988 - DNA, 201 bp, Bos taurus
cagccccaggagtgagggaaagctcaggtcagcagaggtgaagccagggcatcagagttccccgcaccacgtggtcaccaccagagcagccccgaggcccrcctgggagtcacagtcctgggacactaggtggtgattggaaagatttgcccagtgggcaggtgggactgaaacggatgtaccagccataactgcagacct

SEQ ID NO: 39989 - DNA, 201 bp, Bos taurus
aaaactcctggaagatctcataggcaagacatttcctcacataaatcatacgatgttttcttaggacaaaaataaacaaatgagatctaaccacacttacragcttttgcacagcaaaggaaaccatgagcaaaacaaaagacaacctacagaatgggaaaaaatatttgcaaatgatgcaactgacaaaggcttaatttc

SEQ ID NO: 39990 - DNA, 201 bp, Bos taurus
gagcaggcgagaaagagtgggtacaggaacagtcaggctggtgaggaggtgattgccatagtcctggaggaatgatggggtttcaacaaagggagtggccrtgggagatgaggaagctggtggaacgacattcagcaggtagaatcggtctgacctggagtcctaagtcctttgaattgcaggatgaggatacctctggcc

SEQ ID NO: 39991 - DNA, 201 bp, Bos taurus
ctcctaaactatgagttatttggcctcccagtttcctcccaactcacagaatctgtttagctctgcttctagtagataatttctcacggctatctaaaaargacagatgttcgatggcaggcctggaaggtacattggagatattattaagtggaataaatgctcctatttttgtttgtttggaatataaaagaatattga

SEQ ID NO: 39992 - DNA, 201 bp, Bos taurus
acaattacctacataaaaattcactgggcagcctttgtttctgaagtttatttgtgtaagtcttttatctcacaatattgtggccagattgagataattgrgggtgcaggggggcggggggagggcggtgaaggagccaattctgagaggggagaacgggaggggaaaagacaaagcgctccttcacttccaacttctggc

SEQ ID NO: 39993 - DNA, 201 bp, Bos taurus
ggtcagtgacagcaaaagaaacaggcagcatattggaaaaaagaaggaaaaataaaaagaaatgaaggaaagaagttctttggggacttttgaggttcacrtctcccatcactataggaatgttccaagggctataaaaacttacagataagaataaaatgttgcttcgttactcattttggttggatagaagccaagcat

SEQ ID NO: 39994 - DNA, 201 bp, Bos taurus
agcatcagggtcttttccaatgagtcagttcttcacatcacatggccaaagtattggagtttcagcttcagcatcagtccttctgatgaatattcaggacygtttatattcctttgtaatggcctctcacaattctgggagtttagagcagttgcaggtgtcccggggacaggaaagataactacacatcatcctagcccc

SEQ ID NO: 39995 - DNA, 201 bp, Bos taurus
gccgcggttacctctacttctgtaccctgctgcattttaattagccctagtccctcgacaacttcttcagtgcttcgttattgccatcttcaaggaactcmagtaaggctttttatatttcatgtcgctaattggaaaaaatgttgaacatcctagtagtggggcttgatgaggcgcttcttagaacaatacagtcttggc

SEQ ID NO: 39996 - DNA, 201 bp, Bos taurus
caaatgatcttcaaaagtcattaaacatgaaaaatactattttcctgttagcatacataactgtcagtcaacatggaaactaacagacatagatttacttyctctgagaatcagggaagttgtacaaactctcatgagctgatctcttaattcctctacttacaggccacttgctaacttcaagacatctctttctcacac

SEQ ID NO: 39997 - DNA, 201 bp, Bos taurus
tgctcagcctaacatcaaattaacagaagcatcccagtttcaaaatacaaagagaacatatactcttaaaatgactttttttttcatgtttttcattgaayttaaaacataaaaagctatgtcaaacacaaaaagtacacagtgaatataactttagggaagaaataactaacttgtttaacaaggaaccagttttcagag

SEQ ID NO: 39998 - DNA, 201 bp, Bos taurus
tccgtggtctacagcagtgattctcaaagcttggtcctgagctaagagcatcagcatcccctggggacttgttacaagtggaagatctcaggccgaggtayggctcaggactttttggagtgaggctctccaaatgagcctaatgcactctcaagtgtgagaatccctgggctgttactgtccacacaaaatcattttttc

SEQ ID NO: 39999 - DNA, 201 bp, Bos taurus
cactaggttcccagcactgcgctcattcctttacctgcaggagatcatttaattgtcaaaatgcccaatcagtagaatctgatattggccccattttacaraagagaaaactgaggttcagagaggccctgccactggtaggagagctgaaagcagtggtaaaggtggatttgggtccatgacaagtaggcgtgaggactt

SEQ ID NO: 40000 - DNA, 201 bp, Bos taurus
actgtttcaggcagtcagttggcccttcacactcttccagtgtgaaatcctaagacccaaagatgctgctttgattaacattgtagatgacaacttccacrtggccttgccattttcagagaggttagctctgtatcatctcgttattaagtcgggcagacaaggtagtcaagaataattagcattaggagtaattcattt

SEQ ID NO: 40001 - DNA, 201 bp, Bos taurus
gtacggaagatgttaatacctggcctgcggagaccatgagcaagtataggaggctgttgtgactgtcagatgggagatgatgcactgaactatgacagtcracagtggtaatgagaggccaaatcaaaagacattttgatgataaaatgatcaggattgagtctggttaaatttcttcgaggccgtgtaggcagcataaag

SEQ ID NO: 40002 - DNA, 201 bp, Bos taurus
ataaggactggctgctcctatgtgccaggccttgctggcaacatagcacttaagaaaataaacactccctgatctcttgggctaagaaatctgagtccagrtcttcaggagtggggcctaggcatctgaaatttctaaaagctgagcagccaagattaagaactggggagtagcaaaaagggcaaggagtccaacagctgt

SEQ ID NO: 40003 - DNA, 201 bp, Bos taurus
gattcactagatttctttaaataaagagcttgcccctcgtccctgacaccctgcttctaaggtccagttttttaagttctatataaattccgtggtatttraaataaggatgcggggctctggaaccagcctgtctgaatttaagatatagaagtgccactgtaaccttcctgggcctcagtttcttcatgtgtaagatgg

SEQ ID NO: 40004 - DNA, 201 bp, Bos taurus
tttgtaatttaaatttccttctaagcaaggaagtacagtatattattaattttttaaaaaatatatacttagaagttcaagttgtgtaattatcttaatgytccagagcctcttttctgactaaacattggaatttatgatgttgaatgcagggaatttgtccagaaaagcttaaggaaatttagcctacacggggaaatt

SEQ ID NO: 40005 - DNA, 201 bp, Bos taurus
gcaggaatggacgtggggagggagtccagaacacactgagactagtacccagcagagacatagtgaccacagaggcagaacggggagtgttttctcgtccrtaccccagatacagagagaagtccctccccaggcccttggttgagcatgtgtgcaagtgaccagctagaccagcagggagggcgcagccaggagggaagt

SEQ ID NO: 40006 - DNA, 201 bp, Bos taurus
ccagaggtgcagccttgctaaggtagcaatgggcagttttggaattttaagatgccgttggtttgctgattttgtcttgccctctgttcaaccatttagcygttcatgcagtgatcttatgctaattaccaggagaattgttaaggtgtacgggcatggactttgaggagcttatatagtatgttttggcaactcaaggat

SEQ ID NO: 40007 - DNA, 201 bp, Bos taurus
gtctcctgcactgcaggaagatcctttactgtctgagccaccggggaagttctcatgcttcaaaataccacctgccaaatgatttttataaattctactaytttagagctgaaaagggtaaccaattattagtctagttctcgcatttatttatgggaaaactgaggccctgagatgttaaaggatttgctcaaagtcacc

SEQ ID NO: 40008 - DNA, 201 bp, Bos taurus
ggatgatctgacattcagatgatccagaagggctctatttaccccgccttgttccatgagactggacggcaggaggcctgagaaatgaagaatcaggggaratgatacagccaaagagctccaacctctccaaaggggaataactacaagctccagaaaggccaagtgccagtccgcattacacaacggcatttgccagaa

SEQ ID NO: 40009 - DNA, 201 bp, Bos taurus
aatacagtgtacaagctgctggcccactctctccaccgccccagggacacctggaaccaagctgtcgcccccagcacgtgctctgtacacacacaactcgrggagaacgctgagcctgcctggccaccggccataatctaggaacacagacgcccaagaaactgtccagggccaccatggaggataggaccctcgtcctta

SEQ ID NO: 40010 - DNA, 201 bp, Bos taurus
aactcccaactatcccttctgcccagcaagtctggttgcttcttgatgccaaagagagaggcaccttcatctcagattagggtttgctatacctctcaaargatgaactccttcagaaaacattcttggtgatcgctgacctgctcatagactcactatagctgttagaacgaggaggaacctttatactatccatcttcc

SEQ ID NO: 40011 - DNA, 201 bp, Bos taurus
agatgcacctgtcacccaaagatgctcagttgagggtggggggatttgctggtctacaaagtcgatttgttgaaggttaggtggtggatggcctcagtatyatttggaaacagtgtctggaatgttccaagactctccactcatctcttagttgagtttttcctctcagaagactttcttcccaaagctggaactacacat

SEQ ID NO: 40012 - DNA, 201 bp, Bos taurus
gctgagatttctcacctggggaccggactgtgtgggaaggatgaagaaggctaaagggagaggagggggtctcagtttactctgccgcaaggcactgctcragaaaggatcttactgtctataccgtaatgtgaactcgcaagacagcaagctatgaactttttaaagtctttctcgaatttgttacaatattgtttctgt

SEQ ID NO: 40013 - DNA, 201 bp, Bos taurus
cctgccagcaagggcgggatgctccctgctcacaacagatcagccccacgcttcttaggtttagccaagataagcataagaatatgcagacctatgatttygtggccaacccatccatttctgggacagtgatgctctcaaaatcaatgtttgtttgcctcccagaataaaacgctttccgtgaagacaacataaagcagc

SEQ ID NO: 40014 - DNA, 201 bp, Bos taurus
gattatacttcctctgacactctctgccaccatcagcccataagtgggtgttgccaaaattcagaagtgctgtaacaggacttgagttgtttgtttgtttktttttttttacttttggtaaaatggatttaatggtcttcctttgttttcaatgtaaaagagaggttttcctccaggatgacacagtagcaagtccctaat

SEQ ID NO: 40015 - DNA, 201 bp, Bos taurus
tggctacccaccctcctggctcacgtctccccactcctctctgtgtctgtgtcttggacagccttgagaaggagccctccggtggtcccttcccttgctcygaaagttcaggcctctcctctggtccctgctgcctcttgtttgtgtctctctgcacgcatcccatcgcactgtaacagaacacggctctcgtcctctcta

SEQ ID NO: 40016 - DNA, 201 bp, Bos taurus
aactgagtctgtgaggtcaagcattaccataatccccattttacaggtgatgaaactgaggccaaaagggatcgacagggaggaaactaggatttgaatgmagggctgactctaactgacatcaggagtggagaattcaggagggctgagttgggtgaaagagcctgggagctggggatttgaggaaggagccggcagatg

SEQ ID NO: 40017 - DNA, 201 bp, Bos taurus
acggggtgactatttggagctatggccttcgtggaaggaataaaggctcaggaggccatgcgcatggtgcttagatctgattgaactgatggccttataarcagagacaccggagcactctctctgtctgccctgtgggtcccctggggagtgggcagccagctgcaagccaggaagtgaacttttaccagaccctgacca

SEQ ID NO: 40018 - DNA, 201 bp, Bos taurus
aaagaacccacttagtctctctcgcagacagcaggcatcacagtggacagtacactggcttcagtgacgagattaagacagccaccctgtagaggactccrctttctttcctgctccctccaaaacgttcggtggagaaattcagccatgacaggaccggaaagtgttggtagaggatgctgagacggggagagtccttga

SEQ ID NO: 40019 - DNA, 201 bp, Bos taurus
cagcacggttctgaaatgggtggggtggcctgtaaagagccctgtaagaggtgcattcattcattcacctgccatccagctagggctgttctgtgtcgggktctcttctcataaaggccagtttttgcccagagctggagataaaggatgaagaaagaggtgccagatttaagtgacctcacttatgtgaaaagggaaaac

SEQ ID NO: 40020 - DNA, 201 bp, Bos taurus
ctatgctctgggggtaaagctgtgctttcctgtacctgagacaatgcctggacctcgtgaacataactgacaacataattttgccgcacaggttattgttrtgttgttccaatatgcttgaagtgatcatgaatcttcacggaatgctgaacgttttcccacgggaaatactttattttgcacacagagccacccggtctg

SEQ ID NO: 40021 - DNA, 201 bp, Bos taurus
gcctttctcaatgtttattatatgctaggcatggagtgtttggtgcttatctcatttaattctcacaataacttcgcagggtaaacattatggccattttrcagatggctatactgaggcacaacaccaaagtatcttcccaggcatcatactggtagtaaatggtggccttgggatttgaacccaggacatctgacaaca

SEQ ID NO: 40022 - DNA, 201 bp, Bos taurus
ataagtccagaaactgaaggagaaatggcacgtggtggccttgacaccgagactttgggaactgaaggagagggcgagcctcggggctcccgccatccctycccgagctgaaccgagagggccggtgagcaaccgactagcactaagtgtgtgtaaaatcagggggaaataaccgtcccggcttcctgcaccaagagcttt

SEQ ID NO: 40023 - DNA, 201 bp, Bos taurus
ctccaaaccacaccacgtgaggtcgcagcaggcccccacatcctgcctcttcacacctgtaagagtgtcatccttaacccactcccaagacctactcttgrgaaggcctgcctaggtggatcaggggaaatcataaagtctctattgtgtccagatgcactggggtgatttgttggcgaatgtgtctcagccaaccttgag

SEQ ID NO: 40024 - DNA, 201 bp, Bos taurus
atgcctgtgtcacgcgatctgggcctccatcctgtgtgaccgcactgccatctccagtcgttcccaaatatgcacatgccttcttcccgtccacagggcargatgctaatgaacagggccatgctttgtctttctctgctagtctccctagagcccctggcatattagagcgtgcttagaaatgcttcagtgccagttagc

SEQ ID NO: 40025 - DNA, 201 bp, Bos taurus
aaggatgttcttttcttccagctctcgcttggagggcctattgctgagtttgatggctaaggagtccttcctgcacaccttcatggccagggagcctgcargagggcagagatgagttaatgaagtcatcgccaacctgggctccgggctcccccagagtcagctgtggcccacagggcacaagacagggagacggatata

SEQ ID NO: 40026 - DNA, 201 bp, Bos taurus
tattgtcaaattgggacacttctgggagcaaaagggggtgccatgactagttactctggaacagaagacatggctgaggctctagcaggcctagtggggcrcagtcaccctactttcaggggtctatttaggtgatgtgctgttttacatttgctgacaggctgcttttggaatctttctcaagttgcttcttgcgggccg

SEQ ID NO: 40027 - DNA, 201 bp, Bos taurus
gccccagcaaagctgatgcctttcctgggtttctttttctatagtgttatgtaaattcctgtcaaacctacgcacccactgtgtggtttcctcagtttctrtcttactcactctcctggtgagcaatggttccagggtgcactgatgaggaggagaagagggcatcttggtgacgtctgctctgagatggtgagatgtcca

SEQ ID NO: 40028 - DNA, 201 bp, Bos taurus
catgtcccatgaaaacaagcagggctctgctactaacaatttccacttgagtacaagcagcttcctaacactgagttttctttaagtcccttaactccaartttataatgaaaggcttgtccaatatataataatattaggataacaaaatggtgggtgcaaaagatttttttttccacaagctgggttgctttactattt

SEQ ID NO: 40029 - DNA, 201 bp, Bos taurus
atatctgttctggagatgctgataatgatacccagcctgtaaatctcttaatgggtcagtccctccatgccccgtgatcagttgttggtgcatttggcctraagaactgtgatgctctgaggttatttatgggtgactccagtcttcaggaatttcggttgatccagtaactggcctaagaattcgtttttgatgatttag

SEQ ID NO: 40030 - DNA, 201 bp, Bos taurus
tagttcagctatgattcagatgtatataaatgtgatattaaagttgagattgaattgcaataataacaacttccatgagtgtaataccgatccaatgttamcgatgcattaggtagattgaagtcagcaagattacatctgggcttttatttgaaataaagcagttaatttacctagcagagaaataccattatcacaatt

SEQ ID NO: 40031 - DNA, 201 bp, Bos taurus
atagatgcctttggtgtgaagacactgatttttcttagaggaaaatgcatttatttaaagatgggaggcttttcattttattcccatctttcccttattgyttataaagtgctagccttgaagagccaagctttcctgtagaaaaatctaccgtatttatgaagtgatccttgagtaccaccagtttttcttcttaaattc

SEQ ID NO: 40032 - DNA, 201 bp, Bos taurus
aagtttgtttggggagacctgtgctaaatccataaacactcctgaaaggaagcacttaccaaagagctcagcaaacaccggcaggccctgaggcaaacatsagtacagatatcagtgtgaggagaaagtggagggacttccctggtagtccagtggctaagactctgcgctcccagtgcaggggcccgggttctatcccca

SEQ ID NO: 40033 - DNA, 201 bp, Bos taurus
ccaagttgtatcagctgtgttctggctgggaggcaaaggttggtagcatgtgtacatatacgcattcatggatttagatataacttcataccttggggatwgcatacattgatgcaggaagataagatagatgggcatgtgcaaataggaagatctttcccttctttcaaatatgctttattagatgttacaacttgtgtg

SEQ ID NO: 40034 - DNA, 201 bp, Bos taurus
cggcgggctacagtccgtgaggtcacaaaagagtcagacacgatttagcgactaaacaacagtgagggaacaggcttagaacgggcaaatgccttggccaygtcatggctgctaggcggcataaccagggtccacacccagctctgcctgcgtccagcctatgttctcaatcactgccctcgtcagacctgatcctttcaa

SEQ ID NO: 40035 - DNA, 201 bp, Bos taurus
gtttcgtttctcatctttgatcctggcaaaacctttgagtattaggataaattttaaaagtgtcttctcttccatgcaccatacatctgatggcaggagcrcgtgccccagctggagcaggttaccccacaccctgggctggtagaaacagcgccttccagtcacgacccctcggctgtggtacagatgcagtcatttcaa

SEQ ID NO: 40036 - DNA, 201 bp, Bos taurus
gatattttacttctcaatatattaagcacaaccttcattctcattctttctcttagatcccacccatttctataattcaaaataaaatccaccatttccamtatacaaactgaaataatccacgctcatctcaacagactccacttgaagagaaatggaaacatcctctgagaggcctgcttctcagacaatagtctcctt

SEQ ID NO: 40037 - DNA, 201 bp, Bos taurus
cagctgcttccacggccaaacagtactatttgaaacagtcaagataccttccgggtaagtagagaccacaaagtgtttcctggtggcgaaagcatgctagyaggtcatgctccagggcctctgagtctttgacgaaagggcgcccgtgacccgccgctgcagccctccgctggcctgcctgtcaccaggtactgttctgga

SEQ ID NO: 40038 - DNA, 201 bp, Bos taurus
gggatccagccagttcagactcaccaataccaacccctggggcagcactacggaatcctaatcttaaaaccatgaatatcaatcaggccttgaagagatgkaacatgtaaaagatctgtgcccaatgaacctttaagaaaatccacctcacttaactcaaagtcatactgacagtaagacctgcatttggtttatttatat

SEQ ID NO: 40039 - DNA, 201 bp, Bos taurus
gaacacagtagacgttctggggcatgtagacggccctgaagagtctttcaaaagtattaaagtccttatggatgaccatgacatatgccagagggaactcrgcttcttctttcgacaaaggccttgtgatatagtgattctggatcaggtagtccttgcacgggacacttcccatgggggacatcaatgtcttttcccaca

SEQ ID NO: 40040 - DNA, 201 bp, Bos taurus
tagtgactaacctgggtggactgtaagctgttggtgattttgacagcagaagactacctggttggcatgaaagcaatactttggcaggaaaaacatggggygcaagaggatggtcacaccccaggtctcaggtgagtccctggagagggctgccatgtgagggtccctggttcctcacagaaaggacttcaagagccagcc

SEQ ID NO: 40041 - DNA, 201 bp, Bos taurus
atgccccctgcatgagtggcagcctactatggcagagggtgcccgctggctggcccaacaggcgtgggcatactcctcttgtaacagcactctagacttaygtggggtgctcattgttgctcagctgaaaaccttcatttcacaggctttcctttacctaattatgtttgcttagtaactaagttgtagatactggaatgg

SEQ ID NO: 40042 - DNA, 201 bp, Bos taurus
ctctttcttttatttatttattttcttttaaatatttatttatttggctgcaccagatctcggctgtggcaagcaggatctttagttgtggcatatgaacygtgaacccgtagttatggctgctgggatttagttccccgaccagggattgaacctgagccccttgcattgggagtgtgtggaaatcttagcactgggcca

SEQ ID NO: 40043 - DNA, 201 bp, Bos taurus
ggatgtaaagaaaacattctccctctcttgttctgaaatgtacccaagatttgttgatgtcctctgcagaaacgaagagtgacccatatccggaggcctcmggtaagtcaagtgacaccttctgagggagacccagggaaagaaagcctttgtcttttttctccctgtccttttcttgatgcctcactggtggttgtccag

SEQ ID NO: 40044 - DNA, 201 bp, Bos taurus
atgccttgttttctcttctcaaatcaacatgtctccgtatttatacaattcagagttcaaacaacattcattgcactgctgtcactgtacgtaaagacaayccaaacttgttatgcctaaatataaaacacaatccaactaatcgaacagatctgtggcatgagcagagcctcaccatgctgttcccatttattgtctgcc

SEQ ID NO: 40045 - DNA, 201 bp, Bos taurus
ttttgcagtgtttgaggcaagttatcatcagagtaggttaccttttgctgaatgtaaattactggcaaccggatgatacacatttcagtctgcagaaagtrtgaaagtagattcggaaaattgatagcagaccttttactgtattacaaattcgtgtttccagtcgcagtttcattatctacctaaggacaaaagttaagt

SEQ ID NO: 40046 - DNA, 201 bp, Bos taurus
aaagaggtaatgaataaaggaagtattggagaaaaatagctggagacttgttgttgactagctatacactaaaggttgaatataaataggaggaaatctcrtagtataacactaatgttgttcaagcaggaggagaaagttttgttggtttttgagcttgccaaagggtttgggcagtctaggtcagaccaacatctggag

SEQ ID NO: 40047 - DNA, 201 bp, Bos taurus
tttattttctaccatggacagatatggatatcaaccagcaaataacaagaaataaagggggaaggacaggattagaagaaaagctgtgaacttgattttgracctactgagtttgagctttctacattatatccaaatataaatgtttgggggatctttggaaaaaatgcatgtgaaacttgagagagagatggaagtttg

SEQ ID NO: 40048 - DNA, 201 bp, Bos taurus
ttaccaactgagcttttaggaaagccctttctacgctaaaagtgttattaatcatgagatcatatactcccctcattgttccagggttttattttttagamttaacactttaattcatggagaatttatgttacagagggaagattgaacctcattttcttttcacttaaccaatcatccccagatcattaattccttacc

SEQ ID NO: 40049 - DNA, 201 bp, Bos taurus
caaagtaaagtatgaacatttttcataaatgggtattctaagaacatacatctcttttgtatgtagacagatatatctattgtaacctcttagaagcatgktaattcttttttgagtatgtcaaggtatgaccaaagcaatgacagctaaaataatctcaagtgcttttcagtatttacactgtttttgctgctgtttatt

SEQ ID NO: 40050 - DNA, 201 bp, Bos taurus
ctggatgtcacttaagatatggtccttggataaacatcacatgctcctggctttcttacaaaatgggtaagcactgagtctctttttggccgctgaagccrcttttattttcctgaagccttctagttagcaggtggcttgaagagaccgtggaaagggacagacagcacgcatgtgaattactgtcttcctggccttcac

SEQ ID NO: 40051 - DNA, 201 bp, Bos taurus
gcaggaagtgagaccaggaggaagcacagcacagccgatgcgtgtctgtcgtggtaactaaatccacgtctgggtttaatcagagggcagtggtgagtcaygacatggaaagcaggggtcttcatggcactaatcagcagcagaagcccacatcaaaatgcagcgtccatgcttgacttcctgctctctattgttccagac

SEQ ID NO: 40052 - DNA, 201 bp, Bos taurus
gaaaccccaggaatgccacaggaataaacgatcagaatagcatttgtaaagtctctaaacattccattatcatcagaactacagctcctaaaacaatccargacttacatgctaaagttactcagagttactgacaactaaaaaaaaaaaaagattttaataggataaagagtatcctaatatatttaatgcatcaaggat

SEQ ID NO: 40053 - DNA, 201 bp, Bos taurus
taccctggtcaagggattggagggtttctttctggggaaatgtcccaatccaagagtaaatttccatagagactgggacttggaaaccctgaacccaaagkttgagtttacacccagtcaacaaatctgctcactcacccatccagaccttcctgggggtgcacactgcctcattttgaaaatgaacagagccagacacat

SEQ ID NO: 40054 - DNA, 201 bp, Bos taurus
aataaacgtcaccacttgccactccttggccctaggaaatgtcacatcccctagaacgggcacctcactgctctcccatccacggatgagcgccctcctcygggtctaggactgagggccgctccttgggggcggtattccccagctctgaggctgctgcacgcccaggcagggcaggctccactggccacaggaagcccg

SEQ ID NO: 40055 - DNA, 201 bp, Bos taurus
aagacgagggacccctgggaagaagaggggctcggtgtctgggtgatggcgcccagccgcacacggtgagtctgggtccgagagctcagagggcatcaccrattagggtcatatcagtgcagtaggtaccagctgttgggtgaggtttcctgaggtaggcagagcaggcggtctctacatggctaaaattctgctagttca

SEQ ID NO: 40056 - DNA, 201 bp, Bos taurus
cgaaactcctgaatctgtgtcccagaaaaaaaagtttcaaatcacagaaaaatctcagatcgttcaatgattcatattaactacaggtaaaaagaataaayctgcaggaaaacaaaaatgctatcatctgaagggctatttccagcccctgtaaacttctaactccactcatgccacaaagctgaaggtcttgtaatacct

SEQ ID NO: 40057 - DNA, 201 bp, Bos taurus
gaggcagcaaaccatctcacttggattcatagtgagtggactctgcagggaaagggacccgaagttgtcaacgcaacaccaagcacagccagagactcacragcctccaggaaccctggccaagaccctgtgtcacctttcgaagtctgacttgacccagcagagccaaatcttcccccttctatgtccccacaccctgta

SEQ ID NO: 40058 - DNA, 201 bp, Bos taurus
atgtagcagtaaacgtcattcctctaatttactattttacttaccgagactagtgacatttgcagcaaagacaactaagcctttctccttgtgtaaggaaycgtgatcccaaatcctctttgctgattcttcagcaataaatgttttggcctcttttgtgtccaccttccctgtctttctgatcaatgtgccacttgtgct

SEQ ID NO: 40059 - DNA, 201 bp, Bos taurus
gggggtcctcagagagccctcaggtagagcaggctggaggcccctcgtgtgcgttcagtgacagcatttactgtcaacagtacctttcattcagaattcckcatcgacctcagagagcaaaccgggtgcggggtccaccgtgccaggccggggggtacggcggtggtcgaggcggccgtgcccctcccgtcccctccggag

SEQ ID NO: 40060 - DNA, 201 bp, Bos taurus
acacaggctggaaaccctagaagccaaccgtagaaggaggaggaaaggagaagaatgccgagtgctgcttcttagaattcagtttcaagacagaaaatacrtggggttatttgcactctcttttgggagtcatgacacaagtatgatcgtgggatgatcgtattgtgattttcgagggacagatcactattgataaatcac

SEQ ID NO: 40061 - DNA, 201 bp, Bos taurus
gattctggtgacagcgtcatccaaagcattgttttcaaagggcccacgagtcctagccaggtggccttgccttgtggccctgttgagttgctttgatcacrtgacttgttcatacgtggctggtccataggttggagcagatttcacacacaaacccctgatgcctgtggaagagccacttgtccagcccctctggacctc

SEQ ID NO: 40062 - DNA, 201 bp, Bos taurus
ccacagtggacttctgaccgtgacaacggagctatttggttttgatgaaacattcaagtcttaaaagttaagagtaactgacaggccagtttctcgccccrgttcccagggtgaccagggtttcagattcctggtcagttacactgcatcagatgacctgttattatccacggcccagcgtcgggcgtgccaagcacagga

SEQ ID NO: 40063 - DNA, 201 bp, Bos taurus
caaacctgtcctccacggcctttctcctgcgcttctcatcctcgatctcgtacgtcagccgggtgatcttctcgttgagttctttgatctgcccgtagcayttgtctaggttttgcttggccgacttgccgtccagctcggcctgtctcttcagctcctccaggctcacgagcttagctttgaactgggagcactccgcct

SEQ ID NO: 40064 - DNA, 201 bp, Bos taurus
gacttaatcatgtgtgggactataaaaactggcacagggagttcctaggcaggtgcagatgggaactctgggtaagggaagggcttggccaagatgttcgmtgggggttgtccgtatcgtaaaaaattaaaacaataaacactaaaaaagtaaaaggaagcagagaggccaaacttgcgaatgaaagtctctaagtatata

SEQ ID NO: 40065 - DNA, 201 bp, Bos taurus
ggctcaaggctctggagaacaggacaattaacttaccagacactgcgctctgtagggaagaaactgaggatgtgatcatggaggatgtggcccaccagtcrgagttcatacccaaggagagctatttgcctgaatggatttgagaagacttgtttttcagttgcccaattgtgtccaactcgttgtgaccccatggactgc

SEQ ID NO: 40066 - DNA, 201 bp, Bos taurus
tcttctcctttggaaaccagcttagatgcttccagacccacccaatattataaccgcccccggaacaccaataaatgcccttatgtccaaggcaacacaarcccaaagcatatggaagttaaaaactccaaccaaaatgcagggcatgtaacgacctagtctgattcaagaaacagaaaacatggagcactcctgttttat

SEQ ID NO: 40067 - DNA, 201 bp, Bos taurus
atccccaatcgacggcccaaagactgtgcccgcctgaagttttgtcttcataaggtttgaatttgaaagtgtcgccagcgcttcttgctgcagcctttccmtcacccccggcccttcagacatctgctttctcaccatatttgcctgattttctcttctctcagcggatgctgctgttctttctcagtcttatttgctggc

SEQ ID NO: 40068 - DNA, 201 bp, Bos taurus
acacctgtctggtccatctccagatttatcgggaggatgaaagatgaggatgtacatgagagtgcttggaaaactgtagatttctatgcaaacaggccagmaaattattatggtctgaattgtgtccctccccacttccctgttcatatgtggaagtctggacccccaatatggctgcatttgaagacacggcctttgagg

SEQ ID NO: 40069 - DNA, 201 bp, Bos taurus
ggccttgttacccacaggagtccttcccggaggaaccccttgaggctgcgagtcccgtcaagagtgggtctgcgtcttgttgctcttgtctttttgttgtygttgttgagaacgagggccttgcagtgcctctgaactcaccccagctgagtgttcacttagcctccctgcaaggctggctctcgtcacccacgtctgggc

SEQ ID NO: 40070 - DNA, 201 bp, Bos taurus
tgagttttgactcccttgtcaactgagatggattgcaattctcagggagagaaagtacaagctgagtaactggaaatctgtgcctgccttcctgtggccayggagaggtgttagaacacgaaggtgatgactgctcaggcgctggtaacttctgtaacagcccagctgggcagctgagtggtttctggtttacagatggga

SEQ ID NO: 40071 - DNA, 201 bp, Bos taurus
aaaatcactaaattaaaaataataaaatcattaaattttaaatgtcaacaaatagcaagacattataaaatttgtaaaaataacattttaactaactcttkatatctgctttccctctacaagtgcttgttcctcctagatttttgggaatgtcactctcttcagatggcaactttgtcatagttttctataaggagacta

SEQ ID NO: 40072 - DNA, 201 bp, Bos taurus
ctctccaaagctctaatcctcactgcccaggtaagacaaggtatttgggccaagtgcatccacctctattggtcttaaattttatctacctcatgggttcrctgtctttaattactgtggccaccactgcatcggcttcgtttctaaaactctgtcccaaatgtaaacaaaatcattcttctaagttcgtacattttgagg

SEQ ID NO: 40073 - DNA, 201 bp, Bos taurus
gatccagatccatcctgttgattttctctcctaaagtctcaagaatggatccatttctttccatcttgtctcacctgccaccttgagagctgcctgcaccractccccactcctcctggcccctttcactctatgatgcacagaccaggtcctgtccagaccaggtcaccacctcaccctcctgggacactcccctccttt

SEQ ID NO: 40074 - DNA, 201 bp, Bos taurus
cattgggtgctctgggcccctctgccttgattgccaccaccaccaccatcacccaactggtggggaaggtccagctaaactttctgtcctcctccctctarcaagggcagagtcaggcctaattgttcctggaaaccgctgactatctcgctaatctaataggcacacctcctggagccgagggtgtggatcctgctgtcc

SEQ ID NO: 40075 - DNA, 201 bp, Bos taurus
cgcccttcccaccaaggccggaggttcctctaagcgtgccagctacgccctgggtccggccaccactgcctcagtccaggtgccccacgaggcccaaaggmgtcaacaagcacagatcagaagcctctgtccacagcgtcccccactgtcctcttctttgctggacgtcagtgacagacaacaaaagggccgatgggtggc

SEQ ID NO: 40076 - DNA, 201 bp, Bos taurus
taggggccatcgctctgctgggacagcctggctctgtccccgactagttttggtgacttggcggggggttcctttaactcctggtcccccattttcaaaarcgattcttccaccaactgagagaaagtctagagggacggttcctgcctgcttagtgctgggggcgaaggagcaaggtgacgggggtgttcgatcagcagg

SEQ ID NO: 40077 - DNA, 201 bp, Bos taurus
ggcatatgcacctgaaaattaaaatttattaatgttaacataatgaaatcaaaatgattttatgtaatttcatgatttatattttgggggaaagttatttraatgtaatttataggcctttccccccagcatacctgcttttgccctcattttccttggcaagaaaaatcccaaggtttcttaagtctcttctcatgtaaa

SEQ ID NO: 40078 - DNA, 201 bp, Bos taurus
caaggactaattataccttgtttattttctctacagaatcagacccattttccaaacaccagatggcgtaaattaattgttaaaatagtagtaaggttgayccttataaaatataagcaagtcctttttgtttttgcaggatttttacagcggctccacagagtacaatgaagccttaatagaagcaggaacacaggttgt

SEQ ID NO: 40079 - DNA, 201 bp, Bos taurus
acgtccaagagccacggttcttggaagtgtcctgggcttccgtgaggcggctgacccaccgctgtgcgtcggggttcccgggaggggcctgctgcgtgtcygggaaggaagggcgcagtccacgtgtgcctcgtcccgactactgcacacgcggtcgctggagccggccacttggtctctagcgtctgcagggcccatggc

SEQ ID NO: 40080 - DNA, 201 bp, Bos taurus
ggcgcctgccttactgataacgttcacatttcctgtctaagaacaatgtggctaagtgtggtgtcattaaaaactagtttaaaaaaccactataggccacycctgagagtctcactgctggatgctagggctctcccaggagtcagatcacagtggggggcgggggggggggcagtcagctctgccctcagaagacgctcg

SEQ ID NO: 40081 - DNA, 201 bp, Bos taurus
ggagcctgcccccaccaccggggatccctttccagtttatgctcatctgttcttatgctgctttcaatggcaaggccagtgcctgcgtctctgtcacacayacggtcatgggggctgcccgcagcctgccagtctgctccttctgctcacagagaagtgtctggaaatttgtgctctcccaagggcggcctgtggccaatg

SEQ ID NO: 40082 - DNA, 201 bp, Bos taurus
ccagcggtcccgaagcctttgacaatgacgggaaagagggcatcctaattagaagctgtgatatttaattttatgcgtcactttggctgggccacggtgcycatatacatgttagtcactcagttatgtctgactctttgtgacctcctggactgtagcccaccaggctcctctgtccatgaaattctccaggccagaata

SEQ ID NO: 40083 - DNA, 201 bp, Bos taurus
cacaggacaaccacagaaccagatggacaactttcaagaaagtccacctgggagattccacgacctctgccaaggcagcctccacgttgcctgccccgcaygcttacctcccatctcccgtacacatgaccggcgtgtcacagctttgtcgtccagcagtctgacttcatgtcacccttgtctagacactaaaactccttg

SEQ ID NO: 40084 - DNA, 201 bp, Bos taurus
ttctgaccccgagtctgaccttcatcctggcctggatggaccgtgtcagtcctcaggaagaacgcggggctcgggggaggacggggtagcccagggacctrtcctggaatcactggcctggcgatgtttccactggggccgcaagaagtctttggaaaatgtgcctttaaccagaaaaggggtcttaacacttcaatagtt

SEQ ID NO: 40085 - DNA, 201 bp, Bos taurus
agacaggcctggcccaccccgaggcgaggtaggtggggctgttattcagagcaaaggctggggtgcagtcctagccgtgtccacaaggtgtcgcagtcatyctacagaacagggggccccaacctctaggatctaatgcctgacgatctgaggtgaagctgatgtagtaataataatagtagacgtgacaagcacaacacc

SEQ ID NO: 40086 - DNA, 201 bp, Bos taurus
agcctgcctggccctgggatccctgatccgtccaagggagaaaatgaaaccgccgatctcgtgggctgttgggaggactacagagttgatgggtgttcackgcgggtgctggcgaggcctggcgatggtgcagagttggaagcttgggggcagggaaacattatgctaatgagatgtttctcctcagtgtcaacaaagaga

SEQ ID NO: 40087 - DNA, 201 bp, Bos taurus
tcatgtaagtggaatcattctctgtcctcatgggggtggggggtgagctgatttagttctcggatgcagaggacggaaccgcaggtcagctcaggcccgaygtccagtttccaggagctgctgaggaccatgacgagccctgtgatgcatctgaaccagcggctcatcacgctgggccccatcctgggccccgggccccat

SEQ ID NO: 40088 - DNA, 201 bp, Bos taurus
ccaccggggcagtcccttttttgtatctttggccagacattgcaagttttatgttgctgacttcccattttgttacagtcctttaaatgtcgtaggacctygttctggcccacagtgacattacttggaactagaaggacctttggaaacgtgcttctcggctttactagggtgagtccaaagttagtctttgacccaggg

SEQ ID NO: 40089 - DNA, 201 bp, Bos taurus
ccagcccccaccttgaatgaaacaacaaaggccgagaggcagccgtctccagaaaccctctgtgaaccgagcgatcgcagaagctacggggagcaggcccrtcctctgcacagcttctggaaaggtctccctggttgtgaagagcccagggcacggaagctggggcagcgctcgtgagaaggtggaggccacgccctcagc

SEQ ID NO: 40090 - DNA, 201 bp, Bos taurus
ccaggttggcctcctgaagcttcttctgctcctcaatgatgtcactgctcagagactgcttcttgtaggccttgtgggcctccacgccatagttgaagaarccagggttggagagggtgcctgggaagcaggacaaaggctcccactcagcgggacatccacggcccgccagccccacagtgacactgctgcctggacgcc

SEQ ID NO: 40091 - DNA, 201 bp, Bos taurus
acacttgactttgatctctcgtgtcctgtgaacttggctgtggcgctgaagggatggtctttcaaaaagcagatctaatcttggccttgccctgctggccygccaggcgtgcccagccccgctgggcagggagatccctgaagtagcccctgttagctcccccgtcgcctccctgtctggtccttggacagaccaggctct

SEQ ID NO: 40092 - DNA, 201 bp, Bos taurus
tccaggagtaactcacctaccatcagagttagggcatctttcggctggcctgtctcccgtggagcacaagtcctccaatgctaactgctgagaagcacttrgggatccggtaggtctgggcagggcctgagcatctaacgggacccccaggatgccagatgtgggggctgctggcccctggaccccactctgagcagcaga

SEQ ID NO: 40093 - DNA, 201 bp, Bos taurus
attccttttcctgcctgctttaatcactactgctgtctgtctggagagctgtgacgtcactaacccagactctcggtaccgaggtagagaggcctcagtgyttccacctgagctctctgcagaggtgactagaatggaatagggcatatcgtggctttggataaaaagggggtttccacttccttgtgcagggctcagctc

SEQ ID NO: 40094 - DNA, 201 bp, Bos taurus
cgtccagcacgatctcgggcctcgtttttacttcagattcccccaggcagcagcgccgcgcttcagcattcttgttgttcccgtttgattttgagctaacrccagctcctcaaggcccagaactgccctccttgctttgtttttatcagcttgatgaaaggttgctaaactccttatgcttaaaagaattccctttgtctg

SEQ ID NO: 40095 - DNA, 201 bp, Bos taurus
aaatatcaagggcaatttcaagttggaaaatggcctttgttgcccacaaaaagcacgatgaatatgttaacctctgtgtggccacagtcgctcccgaggaygtgctttcacagccctttcacaatgactgcctctctgcttcatcaccagcacccggctcttgaggaatcagagacgcaccgagctgggccttgtctggtg

SEQ ID NO: 40096 - DNA, 201 bp, Bos taurus
gtctgcctgcctgctgctcctgccttttctggtttcctaacaatttttctctacactatgaaagtgcaattttcagaaaatcaaaagccacaggatataaycaacccctgtgaatccatcatgaattgtttatgcaaaaggggtaagaagctgacacctgctgctcctgtcactggtaggttcaaggtcaccaccccctgc

SEQ ID NO: 40097 - DNA, 201 bp, Bos taurus
ttctgcagacagtaacgtttctgtgtggtgtcattaacaactcgacgctcgggcacggaggcagcagccctggctccgactcccgaggccggaactgaccraggttttcccttccgacttcagtggcgctcctggctttcctgtctcccagcgtcctgcgggaacccaggcctgacacaccctgtgtacaacccgtcaaga

SEQ ID NO: 40098 - DNA, 201 bp, Bos taurus
gccccaccttcatggggcagggcatggttcccagcagacgtcagatgactcctgaccccgctggccttccctcggagggggtcattcgtccaggtgggcckcgggaaagtacaggttggggtcccaccaggaggcacggacgcttcagggacagtttctaaagatgagggcggtgagtcacaggccggttcccagcaccac

SEQ ID NO: 40099 - DNA, 201 bp, Bos taurus
aacagctccgaatccaaggaaaggtaggccctttcaaggcccaccagcacttgcccaccagtgggggacacagtggaaagacgtcaggcaccagacaagtrggtaagagctatgctttctgtaacagaaggcaccaaagcacatgaggagcgcctgcgcccttctgcaggctcatcccacggactttcaccactttcccat

SEQ ID NO: 40100 - DNA, 201 bp, Bos taurus
gccctcggcgactgacctcgtcagggctggaggcctggtaggtgcggttgtcatcactgaaatcctggtccgcctcggcgacctcggtctcgccagctgcrccgcgggcctcgtacacgggcgtcacattgtgacacagggcgacagccttcacggcctcatggacccggctgctcacgctcctcctcaccttgggcgctg

SEQ ID NO: 40101 - DNA, 201 bp, Bos taurus
tgagggccacccgccttccagcccagaagccctgcccttccaagtccacttgggtcgggcagacttctttgctgctggtgaccacagagtaagcatggaartcaaagcagagaaccaaggccaaggtgaacattaatgtggctgctgcctggtgagatgttggttcatggggggccagaccccaacatgcaggtgacccct

SEQ ID NO: 40102 - DNA, 201 bp, Bos taurus
tctgacgagtgctagaacaaagcacaaggaggccagggtgccagtctgtgggtgtgtcctgcagccccaggctgcccctgggccatcccaggcagtctgcygtccttggggagaagctgggcactgaccatgctcttgcagactccaggaggtctgtcgtgcagagccctggggcaggactggtctgcgggctcgtctgac

SEQ ID NO: 40103 - DNA, 201 bp, Bos taurus
cctgcaatgctttaggtgttagtagcaaaaagtcaaattagagtcagtaatgacacagacatattcttcaagcggactgcctcctggcctgatggggcacrtgtatagctttaccaccgattaatgatactgagtcttactctacaccggcactctcaaagtccaagcaacttaggggaataaaccttcatctctcaagaa

SEQ ID NO: 40104 - DNA, 201 bp, Bos taurus
gcccttggtgactcctggtgattgagctccttacgcttctattcgtttcatgaaaaggtagcccaggtgtgcctgccctgaggcccagtaccttcctcccraccccgtggcaccagagtctcagcccctcgccgtgacacctggcagcctcacccttgtacctgctgggctggcacccacgtggtcagctcctctcaccac

SEQ ID NO: 40105 - DNA, 201 bp, Bos taurus
gcatggatcgccagttggcaccatcacaaggggccacctggaccctgtgggagcctcagagggttcccctggcatgagctaatagagggcaaagccacctkcaacactcgggcccatctcgggggccgcatcttctgtccaacaccagcaatactggagtaagttgtttaaaagagcagccacaagatgatcagactaaga

SEQ ID NO: 40106 - DNA, 201 bp, Bos taurus
gaccagctgtcccctctcacactgaggacagagaaagaggaaatgggcttacgcttcaatagggaggatttagatgagatataaagagcttccttccagtragggccgtcagcaaagagaccagttaccagtgaagatgctccttaccctgggggagggggggtttcttccctagaggagaagggctggttgtggggcggt

SEQ ID NO: 40107 - DNA, 201 bp, Bos taurus
aaaaccctaggagctaaatgcttaacatcggaatctctcaacgtctaaacgcacctattgttcattgtactaactttacaatgtcacttccagagtcaccrtcatggaggctagacttcagctcgctttgaaaagcatcagagtgctttggggcagctcatccactgttgtcattatgatagtgcttcgtaaatactgtga

SEQ ID NO: 40108 - DNA, 201 bp, Bos taurus
tcctccacgggcagaaatccatcctccatggctccagagtccaaaagatgcttcaaggtgtccaggggctggttcccttcagagactctgagggccatccrtcccacgtctcttcacctccacatgtcctcggcatgtggacgaacctgcagatcctgccccgcgtgccctggcctgcgtcctgctccctgcgtgtcctct

SEQ ID NO: 40109 - DNA, 201 bp, Bos taurus
tattttagcaagaactttgctttcaccctgagactatactgtaccgagttatacgtttgggctattgtcactcagtcctgtaaacactggagtgaggacckataaaccacacactcgggaccctccccgcaagacgcgggccactcaccctcctgagacccagccctgcggggccttccgccccgcccgctgccctctctc

SEQ ID NO: 40110 - DNA, 201 bp, Bos taurus
agaaagagaactatggggagcaactccttctatcaaataaaccatggctgtggcagcaagctttctcaaaatgtgtggcgggacactgggaaaacacatgrgaatttattgttgaaaagtctcttatagaaactgagacgtttacaacaagatctcactttgagagggagtaaatccaccctcctgtagtgccacccacaa

SEQ ID NO: 40111 - DNA, 201 bp, Bos taurus
tcttgagtccacagaaacaccataagtaacttctccatcatcagtaaattgcaggtatagtcaatatatgtgtgaattttaggatatcctctgatacattrtaagttcacagtcttggaaaagtaaattaaggccacccagtttgtgactgtggttcgatttttctggaagcacactaaaacctaaaagtgactgtttcag

SEQ ID NO: 40112 - DNA, 201 bp, Bos taurus
tgcatttgtagacaggcacccactgaggcctccctgtggagtcacggggtggtgagcgctgcctaactgcggatgtctgagcactcctgaaggcgttcatrctggcccaagaaacagagctccagcatcttcccttcatctttaacttcctcccacctgtgtttccatccactttagccttctgattaagaaggctgagta

SEQ ID NO: 40113 - DNA, 201 bp, Bos taurus
ggaggagggggaggccgtgggtccccttgcaggtgagtctgtggacagcagagcttgcccgcttcccttgttctggtgccagtcgctgtcactagccttaygagcagcggcccaaatacagagcaaaactgagcagttggagcttcagttttgtcactcttgggttttcttcccaggtatttgctgtaagtcagcatgagc

SEQ ID NO: 40114 - DNA, 201 bp, Bos taurus
caggggccttaacctcgtgcagggacccgcgtggacacagggacccgcgtggacgcacagccgtggagcagtgcttccaaagacgtgtgactgtgctgggyggccgtgtggttttccccagattctgtaaatagtagcatgtcactttttgcagctacgtgttttaggtttggtgtgtatgtttcctggaaaccctgaagt

SEQ ID NO: 40115 - DNA, 201 bp, Bos taurus
ttcagcctgaaggccctagaatcggtgcttggcaacaggggaagccaccgcgctgagaagcgaattcattggaatcagcagcccccgtgcacagcagcagrggagcccgggccatgacaaaggcacagcaaagcaaaaccaaaaacatacgtaaaaaaaattggaaaaagatcattctagtagctcttcagcagtcggaac

SEQ ID NO: 40116 - DNA, 201 bp, Bos taurus
agccagggagagagcagtgagccaaagagataaaggtctctggcctcatgggaagaaaaactgtaagttaaacctaatacaatggagccttgaatgacatrggtctaaactgcattgggccactgacacgtgggtttttcagtagtagatataacagtcatacaaatgcgagtttggatgagtctgcagatactggactgt

SEQ ID NO: 40117 - DNA, 201 bp, Bos taurus
ccacatggttacgttatcagcacattaaagcaggagtgcttagagacaggaagaaacagataaggactacggtcttcacagaactcattctaataccttcyacatcttggaaggtgagaaaccagcagaggttgcaagtgtcctgccatggcatctcctgtcctttgtccctaggtcaggagaacacgctcctcacgtcca

SEQ ID NO: 40118 - DNA, 201 bp, Bos taurus
aattgaaaaaatagaaataaaaaacagctgagtggttggttttctgtctcggctttattgcacagttcaaagccaggattacggaggtcattaagcagcaytgtctctgtgacatgattagtcaggtagcaaagtccatttgtcacctgcagcagcaaattgagttaatactgcactacaggctatggggactgtataata

SEQ ID NO: 40119 - DNA, 201 bp, Bos taurus
cttgtttttacagacattcttaacctaaagccaaaacgtgcactggcgctaccaagcggccgcgtcttattccactcaagggctctgatgtctacaaggcrtgctgatagggacgcttgctcatatacacgctgcatccccactgcctgctcgttctcaggttttctttctcttcttccccttctttctttcagaatgttt

SEQ ID NO: 40120 - DNA, 201 bp, Bos taurus
gctgacagagaaaaaatatagtaatctcaaaataaactacataaaataccaagcttcagacactaaaggaaggaaaactagagcatgtctgggctcttgamaggagaagaactctgtgtctatttacacagactacagtttgctcaatctataagtaacagttaatctgtaactcactgattctattacatgttcaatact

SEQ ID NO: 40121 - DNA, 201 bp, Bos taurus
actttgcacgtctgggcccccacggaggtgcttccctgagctctccctcctcgtgtgctaagcagactgcagctcacctttcaacactgggctcaggtgcrtcccccagaaagatgcatccccggcctcctgccttctaatgaccagggccagaaagggcaggggggagcctttcacgcgaactgccagggcctctgcacc

SEQ ID NO: 40122 - DNA, 201 bp, Bos taurus
aactaaaccctttaaaatgttatgtctggccaaaattttaagatgcataaagttcaaaaagaagtcaattgatactcatctacccacactcccagcgaaayggccttgcctatagtacctgatatcttgcctgtcatgtttttatagcatttatatgaggtgttgacccttaacccaaggacaccagacccccatgctggc

SEQ ID NO: 40123 - DNA, 201 bp, Bos taurus
gcaaacacctttttatttccatcaggtctcagtttctgaaatgttggttgacagtggatgggagcccagaacgaaaccctgtgactgtcatggatagtttyggcctcaggtgatttcgtcagggtctgctgttccttctcagttgaaaacctcttccctgcttggcagtgcccttccctgccttcccagtgcacatgactc

SEQ ID NO: 40124 - DNA, 201 bp, Bos taurus
cttgagcacgtggcacatcacctttggaactatggaatcgtcagtctctagaaagcgtgatgactgaccagcaccttctcctcattggcgctttcatctaytgagcatgtatttttcaagtgctgctccctgttggaaccactcgtttccagagacctggagctgtgagcacttagcacaggtggtgggcaggtgcaggca

SEQ ID NO: 40125 - DNA, 201 bp, Bos taurus
gctgtcatcactgtgcagagtaagtgtgtgtgcctgtgtgtgtctggggatgtgcacacctgtgcagagcaagcttcacggtatagtactacatggcacamagcctttgcggcccgcagagcactcacattccaaggtttctcagtgatgctctcaacactcctctgccctgagctgggataatggccattgctttacacg

SEQ ID NO: 40126 - DNA, 201 bp, Bos taurus
ccatactccccacaaggaggcctttcccacctttgtggatgtcagcctctgctgtacttgaactcccagcagccaccacctgtggctctatgaaggatgayggccacatatataaagttctagaagactctgagagtataattacttccttctcaccagcatgatgggtgtggacccgtcttctggtggcaccagcccggg

SEQ ID NO: 40127 - DNA, 201 bp, Bos taurus
ccttgctgtggtgtcccggcgttttccttactgatgactcttagccattctgcaaataccaccaggcatctggaagtggtggcgagatactgaagccgacrtgtccccatgggcagaaaagaaaggcaagtggagaacttcctcagccgtcactcggccattaaacaaatggcctggtagagacacaactgcgttgacctt

SEQ ID NO: 40128 - DNA, 201 bp, Bos taurus
ttaaaaccttccaaaagagagtattttgctgaggccactaaataagctaaagcaaagttgtatgaaataaaaaatacagctccaccatatagactggctayaataatttctttctagaaatacaaaaagtggccacattaaaatatgttcagtatgtattctttcttatatgtaaacagaaaaatgtcctagagttttcaa

SEQ ID NO: 40129 - DNA, 201 bp, Bos taurus
caaaatagctgaagactagatgcgtataaatctgatttctaaaagttttgcttgacatcataaggaaacatttaagaagctaagtcttaggtgtcagtgtktgttaccaagctccaacccaacaatatctgctatgtttgccactgtttttagcatgattaatgaagaaatgctttattcataatttatttatttatcctt

SEQ ID NO: 40130 - DNA, 201 bp, Bos taurus
atgggtgggctctcctgacacttaggaatctcccagaagttccagacggaattttagagtgaatcgcaagctctttccaagggcctctactggatgctcamgagaagcctggttgaaggaggattcttgaaattatccacattggtggtgcctcagcaggaaatttcaccctcatctggcccatgtgtcactcagagcaga

SEQ ID NO: 40131 - DNA, 201 bp, Bos taurus
ttttctaaatgccattttattggcatgcaactaagcttccaaaatcttgtaagacattttgtattattttcctcattaagcagctaccaaaaaaatatgakttgacccaggtcagacactaattgagactggtgtctttatttgaatagatctgcctttggatagcctcagctagaataaaatgtaggacatttttaaacc

SEQ ID NO: 40132 - DNA, 201 bp, Bos taurus
gcatttgagtggaaccctgggtcttcatagtcctcaggactatgtttcagattcatgctttttccagtgtttttatccaatttgtctctattcctctataygtttcccagttctcaaattcacaaggaaataataccagatgggcaatcacaatggccctgtttaccaagcattgtgtgtatggttagtgactgaaaaaag

SEQ ID NO: 40133 - DNA, 201 bp, Bos taurus
actcctgaaagttagacattattgcaccatttaagctccaaaatgaaaagtttttgccttgaaggtgcaatgtattacaagtacatttcaatagaatccaygactgaatatcactttgcaatttgaaatatcactcaacaaatatcacccaaagggaaacattggccaacagcttatttggatatatcccatctatcaagt

SEQ ID NO: 40134 - DNA, 201 bp, Bos taurus
aataggcaactggaaaaacatttaaacataatacaggagctcaaatacttatgatatgccaagtgaattaattggatattacgaacacagtctcaatttgkatatcaaaattagaaacagtaataatcatacaaaatatatgactatttccattttgggggtcacaattttggttgtttctatctttgtcacatttgctct

SEQ ID NO: 40135 - DNA, 201 bp, Bos taurus
ctaatgtgccattctaacttatgtcatcatcatctgcttcatagactattggacttgacttttagctacactttctatctctgctcttgattcctgtggtkgtggtttagtcatgtcctactcttcacaaacccctcgactgtaaaacccaccaggctcctctgttcatgggattcttcagacaaggatactgaagtcggt

SEQ ID NO: 40136 - DNA, 201 bp, Bos taurus
atcatttaacctgtagatccacagagatgtgtactatggaatttgtaaggccctcgtaagctccaaaattctgattctaaagttagtctcagcgcaagtcrtcagcgcagaacaaaggaaagaggccctcagccctcactcggaggcagacatgagttcatcaagcagaaaactctctagtgagttgtcagtctttgaagt

SEQ ID NO: 40137 - DNA, 201 bp, Bos taurus
aatcttgaattttttacaaagacaattttatttgtgaatgtcctggttcaagcagcccaagttactagttttattaaatcctgaaactttgaatatgattrtgaatttttggtatggcaaaatatgaagtgtagagcagttgtgctgaattctgaagagcgacatttttagagggaaagcacaaggagactaagtttaaaa

SEQ ID NO: 40138 - DNA, 201 bp, Bos taurus
tagtggttgtactgatgtccattctcaccaacagtgtaagagggtttcccttttctccacaccttctcaagcatttattttttatagactttgatggtggygactctgaccagatggagatgatactcattgtacttttgacacgactgagtgactgaactgaactgaactgaataatgagctacattgagcatctttccc

SEQ ID NO: 40139 - DNA, 201 bp, Bos taurus
ctaaaccggtggacaaaggcccaattccagtattataaagctgtaaagctccatagcaaggaaaaaccaccatattttattttcaccatttacaatattgmcctggccagaaaagaaagaaatctctatttatcgccaccatttcttttggtggagaagattttattgcatttttgacacttattcagatcaagactttat

SEQ ID NO: 40140 - DNA, 201 bp, Bos taurus
agtgagattaatattttccagcttgctgacagcatctattctgcagcccatggatcaaaggagtaatttttacttttgagaattatattttgtaaggttaytgcggtcataaatggttattctactgatggatctgatcaaagcaaattaaaaaccttctggaaaggattgatcattctaaatgccatgaaaagctttcat

SEQ ID NO: 40141 - DNA, 201 bp, Bos taurus
aagccagctcaagatctcagtcaactcttcccattagaaataaaaatgcccacatatatactgctttcagtgttcctattgatattgtatccctcaagctyttgacttaaatctttcctattcttccgaccttatgtcagtactacagactacaacagccttacctgagtgtctggtcattgtaccgtatctgatggggtg

SEQ ID NO: 40142 - DNA, 201 bp, Bos taurus
caatggacatgagtttgaggaagctccaggagatggtgatggacagggaggtctggcttgctccagtccatggaattgcaaatagtcagacatgactgagygactaaaaacccacaacaggcagtcaaatccttctttttctttgaacttttgacacccattctgtgcctagccaaagggagatctctgcttttaaagggc

SEQ ID NO: 40143 - DNA, 201 bp, Bos taurus
gtacatcaactctaagagccctattcatcacacgcaaggcttccgcagtcaggcggccttaattctctggttttgtattgcgagtcaggccacaagatacrtattatttcacaaggaaatactggagatggttggaggcgcttgcagacacacacacgggatggaataatgacgtctggcccgtttactccatgcacagga

SEQ ID NO: 40144 - DNA, 201 bp, Bos taurus
gccgcccaaagaccttgacgtcaggagatggcagggacctcgcctccctccccagatctgccagatgccttcctggcagctactgcggcctgcctggccckctgagtaacgcggaacatctcggtgtcactgtagccatctacactctcgctggcataaggagtgatcgcccctggtaactgactgaccatccacgtgacg

SEQ ID NO: 40145 - DNA, 201 bp, Bos taurus
ttatttcttcttatcttctttatttcttctctgtttctcatctgagcaatttaatttaattcaacaattccttactgactgcctgatatacccaagacackatctttggttcagggggatacaaagttttttaagatgcagtctcaacaccccatgaatcaaaatgttatcaaacaaacagtagcttagtggaaataaaaa

SEQ ID NO: 40146 - DNA, 201 bp, Bos taurus
ccttctgctcgcccacctccaaatgcagatgccaaaaaagcgtgatccttccttttccagccacttttgtggttcagggagggaggccatgagaccccctytgcccagagagatgtaggcagagcgacctccgggaaagatatttctccgtggatacaggagatgggtgtgtgggaagggtggccttttccaccctgacag

SEQ ID NO: 40147 - DNA, 201 bp, Bos taurus
catcccctggtccactgagctctccccttcctcgccgagcacgtcttgtcttccctcagacctcctacatctcccctaccttcaatctcagctgaaggccrggctccctacttaccggagacaatcgagaccttcagaagcaaacgtgacaccgcagcgccgcggcagcccacgcccacccggctaccataaacccaccga

SEQ ID NO: 40148 - DNA, 201 bp, Bos taurus
acccagggctggacgcaccttggttcttcacggatgatgtgcagtactagggtcttgccctcttccttccaggtccctagagcatccctcagaggaagttrcaacacccttggccttgggcggggggcagctggcccaggggcaggagagatgtcgcctctgcttccaagcaatgaaggcaaggcgtaatggtttgatgcc

SEQ ID NO: 40149 - DNA, 201 bp, Bos taurus
ctcacttctgtgtcacgtcatgtattcgtttcccttagttaactgtaaagcgacacttggcggaaaaatcatgaaacctcgatgagacactataggactcratcattggccatttcttttcacttctgagatttctctcttttttattcttatttattttgggctgcgctgggtcttcgttgctcagtgggctttctctag

SEQ ID NO: 40150 - DNA, 201 bp, Bos taurus
agtggcctggatgctatgctctggacatgtgcatccatgtcccccgcttggctgtggtcattcctgcccctgcatgtcctttggcctagagcctggtcccyacagctggctgtgccttcaaggtgagacttcagggctccgtgattctgaccaagggttgggaggccttggcattgacgggggcttgcttgaaagatggcg

SEQ ID NO: 40151 - DNA, 201 bp, Bos taurus
ctgtcatccaatgtccagcatgtcagactggacaggggccgggcagtgcccagggtgttcactgctgcaatttgattcttcagcaacacaaagtaggagcratgggattaccaagggcctcctaatgtattcaggaggttgttttatgttttaaaaattatcactggatggaggatatgaattaggatgtttgatctgtct

SEQ ID NO: 40152 - DNA, 201 bp, Bos taurus
agaaccccatggagggaggagccctacaggttgcagtccatagggctgcacagagtcagacatgactgaagtgacttagcatgcatgtaaggcctcattayagctagtgtgaaagggaaatgacttaaaaatatttccctgtgtaagcaaaagctgattctattacaagtagcaaacttgggttgacttgactcctatcat

SEQ ID NO: 40153 - DNA, 201 bp, Bos taurus
agaggcactgagtatcattatgatgttcccattcagactggatattaacaggactgccgtgttgttgttttcaggctgtaacaccaaaagatttgcatgamatactcatgaggccaactcccatcttccagcaccaaagagattttagattcttctctgtgattctctgaggagtttcggtagaaaataaatgtctcaaga

SEQ ID NO: 40154 - DNA, 201 bp, Bos taurus
acaggcattgtttgcttaattctccaagcttgaatggaaacctcagaagtcagaccacctgggaacaaaatccagacacagccagataataaacaggcacygataacatctgtagcaacagagagaccaagcttactaacagtcttccacagcacattctcaccacgataagccatgcagttcataggtggatcttaatgc

SEQ ID NO: 40155 - DNA, 201 bp, Bos taurus
actagaaaaacaaaaataaggaaggaaggaaagggaagagagggagagagagacagagggagggaaatccactttccatagaaagtcaactgaatgatatrtgaaattctagcaggtcaactgctattaattatatgacagttacaacttcccagtgctctgagttagtcttttgctcagctctccatggcctagtatgtg

SEQ ID NO: 40156 - DNA, 201 bp, Bos taurus
acactcatttttatctgtaacttaatttagcaaaaagctagtatctcataaaatataagaattcatatcactaattcaaagattgttttcattaatatttyagtgtttcaaaaatacttctactggccatttgactgtaaaaagcagaggtcattaaggatgagaggaagcagtgtatatggctatcatttacatttatat

SEQ ID NO: 40157 - DNA, 201 bp, Bos taurus
agatataatctaatctttagataaaaatggattcttaaaaaaaaacaataccataatttctatgagaaaaatgatgtgtaataaactaatacacttgtagytcaaatgacatcaattatgattttgaaagttaatgaactaatcccctttctgtttattaacatcaagggtatctatataggttatatggactctgttttc

SEQ ID NO: 40158 - DNA, 201 bp, Bos taurus
acctggaaaaggcagggaatagattatccccctggagcttctagagggggcacgtctaggagacatgttgattctggcccaattgatactgattttggacytcaggtgtacagaacaattaaacaataaatctctgttatttgaaggctccaagattgtggtgcttcgttacagaagccttaggaaactgacctaggcccc

SEQ ID NO: 40159 - DNA, 201 bp, Bos taurus
aatatttggtcatcaccacagacacatgactaatgtacctattctttctgtggaattctcctattttaaatctttacgttctcatcttttcctccatccaygtattttcctatgtgttgtatttcatagtaaaggaaagtgaaaacatttgatttcatcagaaaaataactatttaagtttagacagacttctccattagc

SEQ ID NO: 40160 - DNA, 201 bp, Bos taurus
tataggtcacttcacgttcacaaatgccctgggccccttcaggaaagaaattggcaatcaccaaggaaattgattcggattacttcaggaaatacagatayaagatggccagaaaaccacatgacccagtccagtagggaagaaaatctaaggtgggtatccggcttcccgtcattgcagggcacttcccaggaggccccc

SEQ ID NO: 40161 - DNA, 201 bp, Bos taurus
aaaacccagagtcactgcttgatgctttccagcaggttatgtctttttgctaattggagaaactggacatttgtgctatttcactggttcacagttacatygagcatattctagagggtcatacacccatgtacatgtacatgcctgtatgtatgcatatgcttccctggttgctcaggtggtaaaacgtctgcctgcaat

SEQ ID NO: 40162 - DNA, 201 bp, Bos taurus
gcatgactacccattccatggattccccattgcctggagaattccactggacagaggagcctggtaggctacagtccacagggccgccaagagtcggtcaygactaaagcaacctggcatgcacgcacaatggagacaatatttaaagactggacagtgaacagtacttaaggaaggaatctgccagaaggttagggccca

SEQ ID NO: 40163 - DNA, 201 bp, Bos taurus
atggcagaggatgaaatggttggatggcatcaccaactcaatggacatgaatttgggtagactctgggagttggtgatggacagggaggcctggcatgctytggttcaaggagttgcaaagcatcagactgagtaactgaactgaactgaacgtgaaaagagctgaaacacacagaccctttcctagaaccaaggcccacc

SEQ ID NO: 40164 - DNA, 201 bp, Bos taurus
catggcctcccaccctcaaccccttgacctttcatttatttttaaaatttttactgcaacctgggattctcttgtaagctctttccttttctctctacatkcactatcacatggccgaggacttattccctcctatagaacatattgaagtgcaattcctacttctgtgctgagtcttgagtctccaacttccatccactc

SEQ ID NO: 40165 - DNA, 201 bp, Bos taurus
tgaaaacccattccagtactcttgcctgggaattcccatggacagaggagcctggcaggctacagtccatgggattgcaaagagtgggacacgactaggcmcatgtttgcacacagcatgcctacatcttagcctatatcctttacatcttctcctctcatcagaggtacattctccttcctgctgtctaagaccaacatc

SEQ ID NO: 40166 - DNA, 201 bp, Bos taurus
ttcttaccagactttacagagacactgcaaggttctccgtggggactgagaagagcgtactgcaccgtgcctggatgaggaggttgataatgagtgatgcmggaggttaaaagtactgccagtagcagcatcctcatctctagcaacatatacaggaaaactagcatccagccccacaaccccagatgggtgttatccttt

SEQ ID NO: 40167 - DNA, 201 bp, Bos taurus
aagctatagtccatgggtcatggagaatcagacacaactgagtgactgatcatgcaagcatgcagagtacaataataaatattggagagtgaagcagacayagtttagtctataaaagtgggaaatggttaaactacttaacatatccaaagcatatgctctttccattatactaggcagtgtgtgtgtgagtgcatgcat

SEQ ID NO: 40168 - DNA, 201 bp, Bos taurus
ttgacttgccaaccattttctgcagcccatatgaagcgggtcccctcctttctacctgtagctctaaggatctgatactaggaagtcacgactacatgaayctgtatttagtactagaacagggcacatattgctctcatgtcatcatttgatattctattcattcatactgtatttacaactagatttccttttataaag

SEQ ID NO: 40169 - DNA, 201 bp, Bos taurus
agcccgctataggagcagagcaggcgtaagtcttatgttggtgaaccttggcagaagcagttcaagccagctcagctctgtggtctgatgccagcactttyctcagcgactgcagcttgcttgatcctcgtcatggtgtagactgcactgcatagcttatctaattattctgcattgggtgtatctctcagcatacatttt

SEQ ID NO: 40170 - DNA, 201 bp, Bos taurus
ctgacactgctgagaatcttgaatcactaaatttctctcatccttcttaccaacagaaccagctccaatttcactgacaaaaatgtggccatcagttaaaytgatagtactaaattatgtcacctgacagtttgtgcatgcctgggctttttaagcctttcctgcaacccctaactgtctccaggccaatagcagtagcta

SEQ ID NO: 40171 - DNA, 201 bp, Bos taurus
tatccagctcatctaactactaatatttccctgctgtttttagaaagcacttttgataagaaacatcatttttaagatggcttaaatatatgaacaggcaygacaagatctggccaaaatcaggcagcggataaaggtcacgattttccccacaagactctattggatttatatacagaactcacagattttacctctttg

SEQ ID NO: 40172 - DNA, 201 bp, Bos taurus
gtgccctgcccaaagtcacttctcatttgaacccaggaggtctgctcctacagcctataagtagttcatcccacagtatgactcacaaagaaggggcctcyccattctccaaaacaacagcatgtggagaaagagctgggcttcattggaaatggtatcggatgcttcaatatcattatccttcattaaactgcagtgtta

SEQ ID NO: 40173 - DNA, 201 bp, Bos taurus
tttaaaaaccaccatgtgaagcaaaaacaaaatctttatatctaattgaaaaagttcataaaaggaagaaaaaaattgaatcacagctttgcaaagcttgrttactagattgctgtcaggaataccatttctatctaggacatcataatacttacagaatttttatctttcatagatttctgtacatacgtcattaaaata

SEQ ID NO: 40174 - DNA, 201 bp, Bos taurus
ggaaattatcaatctctgttaatccttctatacaatgaccttacatttgaaatgcctactgttgcgtgatgagttcttcatgcaattttgggcaaaaattytcaaaagggaatctggcagaacagcatcttggctcattcattcactggggactctgaacacagagaaaggttgctgtgttctaggcactgtttcaggtgt

SEQ ID NO: 40175 - DNA, 201 bp, Bos taurus
actaaagtcatttgtttgtggctgctgatagaaaatggtaaagcatataactaattatataataaatataaataatatctcctagggcctttttagtttayagagtacttgcatgtgccttgtttcatttaattattataatagtattgacaggtaatattacagcttaattacagaatagaaactaatgcctcacgtgtc

SEQ ID NO: 40176 - DNA, 201 bp, Bos taurus
gagctgatgatagacaggaaggcctggcgtgttgcagtccatggggtcgcaaagagtcagacaggactgagctactgaactaaattgaatctgtccacccrtcctggcctctcttctcagtcccttccagagcacagagctgataatcagttatagttcccctcaggtctttcaattactttgttatttttattttactgt

SEQ ID NO: 40177 - DNA, 201 bp, Bos taurus
caagggatgaagaaatgtatcccaagcaaatataaatcaaaagaaagctgaggtagcaaaataaactttaaaactttaatcagacaaaataaactttaaarcaaagactgtgacaagagacaagaatatcatataaagggatcaatccaatgagaatatgtaacagttgtaaatataatgcaaccaacataagagaaccta

SEQ ID NO: 40178 - DNA, 201 bp, Bos taurus
cttaaaatgatgaaaggaaaaaaacctacaaccaagactacccaacaaggatcatactaaaggagcttctctagacaggaaacactggaaaggcctataarcaatgaagtagatggtaatgtgtcatcagttcagttcagtctctcagtcatgtccgactctttgcgaccccatggactgcagcatgccaggcctccctgt

SEQ ID NO: 40179 - DNA, 201 bp, Bos taurus
caagcccagatttctattgttccatagttccttcctttttctcctgaattaggtttcatctccatatctccacttaaagataaattatgctcataagaagmagtgcagacagactttgaatttcaatttagttttacttccattatattgcaaatgccttcaaaagctatgctaatctgttattttaaactgctttattac

SEQ ID NO: 40180 - DNA, 201 bp, Bos taurus
aataaggagaaagactttccatggcaaaaagagtgaaaaaaaaaaaaaatccagagagtgtatcttctccatcagttgtggccccacctgggagaaagccrtggggtttgagatgcagttgtctgccaaatcaaaattgggatctgggtgaatgagttttcttcctctcagccctgctgagcctcattttcagagctcgaa

SEQ ID NO: 40181 - DNA, 201 bp, Bos taurus
tttctcatagttttggagactacaaggccaaaatcaaggtatcagcaggattggatccttttgtggcctgtgagggatgaatccattccaggcctttcttyctaggttacagatagctgttttatcctccggtgtccccgcattgtcttcccccatatctacctttgtcctcatttcctcttcatataaagacagcaatca

SEQ ID NO: 40182 - DNA, 201 bp, Bos taurus
ttgtctcagactgcatagataatgaaaaatggcctgcttacactgcaagagtagcaaaaagatatgtttgtttgtgtgtgtgtgtgtgtgtcttgtctttkgggccagaaaagaagtagaatgactaacgcaaacactgaacaaaattaatacatatttttatcatccttaatttctaacaaattgcaagaaatgactgga

SEQ ID NO: 40183 - DNA, 201 bp, Bos taurus
tctatccaatatatcttgcataatccaacatatgtaactttcaacacagtaggcaagactcacaaaataaacattaatatcctctcaaattagagactgcytgttattagactacaaggtttgattgttttttatttttccttgccccctgttcttacagttaagagttgggtagttgctggttttatgtaatagcaattc

SEQ ID NO: 40184 - DNA, 201 bp, Bos taurus
tgtatacacttgtatctgtttcttccaaggctaagggccatatcttacacaaggctgttagttacatatatgttgtctaataatacataatgtgtgatccrtgacttctcttggccactcagagttgatatctctgtggcagcagcacaacagctccacacccctctatctgcaagtccatacaaataggtttccacacca

SEQ ID NO: 40185 - DNA, 201 bp, Bos taurus
agatgttccatcaaaagaaaatttaaaatatagatatgaatgcaaatgatatatttccttctaatattgtaatgagttatattgtaaaatttattgtacartattgttattgttatattgtaaagaacacttgattgtaaagaacactttaaatattgttatattgtaaagttatattgtaaacaacacttgagtagaaaa

SEQ ID NO: 40186 - DNA, 201 bp, Bos taurus
gggaaaggctacccactccagtattctggccaggagaattccatagactatatagtccatggggtctcaaagagtcccacacaactcaaagactttcactytcaactcaatcttaagagtcagggaagagtgtctgtataaacagtcccaatataggtttcaactccatgtgattctttatcttcctgctcatctctggct

SEQ ID NO: 40187 - DNA, 201 bp, Bos taurus
ctgtcagtctacattgggaactgggatgttactaattctgtaaagcacatttagtcctgtgaaaagtggtatacaaataaaatgattgatgtcctgtcaayaggaacttcacgaagaggatcaaacagagcagtttcttttgaagaagggatggaggttaggggaaaggtgttagattttacttttctatcataaacccca

SEQ ID NO: 40188 - DNA, 201 bp, Bos taurus
aagaatctgataattcagttccaccccaggcctatgctaatattcagccaattgtggaatgccttgacctctgtggaagatgcattcgggttctgtgcagyatcagattgggagtttgggcccagatacaatttttattagaaattgagagtcaggcataataaggaggggggattttgatcacaaaagaaatgtatagga

SEQ ID NO: 40189 - DNA, 201 bp, Bos taurus
actcttgagtaaagacctaagagtagaacagtctgaatcatatgtttatatgttttgttaagaaactatcaactatttttagagtgtttatagtagtcatyattttacgttccaccagcagaatgtgacagtaccattttgtcaacattctcttcaatagttgattttaagcatttattttagcctttaattttagttatt

SEQ ID NO: 40190 - DNA, 201 bp, Bos taurus
tgtgcacagactcatataggaaaggaaatgtcataactttagacatttgatatgaatgatatccatcttctttttgtacagacaaaactgtttctttcccytcttagcaaaattattttccattcctttggttcctttaagtttttggtattaaaatgtattaatggtaattataaaaatatattgcatgtactttcagat

SEQ ID NO: 40191 - DNA, 201 bp, Bos taurus
ggcatgcgctgcaattaagtaaatgaatgaatgaagtacattgggatctcagttgactgtgttatctacttcaagaattgctgggagtaggaaaaagcacrcaaaatgtctcacttactcctccctgttggccccattgttcccattctgccctctttgtttgtacgtagaagaaggctagcatcaggaatgtttcacgca

SEQ ID NO: 40192 - DNA, 201 bp, Bos taurus
ggtggttgtacaatttaaaaaccagagacttttacctctaaacttcgattatctacaccccggccccattgttgactttgtcatcacctgaaaattctgtrtgtcaggaatccttatcactggctacaagcagaagcccagtagctatgtcactggtgggtcccagaattcagtgagaaatgtagaggctgccctgctgag

SEQ ID NO: 40193 - DNA, 201 bp, Bos taurus
gcacccagggttggctggccacatttggagttagatgggactctcccaggctcacctccagaagaggaccatctgagggtgctcacagcaacattgccttmcttcccaggctcatcaacaggcctgagatagcttcttttcacttctattaatcttgttaacaatttaatgccttgcatgtattcttttctgaccagatct

SEQ ID NO: 40194 - DNA, 201 bp, Bos taurus
caaggcagaatctgggtttacctaatcatatgacatgactttgagtggatggagctaagggaaattgcttcactgcatctggattactcacatttttgaaygtccatagttttatgagaattgtttgaacacagaatcaatatatagaaacttgcagaaaaagataatagttaaaaagagaataaaaagaatagccaagaa

SEQ ID NO: 40195 - DNA, 201 bp, Bos taurus
tatccctcgcaggtcaagtcagttccagggtcctggatttggttttgcagctcgaaggcggtgtcctcgcacccgtgaaaaatggccacataatagcccayggtgcccagggcatagcagtcagaggacaccagcaagtagatgagcagtgtcacaggacctcccagcaagaggagggcagtgccaggcccagggctgccg

SEQ ID NO: 40196 - DNA, 201 bp, Bos taurus
atacatccaacaaagtaaaaagaaaaataagcatcctttccttgtttatgtgttgttttaagtgatttccttcgatgcttcgagcaccgtatttgtttccrtggggcagatacgtgccctcccctttgtcttgatttgagatagagacagaaggatcactgcactctccttcttactcacatagcagacgatccacgtgtc

SEQ ID NO: 40197 - DNA, 201 bp, Bos taurus
gaagagtaaaggaaatatggaattctgtgagtcatgtagaatttaggaaatggttataaataagtgtgcagtcttctccacttcttctcaccttctacttyaatggcttgtctctccaaaagaaaatcaggatgttagagcttctgatcctcctggactgctgttttttatggtctatgtgactattcctccaatatgaaa

SEQ ID NO: 40198 - DNA, 201 bp, Bos taurus
ttttatctatcaacaggactgtaccatgggagcccaaacatttggccaaagatttttctgggtgtgtctatgaggatgtttctggatgagattaacatttyaataggtagactgactgaagcagattgccctctttaatttgggtgggtctcatccagtcaaaggaagactggaatagaacaaaaagactgaattagaggg

SEQ ID NO: 40199 - DNA, 201 bp, Bos taurus
acgtagatcaactcctaggaaatcagctatgttaaccattatgccaccaatgctgcatcataaatgcgttagaaaaaagcaaaaggcatcagaattgcagrcattctgtcaagtcaagaatttaagtcccaaagaagtgtctatccaagttcaccagctagtccctggcatgatcaggataaacctacttctaaacctgtt

SEQ ID NO: 40200 - DNA, 201 bp, Bos taurus
gttattcacattgtctctctgacccaacctcagaagtttttgatcgtttctttgttttctggtatgaaaacatatcccagttcatagtaaatattttctgkcacagatctgaaacctaataatcctattttctttcagtgggattggttattttgagaatattatgtgacttgtagatgtgctcatagctagtggtttagt

SEQ ID NO: 40201 - DNA, 201 bp, Bos taurus
ccgtcaatctagggtaataaaacaattcaaggttttacttaatcccaggcatccaaagttaccagtgactgttggctcaacaaaaacaagttatttggagytgggacagatgagaaggaatctgtgttgagggtagcatttctcagagtgctcagctttcaaatccttgagaatatcctctctaaatctcccttgcttttt

SEQ ID NO: 40202 - DNA, 201 bp, Bos taurus
agaggaaagaaatatataggatagctcatacaaagatattaatagagaatattttatgtgtcataaaatagacaatttattttcactacaaataagttctkaattcattggcatatggtttttgaaatctatagtgaatattacctcatccttaaaatttgcttttaacataaagctagaagaacaaggtatcttagacaa

SEQ ID NO: 40203 - DNA, 201 bp, Bos taurus
acaccctgcaagcttgagtgcttatcaagccagcactgataagatggttaagaagggtgtgtacagagggtatggaatcagagacagaattcccctgggtytcaacttttatataagtcaccatccttgtcaaccagagccaccactttttgggtgttcaccccaaatgaagcaaggcactgcaggaagtcttacttcacc

SEQ ID NO: 40204 - DNA, 201 bp, Bos taurus
ctacagatgtacctggccaacatggaataataagatgatcaactgcagactcactttcaaaatgtgatacgggctctgaactaatgaccaatatgtagtaytattccttccatggccataaagcatgagtttggaaataaagaggagaagggggggactaatctcgctgttatacctaataaatcacacaaaaatttttgc

SEQ ID NO: 40205 - DNA, 201 bp, Bos taurus
ccttggagtactaggaaatgttgtaggtgaataatgtcaagcttaaaaacgagcccctgaactcagaaggctttagacctggcctcaagctgcttgcatcrccacccttctccacaaggggtacagatttcatgggaagacatgaagaggcagagcaaagcaatgatgccaacaatcaagtattttattaaagcaccaact

SEQ ID NO: 40206 - DNA, 201 bp, Bos taurus
aaggcctggtgaagtacagtttggtcctgctgataaagggaactagctagggggagagccttttccactgagtaggaggtatatctggtgagagaagcagracttatggttataggccttagggaccccgtgaggctccaagatgtcaaagcagcatttaatattgcaagttaatgtcaagcctcccattacaacatgaaa

SEQ ID NO: 40207 - DNA, 201 bp, Bos taurus
gctttcagtggctttaattttcaatggtaagcacagcttctatatagtgttgtcaaaaccgcaatgaagtcatgtcattgaatattaaaggcccggcccgyggaatgccaacacagagatttgaatttcatgctcgctcctaaacatcaagacaaatatgtctaatttcataaaaacccggccagccccagggaggctgac

SEQ ID NO: 40208 - DNA, 201 bp, Bos taurus
taagatggcccagctcacaccaaaaggtgcttttctgagatcttccctaataaatgcacagcccactctcttccatgatgctacacccaataggagccagracaaggccttcccagttgcttgctgagcctccagacacagcgcccacacaaaatggttcaattttaaaggaaagaatggcctgatggcagaagggaaatt

SEQ ID NO: 40209 - DNA, 201 bp, Bos taurus
tggcagcaccagagagcacacgccccttgttcagactgcaccgccggccaagcctttagaatcttgctttgtgtccagactgttttcgctagtctgacttmatctggggaccactcctttggccacctggagctttccctgagcagtgaaagttcttcttgaaaatactttttctagacacaggctcagtctcagggtaaa

SEQ ID NO: 40210 - DNA, 201 bp, Bos taurus
gcccacaggcccacttcagccctgcctgtcacaaggtgtgaaggaccctggaggcaggacccaaggtgggtggaggggcccaaatgactgggaccctgccyagctcctttccctgtcttctgtgggaagtggaggtgccgggcattgtctaaagatggaagggagccagttaacctctgtcaggccgtgtcttgggcacat

SEQ ID NO: 40211 - DNA, 201 bp, Bos taurus
aaaaggaagtggccctgcgccccagccatgaaccccccacatagggaaacttggagcctgggggcccacgtctggtctctccaccagcccgggcccccgcytgtctcagtctctctctggcaggacgaaggttggggcaagtgtgacagcccgtccgtgagacgttcatttccactccgtgcagagcaggtgcaggccagt

SEQ ID NO: 40212 - DNA, 201 bp, Bos taurus
taggtgagccgccattgctcagatgctgcgactgtggtcacgagagcagggcctggaggtgagtgcccaaaaggaccggctggagtgacctcagccctccmgccccaccctgagaaagacaatggccaagtcaagaaaggctggtcctgtgagaagatgtgtcacaagacaggatgaagatgtgctgagcaaaggggatgt

SEQ ID NO: 40213 - DNA, 201 bp, Bos taurus
taacagatttttacctttcaaatgaaatatttcaggaaaatgcctacagtgattggaagttgttgcactgtttaatcttggccagcctggggaccagctgkgatgtgaaggaattaaatgcagggctttagattgagaaaacctgagtatggccagtcagttaacctctctgagcctcagtttacctgcttgtaaaatgga

SEQ ID NO: 40214 - DNA, 201 bp, Bos taurus
cacataggccacagagaagagggaaagcaaagaataagatgatatgaaagaaaggaagcagcagagaagggagaaaaagcccagcaggagagaggagagawgcagcaggcagcgggccctgctcaggagggaaggaagctgccccagacctcgggatcctccaggagacaggccccgtgctctggcttcagccctgcgtca

SEQ ID NO: 40215 - DNA, 201 bp, Bos taurus
taacccctaatatttcagtgcatagatatgctgtaattttaaccactctccttttcttagatttcttctaactccccatcacaaataatgctgtacagaayatttttatgtgcacagtatctctttcatttttagagctacttacgatatgtaccagagaaggcaatggcaccccactccagtactcttgcctggaaaatc

SEQ ID NO: 40216 - DNA, 201 bp, Bos taurus
ccctcgccacttgaaccagtgtctggcttcgtttatctttgacatcaagtctagcctcagggactcatctttcttggggccgttccccactgcaaccactyctcttccccacctcaactgagaagacagggctgacccccctcacacacaccccacgggccagtccgtcctctccttctcccagagctcctcttcgtcctg

SEQ ID NO: 40217 - DNA, 201 bp, Bos taurus
tgtcacctacttaaacgcttccaggtgttgatcaaccagtcacctcccaaggcctttcctatgaccagtctgtctgtagaccccaggcctgtggccctccratgggataccatcagaaccagattttcccaatgttgggggtgggggggaaatcacatcaactcagttaggagtgaggaacaagcccatttagtacaattt

SEQ ID NO: 40218 - DNA, 201 bp, Bos taurus
cacccagaaaagcaagtgggtggaagaggctgttttggccacagttgccctccattctactttctcatcacaacttcatcttttctcaccctgagaccttyggaatcccacagaggcttggccagtgcccagccgggtgaaggagctggctgctggaacaggatgagagctatattcccagtacaatggggcacttgcttc

SEQ ID NO: 40219 - DNA, 201 bp, Bos taurus
aggacgtgcctgttctgaattgatggcctgaggcagagctcaactttaatgtgtgtgtgagtcacctggagatctagttaaaatccaggttctaatccatkcactctggggtgtggcctgagatcatgcatttctaaatagctcccaggggatgcagtgctgttttcatgagaacagattatactgtgtgacctgagggac

SEQ ID NO: 40220 - DNA, 201 bp, Bos taurus
aggcatggagcagcatcgctggtgcatatggcagcaacagcaggtactgcatcgggaaaaggggaggggggtggggggaggcctggggaagcctggtctckgtctgtgccaggcacaagttctttaccatcgcacctcatgcctgtcgtgaccttccagtgaatgcggccctatcatcctgactttaaagatggagaaact

SEQ ID NO: 40221 - DNA, 201 bp, Bos taurus
accaccaaccaatcagaagacagtcccacacctgcatccttcactccagatttcgcctataaaaactcttccatcaaggccatgtgagagtttgagtcttkgcagcatgaactgcctgctctccctgcctgaccctgcagtaagcctctgtctgctccagactccaacattttggtttgtttggcctcactgtgcatcgga

SEQ ID NO: 40222 - DNA, 201 bp, Bos taurus
caggatcctatggaatgactaatttgtgtgggggcccagcatacatgaaacctcggtgcctgcaagagtgatgtttctatttcccccagtcctgtggaacycccacagtcaaaacccactggccttcaaagccaaatattctagagattccccctccctatgccagtccctcaggctgtggagcctgatgtgtggggctca

SEQ ID NO: 40223 - DNA, 201 bp, Bos taurus
tctgagccccaggttccttatcgatgaaatggggagacatacttctcaaggtgtgaagaaacattaagacagtgtgcagagagcacggccagctcagagtygctcgctgtcggaacgttccacagcgttctgagcagctgtggacggtctggcagccctgagagccgaaggtccccacacataccactgctcccaaggcct

SEQ ID NO: 40224 - DNA, 201 bp, Bos taurus
ggggaattggtctgagttaggaaaaggcaaaaggatatttcaggtggacaaaacaatatgagttaaaatagggagacagaaaaatcaagggacttctgggracaatgaacagaaaaatggggagatgtggttgtgtgtttggaaaagggaaatctcattctacttcatgtctcaagtagaatgagtataagaaagagactt

SEQ ID NO: 40225 - DNA, 201 bp, Bos taurus
ctccacaatggagtgctgctgagaaggccgagtggagcacccaggctggtaacaaggcacccttccacaccatgtcccctgagaatcctggacctctaacyccacctggccataacagaacactctctctacttcttaggtcaagggacgtcaaggggggagcctgtacttctactatacctagcagtagcaaggctgcac

SEQ ID NO: 40226 - DNA, 201 bp, Bos taurus
tcctgaaaatccccacccctttcccaaaggaactggaatactcctcccactcattagcctgtgaaattacccactcctacaaaaactgacaaccccatacyaaagggcctctcttacctcttttgccttccaagacggccctccctctgtctgtggagtgtgtttcttccctgaataaaccttctttcactttgctgtggc

SEQ ID NO: 40227 - DNA, 201 bp, Bos taurus
cagtgaggggctgtttccctgtgtgggggcctggccagaaggcccacagggtcacacctgtgttgagccctggttacaaggctgtggaaagtgcttcagcmctgggggaagtgggggccagcgttcactgcccagctccctgcaacaagggaggcgataaagccacttgctgcctgccctctgaggagggggccttggctt

SEQ ID NO: 40228 - DNA, 201 bp, Bos taurus
ccattctgggctgaaacagcttagcgtgaagctcactaaaactgggtcctgtacttcagagtttctttgggtaatctcttctttcctgaaggatataaaakcactgttaacttacagcgatgaaaaaaaacctctaagaacttgtaataataaagatcagtcactggaataacatatggagtggggtcagggtggagaccg

SEQ ID NO: 40229 - DNA, 201 bp, Bos taurus
aacaccagtgacttcctttagggtaatgcactcatcaaattttatcaaaacaagctgtctgacataagcagcttcgtgccataagctctggcctctacatrggaatcaggaatgcaggaatgggagaggccctgggagcgcaggcaggatggtggcaggacaaaatgtcactggctcccagatactgaaactggcagcgcg

SEQ ID NO: 40230 - DNA, 201 bp, Bos taurus
tctgtctaaaaggtatagcatttttcattcatactgtatactggtgtccatgtattaaagtgaaacagagagttagggcaatcatttagatgattcagggraaaaaaaccacaagtctccagttacccagacagttctgggtaaatttatttttgctacaaaatattcagaaagttacttgatctgtatatatccatgcaa

SEQ ID NO: 40231 - DNA, 201 bp, Bos taurus
caagtgattcaagaacagaggtatacttatgcttagtcaatttccttgtgccctgtggcccacccaagggcatagaatcccagagtatttatgggggactkgttccaggatacccccatcctgcagatgccagcatccatggatactcaaagtcccctccagttgagcctcagtatccacagattctgaatctcctgatat

SEQ ID NO: 40232 - DNA, 201 bp, Bos taurus
ggaggggcatggcaactcactccagtattcctgcctggagaatcccatggatagtgggctacaattcatggcactgcaaagtgtcagacactattgaagcractcagcacacatgcacacatctgattaattgctgttctttgggaggggatggaggccaccattttggtgacttcactctgcctaattcttcccaaagtc

SEQ ID NO: 40233 - DNA, 201 bp, Bos taurus
gggccttgctgctctagttctcctttgcctgtgtttctccccactgcactgcaaatgagaaaaagaatcagtaattctcttttcagcatgttctgggtggytgggactctgccccaaaggccttgagactgcttgcaggtctgctttcccaggtggacctacttctgctatgcacaatgtaaagccttaggggtggctggt

SEQ ID NO: 40234 - DNA, 201 bp, Bos taurus
attgcaaatattttagaaaaagtgtcaggaacttttctcagcattttgcattcagcatacatatactcaccacggtcctatgatgtaggcactgttatgaytctcattttcagaggtgaacatttctaagcaaaatttcccaagagcacacaacccattaagggttacatgctgggctgtgagttcagtccacgtgggtcc

SEQ ID NO: 40235 - DNA, 201 bp, Bos taurus
atctaaaatttaaaaaaaaataagaagcttgcctgtggtcaagtgagtcatgtgtatgcaaagaaccagggtgtgtgtccagcacattaatacagaggccygtgctcagaagggcagcacacttggggtttaatgctctcccattgctgtcttgattttcttaacaactcttttaacttacattttatgaatgacatctga

SEQ ID NO: 40236 - DNA, 201 bp, Bos taurus
gtatatttttaatactaagttgacattgactgacatgcaaggaaataagcatacacatcattgcttggggacaaacccaacttggtaaagactcattttgkattgtttggcaatgtctgtgcttagatcccatagttaatttctaggaattttgtctaagcaaattatgaggaatatgttgaaggatttttgtataaggct

SEQ ID NO: 40237 - DNA, 201 bp, Bos taurus
aaacctagctacagagagaggctgtccagtttggggctaatagtgatttctctttgaaatagaaagatttaactgtgggcctgaaacacaaagggggtgtrgaggcagctggtaggaatgaactttccctgaggcactgagaagagtgtgctgaagattattatctttcaagatggaaatgatcataccgctcagaaaccc

SEQ ID NO: 40238 - DNA, 201 bp, Bos taurus
tgaatttaaaatttgcatttatgatatatatatatatatatattatatatttaaacagaaaaattgcaagtattttttaaaatgtaattcaggccttgaargaattttgaaaatttccaagacactataactaaaccaagaactccagacgaaagattttgaactcacaaatttattgggccatgttcacttgcttcccta

SEQ ID NO: 40239 - DNA, 201 bp, Bos taurus
ttccttggtgctctgaaccaaatattttgtagtagttttaatggctcttatgaaatgtctcttaggttgctaagttttatatagcttagttttaatgtctyttaggtagccaaaatgtctcttaggaaaatcagctttgaaaacatcggatgagcatttgttgtggaatagtcacaagaaaactcattttgtcactgagta

SEQ ID NO: 40240 - DNA, 201 bp, Bos taurus
ttcaaattcttcctttggcaatcctaataggtattttaaaaatattcatttaatggcacggtggggtggtgtattttggaaaattttgaagtgatgatgamaagaaaaaagagatgatacaatcagaggcttagaagccagaagcacaaagtcaaaggtgacacgtctttttataatgtttgtggtaaataattattaaaa

SEQ ID NO: 40241 - DNA, 201 bp, Bos taurus
tctagattaatatattggtaatatctgtttttgccttttaaaactttgacttagcatagtctttataatatcaacatgattgacatgaaactgttattgcygttattcctattagggataattttagaaaacttaaatcacaaaaaatcaattgtagtctgaggattaatttgaggggttataaaacaactttctctgaag

SEQ ID NO: 40242 - DNA, 201 bp, Bos taurus
atcacagccttcgaatctaacctgtggccagaagaaggtacccagatggtgaggaacttaaacaccttgacacattgagaagtcattgaaggagccagacrcatttagcctagaaaagagaggcctatatgatacaaaagtcttatttaacattaggactgactgtggaagacactgatttattatctagctagtccaaat

SEQ ID NO: 40243 - DNA, 201 bp, Bos taurus
tttgaatatgctatctaggttggtcataactttccttccaaggagggcatttaaattattattattattgttattttggctgttctctgaaatcttagttsccccaccagggatcaaaagctgtattgggatcttggagtcttaaccactagacttccacagaagtctcaagcctttttgaataggatcagtctcgagaag

SEQ ID NO: 40244 - DNA, 201 bp, Bos taurus
agagagaaagacccaggttagagaagaaaagagttattgaaaatgtaggggcattgttgaaaaatgcagatggttggatgcgtgtggatgtcttgtgtgcrtagccccctgacatagtgtgcaccgtcggctgtcaacttgaaattttctgtacagtggctcctgagaggttttgttgttttttattttttaatcagctaa

SEQ ID NO: 40245 - DNA, 201 bp, Bos taurus
atgccaattgtattaaagaaaatgacccatatatataacttctctggaagaaaaatccaagaaaacaacagggctggcctctgcagtagggaactgaaagrttgagagggatttgaggaaaacttattcttcctgcagatcattagtttttacaagactgtacttttacaaaacatggccaataattactttttccaaaaa

SEQ ID NO: 40246 - DNA, 201 bp, Bos taurus
ttctttcagtcccgccaacttttgtcagcaacttttctcaatacctatgtctaatttgagaaagaaagaagggagaggaggagagagaaagagaatgaggrtgaaggggaggaagtggggaggacaggagggagacagacttgatgttgaactctgtcactttctaggaataaataataatcatctgtagattcataacct

SEQ ID NO: 40247 - DNA, 201 bp, Bos taurus
gaatctgctgtggggttgagaacacaccaagttaagaaaacaggttctggtgtctctttccctgtttaaggcttccaaaccaagcctgctaataccaatcrcgtatgttatggaggacactgtattcctaattattttagggtaatgtatttagctacacactaaattaacactaattgaacttggaagaggttcagaaag

SEQ ID NO: 40248 - DNA, 201 bp, Bos taurus
gcgccggtggtttgcacggggtttgcccttcctgtcccgggcgccccacgcttggcagaatcctctgccatcactgtttcagaattcttgataatttaggsacaagaggccccacattctcattttgccctgggctctgcaaattatgtagccagacccgcttctaatagatacattgttcgaattctgtcctattgaggt

SEQ ID NO: 40249 - DNA, 201 bp, Bos taurus
ttcagaaggtggtgaactggagtgggggaatgggaagctgttcatggttctggtcactcccagctgggccgggcaagagggcatccttctcagggccctcrttccctctgcccacattttcaatctacttgctggtctccttagtgaatgatgttatgagggacactttggctgaacccacctgcattggccagggcacaa

SEQ ID NO: 40250 - DNA, 201 bp, Bos taurus
tggcaggaaatgatccacctgggaatttacctgaaatttacctgaatccacctgaaatttataactgatctacctgggaagccccagggatagagtaggakaaccaaaagctagctcagaagtcccattaggagactgttaatagacagggaacttagtgggctttgggagaccacagtaagtaaataatcactcaagcaa

SEQ ID NO: 40251 - DNA, 201 bp, Bos taurus
ttctgattattagtttaattctcatgcataaacagagtcacaagtcagctctgtgtgttctagaccccagagcaagcttctgttgagaataggccccggargtaacagcaaggcgacttcctcaggacctgcaaggctgctccagagggtctagttcctctcacctcaaggtggcctctgcagaccttgttgctacagcag

SEQ ID NO: 40252 - DNA, 201 bp, Bos taurus
tttctctggtggctctattaccagggccctgcttccttactctgttgtctttaatcactcatgactcacccaggcagccagaaggcttcacgccgctggcrgggtgactggcccagagcagctgagtctatttcacttgagcaaacacagaattgcacatctctgggacacggaggatggtattgggaaagggacagacct

SEQ ID NO: 40253 - DNA, 201 bp, Bos taurus
ttctgcactggtgtctttctgaattttagtttaaagctcattagcctatttgtctgttttttgtgcaaaaaccatgctggaaattcttggttggcccagcktatattttgacaaatataccaatatgggtccatcatgtttgagatcagattaggaatgcccaccctgctgaatttgactcaagacaagatttattttaat

SEQ ID NO: 40254 - DNA, 201 bp, Bos taurus
gaaagtctgcgttattgtttacatttgggtataatgacagcaaccaatgtatagtgcaatacagtgtaaggaattcatgtgtatatcatagactacttgamgtagaaccaaatggaaaattgtagagaccttgctctaatgtaatcttcagttacctgattcattaatcatttgtatggtacttaaagactgctgttctcc

SEQ ID NO: 40255 - DNA, 201 bp, Bos taurus
gatttagtcatttcatgtcaaagtgtgatccagtacagagattctaatttgagaaatcgccggggacccaggcttcttcctttttaagcttggccatcctytcaggttcaagacactcatccttgtgtccaaatgacggaacgcacacctccacttttctagagcacagtctgaatctcacctgtgttgggttggccaaaa

SEQ ID NO: 40256 - DNA, 201 bp, Bos taurus
tgcaaaatttaaggccatggcacatgataagtgctcagggaaaatagaaagagcattgcatttgtgggtggaagactggaacagaaaatgtgttccacctratgcaggggaggccaaattctccaggtaagaacacaggagtgggtagccattcccttctccagggaccttcctgacccagtgatcgaaaccaggtctcct

SEQ ID NO: 40257 - DNA, 201 bp, Bos taurus
ttcatgacaaatgatttctaaagtagaattttatactcaatcccattaacagtatgagtgttgattagcagcatattcaggaatatcagccaagaatcttrctaacaaaatccacttgggttagtttcaataaatgggaaggtattacagtccatcatttagctctcagaacttttaggtggacaagaaaactgagctcag

SEQ ID NO: 40258 - DNA, 201 bp, Bos taurus
ttcttgtttaatcacacactattgcaaaacttttaaagacagcccagaaggggcctttttttttttcattgtaaaatgagttgtaatatttcagataaaayaaggccacttgagtacacttgaggaagataatatttttaaaagttgctggcatcatttctttttcttaggaaaaaaaaacagacaataggaaaaatgttt

SEQ ID NO: 40259 - DNA, 201 bp, Bos taurus
taaagggttgtagctaaaagtgacatgcttacttctgggcctagcatttacctgctccatgcctgccccccaaccccaccaactttggtgtgggcacaaamaatactggaaatagaggtggccccaacgtgtcccctagggatctccctggtgctctagtggttaagactctatgcttccaatgcagggatgtgcgtttga

SEQ ID NO: 40260 - DNA, 201 bp, Bos taurus
atttctgtctttagactatgaggacattcataaacaatgactttaatcattaataaaaatacattcaacctgtgcatacatttttcacataccaaattacmtgatcattctgggcttaaatgttcaaattatctataatgtgacacattttggggcaaagctatactatttaattttttcctactctaaaattctctccct

SEQ ID NO: 40261 - DNA, 201 bp, Bos taurus
tcctttaaggttcagcagacgtctcttctctgttctccctcaccaacgacacagccttagcaggaacttctctcttaattagccttgagtaagaatttctyaacagagtgctggaaccactttgtcccaaatagcattatgattttcttctaatcagttcagttcagtcactcagttgtgtctgactcttgtgactccatg

SEQ ID NO: 40262 - DNA, 201 bp, Bos taurus
ttctgaaggcttttttttttttctagaatttgaacattttcatttcaaccactgagagaacagaaactcctgttggtggttagattggcaggcatgccaarttttagctctggagttgatccaaactaccccatttacagctcaaaagcaaggcttccgaaccattcttagaaataatcttaatgcgaagaaaatcagtcc

SEQ ID NO: 40263 - DNA, 201 bp, Bos taurus
tgttggcattaaaaaccacctgggcaaataatgagcattcttatgccttggtttccacatcttccacaaaaacaaagctcagtaatatctgctttgcccgmctcacaaaacctttctaaagatctcatgaaagaatggatacaagggacttcccttgtatggtcccttggtggtccagtggttaagaatccaccttcagat

SEQ ID NO: 40264 - DNA, 201 bp, Bos taurus
gccaggcaggcaggtgggcacggcggccgtgagatgctctatccttagtcccgctgcatgtgaaagaccaaaacccatggttggccatgactggtatgtgkgtgtgactggtgggcaaaggggtagactatgaaagctgtttctctcatgcttaaattggagcaggccttacccctcagaaagcctgcgtgggtaccatca

SEQ ID NO: 40265 - DNA, 201 bp, Bos taurus
tctcagagtccccaaatcatagtatttaatttaaccttctatgactatgcagtcaatgggaaaagaaaagtgatagattttaaaggccaccttctttctcytcctggaccaaggattataagtgtagtctccagagcagcagcagcaattgcaaaatcagtggaaattggtcagaaatgtgaattctcaggcctcacccag

SEQ ID NO: 40266 - DNA, 201 bp, Bos taurus
aatcacatgggataaggaaaatgtggtagagtagaaaaggaaaaaaaaaaaaagttacaacacagaagcaagtacttcctggggaattcgctttctcaaamatgtgtttcccagagctcagaaaacactgatttctgtgttgttgtattgtgtctttgttctactcagccacttccttatcccacatgattccatttcacg

SEQ ID NO: 40267 - DNA, 201 bp, Bos taurus
tctgccgtccatttcggagttctccatgcctcctctcaaggctgctcttgatggccacttctaatgctattaaaaatgttaggggatgagaacactcagtrgtttgccccgggcccctcttcaggctctgagagcaccagtatttcaccttgattgcatttgttccatgataatattggatgagtttgttaattttctatt

SEQ ID NO: 40268 - DNA, 201 bp, Bos taurus
tatttctactgatgcccatcatttcaatctagcacttgtcgaacatcccaatcttttttctctccgtgtttgttactgccttctcgagtagtgagccaccyagcttcccttatcttcaatatatatactcagttgctgagtctagaacacacagtaagtagtttaaaaattacatactcatatcatcaggataagcagacc

SEQ ID NO: 40269 - DNA, 201 bp, Bos taurus
gggaggcctaccaaaacacagaacccgtttctgggcttttttttaagggagagaagagcttattttcgtctgtgctgccacgtggggggcactcgggctgyggcccataaaaaggtagagaggatgtgaacccggtcaaaagaaagagtgttggctctgcggggaggagctgggacaagtttacagagaaggcaggagccg

SEQ ID NO: 40270 - DNA, 201 bp, Bos taurus
agaagcctgagccctgcaataaagagaggctgccactcactgcaactagagaaagccacagaaaacaacaaagacccagtgcagccaaaaaaagaaaaaamcaacacttttcccttatctcctgcttatgagaacctggagtaatgttctacttttcttccacaaagagatgaatattcttagactttcaagagtgtttta

SEQ ID NO: 40271 - DNA, 201 bp, Bos taurus
gttcatagggtcccacagagtcagacatgactgaagtgacttagcaaacatggagagtaacattacatgagcaatctgagcacaagacaatccagataacyacatcaaagcaagtctttgatttctctacaaacaaatagggcgtgcatgtgcacaaatgcaggtgtgcatgtgtatgagcatatgtggtttttagtgaca

SEQ ID NO: 40272 - DNA, 201 bp, Bos taurus
ttgtctgtacaaaggccagcccttgcgaggatgcacatgtctggggtgctgctctgccccgggcagtaacctgcatgatatcagagtcacatcgttatackcagtgtctgacggcccgacgacttgaaggctaacggatatatcacttaattcaaggctctgtatctgcccccgagccaatggttttctcttcctgtgccc

SEQ ID NO: 40273 - DNA, 201 bp, Bos taurus
tgagtccctgggatgaccttgagcctcagggcttggggatcacaaccgaaccaaaagcactgattcaatagcatccttatgttgccaggcctgcggtctckctccctcacttgtgaataaggagaaaatgaaacctctgctgctctattgctgcttctggagaacatgcaggttcaagagactggtgagaggcccccaggg

SEQ ID NO: 40274 - DNA, 201 bp, Bos taurus
agagctcctgacctaagggcttccacgtattgatgggcacaagggggcccaagaggtgacatcacatggctgagatcacgcagcttgggaatggcctattygcaggtgggtgaggtttttctgagtggtgcacatttgaccttggagctcctttctcaccccagctcaacccgtgtgctcccgttcccaggagctggccca

SEQ ID NO: 40275 - DNA, 201 bp, Bos taurus
gggtggacacagaagacttgcaaggagggacatgggtacccacagctgatcaggcagcagaacacagacaagcagaagcgtgactagcacaaagcccagayagtccaaggatggttaagatccaagccaggcacacacttaactcctaagtattttactctttacccactgccttctggccttcagagtttctcacagaaa

SEQ ID NO: 40276 - DNA, 201 bp, Bos taurus
accaacacaacattgtaaagcaactatcttccaattaaaaaaaaaaaagcctaaaaaaaaaaaaaaaagatctcaagaggccctatctctaacctaaatgygcactgaaaagaaaaaaagattttctgcaagcaaattcgtcaactgaacgctatgagttttcataaactgacttgggagcttaaaggccttgcaataagc

SEQ ID NO: 40277 - DNA, 201 bp, Bos taurus
tgcccaaacatgtttgtgcctgttgcctttattaactgcaattatcgaattcattgtttactgtgtaaacagatgaaacaagactccaaaaagtgttatawatgaaaaataattatgagctttgaaaagactgataaaggcatatgactctgaaagctcctttaggattagattaaaagctcctcagagtgctctgccaat

SEQ ID NO: 40278 - DNA, 201 bp, Bos taurus
cgaaatttggaaggcaaaaatgctggctgaggcctacacgctgctgaaaaggccagccaattatgtaattcagtgaacataggccttcaggagggttctcrtccgaggaattcagcaggctaaccaacagagtctgctctgggcacatgccagggtcaggcactcaacgtgctatagtgcagaatcccgcattcccactct

SEQ ID NO: 40279 - DNA, 201 bp, Bos taurus
gatgacctagaatgacaatgaataacaggaaatcacccgaagtgacttcgagaaaaggtttatctcactgcatttctgtagacaaatctcatgggtaaatytactttatcttatgactgttgccaagccctgactgcagctcataagcctacaggggtgcctaaggctcatgaacagggccgggccctccctctgctcagg

SEQ ID NO: 40280 - DNA, 201 bp, Bos taurus
tgcttaatttacagctaatttcctcaaaggtaaaaaaaggaaaattcatataatttcaattttttgcataaagggggattttattaatatttcttattgtmctattccaactctgcataattcacacttatttgcactaattactgcagtgatatacataaggggcttaaataactgagcagttatagctgctaccttggc

SEQ ID NO: 40281 - DNA, 201 bp, Bos taurus
aggcattcaaatccacagtggtctgacctcagaacccttgttcttcatattttctgtacaagaggtttccaccctctggaggcccaggttcctcaggaaayctacaagggggcagggaggaggggtctgcaggaaagaatgacaggaactgaaactaagggctgttctaggctcttagcgtctgggaacccaccaagggag

SEQ ID NO: 40282 - DNA, 201 bp, Bos taurus
gcaggcaggttctttacctctgagccacctgggaaatcaggaacccaggtggatccccaagtagcaaaaccattacaaagatgtgcaaagacaaaccactrcaccagcagcttctgctgggtttcctaggtgccaagatgctctctaagctgagccccctctagctcatcacgcccagcaaatctgattaaaatggattag

SEQ ID NO: 40283 - DNA, 201 bp, Bos taurus
caactgcgatggtctcctgggggagaggctgaagaggttcagacttgttgggagcggtcatcactacctaagccatgatgcttctccaaataatttaggtkttttttttttggccatgctgtgttgcatgtgggatcttagtcctctcccaggagttgaatctgcgccctcctgtattggaagcatggaatcttaaccact

SEQ ID NO: 40284 - DNA, 201 bp, Bos taurus
gcttataacccatattcctttctatccttggcaactctatctgccaggcattatgcctatccctatagcatatatcaacaaagatgtggtttctgctctcrgatagttagcactctatatataagacatgtgtgtttcaggaaaagtagctcctgcctatgcttcttccatggaattatcatttctttttgaaagactata

SEQ ID NO: 40285 - DNA, 201 bp, Bos taurus
gttttacacacaggaagcctaaccatcacaaaaaccctaaagggtagatttccagtctgttgttgctgtgaagacagtctggccaaaatggggttagtaamtttcctgctgtcacacagatagcaaatgagggagctgagactgactcctgatctttctggtaccaaggcccatagtctttgcactcaatgatattggggt

SEQ ID NO: 40286 - DNA, 201 bp, Bos taurus
gtttggaaggtgatctgctgatcactttttctgtctgtcttactgggcctcctccctggtctcctgtgtctggactccagccctccactccgagccttctyttgtcccctgagtgccaacaaggccttgctgatggtattccttgtttgcagaagataatgactctctcatctcttcctttctcatcctacctcttggcct

SEQ ID NO: 40287 - DNA, 201 bp, Bos taurus
caatgtagtatacacttgccagatcatgttttaatctataacaggataacagagcagctacatgtaatcaaaacatattttactagcagaggcaatcagcrctcaaaatcaaaacggttcttaaacgagtgttgctggtataacacagctaattgaccttttaagtatcatgtaaaccttttacctgacattctccgctct

SEQ ID NO: 40288 - DNA, 201 bp, Bos taurus
agcatccagaattgtgtgaaataaatctttgttgttaataagccacccagtctgcggtattttgttaggctaccctgagatgactaagataatacctcacygtggttttgatttgcctttccttaataattaatgatggtgagcttgtctcatacgcttgttgcccattcttcacatctccatgatttttgacaattctgc

SEQ ID NO: 40289 - DNA, 201 bp, Bos taurus
aaatcttttaagtccagggtatccttccccggtaccctaaacctgctagtttattacatacaggattaaccaggaccctggcagaatcggtcaaggtcacyggggcaggtgccactaccccagaacctgacagcacgcttccaggcccatttccatcttcgctctcccacccccactctcactcccaccccccactccggg

SEQ ID NO: 40290 - DNA, 201 bp, Bos taurus
agtgactgaacaacaagaggtatttggtgaagctgtgaaggtaaacgggacctccaggagctgagtgtggaccagagaatgaacagatgcaggcctatgayagaacttccggaactgaatcctcccttttggggtggtaggaagaatgacaggaactagcaggaaatggaaagccagtggccggaggaggatgggacacag

SEQ ID NO: 40291 - DNA, 201 bp, Bos taurus
tttgtccccaccttgatgaacactgggtccctttgccttctgtttgcagtcaactaataggtacaaaaacagagggtggaaaaagatacacacatacacgrcacacacaaatgctggtgctatctcaatttacctaacttcccagaaggcctaaggctcctgtttggtaacaatctttgcagaatatctccttcttgttaa

SEQ ID NO: 40292 - DNA, 201 bp, Bos taurus
cagagagaggaataagaacatggtcttgcctctgacttgtctcaccccctcaatctcatcctcctttatcctggtgagatacacccagagcaggccaagcratctttgggattttaagctttcagatagggccctgagtcgcagcaattgccttagaggtcaccgggtagtgattgattgcctttatagaagtcagtcata

SEQ ID NO: 40293 - DNA, 201 bp, Bos taurus
acttactttgagaattaaacacatttttatattaatattcacaaataatcagattgccatcttaagttgcacttgtaccatatctctcccacttctcatcmataactcctgttgcataacataaaacagtggttgaatttctttcctaatgctccccgactccacacacacacatatgacgttaatacacgatgcacaggc

SEQ ID NO: 40294 - DNA, 201 bp, Bos taurus
gaaatggcaaaccactcccgtactcttgtctgggaaatcccatggctggagaagcctggtaggctacagtccgtggggtagcaaagagttggatatgaccragcgacttcagtcccagtttccgagtatcccgacaatcgagagaacacaagcagcaatgagttcagttgggttacagaggcccgattctaagtgcgtgaa

SEQ ID NO: 40295 - DNA, 201 bp, Bos taurus
cgtgttcattgactaacacccattttcaggctttgtctaatttttcctttgtgaagattagggaataattggatagatctggcctttgaggtgtaaggggyaggtgccaagtcactgtttctaggaccaccctttgggcagttgtatccaccttgtttccccttcttacctctgaaccccactttgggtggcccctacaat

SEQ ID NO: 40296 - DNA, 201 bp, Bos taurus
agcaaacctctgatttttagtatctcctaagaaacagaatagccctgagcttctcaagcatatgccatagtgaaagttagaaaatgaacaatctggccagygaaataataaaggagggacattgtggctggcagaataatgcctttccccattcccgccaatgtccatgccctaatggcctagcaactaaggttgaaccag

SEQ ID NO: 40297 - DNA, 201 bp, Bos taurus
ccttaaaagagatgcacagtctcaaatcctcatgaaaacgacagtaccaactactctgaactattcatatgtgtgagaatgaatcttgggtatctgcctcyaagctgatatcatttaaacaacattctgattggtacccatcctgcggatcaaaactctgtggtaccaaaccacttacaaaaagtaaaatatttttaccca

SEQ ID NO: 40298 - DNA, 201 bp, Bos taurus
tggaagggccagactccggcccctagatataacaatagggcttaaacgagttacctgagtataaatttggtgaaagaggtcatggaaagtcagattcaggktgatccttaggctgcctacttggcccagctggacaaaccaaggtcaattgctccaaattttatgaaccccagccaactctatgattttatcaggacacta

SEQ ID NO: 40299 - DNA, 201 bp, Bos taurus
gaggcacccaggaagcacagatgctaaggagcaaagcagcaccaggctcacagacaggctccaacagtctgacctggctgacctctatcaatcatctctgytgccatgaacacaagtccctgcaccagtgagaactctctggttgaatatctgttccttcttctcccttcctgtccccctttccctgggacttccagcgaa

SEQ ID NO: 40300 - DNA, 201 bp, Bos taurus
ctgtattatttctacagttaaatattccttgttcaatatattcataactactgaacactgtatttgttgggaaaatggcatctcatctatacattggctaratagctataatctacactaacagaagcttttttttaagcacatgctcatttgaatgacaaatatttaaatcagtttaaccttgatcatgttgctggttag

SEQ ID NO: 40301 - DNA, 201 bp, Bos taurus
gtttccaccggtggtgctggccgcctgtctatgcaggaattaagatcccaggacttaaataaaccaggtctccatacccctcaaacgtgagtacctcatgycttattgtctttggccgagaaatctgtaaacgtagttaatgcaaatatgtagtgtgagtaatattgtgatgaatcttgtctgttgtcagcgatacctgat

SEQ ID NO: 40302 - DNA, 201 bp, Bos taurus
tttttatagcttttctaaatctagttcattaacttaagatatgtagaacctgaaattatggtaacttgttggattgttatatttagatatgaaagaccagytatattatgtacctggagttaataaattgcctcagtgcagtgtgttttttcccctgatttctctgcctaacttgacatggttagaaaaataagtatttcg

SEQ ID NO: 40303 - DNA, 201 bp, Bos taurus
tgtaaatccacaggcttaatgcttttattattaaatgagaaaaacaaatttaaccattcaactcaaatgacaggaggaaaaaatacatctcaagaaacaaktacagccaaatgaattgggaaaaaagaaaacctttgtatcaaataatatataattcctgaaggtggtctttgggcaaaataaatacaaaaagtaatggct

SEQ ID NO: 40304 - DNA, 201 bp, Bos taurus
cgcctgccagccaggcagcagggcccccggcacttcagatcttatgattccccaagacctgcttcccagaggcctgcatgccaggggcacctgtctccacrgctccagagcaggagcaagatgcttaggaagcagcaatgagtatcctgactctaagctcatgatgcgtatatacaaacatagatgtacttttggccatac

SEQ ID NO: 40305 - DNA, 201 bp, Bos taurus
tggagaaacaataataattccagggttgaggcaaagagagtagattctcctggactatcttccagtgccagaaagtaacaaagaagtgctcaaaaaatgayaggagcgtttcaaaagcactcagctcggaggagctaacgacgactgaaaccgggaccatcttagcaactacagaaataaagatggtaatgattacaaccc

SEQ ID NO: 40306 - DNA, 201 bp, Bos taurus
gtggttacctcgtgcccttcacagggttgttgttgcaaggctcccacttgccagagccaacaatgcttgactctatgtagtacccgaccagctctttagcrtctttgggttcctcccatgtaacgaccactgatgtgtctgtgtttctgcttgggatgatattgcttggaggcttggggatgtctgagaaaagaagaaaat

SEQ ID NO: 40307 - DNA, 201 bp, Bos taurus
ttctctcgctttctatctctctcacacacacacacacacattttctctccactgggactctatatgtcagtataaaaagcacctgttttaaagcagcacaygaggattaaatgaggaagctattcagatctgttctccaaggaattcaccttgcgaggcactcggattcagagccacttctgattgtcttcagtatcaaat

SEQ ID NO: 40308 - DNA, 201 bp, Bos taurus
cccggcccagccctcctctgcggggatcaccctcctccgcggatacgggcagcatagtctccctcagggtggggaggattttccttctacgagatgcctcsggcaggcggtcctgaggccagagagctgagcactacaggcccgatttcctgtcctcttcacggggcgcacctcggcaccagtaagagtagggggcgaggt

SEQ ID NO: 40309 - DNA, 201 bp, Bos taurus
gaaaatgaagatgtagctagaagggatacaagattaaagatatgttttgatttttttttaaatgagagccttttgagcatgtacttacagtgactgtactrgtctctttgcatatatctcatttaattctcacttctgttagagcagttattgtgttttgctctaaaacagaatttagtgagcttttctaaattttcaagc

SEQ ID NO: 40310 - DNA, 201 bp, Bos taurus
ggggcatcttgccagctttagtgactgcttcgatgtgattcgctcgaggaaaaaggtgagcattgcccggatcaagccgtacttacagcgagagaggaaawtttgactttttcctcctcctcgcagtttaaaagagactgttaatcctctgcgccgctccccacttcccctgcaaagttggttttctagctgtgaactccg

SEQ ID NO: 40311 - DNA, 201 bp, Bos taurus
atgaataggtactggttgctaacatttactgaaccagctaattcccactaagctgcaattggagaatagtgtagtatatcaagtgggaaatgcaaagaacrtgtgtttagaatacattgcacttctctcttgaacttactcgtttccaaagactatttctgattacacggattttttttttttttttgattacacagattt

SEQ ID NO: 40312 - DNA, 201 bp, Bos taurus
tcctctgtccatgggatttcctaggcaagattgttcctcgtggttttctgtttataatactagttgtgctgactctggctggaagagccaggccatttggrataaagtggaacatgcctctggatgaattaagcctccttattgtcaacttttgacttctttctactcacttggcctcccgccacgatggtttagacttta

SEQ ID NO: 40313 - DNA, 201 bp, Bos taurus
cggtgctttagctcaggaatctgtgcccttaaccatcattgaggggaacaagcaagttgggccagtgggggaaggagaaatgtgttttcttaccatgagayctttcatatctcctaagtttacattttcttttgaatttttttttttttttggccatgccttgtggcatgccatctagttcccagatcagggattgaaccc

SEQ ID NO: 40314 - DNA, 201 bp, Bos taurus
agcaggaatctggtctttcttgcttgctgctgtaactccgttaactagaacagtgcctggcatacagtaattacttgaaatatttatcaaatgaataagcratcgttcccaagtatttccaggtgtcagaaaagaaaatttgatctggcctagcaagtataattcaatagtggatgtcactgagcagaatactagatttta

SEQ ID NO: 40315 - DNA, 201 bp, Bos taurus
gcattaaatttattgtgcactttacttctcttattattacatcagctctacctcagatcacaggcactagatcctagaaattgggggccctgacctaaccygctctgtatccacctgcattttatcccaggagccccagccgcacggcttccccgcccttggatcctcacttgtctgcccggcagtggcctcctgccctac

SEQ ID NO: 40316 - DNA, 201 bp, Bos taurus
gataaagcagcgttgcttcttcaccattttgtggtgcccttaccaatgattgttatcgattttttcggggaaccagaacacctgcatgatggccacatttyggggaatcagaacacctccaggatggccacactctcaagggtgttatgggggcctccaagcactccggtagcttttcagcatttgtaagaagacttcgcc

SEQ ID NO: 40317 - DNA, 201 bp, Bos taurus
aaattcgctgaaataagagcaacataaaaggaatatgtgtgcaggtcctataggggatatggaaaacagcagccacaaatttcttgtaaataataaaaatrcactgggaaaatatgttgccacaaggaagattaaaagcataaccccaaatcaagacagtaattcttgaagcaattacagctgtaaaggaagaccacagag

SEQ ID NO: 40318 - DNA, 201 bp, Bos taurus
tcaactacagatctttgagttgccccaggcagggagcactgtggaaagacagtttctccgcgtagatctactaactgttacttttctttagtgactttgcytagtcactaaaaacaaaactgcatttactgagaaaatgtactgacaaagtacaggtactttcagtgtggtttcttcattcatcgtgattacggaccatac

SEQ ID NO: 40319 - DNA, 201 bp, Bos taurus
aacagggccagcattagatcagctgatttgactcataaaactctgaaggacacattttcaaagtttcacccacttacatgtgacagaagtcattgagtagytggcccattttaagataagtggtcataaaggacactcaggatctccggggagggacatagctccccatgacgactcctgtgcaatcagggctgagaatct

SEQ ID NO: 40320 - DNA, 201 bp, Bos taurus
cagcctctgccccttctttcttttgggttcatctgccagggagaaggccacctgctggtctgcatgctgccttgcaatcggggcctctgctgggggcgctrgaactcacagcttcacaagtgtccatgcggattaagaggggagtctggtaaggcccaccggctgcagtcctgagtggattccactcactgaggctagtgg

SEQ ID NO: 40321 - DNA, 201 bp, Bos taurus
atatgtgcacttgtagctgattcatatggatgtatggcaaaaaccactacaatatcgtaaatagccaccaattaaaataaattaattaatttgttaaaagrcaaaaaaagaagggttgggaggaaaggtttagaattcttttagaattccagaatgagttagctaattgcccccatagagtaggggaggaaccacagggga

SEQ ID NO: 40322 - DNA, 201 bp, Bos taurus
cactctaagttggaaactaagaggtaataaaaatagaagaaagatatttcaatgcaaaaatcctcattacaggaaagtgagtttcaaaggactgtgggccygagaagcatctgaggggcttggtaaaaatgtcaatccctaggctccactctactctactccatagctctgatctccacaaggagatcaaaccagcccatc

SEQ ID NO: 40323 - DNA, 201 bp, Bos taurus
tgggcccgctagccctgcagaggtgaccttgcagagaccttggccccaagcggtgactccagagcatcacacaaagctcgctcacaagctcctcatggggyagttaccaaggatgtgacagatgaagagtggatggcacaagaccattttcaggatgtggataaaaatgaatgctggttaccatgtgggaagccagggctt

SEQ ID NO: 40324 - DNA, 201 bp, Bos taurus
gatttgtactggaaatgttgtgacgtcctatgattgttccaggatgtcttatttattacaactcactcatctgccatcatggttataatgctttaaacaarttttgcattttaggtaatggaagagtgtggatggaggtggggacaaatttaattttcatgattggatagagaagttaatggttaaccttatgccctacct

SEQ ID NO: 40325 - DNA, 201 bp, Bos taurus
ctacacttctgtatagctctaggctctgtgatttcacgtggtattaaaacccttgtctggctattgcttggggagtgggctgtgctctttatgggaagaayagggcccccttctctctctctttccccctctcccatcaccctttctccattttttttttttttttttttcagtaaagactgactcctaagctaatctgga

SEQ ID NO: 40326 - DNA, 201 bp, Bos taurus
atcacccagcagatcatcacacagagacccgaactcagatatcatatttcactcagccccttcggcagcagtgggaaggccagatgacaaccttgtctggrtgtttgacagattgagaattttccttgccacggacatttaagcatgtgctggttggtctccctcttagctggttgtgcaggaagtggcctccctccactt

SEQ ID NO: 40327 - DNA, 201 bp, Bos taurus
aatgctccaactgtgagattaaaaaataaagtatattttatataacaagtatttcagcgcataaacgttgggacacaactcaagcagatgggactgtgaargagttggatggctgctcttatgggcagagtcagcatggatggggaccctgcacatggaaatcaggctgcctgggcttcctgctgccttgctgcataggac

SEQ ID NO: 40328 - DNA, 201 bp, Bos taurus
taaaatagtctccatctgcaaataatatgatcatttatatacaaaagcctaaggtaccttcagctaatagaactaataagatgatttagcaaggtcatggygtacaagattattatataaaaatcaggttgggaaaaatataattgtaaagcatatatttaacaaaggactaatattcaggctatatcaagaactcattaa

SEQ ID NO: 40329 - DNA, 201 bp, Bos taurus
gggctatctgaggtcaatccgtgggccccagttgtttccaggtggtgctcctctaaagcacaggtctctagaatgtgtacccttgaagtgtggaaagatgrtgcattgggatgcaaaaagaggggacataattaaaatatgaaaaaaaatcaatcctaagggcatcagtagcaatatatggagaatcccctgaaagcagat

SEQ ID NO: 40330 - DNA, 201 bp, Bos taurus
tgttgcaggggccccaagcccaggtgacttcctgggggaacaagtgacacgagtgggtgaagcctcagagaagaggcctctgctcagctccaggtaggaayatgcacccagttttgccagatctgctgagttttcataaaagccccatgtctggaattttcaaagtgaaaatatcctgatccatgtggccaagccattcag

SEQ ID NO: 40331 - DNA, 201 bp, Bos taurus
ctttacacatcctgaaggatttgttacaatcagttgagtcatcatttggtatcacacttttcccttttcactgagatgtcttccttcattagaagaggggmgagttgtcactcactaggactcacgtttgtatgagctttgtattgggtcgtgaaagcatctacactgttgtgtgttcttggcacattgtcccaagactgt

SEQ ID NO: 40332 - DNA, 201 bp, Bos taurus
ggccagaatgaaggcttcctgacaaatggctgctgcgctgacccagagcagccttgctgatagctccagggtttctgttgctgctgttattattagcatcragccaccaggctggccacaggccgctcatcgagagctgggctgtaggacctgctgctgaggctcccacagggcctaccgccacactccaggatctaccgc

SEQ ID NO: 40333 - DNA, 201 bp, Bos taurus
tataaaactcgaccccagtattcctgaaactagacttcttggttgtgttcacagctggggttgctctccatcctaccccctcttcccttctggccttagcrccccaagggacaggtggaagcctgcccacatgccttcccctggagcccgggtgcttcttgctaggtgattaagtggcctactccatgttctgtggctaca

SEQ ID NO: 40334 - DNA, 201 bp, Bos taurus
tttctttatgtttaaaacaggaagagatgagaggcctttggaactcagtgttttcttttgagagcttcctggtaattcccatcacaaagcagggagggaaragcagggccaggatgggggaaggaggcttctccccaaaggggccttcccatccctagatcttacccccacagggcaactgagaggcttgtagactggctc

SEQ ID NO: 40335 - DNA, 201 bp, Bos taurus
tcttggtccccctagaaggacacacggaagcctgaactgaccttccctccctggaggggagggttctccacagcttccacggtggccagagggctcccccmacaaccacacctgtgaacagtctcctctgctccaccttagggcagggaggagccccatcctatgagctttggtttgataaagacggccaggaagaaaaag

SEQ ID NO: 40336 - DNA, 201 bp, Bos taurus
tggctttgatttctattaaacatataacaagtagacaagggctaaagccattgtaccaagtaaagtgctgaggatattacagtgttaatgcttcctctatyaactcgatgtatttctttcatcatacaaacctgccagatgagttcatgggggtcagtagggtctggccacgcctccagatccactcaaaagatggttgac

SEQ ID NO: 40337 - DNA, 201 bp, Bos taurus
agcacctgctggcccagtgctggacgagcctttagaaacggccctgcattatccgggatgggaaccaggtataaggagggcaaaagtgtggtctggaaaargtctcccttacagccggcctctgcgatgggcccttcgttcctaacctggagctgagcctctgactcctgctcaagtcatggggcggcagccatgtgggtg

SEQ ID NO: 40338 - DNA, 201 bp, Bos taurus
acgtcccaatgtcaccaagactaggatctggctaaaggtgatgagtggacggattctctggccagcccactgaccgcagctgtgaggtgtggggccagacycctgtgatgacctcccctgcttaatgtgctcacagtatccctccatgtttccggagctgtgaggtgaggggttgggcccctgtgatgcccccctcttgcg

SEQ ID NO: 40339 - DNA, 201 bp, Bos taurus
cctgagttgcaggcaggttctttaccttctgagcctccacatgtgtatattcctaattttccctatgagaagtttcaggccaaacttcccagactaaagcrcatgatcctttatgagatacaacagaatcagtgcagctgggaaccatggtgacgagaggtgacagagtgaacatgctggccaagatcctaggactgtgag

SEQ ID NO: 40340 - DNA, 201 bp, Bos taurus
ttaaacagcactgagcatacaaaaataaatttggggataaataaagcttatttactcaataaaaggttcaccctatcattctaatcaagagaagtcccttmaaaactggacatacttcatgtgcagccttttagaagcacatactgtgtagggagagagggtttgttaggtcgagtgctccctagggcacagctctgactt

SEQ ID NO: 40341 - DNA, 201 bp, Bos taurus
tctggtggcctctggagcccaggcactgatgcttggtcaccatcccatagcaggggagctgcacagggacagggatgccccaggcaccctccctgagtctygtcggggccccacttcagcaccaatgcagactggttcaccttctctttcctccgggacccctcatttccccagcagtgtcaacgattgtgcacagtctag

SEQ ID NO: 40342 - DNA, 201 bp, Bos taurus
aactgtgggagaggagctgctcccagagcagtgatcccagtgcctgtgggtgtgtacagccaaccagaagaccttgtagggctcgtgaaccactaggcccrtttgtggaattctgcaccaagggacctgcaaatggtaaggagtgaagaaccaccaggtgatggagtccattcccctggaggccggctgatcttagggagc

SEQ ID NO: 40343 - DNA, 201 bp, Bos taurus
tgtattaattgtccacctgatattttatagccaaacagacaacacagcacaaccagctcatgcaggatttcagcctttttagagcagagaggcccacaccrtccacacccactaaccagtactgacctgtctacagggactgtctccacagcaagaggtcatcaggaagtatccctgggcctgaatggaggtaagagaaag

SEQ ID NO: 40344 - DNA, 201 bp, Bos taurus
ccgcatctgtccgtggaggggcttggggccacaggtgggtctgcgcctggctcccctcgattggctaggacttagggccgagggtgtacaaatccaccctmctcggaggtgacaatgccgcctctcaggggctggaagtcacgtgctaacccaccccacacaaagcctcagccctggactccagtgctcactgacaacctg

SEQ ID NO: 40345 - DNA, 201 bp, Bos taurus
gtcgaggagcgtgggcccctggacagagagtcatggggtcaggtttacttacatgtctccccataacctcacttctgccatctgcacttgaaggactcaaytggcccctctaagcagctccacactccatggaggccaaaaacagcaccgtccaaaccacacacctgacacagtgaccccaccgggaggtcagaccttggg

SEQ ID NO: 40346 - DNA, 201 bp, Bos taurus
gtcccccaggatgaagacaacttccggctgcagcagccataccgctgtctggaaggctcgctccatctgccactccctggaggccaagaggaaaggagggrtggtgtgttccggttcttgtctacctcacacctcccggggtttaaagctctgagaggaaatacagtagccctgccttcatctgtctggcctccccaaccc

SEQ ID NO: 40347 - DNA, 201 bp, Bos taurus
ttaaagggaaacactcactggcataaaatcaacagggatatacacacctggcctctcctcactctccagctctggccagggaagctattctactgctttarcacctcgggaagcactttccattgctgttacctatagtgcagacagggacacagcagctagcaattcggaagtgggccctgtggccacggcccagcggca

SEQ ID NO: 40348 - DNA, 201 bp, Bos taurus
cttcttgaaattctctcccacttgtgggccagataaaatgattagaaaacaagccagagctgtgtccctgtgtccatcctgacccataggacccacacctrttcctggaaacttggccggcacacagaggcccattttctgaaaccacgagcctggatgggcaatgattggcttacctggccagcccgccctttacacatg

SEQ ID NO: 40349 - DNA, 201 bp, Bos taurus
cctttcctagaaatttttaacaaaaatttaaaccaaaaaaaaaaaaaaccacacaaaaaccctgttgaaattaatcaatgaatttagtaaagttgcagtayacaatttaacatataaatatcagtagtgcctccatacactaaaaggaaattttctgaaaaagaaatagagaaataaatctcatttacaacagcatcaaaa

SEQ ID NO: 40350 - DNA, 201 bp, Bos taurus
aagaaaaaaattgcttctttaattaagatttatgggcctcagtagggcccagccagaggagaaaagtggttcaagagagtaaaaactaatggttaaaaatragacaatatgattacaggcctttaattcctcctgcttcttttgcagagcttccagtggccccaggcaaaagcaggaacttattgtctttaaaatagcatt

SEQ ID NO: 40351 - DNA, 201 bp, Bos taurus
tcaggattgtcatgaagatattctttcacctacccattcttaaaaatgcctaaacttttatatctaagggataatatttgtcctttcagatgcagaaatcrggcataatgcaagtccccctgcaggggagataaattatgacttcaatttctcttaagagttaggttcctggtataaggaactctgatgactacaggtttg

SEQ ID NO: 40352 - DNA, 201 bp, Bos taurus
tctggcctatgactctcttgatgtggtgaattaggtgagtgtcaggagctccgtgttgcccagcaaggttcccaggggatattatggtctatgagggaagrttcagttagcctcagctggccttgcattgtgataattgcacaaagaacatccttttctccacttcttactgctccacaaagacagcctatgacttcaatc

SEQ ID NO: 40353 - DNA, 201 bp, Bos taurus
tactcacttaaagatcttgctatcttttgtggtcctcaattaaggctcacaagaacctcttgagggtaaattggtgccaatctaagcattgagagtagaakaaaaagtaatgaaaacccaaagcttgtacgaactttcaaaagtcatctctaaggactcgagggagcagctaaaattgattgtaacctgaacatctagaat

SEQ ID NO: 40354 - DNA, 201 bp, Bos taurus
gggcagcagaggtagctttatggagaagcagaagagatgccccctctaggctgaaacttgagggagattaagcaggcctcccctgcccctggcctccctcytactccactctaaaaatcagacaagtcagaagatctgggcttctttccctgtgactgaaggcgtgaggcccaggagaagggacctgctcagggtcagggt

SEQ ID NO: 40355 - DNA, 201 bp, Bos taurus
tgacattccaatttctgcttctgtcttcacatggccttcttctctctttgcttgtctctgtgtttcatctcctctccttgtaagaataccagtcaatggaygtagggccccgcatggtaaagaagctgcctgcaatgcaggagacccaggttcaatccctgggttgggaagatcccctgaagaaggaatggctactcactc

SEQ ID NO: 40356 - DNA, 201 bp, Bos taurus
gggggtatttatacaccagatcccaagagtcgttgatttgagggctatttctagagggggataattctttgaaactctggcctgccatatatttatagagmaaactttcctccactgaggctgaaggaaggagagccttcaggcaaagaagtgcaaaaataagcagttgtaagctagctgctgctgcggccgctgctgcgc

SEQ ID NO: 40357 - DNA, 201 bp, Bos taurus
catgtgagagagattaaagttgaaagcaataccatcacacaaataccatcctaccctcaagggagaaggctggtcaaaggccgagctccctgtggtcaacrcaacagaccaaagtcacgctctgtctctgccctttgctcatgccctctcctaacatctgcaggctggggcgagagtgcatacgaaggcccatgtatgcca

SEQ ID NO: 40358 - DNA, 201 bp, Bos taurus
gcatttctacaagcatcacccagtgacttgagaaggccgatcctccagagtatatgaaggactgagggaggggcataggagagggggctctgggtggggtragagcagtatatgctgctgggcctcacatagaggcccagaacaaagctacagcagagggcctgagccactgcaacttacaggttcccatgtggtgctgat

SEQ ID NO: 40359 - DNA, 201 bp, Bos taurus
agaaaagccctgtcttgatcacactctcatgctttaaagcgtcctactctgaccttcctctggccatgcccttccccatgggaataatagcccaggcccaygggacacttccacctggagcctggttcctccttcgagacatgcttcaagcacctcaggtcacagaatgtccttccaagtgtcctgcggctgcttcctggg

SEQ ID NO: 40360 - DNA, 201 bp, Bos taurus
tccagatgccctgtggccatctcatgtgcatatgagcacattaaggattgtttcttcctcttcttaaagaaatatgtttttccctctgactccatctagarccaaggcccaggcagtcatgtaactgtccttgctcatccaggagtatattttacttgtaggcaggcatgtctaacgtgacccccactctgctttttcccc

SEQ ID NO: 40361 - DNA, 201 bp, Bos taurus
ccctggcacctcccctccagtgtccactccttctgttcctaacttatcctgtcttgacttttgttcccataattccctctctggtgagtgcccacaaggakaggaggcccttccttactgattcatggaaccaaaaagatccttcaaggacatccaatccatgatcatggttttgtagaggggaaaagggagtcacagaga

SEQ ID NO: 40362 - DNA, 201 bp, Bos taurus
gggagagtaccaagtggccagtgaggatggagagaggcaggtgaagggctgggacatcggccagagaggacaaggcttatgggtccaggagagccatgatrggatctggggagggccatcaccgagaggggatgagaaggctccagacagagacagtgaggagcaggagacattggttctgggaatgttgctctccttgga

SEQ ID NO: 40363 - DNA, 201 bp, Bos taurus
aatatacagccactttatatagtgttcgaaatgtaagggagcagctttactaggctgttggcagttgtgtctgttttgtctattttatctggaaagataamatgaaaattactctattagaaataatgctgattctatgtaattttttttaaacttctcttttatttttaatttatttttggctgcgccatgcagaatgtg

SEQ ID NO: 40364 - DNA, 201 bp, Bos taurus
taactaagatagcagtgtcaagttctcagaacaatagtaaaggggagagattactacgatttgcccgttatccacatgcagtgccttaggcctcagtttgrctagtctaatggtggaattgctgatgctcttccaacagggaacattttagggacaaggagttctcagggcctctctcaagcttgtacgtttgaaggtaga

SEQ ID NO: 40365 - DNA, 201 bp, Bos taurus
ggcccgtgggcagcgaccaggccccttgcctttcctgggcctgtcccaggatgccaggctctgtcctctgcctcccaggccctggcctttccttccccacygctgactctcctcttggcagccttcgcaaggctctgccaggcacttttaagaatccttcaggccaagcatccctggttccaccagtgtcgttgcttccaa

SEQ ID NO: 40366 - DNA, 201 bp, Bos taurus
ttcaggccaattctaacatcagatggaattctcagatggcctttgaggtcccttccagccccctggatcctttctgtggtggtttggaggggtggtgctcrttgtgagtctggtgcccaaaggccagattcagaaaatagtccctgtaagccttgctcttgctcttctgcgtcctgagcacctatttgcagctgctattgg

SEQ ID NO: 40367 - DNA, 201 bp, Bos taurus
cttgcagactcatacctaaaccctgtcggtgagtggaaagtaacaagctgcgtctggtggcaggctttaagtcagaatccaacacttactttagtccatgygtggcccacgcattattttatttaccacttccacccatgcctctttctcactctgcacacttttctcagtcacagtttcggcaagcccacaagctaaccc

SEQ ID NO: 40368 - DNA, 201 bp, Bos taurus
gatcgactgccaaccacctcctcacacctgctgtgctcaggcttgtggccttggctgaccctctgccagttaaaactgccaccctctcaccccaccaggtrcagctcccaatgctgggggccccgagaggaacgaataccaaagaggaccctccccacagactctgggcagggtatgcggccaggggtaagccccaggcct

SEQ ID NO: 40369 - DNA, 201 bp, Bos taurus
agagtatgtttagttttgtaagaaaccaacaaactgtcttctgaagcggccgtaccattctgcattcccaccatcagtgagtgagagttcccatggcttcrcatcttcatcagtatgtggtgctggtagtgttttggattttcaccattctgataggtgtgcagtgatatcttgttttaatgtgctactccttgatgacgt

SEQ ID NO: 40370 - DNA, 201 bp, Bos taurus
ggtggctttctgagaggcactgagagtgagtgggggtggcccgtggaagagcaggcactcaccctgggggcagctctgacccctgacctcttacgtggccrcaatgaatgcctgggatagatttccgtttccacccttctattcacacacgaggcttcccagtctgagggccctgagtgggctacggcttgctgagctgat

SEQ ID NO: 40371 - DNA, 201 bp, Bos taurus
agagctggttgatggcacagcagagactagagctcaagtcattcgacctggagtccagcatgcacatggccttcagttgtatcttatcactgaggccaacmctttcttccttcttcagagtccaagcatgagtatgccaagctgaggtttggattaaagcataccatgagatttcacaaggctgacgattgtctaggaaaa

SEQ ID NO: 40372 - DNA, 201 bp, Bos taurus
taaggaggtgaaggaagcaggcacatggcttgtccttaaaacatgacagttccctttgggagaagagagaagtgtgacaagttagctaaccaagtgggccyagacatggcaagaggtacagagggtacactctgggccaggggtccaggatggattgagattccttggggaagcaggtgtatcagtcaggataggctgagt

SEQ ID NO: 40373 - DNA, 201 bp, Bos taurus
atctcagtaccccagacccctaggctggggccaggggttcagttgtgcaaatcctgaccccagaagggcaaatgggacaggaccgcaggcaattctgcgcrgtggcgctgggggaaggccgccggcaggaaagacaccgagctgccttctcaacactgtgacacagattaaggggttcatggtggaattgggggaatgaaa

SEQ ID NO: 40374 - DNA, 201 bp, Bos taurus
ggagaggaaggagcagctgcaggacatttgatgtcttgggattaagatccagctcctctctggcaagatgcatgacccggaaagggtggtcggccccatcractcatagcttcccctgtcagtgaatgagctgaactaacttcaaggtctctacaaggtttgatgatccctgagtctatgacaaataaaacagcaatgaac

SEQ ID NO: 40375 - DNA, 201 bp, Bos taurus
aaaagtgaggcaggagcggcaagtaagaggggcaacctgaatgagagctggcaggctttggctccttctcctttgcccccttctcctttgcccagaggccyttacagttgacaaaaggaccccttctctggcactcactcaccttcatgtggtacaaggtcagtgtgcgagggcaaacggcctggtcaagaaagtcagtaa

SEQ ID NO: 40376 - DNA, 201 bp, Bos taurus
aggcaaggaggccaggaggaggtctgaaagacctggggacaggaagtatctaaccagagccatccttagagcgatgtgagcaggtgcactgggacagggaratgtgagatggccagcacagagggtcaggtgcccacaactaagatgtaaactagatcagaggtagtggggacagagagggggtgatgactgttagttacc

SEQ ID NO: 40377 - DNA, 201 bp, Bos taurus
ggggacttggactaattgtccaggttagtctggacagagaccataggtgtccatctcatgcagaatggatggagagaccagaggtggggccaggttgggaraggctccctattgtcatcgagattaatttgtgtgacctctgacggcagaaaccagaccggtgctcacctgtttcaggtgagggctcagaagagggaggcc

SEQ ID NO: 40378 - DNA, 201 bp, Bos taurus
aaaattatttgtgtctctcccaggcctggcccatccaaatctcctaggtgtggccttccattctgtatctggctcatggagaccttagaggccacatcctraagatggcagctccatcacatgacagacgcctgggtctctgaaggaccacgtggagcagaggcccctgtctgactcccactggacatgaacatgagcaag

SEQ ID NO: 40379 - DNA, 201 bp, Bos taurus
tcttttattccgctcaggagcctgccgcttgggcagggctcagtaggtacaactcacatctactgcacgtggtattggctgggatagctctaccaaggccrgaagatccacttccaagacggcttgtttctgaggctggcgagttgtgttggcttcacctccatgtgggcttctccacggggcctcctgggcttcttcgaa

SEQ ID NO: 40380 - DNA, 201 bp, Bos taurus
cccagctcccatcctgggaaggagttcgccctggcaggcccaggtgaggcgctgcggcaggtgtcctgatcggcagtaataactgcctgtcactgagagcrgggctgctttgtcacctttggggccctcctccccacccccacctgctgaacccccagagacaggcatgagcacttgagcaccaggggaggaggtagaaca

SEQ ID NO: 40381 - DNA, 201 bp, Bos taurus
ttactcccttaaagcccagcccactaataccatcaccctgggattagggcacagtatgtgcagctgaggtcagaggatacgttcagtcgtaacagttcacrttctccagggggaaggcacacttgctaagcactggggccaccagcagttccacctcaatccactttcaggaactgaatgaagtgattgagaagctggatc

SEQ ID NO: 40382 - DNA, 201 bp, Bos taurus
agatgtccactggacttaagctggtggacaaacagcagctcagctgcaaatgaaaagaacaaaagagcattataatctcctgaactgctaagcaaataaargaagaggacagtctgtcaacacacagaaccatcaactacccaccctcacggacggctccttcagtgagacaaccatcgtgataaagtggccatgactgag

SEQ ID NO: 40383 - DNA, 201 bp, Bos taurus
ggcacttagattgctagcaattttcaattatcataaacattgctaccaactgtctttacacatatatctctctacatacatttcttaaacttgtccaatcrtctccttaatataaattctagaaatggaattgctagatcaatgacatttctgttctggtgaatactgcaaattgcattccagaaagatctaaccaattac

SEQ ID NO: 40384 - DNA, 201 bp, Bos taurus
gggaaaggagattcagacaacttattaagtcctcaaggcccactcctcctaataggcacacccggggctgccctaggcatggctccccttagatcctccartttctctgctccagggctccttggccggatatgagagagtgagaacaattgccagtttgggctctcttcttgggccgagagcacagtccgagggtcaaca

SEQ ID NO: 40385 - DNA, 201 bp, Bos taurus
gaagtgtctcaagagaagtcgggaaaatccaggaagctctggaagccgcccttctcatggagaagaactggaaccagcccttttgggcctggatgttctgrgttctgcccacacagacccccacctctgtgactcacagacagccacgtcctagaagacgggagaccgcctgaccaacaacgtctgcaggctggctggccc

SEQ ID NO: 40386 - DNA, 201 bp, Bos taurus
ccaaagagtctgcaaacagtataacatccttcaattccttaactcagttgtactggataatacaattcccttccattttcttttcatttttgatgtctttrtttatttggccatgctgctttcaagaccttagttcccagagcagggatcaaacccatgcccctgtattggaagctcagagtcctaaccactggaccacca

SEQ ID NO: 40387 - DNA, 201 bp, Bos taurus
agccttaatgatttgtgctctgaccctctctctgactgctcttccttccctcaccctactgtgcagcctgtgatcatttcaaatgctcttgctgtttcctyggccttccctgtactcttccctccccttgagccacttttcgtatccacacacagcgccatttttgctgccccatgaattctttcttgatcccatccccca

SEQ ID NO: 40388 - DNA, 201 bp, Bos taurus
agccaaggtaggtacacgtgtattgctgactttatagaaaacggcagagatactccttgtctacttcggctgtcaaccgatgtatgactggcatttcgatrttcatccagattttaaaaatatcagtcctccacagacaagctaaataagagtaacatacataatatttaaaatgatcaagacagttttactacagaaacc

SEQ ID NO: 40389 - DNA, 201 bp, Bos taurus
attttcagtttatctcagatgctttctcaaataggtctcagaaccagtgttcttgctcagcctgaaactggtggctctgggctggggccagaagctgcacsctctagtttgcgctctgccactgaaacttgatgtatatgaccttgggcaagtcatttcccttccttgggcctcagttgcctcatctgtaaaatgagggag

SEQ ID NO: 40390 - DNA, 201 bp, Bos taurus
gagaaagagcgttgtcaattctgttttacctgaagtgattaactcattaccgttggatataatttatgagtaactgcaggttaccttctatgactttcccrttatctgaaatgtttcatatttcaggctgctttggccagatctgtgctaaaagaaataaacagtaagagaaagagtgaatttctatcttatttgaaatat

SEQ ID NO: 40391 - DNA, 201 bp, Bos taurus
tgattcatcttcataaaatgtaccttttctcatgttccaattcagctctagactgcagtgatctttaataaaacagcccagaagccggcctaggtctctgycctccagatctaggcaaaattaatcccaaactttgtacattataagcccccaatgatgcctatggcctgtgagctgatgcacaggatggaactgtcaaat

SEQ ID NO: 40392 - DNA, 201 bp, Bos taurus
ggtgggggtgggtaggggggtgggcgggtccgtggggataatcagcttccaggccctgccctgaaccagactggatgtgtgtgaggccttgaccatgtgcygacttccttgggattctcaactcccaatggctacaactgcctctatagcaacctcttggtgggtaaaaggcttcctcccgtgtttgtcttggcccagcat

SEQ ID NO: 40393 - DNA, 201 bp, Bos taurus
ttcagtctttttcatgagcctcgaacggaagcctgtgaagaaaagcctgaggatgacaatgcatgttgtgtatgtagctccccagcatcagggtttctacrccctcatattgttccaaattcagcatctagcaattcattaaaaaaaatttagccaaattccttgtatccactgtgtagtggccccatcgtcctcttatgc

SEQ ID NO: 40394 - DNA, 201 bp, Bos taurus
gtcctgtctctggggccgaagcagactgggtggcacctcgcttggcttacaaagagcaaaggtttgttcagctgagtagaacaaggagaagcgttatggayggttatctgggaggccatttccaaatggagtgatgatgcctgaaacaggaaccaggtcctggtttgggtcctgttagtgaggacaggaggctgagccaaa

SEQ ID NO: 40395 - DNA, 201 bp, Bos taurus
aaaatgttggttttgacttttatatggaagtgagggtgaagacggagggtgctatagttttgccagttcttagggactcgtgttggctgatagtcatggastcttaacccatgttctatgctctaaacatctcaaacgtacttgctaatcttaatcctcacaacaaaccttaggaatgaataaccccatttagcagttgaa

SEQ ID NO: 40396 - DNA, 201 bp, Bos taurus
tcaagcttcgctctggggaagagaccctcaccccaagggctccttctcctgacatctatcaggcatcttaagccattaacctccagcacctctttgaaagygtgtttttctacaaaaactttggcttgaggatagagagagagagaattatatttgctcgaatacaatgctttaaaaataaatacagttggggccctgttt

SEQ ID NO: 40397 - DNA, 201 bp, Bos taurus
ctaaattcatatcttttttttttttctggtttttctttattttattctttccactgcttccttccatttttcctacctttaagcatcattttcatgtccartcaaggccttcatccctcccagccatgacggcagtactccagtagcatatggccctttcctcccagttttcttcttgcatccatctcatcttcctgtcct

SEQ ID NO: 40398 - DNA, 201 bp, Bos taurus
tctgagggaatttttgaggcccagatttaaagtacattctcctgggaagatttgctttcccaaaatgagtccatattaaaccaagtttttgttaagatgcrtttggtccatgcaggcctcatgtgcttagtccctaaccccatggactgtagcccgccaggctcctctgtccatgggattctccaggcaagaatactggcg

SEQ ID NO: 40399 - DNA, 201 bp, Bos taurus
cccactgtcttttttttttaacccataccataagcctttgaggtcggtactgttattagttcataatgcagatgagaaaacttaggcccagagagcttaastggttccttgactgataaggaaggtgactaatatggatgtgagcagtgtgaccctgaggcgtggggatcagttacttagctatgtctgtgttctgggcca

SEQ ID NO: 40400 - DNA, 201 bp, Bos taurus
cttatctgccagctttatgggccccctcctagcccttcatacaagtagcccgcaacgtgggatgtgaatggctgtgttctggcctctgtccatctgttacrtggacatgcaccacatttctctggcagaacttctctacagagtcacatctaacgtctgcaaagggagaggccttagccaatgcaaggaagcagagcaggg

SEQ ID NO: 40401 - DNA, 201 bp, Bos taurus
ctagctaactggggagcccagtgaaaagtgaaatgtgaggccctggccaggagcaggaaaaaaccctctccacaggcccagcctgactcagggtgagcccygaggcactgtaaccttcctgccaggctgagattggtacttaccagggaagggcaagaggcccactgagtgcctccagaacattctggaatatatcccccc

SEQ ID NO: 40402 - DNA, 201 bp, Bos taurus
ttctttaaattggagtctctacacaaaacgttttttaaattagccttcgttccttcatttccaaagtctaacacacattaccactgttttacactagcatrttacatctgatttttaatttggaataatgtgtctttcaaccccatttattttatatgatttgttaagaacatcagtctcatcaaactaattatcgaaggc

SEQ ID NO: 40403 - DNA, 201 bp, Bos taurus
tagtcagggaactgagatctcacatgcttcgtggccaaaaaatcaaaacatagagcagaagcaatattataataaattcaataaagacttaaaaagaaaamtatgaacaccccacttacaaccgaggtttctagcagtcataatggctgctactagctatgcattattgacaagaaaattgacaagaaaattcatggatct

SEQ ID NO: 40404 - DNA, 201 bp, Bos taurus
ccacccatctttcaaatttgtaaaattttgagtgtattttgaattttttttttttactatgttgaagtccacttgtttttaattcattttctacaggagcrgagtaaaaatgcatgtgttcagttcatcttgttaaaccacaaaatattctagtttactttcaccagaaaataaacctcagtctcttggaggctgagttga

SEQ ID NO: 40405 - DNA, 201 bp, Bos taurus
tgcatattggaaccatttgaggagcatcaaaaaatactaacacttttgtctcaccatcaggattcagatttatgtggtttgggctctggcccaggcaaaarggaattttaaaagcagccaagtttgagaaccactaagttggaaaaacctattttccgatcttgctgatagatctcagggaaagcattggcctctttgggt

SEQ ID NO: 40406 - DNA, 201 bp, Bos taurus
ctggccatgccctccagtaaggacatctggcttattgatttcaatccttttgccaaaaaatgcctcctcatgtcacttttctttccagacaaatacccgargaggggtgaagggcccctgttctgtgcgtaggtgaagggagcagtgactgcgactccccagctttgcctgaatccttttatccaaagcttccctgtgagc

SEQ ID NO: 40407 - DNA, 201 bp, Bos taurus
aggttacattcacaataaccaccagtgggtatgtctctaagattcacatggcttaaatttcccatctgaaaagtggagatacaataactgctttctaatgrggatgtagataaagataaaacttaggcgaattatgggaaatcacaaataccatacagttatatgaatattgtcatttctgtcccaccccaccctcttttc

SEQ ID NO: 40408 - DNA, 201 bp, Bos taurus
acccagaataaatcttcatatcacagtcctggagttttgccatggtctactctgtacttggggcttgtagtgcatttctattcgcttggccaaaaaactcrttcagatttttctgtgccatcttatggtaaaacccaaacaaactttttggccgatcctactttgggaagctactctttcccccctgcagaatgtttactt

SEQ ID NO: 40409 - DNA, 201 bp, Bos taurus
taaaatgctaagggaaaactaaggcagggtaagagatttatgaattgatggaaagatgttttattggatatactggccaaggaaatcctctcttaaaggaygactttgaagcagggaccagaataaggagaggaataagccgcatggacatctggtgaaagacttttggaggcagagaagatagtgggtcagaggccttga

SEQ ID NO: 40410 - DNA, 201 bp, Bos taurus
atctctttaataactgcctgcacttggacagcatggaacttgctgaggcctttagactgctcagttcacccaaatcccagtatgtggaacagcccccttcytcaaaagtctaggacacttgtaggcctcaaggaagtgagaccttgactccataggagagagagtaacttcacaccctgactcaaaggagactggggggag

SEQ ID NO: 40411 - DNA, 201 bp, Bos taurus
cccttcacggttccactgctttcttccttctcctgaaagctaaggagctgaatcgcacagctgagaccagagagtgagcccagggcttctgcccaccccayggccttacagaagcagagcaagttggcaggagccggtgtgacctcattggatgcaagctgcaaggctccggccccgtgatggcagccctgtggttacctc

SEQ ID NO: 40412 - DNA, 201 bp, Bos taurus
agaaaaaaatttttaagacaataaaattttaaataacagctaagatagagacagcgtgatcaaggcagaactacactaccccacttcctctgtgacaacaytgcaggaaaatacagggaaacacaacaggtttacactgggagtgagggctagacataaaaggaatgtctcatttaggtgggtagaaagtatgaaggcagc

SEQ ID NO: 40413 - DNA, 201 bp, Bos taurus
gctgtggtctgaacctctgtcccctggagtggaagtgtgagggcctgacgatggcttgccaggagtccccggcgttctttcttgatctcagcacgttgtgytagttgctctgagcttatttagttgagagaaatcttcggtgatacatcttaaaaatgaatgttgtcaccatggagaagtgaactccttccagattccctt

SEQ ID NO: 40414 - DNA, 201 bp, Bos taurus
atgtaactacatgtttattagtttgggtttttaaaaacacactttattctacttttactatcctaagtcatctatcagtgagttaaacctttctttatgtycctaaagaacgtatgtgccatgtaatatttctactactttttcctttttctctctgaaactgttttttgttttcttaaatattcctgtttgaaatcggac

SEQ ID NO: 40415 - DNA, 201 bp, Bos taurus
ctgacacccggggtggactcagttctttgtttttcttatcgcaccttccactgtcctttatttgtaacaccactcatactgcatagtcatgtcattatttrttagttagagccttgcaggaacatagatgaatgcggcataaatgaatgaaatactgggatggaattcaaaaaatcttcttttttttttccttcatatttt

SEQ ID NO: 40416 - DNA, 201 bp, Bos taurus
tactttaaagcagggcttattagtaaagggatttatgatgttgatggtacatactggcttcttgcccatgtgcttaattctgcttccttggtttttctttkcattcaacagttatttttgctcaccttctaggttttgaatactcactagttgttgagtatagggtgaagtttgtactccaaagggcaagactgatggctg

SEQ ID NO: 40417 - DNA, 201 bp, Bos taurus
ggaggattcaggaggcaggtgtcagagcagaaaaccaaagatctccactccagccaccggagtgatttcaccagcacagtgatgccaggctggcctgaacrgggttccagtgattcctgtaattgactcccaaatgactgggttctattgtctccatcgctaggcgttacaagaagtggtctgagtgctgaggggcttttc

SEQ ID NO: 40418 - DNA, 201 bp, Bos taurus
caccgtgatggccactctccagaaactctctagaactgagagacacgtaaatgaggtaagcagacacccatcctgtgctcactgggggctgatttggcgckcgtgagggggcctcagcccagaagaatgaatggaggagatagaatcagaaggattatgctgagcagcgatccaaacggaaagaaaggtgcaggaaaggtg

SEQ ID NO: 40419 - DNA, 201 bp, Bos taurus
ttgacagacaggataataattcccacagaccattagttctaagaagagcgactgttgattccatcccaccaaatgctccaccttcaggcatgggcccctamccatctttagttagtaacaattgaaggcaacacttcttagatcaacaaatgcctaggcagtgatcctcataattaaatccccctgtgcctctcactgggc

SEQ ID NO: 40420 - DNA, 201 bp, Bos taurus
cagccgccatactggttttgtagagaatcgctccagtaagccttcaacagattttcctctgggcccctgaagcagactggcctgtagcagcaaggcctcaygagactagaagcttctggtgagtagaagccatgtgtttcgactttgagtagcagcgtgaaccagggaagggcactggctgggccactgatgaatgcctgt

SEQ ID NO: 40421 - DNA, 201 bp, Bos taurus
cgcttctggccacatcagctgtggctgcaagactgagattctagcccagctccgtcgggtgtttgtccccttccactggagttccatcatctgtggaccgmgtggcatggcacggccaccgccactggccgccgtctgtctagcgttcattcaaagagaaaccagcgacctgccagagttgacgtccgcacacagacctgg

SEQ ID NO: 40422 - DNA, 201 bp, Bos taurus
taatttacatccccactaacagtgcaggaaggttcccttttcttcacatcgtcttgtcaactctcgcttgttgttttttcatactggccgtactaaagacrtgaggggatatctcatcgtgattttggtttgcatttccctgatgattagtgatgttgagcgtcttttcatgtgcctgttggccatcttatgtcttctttg

SEQ ID NO: 40423 - DNA, 201 bp, Bos taurus
tcagggattcctgttgcgagtgttgcttagatgggaggacagttccgtgaagcagagatggttgtaggtaggttccctcacaggctgtgagctctcggcarcgtgggttttgctgcagatagtgactgttattaaattccatgctgtctagcctggtgctttttcacgtaggaattttttaagaagtattcattccacagt

SEQ ID NO: 40424 - DNA, 201 bp, Bos taurus
gggagacttcccatggggacatggggtgtgagtctgtgatcagagttggcctttaaaccacccatttttgaggttggagcagtttggatgttgacaaggtmtaggagagaagaggaaaaggccattagaaatgaggaagtcaagtgcctgagaagccaggcagttggagggacatcactgcatctgtttagtgtgtcccag

SEQ ID NO: 40425 - DNA, 201 bp, Bos taurus
atgggtagaggaaccctggtgggctacagtccttggggactcagagtcgaacaggacggagcaaataaacaatgaaagcggccttggttcagccttcactrtgctggaagagggtgagggcagacaggcagggacacaggagcttgtccagtcatcaaggtgagagatgctggtggcctgaacaaggctgcagcatctaaa

SEQ ID NO: 40426 - DNA, 201 bp, Bos taurus
cagaagtcgtgtcccggagcagggcttgctgcatctgttttccccggtttctgaggtcattgtttttgtcctctggttcatcgtgtgcttccttgacagayggaggccttgaaacacggtcacagcctcggtgcagggagaagatgtgagcccgggagagcattcttaagtcgctgctgaggaaattgatgctcctttgtc

SEQ ID NO: 40427 - DNA, 201 bp, Bos taurus
tagggaaaaacatggacagcttttacagataaggcctgagacagatatcatcaggttatacataggtcataaatgcattgcttagaaaagccatctcctcmcctatgctgctggcctgtcttagagatggattgggatgagggtggtggagagtttagaaaagacctctggccttcatacggttttaagagtcatgggtaa

SEQ ID NO: 40428 - DNA, 201 bp, Bos taurus
gccctggtcacttgggagcctcaggcagagggaaatccttggggctcagaccaacggccagacttgccctctgagctggccccaaacctctgacccaaggrtccttcttccccagcaaagcatggaagggaatttatagccactggagtctatggtccgagatacaaagagagcaggagccacgaaggactaggcctgtgg

SEQ ID NO: 40429 - DNA, 201 bp, Bos taurus
gagagaggtcgaggaaggcttttccaggtgagtgacataaatttagatctaaagatgcttggaagcgagttacacaaaggggactgggggtggtggtgagyggtggtcctcagcctttgttggcgccaaggacgggttccatggaagatgatttttccatagaccggggtggcggggatggtttggggatgatccaagtgc

SEQ ID NO: 40430 - DNA, 201 bp, Bos taurus
aactgatggatggttccatacgagcctgtagcccccctcaagaggctgacttgatgcaaagactttcaaggcctgggaaatgactctcccccatggccatygtttcctcaaagttgtctcctctcgcagctgaaaattccaattccttcaacgcttcctcaatgacagccagctgtttcaagatttctcggccagcacccc

SEQ ID NO: 40431 - DNA, 201 bp, Bos taurus
ctggaatctgcacccgatctgggaggcttctcctcctccttcagggtgcagctcaactgagaaactactgctgacctttacctccctcctggcagagttayaggcttctggcctctgggtccctaatggtatccgtgttgtagcatttatcacgcagcatggtgttacctacggttgcctccatgagacacgctctttgca

SEQ ID NO: 40432 - DNA, 201 bp, Bos taurus
tcaacggagtcaaatcccagctgtggacaagtccccggggtgctcagccagctgtgctctgtcttctaggaacagttaaagtggcggacatgacggggccyggagcataaagaggcctcgggtccgcgggacaggagaaagtgagctgcagtaacacccgcctcccatcctcctttcctggagatgactaatgcgagctct

SEQ ID NO: 40433 - DNA, 201 bp, Bos taurus
tgatgtaaggagacctgttcttttaaaaaagaacacagacagaacagtagaggctgcttcccctgatccacctcggcctggataacacactaactggatgyggagggaccaagcctagctgcccacagagcagaagccgctttacttctgctgcaaccctctcccaagtggcccctgcgtccccaggggcctgcatgcgaa

SEQ ID NO: 40434 - DNA, 201 bp, Bos taurus
ttcacatctctgcaaatggcactgtttcgttcccttttacggccgagtgatattcccctgtgtgtgtggagcacttcctctttatccattccactgttgakggacatttaggttgcggccacatcctagctattgtaaatagcgctgccatgaacactgaggtgcatgcatcctttcgaattccagtttctcaggatatat

SEQ ID NO: 40435 - DNA, 201 bp, Bos taurus
tagaagttctgtagaggccccttaaaacaccatgcatctgttagtgaagtgttcactagaactttcctcatcacacacacaaacagctgtctccagtttcrgtacagagaagccctctccaggccagctcatggaatgctcctcaggttttcactgcttggtttcctgctttgtcagaacccagctccctcccattccctg

SEQ ID NO: 40436 - DNA, 201 bp, Bos taurus
aagagctaagagcccacatgactcatggccacgaaaccaaaacataaaacagaattaatattgtaacaaatgctacaaaggctttaaaaatggttcacatmatttaaaaagtatatggccttatacgtgtaaatgtacacctggctgaagatatactgtgatgggatatagatgcatattataaccaagtaaagggaactt

SEQ ID NO: 40437 - DNA, 201 bp, Bos taurus
tgaacataaggaaaggaaagaaactccataagggattccaatgaagggcacagtgaaaatgaatgagtttccccctcttacactctcctctaatataagarcagagagatactcaataaaattagcaggcagtaaatttagatctaataatagggaatacatcattagttccgtatatggagttctctgcagcaagaggtc

SEQ ID NO: 40438 - DNA, 201 bp, Bos taurus
aaacaacatcatttaaaatgatgtcaaagtcagaatgaagaaaatagattttgatgatagatgtttcccaacttataaatgttaaacctaatttatccttkgattcactctgtaattttgaactggtttccttgtttttggtttcctctatttttttctaaaacaaaaaatgctatttattaactagcactttattaactt

SEQ ID NO: 40439 - DNA, 201 bp, Bos taurus
ttgtaaggtttccaagcatctcaaaaaaagattctttagattacaagtgatgcctaagtctagagcgcttctgacaggcaaagtttcgttacattcggtaycctgtttccttgatttttgttgctgggagggattgaggcaggagaaaaaggggacgacagaggatgagatggctggatggcatcaccaactcgatggacg

SEQ ID NO: 40440 - DNA, 201 bp, Bos taurus
aagtgggtgtgggttggggcagccgaaaaatgacagctgggtggcagctgacgttggccgtcggagaggcaacaaagaacaagaaacagaccgggccgccrgcgcctctcacaacccacgcgactcaggcagtctgtcttgaaatatgtaaggacgctgcaaagaaaagaacaattccaactgtaagaacacccctgcgga

SEQ ID NO: 40441 - DNA, 201 bp, Bos taurus
gcggctaccattttccattcccacggatggcaggtgagggttccgctagctccacaccgacacattgccaacttttccagttttagctcttctagtgggcrtgcagtgttagcccaatgtagttttaatttgcatttccttaataattaatggtattgaacatctttgtgtgtatctatttgccacctgtacttcttctat

SEQ ID NO: 40442 - DNA, 201 bp, Bos taurus
ggccctgggccttctggtactcagagattggctgttcccagaaatcagggataaagaatggcaaaaatctgttgtctatatgtaacctaatcacatctccrctggcaggccatattcttgtttcttcttccctcttctgaaaagaagaaacattaagtgatgttctcttctgattcctcccatgcatagcctggctgtgaa

SEQ ID NO: 40443 - DNA, 201 bp, Bos taurus
aacagaccggtaaaagaatcaacctcactttcttcccctcaaagaaaagaaatttaacagactgtggccatccttgatgttcaaatcacaataaggaggakactgactttttgttcagattatacttgaagtaatgatgttacagggatcccgtgttaaaatgtccccacactgaagattccaggaggcgtatggtgacca

SEQ ID NO: 40444 - DNA, 201 bp, Bos taurus
tttgaactgtggtgttggagaagactcttgagagtcccctggactgcaaggacatccaaccagtccatcttaaaggagatcagtcctgggtgttcattggwaggaatgtgcaagctgtgcattaaatcacaagtgcttgctgcgctcctaatagtttgttaccgaagtggagtgaagtgaagtgaagtcgctcagtcgtgt

SEQ ID NO: 40445 - DNA, 201 bp, Bos taurus
acaccaccccctttcaacaggccctggcacccaagatctgtgctgggtcccctgtcaagctttgcctttcccacagtgaatggaagcatgcggtgtgcagytactggagtctggcctccttcacttagcaaggtgctcctttctgcttgtatcaatggtttgttcctttttattgctgagtaatgttcttttgcctgaata

SEQ ID NO: 40446 - DNA, 201 bp, Bos taurus
tagtgttgtgtctcataattctgtgggccaggaattcagacagggagctaacagcaagagtgacttgtgtctgctgcagaatgtctgggcacacagctggyggctgtgggcctctctcgcctttcctctctgtgcatgtctatggcgcggcgtctccggggaaccactgttcctataggcctggggtcccagagcaagtgt

SEQ ID NO: 40447 - DNA, 201 bp, Bos taurus
ttgcaggggaaggtaaacaggccgtcagcacagaccgaggatccgagagacagacgtgtggggacttggtgtgtgaaaggtggtgtttcagagaaccatcraagtgtgtgtgagcagtggtaccggctggctttccagttgggaaaaattatataattagatccctacttctgtcgcgcacagaacgtttcaagtgaatag

SEQ ID NO: 40448 - DNA, 201 bp, Bos taurus
tgccctcctagttccagtttctccacaaacctattttaatattattttgttaattgattcactttattgagtttctccaaagcattcagtttagttatacrtatttgtgaagtgaagtgaaagtcgctcagtcgtgtccaactgtttgagaccccatggtctatatagtccatgaaattctccagaatgctggagtgggta

SEQ ID NO: 40449 - DNA, 201 bp, Bos taurus
ctatgtttatagagtggtattttcttactagaaaagtcattcatttttaatctccttgatactcaatgtacattgaatagctataggaaaaagaatatcarggtaatcacattaaaaatgattagttttgttaaatgccagctcttgaatgttatctttctatatcagtctgtataatattttctccttagtatacttaaa

SEQ ID NO: 40450 - DNA, 201 bp, Bos taurus
tgctcgccaggtcttggcagccttctttggaccttggggctctttgagtacttacagtctttgttcaaataagcagcctcctgatggctggcccccatgcraggcccacatctggaaaccatccctggtcttggcccaggcgttcaggcctagggggtgtgtgtgcgtcaggtagagcccgcccggggatccacacgccag

SEQ ID NO: 40451 - DNA, 201 bp, Bos taurus
tgtgggtgtgtgtttttggtggcgaggcccgtggctgattctcctttcactccttcaagcatcagcctgggctctggtttcctttcctggttcaggaggtkccggggctgtcgttaaccctggccagggctgggcgggccaccttaggatggaggccgcacacagaccccacttggggtgagcagatagccggcccaggag

SEQ ID NO: 40452 - DNA, 201 bp, Bos taurus
tctgtcattatttgtttaagtctgaaagctgttttaaataaacacatgctcattttatgtattaaaagcaacaaagagggaagaagaaaacctgggccatygtcatgtgatctggacaaaccccccgcctatatgttcagggtgcactcagcccctggttgtgtcgggactggccagggctctgcccgacctcagggatgg

SEQ ID NO: 40453 - DNA, 201 bp, Bos taurus
ttcccctcccccgtctccctccaaggaaaagcaggtgctatttccaaccagcagtcgcaggccagccttctatcagccccaagtccccgccaatggccatrtccgacatgactgatgagtttctggatgacctctgggcttggggaaaccctcaaatatcttctgactcattaagacacatacgtatgtctggtgtagttg

SEQ ID NO: 40454 - DNA, 201 bp, Bos taurus
caagtgtgtgtgcacatatatatatatataacatgtttatatagagaccatttgcacttcaacaaacctgggacctgacctaccatcttacctccaccccscaccagctctttcttctgaattccttctcaatgagttgaatcttgggcttccaacaaccccagtcagaagtttgggaatcatcccggttgcatcttctcc

SEQ ID NO: 40455 - DNA, 201 bp, Bos taurus
ctgtctagcgcaacagtaccagggggaaaaaaaaacagctcacagatgttcttcaaaaatacaagcatcaatcacttcaactaaagtcacagcatgagaayccacagctaagaatcaattcttctatctttataaagatactctggacgcaagtttgcccagcagagcatcccaccaaacggtgtgcattgtaggttaggg

SEQ ID NO: 40456 - DNA, 201 bp, Bos taurus
aacactaacataatcacaacatcatgatcacatccaagacaataacaattccaaagtatctggtatctggtttgtagtcagatttctgcaattacctccartgtctaataaagctgttttcccctcaaaccaggattcaaatcaatgttcttaccatgcattaggttctgggttgtcctcagtttcttttaacctggggct

SEQ ID NO: 40457 - DNA, 201 bp, Bos taurus
tgcccatgcgagtagccacaggcccccaagcactgccttcgagggaccctgtgcctggtgaccacagggatgatctcaggagcctgcgctccactcctacmattttaaacctcattacacgatggtcagagggaaagaactgggcagcattcctgccaagcgtttcttctgctaccagccagtcaaggaggcgatttgatg

SEQ ID NO: 40458 - DNA, 201 bp, Bos taurus
cccaccactgcaagttcagagatgcccccacaactcgagagcctcatgaacacaactaacttggagtcccctgccacaacaagaaaattgcaccctgacayaactagagaggtgtccgcacatcacaactagagaaaagccccccacaactagacaggagcccctggaaattgactgagaggagcccacaggaacaacaaa

SEQ ID NO: 40459 - DNA, 201 bp, Bos taurus
tgactcagggaggtgcctggtgttctggctcctaagggagataggcagcagggcggacggccagccctgctccggcctccagccagagacaccctgggccygccccggcacactgttacctcacaggagctgaaacggctctcgaagacactgcaaggtagagctcagtgtttcactttccggagtggcttactagtggcc

SEQ ID NO: 40460 - DNA, 201 bp, Bos taurus
gatgggagagcgccaccgcaggcaaaaaagacaggcatgcaggcccctacaggcaaagagttacagcaaatagatcgggtgtgctgagactctcagctccyggaattctatcagaaaggctaccggccaggaaacgagacagacagagctgtgtcactggtcagagcctcaggctgccctgcccgagggaggccatctggg

SEQ ID NO: 40461 - DNA, 201 bp, Bos taurus
ctgataactgtccgttgcttctccacctccttagtctcaggcctggattaggggtccagaggtgtcctgtaaggaatgacgcctccccttctgttttgtgyagagagctgccggttaggccagagggcacgctgcccctcacatggccgggagcagggcctggtcgtccctggtcagaggagagccgagtgggggaccctt

SEQ ID NO: 40462 - DNA, 201 bp, Bos taurus
ttcctgcctcccactggccagcttcctgttcctggtttgccctgggcaccaaccagacctggggcattgttcctatccgtccatgcccactgactctgcgyaggcttggtgtggctcccataggccctggacggcccagccccaccccgatcttgtgtgctcctcacctgtgccctgcaccctgcgtggctgccccttgcc

SEQ ID NO: 40463 - DNA, 201 bp, Bos taurus
ggctcttgaggccgggttggtaggcctgagcacgttctctgacgctctggctgtgtgtgggcacccctgtccctgaacccgagctggtgcagagctcgtcytctgctctggccatgcccacaggacctgctttgtccaaacctgatcatcgagcgtctggtggttggacaggagcaggtggggtttctcccaaggcatgtg

SEQ ID NO: 40464 - DNA, 201 bp, Bos taurus
cagtgcccattctgtggccagagaccagagggagcccagaggcccaggacacctgctcctcctggtccctgccctgtggggacccagaggcggaggagccrgggggacatggggggccacagagcagcttgtctgagtgggctgattccacaggcacagctcgagaaataaacaggacgctaaagtgcaaaggagaccact

SEQ ID NO: 40465 - DNA, 201 bp, Bos taurus
tgtccatcctggaggaggacaaggactggcggccagccatcaccatcaagcaggtatgcgcccatgcccaccctccccagtggagcccagcccgcggccgragagcctgcccttcccaccactctgttctctctcatgcagatcttattaggaatacaggaacttctaaacgaaccaaatatccaagacccagctcaagca

SEQ ID NO: 40466 - DNA, 201 bp, Bos taurus
ggccctgggcagtgaaagcgaggagtcctaaccactggaccaccagggaatttcctgcaaagacttgtttctaaataaggtcacattcccagggtcagaarcagacagtgcagggctgaggcaggcctttaatttaaccatcagtaactgggaccacccatcctcaccaggctgttctctgtgcccaacagcacctcctgc

SEQ ID NO: 40467 - DNA, 201 bp, Bos taurus
gatagcacttgcatctcctttgtctcctgaattgcaggcagattctttactcctgagtcaccagggaagccttgtaattctttatgctatatgaaaaaacmtgattattttcactgtttctatggtagccaaacccttctgcacatttgggaattgaacattattaaaaataaccctaaattccctaatttactaggtcat

SEQ ID NO: 40468 - DNA, 201 bp, Bos taurus
caaaagggttatagaagacgaatattaaacacagatggagatggtaaatttaatttcatggacttgttatattttactggttctaacaaacatttttgacyaggaaccatttaaatgtatttattccagacaaacatctaaaagaacttcataaatgttcattctacaaggaatagtacaaagtaataagacagttaacta

SEQ ID NO: 40469 - DNA, 201 bp, Bos taurus
gagcaccctctcttgttccccagacaggccaccccgattctgagcagccccatcccctcacacctggggtgaggggctgcaaggaagccggggagactgcraggggccttagcgcccattgttgctttctctccaaggaagggggaggtgccccactgtggaaggggaatgggatgggatggggtgcccacgcttgccaca

SEQ ID NO: 40470 - DNA, 201 bp, Bos taurus
cccacctcccatcctgccctcactccccctacagctgccacaatacacccgagctcgaccaagtccagcccctcggtcttccccttccacttcaagcatcmggccaattctaagcatccggccaattctaagcatccatcaagagctctacactgcccagcccagcttcctcctcctgggctcccaggtgctgggtatcgc

SEQ ID NO: 40471 - DNA, 201 bp, Bos taurus
tgtggggaagtgggagcgagggaggcaggtgggagctagcagcccgggctgtcgggggcaggtacggatggcagcgggctttggggctgcatggccaaagyggcacttgaaatggagtcttccccctgcaggtgtggacttgttaacagaatccacgccgggtctcagcttcctctgggcctgacctaggcctaagcccgg

SEQ ID NO: 40472 - DNA, 201 bp, Bos taurus
cttggtcaaggggccaaaggaaggaaaaggggtgcagctgcaatttggaagcctggtgggaagatgccctgggagaggctgtctcaagatccttttttttyccctctgaggccacgtgtgtagaatgtgggaaggctggatggaagaggaggcacaagggaccccagtaatggaggggtcactaggattagtgaagcgacc

SEQ ID NO: 40473 - DNA, 201 bp, Bos taurus
aagcaaaggcaaagaattctattctggatgcgagcaaagcagctgcatcgatgccagccggggcgacttctgccagacagaaggcatgggggctggcctgyttctgcgacttctgagctcagtgattcttttgcagggggtcgaggtcaggagcgagcgagcaagggaaactgctgtctgttctcgctccctcccccgacc

SEQ ID NO: 40474 - DNA, 201 bp, Bos taurus
agcagacaaagccgagggcatcagtcagcctttgtactgttgtggctctgaatgacaatgacttgaggatattatgtcttccacttgcttctaggacttaytacaccttcaagaggacaggtatttatcaatggatatgaactttctaaagacatgcttcaaatccggaagagcatgggctggtgcccccagcatgatatc

SEQ ID NO: 40475 - DNA, 201 bp, Bos taurus
ctgagcaggtgcaatgatccgtgtgcccccagggttggcagaaatgtgggcgatgctgcctggtgctggtgggctgctcgaggtcctcggtgtgtgtcccycaccctacttctgtgtctgttcatcagtgtcatcctgtgccttctgtgtccccagccctggcgagagtgccccatgctgggagcatgggctcttgggctc

SEQ ID NO: 40476 - DNA, 201 bp, Bos taurus
aacttttgtgtatttccgatttaactttgacactatctaaaaatccttccttaatggccatctaaatttttaactgtacgtctggccacctctcctaagtrttcttatgtatctcactgatgaaaattttgttgtcactttgttgacaggttactgtattgctgtccaaaaccattttagtggcagcacgggtccatggtg

SEQ ID NO: 40477 - DNA, 201 bp, Bos taurus
ggagtacgtgcgccccgcccgcccctccacccggtttcccggaccccaggctgcccacccagccccggtttccaggcctctggccggtcttgagtccctcrggagagctctggcttccacccagaagcctcttttgcacgcagtgtgtgtgtccccaggcctgtctggctctttgtgatcccatggactatagccttccag

SEQ ID NO: 40478 - DNA, 201 bp, Bos taurus
cggcatggggtgggctcaggctgcagccctcccagagggcctgggttgtgcgggacatcagtggaaaaacacctgggtcccaggaaggccacccctacccmacacgttccacaaaccagctctggaggctggagcatgggcttgagcctggtcctggaacgtggactgtggaagtcaggcccgaggctgctctccctcgct

SEQ ID NO: 40479 - DNA, 201 bp, Bos taurus
ttttgctttggcgttggtgagcgagaactgctagactcccggacaaggctgagtgaagatgaaaagaagcaaagatgggtgctaagatgaattttctgagmcatttcaacttcagaacaaaatcttaagaatatgagaagaaataatccacacacaaaaaatggagcaaagcacttagaattaggaagagaaactgacact

SEQ ID NO: 40480 - DNA, 201 bp, Bos taurus
ttcctgattgtttttttaaaggcaaagtgatttattggaatttgtcttcagtaagctgtgctgtattaagttgaataatagaaagtagaaaaacatggccytggcagttgatttttaaagttcatctttctcattataactagcagatagtaaagttcatgtgacagcatcttactgacatgcacttttttctgccctgaa

SEQ ID NO: 40481 - DNA, 201 bp, Bos taurus
ctctgaggcccagacctagcaggcggccttcaaacagaactgtccttacacgccctaaatttagggttgttagtcttgaaaaacatcctacgcttctcacygctgacggcttcgcgtccaactaaaccaccatcagctcttacttgagcatctcaaacacgacacatcggctcagactctgacaccttcctccccctgctg

SEQ ID NO: 40482 - DNA, 201 bp, Bos taurus
ttaacctgtcatcagacactgaataaaactaggtagatcaaactgattatgactgccagagattactcctgggtgggaatttaaattaaatccacagttayaacatggttgtaggttgtcacactttgctctaatgtattatacatatgaccataaaaaagcctgaatgaggctcagccactcagacatctacactcccat

SEQ ID NO: 40483 - DNA, 201 bp, Bos taurus
caccatcacactttcctcaccattactcttccctgttctctagttcagaacaaaacatgacacaggagagtgaagcaggaggctgttgcaacacaacacarctgtgctttccacacacccagtgtccccacatacaggttgggcaaacaccagtctgaatcatcggaagttccgaaaattcaagattgagcgccaccactt

SEQ ID NO: 40484 - DNA, 201 bp, Bos taurus
ctgccctgccatatgctctactcagatcagcacttcccacaaccctggatggaaactgtcctctttttacagaggagggaataaggcccagaggagagccmctccgtcactaaggagctccatggggttgcagacgtgagactgcctgctctctccagtctcagaggccatttcaccaaggaatccccatttacaggatgc

SEQ ID NO: 40485 - DNA, 201 bp, Bos taurus
agatttagggttttctcctttgtggggacgaattcacatacaggtgaaattcagggcttacatacagactgtgggagatcaaaacgagccttcaaattccygttgctcaggaaaatgaaaaatggctgcccaaacacaagactgagaactactgagtaaaaccagcacgtctttagtaaaattatgaggaaacacacacct

SEQ ID NO: 40486 - DNA, 201 bp, Bos taurus
tgtccctgagccctgagaaagatacatcccaggtaacacagaccaggaaacgaatgtctccagaaactcagtgcagatgaaaactgacccatcccattgcygaattacgccaccccctttacctcctgctgacgacagcaaggctgggggtgagcagcgggtgagttttttaaccacagagcaagtcctacagctgtggcc

SEQ ID NO: 40487 - DNA, 201 bp, Bos taurus
ggctcccttcaggctcctctcagccacctggctgtgatcatccccagaatagccatcaggctgagaactcactcacctggtcccaggggtccagccctgcmcaggtaaggccaggtgcaagagggcagctgaaggatgtgtagggcgagaaccccatctgctgaaacaaggccaggttcacggtgataaagaacccacgtg

SEQ ID NO: 40488 - DNA, 201 bp, Bos taurus
gggttattgttattttacatttcacagtgaggccagaggggtgacccctggaagatgctggctggtcctcccttcatctcgataagcacccttttcagagrtgggaggtttccatggctggtgagggggatctctggggccagccaaaagatgctgatctcccccagcccaaattgcctcccctctctgggcttgtgaaag

SEQ ID NO: 40489 - DNA, 201 bp, Bos taurus
gggttctctttaaagtgatttgctcagctctgggggcttggggaccttctgtagagaggcactgtctcatttttctgtctcatataatcaggtttggttcrgaattcaggaggcagtgtgctctaggtcagtttgagctcctgcagcttgtcctcaggcagtgtgttgtagcacaggctcacaccacacatacgggtcttc

SEQ ID NO: 40490 - DNA, 201 bp, Bos taurus
tgaccattcaggtactctgtgatgttgttgactccagtttggtttactttttcatattgacttcgtttatttaccataaaatgtctcctattatattacayattgtaaagccagtgaaatttagcagtattgttgatggtctggtctaacaatgttatatatgtttacagaatatgcattacatttattcataaatccttt

SEQ ID NO: 40491 - DNA, 201 bp, Bos taurus
cagtgcatgtggaggccttcacgggtccagtcagcccgtggtccagtgtctcctcagcgcctcgctctctgaaggctgcattcctcaaacagcttctaccktgggaaccatgggcaggccgtacttctgagagcgggagagggatgaggaggccctggttgcctgggtgcggctaggaggctcacctcattacccaaccag

SEQ ID NO: 40492 - DNA, 201 bp, Bos taurus
ctcacaaactggaactcgatttgggattctcaggggaaattcagactgcaggccagggtcctcctaatttaaaaaatttaatcaagatggccatcgttccrttgtgtcctctggaacatgacttggagctcagggaataggagggagaccagtttgggcactgggacaggagtctctgctttactggtggcctggacaatg

SEQ ID NO: 40493 - DNA, 201 bp, Bos taurus
gcactgtaatcgactacaaccctctaaccaccaataaaatccaataaatacttgtttaatgcacctgtgcctgaatgcttttggctgcggcccaggcatcrgggacctggctggggagggaccatgcatggctgtcctgtgggtctgggtgtaattgcacgtggccagctccgcaccgtccatggctgacttgctttgtcc

SEQ ID NO: 40494 - DNA, 201 bp, Bos taurus
acaggggccctgtgcttggtttagtgttctgcgctgacatcttgagattcacaataattctgaacagaggcttttgcacgttattttgcattcagtcctgmaaattatgcagctggccttgcttgagccaggaggtgaatggtggccccgtttatgaagatagagggggccggaagagggacatctgggggaggatatgga

SEQ ID NO: 40495 - DNA, 201 bp, Bos taurus
ctcagccttcgtgcagtgaggtgaggctggtggtgacgtcttacggggcaacgtggcagccccgtaagtgggaagtgatgtgtgacggagttcagttcctmaactgtggactgcagctgccctttgacctcaggttcctaagttaggaggtgttcagggtgtcaggaggaacggcctagtcttctgagattctgagaacga

SEQ ID NO: 40496 - DNA, 201 bp, Bos taurus
gggaaaaccatagcttgggtcttgtaagatgaaccagtttcagtgataatattgatggccacatttacaggaatgtgccatgctctgttctcagactttaygcatagtaactcatttagccttgcagtggccctctggggaaggtgctattgttatcctccttttatcagaggcagaaaccaaggcacagagaggctaggt

SEQ ID NO: 40497 - DNA, 201 bp, Bos taurus
acagggatttttattcctctctgtctgcaagttgacagtgactcaagaatgtcaggtttggctcgtggggcagtttagactgcggaagccttccagtcctrgggccatgctggggccatgtgaggcgggccaggttccatcgcagagtgcaggggctgtaagagtgtttaatactcatgtgctatttcctgctatttcgtt

SEQ ID NO: 40498 - DNA, 201 bp, Bos taurus
attgtcttgttgtacctcagctgggaatgtgtcaggcaactcagatttttcttgctatgtgcagtcttgcacaaacatcacccaaagcgcttcatgtattrattctgaagttacaaagaaattttagcaagtaagctaattcacaaatacccacaagtagtgaggattgactctctgtgtgtgttaatgttagaggatgca

SEQ ID NO: 40499 - DNA, 201 bp, Bos taurus
catgtcaagagagtaagggcttccctgatggcccagtgattgagactgtgctcccatggtggcaggtgtgggttcagtccttggtcaaggaactatcctayatgccgtgtggtgtggccaataaataaataaactttaggacttcgctggtggctcagtggtaaagaatccacctgccaatgcagggcacacaggttcgct

SEQ ID NO: 40500 - DNA, 201 bp, Bos taurus
acgtggctgccacaaaccagtccaattcctctcccatgattcagtgtcattccttgtccagattcatggcccagcgtgggcccgtgaaccagtgttctgayctcttccctcaagttttagcttgagtgtttgttttcctgttgctcagtcactgcccacgatcattgttttcagggtgacacgatacatccacagaatgat

SEQ ID NO: 40501 - DNA, 201 bp, Bos taurus
ataagcagttggttactggtcttgaatggtgattggtttgcagatggagtgattaaaatcttttcctcatggcacagtcaaaaaatgattctgtcacagtrgtcaaatagtaggcagttgccatattctacaaggtaaaaacttgaatcttcatggagagaggttgtgtcctcaagaaaagaaggagtgtatatgtggaac

SEQ ID NO: 40502 - DNA, 201 bp, Bos taurus
gcctagtaagatgggggggcagagtgggcaggcagccatagcctaaatggcctgggttttgagttgtgctgaccagggttcaagtactccaaaccaaaatrctcatggataacagcactggccaatagaacgcaaggcatatgtcatgttagtttttctagtagcctcattctcaaaaaaaaaaaaaagcgcaaagaaaca

SEQ ID NO: 40503 - DNA, 201 bp, Bos taurus
ctggcaggctatagtccatagggttgcaaaaagtggacatgactaaagtgacttagcacacacacataatttgtgattatagaccacagtggttaaaaacytgagctcttttaggacagtgaaaattctctgtaagatactatagtgatgggtacatgtatttatacatgtgtccaaacccatccaatatgtaacacctag

SEQ ID NO: 40504 - DNA, 201 bp, Bos taurus
tgaagttatctttggtaggctggggagaggaaaagctgtaaatattttcatactaataatattcccttgctatgtctacataagatatcatccagcatctyagagatgtatgtggttcacaaagatgacccagacaaacacctattagaatatttagatgatttagaatagaattaattggagtagaaatcactgtagaat

SEQ ID NO: 40505 - DNA, 201 bp, Bos taurus
ttctcttccatgagctcccacctggagttaagaattgaacgtcttaaacagattcctattttgttttagtggtcagttcctggccagctctaactgtgagyatctggttccttaaggccaatctgtagatattctcagtgacccctacatctcctgacatcactgtattcatagatggcttctctaggaaaaccattatta

SEQ ID NO: 40506 - DNA, 201 bp, Bos taurus
cagagactccatattgtcctcaagagtcgccaggatcatttctgtccagagacgtttattttcttttgttgtatgagcacaattgtgtggcccctaagctygtcccttctccgtgtcaggatagtcacctcagttccaatcgtcacatggagagatggcaagactggccccaaagcctcctgcccctgaggagcaccagga

SEQ ID NO: 40507 - DNA, 201 bp, Bos taurus
aactggtcatcactgcaggtgttttctggtggtttctggcagagctaagccatagcatttaggaaaggagttgacaacaaggaagacttgccgtttctgaygcccataggggtgagatccgctatcatcccaggggatggttcgatcaggcaaccacttacgtttctgtatcttcatgataatcacatatcttaggaaagc

SEQ ID NO: 40508 - DNA, 201 bp, Bos taurus
gcacaatgccactgccaaaaacacatgtcctcccaagccccattcacttcagtgctataaacagaattcagaagcaaccagatatatgtgcatatctgtgygaaaaggttcagaaaggaggatgttattttcacatttcctgcagaactgagttcaatttgacaggcattttcccccccttcttggaagccattttgtctc

SEQ ID NO: 40509 - DNA, 201 bp, Bos taurus
ttgttcaagttcagcaaaggcgaggaaccagcctgaccgtcctcggtggaatttctggctcttggcttagatcaggctttgcacccaagaggccaagggarcagcttctggcagagtgagctgaaaggagaggatagaaagatgcaggagcaacccgtttcggttggaagatcttcatttctgaaatgcagacattgtgaa

SEQ ID NO: 40510 - DNA, 201 bp, Bos taurus
tcctgtaatctaagaaatgggggcctcacaaaagccttgtgtccaccagccccgcaggggcctgcacgttggatacccaggcaggaggagggccagatttyagccctgtggaaacctggcccaaatctttgtccatttgctctagtagaacagctggggctggacctggggctgggtggaaggagggggagggtgggcttt

SEQ ID NO: 40511 - DNA, 201 bp, Bos taurus
agagtttctgaagaatcatttcgtcactaagatatattgaatatgacagcagtgcttgcaaatcagtcattttggggaaaagactatagtcacatcctaargaggagatggacccctttgttcggaatccatgtttgcagagtaggaaaaagtgttttaggactatctgtggcatggttagtagagctttggagcactcaa

SEQ ID NO: 40512 - DNA, 201 bp, Bos taurus
tctttattttatcaagagtcggctactagcattgctcttctctttcctctgattgcctggggtttgttttgggaagcaatcattaaagacactgctgagaytcagagacacaatttctggatccgcttcactagagaacccagtggggagaggatgtcgggccaggcgaccttggtcactccctacaggcatccctgctgg

SEQ ID NO: 40513 - DNA, 201 bp, Bos taurus
gagacattctctaacatagaaggagggaagactgaactgaattttccagttttgatatcaattcttctagaagagagacactcatcttgaaatcttttttycccctctttgctagattatgtgtgtatcagaattgagattgggcttggctgtttctttcttggcttaaaatgtatctggcttcagtgaacataaactcag

SEQ ID NO: 40514 - DNA, 201 bp, Bos taurus
aataaaaaatagagattaaagacaattttaaagtagacagtaaccaacatgtgaatatgttctattgaccttgggtgtaaacaattgtatgcattcaggartggatagagctctagggtacccactcgggggtctggaggtcaatagaaatggggagattggttctcagaaaatgaaaggagagactccttgagccatgtt

SEQ ID NO: 40515 - DNA, 201 bp, Bos taurus
caatgccttctccagattacagttttggagagaagctggtgaggtagcatcttcagaaagctgcttggaaatgacctttctctttgcactcctgccctggrgaagacagtgttgagaaaaagtacctctctcctccaatgaaaccgaactcataggtgcttggtcttctcatctgtgtgtgtcctaatccatgcctcccct

SEQ ID NO: 40516 - DNA, 201 bp, Bos taurus
ttctttatcatcttcctgttcgttttccagcacttcttccacctcacaggtttccttctttctggacagttctccctttcctgtggagccttcctctgccktttttaatgaaggtctattttcccacgtttctttttttatttatatattttttcaacctgacactgaaagcacagcctgccttttcctaagcaaggcaga

SEQ ID NO: 40517 - DNA, 201 bp, Bos taurus
gaggggaggagggggagaccagtttccagtggccaaactttcctaattaccttcacagcagctctcgggtccctgggcgactctcctgaaaaagagaaatygcctctggatgcgggccccaagcagggagcaggcctgcgattggcccaagataattgggctgttgtctgggtctcggggaaaggtctgtttgggaacatt

SEQ ID NO: 40518 - DNA, 201 bp, Bos taurus
gcaaggccgagtggcagagaggcggggacaccgagcgcttgtgcaacaacagaaacgcgctcctcacgctggaagtcaggattctcagaaaactagcaagraaggcaggccaagcaccatcgccaccagccaccaaaagcggagtccagtgactgagcagctctccctgtgcccgggagagacaggagagtgccgaggacg

SEQ ID NO: 40519 - DNA, 201 bp, Bos taurus
caacccatgtcccctgcattaacaggtggatttataaccactggaccaccagtaactccctgctcttggcttttgtgtggggccagttctgtggctcccayttctttggcgctcccattgcacgctcctttatccccgctgcttcctcatggttccttggtaagaactcagttttagagccaaatgggccaaggttaagtc

SEQ ID NO: 40520 - DNA, 201 bp, Bos taurus
ttcaggtaaaaaggacttgaaacacccagacacacgtggggccttccttgggtaatggagccaccatgatcctattatctctctccaaagctctcccaggrgagcaggggcttttctaggccaagcagtaaagtctgcccccatctagacctgaaaatcagcagatacagaaggctttttctggtgaatcctagaaatcca

SEQ ID NO: 40521 - DNA, 201 bp, Bos taurus
tatcgacaggcaggaggtgatgggggagtctggccacacgcctgggacccagcatctgatgggcgtgccaaatggtcctttgtttcaaggccccgctgcaygttctttctgattcccacctggacagcaaaggctgacccctctgcacatccctcctcccaccatcactcagcatgcccctttcgggccccacagatcagt

SEQ ID NO: 40522 - DNA, 201 bp, Bos taurus
atataaagtatatcataataaagctgacgaaagaaaaaaaaaatcaaagaagaaaaaaacaaaaacacaaacaaagatcctgaggccagaaaaagctgatygtggtctggaaactgtcgaggtctgttgtgattggcgaacagtaagtgagaaggagagaggcccaagatatttgatctaatttggttttcagagtagcca

SEQ ID NO: 40523 - DNA, 201 bp, Bos taurus
caaggccatcgctatacataatcacagcatgataacccccccaaattttacattatatagtacttttatctcatctacagtccatattcaaatttatccartaatctcagtaatggccttagctatgtttttagtccaggccaaatccaagataatgtgttacattttgttgtcatatctctttatggttcctcagccttt

SEQ ID NO: 40524 - DNA, 201 bp, Bos taurus
gatttgtggactccaggcaactcccacgtgtgcaaccacaggaagacagtctccttctggtccaggcatctacagcacccttcagtcaggtgaggtgggcrtgaccatccccgctgcttttgatctgttcacggtgacaaaatgagatcagaggctataattattcacggtgacgactttaaatgagagatgtgtgcatgc

SEQ ID NO: 40525 - DNA, 201 bp, Bos taurus
attttggagttagagccaggacaagctcatggtctggatgtgggggctgagtgagagggacatgagggcagctttatgcggccattcactaagatggggarctttgttttgggtgggagggggcaccacaggaggagtctgggtgctgcccagggccctgcctcctgccgctgtgtgaccagtggtagcaaatccagaacc

SEQ ID NO: 40526 - DNA, 201 bp, Bos taurus
ctacccagccttgctagatgaaagaagaggggagggttatattgggacaggtgcccttcttcccgtgtcctggttagatgtccacccaggtggtggcccartgttcaggcttctgatttggaagtcatcagactgtcccctgcagggtcagctggacaggagctctggccaggacctcaccccgtaccccatccagcctgg

SEQ ID NO: 40527 - DNA, 201 bp, Bos taurus
tctctgaacagctcagattggcctcttcccttgcacctgggactactggaagcatgaataaacatttgtggaatgaatgcttgactcccaaattttctttmtgatgggcctgtggtgccatctctgctggcagcatggcgcccaccaggggaggggaaccttgggtgagggaggaagtccaggttgctgctggtagcccag

SEQ ID NO: 40528 - DNA, 201 bp, Bos taurus
gtcaggtaatctgctcacctgaagtttggccacaccccatccctcctctgggctggggagccaaactcaccccagcacccgctcctcctggtccccactcycttcctgtctgcagaggccagcagttggtcaacaaaggattcgctgttcctggaacgtgcctggctgtgtttggagcttccctgcctgtccctggctctc

SEQ ID NO: 40529 - DNA, 201 bp, Bos taurus
ggtgacccacctgacttcatggcgccccagaaggttcccagactgaagagccatactagttattactattcgaggcctgggatgcatttagcttgggagartaagaactcctcattcgtatcccgagccccagaggtcaaagatgttttattagttgtgtgacctcgggcaagtcatttggcctctctgagcctcccttgc

SEQ ID NO: 40530 - DNA, 201 bp, Bos taurus
tggcagaactcaaataaggtctgcggtttacagaccttcacactggaccaatgttaatttcttagttttgacaaaagcaccaccacaaatggttaaatcaygttaacactggggggagctaggtgaaggtagagcgttaggaaactccggatccatccatccgcgcaacatttctgcagctataaaactggttcaaatttg

SEQ ID NO: 40531 - DNA, 201 bp, Bos taurus
ctttgtaaattaaatagaggattaccatattccatgatgtaacctgctagtcccacctaacagggttatttttgtgcttcattgtacaccttccggtgagrtggttttattttgaatggccgaatttgctcaggttttcccgaagtactttattgactgctgctgccagttactgtttggtaaacataggaaaaggaaaaa

SEQ ID NO: 40532 - DNA, 201 bp, Bos taurus
tttagaaataaattctaagtctgggcagtcccagatttgtggtgtctggtgagagctcccttcccggctcacagccggctgccttctccctgtggtctccygtggcacttgagctctcaagttctctggtggaactctgctcaacgtcatgtggcagtctggatgggaggggagtttgggggagaatggatacgtgtacac

SEQ ID NO: 40533 - DNA, 201 bp, Bos taurus
cgggtgaagcccagagcatatcccttcctctctgcccttttaatttttatttattttttagtagcaagcaaggcagtcattgtgcgggactgctgggggcrggaggcccgtggtcatgcggaaatccacggtgaggatgtctcaccacagtcagtacctgtgttgtctggcacattaattgaaaggaagtcaccctttgtg

SEQ ID NO: 40534 - DNA, 201 bp, Bos taurus
gcacggccacgttggcatggacaggcacgaactttcagggagccatgtgaaggaattgtctgactaacggatgctgagaacgacggttcagagcattcccyctctctcttttccatttgcagcacgttttatgaagactgggcttttgtcatggatgaagaaaggtctagcatgcttcccaccatggcagctggtaagctt

SEQ ID NO: 40535 - DNA, 201 bp, Bos taurus
attttcaagtgatgtcatctactactcagagaaattggggctcactcctcaaccccagccagctgttgactcagtttgttgaaaactatggcatatgtgcyctggccagattggggtgccttgggggtgcccttgtcaagctgtggtatcttgggggtgtcctagacaggctgcggtgggggacttggtgtttctggggag

SEQ ID NO: 40536 - DNA, 201 bp, Bos taurus
aggtgctgagaatgccgagtggtcgtggctgggccgccgagtccttcagccccgtctttggggcggaggcagggtggctcactggctggtgtggggccctygctctttctgtcccccgctcccttgcccttctaacaagcccgaattatgctgggagccctgaggagcaagatcggcccagtcctagggcagaaaccttgg

SEQ ID NO: 40537 - DNA, 201 bp, Bos taurus
ggtaaactctgcctcctttggcctgggggcaggcctgtgagctgagccatggcagttggggctttagctcctgaattgaccaagaatggcaagaatgcttragaggccatttattcaacagccaggtcctgatgactttctgtttgctcctatgggtactggccagagctattctggcttcatttccttctctgggtcaag

SEQ ID NO: 40538 - DNA, 201 bp, Bos taurus
tcattgaagtcaaatttctactctggaggcgttgtcagtggtgggaggttcggtagagtcacttatagtgcacagtgtgccctgctcatggatggtcagartttcaacacaacagcctgtgaaagggtacaaatctgtccttggtcagtagcccatttgtcttccctctgggtttgtatgagtgagtaccaagtcacatgt

SEQ ID NO: 40539 - DNA, 201 bp, Bos taurus
tgctgtataataggctctaggtttgtccacctcattagaaccgagtcaaatgtgagcttttatcgagttgtagcgaatgagggccgcttcactgcagtgckcggacttcacgctgtggtcgcttcccttgtggagcacagggtctgggacactcgggcttcagcggttgcagctcctgggctctggagtagttgcagctcg

SEQ ID NO: 40540 - DNA, 201 bp, Bos taurus
caagggcccatgtgtaagaagccctgccactcacaggagggtggcaagggtcgcgagctgggtgatctaatgcccagaaaagacccgatgtatagttggcrttcacaggtgtgttaagggacttccctggtggtccagagattaagactttacctttcaatgcaggagaggcaagttccatccctggtggggagctaggat

SEQ ID NO: 40541 - DNA, 201 bp, Bos taurus
tcccacactggtcacggcggcgttcgagccgcacttgccctgtgcttgaccagagtttccaaagctttcctggatatgatccagcccattgtgcagaggaygaggcccagatcacatggagccgcgggcctggcaggcctcgcatcacccagagcagctccatcccatgctgcgggctctctgaaaatcccctctggtctt

SEQ ID NO: 40542 - DNA, 201 bp, Bos taurus
ggagccgctgccatgtggggagggtgctgctaggccagggcccaggctggtctctgggcttcaggtctgcctcgcttgtggagcagcctctaggatcggaygagaaaggggcctttgactccaagagggcctcactagaccccagagctttatatcgagacacagcttctgtcaaggttaatttcctgaaaggtaaagccg

SEQ ID NO: 40543 - DNA, 201 bp, Bos taurus
gggtgtgggtgtcctcgggaaccttagggccttaggtggacccttttggagctggtgccactcatcttttggaggttgtgtgtccccctctctaaagaagrgaggtgactctggcctgcagggttgctgcagggagtaaaggagtgaacgggcgaatgccactgagctggcccacagggggcgctacagcagtggggacgg

SEQ ID NO: 40544 - DNA, 201 bp, Bos taurus
aaggaacacttgcctgcctggaccattgagccatgtattaatatggaacacttgccttcccggaccattaaggcgtgtattaatatgcagacacacatctycaggggggctgagttacatgcacctggttgctctaagccttagacccgttaaatgattcactgtagaatctacagtcctggacagtattcaaggacgtat

SEQ ID NO: 40545 - DNA, 201 bp, Bos taurus
ctgttttcagcagcctcactctttccaggctcttcccccatcccttcccaaccaagttccttttttgtacaagcaggtgcggctaaataattaatagggtrggaaaacttgttggaaatagtacagctcatgtttatttttaagcagctgagttatagagccctgctgcaggtgcagtgcaggtggggaaagcgtctttgg

SEQ ID NO: 40546 - DNA, 201 bp, Bos taurus
tgtgagaataggctgcctcataggggtgagctggtacccccactgctggggtgggtggtccaggcagttctggtggggcatgcaccaaactccagcctgtrgaattatgacaactgcctggtaacacaggagcatcttggtgtgttgtgcagtcccagccacgctggctgccatcgatcacagctgagaaataaagctcta

SEQ ID NO: 40547 - DNA, 201 bp, Bos taurus
aagctgagaaaaagacatcagaagaataaaaaggcaaggaaaagtgaattggtggtgactaagcaatctgtatgtcaaaactgccataaattgaacagtgygatgctagcataagaattcgtcctttcatcagtggaactgaaatcaataaccttaaaatgggctccattataattttgtaaaactcagggacaaggcaag

SEQ ID NO: 40548 - DNA, 201 bp, Bos taurus
cctgaactggcaatggaccctccaagggcatggcccaaagtcaccagcaatgctaacagggacctgggacccagggaaggcagtgacggcgggagaggccrcctgggggtggactaggtgctcaacatgcagtgaactgaacccacaagactaggagttttaagcctggccctccaaaaccagggttttccccagtggctc

SEQ ID NO: 40549 - DNA, 201 bp, Bos taurus
tgtgtttgaccagcagactaggagagatctagatgggatgctttacctggatgggcttggggagtcttggaggggcaaacataatttctgcctagcttctmttggccagaactgttgtatgcatacatgctaagttgcttcagtcacatctgactctctgtgaccctgtggactgtggccctccaggtttctctgtccatg

SEQ ID NO: 40550 - DNA, 201 bp, Bos taurus
gaggtgcgttagcacagcctgctgctgtctccaggcagtctctttagccaatccctgcctcctgaacctgcctccatcctagctcccctgagctatggctratagaaaatgttcatgcctctgcaagtttccagccaggggtttggagctgggcagcaacctggttctcctgccccagaagctccagtctttctatctctg

SEQ ID NO: 40551 - DNA, 201 bp, Bos taurus
aatttgcagttcctgccaacctaatacttgaaatattgagatcaagcatgatctccacctctccatctttcctataaattaattcattcaccctttgctamttgagtgcttgttgatatctatagtaggtctgggacaagtaacaaaaatgatgaataagatgtgatccaagtctacttggaatggcacaccactatcttt

SEQ ID NO: 40552 - DNA, 201 bp, Bos taurus
cataaagacagtaaacaaaggatcagaggagtggcccaagcaccacaaggaaatgttctgtttctgcaggatgacttgctcaagaaggatgtgttcgattyactgggagcagatatggatcaaactcttgctgagaagtgagagggatctgagcgctgtgcttctgtgccctgctcttgactcttaaaataggctcactcg

SEQ ID NO: 40553 - DNA, 201 bp, Bos taurus
cagagcctccatgagaacattctgtgggcaaacaccatggccagtgtgcttggagccccatgtcctcactcagtcccaggtgattcactcctgggattggrgctgggagctgggccaggttcctaaataggcaagggtaatggtgctcttggacagccttcaggtcactttgaaaagtaatcctttttccttaagaatctg

SEQ ID NO: 40554 - DNA, 201 bp, Bos taurus
atttaaaaggtttatgaggaaattgttggtgacaagagggctgttcaacgtcttgattataggggtttctacacaagtgacaaaattcagagaactgtacrttcagttcagctcagttgctcaatcgtttctgactctttgcaaccccatggactgcagcacaccaggcctccctgtacatcaccaactcctggaccttgc

SEQ ID NO: 40555 - DNA, 201 bp, Bos taurus
tgccaaacagggcacacgggttcgatccctggttcggaaagattgcacatgccgaggagtaattaagccacagcttagtccaccacagttactgagccctygggccaaaactcgagagtaatccccacttgctgcaactagagaatgcctgcacacagcaacaaagactaagcacagccaaaactaaacaaataaatattt

SEQ ID NO: 40556 - DNA, 201 bp, Bos taurus
catctacagtggagtcacctctccctaaactcagtgggaactgtgcttccaaacagaaaagtacccaagatctcttttgccaaaagtcctcggaatgtctmcaatcctgctacttggtgaggttccattagaatagtggtccctaacccttctggagccagggaccagtttcatggaagacaatttttccatggaaatggg

SEQ ID NO: 40557 - DNA, 201 bp, Bos taurus
agtgagaatactgggcatcagtgtcatcaaccttctagttccaaccagtctggggtctacatgcttgtgggcagcacacagttaacttctcccacctggaygggggttttcagtctctgaaaaacagcttgttttgtgtatcccttgagggggaaccaggaccttgccccaaggcttgtgcgtatctcagcatcccctctc

SEQ ID NO: 40558 - DNA, 201 bp, Bos taurus
gggcctggagatgggatgtgtcccacaggaaagacacaaagaattgccctgctccaaatgctagtagcccccagttgagaaacctgtacattaagaaacakccaggggccatatgagcctgcaatcccactctggccatatatcctgacaaaactgtaattcaaaaaagatacatgcatatattcataggagccctattta

SEQ ID NO: 40559 - DNA, 201 bp, Bos taurus
gcaaacagcgagacatgaaattctcatagtgtcacaactgggaatgaaataattggatgctgaatagccaagatgtgaaactgtgggattcttgctttccytttctataactagaggtaatagaaatgaataattttatgtaaaattgttttgtcattgactttataattaacatatttaggttcttcaatatttgaaata

SEQ ID NO: 40560 - DNA, 201 bp, Bos taurus
ggacatctggaccttcctgtctggctaatcctccagccaagggaacccaatcaaaaccaacagaggaatccaaccaagccaatcacaggatcatgaaaagyaatacattgttgttctaagccattatgttctagggcgtgtttgtcatgcagccaaggctcactgagacatgttgtaagaagccaagctgagattcgaacc

SEQ ID NO: 40561 - DNA, 201 bp, Bos taurus
acaaggaaaagaaaaagtccttaacaaaaggtctggcctggccccaggatgtcggaaaagtggcttgaggtcgtcaaaggaaccctgaggtcaggtctgcygtttagaagccaggtggccttgggaacatcccacagctctccccatctgggtctcctcacctggagaagagagtcctgctccccagcctcccttacagtg

SEQ ID NO: 40562 - DNA, 201 bp, Bos taurus
atcaatttttgttttttaaaatttctctgtagtattcatggtgtgctccaacctctgactttcaaaacaaatgaaaagctaattttcctcaagctatttcyataacaattataggcagagggataatgccttataatgtatttaaggagtttccctcgtagctcacactataaagaatctgcctgcactgcaggagaaacg

SEQ ID NO: 40563 - DNA, 201 bp, Bos taurus
ttacatgtgtcccagctctttttctcccaccatggattttcagacagttgtaccctgtcagttaggtatttcttggggagaacatgcatagctttggggtratagatatcttgtgatgattatcttctagctatcgtttcctatccgttgtgccaacagacctcacccatgaacattttagaaaatgtcagctgtgcagtt

SEQ ID NO: 40564 - DNA, 201 bp, Bos taurus
aaaggaagaaaaatattaggattaaagcaaacttaaaatacctttccccaatcacctactacagttatttgttaaatcttaagaagtcagccccaacttgraaggccaaacttggaaattcatttgaccttttggaaaggcactttggcaatatttcagtttagttcagtcgctcagtcatgtccgactcttggcaacccc

SEQ ID NO: 40565 - DNA, 201 bp, Bos taurus
ccctggttgtcccctggttaggaccccacgctttcactgccaagggcatggattcagtccctgatcagggagctaggaacctgcaagcctgtgccgcagtyaaaaaagaaaatccctcaaaataatcactgtaacattttgaatggagtcttcctgtcttttatcgaagcatctgtactttgcaaaattgggtcctaacgt

SEQ ID NO: 40566 - DNA, 201 bp, Bos taurus
aacagtacttggttggctttgattggcccttgggtttgcaaccacagtcctagatgtcccatagtggctcttctcagacagagggcttctgctgggagacrcactctggccaaattgatgtctcagtttttcaaataaaacacactctatctgaccccagtgccttggcatatgctgtaaactcttcccctcttttcttca

SEQ ID NO: 40567 - DNA, 201 bp, Bos taurus
gataattctttgccggtgggatggatggcgggcgaaagtgtgggggaggggggcaggtggagcgtgcagggagagggcctgccccttgccttgtaaggccrttagcagcctctccggtctcgacgcgacaaccgaaaatgtctgcaggtatcgctagatgtctcagtgggaggactgtcccagccaacctggaatgccagc

SEQ ID NO: 40568 - DNA, 201 bp, Bos taurus
aacaacctggtctgggcaagggcccgtggaaggagctgtggagacaagaaggcagctggcaggtggagatgatcagatcaagctgctggtagttttgcccrgggtggccctgtcaggtagcttgacaattacgcgcatcctcccctacccccattaaagttaattgagttgttatggagccacagtgagggagtgggagtg

SEQ ID NO: 40569 - DNA, 201 bp, Bos taurus
gttttgccccctgggggacatttggcaatatctggggacatttttggttgtcagaactgggagtggtactactggcatctattgggtagatgctaggaacyccgctaaacagcctacaatgcaccggacagcccctaatcaaaaattacctggcgccagctgtcagtagcgccaaggttgagaaactgggctatgagttac

SEQ ID NO: 40570 - DNA, 201 bp, Bos taurus
aggagctggccggagagacgggagccacaggcctccatccaggggattggagcagctcacgtggtgcaccccggggagtggggaagatttcctgcgaaagraggtggactgttggccggcacttatagagtggatagagtttagagaagctggtggggggtcattccaggcgggggaccagtgagaacactggtccagtgg

SEQ ID NO: 40571 - DNA, 201 bp, Bos taurus
caactaaatggtttggaatgaaaaaaagattgagaacccaggaggaaatgtttcttcccatgcatgaaagctgaatggcctgggttatagagagttatctrtggtcagatctcacttggaaggcgaatgagatccctaagggtagggcacccttaaaagatatttcaacatatccattaagggaggcctataaattctagg

SEQ ID NO: 40572 - DNA, 201 bp, Bos taurus
ttcttactattgtggaaaatagagcccactggcccaaacccaaagcatggacttggagacacgaggtgcagcgggaagcgaggctttaatgatggtcttayaggatggcctctggtgggcaggcacagccatggcagttacaacaagcattttatattttggcatgcaaggtccctccgccggttcctcattggttgagta

SEQ ID NO: 40573 - DNA, 201 bp, Bos taurus
ggggaggtgacagttgtgcgcagtagccaggcagcagccatacagctagaagccatgctttctggcagaaaagcgcatccagggcctcaggcaggtgtatycaaagcgtagttccaagaactgtagttctgtgcactttgtaaaggattacaaaacctccggaggcccacgcagcatgaagtgttctgtataacggtttag

SEQ ID NO: 40574 - DNA, 201 bp, Bos taurus
gaaggctccctggaggagctgttgcccacaccattgccctaaggtaagtgagggtggccaggagagtcagggatcaggggcatacaggccattcccaacayagagaacagagatgaagtgatggcttctatcaggaaatcacaagacatatgatattaatggtgatcagcaagagaagcagagaatggcgagagatgggcc

SEQ ID NO: 40575 - DNA, 201 bp, Bos taurus
ataagcctcattaaggcccaaaacaatagttgttacatagtggtaggaagctggtctggaaaagttaggaaatacttcctggaagaggtggcatgataaayagccttcaaagatggccaccaccaattctttccctgcttgtttttacacgctgctctaagcaccaagacggaacccatttctactcccagtgaaatctag

SEQ ID NO: 40576 - DNA, 201 bp, Bos taurus
gatactcccgacaacatggattaatctcaagctaatcatgagtgtgagagaaactgcacaaaaaagtgtacatgctctatggttccatttatataaatctytagataatataaactaatctatgacgacagacagcaaattagcagttgcacttcagtggagggtggtggctggggtggggagaagccaaggggagattag

SEQ ID NO: 40577 - DNA, 201 bp, Bos taurus
tgccatctgcatgctgagagccaagagatcattatcctccattggatctttgtgccaggaaagactgggcaaggatgatggatggctttccacaaatccayctgcaattggaggcataactcaaagctgtgtctggatttcttcttaggtacaaatttattcattcatccatcgtctcgcctattcactcactcacttatt

SEQ ID NO: 40578 - DNA, 201 bp, Bos taurus
ggagttaaaaaattttgtccacacaaaaacctacacacagatatttacagaagctttattcataattgccaaaacctgaaagcaaccaaaatgtccttccrtatatgaatggacaaagaaactggggtccatccagatactggaatattgttgttgttttagtcacaagtcatgtctgactcttttgcgaccctatggact

SEQ ID NO: 40579 - DNA, 201 bp, Bos taurus
ctgccatggcccacttcggagggcttcaaagactgggagagagagggaaatattgagacccgttttccatttcagagatttacgagggagcaaatgaaatycgcttctgctctcagacctggccccctgggaaaggaaacactgtccgaatcaagtaaataaggtcctttgtgtcagcaaaggctgtggtggatgaaatta

SEQ ID NO: 40580 - DNA, 201 bp, Bos taurus
atactaaattaatgacaataattatatagaaaaatggacaaaagacttaagtcttttggttcttcaccccaagaaaaaaaaaatatctaaatggccaatgrtagatggaaagatcagagaaggcaatggcaccccactccagtactcttgcctggaaaatcccatggatggaggggcctggtaggctccagtccatggggt

SEQ ID NO: 40581 - DNA, 201 bp, Bos taurus
taaaccagtcatgaaagaccacgtattgtattatttcaatttgatgtaatgtccagactaggcgaatctatagaaacagaaagtagataaagtggttgccyagggctgggaggttgatgagaaatgaggagtgactgctaatgggtatgaggattctttttagacatgaaactgttctaaaattgattgttgtgatggttg

SEQ ID NO: 40582 - DNA, 201 bp, Bos taurus
tacacctgagaagtaggctaagcaaattaatgagatacactgaaaactgcaacacctgtagctggcactggtcagcagaaagggccaaattcttctccatracaacacccaaccacacatcccacgagcaaggcttcaaaagttgaacaaattgtgctacaaagtttggcctcatctgccatatccacctggcctcctgcc

SEQ ID NO: 40583 - DNA, 201 bp, Bos taurus
aagaaaaacacaaatatctccataaaaatttaagaggttatactctacattaaaaaaattaacaagctggagtatttcatacaggagttaaatcacaaaaygtctgcagtcttcactgttagacctctatacaagagagagtatgttttactttgtagtccccaacataaaatggattttaagaaaactttaagacaacca

SEQ ID NO: 40584 - DNA, 201 bp, Bos taurus
agagagtctttgtacccggaagccctactgggccctgcttggtatctgatgctgcagagcaaacaagattctcagctctgagacaaaaggcctcatcactygctgcaatagcagtggttggtgtacagtattcatgctggttccccaagccccagttccccaagggtgatgcaaaagggggacaggggccggcagacacaa

SEQ ID NO: 40585 - DNA, 201 bp, Bos taurus
taggacatgactgagtgactttcattttcactttacatattcatcataacacacaaaaaagaggtccaggatcaaatagattagggaaacagcaggttaakgagactttaacaaggttttttattgcaggacttctcagagcctttagcacattaacgtgcactcatctatccaaccagcatatagtcagtgtctaccgtg

SEQ ID NO: 40586 - DNA, 201 bp, Bos taurus
caaccggcacattacactttctggaatttctctctacagaatcatcaacatatgtgcctctgtggtgccagtcaccacggccatgcagctgaggaagtccyaactggcaaaaccaaagcaggatgagaggctcaaggctttgaaggagtgtggagagtaccacttctctactaagcacctactctgtatatagcccaggac

SEQ ID NO: 40587 - DNA, 201 bp, Bos taurus
gcttgctcactgggtccaggtggtgattactgggcccctccattgtaaagttgtgctgctttgcaattcctttccacctctaagagccttgtgataagacrtctaggttctcactggccttgtttgcctctttcctggcaaacaaatggtctaaactgaccagtgcaggcttcttatatacggaaaaaggaaactctgccg

SEQ ID NO: 40588 - DNA, 201 bp, Bos taurus
ttggccacatccaagacagctggggaacttattaaaagtaccaattaccatggacagctctttcttacagaagaattcaattactaaatgtagaaagaatmagggaaatagaaggccattataaaccaaatatcacagtaataattgttgcaagcaagatccacgggtggatgctaaaatgagtgggtgaaagtttaggaa

SEQ ID NO: 40589 - DNA, 201 bp, Bos taurus
gtatatccattggaagtatattacattcattgtatgaataatctatttttgtttcttgtaatgctggatgcgtgggttgtgttaaaaattcttttgaagtmttttagtagagaggggatcatttaacttgctcatatcttagcttctgcctattctaatttttaatatataatatgggttgaagcctagactaaatgaggc

SEQ ID NO: 40590 - DNA, 201 bp, Bos taurus
ttagatgaggactggtgctatggagggaaaaaaaaacccaaatcagagcagtgggtggcggtgggctgcacttttaaatagggtggttggaggaggcctcrctgagaagttgatgtgtgagcaattacttgaagtacatgagagatgaaccacatgctggcaacgtggggccagttaggaccaaggaatagccagtgcaaa

SEQ ID NO: 40591 - DNA, 201 bp, Bos taurus
tgagagtctcactccctaggtaagattggccctggaatcagcatgtttgaaagcttccttgagtcaagtataggtggtcctaggaccacactttaagaaaygtccctctggtctcaggccatgaaccattcagctcccacaggtatgggcttactttggggtgatgaaaatgttctaaaattgtgatgatgattgtgaata

SEQ ID NO: 40592 - DNA, 201 bp, Bos taurus
aatcttagttcccctggccagggattgaacccagagctctggcactggaagctcagagtcctcaccactgaaccaccagggaattccctcaattgactctmaattggggagattattgtaggtgggcctggcttaatcaggtgagtccttaaaagaagtcagattcaagcagaagagacttctgcttgctttgaatacgca

SEQ ID NO: 40593 - DNA, 201 bp, Bos taurus
cgtggaccctcgggaaacaggccctgagtgatggctgagcgataccgtgctctttcccaaacttgtcacatccagaaggatcactcaaagcacagtggtgkgagcagtcctgattcccaggcctcactctccgagattctaattgtcaaggtctgggaccctttgcactgaggccacacgtgggcaactctgaatgagcat

SEQ ID NO: 40594 - DNA, 201 bp, Bos taurus
caatgggagcagaggttggaatgtgcaggctgctctctggatggggccacaagccaaggagtgtgggcagcctctagaagctggaaaagtcaaggcaacakattgtcccctagaagctccacaaagaaccagctctaccaacatgttgacttttaacctgtttaagactcctgatctccagaactgtgagatgataaataa

SEQ ID NO: 40595 - DNA, 201 bp, Bos taurus
ctcctgcattgcaggtggattctttaatatctgagctaccagcggaacctgataaatatccagcaactatttattgagggcctactgtgtgctatgtaccytgctttacatgttgatcttgttttttagcctcacaaaatcctgccaagtaggcatcagtttgtaccattttatgttgagaaaattaaggcctagttgtat

SEQ ID NO: 40596 - DNA, 201 bp, Bos taurus
aatactcactgagtgcacggatcctgtcagacaaaggggtctctggtcatcagagagacaggcttctgtccccacgaagtggccatttcttattgtgaagratggaggaggtgccaggagtggctgagggagtccaatgcgggggtcctgcactaatccaggcctagtactcttcttcccccaccttccagctgtccctaa

SEQ ID NO: 40597 - DNA, 201 bp, Bos taurus
tgttgaggacacaaaggtggtcagacaggcccaacttgctccagagagatctagcacagctttggttcacagaagtaaggatgtgagaaagccactcacaytggccagctagaacccccagttctttgaagcatgtccacagagcctcaagaaggattggggaggtatatagtcttactagaatgaactttgatcaggcaa

SEQ ID NO: 40598 - DNA, 201 bp, Bos taurus
gatctcttccataccacattattatacagtaccacttttcattgcctgtcacaattttttcattacattgaagagaattgctggggaatatggtcaaggargtcaattttttgcttaatttatgtggaacccaaatatcaaagtgattatcacaagcaagctaggacaaatgattttcaatgctttatttggatatttgca

SEQ ID NO: 40599 - DNA, 201 bp, Bos taurus
attagttttgagtttgtgatttttgtttcatactttggagtgcatactgtttctttaaggttcaaatgtttctgaggccagtaaaaagctcaggcattctrcatgagtaaaacaactctgcagatgcagccccttggtccagtcaagggagagtctggccacccagtgttcatggagccactctgcttaccattgatgtga

SEQ ID NO: 40600 - DNA, 201 bp, Bos taurus
tggctggattctgcaccctgtggagccctgggcctgttactggttcactgataagtggagttggggtccagaagatcctgaggctgttgccgccacactgktgggtgaggccaggccctagagctagtgatggttcattagtaggcagagttagatcctatggtttggctgtaggacccagggatcccagagttactattg

SEQ ID NO: 40601 - DNA, 201 bp, Bos taurus
tcagggccagatgacttcacaggtgaatttttccaaatatttagaaaagaattaatatcaagttttctcaatctcttctaaaatattgtaaaagacagaayactttcaaatgcattcagtaaggccagcattaccctgacacaaaagccaaagacattataagaaaactgcagaccaatatccctagtaaatgtcaatgca

SEQ ID NO: 40602 - DNA, 201 bp, Bos taurus
ctggagtcccaaactctctgaatatggaggaagtcattttcttctttcttttcattaagaaaatgttttccagaggcctcacactgaacccattccagttkaagttggacctagtctgactctgaattggagaaggaagtggcaacccactccagtgtttttgcctggagaaacccagggacggcggggcctggtgggctg

SEQ ID NO: 40603 - DNA, 201 bp, Bos taurus
tttaattttatctacatattacacttagaaatacttcaagtttgcctttaatttttttaaaagtgtgtttcttctcagccagaacaatatacggtgagacytagatctgggaatagaaaagtttcaattccttctgttagaatgataagcccagcgagagcaggaacctcatctctcttgttcacttatttccctggagcc

SEQ ID NO: 40604 - DNA, 201 bp, Bos taurus
cgggctctgcagatgctgggcctggtggggtcagggggctggctctgggacctgccacagctgtaatgtctgattaccttgggcccagacctcctacctcygtgtctttctcctctgtttcaggctgatgtccgcaatgcagaggctctgcaccgtaccttcgaaggggtggactgtgttttccacgtggcctcctacgga

SEQ ID NO: 40605 - DNA, 201 bp, Bos taurus
caggcctccattgatggtcactgtgggctcttccctttttttgctgttactaattatgctgtggagaacacttcttcagaccactcatccgttccagggaygtgtgccgagggcctgctctgtgccaggcactatttaaggcaccagggctacagatgataaagaagtaaataagaggatttcagcttggggaaatctctg

SEQ ID NO: 40606 - DNA, 201 bp, Bos taurus
aggcctgggcccagatggaggaataacttgctggaaaaaaccactgccagccagccccaagttacagggctaggagaagggggaagaaaaagacttcttaytgagggttgtttgggggctggagcgggcagatgtttttagtaaatcaacttttgtatgctattttttaactcttgaaaatgtctttgctaccactggaga

SEQ ID NO: 40607 - DNA, 201 bp, Bos taurus
agaatcaggggttggggagaggtgactgctggggccacagtaccacatctgtgtgaaagcttgaatacagacattttttaaggaaaaaaaaaatcttacaraagacattagtggagtgttatttatagatttggagaatctcaaagatctttggatttttttcagaatgtcaatgatctcttttaattgtttaatcatctt

SEQ ID NO: 40608 - DNA, 201 bp, Bos taurus
ctcctccgtccatgggattttctaggccattgccttctccgggtgactctctagttcttacaaattttccttcctaaagaacacgttatgctgcagggcarctgggcctatgagtcacaactactgagcctgtgctctcgtgcccaagagttgcaaatactgaagcccacgtgcctagagtctgctccacaagagaagcca

SEQ ID NO: 40609 - DNA, 201 bp, Bos taurus
aagaggagaaagcagagaaatctcaaggacacaaggattcctctattgaaaacacaaaggcatttatgatgcagaacttcagaatgggaaccctgggccayagaggctgcctgcgcttctcagttaaagctgatgatggagcagccaaacacaactcactgaggacaactctatcgaatgtcacaagtagatgcctgaggg

SEQ ID NO: 40610 - DNA, 201 bp, Bos taurus
gccttgtgctcccgccgactgtgactgtcgctcgagtcctggtggctgctggacaggttcctcaagctaccgaagcaggagatggagaccttgtcatccayggcctccccgatcttctccagggtggatgcagaggtgtgaattggagagtcccctgagtagcgggaaggggaactggagcgcatctgcagcttggcagac

SEQ ID NO: 40611 - DNA, 201 bp, Bos taurus
tttaagtcaaaatccaagagaaaagtgcttgggccaagcttgggtgagaaggaggacagtgatactccacagaaaaaacccaagaggagcaagaaagaaaygctcagtgtgagatggccgtgggctccaagcagagattccagtgggccgctgaaagttagggtacgcaaccagaagataagtaggggctagaggagagtt

SEQ ID NO: 40612 - DNA, 201 bp, Bos taurus
ggtctccgaggtaagtactctgcccactcttcccccctggaaccttcagcctgtagcctgaggtcctggctgagtcctctggcctcagaggtgatccacakgggaggtccatgtcaggagctggggctgagaggagagagcagacaggctggctctggcctctccaggcatccccaggccacttctttctccaccacagaa

SEQ ID NO: 40613 - DNA, 201 bp, Bos taurus
ggactctccactcctgggagtgggcacacgggaagcttgagccagaggagggtacctttgctgtgtgtgtgtgtgtgtgtgtgtgtattggggagagggcmccagttccctttgctgcctcctgcaggaaggggattgtcaagctcaatatctacttccaagaattcaactatcgcaccattgaagagtcagcagccaata

SEQ ID NO: 40614 - DNA, 201 bp, Bos taurus
tcctgtccgtggcctgagacacaaaactctggaattcgccatttggtactgtttcctctagcttaaagcaatgtaatacctcgggaaagagatatctgggraggcctcctttgtcataggattcaaaatttaaaaagcaaacaaaagcatcctttggttacactgtgcttaattttgccatttatctgttctcatccaggc

SEQ ID NO: 40615 - DNA, 201 bp, Bos taurus
ccgggccattgctggacagagttgagtatcccagggatgggcatgtgccgtccagttcatcccagccgcccttccctgctgtattacaccagcctggcttmactcagtcacacagcctggcctctgcagggttttaagtttctaacccttgcaatgaagtaggtgcatgtgtgctatcttttcagttgtgtctgactcttt

SEQ ID NO: 40616 - DNA, 201 bp, Bos taurus
gctctggacatttcttgggtccatggcatgtcaacaggggccagactcaaccctcattcacgagcacatcggacgtgtctttccgcaagtgtttatagcakatatcatgggagtgatgtccatggccagcactcaacagacatttattaaaaacaaaaatctgaacaagaggacagaatcttgtcaacagtgtcctatagc

SEQ ID NO: 40617 - DNA, 201 bp, Bos taurus
aactgaacaacagcaatgaaagacaaaggtggggaggtcttatcactgtgtccaatggatgtactcgatcttgatcaaccagaccaacccccttcttagargtgcagtgaaggtggggaggaagcactatgaccatcctttctctgaccaggagtttctgagccagtgtgggtggccaggctgtcaccattcatctgaatg

SEQ ID NO: 40618 - DNA, 201 bp, Bos taurus
cctgatgtgctgcagtccatggggttgcaaagagttgcacacgactgagtgactgaactgattgactgtcttgaaccattgaggggggaaaaaagaaatgytcaaactgtttaccctggcccactcactctatattattgagccccagtccaactcgctgacctccttggctaggattttccttcttgttcatgagattcc

SEQ ID NO: 40619 - DNA, 201 bp, Bos taurus
caaacccattctgccgctcaaattctatcccctccacaccctacaaaggtaaaggaaacctgacctctgcctagaaaggcaaaaggaagaaagctaaagcygacttttatttagcacctagtatatgggcttctggaaaaggcaatggcacctgactccagtactcttgcctggaaaatcccatgcaccgaggagcctggt

SEQ ID NO: 40620 - DNA, 201 bp, Bos taurus
ccctattgttattattttgaaatcccgatgcaaagttgagaagcaaggtgcccttggttttcactactgataaaggctcccaggccaattatgcagaggarggcagaatccacattccttccagccctgtcacgtgggctgactggctgcagagaccaccactgtatgactcaggccatctctggtttccttgcagggtgc

SEQ ID NO: 40621 - DNA, 201 bp, Bos taurus
tagatctctgattaggtttttaaaacatatcactaggtggggaaccggaaaaagcaagctgttcaatgtgaagtcattaaacaaataccacatttaaaaaytgattagacagatagatcaagatagattcacaccaagtgtttccttctgtgtttctgtggagggaaagaggaaacttaggctaacttggatttaataaga

SEQ ID NO: 40622 - DNA, 201 bp, Bos taurus
cctcaggcgtccgtcaatccggtttacatgtctccggtggacgcaccaccccgaaacctccacacccatggctgctagcctgaggaggccctctttcaccrcctgttcttcccctactgacacggacgacgagggcgtgcgcggcacttgcgaagatgcttctatatgcaagaggtgcctgcccggcgcggggttaggggc

SEQ ID NO: 40623 - DNA, 201 bp, Bos taurus
gtaccctaagctgattgctcaaatctatcctaggcccttgaaaaggtgaacttgtactttaaggtccaaaaactcggcctcttctcgccacaatatatgtycccgcgatgtagtttttcaagattcatcttttagtgcaatgtctgaaacagcgaggctagaggaccagaaaatctaggggaccgaggacaggagggcggg

SEQ ID NO: 40624 - DNA, 201 bp, Bos taurus
ggacagctggaggtagaggcttactggggagatacacttgtgaaaaagggcagaggggtgagctgacctgcaatatgcttgcagctgaggcctctagaacktggacaagaacttgacctgggacagacttccagagtcccaaattgagagagaggtgctgagcctttgaacccttgatccaaaggattattggccaactgc

SEQ ID NO: 40625 - DNA, 201 bp, Bos taurus
ccaggggagacaccaagtatggcaaacaatgagttgtgtaacaaattgaactccagagtgggctaggtaagaaaagtctttgtgactgataaggttgaacrttgattctgtgtccaggaaggccagctgcccagaatctctgagaaaagttagttgatattatgtgacagtccaatacagattgataggggataataagat

SEQ ID NO: 40626 - DNA, 201 bp, Bos taurus
ggcagttttcactagggagttctccagccatcacgtcatgatttatttatttttatttttgtaaatcatgccagtcatttttacttttaaattgagtcagragagaagctgtgagacttcaggtgaatgagggattgctagggttgtacagtagaaagttttaaaggttttggttttgcataatggatggtatctctggaa

SEQ ID NO: 40627 - DNA, 201 bp, Bos taurus
tgcaagggaggctgggaaatagtcttttggctaaggagctatgtacccaaataaaaacgagaattctattactaaaagtggaagaaagactaaagggcaayggacagttttggccacagatatgttgttgataacatcttgagcaaggtcatgtattgcacaaccagagaccttcccgaatatgactctgagtagatgatc

SEQ ID NO: 40628 - DNA, 201 bp, Bos taurus
actgagcgactaacactttcactttcaaggaacacttacaacgtggtattgactttagttgtgaatttgtctccctaagagattaaaagctccttgaagayagggaccatatcttattaattctctcagcttgaggacctagcatggtagcaggtgcttaataaaagcctgatacatatgctgaatttgtaaataggaaat

SEQ ID NO: 40629 - DNA, 201 bp, Bos taurus
tgatctgagtccagatgaagtggttttttgggtgtagaagaggaggagatctttcttggtatccagcacccagacaggagtctcctgggccttgttatgcrcgtggggctcttttgttatgtaggaaggacttgttgtggctggtagaagcttcatctttggcctcaggagggtggcctcccggcttcctaggtggtcttc

SEQ ID NO: 40630 - DNA, 201 bp, Bos taurus
cagcgaggagaggagagcctggcctggagtgagaagtgcataatgcacctgcttctcaattctgttttaaaagtaacagaattattggtctcttctctccrtttctgggccctttccttcttctttatgcaggaggagttgtcaaggaaaatacaatcatgtcatgaaaatttcaagtccttaacgtctgtggatgtgttt

SEQ ID NO: 40631 - DNA, 201 bp, Bos taurus
agtggacctcttccacaacaccaaggaatgaaccatgaccaatataagcaattatgctcatttaattccccattgccaagagacttgtggccagtgagaaytgagcagtggacagctcagggcttttgagaaatataatctctaaagattaaaaaataaaaagtggccagtgataggatgaggaaggatagcaattcattt

SEQ ID NO: 40632 - DNA, 201 bp, Bos taurus
tggctagaaatgactattacaagtcatatcaccatcctgtgtgatataatcacaacttcttgaagaatattgaaatttttgtgtgtgtttgttttaattaycagcttgataaacattgcggccagtatctgaatctgatattggaccagctatgaaaagattaatcagatgccccctaatgacaaacatataactattttt

SEQ ID NO: 40633 - DNA, 201 bp, Bos taurus
ctgtgcagggtcttagctgtggtatgcaggatcttcaggaccctttttagtttcggcatgcagaatctttaatttctgcacacaaactcttagatgcagcmcgtgagttctagttccctgaccagggatcaaacctgggccctcttcattgagaatgcagagtcttagccactggagcaccagggaagtccctgtgcattc

SEQ ID NO: 40634 - DNA, 201 bp, Bos taurus
aggatgaactgtattttgtacactgccctaaaaattctctctgctccacctattcatcccttcttcccactcaatctctggccactactgatctttttgtyttcacggtttgcctttttcagaatgtcatattgttggaattatgcaatatatagtcttttcaatatgacttctttcacttattaacatgtatttaagctt

SEQ ID NO: 40635 - DNA, 201 bp, Bos taurus
gtaaatgtgtcaggaagatgcctaccaggctgtaggtgcttataaagcttcagctgagcctggatgtgggtgcctagaaaccctctgatccaaaagtgatratgatagaagatcaatggcccccagatcagggaggacatgggaagcatgctcagtcatcgaagaaaaccatagaaattctattacagttaaaatcctttc

SEQ ID NO: 40636 - DNA, 201 bp, Bos taurus
gagagatggaaagtggagaaggcccagaaagatgttttgcatctggcagagattctgccatctcagtcatccctgtaggcattcacacaaccccctctcaygagaggccccaagctttcagatctcagcttacatgctgtttctgcttcgggtcagacagaactagcttccagacccagctctaatactttggccacctga

SEQ ID NO: 40637 - DNA, 201 bp, Bos taurus
attaggtttcaatgaggtcatgaaggtggggcctccatgatgagattagtgtccctaaatgaagaggaagagaccagagtgtccatgcactctctttctcygccatggacactgtgagaaggtggccgtctgcaagccaggaagggagccctcaccaggaacccaatcatgctggtgcttttggtcttggagttttcagct

SEQ ID NO: 40638 - DNA, 201 bp, Bos taurus
ggagcccagagcctgcctggagtgttggagagaccaaacgaggcagacctaggggagtcagtgagcaggaggagggaagaggtggagacaactaagtaagygggggcccgagcaggatgggagctgggaggcagggaggaggcaccgtgagacgggtggggccgagaccggcagagcagagggggtgggcattggcatttg

SEQ ID NO: 40639 - DNA, 201 bp, Bos taurus
agaaaagagattactggggctgagagtaggaatgagattgcaaacaggaacaaggggcctttttggaaatgtgcaaaagattaggtggttccaaaactcarcaaacttactaaaactcagtgaactgtatacttctaatggctgatgtaaattatacttcaataaaactgctgaaataaaaataaaaaagaggaaatgggt

SEQ ID NO: 40640 - DNA, 201 bp, Bos taurus
gaggcgagaagtgaaagccggccaagcagcccagtgaacggctgagcctgcctttacctttcttggtcttgcaaggtccacgttcagggtggatctctttyaagggaagaggcaccaccttggccagccccgcgttcagcatgtactggtacaggcgcttgaatgtcctctcgcacagtccctgcaacatgtaaatgcggc

SEQ ID NO: 40641 - DNA, 201 bp, Bos taurus
gcatgggccataggtgaatgggacccacgtattaacctcagagcatctgctggacccattttggatgctccctgggaactgagaaaccggagggagccatytttgcaatttcaggccactttgctgatcccagtgcctgtgggtgtcactttggaattctccctctagtctgagcaccagtaagcacaccccacttagaac

SEQ ID NO: 40642 - DNA, 201 bp, Bos taurus
tttaattaaatgttttattttaagatcatcataaattcacatgcaattgtaagaaataatcagagagagccttgtgcactctaccgtgtttcccccaatgrcaaaactgaaaaagtgaaagtgttagttgctcagtcatgtccaactctttgtggctccatggcctgtagcctccaggctcctctgaccacgggattctcc

SEQ ID NO: 40643 - DNA, 201 bp, Bos taurus
caaatgagattccctggagtcctgcagtgcacagcctgtatggctgtacacagcagccatggatatttttagagtaacaaatacccccaaacataggacaraagagaattaatctgctattcagctagactgaaattggcaaagttcctcactccaaattatggcactctttgatcttcccaccatgtacccgccccccca

SEQ ID NO: 40644 - DNA, 201 bp, Bos taurus
caaggtcgcagcaattcccgtcagctcaggagtcatccacttggtgggcagaggtggggtgggctgatggcagcctgtggaccaaaggccccacctctgcmaaaatggcaggtaagccttccttgagggctccaagagtggacagcatctgatggcttctctggaaggagctgcgcctctggatgagcctcctgtttcagg

SEQ ID NO: 40645 - DNA, 201 bp, Bos taurus
aactctggagacatgatcagtcaaccccagcagaaaaatgtgacggtagacagagtgctcctcaaagagaacgaatgtgtctgggactttcctggcagccyagtggttaagactcctagcttccagtacaggaggcacaggttggatctctggctggggagctaagaacccacatgccttgtggccaaaaaaacaaaacat

SEQ ID NO: 40646 - DNA, 201 bp, Bos taurus
gagactcagtttaaggcaacccgctccaattttcttgtctgggaaatcccttggacaaggagcctggtggggctacagtccatggggttgcagagagtccracaggacggagtgattaaacaataaccaccaccaggtgggcagcttgaataaaccagcatttgggaaaccccagaatgagacagggatgggctctagagt

SEQ ID NO: 40647 - DNA, 201 bp, Bos taurus
gacaccacaatggagacgggatcagggaaatccagtgtagactggtgactttcaatcacagtgaagactgagtcccagccattttatgacagtggtcacgmgattcttaccccatcatctgcctctaggctgggccatggcaacagggccggtgaggggtgggtaggagacataatgaagcagggggagaggactggtcgg

SEQ ID NO: 40648 - DNA, 201 bp, Bos taurus
gttggaagccaggccccctctgggcctctccccacatcccctccctgtggcaaaatcctcctcaggcttcgttcctctcaccaatgatgtcagccacgccragctttagggccctgggggtggcggtaggggacagctcggtctctcccaacagcaagaggatcctgcttggggacaccccaaggcgggcggccatgtggt

SEQ ID NO: 40649 - DNA, 201 bp, Bos taurus
ttctcaggatgttcagatactcctaaaactcccagacaggggaccagggtgtgtggaatgcgtcccatcttgggtttattttagatcaagggtccccaacycctgggccaccgaccaggtacttcccgtcaaatcagtgatggcattagattagaaatattgtgcacaaacatataatgagctggaatcatcctgaaacca

SEQ ID NO: 40650 - DNA, 201 bp, Bos taurus
ccgctctgggcccccttagctggttaatccccctggggaagccgagcaggttccctcgttctcagttgcgtccgtcactggagaccaaagctgagtcaaaygggagccgtggcgggcctcggagggaggggacgaggatggagaggcctgctggacatgtccccctctcctcacgctgcaggttctggcggcagataggcg

SEQ ID NO: 40651 - DNA, 201 bp, Bos taurus
ctacctcccacaccgccgggccaggccctgtcgtcacagtgacccacgctgggatgcacaggactgagcgcagagctcacctgccctgtgacaggctgaakggtgtggccgtgtgtcacctcacctgcaagtaagcgtcaccatccactgtggtggccttgagaacactgtgggtccagagggggctgtgcaagagcggag

SEQ ID NO: 40652 - DNA, 201 bp, Bos taurus
actgtgctgctctgcgtctggccaatgctcaaagcaaacaggagcttccagccaacagcgaacacttcccaagtgattttggccatgaaggcaggaacggyggagtgggtgtagctgtttttcaaggttacctaaagtatattccttaccactcactgttcttaagttatcttctctccacaataggccactccccaaatt

SEQ ID NO: 40653 - DNA, 201 bp, Bos taurus
aacagtatatcctcactggaaaaaaaaccagcaacccacgagtgaataagcgtgtccgcagcctggtggaagagtgactgatgctgtaactgaactcatcytcaagcacagctccgaatgcctgttaggctggaaaactgttgtgctgcgtggtaactggacataaaccaaggcggtcacatggctgattcacctgggctg

SEQ ID NO: 40654 - DNA, 201 bp, Bos taurus
atctgacattcgtcattttcttagcttgtgttctaagtgttatttattacaagtctgggtactgcattttcaaaataaaaaaattttaaaacataaatttrcacctaccaggacggctcagattaaacactaatgacattgctggcagagggcgagtgtaaattggaacaagcactgcagaacactaactctgttttctaa

SEQ ID NO: 40655 - DNA, 201 bp, Bos taurus
gggaccccttattcgtgacccctcacggccgaagccacctcgggtttttctggagagaagatgctggaataatgcatgatgatgaccgtactgggggatcygcggtgggggcccggcatgtcctaatcgctctaccatggatgctgcatgtgctggtggggggacgcttatgtcctctgctgaaacactctgactccaact

SEQ ID NO: 40656 - DNA, 201 bp, Bos taurus
cgaagcggctgccccgcaccagcaggtgcagcaggaagcagagcagctccaggcccgcggagaccaggaagaagatgagcgtgccggcccgctcgtccggmagcagcagcttggtgaggatgcggctcagcgagaccatcactcctgcggtgcctgaggaggaggggccgtgacgcccgccccgccctccctctcggcccc

SEQ ID NO: 40657 - DNA, 201 bp, Bos taurus
ctgtggagccctgtgccaaggtcacaggtgcgcagccccacaccagggtcgtctctggatctgactgagccccatagcaaccattgccatgggctcccctkattgaatctggccagcttcctgaccccgtattaggtaaaaacacccaccctcacccatctcctaatcccacccttccggcaggaattttctttgtcccga

SEQ ID NO: 40658 - DNA, 201 bp, Bos taurus
tcgggttcctcgcagcgtcgtcgcctgtgtgttctgcccgcgacagtgtggcttcgcttgttttgagttgtgcgggtggatttaggtctcgtccgtcatgytgctcccggccatggcctgtccccccgcgaacgagtctgggagccacgctgctgcgagcatcctggtccccacatgtgcggcccctctgcggtgcgcgcc

SEQ ID NO: 40659 - DNA, 201 bp, Bos taurus
atccagaaatggtttctgtaggcctgtcatctgttaatattttataaaactcagtgggaagaagactcaagtctggcccttcagcacatgtagaactcacrgaagactgttttgtatatgacgtcagctctaccttacacccggttttagagaactaccagttttctcatggccgttgggaaactaccatacatgggtagg

SEQ ID NO: 40660 - DNA, 201 bp, Bos taurus
aaccaagctcccttcagactccactgccctacagagggctcggggggccgcagcgaggaggtgccgcatttactctctgtgcaatgaggcctgtaacagaygacagctgagctccaaagctcacagtaccggcaagagtttaaacactgacaatctgtaaccgcgtttcatctgactccaagcagctgcgggcctccatcc

SEQ ID NO: 40661 - DNA, 201 bp, Bos taurus
gctgactgacgggctgctgttgtcagtagctgtcagttatcacgccatcagaacatggagtcgtttctaagctgagcttactgtcggtttgcaaagcgccrgagagaagaggcctgaaaggccagcacgtgagctaaacaggtccggactctcagacccagagggtcgtcaggagtccgctctgaccctgccccggttctc

SEQ ID NO: 40662 - DNA, 201 bp, Bos taurus
tgacctgcccttcggtccacttcagagtccctcacaggtttttctggcactctcccccgtgggactgtaccaaccttaaagactagtcttgatcaaactckaccagcactttagagcaggccacgccctcctgctgtgtgacagtcctcagcctgtctgcagggtcccctgccctctctcttttcctttgtttgagtcaca

SEQ ID NO: 40663 - DNA, 201 bp, Bos taurus
tcgcttgtgttcttgaactggaaccgtaagaagagaactaatcgtcaatgccgctatgcagatgggggtccaccagtgtgacggcccaccacacactgcaygcaagcgccccaaggcaggtggaaaactctcatcttccaggcaggcaggatgccttcctacgtccatctgctctcagaaccttccagtgggccctggttt

SEQ ID NO: 40664 - DNA, 201 bp, Bos taurus
aggccacaaagagttgtaagtgatctagagatggtttaaagcacaagagaggattccgatgttacatgcatatactgcaccatttcatataaggggcttgrgcatcttgggattttggtagctcggaagtgaggggtagtagagggtgagggttctgggaccaacccactgaggataccaagggatgagtataatcccaga

SEQ ID NO: 40665 - DNA, 201 bp, Bos taurus
gtaaaaacacgagcgaaaacaaggaccctgcctgctctgcttagggcgaaagacaatggcttggtgacggagatggccaaaaactgtccaggacaaagaayaggaaggcaataataatttaagaaaaaaggaggatgaaagttatgttaatacacatggccttaagatacaaaaaacacaaaaccttttttaaggtctcat

SEQ ID NO: 40666 - DNA, 201 bp, Bos taurus
gtgaggctaccatcagccttctgacggcacgtcaggaggagggccatctgcctcagtcatctgagaccctgaacagtgacgatgtccacgaccggatgtcmggagcagacgatgcgggtgctggggcctcaccgtggtgggacagagcagcatggtgagagactgcatcaagcaactctcaacagcgctcgatgtaaaact

SEQ ID NO: 40667 - DNA, 201 bp, Bos taurus
tgtgagatctcctgctgagaaggccgtctcctgaaaagcctggaggcacaagccataactgagcctccacccagtctacatcggtggatctgcccaaccayggctgcacctcagggccactcggggagctccgacaggcacggaggccctgatcctcacgtgcagcctagctgagaaccactgatctcattcactctactc

SEQ ID NO: 40668 - DNA, 201 bp, Bos taurus
caccattctggtaagagctgcctgccactgactattacatacagtgcacgggactccatccaacccaacttattccctaaaagtgggggatgggggtcagrgcaggttaagactcccagtgtttcctcactagctgactttggagaagggcaaatggggtttgggttttgtttgttttttagagttttttttctcaatagt

SEQ ID NO: 40669 - DNA, 201 bp, Bos taurus
cctctcaccaggccgggcacaaacgccctggccccgcactcgggatccctgctgtttccctctggtttgttctccagactccactagcagtgtgctctgcragtctctccccggccactctgcagcccctcacccgtgacccgtctggcccaggcagctgaggctgtgaggaggcactgtctcaccttcccagtgacagcg

SEQ ID NO: 40670 - DNA, 201 bp, Bos taurus
gagggcgtctccgaccctctctgcatccccgccagccccctttccatcttcactcagtggggccagcgccctggtgatgagcctgtgtcctcagccttgcrgtcgccttcactttgagggaaagtgagttgggggagggtggagggaatcctctccccacccccgaccctgctcgctaacccaggaagatgctgtgacttg

SEQ ID NO: 40671 - DNA, 201 bp, Bos taurus
gctgccccctccccgagctggcagctcccaagaaggctggacccaacccccgggtgatcccagcgtcctgttggtaagggagggagaaattcagagatccygtccagcggccccgctcccttggaggaggctcccctcatccctccaacattacttccaagtcctctcccttcacaggagaatgcctttgcccccagggtg

SEQ ID NO: 40672 - DNA, 201 bp, Bos taurus
aaaaagcacctccttccgcccctctggcaaggggccatgtgccctgccctcctcaccttaccccctggctccctagggtctggtgtccaggctgaggaccyggcgacagggtctcctctgggcctctcaatgcccaaagaagctgacttagaactggcacagctttcaacgcctgtgggtttctccagattacaagaacca

SEQ ID NO: 40673 - DNA, 201 bp, Bos taurus
gcgctgtcgccccagctcccaaaacggccctgccctcgggtcaggcctaaactctcctggtggtggaaggccatcccgggcctcgggcgtgcgtcgctgtrtgccttgcttttaagatgtcctcctccaacccccaaatggttttcaaggctctgtggggccaggagggcccccgggtgccccggcccagccataaccagc

SEQ ID NO: 40674 - DNA, 201 bp, Bos taurus
accactatgccagtgccattgagtgcgggccagggcaccaggctgtggacacttccttcctgcctggggatccggattccacaggcccagtgactggggtkcctggtcacccagagcatgtctgagttcctctttggtgatgaatgcagagccctagggtgagtagggggagcggctttgctcgcaagacggcccaggcgt

SEQ ID NO: 40675 - DNA, 201 bp, Bos taurus
ggtccccccacagcgccccacgacaccccccacgccacaccccggcccttctcccaaagtgctgtgggaacgccgtgctctgggaaacatttctggaagayattagaacccaaacatttttcaaccaaaattttagaaacccagaccacttccaaagacgaccgactttgaaacctgacacttcaaatccacttttcgaat

SEQ ID NO: 40676 - DNA, 201 bp, Bos taurus
ccctgagcctcaggagctgctctcactttctagactgtggccgcctggcttctgtccctgagaccaagccctatcaccctgagggagaacccagtccatcyggggtcctggtggtgccaggcccgcaaaggacccccctggcagtgctggtggttttgcccaggctcgtgtgagggcaaggcaggggctgtgtgtggaagc

SEQ ID NO: 40677 - DNA, 201 bp, Bos taurus
caggggagaccctcagccgctgcctccggggcgaagcgggccagccccccggccggggcggccacactcagtcacacaggctggctccctaggcccctccyctccgtctcctgtgtctcttctgtgtcctggtgtcagcgctgtgggacatgcccatgatacaggcgtgtggttggccctacggaggctacggtcccgggg

SEQ ID NO: 40678 - DNA, 201 bp, Bos taurus
caaaacgctgcagaacgagattctagaaagtggccaaggaacccacaggaaggcgaaagaagggagacacagggaacagggagcgtaagtgaagcggcagrtgtggccatcgggaggtcgagctacatttaatgtgagcgacgtaaatgcactcattaggaggcagatgggcagcgtggatacacacacacaacccggtta

SEQ ID NO: 40679 - DNA, 201 bp, Bos taurus
cccctagccccagccctcagaagggcgccaggacctcagcccgcctggccaccgcgacccttccccaggtccagctccgtcacaccgggcgggcactgccygggttggaaacaagaggggagggccggaccctgttgggttgatttatcgttcgtcagagagcctctgggttctaccaggaagacaggaggccacctcccc

SEQ ID NO: 40680 - DNA, 201 bp, Bos taurus
gaggggcaggtgctgaccgctgtcacacggagctggtggctgtgacagtcagagcccagtcgacccaccccaacctccctaacgatatcagctaaagcgtygaggccttggcccggcactacctgcgcgttctcacgcccgcactcccgccggacggggccggagtctccacccacccccatgaccagctctggccaacag

SEQ ID NO: 40681 - DNA, 201 bp, Bos taurus
aaccaccaccaaaaaaaaagcaactaaagaaaagttctgctaaggttatggtgaaaccagcacaatttttttggaaagtcatttggcaacacagataaaargcttccaaagtgtgcatagctgacagcagaagagaggcttaatgacgaagctgaaacttcccgtctgagaccagggacagcacgcggatgctgccaccac

SEQ ID NO: 40682 - DNA, 201 bp, Bos taurus
cttggcgcacggagcggttggtgtcacggatcacgcaagggcctgtgcttagagcactgccagtggaactcaatgacccgtgagggggaggagactgtaarcgcctcgtatgggccaggccctaaaggaggcccttctgcgagtgggatgtcatttaatcctcccaagtgttgaacgagcaagaatgggttcctccaagag

SEQ ID NO: 40683 - DNA, 201 bp, Bos taurus
ccaagggcgctgtctaaatggcctcctcagtgccgtgacctcccagcacgcagaagcggcagcaggtggctgtgggagctgggggtctgcgcctgtgctgrggccagtcacgcaggtccacttctggatctcagtttcctcagctggaaaatgggcttgatgaacgaacttctttacaaaaccgaaactgagtcagaaact

SEQ ID NO: 40684 - DNA, 201 bp, Bos taurus
cccggactctgccccccgcctctaggttgctggggtggggggggacacatctctgtcacacacgccctctgctcgacttagatctgctggaggtcctgagygacgtggatgagatgtctcggcggagaccggagatcctgggcttcttctcggtgcggagcagccgcgggccccagggggctggggcgggaggcatagcca

SEQ ID NO: 40685 - DNA, 201 bp, Bos taurus
ggaatcaggatggcttcccagaggagagggcactggcacagggccttggcggatgagcaggagtttgccacgcaggcaggagaaaggagggagagctcttkaggcagcaaatgtggccaggtgcctgtgtgcggagaaggcaatggcaccccactccagtactcttgcctggaaactcccatggatggagtagcctggtag

SEQ ID NO: 40686 - DNA, 201 bp, Bos taurus
ctggctgtccggaagtggccgtggtcagggcggcgtggcccactggtggcttctcgcctcacgtctacgcggctgtggcgcggcccaccttcctggtagaytcagcagcgcgtctccctccagtgaaattccacagaaacaggaggtgagtcagcacaacgagcaccgagctccggtgttgggcgtccaggctgaagtccg

SEQ ID NO: 40687 - DNA, 201 bp, Bos taurus
cctgctcggatgagaccagggcacccagccccaccggccgctcacctgtccgcagatttaagtacaacactgtttatacctaaaaccatgacactctcccracactggccacttggtgccacccaccaaggacacactccagacagagctggaaaaacactggtcccagcgcccgcgggcctcacggggcatccaggccgc

SEQ ID NO: 40688 - DNA, 201 bp, Bos taurus
agggtggggtggaaggcggggctacagcccagggctgcctaagacggtacttctagaagctccaggaaggccagggcccttcaaccctcaatgtaaattcygtcctctccttcttcggtgctgaaatatttaccagtgcacagaactcctgttcagcactcgctgaagaatgacccgttgaccccacgggtgtttttgggc

SEQ ID NO: 40689 - DNA, 201 bp, Bos taurus
gtcaacgtggcccaggacacggctcggggcacaatcactcagtcgcgagctatagcccatgcggtacccgggggcagaggaaacgtcctgaacgccatccrgctcctagagacaaggcccggcctcgccgcgcaagcctgtccattcaagccaagcgggagcaggacgcgtcgaggcccggagacggggccccggcgcgcc

SEQ ID NO: 40690 - DNA, 201 bp, Bos taurus
ctggcgtgctgtgattcatagggtcgcaaagagtcgggcacaactgagcgactgaactgaactgaactgatgctgactaaatatactaccagttctttgawtgtcattcttcactggccttgaatctgagggtataaggaggaggcttttgtttggttcatataatttaaatttggtatcttcaaagagaatttcttccta

SEQ ID NO: 40691 - DNA, 201 bp, Bos taurus
ccaaccatactgaatcatctgccccatgggtcaagtaactagttgtatgtatgtaaaactgcgtgtaaagaaaaacacattaaagtatttggccagttagygtgaaagaatttttaaagaaatgaaatcctaaatgcatgatgaattgctatatattagacagcatgaatgaattggcccatgtgatgctttaatgtttat

SEQ ID NO: 40692 - DNA, 201 bp, Bos taurus
cagaaaatcctagtatcctggttgctaactttaatttctttccacttggctacagggattaatccagtctcttttttcccttctacttgtccctgtcttgmatatcttaatttaaaatgacatcattaatattagtatttcttaagtattttatatattaaattgttcattaaagagattaggacacagtgatacaaaata

SEQ ID NO: 40693 - DNA, 201 bp, Bos taurus
tgtccttctttgtttctgcatctattagcttttctaaagatagctgttacagcttgtttctttctttctttactcatggaaagtctcagaagtcatagtayatggccacagttttttttttttttttctgtaattaccagcaagcaggggactcactggagatcctttcaccaggaaggcctctacataagtctgctaggt

SEQ ID NO: 40694 - DNA, 201 bp, Bos taurus
gtgttctctgagtgacaatcataaatattggaatgtcagatgagtacataaattcttttctgggagtcatcagttaactagggccaggcagagggagagcrccaagatggatttcattgcccatgctccttgagagtggctccatcagccactagataagcaaagaggcctcttcagagaatgactgggtaaatgtgcact

SEQ ID NO: 40695 - DNA, 201 bp, Bos taurus
cactaccatctccagccacaaagagggaactccaaggctttcttgaaatggctgaattctgttgtatcaggattccaaatcatggccttatagctaagccytatatgaggctctaaagagaggagaaagggagccccttcaatggaataaggacaactagcaggcctttgagactctaaagactgagtagagagccagcaa

SEQ ID NO: 40696 - DNA, 201 bp, Bos taurus
aattacttctgctgtactttccataaaaaggttttgtggggaaaattggaaattagtgacttaatggtcaacctatgctatttgttggtttgaataacgarctatccctaagatatatgaaatacatttaaatttatacagccttaaataaatcacaaaaggagagaccatgtcactatatatttttttaaatatccagtt

SEQ ID NO: 40697 - DNA, 201 bp, Bos taurus
cacagcaaatatgtatgtatgaatatcaaaaatagcataaatgaaagcaccaaaattctaccgttcattttatgcttgacgttgagattttctgacatctyggttcatgttactatatagacttactccataaaaggtagataaaagaaagataaagtcttcatagacaaagccatctagaaagagaaaagcaactgagga

SEQ ID NO: 40698 - DNA, 201 bp, Bos taurus
ctggtgttcatccactttgagaataaaataatgggatctattagttggaaaaaacaggatcaggagtctcactgagtaaattatgtatattacatatggaytgtgtttctcaaataagatcccctctaacaggcctccttcacatttatgaattagttgccatgttagcttaagaaaggaagaaacagacaggacattata

SEQ ID NO: 40699 - DNA, 201 bp, Bos taurus
gttctttccgggataaatcatgaacagaagaccctggagggctacagtccatagggtcacaaagagtcagacactactgtgcacagattggccataaatckcagcaaagggagcaaaattttacagaagaggtttgcaattaatctttcttataaatatttgatatgaggtgattaaaagatcatctgctttttatatccc

SEQ ID NO: 40700 - DNA, 201 bp, Bos taurus
aaatggtatacatttattgtaagtttatatccagctgataaaagagtaaaaagttaacctttgcagtttcagtgctacattaagtgttaatttggtcatamacacacagagaagcagatgcatgcatccacacacacacacgactcacagagaaaagaagagagagagagaatatgacaaaaagagtttagcttcaagaat

SEQ ID NO: 40701 - DNA, 201 bp, Bos taurus
ataatcaatgataagaattcaaaccatggctcagaaaagatgaaatgattcaggattgaaacattagtgcttttaaggcactaggttagccccaaattagkaggatgatttataagattaagcacaataatgagtaagaacaggagatcacaaatgatatataatgagttaggtaagaattttagtaccaaatccattaag

SEQ ID NO: 40702 - DNA, 201 bp, Bos taurus
gggacatttaccttagggccacaggacattgatataattctcatagacttttttcagcagatggcagtactattttttaccgactgttttcagcagatggyagtattatgctatggggaatgaacccattttttgatttacacaaaattgacccttgcacttcttggagctcgatattacttgcttttgactttagttctg

SEQ ID NO: 40703 - DNA, 201 bp, Bos taurus
ccatagggccacaaagagttggaggcgactgagcatgcatgccctatgcttacattagcatgcatgcatactatgtcacttcagtcatattagcattaagkatattaatttaataacaaactactattaatgccaaatgtaataaaactttgaaatttataaagtgatttttctttcattataccttataatgatcttatg

SEQ ID NO: 40704 - DNA, 201 bp, Bos taurus
ttacatttggccttttgaaagaaatgtgtctgacatgacttgtgtagtatggttgttgttgttcaaccagtaagccatgtctcacttttttccaccccagraacttcagcatgccaggcttccctgtccttctgtatctccctgagtttgatcaaactcatgttcattgagtcactgatgccttacaaccatcacattctc

SEQ ID NO: 40705 - DNA, 201 bp, Bos taurus
agatctctataagactggaactccatctttgagggtacagagagtccctaagaggagagaggtttgccaatatataattaaactccagggacttggagtgrcatgtgaaaaatgttatgagatccagcagatagagcactgactggcaaaaagcctgaagaagcctcccagtggagagaaagaaacattcagcgtggacaa

SEQ ID NO: 40706 - DNA, 201 bp, Bos taurus
agaaaataccaaatgaacttttttgccaaaccaatagtataaatttgggaacagcatatgacagaatggtcagtgtgaaaagaatctacagaaggcaagakaatatatatctgtctgtttctcagacaaggagataaatagttggtgttcaatggagggagtaagtggtgacagtggaaagacagagtggctgggtttgaa

SEQ ID NO: 40707 - DNA, 201 bp, Bos taurus
gagtaattacactcagtgaccttgcatagggccgtggaaatgattcatcctcagaatttcctgagtccacatagtatttgtggcagttcaaaattaacacrtgaacaagactaaagatgagaatattcactcagatattatatatagaaaaatcaacctgcctcactaattttcattcataagatagaattttttggcatt

SEQ ID NO: 40708 - DNA, 201 bp, Bos taurus
tccatggacagaggagcctggcaggcaatagtccatggggttgcaaagagttgtccatgacttagtgactatcactcactcattctatggatcttatagcrttgatcatattacttgggtgccatcccttctgaagtttgtcctgagatattagacaatttagacactcagatatattaagcaattactagagcctttctt

SEQ ID NO: 40709 - DNA, 201 bp, Bos taurus
tgacagtaaaatttccaagaacagggatttgcatctctgattctttgtgtcttccacacaacttacctgaggtttagatattggaaagattttgactggcrgtatttaattcgaattgttagcaactttcacatctatatgccaagctgcaagtactctgtaaaaattaaaataaaaagtatcaattttatagtagattta

SEQ ID NO: 40710 - DNA, 201 bp, Bos taurus
gagtcagacacgacttaaacaacaacaacaaagggcatggatggcactttaattttcttaactgaagacaaataggtttttcagagaaaatagagcatgtrgatctgctgctatttctgaaaatagagataggatgctattagggtgagggctacagggaaatgaggaagattagtcttctaaatggatcttaaattttgt

SEQ ID NO: 40711 - DNA, 201 bp, Bos taurus
aaagtgaaaacaaaagtttattaaaaaatgaacataatttcatgtcacaatggaaattttacttatagaaattagtgattaaattaaaaacaactttattrggaatagggatctttgcaatttgttggaaatattcacagaacaaacatttgtaagcaaacacaaatgtgtttactgaagtatgggattattcatttcctg

SEQ ID NO: 40712 - DNA, 201 bp, Bos taurus
agttgttgttgactcactgtctctcatgttcaatacccagtttatgaggaaataccattatatatagaacatacccacattggccctttgtgctttactayctttattgttatcaacttgttctcagttcagttcagttcagttgttcagtcgtgtctgactctttgtgaccccatgaatcgtagcacgccaggcctccct

SEQ ID NO: 40713 - DNA, 201 bp, Bos taurus
agtagaggcctgtgcattaggtaataggtatacagaccttggtgtggaattcaagttagctgaactcattggacctgatgagcaaggaactgaccctaacktctcagggccatagcctggggaaaacctgggtaatgctgatttaagcagatacccatggatgagagagattttgtgaaagtccagcccactccagtgctc

SEQ ID NO: 40714 - DNA, 201 bp, Bos taurus
aacattgaacttttctttgaaaggcttaattgaaatcatgacaaaaatatttttagtttcaatctatttttctgagctaatttaagtagctggtatatcartgagatcccaagagaaggggaatactgacctaataagactaaaatcaatgaactagtctgatgaatgtttaacagtacttgatgtaatgagagaagtaaa

SEQ ID NO: 40715 - DNA, 201 bp, Bos taurus
ggtcagtgatgctgtggatgggggcatattttctgcacttcctgcctccaggcaaccagttctctgcaactctgatataaggccgttcagtgagactgcarttactagcagagggtagttgaccagagtgaatacttactctgaggaacatgtgtgggccattgacagcttctgttaaaccaatcaaacaaagtgactaaa

SEQ ID NO: 40716 - DNA, 201 bp, Bos taurus
tgtccttcagctgccagacacttcccagaatatttcagtttgcacagagaagggtcacacctttctcactgtagcccactgactgatggccaagtgcaaaraccttctcattttgacccaatctggaataactcaaacatgcagcgccaattccagagctccttctggaattggccaaaactgttgttgatcctgtacagt

SEQ ID NO: 40717 - DNA, 201 bp, Bos taurus
tggctggccttgactttggaccgaagattgggttggactcctgtcaattcgacatacctccctcttcagggatccatgactgagtatgtctgctcttcacrcagtgagggccaggaccacaagagagcttacccaagctcctggtcacacgtaaagcttcttgttacatgtcacagtagctcacagtcctccgaccaaagc

SEQ ID NO: 40718 - DNA, 201 bp, Bos taurus
caggccacacatgtctgtagctcacaaaattgggttctgtctcaatatcaactcttaatgaaataacacttgtaaagtacttaaatcagtaccggattcayactataggccctctgtaaatgttagccattatcatcagtttcacgcctttcgagcgtttctcacaggctgtactctagatgctgagagcaattcaagagg

SEQ ID NO: 40719 - DNA, 201 bp, Bos taurus
tgaattttttctttccttgaaccgtattttattttcaatttagtagctcctgaggatgaatggatatttctccaccacgacaaaaagtagcagcaatttaktagagaagatggtggtacattcagggtaaaaaaaaaactttttttgtttatttccctccaaaggctgcttcctttaagggggagaattaattgccttgaa

SEQ ID NO: 40720 - DNA, 201 bp, Bos taurus
aaaaaaaaagtttcagggaaaaaaataatatttaaaaagcagtacagtgtcttaaactacagtaaatagtttagttcaatcataaatactgtggcctgatmaagtaatttatacaactatgactcagtttcagttcagttcagtcactcagtcacatccaactccctgcgaccccatgaatcatagcataccaggcctccc

SEQ ID NO: 40721 - DNA, 201 bp, Bos taurus
tcttcaaattatctggtaacatttgcttacctgtttcactcccttgcttaaaagctttcaatggtaactacagaaataataagcaacccttattgtgggaytactatgaaccagattaaatgctttttatgtaataacttgcttattcctgcaacaattcactgagaattgcttttcctagttgcattgttttcagagaac

SEQ ID NO: 40722 - DNA, 201 bp, Bos taurus
gcccgatgcctaaaagtacatctgctttaagaatataatacagttataccctgtcaattggtcatctagtatttctccctgctagctcacacaacccctcrtcaggccacttgctttggcgtcctgtgaaaacacatggccttctgtgctgtaaacttttcctggaatggcctttcccccaaacagccttttctcatctat

SEQ ID NO: 40723 - DNA, 201 bp, Bos taurus
aaatgcagtcgggtcagtgttgactgcaggagaattataactatagcctaaactttaattcagattttataattgcaaccaactcagggccagtgtgctayccaactctaagggatcagaatataacctgtaattatataatccttaacatcaacctggcctctgagtttcagttgagaaacatctctagaaactatattt

SEQ ID NO: 40724 - DNA, 201 bp, Bos taurus
aaacaaaacaaaaaacctaattggatgaatgaaccttaatctccatcttcctagcacgacacatggtcaaatccaacaaaaggcctccacctccaacagckgtgctgagaccagctgtcttgcactatctcccctgttaactccccagtccaggccaaaactcacatcctgtgttttgtcagtcctcccatctggccttcc

SEQ ID NO: 40725 - DNA, 201 bp, Bos taurus
taatgttaagtgacattggtattgcttttgttcttccaaatttgcttcactctatctgatacataatttaatctaatttctcattgtgcttgtttattcarcttgaacacttctgtgcattgggtagtatattcatacgtctaacttcatattttggctgtttacttcatttgtatgtcttcagagcaaatgtgtgggcac

SEQ ID NO: 40726 - DNA, 201 bp, Bos taurus
gacacgactgagcgactgatctgatgctcagtcttataagaattgcaaggcaattttatcttgtgctgctaaaacaatcagtcatttaatagctgagaagmcaagtcaccaattgtctttccttttctcattagtgataacaaaaataatgactactctgtgagttgctacatgcctggcaccattcttcacatgcattaa

SEQ ID NO: 40727 - DNA, 201 bp, Bos taurus
ctattgggaattgctgcactgtttagactttcatcaacttgacatgaatgctatatctttagttataatgttggtaaagctgtcagacagagcagggccargtacaaaaccttgttacttaaccctacaggacaactctccaacttcactgggttgacagtgattcaagaagaggccacacagtatggtaatatgtacttg

SEQ ID NO: 40728 - DNA, 201 bp, Bos taurus
aaagagcttcttatccataaagtaaccattaaggattttacagctgaaaatcaatgagtcccctcacttgaaagcctgtcattgacactgagctgactgayggctacagaggtttggccataaggtttctgagaatgtgtgcagtcctttgggttgctgtcccatgtttataggtcagggttaccactgaggagagagttt

SEQ ID NO: 40729 - DNA, 201 bp, Bos taurus
actcaaatgccatggggcagcgggaagattacaagactttaggccttgtcaattacaataacctttatttgaattaaattaaaagagtaggtatatggccmactacagagttcagagagatgagacaaaatagtaaaggaaaaataacatttatgaaaggctgtctatgtgccaggccttatagttaaaactctgacatga

SEQ ID NO: 40730 - DNA, 201 bp, Bos taurus
ccttctctctgtttgctcacatggcagacggagagagagtagagagttttcttgcatctctttccacaaggcaacaaattctatcacatcagagccccacyttcacaaccccgtttaaacttaattacattcttatgaaccctgtctcgaaacacactcacatgcttggagatggggagggtggagcttcaacacaggaat

SEQ ID NO: 40731 - DNA, 201 bp, Bos taurus
ataatttgaaaaggccaaccacacagatcccatgtgctctcaatttgccaggataaagccactttcaaaaagtctgttttgtactcacattatgtgcctcrgggtttgtttatttggagagtatatcccagtatttataccaactattacatcagcataatgattactacttgaaatcaggacatgggagtggggtagaaa

SEQ ID NO: 40732 - DNA, 201 bp, Bos taurus
ggaatgatctaagagtcttcactttccttgtggtaatccttgtgcctctgctgcgattatcatctaacacagtgtcagagtcaaacagtgtcctgggccaragagcctctgactaagtcacctcattgatatttggaccaagtctcctcatctatggagagcatatggaatcggtcctgtctggcagcaccataagaaaac

SEQ ID NO: 40733 - DNA, 201 bp, Bos taurus
ttacacaagtttttcatgacaagaaatagaaaaaaatgtattacaaagaaatacctttacctcatagaatgtgatgcccaagggtaaggccagctgaagayatggcaggtataaaggtttgctgcttatcccatttccatgtttctgccttcacctttctctgccatcctcagcatcattttcaatctaacactggttctt

SEQ ID NO: 40734 - DNA, 201 bp, Bos taurus
attggatagagcggtgggaaagaaggatgagtcattttaggttttcaatacagagaaccaggataatgatgttagggaagtcaggcagggaaacctatttrgacagaaaggtgatgaactgagctttgcacgtgattattcatttattctacaaatacctgtgaatgtctacaatgaggaagaaatctcgctgggcttggg

SEQ ID NO: 40735 - DNA, 201 bp, Bos taurus
tccagcaagacactgggctccaatagtcagcaataagactatctctgggtgaggggaaaatgtaatcactgtgaatattttgtacatgtgttttatttccrtctgaatggccacacagccatgatcacatagtagctagtattctgccttgtgaatggccagacaaatcctgtttggataaggatggctatccttttcaat

SEQ ID NO: 40736 - DNA, 201 bp, Bos taurus
aaaaatatttttcttcattctgaccaaaaaaaagaaaagcaacacatacggactcaaatcacagccagcacaccaaattcaggtgatgacagctgtgcccrgtcatcagctgtccttcttggagggaccatgagaatgttagaacagtaagcatacctttaaatgtttgtcttaacagttgtttttctgactgtgtggaag

SEQ ID NO: 40737 - DNA, 201 bp, Bos taurus
aatgatctggaagcattcacagctgtacttggcactgctaattgggcattgggacagttttacagttaacctaggatatgagggtacaggcttggatatargatgcatatttctaagtcaagactaacagatagggtaactagtctcctggacactggaaatatatcagtggaagtttttattgtttggggactaacagag

SEQ ID NO: 40738 - DNA, 201 bp, Bos taurus
gttcttgaggccaactcataatttcttcgatctatgtctttaaaaacatatatctttgcagcaagaaaagactgtgtacactcacttgaatttgctttccrttctgtaaaaggagagaatacgttctattgtttgttaaaatattttctttacaataatttcttgtattttaagggcaatttttaaagtttttgtttagga

SEQ ID NO: 40739 - DNA, 201 bp, Bos taurus
ttatttattttgtactcacagattaagtgagtcagaaatctggacaaggcatgatggaaatgacttgtttctgctccagaatatttggggccttagttggraaaactcagtgacaggagatgagttttggcagattgagggctgaatcatctatttgtattttcactcatgtgtctggtataggctgtttgttatctgggt

SEQ ID NO: 40740 - DNA, 201 bp, Bos taurus
cagccactacagcatttttgggtcatttccctcttctgggtgtggggctgcaggagctggggttctgctacccttcattattagagaagcccttcagaaaygtactagcagtcacttgtaggtatcttattttcacattgacttagaccgttcttaccttcaaatagctcaataaataatttatttctgaattctgaagga

SEQ ID NO: 40741 - DNA, 201 bp, Bos taurus
gatggggaagtctgaggagagagcattttaggtgaaggaaatagtaagtgcaaagtcccaaaggcgggagagtgcctggagtgttcagtaaaaagcaaagrggctagtgtggtaggagatggggttggggagcgagccagaggctcaaagggctctgccctcacagttagaccttaggcttttcccctgagtaacatgaaa

SEQ ID NO: 40742 - DNA, 201 bp, Bos taurus
gcctgtgcctctttgtggctaacaccatccggccaatcagagccccggcaacagtgttctgttcctacagctttgtccattccagaaagtcccacaaatayttagaataatatagtatgtggcctttgattctgacttttctcactcagataatacttctgagactcacgcatgccgctgcagatattagtagtccgttgc

SEQ ID NO: 40743 - DNA, 201 bp, Bos taurus
gcagagttggatgtgactgagcaattgagcacacacacaacccttgctttgaaagctattccttcaagcctagtaagtactaatagcattcgcattcaccrgttgctcaagctaaaaacctgaaagtcatctttgtctttgctttctccttatgcttaatttatctgcaatgtggattcaatttccaaaatgcatcttgaa

SEQ ID NO: 40744 - DNA, 201 bp, Bos taurus
tgatatctattagtcttctggtcttttttatctcttctcctctgtctcttaaatgcaatccctcacgattgtacttcagaaaagcacaaattccatttctmccagcaatattctacagtgcctattttaccacattcttgtcaactgtggacattgagcactttgaaaagtgatcattgacagattaatccattcatttca

SEQ ID NO: 40745 - DNA, 201 bp, Bos taurus
acttcgggtatcactgttctaagtctgttaagcagacaaattttgttgctctgttgttgatttgctttcctttgtctacggtttatagtcagaaacttgcyaagtacttacacccattgttctaaatacttgtacccattgttatctttatatattgactctggtaagtaacatacctctttttagagacaattcttatat

SEQ ID NO: 40746 - DNA, 201 bp, Bos taurus
atttttttaagttttacagaattaaaacaggtttcatacatttttgtttcatgaagttatgatgaaatgataaaatatgatcttctagccaccattgattytgttgtgaagaaaacaggacaaaaataaatttactatgtaggctattccccgggaacaactatagatatggtaagaaatacaaaaactgattatggtata

SEQ ID NO: 40747 - DNA, 201 bp, Bos taurus
aactcactccagtattcttgcctcgagaaaccccgtggacagaggagcctggcaggctacagtccatggggtctaaaagagtcagacacaaccgagcaackaagcacaggacaggtttgtggtaatttgttacagcagcaataggaaactaatacagagactaattctcatatgaagtgatataacattatttaaaaccat

SEQ ID NO: 40748 - DNA, 201 bp, Bos taurus
atccccgtaccacgggtgtccccagagtgaatggtctgcagacccatagtccaagactgagacacaatccaggccttttactacttcttcatatgagatckcaaagactatgatgctttccttagcattaattcaatctgggaaaattttaatctctgtgcaatatccagggaagtctcaccatcctgagaagaaaaagaa

SEQ ID NO: 40749 - DNA, 201 bp, Bos taurus
acatggaaaagcactaaatttttaacttgagatatctagcttttttttgttaacagtaatcttttgttcctactcctgcccttgcttgcaaagctcctatrtatcctggcttccccttcacctccttggagcagttttctcagggttacttgagatgttgccttctgggcttaagatcctcagagtgtctgctgaataaaa

SEQ ID NO: 40750 - DNA, 201 bp, Bos taurus
attaggaatacaagatgggagttatgttattttataacttgcctttttttcacttgatgctgtaactcggacaacttcctggttcagagcatacagatgtmagtcttttctgatggcttcatttactatagaaatttttttttcaaataacctgcatatttccatttcctcctacatatttcagtttccagaattataata

SEQ ID NO: 40751 - DNA, 201 bp, Bos taurus
gtaaggtatgaaaaatacagcggctgaaattttgccccaagaactggcactttattactccctggctgtgggtgtgaccttcacctcagttttctcatttrcaaaatgaccatgaaacctactcaatcacggcacaagattcctgagctaaattttatagaaagacttaaattgctagagtactttgaaaactttaaatag

SEQ ID NO: 40752 - DNA, 201 bp, Bos taurus
ttttattcttgcactgagtttatagaaggagaaaagtgagatagaggcaaagaggactcaagattttgatgttgtctgtaagtaagtttctttggaatackaaacaagtaatttacctctaaatagttcctaagagtggaagtgtcagcatttcaaaggaacctctctgaaggctaccagcactataccacagctgctaag

SEQ ID NO: 40753 - DNA, 201 bp, Bos taurus
acagctttgttttccttcacaagcagttgggtatagtatagaagaactctgcctaaactcctaggtaatctgaattgtagactcagttgtatacttactcktggtgtatcctagttccagtgagtcagtgataagatggtcataaacccttggcctgccttttatatttgtggatcattgatcatcaggtccatgaaggca

SEQ ID NO: 40754 - DNA, 201 bp, Bos taurus
aattccagtgatgatcccctgagaaatacagacctaggaacctgcagatgtgcttccaggagccttgagttctctagaattatgtattacattgagcttgygtgtaaatttttctaggaaacagcccatccttttcatcagcttttctaaaatccaggttggaaatgaattacaaatcacctccttgaagagtattgattg

SEQ ID NO: 40755 - DNA, 201 bp, Bos taurus
agagaatggttcactcatttttctgccgtagaacattcccaataggtgtaaagagcaggtatggccacaggtgcatagaggaaaatgaaaacaaaggccaytgcatagagaatatcaaggaatactgacatgaggggacgacctgagtaattgcactaccatcttatttacacagcaaaagggtctccatcctgcctgtga

SEQ ID NO: 40756 - DNA, 201 bp, Bos taurus
gaagaaaataataatgagtagttttattttggttgctttgttagttagatgcctaaaattccaataattagttttattccataggagccatcttaaggaayagtttctctttgcttcatgtaaaacaaaatgattatttcatcctatgaacaagggttggttaatttgatgactgcagcccactgttaacatgttcatttc

SEQ ID NO: 40757 - DNA, 201 bp, Bos taurus
accctatgcaaaatgggttctggtccaataagcttgagaaatattgcaaactaaatcacccccttgaacactgacatttcatgtgagtacattgaggctcytccttcagtcattatacttgacacacagtggctttcattcagttctttaatcacaccaatatattttaggatgttaaaggagtgattctttttgcctaga

SEQ ID NO: 40758 - DNA, 201 bp, Bos taurus
acctcagactgactccaaggacaaaccaaaaacttgaggttaaatgctgcctgctctgatctgaatgtgtgtatcctccctatattcacatgttgaaatcrtaactccctgaagatgatggtgttaggagatggggcctttcagcagttcttaggttgtgagccctcatgaatgagattagtgttctcatgaaaaagaccc

SEQ ID NO: 40759 - DNA, 201 bp, Bos taurus
ttcttacagcagcatcaccttctggttttcttccctcctcactggccactccttacctcttctgcagtttttcatcctctatccaatttctctgactgtcrctgtgtaccaagtcttcatctgggccagccctctcctctgcctctagtctttctataggtaatggcttgcagacccaaggctttcagaactacctacacg

SEQ ID NO: 40760 - DNA, 201 bp, Bos taurus
gatctctaaccccagaaagcttgtgattttgtagaggtgacatttaaaaataaacacacaaatgaatatggaattataattaaaatatgttctctggtggraaagagcagggtgctatgagaacgtgtcgtgtgggtggtgatagtgtgataggcaatttgtgtgcctgtgtgctcagtcgtgtccaacacttttgggacc

SEQ ID NO: 40761 - DNA, 201 bp, Bos taurus
tttatgattaaaacagccattatcagcaggaattagtttgacaagattttaaaagataacaatctatttcaacctattcagtcttcatttgaaatcttttrggatatgtaaaaaagcaatagataagatgtagcctccatgttacatgggtaagaacttctatagttgtatatttatgcctttgatgatcttctctcaaga

SEQ ID NO: 40762 - DNA, 201 bp, Bos taurus
atctagctttatttctgagccatttgaaaatgggacacaaaggtttgcatacattagccacttggtaaataccagaagaacagaaaagaaggtgggtagamaggcattttccagcttgaaaaaaattgtgttgatgcgcttcagagaagaatatggttccaagtgtatggtaactagatgcaaaaataattataaaacagt

SEQ ID NO: 40763 - DNA, 201 bp, Bos taurus
taaacaggcttgtgggtttgtagccatctagagctggcagctctagatcatcatgaggttccaattctagttcagagtgtaagtaaagttatggttataayctctgtcacagaaaaaataaatatatcttggcaacacattagtagttttgctgatgagaatgaacagagtgaagaggggaaatctcattaaacttgaaag

SEQ ID NO: 40764 - DNA, 201 bp, Bos taurus
atcattcacccccactttacggatgaggaatccaaagctcagaaaaattaagtgtccacagccatatcacactggacttgcacccaggcctgcatgacttyagaaaccctgtgtctgatcccaattaacaacgcttcttatataatcataaactttatggataacatgaaatgacaggccatgtgctaaacaatcctttaa

SEQ ID NO: 40765 - DNA, 201 bp, Bos taurus
agttagcagaagttttaagttgaaaaattttaatcaaaaaatagacatcagatatagcagctatccaaccctagtctcaagagagattttttaaaaagtarttttaaggggagccctcatgatagtgacttcatggtggtgatttaccataaacatccccaaagttgttcagtagtcaactttatcatccgtgaatatcta

SEQ ID NO: 40766 - DNA, 201 bp, Bos taurus
atacttgttagcatctcatataaactctatattgtcacaccccatggtcatgtccctgttctcatcttattcatttttgacatagcaggtatttctcaaartaaccttttttccctacttccttatctatttctctccaatctcacttggtgttttttacctcttcaaggctgcctggggctgctggtctctcatcccttc

SEQ ID NO: 40767 - DNA, 201 bp, Bos taurus
caaatagacatttttccaaagaaacacagatggccaaaaagcatatgaaaagatgctcgacatcactaataattagagaaatgcaatgagacacagcttcmcatcagtgagaagggccatcattgaaaagtctacaaataacaaatgctggagaggatgtgaagaaaagggaagcctcttacattgtggtccagttcagtt

SEQ ID NO: 40768 - DNA, 201 bp, Bos taurus
aatttaccctttctcctgctgtaggacatttgtttctaaattttcattattttccaaacttttgtttccttaaagctatatttctaaagaaatccggactygatgaaaggcataacattaaagcatctgacatgtattagcaaaatttttaagcttcagcagtttgtatttcctaaagaattaaccttctaatatgaaaac

SEQ ID NO: 40769 - DNA, 201 bp, Bos taurus
atccaaaaacaatttatcctgatgtcttcatctattctttcctttgtgcttttaaatttaatcatcttactctcttatagtcatactttaccagaaagagraatgactgggttttttctttctctcaggtgaaaattgaatgagaccatatgtgaaatcatttgtgtaatacttttgttctccaagttcaagaggttaaga

SEQ ID NO: 40770 - DNA, 201 bp, Bos taurus
tggagattactaaaaaatatatattcttttaactatcatgtgatccagcaatcccacttctgagtatgtatctgaaggaattaaatcactgtgtggaagarataacctacacccccacattcactgcagcattcttcacaatagccaagatatggaagcagcctaaaagtccatcaacagatggtgaagaaaacgtgtgtg

SEQ ID NO: 40771 - DNA, 201 bp, Bos taurus
agctgcacagtggccaaggcgggaaaaggtgaagatactaaacttaagagaatttaaatttcttgtccaaagtcgttaacctagtaagctgcaaagctgcmtttgaatcttggcctaattccaaagtccatatgcattccactcccctgcactgccctagaaggccctttcactagaccctgtcagcactcagtctctttg

SEQ ID NO: 40772 - DNA, 201 bp, Bos taurus
aagtatctttagtgcaaagacattaatttacacttctttgcattttctaatgcactttacatgtagaagacctttacaaaattacttgtcaacagagaaakagagaatctgagcgtatgtataataccgtactcagatttctataatcctttgtggtatgtgctacaaagcataactgtcacgtaacaattaagacagaaa

SEQ ID NO: 40773 - DNA, 201 bp, Bos taurus
tgcatggtacctctcagatctcaattagccaccaaagtcgagtagctagaaaaggagtgtgattggagggcatgccatagtttcccttgagaggctcaagrcttcctggggagacctttgtttttctccttcagtggacatgtgtagaggggcagcttctaagaagggatatggccccttttcaagtggctttggagtggc

SEQ ID NO: 40774 - DNA, 201 bp, Bos taurus
gatctagaggtcaggattgcagtacttctgtccaggtgttggggaggggagtttggaaaccccaggtttagacaggccagtgtatttctttcttttttttktttttgttgccattattattattatttttttaattggaggataactgctttccagtgttgtgttggtttctactgtacaataaggtgagtcaattataaa

SEQ ID NO: 40775 - DNA, 201 bp, Bos taurus
ctgtcttagcatttcctcttctttgcggcctcgtttccccacccccaatctgtgactattaaccgcactgccagtcaggacttactccagggctgtccatkcagaaagctggcctttccaagctcagatgccctgaataggcttcaggtcacaccatgcttctacttagctttttcagggcttggaatcttgaaagtgttg

SEQ ID NO: 40776 - DNA, 201 bp, Bos taurus
gccctgtgcctggcatgatagtgataagcgatgatggctattgtctcttcctgagagtgcctgagtctggagcggtttggaagaggactcacttgccaagygagatcctacagggccttgcaagggcattctgatgacactgtggtgaggatgccacactagcataggcaggggataaagagaactttcagctaaaaggga

SEQ ID NO: 40777 - DNA, 201 bp, Bos taurus
gactcagaggctttcagtcctcttagggaagaagcggtggagtgcttctggagtcgtactgccctgggtgagcctgtgctgccgctccatgcagacccgtraaatagaaaggccccctcacttgaaagggcagcctgccatcatcctctgtccactaccctgtgttgttattcttctcagtacaacttgtctgcatgtgta

SEQ ID NO: 40778 - DNA, 201 bp, Bos taurus
gggagctacaaggaggccaacggtggttcactcgatgtaagggtgatctttctatgaattagtagtgtcacacagtgggacagattgcattaggagcagargaaatattaaggccaagtgttgtattttatctttcaggatatagtcaaaactcttcctctgtggatgagaggttgaccagatcaactctatggccctttc

SEQ ID NO: 40779 - DNA, 201 bp, Bos taurus
gggcgtgaccgcgggggaggcgggatcagtgggagatcgcgttggctgggattcaatctctgcctaccttggagccagtcgccgttccctggcgctcactktgtgcctgtccccgggaggccgtcgccgattggatccccgctttcagctctgccgtgagtgttatcatcctcttttagacaagcgcagggagttctagtg

SEQ ID NO: 40780 - DNA, 201 bp, Bos taurus
tcacttgtctcgcttggacttagcttttcgttttccactttctacttgggtttctctgttttggccaataggtgtgacatggatagggggattacaggcckgaggcacgtgaaagctcctgctatttactcagaacggtgtggctgtcacgtcctacattttgcatgtatccgaaggccactcggtgccctgtccacttgg

SEQ ID NO: 40781 - DNA, 201 bp, Bos taurus
cttgcacaaaaagttgtacataggtcactttttgtaagaggcaaacagcaaagttactgtacttcaatctctcttggcatccactcttgtaccacttgtgygctttggagggaccgtagggctcaaagaaaaagaactactggcccagagaatcaagttaaacttcccagcaaagcttacatggtttgttgttacctgtcc

SEQ ID NO: 40782 - DNA, 201 bp, Bos taurus
tcttttggcctcaattttctctataatttattggaactggatcaggtccttccagttctgaaagttctgtatctctgtgttattatggggaaaaaattagyttggatgttaggagatcttggcccagtactgtcacttttatatttctgtgaccttgagaaatcatttttatccttgggccacaacttcctgtctttaaaa

SEQ ID NO: 40783 - DNA, 201 bp, Bos taurus
tggccacatcactctcccagcatctccacgtattcacccacccagaagctctctgaatcccttatcttgggcttttatgaaggcttcattataggcttaaytgatgaaaatcactggccattgatgactgaactcaatctccagccgctagttcctacccacctccctggaggtggagagtgaagagtgagggtaggacca

SEQ ID NO: 40784 - DNA, 201 bp, Bos taurus
ctgacttactggttaaggcccagtgtcagcacgaggatttagcaaataacatcctatcagaatttgaaagtgaaattctggaataaataagcaaaccatgrtcaaaagggctagcaggcccagagggattggggttggttttcctgtttaccccttacctcagccaccctggaatcccagggaagagccaagcagaggacc

SEQ ID NO: 40785 - DNA, 201 bp, Bos taurus
ctcactagccatcccgcggccccagccagcctctcgtccttacactttcccaggaagtcacacaccaggcagtccacatgatcaacaagctgccaggacaygggccagcctctccatgaagttccctgaagcccctgaacttggggagatctcctccttctcacttaccatgtcctgacagccctctgcaaagaagtcccc

SEQ ID NO: 40786 - DNA, 201 bp, Bos taurus
aaggttaaccattggcatagtctaagtatattataaattattgttccatgatggcatgttaaaggtttaattacttttaaaatgtatgctaattttttctraacaagacttaaagcagcagataagcacaaaggattttaactaaaatatacaaagttaaatatagttatttttataaaaatcaagtaatttcatttcatt

SEQ ID NO: 40787 - DNA, 201 bp, Bos taurus
ctgaaatgggggagcctgtgggagaggccgctttggggatatactgaggaatttagtcctggacatacttgaagtttccgacacccatgcagtatttcagyggaggggtggataggaatcaggccatgggagagccccaggcaagagatgagcatatagaggactttttaaagacacaagagtggatgaggacaccgggga

SEQ ID NO: 40788 - DNA, 201 bp, Bos taurus
tggggctgcaggtatgttctttctctttaaattatcccttagggttctctcttccccagaggacctccagcttgggagctggatcttcccaatgtcaccayctttcctgagaccagaatggcaagctgcagaggggcaagagttaggttcaggaatacagagtcaaaaagctaccatcagcctacagtgctggaggccact

SEQ ID NO: 40789 - DNA, 201 bp, Bos taurus
cacaggaacgagccttgggccacctacaaggagactcttccagctcatctctccaatacccagctttccatgcatctccacaacaccactaagctcacagytcagcagtgtggctccaccaggcctaaagtctaataaacctttgctcaagggcttccctggtggtccagtagttaagaatccaccttgaaatgcaagaaa

SEQ ID NO: 40790 - DNA, 201 bp, Bos taurus
gcaaccaacattacccatttcttctgtgctccaaagacacggcgtgcatgtacaagcaaataaacatgctctcctctttttgcacaaacggcagcacaccrtatatgctgctccatacactgcctttttcacttaaacatattctaaggcttccctggtggcacagtggataagagtctgcctgccaatgcaggggacatg

SEQ ID NO: 40791 - DNA, 201 bp, Bos taurus
cccaacaagggcagaggcccagagagcagaagccacaaacccaaagcccagagcagatccatgaccagatcaaagccagaggtcctgcttctggcccagargactttcactaaagctttttgagaccatccgtttcctttttcaaagagacagattaaaccccaaattaccagtgaggtctctgtacaacaaatctatttc

SEQ ID NO: 40792 - DNA, 201 bp, Bos taurus
cataagcagtaagtactaatgcactaatgcacacaggatttgaattcctgtgtgacgccactataacttaagggcatagcaaaatcttgtgaaccatctasagcagagttgggcaagcttaggcctgaaagctaaggatatttttacttttttaaaatggttgaaaactttgtgtttcctggcttagctggaaaagtgtca

SEQ ID NO: 40793 - DNA, 201 bp, Bos taurus
aaggaagtatgccagtgtggaggccatagtaatccaaggacattttaagaaacactgacccaaggataaccagtgatcactataaacacattctatgtatrtattcttgactactaagagtgtttagggctccatgtgtctgtttattcatctgttctctaccatctattaacagttgaacaaagtaaatcctgatatggc

SEQ ID NO: 40794 - DNA, 201 bp, Bos taurus
tgtaaatgtagtgaagccattagccagcatttcctgcctctgcccctccccctcagtgcacagtgtggctgagactcggcaaaggtgaggtcgggaggtgraagggctctgagaggtcaggaatactagtaagtccagagatcagagattcgaggacaataaatgttgattggtttgataggaaggtaagagaagatgaac

SEQ ID NO: 40795 - DNA, 201 bp, Bos taurus
atacagcagcacttaccaacatgcccttaaagggaccgactgcagccatgctgcctcctgattctagaccagcagttcgtttcaaactatcatttaccaakggcctaccaggtatataacccatattataactgtcaaggactgtcccttggccattcccaggctaactgcccttaaattctgtctcaacaaccttaattc

SEQ ID NO: 40796 - DNA, 201 bp, Bos taurus
caggtcagaacgtgggccttgagggtgggcttcggaagatgtctgagctcattttttaattctttatttagctcattttccagggaggccctggccagccygaatcccctaagtctgaagtgcttgtcccagatggggcatgaagtcttcacctcttcccttccctgctgtgcatgcatgcagggctttgtggtggggcca

SEQ ID NO: 40797 - DNA, 201 bp, Bos taurus
tcttcacactccccgaggtgtcttcccagccccagggatgctggcaaacagtggttgagaggtctctgtggtgctccggaggccctggaacccagtgattkacagttacctgggcatttgtacagcttcctggcttgagctatgtctccctgactgagccgcacgcgctggccgatggttggcctgacaccgttgtcatct

SEQ ID NO: 40798 - DNA, 201 bp, Bos taurus
ggaacatgtacactgtgaagtctgagaagcactgactcaaagcaccagaggctttgcctccagcgaccatgcccctggggccacgggctctcctctacccytctgtgcctgtcatggctgtaaggaaaaggtcaagcagggtaattcttcacagaaatgtagaacatgggtgtataggccataggaaagatctaaaatgta

SEQ ID NO: 40799 - DNA, 201 bp, Bos taurus
ctggcctgaagcatctcaacatctagaaggaaaaaggagactaagaatttatatgttgttcttccacacatgcaaagacattttgtaaatggatacattgyttggccaaaaaagtttgttcaagttttttgtgtaacatcttatggaaaacttgaataaactttttggccaacccaataaaagttttgacaaattaagaga

SEQ ID NO: 40800 - DNA, 201 bp, Bos taurus
tctctggcacctggccctggtgcttgatgttgcccttgattaccctccagtgaccttcctgtaattcctgatctccagacggcacaagagcgttaatgatratctcatatgtcaaacggaaggtatcgtcgtcattgccttttgtgcctttgaggtagcacctatcatggccttcaggttagcgctgaagaaagaagccaa

SEQ ID NO: 40801 - DNA, 201 bp, Bos taurus
tcagaattaaggctaaatgcagtcttaagggtggggccctagtctgacaggactggtatcttcataagaagagacacagggatatccctgtgcacacacayaggaaaggccacttgaggacacagcaagaaggtggccaggagcagaggcctccccaaaccaaccccgatggcatcctggccttagacttctagcccccag

SEQ ID NO: 40802 - DNA, 201 bp, Bos taurus
ggtggggggagaccaggtccccaggacctggccacggggctcacctgtcgcctttgccctggacaggttcctcctcctcctcttcttcctcttctacggcrgcttggttgagggcccggtgtttcttggcccgggactcagctttccggatgtttaccaggactttgtggtactcctccggcagcagtttcttcaccagct

SEQ ID NO: 40803 - DNA, 201 bp, Bos taurus
tgcccactgtgtcatggtgcctaagctgggtttcccaaaatcaagacggtaaagtccgttgtgactggaaccatgcttctccttgctgaggctcaaggttrgggaactgaatggagccatgccctttcttgtaaatcagtccatctcctgtacaaacattaattgagcatctactatgttctaggtactattctgaacact

SEQ ID NO: 40804 - DNA, 201 bp, Bos taurus
cacacgcctcacctggccaaaccccagtgtcccccaagtgaacactggtgcacaaacccaaccattgctcatgcctggggcagacactttctcggtatcakgagttgctttccaagggccacgtgatggaagggctgctgctaattcagcattccaaccagctctgcttgcctcagacacttttttttttcaccagctaga

SEQ ID NO: 40805 - DNA, 201 bp, Bos taurus
cacacgcggcccttccatcagtcactcgaggcagggctgacatgagcgttcccatttcacaggcaaggtaactgagtccgggagaggacggaaactgcccrttgttgtagctgatgagctgggccaccgcctcgctccaacaccagatgctagaggccctttctagtgtgtgcccttcctcctccacagccagaggcacag

SEQ ID NO: 40806 - DNA, 201 bp, Bos taurus
aatttctcagacccccaaatccagactttccacatcagaaactctgaggatgaaactcaggaaaatgtgtttttaaataggcctccagatgattctgatgmccattcaagcttgagaatcactggcttggactgtcacaatggtctataatgatcgcctgcctccaagcaacccttcagtctggccaccacgactgccttc

SEQ ID NO: 40807 - DNA, 201 bp, Bos taurus
ctgctggtggttttggttccagactcagggagaaagatgctctgaagtaattaggctgacaggccaagatgcagaggccgggatgagaggcagaaggccakggagagtgatcctagccatctttggactttggctcctgtcaatcctgacgtccccacccctgcccctgtgtctgctttcttgaggatcagatggccagat

SEQ ID NO: 40808 - DNA, 201 bp, Bos taurus
actgccagcagtgctgtcattaatgggatagttggtgctccagccactgcaaggctgctgggcaaggcccagaaccagggccctggcctgacctcttcagrgctcagatggcttcctggactctgggacttcccacttggatcagaacactgggggatgaccttcttctctccaatgggcacaccctgctctcttcaccct

SEQ ID NO: 40809 - DNA, 201 bp, Bos taurus
gtgtgatgtgattaaatttttctggttatataaataggcctgatggcagtggggaggaacccacagaggtgctgatggcagttgggaggaacttgcagagrtgctgaagtgctgggcccagtaaggaagcccacgctgtaaccaggtaaaaaatgagacgggtctgatttaaatctctggcggtgggtgtgaagaggaaac

SEQ ID NO: 40810 - DNA, 201 bp, Bos taurus
cagatagaaacagcattttaggattatgtgcaaatacaaaatttcagtccatcctggttttaatcactctccttgatgttggtagtcatgtctccctggcrtatccaaggtgcccatacttgagtctagtgaggatatcactgacacactgtatatagtttatatgattctaataacttcacattccactggatacacaaa

SEQ ID NO: 40811 - DNA, 201 bp, Bos taurus
atcaactacgtttggcgttgcccctgtgcacagcattgtgctccctaattaggaagactagcgagagagcaggattttgttcctctttttaagatgtacartctggtagagatatctgccttgagtaagaaagaaaatatgaacctgatattttaagcagttttttcttctcttcacttccgaagattttaagattaaaag

SEQ ID NO: 40812 - DNA, 201 bp, Bos taurus
cagaccaagcagatgaatacaccctcttagaggtaaagtaacttcaagaataaagcattatttgaacctcagttctgccacttgctactgggaggacctcrggcgcattgtttttttctctctgactctcagtgatctcaacacctaccatggaaatctcttgtgaggagggagaagtcatacatagggtatgtgggacac

SEQ ID NO: 40813 - DNA, 201 bp, Bos taurus
tattttagatttttcttcaaacagcatttagttgaacttcatttcttcttatctgaaaatttttgtcttttaattgaagcatttgtcctattgacaataayattacaaataattttgtgtttaaattcatcattttacagtttgctttctattagttccaccagttctttgttgtctttttcttctttcttgattttagat

SEQ ID NO: 40814 - DNA, 201 bp, Bos taurus
agcagagtatttttgaaagaaaaccctcagcaacactgaacaacctctctgtgccgctccatgtgaggacatggggctggaagaccccaggcatatcatgyagccactgactcattatcttcatctgcatctgccaggattccatcttaaaagatatttgcttgaccagcctgatttgcccttcacaaatgtaataaagaa

SEQ ID NO: 40815 - DNA, 201 bp, Bos taurus
acagcatactgaagatcctaacaagttaaaaaaaaaatagacaaaacccacaaagaaaatcaaaagtacatcgctattagaaagaaagaaaccaattgatyataatttgtaagcaatacaatgatctatagaaaagctcaatggctcagtgggtaaagaatctgcctgcagtgcaggagacacatgggttcaatccttggg

SEQ ID NO: 40816 - DNA, 201 bp, Bos taurus
acaggccccactgagttcaacctttgagtcattccagcccaggcatcataaatgtgagtgaagaatccaggaccagtttcaaagacatgtaaactatacartcacacaaggcccacactcagaagggcctatggttggtttaatctctattattaccaattacatctttgaacttgtgttttataagtgaagtccaaggga

SEQ ID NO: 40817 - DNA, 201 bp, Bos taurus
aggatctctgcctgcagggtattggtgttggcccactggcgagcagccagctcctagtgcagctggctgagggatccagggcatcccaaaacttgtatcarcctgctagtgagtggggccagatcccaagacagctggctgagggacctcaggtgtctcagagctggaggtgaccaactgatgggcatgctgggtcctata

SEQ ID NO: 40818 - DNA, 201 bp, Bos taurus
atgcttctcttgccccacatgtatctcccctactgcttgcctcccagtggctgttttctaacttaattcatacagagtcctttctgccacagatcactttrtgtagcaatcataccatgactcatgtaaaagaagagagtaaacaccatttgttatttatctactatgtattgggcaggaaactgaccacatgggtcacaa

SEQ ID NO: 40819 - DNA, 201 bp, Bos taurus
ggcaaccacagtcagattccccacacgctcatctaaaaagaaggacaggtgtcagccctggggctccagcgggggtggggccggggtggctgggctgtaaygcaggagagcactcactgtagagcccgaagtttttggagaaggactgggcacagaagagctcgaacccttcagacacaaaatagcgaatggcccaggcgt

SEQ ID NO: 40820 - DNA, 201 bp, Bos taurus
ccttgacatcaacaatatcaccactcctgtatttgatagatccacatgcatgtagccaaagaagcaactccatgtttcctaaaaggccctgaggatgtgtratgggtgcttctcccctttccctttgtgttggtcatttggcaaattactagaagatagcactcctggccaaaaataataataattttaaaaagcagttaa

SEQ ID NO: 40821 - DNA, 201 bp, Bos taurus
cccttgtcctctcccagatttagccccctgtgttttaaggcagtccctgaaacacttcccagctgaggtgatctcaaagtgaaatggccccttaatctagyaggattggcaggaaaaaagaggagagaaggtcaatccaacctgctctagcctgtgtggagtgggggagggggtcaggcctggtctgggagcccccatctg

SEQ ID NO: 40822 - DNA, 201 bp, Bos taurus
gccgtagccactcagaggttagtccacctgggctccaggcagggtctgggactggtgagactcaggtgtccctggacagctaggaccaggctctttggtcyccacgagggcctgtccttgtcctggactctgacaactgcagttctcccggcgtgtctgcagcaggacccaggtgttgggctgagtgtggtctgctgcagg

SEQ ID NO: 40823 - DNA, 201 bp, Bos taurus
ccgacgggatcagcaccagtccatggcctggaagctgggacccctcttctagaagcatttctaacagaggaagttacagattgtttacaacaaaaacagtrtttatgtaaatatatggagtaaggaggtagctgcccaaggtagtgggacaacacttaaattgaatagctgtggtaatatttctaagtcagtcacattatt

SEQ ID NO: 40824 - DNA, 201 bp, Bos taurus
tgaacatacagagaaatgcatttttaagtcttgacagtacacttaaagatactgtccagcaaattttcactgatttggccattttcatgttctcagttcayaaaactgtctataataataatagcaggagtccaaccataagttataagaatgcatttggtattatgaatttaaataaattcctagtaaaaggccaccata

SEQ ID NO: 40825 - DNA, 201 bp, Bos taurus
gctgccactgtcatgaaagtgaagaggcctacatggcaaggaactgaggactgatggtctgagtgaacctgtgggaccagatccttgattgagccccagaygctggcggcccagataacagcttgactccaacctcatgagagacccagagccagaatcacctacctaagccactcccagattcctgaaccaaaggaaatg

SEQ ID NO: 40826 - DNA, 201 bp, Bos taurus
aacatacacttctttatcgcacctgcatccctgctggtgggtagtgttccaaggaagcaatgccctctccacactcactgttttggggcaagtatgtgcaygggtgaataattacatagctgtttacttctatttttgtaaactagattcctcaataggtctctacagtttatatgtccgtagatatagtagattactttc

SEQ ID NO: 40827 - DNA, 201 bp, Bos taurus
gttaaccttttttagcgaatttaataaatgataccttccttaaaccagaagtgtggtaagtagggaaatagtctgcaacttaaaatacttgaaaaattacwaacactcacatgaaaagatgcttcgatttaaaaagcaaaggtcatggaaaagaatttgaaaaagaataggtgtatatatatacggctgagtcccttcgct

SEQ ID NO: 40828 - DNA, 201 bp, Bos taurus
ttccaccccctgatctccactgacagactgactaccgggaacatgttgccccaggagactgaaatgctgatctttcaaaaatgttttgcctccatccactragtagaaaagatggtagagatcagctgtggggagccaggaagagccaggtgaaggaccactcactgcgcctggaagaggagccagccaccccttcctctc

SEQ ID NO: 40829 - DNA, 201 bp, Bos taurus
atgaactggacctcgatagatagagtcagggtgagaaaggggaagcatacaattgtggtgggagcagggacaagaaggggcctatgaatggtgctcagggyaggttctgatgtgattctaccagctgttcagggagagatgactcctgccccaggccatctcttggggcagtgagtaagtgactcacatctaacccttgct

SEQ ID NO: 40830 - DNA, 201 bp, Bos taurus
gcttcctgctactatacaatgccggcgagcaacagcaccttggccaactcttaaaacaggagtcggctgacttatttctacaaaaagccagatagtaaatrttttagcctttacaggccatatagctactcaactctgccatcgtagtatgaatactgccgggagacaagacataaataaatgggtgtggctacagtccaa

SEQ ID NO: 40831 - DNA, 201 bp, Bos taurus
cccagagcctcactctgagcacagttttgtctcccaagactgcgttgacctttctataaagggctgagatcagaccaacgtgatgctgggagtgcaccagragaagcaatagctgggtaggtcaagttctgatgcattgtgagtacatactcagtcgtgtccaactctgtgactccatgaactgtgcatgggattatccca

SEQ ID NO: 40832 - DNA, 201 bp, Bos taurus
acagtcctgaggttgaccataagggccaaaaggtagaaggtggcccaattcctagcaatccctgccccttccccaaaatagttggtataatcttatccagyccataaaactaagcaaaccgcagggcccctcatcttctgacatggcctacagtctatgatggcctggcatgcggcagtccatggagtcacaaagagtcag

SEQ ID NO: 40833 - DNA, 201 bp, Bos taurus
aaattcaagctacagaacaggcacttaaagcatgttacataagagaggagcagcttcatctggggcgtggacattagccaaaatgctggccttcagtgtcyctagaccaggcaggtatcaagagcccatgtaaatccagcccagagtagggagacacactgtggtcaggctcactggcagcccttccaacctccagatacc

SEQ ID NO: 40834 - DNA, 201 bp, Bos taurus
gtggggtgagaagcacctctctgctagacgcacaaggccctgggcacacagggtgcctttcaccgcctgatgtcagacttgcttctctgtgccctcagcaytcaacccctcatgcttcccaggcctgtaggattttctggtcatgtctgggcagatctttctctctgcgtctgctgaaacctggaagagtgagattcgcca

SEQ ID NO: 40835 - DNA, 201 bp, Bos taurus
aacagatgagatctactttcctcatttaggcatatgaggaaggttgtgggtcccttgctttctattcaccccatgtcagtgtgggtaacatgtcagaagcrggaccccacatagctactaagaaaggataattgctcttcaaacactgtaaagagacagcaggcaaagcacaagggttgggacagtgcaacaggacacctg

SEQ ID NO: 40836 - DNA, 201 bp, Bos taurus
gggcactgcaaaatcccatggcctttcaaatctgtaaggagaaggaagtaagagcagtcaacacaagtggtaactggtcggtgggtgacaggtaagcacartgtcctggccagggacccagtctgtgcgctttacgatttgtatttattacacaaatagtgttgccagagccaaagagaacagtttttaaaaaaaagtgct

SEQ ID NO: 40837 - DNA, 201 bp, Bos taurus
ttataggaagactcaaagcacagcacagggtgaaaaataagcctatagcagtcaaaactgttgtctgaaatgtcttcagactggaaggctgaatttattgmacaaaacaagtactagcgaggcggaggtgtgcagtcctgctcattatcactggaaaggagaaccaaaaagccgagtaaaaaattaaattttaataatgcc

SEQ ID NO: 40838 - DNA, 201 bp, Bos taurus
agtggctgggtttccccccaagtggaggaagggggtgtatttgatgtagggcaagttcaaaaccccaaaagccttccacgctggtaggtcagatttcactygcaaggtggggaaatacaacatgtgaaacgtgaaaaggaccaccaacccaggaagtcttattccgccgccgcgggccagcctgaactcttgctttgactg

SEQ ID NO: 40839 - DNA, 201 bp, Bos taurus
acacgactgagcgacttcactttcactttcctacagctttacagggaacacactatttctccgtccctaaacattgggctgagtcattgatttggccaatkcggacacaacacgaataagatataaatgtgcttgcacatttggcttgccacatgccatgaaaagaacctgccctatcaagtcactggtccaaggaggata

SEQ ID NO: 40840 - DNA, 201 bp, Bos taurus
gtggccacactgggagagaagtctcggggcgcccctttgctaccccagccttcaacacaccacctgccccaactcacacactctcagctcgataggaaatkcgccactttatggcctcgcgtaaaagtgccattctgaataaacacaaaagcgatcaaatgctcttgagttgttggtcttaaatatcagtcatgcttcatc

SEQ ID NO: 40841 - DNA, 201 bp, Bos taurus
gggaaaaaagaaagcagtttccatgctttgctcctgtggtcatggggaattttgaacatgaacttgaggcattttcatgaaattcctgttttcatattttyagtttcacaagattttctcttctgactcctacttgacagaatcatctttgccctaaagtgctcttatttctggtctttgggataattaaggaacagccag

SEQ ID NO: 40842 - DNA, 201 bp, Bos taurus
ctgttatcctgggaaattattccctaggagcttccgttttgtcctctgaaaatacagggacagtggcatcagcacccagagggatgtgggatttaaatgaratgttcgtggaagggcagagaacagctttcaggcatctttgcaccgggccgtctttgccgttcagtgttccgttgtagaaagtgagacctcacggggctt

SEQ ID NO: 40843 - DNA, 201 bp, Bos taurus
tatcatggccagtagctgtcactctgggtcactccacaaagggcgtggtctttcctcctcccacctcagccagttttgccaatctgactggccagcagctkggacagatctttctctgctgcatacagatgggcaccaacctgatcctgaaagctgggcatgggcacactgccaggccatcagcatcagctttctcaacag

SEQ ID NO: 40844 - DNA, 201 bp, Bos taurus
gccaggggccagtgaccttcctactagatgccaaattctatggtaagtgctttacctgtgttatcttatttgatttctagaataatcttttgcggaagatrttgcaggtcctcaggcccttagccaaaaattctcggggtctgttgtgttcaaaattaagccttttcctctcagattttagaaaaagaataatacggtata

SEQ ID NO: 40845 - DNA, 201 bp, Bos taurus
aagtgcacttttctagggaaatgggtgataactgagtaggaacaaagtaaaggagaagggcaaagggggtatgagatgaatgctgggcctctgatgattgmtcaagttcaagttggtgaaagatctgcagtgtgcctgttgctttaccaagtgtaatgactttaccaagggtaacaatagcttatctttcaaggatggcca

SEQ ID NO: 40846 - DNA, 201 bp, Bos taurus
tttggccctgggtttgcagcgggcaagcagacccacatgctagtgtggtctctgcctcagacattcacactctgaccaccactctcagtcgccgcctttaygtgccaggtcctgtgtttggccctgggtttgcagccggcaagcagaccaacatgatcagtgtggtctctgcctcagacactcacactctggtagggaaac

SEQ ID NO: 40847 - DNA, 201 bp, Bos taurus
ctattaaaccctaaggccccgtttcccctcccctcagcccctggtaaccaccattctgctttctgccttgtgaacctgattaccctaggaacctcatataygtgaaatcatagggcctcttttctttagtcagagtcttgtttcacttagtgtgttttattttctttaacaaatacttgcttgatactcatgtggtctgct

SEQ ID NO: 40848 - DNA, 201 bp, Bos taurus
aaattttaatacttaataatgttcaacttttaatttttggcatttagatggtcttctgattgttggtgttcactcggccaagtttccaaatgaaaaagtcytggataacattaggagtgctgttcttcgatacaacatcacccaccctgtggttaatgatgcagatgccagcctttggcaagaactagaagtttcctgctg

SEQ ID NO: 40849 - DNA, 201 bp, Bos taurus
aggtgttggctggtttggccagcagggagatggtctggattgttcggcaaacaatatgtaggagtgccagcagaggggcaagtggtcagcaatcagcagcrtggccctgcagtggctactttgtacgactctctggaccacatgtaactgtgtgtattcctgcaggggttttgccttccatgctgagaaggctatagaaag

SEQ ID NO: 40850 - DNA, 201 bp, Bos taurus
atcactccccactccttaagctcaggctgtgcttggtgacttcattccagagtggacagtatggaagaggggtgggagagaacctttacagtgaacaaatytgaaaagcactacctcacctgggtgatcgaggtcaacatcaacaatcaacatcatgttgagagtgtgtacttctgatatgatgtcatgacaactggcact

SEQ ID NO: 40851 - DNA, 201 bp, Bos taurus
ctgatgatgcagatgttctcctgatatttcttcataccttagtgagaacatggccatctggaccccatctggagatattgttgggtactcatggcccacakaaatctacattcctgtctccctaagcttttgcatgccttttctacattacactaggaaattctggcatctcagctcattggatataggccaccattgagc

SEQ ID NO: 40852 - DNA, 201 bp, Bos taurus
catccttgctcaaaatccacgtgctttcagcagtagtgttactgtttcagaatgtcagctgctgagcaatagttttgtcatgctttgccttcaacattgtrttatttttagtatgaattatatgcagtggatttatgttatctttttgtgctatatgtttctagttattcaccaaacctttgacagtagtaagtcttcaca

SEQ ID NO: 40853 - DNA, 201 bp, Bos taurus
gatttattttgtacattcttagcaagatgtgtcccatgctaatatcccctttgttttacaccatttcaatttaggaaaggtttcatagactgttctgcttyagggtgtcctaggaaacctgtctggcctatttttgcatgtctctagatggtgactgcagccatgaaattaaaagacgcttactccttggaaggaaagtta

SEQ ID NO: 40854 - DNA, 201 bp, Bos taurus
acagcctatctgtgtttaaatctcagccctgctactttctggttttgtaaatttaagcaagtttttttaatctcttgcttcagtgttcttagcttatccakttgtaagatttaaataaattaatatatagagagcactttgtacactaatccataggaagtacttaataaaagtactagcatcacgtgtaatcatttttat

SEQ ID NO: 40855 - DNA, 201 bp, Bos taurus
aagaaacatgcatggccccagagaagcctgctttcctcccagcttgctgcaccctggtgaaccagggcagccttgctgacactcccaattagcaagcaccrgttcagaatgccaagaggccatggaaaatggaataggagatagaagatggcaccttcttccttataaggttgataattcatattttaaataatctaaatg

SEQ ID NO: 40856 - DNA, 201 bp, Bos taurus
tttctttacatgcggtgcaaggccatgattggtgggatatgttaagcaacatttgggggttaaactgaaaaggaagtctcctgttagacagaaccatgaaraccatatgggacagtactcaccatttttcctcctagatatagaagctcaggagtcttctcatcttagcatttcacactcatttgcacgtcgtcgtggtcg

SEQ ID NO: 40857 - DNA, 201 bp, Bos taurus
aacagtccacacttcagccacagtgtgctggcctcttctagggcccctcctaagtctcagtgccccacagggcccatgtggctgcccactccttctcgtcytcagctagcagaccccgaaagcagggtgaggcccattagccttggctatcacccggtcaaccttccttatttttgttcagttgttgagtcgcgtctgact

SEQ ID NO: 40858 - DNA, 201 bp, Bos taurus
cacctacactctgctcagcgctattctaaacactgggatgtagggatgaacaacacagcaaggccctggtacctgagtagtttatattccagctggagagrcaggaaaaccataagcaaacaaaaaaacgaacaaatgatttcagacagtattgggtgctatgttagtttcttaggactgttacaacaaatgaccacaaac

SEQ ID NO: 40859 - DNA, 201 bp, Bos taurus
aggcccctgcagaaagctgccgtggccaggaggacattttttttttttcctatgctccaccaaggggtaattcttttaaagttctcacatttgttttgtaytgatcagcacttgaggccagagcactcttctggatctcttactctgtactgtgtactatgttccccacccaacacatactcccaactctttcctctctca

SEQ ID NO: 40860 - DNA, 201 bp, Bos taurus
cttgagggctgtgctctcctcaacccactgcagtctggtttcttccccagtcctgctagcaaaaccactaagaccaccaacggcttcttagtgggactctyccaggcctttcccatctttgctttccttggcccctctgcagaatttgactcgctagcctcctcactggtgggacaccctcccttggttcctgtggtttcc

SEQ ID NO: 40861 - DNA, 201 bp, Bos taurus
gacagtatgaatagcctcagctgtgttggcagcaaaaatactgtgactacacaactgagagtcaccagaaggctagctgacgcatggctggattcacaagraacagttggctgacaaaacaccttctgatcctgacttgatgttggaaaaagtggtgacatttttaataggatcatgttgtggctgtggaagctgtgtttg

SEQ ID NO: 40862 - DNA, 201 bp, Bos taurus
gccctggccatgaacccacactctggacggggcagcaaattcagtcaacaggatacagactctgcagacactcctaatgccagctctgtgccaggcactgractgaggggaagcggcctaccgtgaggcagtgctcttggcatgccagcatgtaaacaaacacagccctgctgccctctgcctgccaaaagcaaggtgcat

SEQ ID NO: 40863 - DNA, 201 bp, Bos taurus
cctccagtgggatgtaaccaatttccttctgctgaaactatatagaagtttctgtaaaagcccaaagcccttgttgtggcctcgagatcctacatgattgyatccctacctacctcccaagcttcatctattgatcatttttctctgactctccaaggccttttaaataaacttcttcaaataatccagcctccatcatgc

SEQ ID NO: 40864 - DNA, 201 bp, Bos taurus
ctggaggactttctctggccactaaagtgcaggcatgtgcagggcaggttagaagtgccaaggggttaacactcccgggtacatccctgaactgatgaccygtgggagtgggtggacatatggccccagcttcttgcccctctcatgggataactttggaccacattcaacactgtctccccgagctccccagggcagtca

SEQ ID NO: 40865 - DNA, 201 bp, Bos taurus
gctggaggggaaatccagtctccttcaccttgtgtttccctcttgagtcagtcgcaatttcccatttggtgctccttttcattgccaccgtggccatcatygtgggattgtatgtgccacgtggctttctcttctcttccacctctggtcatggacttcccaatagacagccaaagtggtttccttcagggttggcttggt

SEQ ID NO: 40866 - DNA, 201 bp, Bos taurus
ttttagtcattgaagatattggctgagttcaaccatttgccgtaaaggccattccaaactttaaatctatatattgcaaaaactgaaggactgtagttagyggggatgatgttaagtgtggccaaggacactgcggcaagttttcaagcactgagtttctatttcaagatcatagacttactaaagagagtgacaaatgct

SEQ ID NO: 40867 - DNA, 201 bp, Bos taurus
ggaatcttcttaccagcttcattttcacggcccaccctggtgggatgttggcttcactcgttttcatgtaaggacatccttcatctttctttttgggggcrttgcccccttgggccctccctcacacccaaagcgctctccttttggtgtgaaattaagcagatggagtcagagcagagccttgcagggtacggcataatt

SEQ ID NO: 40868 - DNA, 201 bp, Bos taurus
cttggcatctggcctaaactcactgctacctgaaagagtgccaacctgttcagcacatttgaatttgcaaataatctcttatttactctcagagtatccaygaagctgaagcttgtgatgggtttttattatgtggtaataagtactgttggggaagatctatctttgcaaagcccaattagtgtatttatttattaggct

SEQ ID NO: 40869 - DNA, 201 bp, Bos taurus
cggtaagtccatctgtccttcctctatcttgcctccaaatgggtccaacaaactgctgggcagaaacaagcaaaatttagttaaggctcacagagaacttkaatttcaggaaggccatgctcactaattcccaggaagatgccttgtttaggggaggagttgggggtgggtggatggctggagcgggtcaccctgtggacc

SEQ ID NO: 40870 - DNA, 201 bp, Bos taurus
gcaatggacatggccatgacctgctgctttagctagttctgcgagcccagtgcctgtgcattaatgattagaggagaagcgggtgatgtccagaacttcgyggaggatgttttctcataatggccagttggttttacatgataccttgacagatgaaaataaggactatacccataatggtaataatgacagtaatcatag

SEQ ID NO: 40871 - DNA, 201 bp, Bos taurus
gtggacatggagacaatgctgcctctgtttgtggcccgctgggctctgaccttgctggaggcaaagtggtgtcacagctgcacttgcaggacggtcagtgrtggtggaaaaggggccaacgtggtcccctctcaccctgtctgcctgtctgcaggtgtggcgacctctatttgtatattttactgtatttgtttatttgcc

SEQ ID NO: 40872 - DNA, 201 bp, Bos taurus
ggctgttcactacaagggacacggtttggagcctgacgttagttaactgcccactttttttaaaaaaaaatcagtttcttcagaggaacacaacaaaatcygggggctctacaatatatatcattcatgaatggatactacgcaaaatactaagtacatgaagaaaaaaaatgtgagccaaaaagcagtcaatggagactt

SEQ ID NO: 40873 - DNA, 201 bp, Bos taurus
aaactacacatgaacatgactttggaagaaaaatgccaaggtcaacttgactgcctcttggcaaacaagtacaatcagtggccatcacatactatgggtcrttccatcctagagtgcccagtgctttctcagatccactcggaagggtcctgactcagaacccacagcagagaagtaggaaggagagggccactcagaggt

SEQ ID NO: 40874 - DNA, 201 bp, Bos taurus
tggccccatttgactttctgtacaagggactcagtcattgcctgacccagtcatgcccaccatgtgtaacctcacccctggtcagggcagatcgacccaamgaggtggcccacccaacctgaggctagaatgtgtaagatagccagatgcaaaggaataatccaggtcaattatttctttctttccggaacctgaacacag

SEQ ID NO: 40875 - DNA, 201 bp, Bos taurus
tgatggcctgggagcctggaccagccgccgacccattgcccaccaccgtctctgagctctggttgaccggacttgaagacgcaggcagcagcccattaaawaagtcaggggccgctggaccctgagtgggcaatgaggccatagccacctgtccaaagataatcagagtctgtcacctcccattctctttccgtcccctcc

SEQ ID NO: 40876 - DNA, 201 bp, Bos taurus
ctttctgacagaaaaggaccaccaggaactagactcaccgcttcacccttgctctggctatgctggtgggtggcagaagcgttttgtctgcatttggcctyccatttactcgcaagcattcctgtctccagtcatagctccccacaacatcacatctgaacaacaactcctgaattgcatggctgtaatattgacaaacag

SEQ ID NO: 40877 - DNA, 201 bp, Bos taurus
agagtctgaggccttatctactgaaacaataaaactcaaatccaactcaactactaacatgactgactcaactcctcacactaagagcccaacagaagagyggcaggcccactagtaataagcataaaatcatttatgccagtctctactattgtttccatacacactgtccagcattcaattagaaacaccccaaaaaag

SEQ ID NO: 40878 - DNA, 201 bp, Bos taurus
gggcagctccctctcatatctggtcaacagtatgtgtttatgaaaactgcaggggttttgccatattgttttataaaaatgagtagaaaatggaatactgratggactggtgtgtgtgtgtgcgcacacgcgcgctcagtcatgtgcaactttttcgacactgatctgtagccctccaggcccctatgtccatggtatttt

SEQ ID NO: 40879 - DNA, 201 bp, Bos taurus
gctcagagaccacccagtcagcttccccagccgctctcagctgcacagtccccggaagcaggacgctgtgtggaaggctctgctctgcggcccctctggaytcctctgagattccccctaagccttcaacatccacccacgtagagctgggtctcatactgcctccagtccccagaaaggcccagaaaaccaaaatctcac

SEQ ID NO: 40880 - DNA, 201 bp, Bos taurus
taacctttccctgaggaatacttggttcgtgttctgagtgcagcacacccccctacccccacccccaccacacacacacctgtgtcttggtttctggctcygggcagagatcaatctgtggccagtccccccccagacaaggtttctgaaaagatcgttggggctggaatgttttaggctggtcttgggaagctctctgtt

SEQ ID NO: 40881 - DNA, 201 bp, Bos taurus
caaaggagctcaggactcaccgtcctttctgggcgagggagcgcagaggcacgtattaactgggcatctcaagtctccaggcacaagcagccccaggggayttggtggctttgccagcccagggcctctagagggccctttgagcatggccgtccagccccaggttgcctccggccttcccctgctgccttcacaagatga

SEQ ID NO: 40882 - DNA, 201 bp, Bos taurus
tcacacgagctgatgagatgccagagccgtgaggatggggtgttggacgttaggagactcttctcatcggcagaaacatatttgagaccctggccatcgtraagcacagggtggtccccagggggattgtcctgcctgcccttgggtctggattcagctggcagagttgggcctcgtttgttccctccgcactgccttagg

SEQ ID NO: 40883 - DNA, 201 bp, Bos taurus
gcactgagtaatctgcattcccttgccgcccaaccctgccccccgaccccaatgaaggacggaagcagctggcatcaggggtcagagccaagggccctggytttcaagaggaccaaaccttatgagcccagctggcacatagtcaccattgaaattaaactggttccctcagggcctaaccccagccagtccctcccaact

SEQ ID NO: 40884 - DNA, 201 bp, Bos taurus
tgtagaattattcttaatttctgcaggactcattttaatcactgacctccattatccacagagagaaagtgaaatgactgagttccagagtgaagggcgtrtgcacaaccatcactcagggatgagagtggctttgctgggtaggggggtgaggtgggggcggctgtctctttgtgtttcctcctcatctctgtcaagatg

SEQ ID NO: 40885 - DNA, 201 bp, Bos taurus
acaggacacatgacctacgacactggacaggtgagacagtgattagtcacatgcagtcccagtcccaggaaggaggacacagcatggcatgcatggccatktgagggttgcactcaggaatcgcatgggcaagaggggtgaaccctggtttccatggaaagatgtgataggcctgtttgaataattttgcaggccagaaac

SEQ ID NO: 40886 - DNA, 201 bp, Bos taurus
tgagttgtctgaaccctgagacttggtagcagagagaagtgccaactgctgttcacagaggtcttcctgggatggtgggggccactgtggggagcgagccrcgcagcggggagaaggaggtctgcagtctttgctttgataaatgatgccctgtggggccccgctgtaacactgcacaggctccacgcaggacccagcaaa

SEQ ID NO: 40887 - DNA, 201 bp, Bos taurus
ttgcttccttgatctgccttttgaaatgtggttaaataggggaaagagtttccttgcttgggcagtgggtctcagccaccacttctacaatggccacaggrcacctagctctgcctgacttcctgctattacccaaattctctccctaccccatgtcctgcaccccaggcctggcctaaaatacaagcagtttgatgaaag

SEQ ID NO: 40888 - DNA, 201 bp, Bos taurus
atatttatcatctggggcctcaactcaggtggctttctgagactatttgagttccacttaactactgtacattgatcatttgcaggagaccttttgcccgytggccccttgctctttattctactgagcaattgggaatacacttgactttcaaaggctcaacttgcgccattcaaaggaaaaatgtccacctcattttta

SEQ ID NO: 40889 - DNA, 201 bp, Bos taurus
ttgaggacaagacagcatctgcctgctcctgtttcgggtcactgctgaaatgccacctcctcaggaaggccttgctgaaggcccagtcttctctatcaccragtgctgtcggcttcttccaagacacggatcaccatttgtaatcacacatttgttgagtcatttgttgtctagaacagaagctctgtgaaagggccaggc

SEQ ID NO: 40890 - DNA, 201 bp, Bos taurus
agaggtcagtggtcttaggacaggcaggagataagccactagctatgtgaagtcatgttgactttgatctgctaggccttttggctccgaaagaaaggcakcaatgagccagaggtcctctaatctccttagagataagctgaaaccgcttggctggggtagggggatccaggcttctctctgtgcactgaggccagactc

SEQ ID NO: 40891 - DNA, 201 bp, Bos taurus
cctcccatgcaataccttttatatcattgcttctgccacatcttagatgcctacaggcagctgttgttgttatggcacctggggactctgaggagggagcmtgaaggggactcctggaagaacctaccccctcccctcacttccagcagccccagctacaggtctcagctcctggtttctcatgagcaggaggccagggca

SEQ ID NO: 40892 - DNA, 201 bp, Bos taurus
ttttaaatccatttgccccaattatttggctatcacaagaaaacttaagtgggattatcaggaaaattaccttcatcctttactccctttgtgctcgcacrctgcttgtaggagctagaagagccaggaacatacaggtctcaggaatgcctgtggctgactctcttatcttgaatttattttcttaaggactctaacaag

SEQ ID NO: 40893 - DNA, 201 bp, Bos taurus
taaactgttcaaagaatttgcagattctgagcatggaagatcaaatgttgcaatcgaagggaatgaggatgtttaatctaaccggaaaagaaagctccacrttgcagaaccatcagaattcactgagtctttgcttctatgacaggaaaccaccaagtttaacattagaagcgttcattcagaaatccaaagtcttggttt

SEQ ID NO: 40894 - DNA, 201 bp, Bos taurus
ttttattaatgtgactctccctgccccacttccacaccttggcctgaaaccgatgagcattctccatctgacatggcgagcctgctccacagcctccaaaygctgactgggttggccctgctaagagttcaaagccgactacaatgaccccattggtctttgcactgtaagcctccagctcatttagggaattatctgcag

SEQ ID NO: 40895 - DNA, 201 bp, Bos taurus
actaatccaccagctaactcgaacagcattggaactgcttacccatctgtttccccaatggaatggattccatagaggcctgaagcccaaaattggagtcrgggctgggggatgcagtcgaagtttagcgggaacacatcagatgtgttctggcccaactatccatacctgggaagcaggcaggcacaagaccagaatctc

SEQ ID NO: 40896 - DNA, 201 bp, Bos taurus
tgggtgaagaagagaggatttggaggcagtaaacaggccagagtgggatgtagccagtggtttctgagctatcagtggttcctgtggataacaagaacccrggagctgggttaaatggccctgaaattgtttcgaatttccttggtctaacttggagagttgtttctttctttctttttttttaatcttttcccttcttgt

SEQ ID NO: 40897 - DNA, 201 bp, Bos taurus
acaggagaggttctgccctccgatctggtggccctctttcttctaagaggtcagtctgcctgctcccgacagctgttagctctggctgttagctgttctgytcaaatgtccggccgcagaatacctttaggacccgaggctgagggaccctggcattccattggacggtgggtatccctgatgtctggttgaacaaaactg

SEQ ID NO: 40898 - DNA, 201 bp, Bos taurus
ctctcagaaagagctttgtgtgtgtagggaacttactgtaccctcttagcagtggctgtaatcgctacattacagatgagcgagttgcagctgcagggccrgaaagcagcctgcaagagattccgcagccaacttggggcagaactgacccctgcccaggtctgacctcagaactgtgtgactctggacaagttattcccc

SEQ ID NO: 40899 - DNA, 201 bp, Bos taurus
ctctccccacctcctccttggccatgttttgtaacatcatcgcccacggcatctctctgtctttgtcactgccttgccttctttattctctaacttggctyccctagtcacacattaaggaaggctttccctggtggcgctgtggataagaatccggcgaccaacacaggggacatgggttcaatccccagtccaggaaga

SEQ ID NO: 40900 - DNA, 201 bp, Bos taurus
ccattttactttaaaatcgttattatgtaaatttgcagaagacaaattttaagtatacctcaagtgttcctataaatttaagacatttagtaatacttcarggtggcttgcaacttaaattctataacttttgttaggaagtgtaggattccattgtggaataaactgtagatgccccccaacaccccaccccctcatcag

SEQ ID NO: 40901 - DNA, 201 bp, Bos taurus
cctgctgttccttctccccctcagctgccagtccttctcctcctgtgcccctcgaggtaacgctcaatccatcgtgcaccctcacaaagagagctttgctyagtgagaaaagcatccttgtgcctccccgggatgtggaccagccgctctcccagctgtgcggtgtcaggttacttaaccgcctgcctcctggtgcagctc

SEQ ID NO: 40902 - DNA, 201 bp, Bos taurus
gtgccaggcactgggcccaggcacacgccctgccctgggcagcccccggttgcacgtgggagacctcgaatgttagggtgaactggcaccccacagccccrccttgctgaatcctgggcccaccccactcctagagattgtgatcaactgggtttgggaagggacagtggaatctgcattttaacagatgatccgggtgat

SEQ ID NO: 40903 - DNA, 201 bp, Bos taurus
tgggccaccctctgggctatgcgcaggcgcagtgcggtggtcagacaccccgcccccaccctcccagcctttacttaactttaggttcattcactcagtcktggcccattccttccgacccaggaactgcagcacaccaggcttccctgtccatcaccaactcccagagcttgctcaaactcatgtccatccagtctgtga

SEQ ID NO: 40904 - DNA, 201 bp, Bos taurus
ccaggctgcacagtgtagccaaaaaaataaaaataatctataagaagatggacagggaagcctggtgtgctgcagtccatggggtagcaaagaactgtacmtcaccgagcgactgaaatggtaagattatatctcaataaaactgaaaaacacacctcaaaatatacagggatggggagaaacataaaaatatacataaaa

SEQ ID NO: 40905 - DNA, 201 bp, Bos taurus
taactggcctctggcactgggaatgcttccagtagctcctgcaaactttgagttcctgttcaccagagtgaccaccgactacttgctgagacatcttcackaaggcgcaggtggccgaggttggaggctgagggagcacgcagaaagagagggctgagcagttcctcttagcactggaattcacacagatttgaatattca

SEQ ID NO: 40906 - DNA, 201 bp, Bos taurus
cttgcttctcttccatcgcatggaggctggtgcgctgcagggtgttatcatcagttcttttcttctcacttccacacctcctctgggccctttggttctcytttatgactcaaattatagtaagattacagttaaactatggcttgaaatcacatctgtctcttgagctcaccacctgcaaacccaggtgccttctgcacg

SEQ ID NO: 40907 - DNA, 201 bp, Bos taurus
tgggtccctgtagaggcaaccaggatatacagtgaaaacagctacgataagataacaactacaacaataacaactaacaagaaagaggctctttctctgtkgccccacgcagtcagtactgggcacttcctatggagagaacctggcctttggagcagggggagctgggctcatatttcatctctgctcctcctatcaaca

SEQ ID NO: 40908 - DNA, 201 bp, Bos taurus
aacttgatcttcttggccccattctgtatttcagagtcacagcccaagacactagctttctttggagagggtcaacatgtttaaacgtgcctactccaacrccttccaatgtgttttctgtgtggccagacaggagttctgcccttctgagaaccagaagtctcccataggggtggggaaggcaggcaatttcagaattct

SEQ ID NO: 40909 - DNA, 201 bp, Bos taurus
gcacagctgggactaggacacatagccagagcgtgctcactgatcagggttactctaaaatgtctgagaaaaggaaaacatggctgggggtcacaccccgraggagggccagcttccagtgtcaccaccagattctctggtgccccttgatgagtcatttatggtaaatgaaagtgatcctcattttcaaggagatgtcca

SEQ ID NO: 40910 - DNA, 201 bp, Bos taurus
ggaagaagccatctcaataatccaggccagaggaaggaggagtctgcagagactgagtcaggtaacatttgaggaccaggatgaggtggaagtcagagaamagaagacagagctgacagcagggcctcaacagatgaagcggctgcacccctctgcacattaaataaagctaaaaaaaataataaagactagtgtccctgt

SEQ ID NO: 40911 - DNA, 201 bp, Bos taurus
cctgtcgtgagaactggagctgattcgtgttaaatgccaggcacggagcctgccccaagctcaatgaaccatcgccatgtcggtggccagagccactagcrgtgcagcccgaatcctcccctccatgtgggtacctggatgttgagtctcccccgatgggcccccaggccatagcgcttggaagtggatgcatggagctgg

SEQ ID NO: 40912 - DNA, 201 bp, Bos taurus
ctgggaagccaagaacggcccagatgtggggcagatgtcctgttacccctgagatcaacatgtgggaaacagagtccccacagggagtggcaaagaagcaraaacaggcagggcccctgccaccttctctaggaagatctacttctgggatagttacctacagatgtgattccagccccaggcagacaggctctgccactg

SEQ ID NO: 40913 - DNA, 201 bp, Bos taurus
cctagactgtgacagatgcaaggctcgggtacccacggcttctcatccaccggagctcaacgctctgactcaccacgggccttgtgttagtttcctggggytgccgctttgcagtaccacaaactggatgacttcaaacacgttgagtttaccctctcacagatccagaagccagagtctgggaccagggtgtccctgggc

SEQ ID NO: 40914 - DNA, 201 bp, Bos taurus
ttgagacccactgagacagtcagttgggtttgaattcactacctccctgccccaatcgcttcttggccttttgtctgagaccaagtgtgaattcactctcyggattggtttgtggcctcttcaggagacgagaaaatccataacgaaaggccattaagagagacagaagaagagagggtctctcttcttccccgggaccgt

SEQ ID NO: 40915 - DNA, 201 bp, Bos taurus
agaatcagtccctcaggaaaatgagcacggctataaacagacggttaacagcgaggagacagcatctgatgaggaagcgaggaggcctctgccagagataygggaacagggagacaccgcctccagccatccgattctcagcaaacggaaggtcgatgagagcacaggtagctgtgagcttgcagaacaggggtcccgctg

SEQ ID NO: 40916 - DNA, 201 bp, Bos taurus
gaccctcctggcggtgagtgtgtgtggatcccctcactagtaaaatctgcctgctcctggagtgtccctggggatgtcagactttgggacatgcttccctrgtggcccagaggttaaagcgtctgcctgcaatgcgggagacctgggttcgatccctgggtggggaagatcccctggagaaggaaacggcaacccattcca

SEQ ID NO: 40917 - DNA, 201 bp, Bos taurus
ggccttctgggatgtcctggtcttcccggagaagacggggtgctcggagtcccaagtgcctttgttttccaagttggacgccgtgttcgcggcttcaagcytggccctccacctcctctggagcttggcccctcagctgcgctggtcgtccccctgctccctgtcgctccctccccgtccgcctcccaggaccctgacccc

SEQ ID NO: 40918 - DNA, 201 bp, Bos taurus
caagctggcgtccccgagggccagaatgaatggcccccctcactgggcggctttgcccgtttacgaggtgccgtctggactgtgatgaataagtggcatcygtcagcttttcggggaacctggccagggtggaaggtgctaaatcaacatgggcgaggggcacctggctctccactgtttcactcctggcccgcgccagcc

SEQ ID NO: 40919 - DNA, 201 bp, Bos taurus
ggagcccacacaggagcaccccacacccaggctacactgtggtgaaggctgtttctacaccaggtccctggggcgggggcgcagatggcctgcctgcacaraggtgcggacgctgacgccaagcagctcacaaatgggaaatgaagcattctgcggtgtgtgttccggccagcacacactcaggacaggacttgtgaaacc

SEQ ID NO: 40920 - DNA, 201 bp, Bos taurus
aggctgctgcatctccagccagcgcaaactttccaggggtttgtcccgagtgacgaaaaccccttgcatcctgagttgtgtcctagcagcttgggcagaayggcctcacccgaaattcttcgagggatgatgagaacagagccgggggagggggtgaaagcaggaggaagtgaaccaggctccccggccgcagagacagga

SEQ ID NO: 40921 - DNA, 201 bp, Bos taurus
gggtcaggtcaccaaacaaaagaaacaggaatagaagctaatttttaatggcaaaccgccctgagcgctgggcacgctgtcacgttgtacagaaggcctcrgtaaggctccaaggagaggataccggacgcccccgcccctccattcaacaccgtctctgcacaaacaaccgtaaccctttcaacagtgacgatggctgtg

SEQ ID NO: 40922 - DNA, 201 bp, Bos taurus
accggacttctccccaaaccgcagtccaggcctctgcctccttccagagcccccaacccttccacctgttgacagatatgatgaccttcactcttgtgttycgtaaacctcgctgaggccctgttcctctgctttgtgaaaagccaggccagtcctttccttgcactgctgcccataccagttggattcagcgttctgggt

SEQ ID NO: 40923 - DNA, 201 bp, Bos taurus
gagcattgagacacccatttatttacttttggaatgtgcttgggttggtatgatgaactctttcacggtagtgtattttaaagcttgtggccttgattcakttctgtgcgctgataaaggttttggcatattacatttaaaatctgaggcttagcataggtttggaactcatgacccaggtgtaggatatttgctgtaaat

SEQ ID NO: 40924 - DNA, 201 bp, Bos taurus
caagaaaaattattattagagacccacctaattaacatatttctagtgtttcccagtgaaggcagaggcctttcttaactggcgctctctgaaatagtcayttgacaattggcacacctcaggcacgattgcccgccaaagctagtggggcctgcgcactcagcagcggttgcccactcccttccctccaagaccgctgcg

SEQ ID NO: 40925 - DNA, 201 bp, Bos taurus
ctgacctctggctctctctcccccgttattccagtttatgaccgtgggcaaatctttcaggctcttttgtgtgtcttgagctacaaaagagacaaatgacrgtggcccctttgttccccatagccatgtatggccagatcttttgttttccctaaaataagaagttggaaagaccaaatatgataatcaagaagaaaattc

SEQ ID NO: 40926 - DNA, 201 bp, Bos taurus
gtggatggagcgcagattgccacttccgactctcagcttctctccccacttcctgccccatcattcacatcgtctacaccagtaattcttttttttttttwattcagatcttctttaatctttgttggaagagcttatccacgaattctgttttttaaaaactttgtatttggcgttggagtatagcctattaacaatgtt

SEQ ID NO: 40927 - DNA, 201 bp, Bos taurus
ttacaggatttcagaatgtgtattctttccactaggctatggtgcttcccagaaaatacaaaaggaaatgggcacacgagcaagagagatacaaagatgcrtgtgctgtgggctgtgcttagctgctcagtcgggcccaactctgtaaccccatggactgcagtcctccagactcctccgtccgtgggattctccaggcag

SEQ ID NO: 40928 - DNA, 201 bp, Bos taurus
catagggtctcaaagagttggacatgaccaaagtgacttagcatgcacgcgcaaatgtttgtataaaataaatgaagaaatggataaacaagtgaacatayaaaatcttgtaagaaaaactcagctgacttctccctactctgttccccatcattctaaccagcttacttttggagatcccctgaatcagcacacactctt

SEQ ID NO: 40929 - DNA, 201 bp, Bos taurus
aggccacgccgatgagtaattaggcagcaggcagagaccgggcagagctttatgggcccattagtacttgcccagctgctttcaaggttccagcctgcaayttgggtgttaggtacctttagtgtcttcagttaaaaaaaaaaaaatgacctacgtgttttttgttgctgttgtttctgtccaaatgtttaaagacatgaa

SEQ ID NO: 40930 - DNA, 201 bp, Bos taurus
agctttcgggggcccagacagctcggtccctggcacccggggatggagcccagggttggagtgggagcaggtctaggtcagctgagctgcaggccgccccrtgcttgatgagatcggctctccctgaagactggcttccccgtgtgcctacctgggggtcccgaccaccctactgccaccggggtcctggtgagggctctg

SEQ ID NO: 40931 - DNA, 201 bp, Bos taurus
attatattaacaatatagtatgttgttatgccaatattatctggcatattttaagcctggtgtgtacatgataccatttgttattggggggtttcaagtakcattttactggtgtagctcaatatagcactagtaaattgatttaaaaggaggcaccttcttcattgcctttaaggattaaacatgtatctaaggacacca

SEQ ID NO: 40932 - DNA, 201 bp, Bos taurus
ctcagttaccctaggaaatctgaggttactggggccagtgcatgaggctaaaatggtcaccacaaacctaagcaaaggtgccaggggtgggatcttagccrgctggagacagtaagttagagctatgggagtggcatgagaaggagacagacagacagactgactcggcgcagagccccaggaaaaaagcagaaggccaca

SEQ ID NO: 40933 - DNA, 201 bp, Bos taurus
attttcaagtttcattcagtgtagcatttggcttgaatatgggtgtatacgttttcagtgagtttcagtcgtgtctgtaaggcctttactcatggaagttyttgtgtgcaggaaagatcattcagattttgagttggttcataacagcttccattgcatgggggccatgaaggggttggatctcagcttagcaagctgaga

SEQ ID NO: 40934 - DNA, 201 bp, Bos taurus
tctgcagtggtccctgagctggcagtgggctggtttgtctggtgtcctcactgacatgcctgttcctggtgacttgtgaatataacatgccaggcagagcrgggccaggactgtgccaggcagaacaatggtattctaccaggctccctgcctgcatacagttgtacgtgaccacacacccctgtgtgtgacttctttttt

SEQ ID NO: 40935 - DNA, 201 bp, Bos taurus
attcttgctggttggcccagctgtaaacgtgagacaaatgtcctgtaaacgtttctcttacctctggttccccacagtcacattcctctccttcttcaacrtatccgttcccgcacttctggcccccgaaggactgcttcacttccggcaggttgaacagacacatgcccatgcccttctgcaggctggcctccaggtcct

SEQ ID NO: 40936 - DNA, 201 bp, Bos taurus
ctgggttgacaccttttagtagcttccccatcttcctctctgacaaccagactgtccccttggccttgaaatcctacctattgtggcccctgtcaaattayaggcaattccccacctccaggtaaaacttggcatcagccagaaatgtccttcccttccccatcccctgggtcatgcttcctcaaccttcgcatcttggtt

SEQ ID NO: 40937 - DNA, 201 bp, Bos taurus
gagaatgctattaataaacatgctaggtgcttatcaggagaagattttttaaaaaagaaagacgactccaaatacagagtgtgatgtgagcaattgccaaytcgaacttcggagtgacccagtttccaacaaggcagtatcctgggtgcctctgtcttctgccagcggtcactgacacctaagaagaagctccccggcttg

SEQ ID NO: 40938 - DNA, 201 bp, Bos taurus
tgctgcctttcagtggacagcggccatctaactccgatgtgtctgcaaaatgcactgacgcacaacagccgcactccaaggacagaccagcgggaatgacrtaagacaatgatgtcctaaggccaagatgttgcctacactcaccccagtcttctcaaacacacacacacacacacacaatgctcgaataagtaaccttgg

SEQ ID NO: 40939 - DNA, 201 bp, Bos taurus
caacatcagtagcatcctgaccacgtattagctgttggtcctggcccagctgttgacccacttactagttcattcattcactcattcattcaccacctatmtattaactgcctgccttgtgacgggccttcgagatctgatgtcttccacttaaatagcccgctgtttctgcttcaaccctcatgttacctggagcgagcc

SEQ ID NO: 40940 - DNA, 201 bp, Bos taurus
atatcttttcatgagcctcgtggccatctgtatgtcttcattggaggactgtgtcgtgacatactcttatttgatttttttccctcagttatttaaaaatktgaacacctgagctcatggccgtaaaccaaccggcgacagacctgatttgggcggacctacagtttgctggtctctggtctcagtgttgctaaggcttag

SEQ ID NO: 40941 - DNA, 201 bp, Bos taurus
ggttttgacctcctagcctcctcctcaccccgattcacctgccgtccaggggaagggatcttgtcgaggtggccagagcatgatccaggcccttgaccctyttctcctggaaacaacactgctgaggtttcctttgtcctcggggctccacccgctttgttctctctgtgacttcctcctcccgtgcctgttcctctgggc

SEQ ID NO: 40942 - DNA, 201 bp, Bos taurus
ccacatcttgccttgggtggctcatcagggggtcatgctggactgggcgtcatgtttgactctcgtttagctcctggcctcctctctgtttatcatcatgyttagtcatgtctgactctttgtgacccctgtggactgcagcatgccaggcctccgtgtccatcaccaactcctggagcttgctgatttccattgagttgg

SEQ ID NO: 40943 - DNA, 201 bp, Bos taurus
tgcgagttgtaagttcacgattgatgggaagccagttgtctagttgtttgtgccatgccatttcaacatggaaaaaagagaaaagcaaaaagccacatctktacgaaccactctcgtatcgcttgaaaaaagaagagatacattggtgagtctggcacaaacccaatgaaattgatatgccatgatataaaattgagaggt

SEQ ID NO: 40944 - DNA, 201 bp, Bos taurus
cctaaggagaaggattaaattagatttcagtttaattaagaagagacattaagtgctaagaaggaggatggggcctgtgtggagggccaagggccagtgtmatgtctaaaatgttctacatccaccccgagaacccattttcacgcccaaagggagacagtgccccgtggagaatgcacggcctggttggtaatgagatgt

SEQ ID NO: 40945 - DNA, 201 bp, Bos taurus
gacattcaccccggagacctggacacacaggctcaaacagacagtgcgacttctacccttaaaaatgattaaagtggcaaattttaaataaaggccagagkaaaagcaaccagccagccagtcaggagagcgaccattccatcagaggctaccttctcacgcctcgattcaaccgcaaggcctccttatcaattgacaccc

SEQ ID NO: 40946 - DNA, 201 bp, Bos taurus
ttatgtccaccacctggtccatcagttctgtcttgggtcagttgcttccttgggctggttgtactcatttgaggggccaacactcacctggctgccactcytccaggtcagccgtctatgattctacaagatacctatgattcaacacatgggagcagttggcagtcatccttctgtgggtgccctgccccggcctctctg

SEQ ID NO: 40947 - DNA, 201 bp, Bos taurus
ggcccaagccctatgcgccagaagtctttccctctgcgtttctcattcatcccctcagccagctccgcttcattttctgagggcattacagctgggaaagrggggcctatggcaaagtctgagatgggagggtgggtttgtgcctagaagcaggccttctgctagctcagatggttgataccggtgccaacttaacctctg

SEQ ID NO: 40948 - DNA, 201 bp, Bos taurus
agcggcgaagatacaggacttgctcctcaggctttgtgtgaacaggcctcagacagtgcagtgttgtaagacgcccggaggtttctaaatgaaggcagagygggacctgcaaccaggagcagggcctgctgtggggtggggcagctcggggatgagggcactaggcccagtgagatggggtcttggccccaagcagcccct

SEQ ID NO: 40949 - DNA, 201 bp, Bos taurus
gatgtttttctgctccgctcccatagttagtaagagggtgagtcactaagtcgaatataagcacggcttggagtaatttattccaggatcatgaagacacrcttctcggcaagagaatctctgctgaacccagcgccccgatgaacacagaggcttcctcagccgctgcgatcgcattttggagtatcgatatcatgtttt

SEQ ID NO: 40950 - DNA, 201 bp, Bos taurus
atcactagtgatgatcccagggtgggccagcctgctggttgggattgtagattgtagcctagagtcatgtgtctaccttccctagtctaaatccaccatgrgtggttggaacagactggctggcccttatgtgtttccccagctgaggaagtttttaattcagatgagtgggtttccctctgcagacagcagtccagtgtg

SEQ ID NO: 40951 - DNA, 201 bp, Bos taurus
tgtgataaatgcattggcatagggggttatttcagaaaagaacaagcagctctttttttttttcgcttaatattggttaagttctcttcctcatccaacaygtatgttttggtccttgtgtcttggttccatcctttgacttgttttctacatgaaagcaaaatggatacaggcatgccaggtctttatccacataataca

SEQ ID NO: 40952 - DNA, 201 bp, Bos taurus
aaccacagcacatctgtgaacaggcccagattcagtggcaggacagcagcttgtggatgacaaaggcatacagaaggggctttctggggggtcaggctaayggcccacagaacaagagtctgttcttagtgtccccagggctggaggcgatgtgtggctgcaaagtaaatccgttgtgatagagttagggtccctcgacct

SEQ ID NO: 40953 - DNA, 201 bp, Bos taurus
gctgatgctcaggcctgagttggtgttaacgttggctcagctgtgggaggggcggggggttacaaacagccctgcacgtagcgacctggaagagacctgaygcatggccgcaggtgatcccagtgatccctgcggggctggggaaaggaacacgcacagcaaacttaggggaatgtgaactttaattaaaggtggaggtac

SEQ ID NO: 40954 - DNA, 201 bp, Bos taurus
agctttaagccaactttttcactctcctctttcactttcatcaagaggctctttagttcttcttctctttctgctgtaagggttttcaggtaagatcatgmaactgagacctgggtcacatggctagaaaatttcaggtttagtgattaaatcaaaattacttctgtctaatcacactgtctttccatcaataatgatggt

SEQ ID NO: 40955 - DNA, 201 bp, Bos taurus
agttcactgtagctactcttggagccatcggcttctgccggggtgattctggagaaacccggatgtggggaagagcggcccttcccccactgtctgccagrggacgcctcctggagcgtggtgtgcagagttcacgcttcagcagctcagagtagggcggccctgcagctcaggggggcaggtgtatatccatcagtaggc

SEQ ID NO: 40956 - DNA, 201 bp, Bos taurus
cccttgccggccatcaagtccccaccgggccacaaggcgcctgtgtgacgagagcccgtgcgatgaggccagctgctgcctgtggaacctgatgctacgcratgctctgttctttgttgttcaatcgctcagttgcgtccgactctttgtgacctcatgaaccgcagcgcgccatgcttccttgtccttcaccatctcctg

SEQ ID NO: 40957 - DNA, 201 bp, Bos taurus
gtggagattctgggcacagaagggtccctgcaccacctgcaaccataagtacttcccagcttctcacctgtctgcccaggagcctggcccagcaggaggcrcaggcaaccaaggagccaggagagagaccacagaacatgagagcattacacactgcacttcacagctaggggccacacagatggcacccctcttccactc

SEQ ID NO: 40958 - DNA, 201 bp, Bos taurus
ttaagaatctgagaaaatggagcagagaaacctagaatcttgaagcatcagaagtgcctgtggcatctgtggggaaattccagccacgctgatcagctgcyccctttcagcccatccgctaggcatgtcctcacctggagatttcaggccataccacagagaaatttcatgccagtagcaattattctagtagtcatgtat

SEQ ID NO: 40959 - DNA, 201 bp, Bos taurus
aattcatctggagattcaagtgataaagcatgaaccctaggtccctcccaaagctgccccgtgcaacgtggggggacagccatggaccccacatgagtgtratacctgcatctgcacttctctgccctactccctgtcaaggtgcccttgctcccatgtgagcacatttactcaaggagtttgttaaaggtttcagagcct

SEQ ID NO: 40960 - DNA, 201 bp, Bos taurus
cttaaaggatggatggctttgtcagatcagacacctcgctctctaccctaaatagattaatctcactgggggctcttgagacttacacacaacagtagaaygcctatttcctcattgaaaacaatagatgacaaggacatagagaatggacatgcagacacagtggggatggggagggtgggacgaattgagtaggtagaa

SEQ ID NO: 40961 - DNA, 201 bp, Bos taurus
ctaaccacagactcatggggagatggtccctgtggcattggggggttcgccaaaatgtggatgcagggctcctggaattcacggatgatccagggaaaggragctggtgggtcacagtcaaggggcccagcgggttaggaagtgggtgccatggaggcaagtgaccagaaagcgactcaagcacaggagagtgaggcgtgg

SEQ ID NO: 40962 - DNA, 201 bp, Bos taurus
tagcattttcagtgagaagggcagcgtttcaaaagcactctgggaagctgagtaaggatcttgcttctacagtgggtttaatttcaaggtaatcatggtgrtatctcaggccctgagttcacaaaaatctgcaagccgagctatattactgacatcaggacgtagcaggccatcctctgtgataagaagcgctgtatcacg

SEQ ID NO: 40963 - DNA, 201 bp, Bos taurus
taacttgatgtaaaatgtttgcataagcaatataagctccaggatagaacatgtgtcctgttggctgaggagatgaactgttgacaatacattccagggcygtcatcgcttttatcagaagtaaaccattcaatgcccctcacaggtgtattgtattcaccgcctgacactccccagcaggggtggcacttcacagtgggc

SEQ ID NO: 40964 - DNA, 201 bp, Bos taurus
agatgaagtgcatgaagaatggatccagttttgacaggagcaggagatactaatcacaaaattattctagaataaacacaatgacagtctaagtgagtaamaagaagagactaggaatgtgttatttcttgaagaagctcttaggcaccttgtatgggtgctctcagctaaaagaactgcaacggagaaaaggccagacac

SEQ ID NO: 40965 - DNA, 201 bp, Bos taurus
tggcctcctctcatttgtaaggccatattatcaaccccattcatctatccacatactcacatgcaagaattcactgagaatcaggtaagagacagaacccrtattagggatgaaggcctcatttagaagaaagttaaaaaccacttcacagctatgcaagagacaagaatacaaacaaattatatcaaactcatgaaacag

SEQ ID NO: 40966 - DNA, 201 bp, Bos taurus
ttcttacttgctacaggttataaatccttccttctcctactctttgccttggttgtgtctttgggattgacactaaccaagagagagaaccagttttgggyaacatgcaaaaatagcaaagataatccaacataacaatttggtttttacatgtaaactattgaaatgtctttctaatgtgaaattaattgtcaagaacaa

SEQ ID NO: 40967 - DNA, 201 bp, Bos taurus
tctccttccctgcatctctctgagccctgagatcccagccttgaaggctagaatcagggagcatccttgctctctgactgctgcactgaaaaaaggagggrgtcaaggtcagggtcacattcctacagataagtgcccatttagtgcaaacacagctccctcctgtgagcaggcctctcctgtgggcacatttctacctcc

SEQ ID NO: 40968 - DNA, 201 bp, Bos taurus
acctcaaactttaaaaatctctcaatactgatcagtttctacacctgatagaagatattctcacttttaagcaaaaagttttctgatcaccacacattctkatttgtgagggattatcttactaagacaaaaaaggcaaagtacaaatgtgtcccagggatggacctttccctcctaatcagacagaaagcatgaggataa

SEQ ID NO: 40969 - DNA, 201 bp, Bos taurus
agaagtgggcctcagggtggattcttgtgactagcctcctgtatacatcccctgagacaagagacaggtgggctccagttaaagtgtttataatcagcctscttttggccctccaaaatggaagtagcaacagaaacagggtaaataacaagactttgtctcttgcaaacaccttaagataatacttgtgacaatagtcag

SEQ ID NO: 40970 - DNA, 201 bp, Bos taurus
ctcacattcacaactcttttcaggggtctctcaggacccttcccaccaccgcctccccagccaaacctgcagaagggagtgaagggcaagttacaggtccyggccttgtgtggtcaccttcacagcaaggaacacactggcagggtgaacttttattctcccaaagcagccatcttattgatgctgtggtttagttgctaa

SEQ ID NO: 40971 - DNA, 201 bp, Bos taurus
ccaactcaaagcagatcccttcagatttgcatatgtttactttttgagtctactatggtgcctagtttctttgtctttggccaaatattctgaatattgcrtatttttatgagtgactcaatggatctgaattttagcaaactcccggagatagtgaaggacagggaagcctggcgggctgcaatccatgggcctgaaaag

SEQ ID NO: 40972 - DNA, 201 bp, Bos taurus
ctgagttaagcattgacccctctgggatgctgtgagattatgttacgagtgtctgttctctcactttttttgcccctaaaacatggtcaggcctggcaccrggtcacttgatctcccagactgatgaaggagagagcaggtgagaaggagaccgttgaggggggcgcagtcaaagtgaggctggagttctcagagtctgca

SEQ ID NO: 40973 - DNA, 201 bp, Bos taurus
gtccaaagccccctgttggggagaagagctcccctcagagtcagtagacacagctgaaagagagctgaagagaatttacagtgtctgtggatgtgaagcasagaaaaggctcaatttcaagaaggaagggggctttccaaatttttaaacatgcaacacctaaagcatatttacttgtaagagctgaattttgcaggtgaa

SEQ ID NO: 40974 - DNA, 201 bp, Bos taurus
tacaaggtggtacaggccaagtgcttttgtattgatctcctcagcaatgttgtttcgtcttaccaggctctattcctttattttgataatttatcacaagytgtaatgcagtctttcaagggccaaatagctactcttggaaggagcacttatcaatatttcagaatcataattaccttgcagacaagagagcccatgaaa

SEQ ID NO: 40975 - DNA, 201 bp, Bos taurus
ttaataatccaaaaactgtggaaacagtaaattatcaagaaaacaagaaatgacgtgtttattgaaatttgcagcactcacccttggactagagatgtcakttcattcacccctactctgccaagcctagattactacatttgattttcaaatctctcaattactgctaataaatgtctacatggcagcactgactcagtc

SEQ ID NO: 40976 - DNA, 201 bp, Bos taurus
gaaccagacagcaacggccaggttagctaagggtcaggtggcttgctgtgctgcccatcagatgtcttcttccagaaagtacgcacagccatgaacacacygaagctgtcagtgaaggccacctgctgggcttactggaacatgcaaatgttgacacattaaagacttagcttccctgcattttgttcctgtgacagtgca

SEQ ID NO: 40977 - DNA, 201 bp, Bos taurus
gctctgtcgtgtccgactcttagccaccccatggactgcagcccaccaggctcctctgtccatggattttccaggcaagagtactggagtggggtgtcgtrggattcactaaattaaggaggagagtcatcggacttgtgggtccattgtccctccttttgttgtgccagaagctttttttctccagcgtatgccctgatg

SEQ ID NO: 40978 - DNA, 201 bp, Bos taurus
aaaaacaaaaaacctctctgcaaacttaaatgagcaaatgacctaaaggaaatttaccgccatggggagtcattaaatttgaaggcctccctgggggcctyggagaagccatcactccatgactccagcccatggaatcatttgagaatgcccttcccgggactggataaaatgatgcaggctgattttccatctgcaggg

SEQ ID NO: 40979 - DNA, 201 bp, Bos taurus
aacatttgcatgtttaatgtcacgtgagccttcgtgcattcctctctccctggacactcagggcatccctccacattcctgaacctgggctggccgagacygctttgccgggcaaaattcagccaaagtcgtgctgatccaggtctgggctagatttaagaggactggccactcccactcccttgctcttggaattctcag

SEQ ID NO: 40980 - DNA, 201 bp, Bos taurus
cgggggtgacagggtctgcgcaggatcgactgagatacgggccggggatgccccactctgctccgaagttctgagtcatcaccagtttcacaagcaatcgygggggtaggcactccagggccggtgcaagaagctttctgttaagaataaatgtgccctaaattactcttaaatagccaacaccattttgagttgttggag

SEQ ID NO: 40981 - DNA, 201 bp, Bos taurus
tgcatgcgtgtgtgaaatctccaggggacagagatgtgggacttggaatggcaggactcttggcagagtatctgtcggcctgccctgaagcatggagagcrtcatgtttcacttgggagcaagacctaagcctgagtgagatccctccccaagaagacagtccttgcctatctggaactggccctcagtcctttgagggga

SEQ ID NO: 40982 - DNA, 201 bp, Bos taurus
ggctggtttctcaggcacgtgaccctggccgaccttgtgcacagtgtcatagacactgagtgtaaaccgctgggcagtccccagcctgtctctgccctggkgcagctacatggggccagagagacagccagctctgccgttgcaggccaagaacactccttagtaggatttttctgtgaagcctctgaaaaatcagagttc

SEQ ID NO: 40983 - DNA, 201 bp, Bos taurus
gaagggaagcccaagaataatggaatgggtagcctatcccttaagaactcaatgtatacaacgattcctgcagcaggttgcaacctggaagagcagctccrgggagagaagcagtgagtgccccctcatgatgcaagatatgctgacgtgggccctatctgcacattgcgtacataggaatattgtttccttcccccagaa

SEQ ID NO: 40984 - DNA, 201 bp, Bos taurus
atatgaatgaggacagatgactgtaaatattgggatgcgtttatcatacacccacttcaaggcaattaactaatttattcttaaaaaaaaaaggtgtcgtygtgttctataccataaaataaaaaagtgagcacacagagattcagtatcttggaactaggatttggacccaggcaacgctccaaagcctgtgcttttaat

SEQ ID NO: 40985 - DNA, 201 bp, Bos taurus
gttatgatgaaaccattttatttttcagaaagtctttgccttctccccatcctagtcccatcagcagatgtggaagcaggactcatcagagagcaaatttrggagtggtacagggggctctctgggtttgggtcacaccggattttcctcaatggtcccaaacaggaatgtcaggacggtcacctcaaacaggagatgaca

SEQ ID NO: 40986 - DNA, 201 bp, Bos taurus
ctaggatggcccatatcctggcatctctgggtgctacagggaagatttctcaaacagcagtctttgtcactcattccacatttatttattatcttttgaayattaggaattatcacattgaaaacattatgcagtatgtgtcttaatagaacataccctaacctggctgcatggttataacaaaaaataaagagcccagag

SEQ ID NO: 40987 - DNA, 201 bp, Bos taurus
gtcttttggagaaactaaaatggtgtacccactggaacccagtagattttcaagacagatcacgtggactgggaatgaggcatttgtggagtcccaggccyctgtggaccagtgtgctgtgtatattcatccagtcctaacctagacaccttcgcttgactgcagataacactgacaccctagacatcagaaaattaaagg

SEQ ID NO: 40988 - DNA, 201 bp, Bos taurus
ccacatccatcaccctggatggaaggtggaaatcaccctgcttgctggccagcagcattcagcatccccatggcttgtgctggcccaggcttctggggacraacagagagcatgggaacacccaagcttcttgtccgtctctggcaggtcactgggctggggccatagggatgccagggccattggggccactcacctgga

SEQ ID NO: 40989 - DNA, 201 bp, Bos taurus
cccacaaaatacccttgaattagtaaataatacatccacaagactgaccgatctatggtcttagaaatcaggattgtggttacccttaagggagaggtggragtgaattgtcctacaggccgtttctgaagtgagagtcaaattttgttacttgacctgaatgctaattacatgggtgcgttttgccgaaattcttcctgc

SEQ ID NO: 40990 - DNA, 201 bp, Bos taurus
gataatgtggtatatatacaatgaaatattacttagacataaaaaatatggaaatatttccatgagtgtaccttgagggccttatgccaactgaaataagytcacttcagttcagttcagtcactcagtcatgtctgactctttgcgaccccatgaatcgcagcacgccaggcctccctgtccatcaccaactcccggagt

SEQ ID NO: 40991 - DNA, 201 bp, Bos taurus
ctagctaaatgaagcttattcgtttaaatctagaaagaggttttttttaacttgtatataacatgtataatagtatttgcttacattcttccatggatccrggtaatggtttcatcttaataactcaggatcattgctaccagcgttcagcattacatggagtcatagagcaagagtgaacagagaacggttaaggaagct

SEQ ID NO: 40992 - DNA, 201 bp, Bos taurus
aacttctaaccaatagtaagcgtgtagcatttgggtattagtggttctgtaattgtttcgggtactcagaatgtataagaacaaggccgtaataaaagtgktaatgattaactttaggacaaattctcttccagcatgctgccagttagaaacaccacagtcaattggccttctagtagagagcgtcatcttatggactgt

SEQ ID NO: 40993 - DNA, 201 bp, Bos taurus
tctcctctttcttcctttcctgtctgttccttgtctcagacgaatggtggcgagagttacatataattaccaaccaacataagaggacttttcatgaattyttcacccaaaggccttggactgaactttctgtcaatgtcttgcgtatattggaggagcagggcaggcagagcagagtttgttaaaaataatgatagaaag

SEQ ID NO: 40994 - DNA, 201 bp, Bos taurus
tacaaattaaatagtctccttaacatgaacactgagagcaactttgtagggagggctgccttgctgaagtccaccagaggcctcttcacgggcagggagaygcctgtggctgcacttccttcacattctttcgtgctgtccatctaccctaccctttccctccaaagtcttccttaggcccctcatcagcagctaacatcg

SEQ ID NO: 40995 - DNA, 201 bp, Bos taurus
acctttgtataatgatcctgtcaagaataatatctattcttgtgagttgtctatgtattgggcttggcaactcaagttcagtgtaacaaactgaaataatygttctatgtatgtgagaggcttttagaaatgagatgattctgggttatgatctcaagatgtatgtttgactgtccctgcagccatggtctctctatcaca

SEQ ID NO: 40996 - DNA, 201 bp, Bos taurus
gtctttagtaatgagactgattgtgctgtgaagggaggtaaacctgactctgtcattttgaagcaggttggctgccccatgaccttttctcccagatggcrtcttgtccccctagaaagctggctgagactgtggtatttctaggttaatggctcctaaacatggaatatttgccttagcagcctgtagcagttcccttcc

SEQ ID NO: 40997 - DNA, 201 bp, Bos taurus
attttacattcccatcaaccaggaatttaccttcacactaatatttgtaattgtgtaggtctattgctgttcttgttcagttgctaagtcttatccccagmtctatgaccccatgggccacagcatgccaggattccctattctttactatctactgtagttttctcaaattcatgtcctttgaatcggtgatgctatctg

SEQ ID NO: 40998 - DNA, 201 bp, Bos taurus
gtttcctcgttaataaaaagatagaggctggtttggggtgcttagacatcaaagacactggtcttgagtcagatccaggttttatcatgtttagtttcgtycacagaaatcaaacaattttgaatcaacactcaaaaatcatgagataccaggtcaaaattgcaaatcccaggttcatttggaaaactggaagagctccaa

SEQ ID NO: 40999 - DNA, 201 bp, Bos taurus
aaatgtaaagagaaataaacaaaatagacatcagaaataataaaaagaaaataattcataaatacaaagacaatggaaatttttaattcattaaaactcaytaaagcagataatgtgcaagaggctaaagattttgtaaaaatagtcagctgcattcttacatttagagcagatggttttacctgaagtttcttttatgtt

SEQ ID NO: 41000 - DNA, 201 bp, Bos taurus
gattttcgaggtgagaatactgttgccatttcctcctccagggatcttcccaacccaggggtcgaaccagcgtctcctgcactgataggaggattctaaascactgagacactataaccaaaacaaggctattcaggggccattctaatactttagtagaaagttatgggagatgacatctgtcttcctgctaaagatgct

SEQ ID NO: 41001 - DNA, 201 bp, Bos taurus
aaagatgtaagacatcattgtacaatgggttgaaaatttcttttactcttaggcttcctagatgagaaattacttactcttgatttcacatcttatatgaracactacctagaaatacggagaaggcaatggcaccctactccagtactcttgcttggaaaatcccatggaaggaggagcctgttacgctgcaatccatgg

SEQ ID NO: 41002 - DNA, 201 bp, Bos taurus
ttgaatattactatgcagaatgtgatatacattatattttttatgccagctttggatcttggaataatattttaaatatttcttcacatagatcacactckttttgtattatgtttgtatttaacatagctctttaagaacagactttagcacagttctggccattgtaagtggaactttcttgatatattttctatctga

SEQ ID NO: 41003 - DNA, 201 bp, Bos taurus
tatttatgcatttcctccttcatggacttgtaaataggagattacattttgtagtttagctattaataatatatattactaagttatacagttttgtttcraattctggctccaccacttactatgtgcctatcactagctagattgatccaattatgtgaaagtttttagtataactggtattaattttcttttttttta

SEQ ID NO: 41004 - DNA, 201 bp, Bos taurus
attatctcctttaaaattcacactaatgtgaggaagataattgttattatgtttacagttagaaaaagcattttatcacaggtctctacataattgtgttygtatagaaacatttaagacacggataaaatggtaaagatcaaaacaggattaatattttaagaaaaaattatccagaggagttacatgagaagtaacata

SEQ ID NO: 41005 - DNA, 201 bp, Bos taurus
agtcaaaaattagtcaataaatgaataagagtatttaaaatactagtccctcaactctggaaaaaaaaaaaaaggttgttctatgtcccttttgaagttcrtatattggaataaactttaaagaccagaatattttgatcagggaaaatttatttaagccacaaggtagcctatatcaattccagcatctatcaattagtt

SEQ ID NO: 41006 - DNA, 201 bp, Bos taurus
gttagaagactatcaaagcatagccacaggaaaatgccctgcattacaaatgtatatatggaattccatgaatgttcattattttattcacaccaaattcyctattcagtgaaatgcttgacttttttattttcataactgttttctataaaaatgtattaaagcactatagatatttactctgaccccaaattttaatac

SEQ ID NO: 41007 - DNA, 201 bp, Bos taurus
cttaatcactccttaatgaaatgagtcctttttctttctttcttttaagtagactgcattttaatttaaaatgtagctatgatgtgaacacacctactaartttgaaatataactttcttgacaatatcagaaaagaatagactgtactttatcatctttcttcagtgtcttatgaacttattcaacctgaccatgaccca

SEQ ID NO: 41008 - DNA, 201 bp, Bos taurus
gagccaagtataaaactggcccaaatctaagcagaatctcatttttaaaatgaatactaaactaaaactcttaagcatatgaattgcaaagatgcccttayggccacaggtttcatggatggggacagtgcagtggtttggaataaaatagttacatgtgacgtactttgctcatctcatgcacagtttgctggtaacaca

SEQ ID NO: 41009 - DNA, 201 bp, Bos taurus
tctttaaaatgattctccacacacagtaagccctcaatgatcgttaggttatgattattactgtagtaattcagtgggttgtctctggccatgaagcattmaggcagttcttctcatttaactggaaacactgccaaagctcactctctctcctggttaattacaatagccatccctccacagacacaaggccagggtgat

SEQ ID NO: 41010 - DNA, 201 bp, Bos taurus
ttgagatgctccctggggggtctgttttataagggcactaatcccagagtattccacctaatcatttcacaaaggccacagttgctaattccatcacgagrggcagtcaggatttcaacatattaattttggtgtaatattcattccatagtacgccagaagcctttttgagcacaagggccattgctttgctcccatcta

SEQ ID NO: 41011 - DNA, 201 bp, Bos taurus
gaaattcctcaataccctcctccctcattattgaagaggccagggttgtggttccagagagtatctaccatttataggccaattttcaatgaggtaattcragtcataaatcttagtgggaaatgctactgttgaacactcttggtgttccattaattgagagggatggtgggcctgtgatgatgctgtactaacccaagg

SEQ ID NO: 41012 - DNA, 201 bp, Bos taurus
ttgccaaagtttttgtctatatctataattatgtttctgtcatttgtaagcaatacaaataaatatcaaacaggtgagcttatttaacagcattaatcttrtaacacaattaacacaacattattaaaactggagatgaatgagcctgattaaagcagcatcagggatttgtagaaatgtagatactattgttttgttttc

SEQ ID NO: 41013 - DNA, 201 bp, Bos taurus
aatcaaattttatggttaagcaataacttgccttcatggacaattttttaaggaattaaaatacaataaaatacaatttatgaaaaaaatagtctaaccaygacttaagagttgatcattcaaagcatttggggaacttacaaagtgttagggatataatgatgaatcttgattatcattttactgaaactgtgcaggcta

SEQ ID NO: 41014 - DNA, 201 bp, Bos taurus
ttatatttgcatctccattatttagcacaatggttggccatatagaagataatcagtatcaaccgaaaaacagggctcccatgttgcaccaccaccatccmgcattgttctgtgagttacctcttctttctcatatattgtccacgtgtccactgatgtttatggtgttggctctgtccccttggcttaaaaattggatag

SEQ ID NO: 41015 - DNA, 201 bp, Bos taurus
tgaactagtttggtgaaactattttgctgcagatttagtgatggaaaaacacatttgcctttaagtagaacaaagagaacactattgaaataaaatttcaygtgtccatttatggtcattttagggactgagtttctgtgtccacctcagtttccatcaagattcaggccttgaggcaatagtgtaagaaaatagcacatc

SEQ ID NO: 41016 - DNA, 201 bp, Bos taurus
acaactagtgctgggacacctgaaggtaatcgtgtgcacccggccctctgcaaactctaggttgggggtgcttcacacagggctcctttgaaagtgaggartgattggaatcctgtataagaggccactgtcaaagcaaaaaagagaataatatctcccccatgaaagtgagagcagaggcaacctctgccactgactcct

SEQ ID NO: 41017 - DNA, 201 bp, Bos taurus
ggcaattcaaggtttttcagaacaactcttcataggctgtgattcttatccctacccccaatctcaagtacatcacacagggattcacagaagaaactcamtcaccagtttgcaaaagaattggggttggcaaattgttctaaagttaatacctaaacaaacagtaacctgtaagtccttgtataattggttactctggta

SEQ ID NO: 41018 - DNA, 201 bp, Bos taurus
aaatactagtgagtatccattaacctctagaaattgcatattattcaactgtaagagtcaaagatgagttttctgtccatcaggctgaactttgaagttcyacagaagtccatagggcatgctttgagctgtagggacccagcacagctcactgataatgagctgatagggtctgaggctgttcccagatagaaattacat

SEQ ID NO: 41019 - DNA, 201 bp, Bos taurus
aaatggaaagtatggttaatctaagttaaaaatgggttctttaaatagctctaattacattctgtttatatttgtatgtataagacacttaagatttaatyggtagcagttctaacaaaccataatgtttattagctggttttaaattattgttatcgatggcaatggaacgaaaaaataaatgacttgtctactataaaa

SEQ ID NO: 41020 - DNA, 201 bp, Bos taurus
cttaaagcaactgaaacttgactttactatcattcctaattagccttcttccaaaagctcatattggccctgacatctgacttatgtcctagacccatgayttatgtcatattggccctgacatctgacttatgtcctagacttattaagcctgataccaatatcagtagactccttttttttaatataaactttgtcact

SEQ ID NO: 41021 - DNA, 201 bp, Bos taurus
ccctggagaagggaaaggctacccactccagtattctggcctggagaattccatggactgtacagtccatggggtcacaaagagtcagatacgactgagtractttcacttcacatggttgtttttgtgctacagtggcagaactgaatagtagcgaaagcaaagcatcgctcagtcgtgtccaactcttcgcaaccccat

SEQ ID NO: 41022 - DNA, 201 bp, Bos taurus
gtggagagaaatttattaatctcttgcatttatttttatgtacccagttggggaatgattgatgtcacataagcacttaacaaatgtacagtgatttaccygtgtagatattagagagagtgctttttgaaagaaaattcaacatatttgcttgcattaatattatttatagaacaaaattggaaactgtagctatatata

SEQ ID NO: 41023 - DNA, 201 bp, Bos taurus
aagctacattaagggaaatccaatttctattaaaagctattggaaggattggtaaagagaaaaatggagtaatgaatcagcaggggtcagtgaaaaacatkcgtctttttaaatcagaaggggtcagtgaaaaaattcatctttttaaaataggattcatcaaaaagaagacaaaggtagggatttcaagatacatttcaa

SEQ ID NO: 41024 - DNA, 201 bp, Bos taurus
aaaactcttccagaaaaagaatcttggtaaagacagtgtataacaatagttgagtcacaaaaactcagtatcacgtaaagaaaagaagggatggtttgaakccgttttaggcttcagtcatatgatgcttttcctgttcaaaattaaacagaggtttaggtggctgtttgttggtatgttttgtcctcatcagaacatgac

SEQ ID NO: 41025 - DNA, 201 bp, Bos taurus
catcagtttcatgccaaatgatcttcagtttagtaccgtgatgaagccaaggtagtgactgttctccccgttttaacagataaagaaatgaagtcattcayacaaatgagaagtatctttgatcttggacaagtaagaaaaatgggagacaagcatgtaatgagcatcttcagcatgtaaggcatatgctggagaggaaac

SEQ ID NO: 41026 - DNA, 201 bp, Bos taurus
gagcgactgaactgaagagaactgaactgaactgatggcagtatagacttcatgaagtcttctaggaagacttcatgaagaaatgttatgtggactagatrttagggtgttggtgagatttcatcaggcagagtttggggaaggcaacccagaaaccaggaattataaggaacaatgtcatggaagtagaataattaagga

SEQ ID NO: 41027 - DNA, 201 bp, Bos taurus
gtttgccaaataaggtcccactctgaagccctggtggaatgacttcgggggcaccctttgcgccaggggagaatccactctgctttcagccacacccaccrtgctgaaactctgaaaactctgatcccaaccatgcgggacactgaccggaaacgtccatgctcactgagcccacaacaggggctgcctcgggccagagct

SEQ ID NO: 41028 - DNA, 201 bp, Bos taurus
gaaaaatggcctaaaaatatcagatctttattgacacagaataggaaaattgactaaagttcctttatgtccaggactttctcctgttaatcaatagcctrgggatgatcaaattaaggccccacttccctagagggacagtccctgctgtgacaaatctgaccttgttatcagagccaatttgagcactatctggtctaa

SEQ ID NO: 41029 - DNA, 201 bp, Bos taurus
tatgaatccacccctcctccaagtctccacaggactcagaggacccaggacagcctgaaaatcccaggtggatgagtgagcctccagaagacctgaagctrctattcagaaaggccaaaaatcttcttaaaccctaagctaagtacccatagcaactatcttctttatgcttcccagcaatcaatccactcagagtaatat

SEQ ID NO: 41030 - DNA, 201 bp, Bos taurus
gcagaggtgacggcagcggctccgcgtccgggtcaagcggccaaagtgacgaacgtggacgccaggggcacacgtggacgggtccgcgccccggcccgtcsctggtcctgcccagaaggggctggggagagggggcgctatttcaacctgcctgatgctcttgaactcagattttcccccttactctccaacttcaggcct

SEQ ID NO: 41031 - DNA, 201 bp, Bos taurus
atttttcctacactattaaccccaatgtcagtaaagaaatcacagttctgagaagatagcagtgagtagcactggaatcaaggcccactgggaagtggacygggagtagggtaacagagctgagttctgagagctgttcttccattccagtaacttgggagtaatgactgtggtcccagtggagaatctgagcagagatgt

SEQ ID NO: 41032 - DNA, 201 bp, Bos taurus
tccctttcactttttgcacgtcttctccgtcaccgtccacactgaggccaccaccccgtgctgttggttctacctctgaagcgtctcctgtagcacgcccrcccaccttgcagataggacggccctttgggccactgtagtcaccgcagtggccttctgcagccatgaagccgctcctgctctacaatcctgccttgattc

SEQ ID NO: 41033 - DNA, 201 bp, Bos taurus
tccgcctctcggcgctccccgggctcttccttgctcctccgtgtgttgtatgttggagtgcagcgctgagagccacagctggggtcgggggatggcggggragaggtggctcagacccagacagcagtgttctgtgaaattctgacaagtgagctgtgaggtcagtgcagttgacgctctaagccagctgggaaggtggag

SEQ ID NO: 41034 - DNA, 201 bp, Bos taurus
ttggctgggtgccctcgtgtaaccgtacggaacttcacggaatgcgggtcacggcttcattttcctttccgtctgaagaggcgagggcctgtgctagcagrtggggtgcttttctatgaagcgcagtgaaagcaagacgccagtgtggttcatgccagggccccgcagacggctcgcccgttcagaagacggcagttctct

SEQ ID NO: 41035 - DNA, 201 bp, Bos taurus
tctccctttctcaaaaaccttcagcacagaaagaaagtgtgtatgagttttctcaaaagacaagaaagagaatgaatgtaaaataatccaagtcatgcatrtttcaaaacaggaaaactgctgcagaacccacatgtggctttatataaaaggtatgttagcggaggacttaggagggaggtttgttctatatacctcaga

SEQ ID NO: 41036 - DNA, 201 bp, Bos taurus
tctggtagaaggccatctaaatctggcttgacttgccatctcttttcatcagttggtcattgagattcgccacaaggccacgggcatcagctgaggtcacyagtgtggctggtccgagcatgctggggtacgactgactggcttctgggcctaatctgtgccttcaggaacagttaggcatcaacctgtgtatatcatctc

SEQ ID NO: 41037 - DNA, 201 bp, Bos taurus
taggtccgtgcaagaccttcctggtaggctggccgcccttcgtccaccccctccggatgcctatgttccctgctccaaggccctgccagagttctcttatyaaattcacatactatactgtcccctccttccttaagaccttccagtgacttctagtttctctcaggataagaatacatttttcagttggcccatgcaagg

SEQ ID NO: 41038 - DNA, 201 bp, Bos taurus
atagccagggcatctctaaagagctacagttccctgactcttctgtaagtggggctgaggttccaaaagaaggacaggatattaatatgtggatcccactrcattcaattaggcgcagaactgacccaaatggaataaataacaagacacaactgaaacccataaccgatagagaaatggaaattaaaggcgatttctttc

SEQ ID NO: 41039 - DNA, 201 bp, Bos taurus
aaaacaagacttaataaagatcatttctgaaggggatcccagagctcctgccagcgtctttctggctccagggttttccctcaaactggccctctgaatamgtttgccaagtgtggggtatactgtatgcgttcaggaacccctaaatgctgctacattccatcagtgatcaaggccttaaggtctttagcaaatacttct

SEQ ID NO: 41040 - DNA, 201 bp, Bos taurus
tgccccggccccccaggcccgggacaccttccttcagacggcagcacagcagctgtatccccattgagagcagcgtcctgccccgctgaggaggcagaaarcagggcacagtggccgaagcccctgcaacaggctgtcggaagaggacacgagaggtctggctggggtccctgacgcctactccatgctcccagggaggct

SEQ ID NO: 41041 - DNA, 201 bp, Bos taurus
gcttgagtctttctctataggctccgaactttttaaaatgctctgccttcttcacttcattttctcaggcacctgatcttaactttctaaggtaaagactrcttagcagattaacttatctaactaaggtagctctcccaaatcatgttatgtgaaaaactagcctctaagatgctccatgaaagaaagtcaagtttgttt

SEQ ID NO: 41042 - DNA, 201 bp, Bos taurus
gcaacagttgttagccctgctttgctgagtaggctgccgtagtgtggtgcttcttagtccaaggttgtagtttggtgttgtgccagacctgtcagctcacrtggaccaaaggcctcagattcactagctgtggttacctgactctagcacatgatctaaccaaagcaacagcaagaaaaacatgggaataatgaatcaata

SEQ ID NO: 41043 - DNA, 201 bp, Bos taurus
ttaccattttgattttagattccctggctgagctttaattcctgccatagtttatcttccatctctctaaactagctgtgagacttctgtcagtgtggccmgatcaactctgctctattttgattctaagcattgtatcctaatccttagctgtattcccaacacaccctaatattttgcacctaagaaagtagtggtagt

SEQ ID NO: 41044 - DNA, 201 bp, Bos taurus
aatgtgattgtatcaatataaaaatgagcagtggttatagaaatcaaggaagattatgatctcacttttacactcacgttggcacctcatggcctcaattwaaaaaaaaaaaatgttgttcttttggttttgtccatgagccagcctgctgcagatgtgagtatctccccagattttagagggtagccctgaatgctgaag

SEQ ID NO: 41045 - DNA, 201 bp, Bos taurus
ccaaaatagatacgtcttcaagtattctctttctagtctgaaattccatgatcctgggactgggttgtttttattaacaaccttgatctttttacaacaascttgatctaatctttgccaaagttgcaacatccagctataagcaaagaaacacaagaaacacaaagattagaaaaccggactacagtgtccctttttctc

SEQ ID NO: 41046 - DNA, 201 bp, Bos taurus
atgtatatacacacatacatacacacacaaacaattaatggaaacaatctatattctatgcaatattctgccttctagacctactaatgaaaagtcttgcygggtagaaaatgtttaattgatgattttaaactttgagagatatacatccttacccttttgtgattcacccaaagagattttctttaaggattgtataac

SEQ ID NO: 41047 - DNA, 201 bp, Bos taurus
tgggccccagtggtctaggccagtggttctccaagtgtggttcttaaatcagcaacatcagaatcaactgggggctggcttgttagaaatgtgcattctcrgggccccaaccagatttgctcaatcagaaatcttggagttaaggcctaatgattaagcttttcacaagccctacagtgatctgatttctagtctgaaaat

SEQ ID NO: 41048 - DNA, 201 bp, Bos taurus
actttatgggaattttagtcaccatatttcatatgaagctcctaactacagcaaggaaaactacaattaccagaagttacgttttaagtggtaaataccaygtgtagatataccatcttcaggaatgaaaacgcttggcacccagggtcatttctacgcttttaagtttcctttgctagacttctggttagtcaattactt

SEQ ID NO: 41049 - DNA, 201 bp, Bos taurus
agagtccttcccaaacttaaaggacagtacagcagagaagattccagggctctgcttggtcacagaggtccagggtccactgcctaagcactattttaatygcagattctaattcaaaccactattctgaaagcacggcgtaggtgggaatagaccatactttggcagagaaatttttgcagagggtttgtaagagtccag

SEQ ID NO: 41050 - DNA, 201 bp, Bos taurus
caagagagaggccaagttaaatgattgcaaaatgagcttccatctactctgacactagcttaacatcacaagaattgctccactgtaatatttttatatgmcaggatctaggccatcagcatctttgacaaagaaaatttctgcaacaccagcaaaatgggtttttaacattctaactaaataccatcccagacattcaac

SEQ ID NO: 41051 - DNA, 201 bp, Bos taurus
ttggaaaaaaggaaagctcggtgtgtgtgtgtgagtgtgtgtgtacacatgtagtttatcagaaaggaaaagccttcttccttgatcagaccgagttcacygcacagccctgacagtggcttaatttacatctgtttcatagaagagaaaaggtgagcagggttgtccaggtgccttccagcacattctctctgctctgca

SEQ ID NO: 41052 - DNA, 201 bp, Bos taurus
ttctggacagattggggccacagtccagacgtgctggtcattcccatatgatgctgctattttggtgttgcttcagaaccaataacctgtctgtcacgaawagggccaggttcgatatactgaaattttatttcagtttccatttggcaagaattgtgaaggtcttaactgaaacagtactattaaacaaggctccaactc

SEQ ID NO: 41053 - DNA, 201 bp, Bos taurus
acagatggaagagcgggagaaggactcttgtttttggttttaacactcctattagctgaagcactgactctgctctaaaagcagctgctcaccttccctcmtcttggctggaaaacagcctactgtaaggcttaggggaccgcatgacctccctgaggtggtcaagtcaagagcagagttagacaggcaacaaatttcatg

SEQ ID NO: 41054 - DNA, 201 bp, Bos taurus
tggcccatgtgggtttaaaaaagaagggctttttcctgccctctccccacataaagcacacactaacacacaagcgcacacgcacaggcaggcacacaacrcagcagtggcgacagtccgcacagggacagattccagtagctcttgctctgctcctcaagaaggattttctggagtatttttgaaggatcttccagagct

SEQ ID NO: 41055 - DNA, 201 bp, Bos taurus
cccaggggactcattccaggcagacacactgtattgatcctgtttatgacatattctagttgctattggcaaaatacctttcttctgggagtaaaatgacrtgtttacaagcaaaattggaggcataaaagattttcagtaaactccttagggctcattagaattggggtctattttatgcactctggtttgggtagatcc

SEQ ID NO: 41056 - DNA, 201 bp, Bos taurus
tgaatgagtttcttgaactcatttagtgccttgtctataacagtcccattaccaagccaccatgtaacttggcaactgttcatcaggggtggcctccggamtgaataagcaagaaggaaatccagccacttgcctcagcacttcatgttatacctgatgctcttggcaggctgtgattgaaagcaggtccttgccgcatgg

SEQ ID NO: 41057 - DNA, 201 bp, Bos taurus
gtgcttgtggttgaaatgcagtcatacaggaaacaagaatgacattgagcagtggatcagagatggtattaaggttttgataattactgaaaattataatycttgcccaatctgaaatgctcacatatataagtaaaaagactgctattgagatgacctattagttattttaaaagagaaacatacttggtaacatactgt

SEQ ID NO: 41058 - DNA, 201 bp, Bos taurus
tgtaataaatctgaaactgttgaaattaaagtggttatgtctatggaaaacttatttttgaagaaatatttctagttgattcttatgtgccccagtaagcrtcctattaacattttgtccaaagtcatctttggaggaagggattaaatgcatctgctgaagtgcaatggtgatgccaagtgtgggggaccagtgaggcta

SEQ ID NO: 41059 - DNA, 201 bp, Bos taurus
tttaaggaatggggaggatcctaatacctgagtaaaaatgcccataaagattcaaggagaatgtgcagtttgaatcacactggtccagttttaagaaatgratgatcagtagtgtcaaatgcatgtcaaagtctagaataatgtctgtgagatatatgatagatttggcgattgaaagaacattgatgacttcatgagagc

SEQ ID NO: 41060 - DNA, 201 bp, Bos taurus
cctaagttattgccacatcttatctgaatagaaagaaatatttttattccaagatatggcaaggcctcctgccaatcatgatttataattttaagtattcratatttattgtttaggaactgagaagatcgcttttatatttaacttccttttgttgttaaactatttgacttaaaatttggcttttgactaaagattgca

SEQ ID NO: 41061 - DNA, 201 bp, Bos taurus
ttccactgtttccccatcttatttcccatgaagtgatcggaccagatgccatgatcttagtttttctactcagagcaacttttagagctgataattattartatctttcagagcctgtttttaagagtagataacacactgtatgttttttataataaaggaatcacatggtccaatgccatcctgagaaatttttttttt

SEQ ID NO: 41062 - DNA, 201 bp, Bos taurus
ttatcataaagaaatataaggttaatccttctgacatacagacatctgaatgatttaccaaagcactctaaattgcactcaacaaatatctacttctatawaaagaatatttattttaaatcattgcaaatcctgtgctttcaatacgttttgatagtcattaatatttttatcacatttcctcaaaggtgagctaattac

SEQ ID NO: 41063 - DNA, 201 bp, Bos taurus
gttatttcctactaaatacatacagttcaacacaataaccctcacattctgccctgagtcactcatatacttaaaggcaagtcttaattttaggtaacatycctcagactggttagtcatgcctaaggggttcttctttggactgagcagagtgagatgaccatggttggcatttccatattttctaattaaaatttaaaa

SEQ ID NO: 41064 - DNA, 201 bp, Bos taurus
aagttattataataactagaaagggcctataattgtagatctccttacagttgtaatctcctctaaattaattttcccctctctgtctgttcagtcctctyggcctctgggccttcccatctcaggtacttagcatttagtgttcccccagcttggaatgcttttctttcaggtattacacacatgtctgtctctcatatc

SEQ ID NO: 41065 - DNA, 201 bp, Bos taurus
aaataacactggttctttcttaatacttttctctctcaaaccttcactgacttgtagaaggcttacctgtgcaaggtgagcccaggatgtagctgacttcrgtatggagcattaactttgatgactcccagtttcatttccatgaaagttactgtagattttccaaacaaaggcattttcaataagggtgaatattagaga

SEQ ID NO: 41066 - DNA, 201 bp, Bos taurus
aagtgacagaatagttcatttcagatacaagggtctttggttcaagtgccaaaatggaaggatttgtcataaaaccgcaaaaagaagtttgattaaagaamctttaatgaagatctgacatttaatctggtcttttattggataagatctttaaatattctctccttatgaattcgtttcatattcactggaatggtactt

SEQ ID NO: 41067 - DNA, 201 bp, Bos taurus
tgctctgtttgaaaccaagtacaccttttaaactgtctggaagtttgatctattacagatctgagcagattaaactcttttggcccacagtttaaaaaaamattttaaaaactctccaggactggaatctaaatgtaggaaaagtaaggacactgcataaactgtatggaaagattgaggcctctgggtatgaagtctcca

SEQ ID NO: 41068 - DNA, 201 bp, Bos taurus
actttcctatgcacgtgaatcactgaggactttggtgaagtgtggattctgctccattaggtctagggtgggacctgagtcctaacaagcttccaggatgyccaggcctctgatcgtggacaccacttagtgtagccaggccaccagagaatccagccaaagggagagtgggtgtaccacagcccaggcagcctggaccag

SEQ ID NO: 41069 - DNA, 201 bp, Bos taurus
gaagttggagccaaaagtttacaaggtggagggtgggccttgtaggcagaaggcagagcgggtgcttgcacaggcatgaacagtgagagagcacagcatgytgttgcatgtggctgtacacggaggctggggtgatgaagggccagagtatgaaggggcctggccttgtgccctgaaagtctggtttaggatgcagatttc

SEQ ID NO: 41070 - DNA, 201 bp, Bos taurus
gatagttttggattaaaaccaagatctttacctcaaatcatttcttttcactgctacttatccttgaagtgaaagacagtttaaacttttgctgcctttayaagcagggagagaaacatctggaggagctatagtctttcttgtcactggctgtgcacttggagtgcaggtgtgtgcggaagagggcagcaaggatagata

SEQ ID NO: 41071 - DNA, 201 bp, Bos taurus
ccttaaggtcattgcacttgcagcattctctgtttgtaacaggaaatgttaaaaacaaaaccacctgaacagaagcacccaggtgctctcaggggggcctrgagggttgtgtagtgttggcgcttgtgaccctggcaggaggcgcgtccgtagagccactgcccagcgtccccagcgacagccatgttgccacggccccgc

SEQ ID NO: 41072 - DNA, 201 bp, Bos taurus
gatctgggtcaaagattatctatgtttttaacttaactttgctttataaactttgatttttgtaaagtattaatatcctcccaatactgcattgtggcccmaaaactgatacttttctggtggcaagttctctgcctgggctttagccctcctgccgtttgtgggcagagggagagaacggtcagcgaatatagatgtcta

SEQ ID NO: 41073 - DNA, 201 bp, Bos taurus
aagacacagcactaaatagacttaaaagcacactcatttacagtataagagttcaaacaggaaggcaataagacctttggtttgatctcaactggaagcgygtacgtgggtgactcagatttttcctactctgtgtatgcttgcaaatgaccacaaaagttacgctgagtattgactttgaggtttaaaataaatgttagc

SEQ ID NO: 41074 - DNA, 201 bp, Bos taurus
catcctcctccctccaccttttcgtagctagaaagtgtccaactggcaatgttcaaatcgtaaaggcagcaaaaacggccctgcgtgctgtcacaaatgtstaaaaagtggattagggatcaccagggagggacagctcggacacccgaggcccccgtcctccgcgcggggctggcgcagctcggctccctgcccagcccg

SEQ ID NO: 41075 - DNA, 201 bp, Bos taurus
aagaaaataattagcttcatatacaccaagaacattaaaactagtatgaatacattttctgataccagtttttttcctaagaaaaagttttaggtccagcrtatagttttactttatgatagtatctcctacagtttaactttattgctaatacacaaagacatggagcctgtggcatatacataaaaaaagatgaagcct

SEQ ID NO: 41076 - DNA, 201 bp, Bos taurus
gcatctccctcaaagaagttttgcatttttttctgccggctttatcagtttgtttttttttttcacccagggtaatagaagtgctaactctaaacccatakgaggcagtgttgttgtttatttgctaagtcatgtccaactcttttttttttttttttaattaatttttttttttttttttaattttattttacatgtcca

SEQ ID NO: 41077 - DNA, 201 bp, Bos taurus
taccatttctgtcctttattgtgcctgtctttgcatgaaatgttctagggataatctaaatcagatctgtccctcatcacaaaaagatctcaccagcagaytcatctatgccaataacttaagacagctttttatttcaagataggagatttacttcccaaatgcactgaaaacctaactgatccctggcttgagtgggca

SEQ ID NO: 41078 - DNA, 201 bp, Bos taurus
ctacagataaatgtgtgcatattgagtgaaatactatatgtaaagcttctggcccagtgcttagcaggtattaggtttgcaataaatatctgttttaaaartgataattctttaggtctttcagggactaaaaatatttcaaagaaaatgcacatataaacaacacattttcttacctaagtctataagttataatagttt

SEQ ID NO: 41079 - DNA, 201 bp, Bos taurus
aaatgttcctttgatgttctctgaagtcattgttaaggaatggcaaaattcaaatgattttctgcaagtcacgcttatgagcgtaataagagtttgaaggsatgtatagcagtctccagttttccagcctcagttttcattctgagaccatttctaatgtgcttacaaatttaatccctcataatgttttattataatatt

SEQ ID NO: 41080 - DNA, 201 bp, Bos taurus
tgggtatcaatagtaacctcatgttgtcataaggattaagtgacgcatgatgtagataataaagcacttagttgcctggtccacagtaaacacccaaataraagttcatcaatagacaaattattgtttcactttttttctagtacagtgtcatttcaaaaaggcttgtgtgtggagaagctatttcaaggtcaggattaa

SEQ ID NO: 41081 - DNA, 201 bp, Bos taurus
gagagcagaggttctgatcatacagatcataaagagagtttctgatcataaagagccttgacagtcacatgaaaattttgacttttattctaaaaggtacrgaagtttttgaaagggtttgaactccagtgaattgatactgaatttttacagtattcttcatactgagaaatcattagaaagttattgcagtcatttaga

SEQ ID NO: 41082 - DNA, 201 bp, Bos taurus
ttattctgattaaccaatctccaggaatgctacaaaacctaagtattaaatctgttccctccagcttcagtttattgttaccctgtccctggttctgcagyttttcatgtggcactagtggtaaagaacccacctgccaatgtaagagacaaaggagacacgggttccatccctgggtttggaagatcccctggaggagaa

SEQ ID NO: 41083 - DNA, 201 bp, Bos taurus
ttattttagctaaaggattctgttttgtctttccagattttctgtcagatattgatgataaaactagcctccagccagttatttgattcacatctgtcatstgtcaggaacacaactttctctgactagctgttccttttcttcttttaaggttccttttactttatagaatcaatcaaatattgctggaactcagtggga

SEQ ID NO: 41084 - DNA, 201 bp, Bos taurus
ctttccctgcttcagccggtgtccaagaaggttgacagctagggactgtcttgccacctggattccagttggattggccagtggtaaacataggccggtcrgaggagaggatgagagagacattgggatacgttttcctggtcatgatttcatctggttgtactcctggcaggggccatcacctcttctttttttgcaata

SEQ ID NO: 41085 - DNA, 201 bp, Bos taurus
atattataagaatttacatagaaattgtaattatttcattatgtataagtaaaataaaccagaattagaaggagcattttcttcattgcctcatttcagcrtactgtctcatttcatttattgattcttttctaatccttacatgaaatttcagtatgtttttaatttgagggtgttagtcttgccttactcttcctcaaa

SEQ ID NO: 41086 - DNA, 201 bp, Bos taurus
attcacaagtgagatattatttagtaagaattaagttttgcatattctatttgcattcacagagagaaaatcttaataaatatgccaaacccttttagaayaggatttttcttttactggctaatgaatccaaattttattcctttattcatgaatcattttgaagaaatttgctaaaattggaagttacttgtctcttca

SEQ ID NO: 41087 - DNA, 201 bp, Bos taurus
gtgttgtgatttctcacttttgggcaatgactatctgctgttatcaaacctagtaccatcaaggtcaagaagataagtcaattttgtctcattacacaatrcttttcatgctactgtgacttgtatgtaaactgtatattttaaattatgtacccagggtaataacctacactctattttttacagctgtctttgagtaat

SEQ ID NO: 41088 - DNA, 201 bp, Bos taurus
tttcttttgaggtcaaagcagagggtagaggctaggactactgaatctcttgcctttcctcttctgctaatcccagcctcccagaatgtatagaatacatmtttccaacctacagacctactcattatctaggagtttctcctttgtttttatatacttttttttcccacatagaacttgttctcccatcatgataaagtc

SEQ ID NO: 41089 - DNA, 201 bp, Bos taurus
gtgtacacagattatttacttcagtatcaggggccttacatgacatctcagccaaacccagtctgcaaaagaacagtactaattgccaggtcatggaataragggagataagccatcagaggccattatttatgatggtccagatctgaaaactacattagctctttttgcttaagattcatttcatattatgtatctatt

SEQ ID NO: 41090 - DNA, 201 bp, Bos taurus
attccttgactcatggccgccacctctgtttttaaactggcagcacagcttcttcaaatctccgactctgagtgtcctcttgcctcctttatctgttaaaygtccctgttaccacaggggcccacctaaccagttcagtgtaattgctctatctcaagatccttaatttagtcatacctcagaattccttatgccatgcca

SEQ ID NO: 41091 - DNA, 201 bp, Bos taurus
tgggcccatggtttatacagagaaaagctagacatgtagacagagaccctcttcagtgtgctggagagattccccaggcagaaatttgggttaagagttakggccatattgggaaagaagaggcatgtttggtttccttatgcacaagagaaaagcaaacaaacaggtcttaatgatctcagggaattggaggatgagtaa

SEQ ID NO: 41092 - DNA, 201 bp, Bos taurus
ttcaggcctgaataatattacacacacacacaaccacacacacacatgcacaccacatcttctttatccattcatccatcagtaggcacttaggctgttamcgtaccttggccattgtggataatgttgctgtgcagctgggagtgcagatacctctttgatatcctctttccttttctttagacatatatacccagacat

SEQ ID NO: 41093 - DNA, 201 bp, Bos taurus
cagataggaaacagaaataaaaatataattttaaattggttgtgtattagaatgtgtttgcaccatacccatggtatgtggccaagtttctccataaggayttgaaatgaccttacaatgaaatttggatttaatgagtttttagaaatgaggggccaagttgccagccctactttgggctatggtaaaatcagaaattaa

SEQ ID NO: 41094 - DNA, 201 bp, Bos taurus
ttcatcacgatgctgtgttgtggtgaaaaggtatagaatacgagccctactcccaagacgggcacaataaacattaaacaataaaaaaagggcaatattcytttatttaacaagtatgaataacttcctacttgaagagaggtgaggcccagctctatggccgttaacaaagaaggtgtccctgaagtcctgaggaaagtg

SEQ ID NO: 41095 - DNA, 201 bp, Bos taurus
agtctatcagtaatactttgccatggtgattttatattcttttataacaatcacaataggtttcttagaaagaagaataaattctgaagagagactaagtrtatgaaaagtggaaaataactcttagtcaaaagtgtgaaagaaatcacacaaataaaggcattccgtttcaaaacccaggtgggaagattaaaatcgaaa

SEQ ID NO: 41096 - DNA, 201 bp, Bos taurus
ggacatgacagtctaatgtgatacttgaacctggattggatcttgcactaagaaatatggaaattattgggatgattgtcagaattaaagtatggactctytatattatatcaatgctgcagttcctgaatttgatcattgtactgtggttatgtagaagaatatacttatataaatatgtgtatatctatatataggtag

SEQ ID NO: 41097 - DNA, 201 bp, Bos taurus
ccacagtgacattcgtagagcaatatcaggtaatttttcattgttttactattacagttggtcttatagtatgtaaacttttgaaaacctctggttggaaygggaaatgtttcttgccccatgtattcctagacgagagggtaaactgcactgatttcagtgtctcaagcaaaatcaaatccaaaagctgctcagagcacc

SEQ ID NO: 41098 - DNA, 201 bp, Bos taurus
ctgtttgagttatactgaagacttcactctccttttcttttttaatttccttgctatttgtcctcagtgctttcatgttcatagccactttctgtctgagrccacctcggagtcttctttttatccaaattgtgcctttgacttaaaaaaagatcattctacgtgtacagctctgtcttaatttcaaggcaacattcatca

SEQ ID NO: 41099 - DNA, 201 bp, Bos taurus
agggcacggggaaaggggtaggatgggggtccggcccagaggaggggctgggagctgcctcacagaagctgtaggagcttcagtgattgtaagagggctgygggctcggccgacgccagatactggcagcagagccagtcctccagctccaccccgcgccggcggtccaccgccttctcggcgaacttcatcatcatcagg

SEQ ID NO: 41100 - DNA, 201 bp, Bos taurus
cacctaagaacaatgagtctctaactcctggcctgttaaggaagaaacgctacatgttcaagagcttgatcatctgttcacacaggggcagatgggaagakgtgaaaagaaggccatgaatgaccaatggaaagtaaagactgaacaactacaattcacagacggggccctcccaccagctgccctgcccacaggtcagca

SEQ ID NO: 41101 - DNA, 201 bp, Bos taurus
cctcttagtgccctgtcagtctcctggaataccgctattccgccacttgctgagccaaatggggattgtacatgtccttagagcagtcaataatgctgtgktctctatgcattcccctttgtggccaattattgtaatactcgatgggagatgctaaatggtttactgtgttcgacctcaagggtgccttcttttctatct

SEQ ID NO: 41102 - DNA, 201 bp, Bos taurus
tctgggctgtagggagacaaggggtgggagatggaagtttgggtcaagtcacagacagccttggatgctatgatcaggaatttagcctccattctagagcycatgagtagccgctaacaggtttctaggtagatagtccaataaccaggtttatatttcacaaagatatgtctggcagcatttggagggaaaatgggaaag

SEQ ID NO: 41103 - DNA, 201 bp, Bos taurus
cagaaattctgagctgaggctggggaatctgcctctgcagatgtttggaggccctcctggtgattctgatgctcagctccaccaggcatcagacccactgsacagcactgcttcccacagcagcactcacacttgtaatgggccttgtggctgggggagttccatcaccaaacctgccttgacccattaaaaatcccttta

SEQ ID NO: 41104 - DNA, 201 bp, Bos taurus
atcccacctgtctgtctatcccaggaacgcacggttaggacactgacattactaactagctgtaggcggcctcacagaaccgcgtgaacttcaccttgacyccttcacagcggtgggcaggaaggcgagcccgctttctcttccgcacactcagcacacacgctcacctgctgtgcacagtcacctcattaatacactaga

SEQ ID NO: 41105 - DNA, 201 bp, Bos taurus
acttcacataaatggacttctatcacacattctttctttaatggagtccttctggttttggctcccacgcagtcccattttctaaacagtctcatggcccyttggagggtgggtctgtgtgcccacaagagaccccgtggtctccccaggctcactcttgaagcagggtcctccgattcaggggtgccctctggcaggcct

SEQ ID NO: 41106 - DNA, 201 bp, Bos taurus
atttcttgaacattccaggcactttgtcagctctgggccttttcatttgttgtttgcactgcctgcaattctcttccctcagagagcctcaaagttggctycttccctccttcaggcctttgcccaagtagcacatcatcaaagagacctcccataaccattctatttacaattgcaagaccctttcccacagaatcatcc

SEQ ID NO: 41107 - DNA, 201 bp, Bos taurus
ggctgcttactcccctaatgagtttgaggctacagaggccactctggccaatcagttctactctgctggctcctgtggccgtagaaccatcctgaatccakccagccagaccctgcctcaagaggagagactggaaatggaccccaccagttctaagactgggaaggccaccccaaacagggtaaattgagtctggaatgt

SEQ ID NO: 41108 - DNA, 201 bp, Bos taurus
actgggaaaaaccttttatggcttttctggttggcctcctcacagcaaggcgcccatgggtaacaacggaaatgctgtgataatatcctgccagttctgaygaggcctgatctcatctgttctttgaagtccttcatggagaagctgatgggtgcagagtagctgttacatgtttcctggtaccagtccttcagagaacta

SEQ ID NO: 41109 - DNA, 201 bp, Bos taurus
atgtatcatgcctaatgaaagaaggacaaaaacaaacaactgatttttttcagtggttctcaccaagaggttatattttctgcccccaaagtggccttgayctctgctgaaataagcaccagaaaatgaatgtattcccatgattggtaatgacagttacctcattatgagttcacatttcctgtcacttgggcaattagt

SEQ ID NO: 41110 - DNA, 201 bp, Bos taurus
tagactggagggcagagggcatgaattggtatggaaaacactatagaggtctctgcacatgagattagagacaagtatgggggccgtaggaatggttgggrggaaaggaaaatctgctaaaaaaactacttcgttatcattatcttcattacgatcattgcatcagcaagatgaagtttcatattggccaacaataagcag

SEQ ID NO: 41111 - DNA, 201 bp, Bos taurus
attatcatccctaaggcagagagacaaggaggaaatggaggtaccagagccaatgagagctgaagacggagaaggggccacacggtgggagtcatggaagrggtgaacaatttgctgcctttctgataccttggtactgtctccttggaccaaatccacctgcagccaatcagcaaagggccccaaggattgagtccgtag

SEQ ID NO: 41112 - DNA, 201 bp, Bos taurus
ggagatactttctgtttaaaatgtgtaatagtacctttagtgaaaacatgttatctctttctagcatataaacgttggtttatcactgcaaagaaaatacractaaataaatatacctacttttgtgtctcataaaaatgtacgtaaactcaaaatatggaaaatttattattttacctctttaggaggactactatcagt

SEQ ID NO: 41113 - DNA, 201 bp, Bos taurus
ttttaattaaaataatgttatttctgattttttttaaaggtaagaagtttgattatttttcattttcatattatatgtgagcagagaaccttttgataacrggtcaaattaaaatgtgacaaatttgttgaagagaaactttattttcctcttgtatttatactgcatataaattaaataccgtcttggcatatttcattg

SEQ ID NO: 41114 - DNA, 201 bp, Bos taurus
cagtctctgcctccttcctgtccctcatttgcttaacgctggtaattttaatttatatgttaagtcaagtgctaatgtcccaagcttcttatcaaaacttyaagttttgaaaatcaaattttgaaagcaagtactccacataaagtactttatgtggagataaaaagtgggctcagattttttggggggttcactccagct

SEQ ID NO: 41115 - DNA, 201 bp, Bos taurus
ataactggatccagttctcctttcctgagcctttaaactcactgtcatagagggagaatgttgtgatttcaagatggccagttaacataagtcctttgttyatctgagttttgaatccatcaagagatcaaaaacaagggccaaatgaaaatatcattttagtgataagccagacccagccagtttagaactagaaccaca

SEQ ID NO: 41116 - DNA, 201 bp, Bos taurus
cacagaatggttactttgatgtgagttgttcaaaatcagctctggatccaagcagattgtgtgtttactgcctgcttctggcctgggttactttatacccratcacaacccgcagcgttttcaggtcacaagctctttcaagtgggctcatgagggtctaccttgcttaattctgtgcccgttcttggagagactttacgg

SEQ ID NO: 41117 - DNA, 201 bp, Bos taurus
tgagcttaatctactgtaccagaggtaaacttctaacttctttttaaacaattacattttcagtcattaactctacttccgaagtaactcagtggcaccartatctgagctttttggaggtcctttgtccaagtgacagtaccgttgctactatattcaccctgaaaagctcttttagcgagcatgaaatgacacatgaat

SEQ ID NO: 41118 - DNA, 201 bp, Bos taurus
aatgtatatattaatcttaatgacttaatgcagaccaagaactgacctttgagaagaaaggtgtctcctggatggccactgccatagccactggagaggartaggagattaaacgagaggacagtgggaaggtgcgggaacctgagaagacaggcctcgggctcccaggagaaggacaggaactgagatggaggaggaaag

SEQ ID NO: 41119 - DNA, 201 bp, Bos taurus
ctttgtgaccccatgaactgtagcctaccaggctcctctgtccatgggattctccaggcagtagtcctggagtgaattgccatttccttctccaggggatmttcccaatccagggccattgtttacagactctttacagtctgagccaccagggaatccatttgtctattactttgttacatattggatttttctggtaac

SEQ ID NO: 41120 - DNA, 201 bp, Bos taurus
acaatgtgtgcttaactctggcttacagactgccaagccatgaaaataggagataataatgttatcgagtcaaaaggtaagctacgtttggaactatattrtgagaagtgattacctcctctctctctgtggtgttctgaaaaacagcctaagtgcaaaccacaacgaagccacgtgcttggaaggacggcaggcatggtt

SEQ ID NO: 41121 - DNA, 201 bp, Bos taurus
tggagagggaggcctggcatgctgcgattcatggggttgcaaagagtcggtcacgacttgagtgactgaactgaactgaactccagtgtgtggtgtgccakggcctctgcaggtgactataccagctgcattctggtcactccccaatccccccatcctactggtcacgctgtctcctcagctctaaatgcgcttggctct

SEQ ID NO: 41122 - DNA, 201 bp, Bos taurus
tacaagcagcatagcacacgacacaatgctggactactcaggatgcttttattacaagtgacaggaacctcgctaacaggccaggaaaagagaacgtattmgataaacaaacacagcaggtcacacagcagtgggaggcacaggggaacagctgggcctggggacagctggaaccacggactggaattcagcaggacacag

SEQ ID NO: 41123 - DNA, 201 bp, Bos taurus
cccagcacatcctataaacatttatgtgcaggcctttcctcacctgttaaagacataattcttcataaactttcccacaatgttttccagttcctaaacayagggaagcaaggttatgggtgaagacaatccatgcattccctgacagaggtttattgccctcagtcccagggcaaacagagctggctcctagcagtacaa

SEQ ID NO: 41124 - DNA, 201 bp, Bos taurus
ggttaggacttgggcttccatggcaggaagcacaggttcaatccctagtccgggaactaagatcctgcaagccacagggtgtggccaaaaaagaaagaaaraaagaagaaaaaaaaaatgctcttcatgagcagactcctcaaagttcgtccagcttctaatacatgcccccaaagccacggccacttgtttggggttggt

SEQ ID NO: 41125 - DNA, 201 bp, Bos taurus
taatgcactcgaatcatcccagaaccatccccctaccctgattcatggagaaactgtcttccagaaaagtggtccctggagccgataaggttggggaccaytgctgtaggagacagctggcagtgggccctttcctagccaccgttagtcaggtaggatgaggcagaaaggggtccagtgagcaagcctggaaactccctg

SEQ ID NO: 41126 - DNA, 201 bp, Bos taurus
catgattgagaaacgtaagcctcattccagtaagtccctctttgtaggtttgttcacagtattataaaccacttgtccgtgtttagagcgtctcttcttgytgtttgtctgtcttggttactgtctgtctcagttatgagtactaagtcttttccccaaatgacttgaagtgatttttaaatccatttattttttttttcc

SEQ ID NO: 41127 - DNA, 201 bp, Bos taurus
actctgggctagactggagggaaacattgctcctgcggtgcctgggacctgcaggctctgtgacagcctcagttttgagggcctccacttctgccacttaytgtgtggagaccagcccaggaataactgctcagtggtggtttgaacagctggatcatacgccaccgattcatcctcagagaccctcacacaggcctgggc

SEQ ID NO: 41128 - DNA, 201 bp, Bos taurus
ttctttcagggacttctgaggcccctggaattgcacacaacactgtgagcgtgcagttgtgtacatggggtcgagcacacgtgcatttttctgctgaacargacggtggccttaggaggaaggtcagccacgctggatggtccctcgagccagagtcagcgagtcatgggtttccccagtgttcatgacgcatctaagtag

SEQ ID NO: 41129 - DNA, 201 bp, Bos taurus
ggtagctcacagaatcttgggaggactggtgatccatattcagaagttaggcagccagagtcacagtggccaaaaccatggctcggaaatgggccagcgargtcagctttagtgtcatggtgttctgatcacgacagctagaaaccaacaagacaggcactagggctgcagccaggctgtcccttgattttactgccacga

SEQ ID NO: 41130 - DNA, 201 bp, Bos taurus
gagaatacattgttcaagggaaaagtacatacaacttttacaacagctccaaacatacttacatttaccaatacatgccaggcctgtggcagataatcagrtgagtatccagtgaatggagaacaatgacagattgattaggctccaacagctgctttgaatcaaataactttggacatggcccacttcaagctaatggtg

SEQ ID NO: 41131 - DNA, 201 bp, Bos taurus
agactagtttgcgcccagcagggccatcagtgagcccagctgagaccagaaccctccagttgagcccagtcaaaatcgccagtccacagaatcttgggctrcatgaatcaatactgttttaggccaacacatttcggactggtttgtcatatagcagtagataactgacacaaagtctgcaaggtggacaggaagggagaa

SEQ ID NO: 41132 - DNA, 201 bp, Bos taurus
agctctggctccaccagttaaaactgtaagttcatgtgcctctcctgatctgctgaattaaaatcacagaggatgggcctcagaaaccatttttacaaacyaaccaggcaattcttgtgtaactttaacatttgagaagcactgccattgaggatattctgtagggattttcctaggcctgtggaatttgctgttctgtga

SEQ ID NO: 41133 - DNA, 201 bp, Bos taurus
tacgcaactctgagagagaaatatagttattacagtgttgacagtattaaaacaaaatcaagccaattactcaggaggagcccaactctttctctaagtgyggccagggagtattttccctttatcagaaaaagacccaatagagtataaggtgtaatgtgaagtcttaaagctgtatctttcagaatctcttgagtagtc

SEQ ID NO: 41134 - DNA, 201 bp, Bos taurus
ttaaagataataggtaaatgaaatgaacatccaataaaaaccagtttgtgtatttaaacagaactaaaaggctaaacttagaatgtaagagagaataggartaaagctgttcatgaaagcagtcaattcagttgatattttgtcattttcctgactttctctaacttaaaggaaaaaaaaaatgtatcatacccccacatc

SEQ ID NO: 41135 - DNA, 201 bp, Bos taurus
atattcaaaatttctttgagaagaatgctctcagtgaagttctatctcctcattctttttactacttgctaaagaaaattcactgacactagttctggatytttatcatcattcagagctgtgtagttaaagaactgagtgaattactaccttcaggagctgaaactcaagggggcagtttgactattgactagcgaaatt

SEQ ID NO: 41136 - DNA, 201 bp, Bos taurus
ccatctgtgagagatgacaaagtagttagtaaagcttatccttccctggcttccaccgaagcaggtgctttttttttttttccctgtggcctgcactgtcyttgtctgtaaaatgaaggtgctgaatcagatgactattatggtccttttaagtgccaagtttctgtgagtcactttttggttgtgtgtatcaagtagtgc

SEQ ID NO: 41137 - DNA, 201 bp, Bos taurus
gctcatttccaccccaccccccatcatgaggtgatgattgacagccagctctaactacacaaaagagggcagtaagaccgcattaacttggataccagtgyctctcaaagtgatttgaaaatcaatagcaagttctgaaattcactgtgtaagaaatagtaatgttgagggtcatttagaagaaagattagtctaatgaat

SEQ ID NO: 41138 - DNA, 201 bp, Bos taurus
gcttctgctctgtcttcattcctctcttttcattaattcatttattcctgttagaatgacctaggctcatttttcttctcatgatgtccaagatttttttwaaatttatttaattggaggctaattactttgcaataaacctgtatgcgagatagcaaaaaagacacagatgtatagaacaagatttttatttattgaaat

SEQ ID NO: 41139 - DNA, 201 bp, Bos taurus
aacctggccctgctatggcagcatagtcgttttctaatatgagggacccaccacttaaattttcaaaaccagagatcatgtatcatggtatttgagaaaayctggctttatttgagactgaactaaatatgatactatattccaggattacagagaaagaaaatataagaatacagagacgatatgatgactaaaatttag

SEQ ID NO: 41140 - DNA, 201 bp, Bos taurus
gtgttcttgcctggagaatcacagggacgggtgggctgccgtctctggggtcgcacagagtcggacacgactgaagcgacttagcagcagcaggattcttrggctatcgagttccagatttctagcgccatagagaccttcctcatccccagccttccctcaccccaacttcacatggattgtgtggtctccggcacctac

SEQ ID NO: 41141 - DNA, 201 bp, Bos taurus
ggggccccagagataccttgtttaaagctcagagcacacaattttattttaagtgcataaccgacattataggatttctctctcatatattccaagttagrgagcaaatggttatttaccagggccaaatagtgagtggtaatatgcgaataatatccatctctgagcttaggaaaacaaattcagagattactcagcacc

SEQ ID NO: 41142 - DNA, 201 bp, Bos taurus
ggtataaatggtaagacaaaatggccagagagaaatcaggagccgggggacaaggacgcagacacagatgcggtgacctctgatcatccaaagttgtttaytgaacacatttttgtgctaaggccgcctgctgttcccactctgcatgcagccttcactcctaattaaagccagtgggctaggatggaaaaaaacaatttc

SEQ ID NO: 41143 - DNA, 201 bp, Bos taurus
cttatggtacccgcagtcagacttaatcagcggcaaacacggtcatccacaccccctcttccttgttctgggtcatcctgaagaggccaccagctggtatytgggggactgagccgatgagatattattatctgccagtcttcattttcaaaaataaaaagagattcagatggatgcaggggacccttgttagctttcagc

SEQ ID NO: 41144 - DNA, 201 bp, Bos taurus
ggtgtcagaatgcatccacaggaaaaagctcgaaacagtggagtctccaaggggcaggctgcgctgctttggaatgcaatccccttgcgtgactcacaccyactcttacccctcaataccagccatgctggtattgacccattttgggtttcaagaaactttggttccagtagacaacattgcccagatagaaaactgtgc

SEQ ID NO: 41145 - DNA, 201 bp, Bos taurus
cttaatgattaagacagtctccacgtgatgtttgaagcgccggctcataattaaaagtcaggtgaataaaatcattggtgttccagaggattcattcctaygattctttttttatgttttctttatattggtttgaaattctttgcaaattaagtatttagtgttggaaccacagagaaaaacagggggctgatagataca

SEQ ID NO: 41146 - DNA, 201 bp, Bos taurus
ctgaaaatagaatagtagaaaaaaaatgcagaaaaaattcttgttctcagagacctcaattctactagaaagaaacaaagcataaataatagatgagtaarttgttttatatatttgttgttcagtcactaagtcatgtccaagtctttgtgacctatgaactgcagcatgccaggcttccttgtccttcaccatttcttg

SEQ ID NO: 41147 - DNA, 201 bp, Bos taurus
ggatatcttgctggtttttgagaattctcctgtcttactcaggttcttgaggccttgacctctggttctactgcactgccaacctcagctctgccttctcygtctgcctgccctgtcacttgtttcttactgaatggcactgatcagtaccatgcagtgtgagcagaaaaatgtatgggagaatgtttgggagaatgatgg

SEQ ID NO: 41148 - DNA, 201 bp, Bos taurus
ggtccatgccaaatggatttggataggaccaaatgtcaaagactttggtgtagaccaaatgtcttatggatgttttggacaggaccagatgtctacaaaaycttgcacattgctccaattcagacaatggctgtgtaatggccatgacacaggagccatgagaatgggtggcattgcccctgcaaagtgagctgagtgaga

SEQ ID NO: 41149 - DNA, 201 bp, Bos taurus
tggtttgtatggagaaaatataaataatatggcccatttgaggaagagttcccattaaaaaatccaaactgggttaggcattttttgtttactatgaatcygttcttagagagtcattggccttcttgggaaaaatgatgatacatttccatttattgaagattgtttgagcttctggctaagacattatgggagatactt

SEQ ID NO: 41150 - DNA, 201 bp, Bos taurus
tgtccttacattatatcaagcctttcttctttattactgtgtaggctgaacagagcagcaaatgacctgtggttgatggagagggttttcagtggaggccraagtgccagacactggcagacgccctactccgcctcatgaatggtctgccctttctgtaccaattcttaaccctgagcctttcatctttctttctttctc

SEQ ID NO: 41151 - DNA, 201 bp, Bos taurus
aggaagttattatattcatttatattagtttgaaagccacagaaatgtattatattattttaggctgaagaattgaagcagggccattgatggtatttttyccccctgatcatccagctttcctctgaaggtcatcttcatgaaatgtgataattttggccttttcattttatttaagatataagcaaaccatgagacctg

SEQ ID NO: 41152 - DNA, 201 bp, Bos taurus
aggtaggaacttgctatgaattttctagaacatgacagagtccggtagggctggagtagagtgcacagaggttacttggggaatctaaggtgggaaattamctaggggccagaccaagaaggactttcttagccatggtaaggatgtgcagttttgttcttagtggtgttcaaagctgtagaacgatttggacccagaaaa

SEQ ID NO: 41153 - DNA, 201 bp, Bos taurus
atgtcctcacgaggtgggcctaagacagtgacaccaaactccatgtcttggaacccaccctccatctgaacccaaagattaaaaaggcagtaagcttcatrtttaggccagagatgcaaaagttcctccccctcaatccctaatactgagtttggcaaggggtatttttttttccaaaaagttaaatgagaaactatatca

SEQ ID NO: 41154 - DNA, 201 bp, Bos taurus
ccagaaaaactgatggtctagttccagtctggaggccggcgggctcaaaacccagggggagctgatctttctatttaagcaaaggcaagaaaaatgctgakgtcctagtctgaaggccatcagacagaaaagatatttctcttgcttacaggaggatttcccatttttgttctattcaggacttcagctaattggatgttg

SEQ ID NO: 41155 - DNA, 201 bp, Bos taurus
tacacacagagggaagaagcttttgaaggtgtatctttgccgtcatcgctctgtcttgtaacaagccctgcagtccttgccagtaggtgggcttcctctgygtggtacctgcttcggcttagcaacatcctcatctcttacaaggatgctgttgaaaatggctgaacctgaggagacacctggtggagacaggaagcattc

SEQ ID NO: 41156 - DNA, 201 bp, Bos taurus
ggaacatgacactctctattccttaggcaggggtggggccttctttttaaaggttacagtatggtcaggggaaagagaaaaaattctacagtggtgaaatmtgacaaacactacctcagtcaggccaccggggtcaacttctgtgctatgaattcttaaattgcagtacagttgacttacagtactatattagtttcaggt

SEQ ID NO: 41157 - DNA, 201 bp, Bos taurus
ccatccagttaatccttaatacatgcagagtctatattgtaaagtgcatattgtatataaagctgttgtagaatactgagtttaagaacatagtgtcttcyttgaacattattctgcttttgtcttaaaggctatttaatcagatcctatgaaaaatctattttctttggtgtgtttttgtttgagatatcactttatatc

SEQ ID NO: 41158 - DNA, 201 bp, Bos taurus
ggtagcagatctgggagtggaatccatgtctgtctggctcaaagcttcaacttttaaccacggttctcctttctttagaagttatttttcggtctgatgtyagaacccagctgccttaccatagtagaaaaggaacagtaatgtcccattttttgaagatttatttaaagcaaagtttctcaaccttagcaaaatgagcac

SEQ ID NO: 41159 - DNA, 201 bp, Bos taurus
ttgtcacgaatcaattatcagtgaacatggccattggtatttcattattgttaataacaagtattattattgccagttagttctcgttggagctagtagaygttaaagttactattcttagttttgtgcttggacagaatgaagcctaactctctttcagtcttcaagatactttcactacatgaatttttagaagattag

SEQ ID NO: 41160 - DNA, 201 bp, Bos taurus
ggacctactctaactaggccagtgattctggtagctgccagaagacaaggtgaatggcttctgcagaccgtggacctggccccaaggctggccagagcatytgcctttggattcacaaaaatctaccccacaaacagaatcccatgagggcatgctatcttctgtttcaatgtccacgttataatccatattactatttta

SEQ ID NO: 41161 - DNA, 201 bp, Bos taurus
cacgaggcctcagagctgtacgtgacttggggtgtcacatggtccagctgtctgctgcccacgcatcacctcccgtccccagctgtttctccccagccctyggccttgttcaggagtttcagaccatgttctgagctgtcctcggagtctactgaggcacattagctcctaccgtggggctgtgaggagactgaacgggaa

SEQ ID NO: 41162 - DNA, 201 bp, Bos taurus
aatttggtgaattcacagagaggtcagggccctttcatttgaaaggtgttgtgtgtttgctgtgaagatgtaactggattttcattttgaattaaagaaartcactcgggctgccacgtgggccagctgttgttactgttgttcagttgctaagtcgtgtctgactctttgtgaccccatggactatagacctctaggctc

SEQ ID NO: 41163 - DNA, 201 bp, Bos taurus
agagtcagacatgacttagcgcctgaacaacaacgagctaaagggaagagtgatagaaagggctagagagcagggcctgtgagcagatgtcagactccagrgttatttcatccagagtggaaaagtctagaaggaagaggatgagagggcctgggttgatttaacaacgcgctttaagcccacgagaggctcttactctca

SEQ ID NO: 41164 - DNA, 201 bp, Bos taurus
tgctcaatggtttcttctaaagtcaaaattacacgtatcctatgatccagcaatgccactcctacgtatttgtccaagagaaatgaaagcatatacccccmaaaatatgtgtactaatatgtctccagagctttattcataattgccaaaaaccagaactgcaaattctcttcaaaaagagaagggatctattggaataca

SEQ ID NO: 41165 - DNA, 201 bp, Bos taurus
cccagcagccagcccccagcctcacctctcctgcagggtcctgttcccaggcctgccctcccctcatggcctgggctttcccctccctgccacaccccctytcctcactccagccccccaaagacgtgcaggttagtgtttgtaaagtgctctgagggggaaaagagccaagtgctttccctccactgaaaggaaacaatt

SEQ ID NO: 41166 - DNA, 201 bp, Bos taurus
ttgaagcgtcttagaatcgttttccatgtgacagaagagtttgtttctttcagaaacataactttttattatgctttccacagtctccaaacaccctgtcytacctccttaaaaaagagtgataaattgtaatgcattaattaatgtttattttacagtaatgactcccagggttcctgacctgaatgatcccaggctgtt

SEQ ID NO: 41167 - DNA, 201 bp, Bos taurus
gtccactgaagtactttctgacaccgggagaaagacttgcagtctttacaagctgcttggtcacagcctaaggagacggagagcctgggtgggaccagagktcctcttcctgcaaagagaaaatcacaggcagcaatgccctgtgaaactgacaggcagtgtgtcccaacgtcccactggagcataagaaccctggaaaga

SEQ ID NO: 41168 - DNA, 201 bp, Bos taurus
caggcttcatcttttatcattttcccctccagacttttaggggggaacagttctaaacagttctaaggaaaagattacaactcccagtggttggccagagsaaagagccagctcctcaaacacaggtgagagcattgtatttcccttccctaaacccgaggggaaaggagccatctgtacaaacttccctgttctcccgcg

SEQ ID NO: 41169 - DNA, 201 bp, Bos taurus
tatatttttctgccgctcccatggtgtcaggtaggggaccacctgcaggtgagaagtgtgccaccctagatatgatagataccttctttctggcccactayttaagaactgtttgattttggacaagtcatgcatttgaaagaaatcaagacctgtttacatgttttccctcagttggctggggccccctcacaaggttgt

SEQ ID NO: 41170 - DNA, 201 bp, Bos taurus
gtgaaccagaaaaaaatggaaaatatgaacagaataatgacaagtactgaaattgaaactgtgattaaaacttccaaacaaaaggccagggacggaaaacrtagcaggtgaattatttcaagcatttagagaagagttaacacctattcttcccaaatcattccaaaaaattgcagaagaaggaacactccaaagctcatt

SEQ ID NO: 41171 - DNA, 201 bp, Bos taurus
attcaagctgatcctagattttgcttttctttgaaaattttcatattgtccaagcatcagccaatttcattctcagtgtctttgagttgttaagggtatgrtcagacctgtcaatgtcctaaaatgaaggacctgacttagcacctaagattggggtgattggaaacctgaccttcagttagcagcctttaaagtatgcaa

SEQ ID NO: 41172 - DNA, 201 bp, Bos taurus
ttcgaagctggaccttcaagctgcaactgagaatgtgagtagtccaaccccttataggaagaaagtgagagctgggtgctttggcctgctccatctataaygcacctgggaataaccatgagatgtgctcatagacacatgaaaaatctgcttctttgtttaatgggagactcatggaggccaagtcccagtggctttctg

SEQ ID NO: 41173 - DNA, 201 bp, Bos taurus
agtgttcccctgttgaaaatgaatgattttatacaagaccaacacctgtaatcaaaatggatgaaggaaaaagagaaaagcactctttaagcaaggccctscactttatttctgagaagggtaaaacctgaaaattgtccaagttacaatagtgaccaaacacccccttttcctggccaatgagtaattcctgcttcttta

SEQ ID NO: 41174 - DNA, 201 bp, Bos taurus
tggtctatagtttctactgagacatctgcttatagcctggttggggtttcattgtaagttacttcatttttttctgcatttcagattatttatttttgackatttcatacaatgagtcttacagaaggtctttttgcgttaatctgccctgttgtctgtactttctattgcattcttcatcttatttcttgaattcttcag

SEQ ID NO: 41175 - DNA, 201 bp, Bos taurus
gccatgatgcttgaaacatgatgtaaaagaggttcaaggtgatagtagaattttgcacagctagagggtatttagaggtcaggtgaaggacatccttgaamgccaggccaagggcatttgaactttgacttacagtgaggagttcttaatgattttgtggcagaacctgagatgttcagtgacctacaggttccatgggcc

SEQ ID NO: 41176 - DNA, 201 bp, Bos taurus
catagcacagggcagtggccagcagaactgaactggaaccctggctcagtccctcctggttctgtaaccttgggtgaatatcttaccctcgctgatactcrgttctggcctacgggtcttgggagaaaacaggataccaacctgagtgagaagcttttagcatcaaggcttggacagtttagtatctgccttagcataagt

SEQ ID NO: 41177 - DNA, 201 bp, Bos taurus
aagatgcccttgtgattcagtcatccttcccttcctgatgcagagaaggagacacccttacaaatggaggttttatcaatttaaaattctttgcaaaaggrtagcttctactgtggtttgcagagcttctcctgggtctgctgtttcttgaaatagtcaactcaaaataatccttctattagaaaaggatattttggtgca

SEQ ID NO: 41178 - DNA, 201 bp, Bos taurus
taattagagatagtgagtgcttcagctgtgaagtccttgatgccttgagaccctatggcagaggggctggtccagtctagaggccaggaagggcctccccrtggaagtgattctcaagatgaaggttgagaggagcttattgagagagaggcaggggcaggaatactggtgttccaagcagaggaaacacaaggagccagc

SEQ ID NO: 41179 - DNA, 201 bp, Bos taurus
cttcttgagcactgcctttttacattcccactgttcactgttatgaagtgaacctcccaccctaatggccccacctcacttagggcccctacagcagtgtygcatgaaagctcacactggcaatgaagcttctcaagtcatcttctcccctaataatgttgaattggcccgaagataatttctccttatctccaaaataag

SEQ ID NO: 41180 - DNA, 201 bp, Bos taurus
atggccagtacatggagggacttttcaatacggatctagaacctcaaatgtatccccatcctctcctcggactccacctcctggactggactccttgtagrgagatagttccagaaggccatctgggagcacggtgcatgggaagggctgggttcaggctggtggtgagaaagtataaacccgatgatttacacggtttgt

SEQ ID NO: 41181 - DNA, 201 bp, Bos taurus
cagcaagctcctgcaggccagtccttgtcagcctggataaactggggatgatgacagggaaaccacttcctacacaggcgccagataagtgagcgcgatcmgtggccccccagaggaaggcaaaccagtgtcctcaggcctctgatacctgccagatgttttcctaggttcatggattgtcacttaattctaataacagcc

SEQ ID NO: 41182 - DNA, 201 bp, Bos taurus
actaatcccctagaaataaatacaaagatataaagcttaggagactctagagaaaataaaacaggatgattaaaaagtatttgattaacccagaagtgaargtacctatattaaaatcaaacaaaacagacttcaagacaaaaaggatttccagagataaagatgtttggtaataataaagagagaaactcattaggagaa

SEQ ID NO: 41183 - DNA, 201 bp, Bos taurus
ccaaaggccaacaatccatagctggtcagtgggtgagaaaagaggagtttcaggggtgtgtggggggaggggctacatgcagaacatcaccatcagctttratggccatctagaaatcagttatcagtggtctgaccagcatcatcttgattgttttaagtacagttactcttcagttccaggatcagttcactcccattt

SEQ ID NO: 41184 - DNA, 201 bp, Bos taurus
cctacctgccaggcgaagagtaaggactccgccaggtgccaaggccagaaaagcccagatggtaggggggggtgggcccctggaactcagcctactccaaygccctcactgtacacatgaaactgcccaaagccacattgctgatgctcgggcactggcccagcttccatggttccaattcccactttccagctctatccc

SEQ ID NO: 41185 - DNA, 201 bp, Bos taurus
gaggaccctgaactcacatcttctcacgagcacaccaaaattacaattaactgctgaacaaccatcaattaaaaagaaaagtctggaatccacaaaaaaaraaaaaagatattctacatccaaaggtgtacagaagaaatcacaagatggtaggaggtatgcactagcaatataatcaaatccataccacctggatgggcc

SEQ ID NO: 41186 - DNA, 201 bp, Bos taurus
tgtacttccagagactggagtccgtgttgaggggccttaaggcaccagcacctctgggtgtaatggcagctccgggatccagcaacatgtttgggggcccrtttgatacccacagctttcttacctcatccatacttctaagaatccacaggaggattgttcggtgttggccacagaacttgtttggctagttgctgttct

SEQ ID NO: 41187 - DNA, 201 bp, Bos taurus
atattagaagcattggcctgatctcagggatttttaaaaacacacacacagacagatgtagaagtcgatatagatgcgtgtacatacgtgaaagcagcagyaatgggcaccctgagtggccagattttggtgtctacaaaccaggctccactcaaaggaaacagaggccttggaaaagtgagtgattcaggactggggcag

SEQ ID NO: 41188 - DNA, 201 bp, Bos taurus
tctttttgggtaagacatagacctggaactcctaaaggatgaactgccttgagaacaagcgagtgcttctgctgagcagccctggggccaccgggcagggyggtagagaagcaatgaggcatcttctcctgtgcatctcagaacccctgtgcccagcatggaagcagctctcagcacgtgtctcaaccaaatgggagcttt

SEQ ID NO: 41189 - DNA, 201 bp, Bos taurus
tatttttggaggggtgaaggatatttcccaggtaagtttctgtggccaagggcattggtatgtactgagatagggcctctcttgacctcggaactcctgayttgggggctggagaattctttgctggtggggggcgggcggtcctgtgcattgtgggatactcagcagcacccttggcctcaactcactggatgccagcac

SEQ ID NO: 41190 - DNA, 201 bp, Bos taurus
catggtctcaataactaaataagatttctgccacagcaacccactgctattcgacttctcaaaagcagggggaggtttgtggccggaggcctttagattgyactgtgtcaaggagtgacacaggctgcctaagctccatgttgagatacccacaacaaccactagatggcagcattgagacaaatacgcagcagaggttct

SEQ ID NO: 41191 - DNA, 201 bp, Bos taurus
aggcggggatttattcagaaagtaaatgaatggaggaaaatggaaatcagcttcctcattgtcagaaaagggagttacaaaatgtgaagggagaaaattgratgaattggaggtattgatgagaactcaagttggataataaaatgaatgtagatatggatatatatctatgtatacggtcagacacacacgtgtgtacat

SEQ ID NO: 41192 - DNA, 201 bp, Bos taurus
gccaacagggccgttgcaggcaaggggcagcgggggaccaagtcaggcacatcctggtgcactggagccaggcaagctgcggaccagcatcagacaagccrcagcgggccggggcagggcgtggggagtgcctcgagatagtctactttgccagaatggggcttggagggtttgggggttttgggcattttggttcagcag

SEQ ID NO: 41193 - DNA, 201 bp, Bos taurus
gtggttcctggggttagaggctgtcactgtgggcatctcttcagctgggcgcttgtaagggcaggggatggaaatgctgggggcccgaggagacgcagaaractgccggggagatgctgcctcatgcgtttcattaacttgctgacgagggtagttgtatttacggcctgaggccgacgggaaggttgctgcaggtcagtg

SEQ ID NO: 41194 - DNA, 201 bp, Bos taurus
ggcgagtggaacttccacaagaggcgggcacagatagcggattccagcatacctggtcatcccacaaacattcactgcacaccttccacaggctgagatayggccatgaaggacctagaaaaggccccagcgccgcaggacctaaaagggcactcactccccctgacagctgagttctgaaggaaggaagaaggggtgttc

SEQ ID NO: 41195 - DNA, 201 bp, Bos taurus
aagaggagctggccaccctcagctcctcccatttctctggccagggttgtctccagctcattcaatgagcactgaggccgtctttccccttctgctcagartgctcactgttggctcctccctgtttagagagggctgcagcctgcctccctcctgttcggaggtcctgggcccggcgggtgggctcctctccagtcctca

SEQ ID NO: 41196 - DNA, 201 bp, Bos taurus
cttctctcttaagcgtagtgtttgttttctaggaaccctcttttaaaaagactatcaaactggtacatatccagaggagaataatcaaaacactgagggayttctgagctggaaattttacaaaatgaaaaaggacaaaaaaataaattgcaagctattcccacttaccttgatgctgattctctatctgagtcgatctag

SEQ ID NO: 41197 - DNA, 201 bp, Bos taurus
ggtaaggcccctgtcccctgaggagtgaagccagcggctctcctgctctgagatagattgcctgagcctcagcatcctcctagcagacggtctttctgtgygcagggggccagtgctgggttccgcttttgggcttaaatgcttcctatcaggaaagaggaagtggaatagcgggaggctttcttgtgaggaggatatctg

SEQ ID NO: 41198 - DNA, 201 bp, Bos taurus
cgcagaggagaacgggcctgggtcacactgtccatgggaaccgggccgggccaccctcaccacagcctccattcccgccaccccaccatggccagatcctycttttcacagcctcatctcttactccactttttccaatcttctgtgggttcccagtctctgcctcagttatcctgagagcatctctgggaccaagacagc

SEQ ID NO: 41199 - DNA, 201 bp, Bos taurus
atcatggccctcatcgggacaccggcattgctagggagtttccccaccctgaaacactgcacttggactcttgatgtcattcactttaattcaatgcaacrtaacactctttgacggccgacggcacccaaagcggtatcaagggaaatctcagtgaaacctgagtagtacctccaaggctaacaaaatgtcatattagta

SEQ ID NO: 41200 - DNA, 201 bp, Bos taurus
tgtaggacaatggattttaaattttatttgcaaatttgtgtttgctttcatgaactagaatctcataaactcaactttatgaatgtgaaaggcctactccrattagcaaaaacacgtatactttaaagatttttaaatgaggacccaagtatatgtagtaactacaaccagaataacaatgagctgtcttttagaaggcca

SEQ ID NO: 41201 - DNA, 201 bp, Bos taurus
tccatttcctggtaaacaaagataatcctagaacttacatcatcgagttactgaaagggttaattgatataatgcaagataagcactttgcaccatacctygcccacagtttgtgcacaacaaatattagttgtcattaaattattattaacaagaaatacataatggaggcacagctctgacaatgactcacgccaccca

SEQ ID NO: 41202 - DNA, 201 bp, Bos taurus
caccctaccgtgtattcacataacctcctttttgttctcactccagcagagacaatgaactctctgatgtctcttctcattagggcactaatcccatcacraggccccatcctcacaaactcctctaaacctaattacccctcaaacattccatctccagataccatcagatttggggtgagggcttcacaagatggattt

SEQ ID NO: 41203 - DNA, 201 bp, Bos taurus
atttctcccagcaatctggattccagtttgtgactcattcagcttggctctcgcataaatgtactctgcatacaagttaaataagcagggccctcaaaacrgtgtgtcccatcccaacccagggggagttgtgaggagttttatagtcaagggtagggttgctgatacggaatgggtgtgtgcagggccctcacgccttca

SEQ ID NO: 41204 - DNA, 201 bp, Bos taurus
gagacgagacgtggacggtgcggggagtgggccaactgcttcacgctgtgctgccgagccctgggctttgaagcccgctacgtctgggattacacaggtgygtagtgtggtggggggccccgaggctggggtgcacactcctgccttgtagtctgaggctccgcttgctttctgtaagataacaggtttttttatggggag

SEQ ID NO: 41205 - DNA, 201 bp, Bos taurus
ctttctctatgctttggggcttgccttggagctgctggtcaaggagggtctctcgcagctcttccagctggaaaccactgttacaattggaggcctgctarcctgggtatagcttgtgggagacccccatgtctgattagtctcaggctttggactgctcagggcctgtgtctcggggtttagccttctcaggagtgtcta

SEQ ID NO: 41206 - DNA, 201 bp, Bos taurus
tccagtgatcagccggtttccttcatcaagctgttcactcctgtgaaacctaacaagttaagagttcagtgttaacttaaggccagcacagccaacacccrcctgccccgaggctccggctcaggaggatcaggagtgacctactctcaccctcactcactcactttaatggcccttgtttaaaacatcacttgaattatc

SEQ ID NO: 41207 - DNA, 201 bp, Bos taurus
ccttgaaagtgaactctaaatgtcctggagagtaaagcctctctttgcaaaatacttaatcacattccccgggaggaattccctcatcttttgtggctcartgccttggccacttgccaccaggaatgaaggtaaattctcactctggagacagttatgggaagcctcttcgggctccagccatttggaccatgttcttaa

SEQ ID NO: 41208 - DNA, 201 bp, Bos taurus
ggttgcagagacaggggccgcccttcatggcagagcgtgggcttctgttggagcgcaggctcagtaggcgtggctcgtgggctcagctgcccctcagcacrtggggccttcctagactagggacagacctcttgtctcctgcgtgggcaggcggactctttaccactgagccatcagggaagccccactgctctcttttta

SEQ ID NO: 41209 - DNA, 201 bp, Bos taurus
ctactaccttgctgacacaggagctcaggaagggtgcagtgtggaggctgccaggggcagctctgggtagacagggagagctgggtggggagtggaggccygagaagcaaaggacaaatactgcagaatctagagcacgtcacggttttcctgggagggcttgagaacagggcttgcgagtcaggcaaccagtggcaacgg

SEQ ID NO: 41210 - DNA, 201 bp, Bos taurus
gcctgtgtccttcaacatagtgtaagtcagctcaggctgctaacaaaatgcgcagactgggtggctcaaacagctgggagtccaagatcgaggtgctggcrtgccatttctaaggcccatccccttgttcatcgatggcctcttctctgggtatactgacgtggcctcctccgtgagtgtgtgtgagtgtgcatgtgtgtt

SEQ ID NO: 41211 - DNA, 201 bp, Bos taurus
gtgctggatcaagactcagctctcctaccaacaccatgcctcagtgactacattttaagttgaattcatattgctgtttacacttggcctcagtagcctcygattcctagatatgcagctggtcttccacgtggactataaagtacgccgaggacacacctgcttctctgacgttgcattcaggctctccttacggcacag

SEQ ID NO: 41212 - DNA, 201 bp, Bos taurus
ccggatgttccagggcctctgaaattctggagcaggaatatagtgtgatgaatatgatattttagagtgatgtaagaaagcaattctacagctgggaatayacttttaaaaactggccactgagcatttatgaagatgctcattgaagagtggtttgtaacattacgaacgggaaacaatatgaatgtgagttcatatgag

SEQ ID NO: 41213 - DNA, 201 bp, Bos taurus
aggaaaatacaattaaggagcattttttttccttaactctattgctcactttatttcaaacttaagaattcggtttagcatgaaataaaggcaattaactyaacaaagtactaggatagctctttgttaaaaacattttttttaatgaaagcaaaatcagcctgttgatagtaccatttccaaaggtcaggcacagattct

SEQ ID NO: 41214 - DNA, 201 bp, Bos taurus
tactggcccaccacacaacttcactagtgaattttatcccagacaaattcaactttaaaatgggaaataaatctctaacagaaatgaggggcatcagaaamttagcctatagctaacatcctggccagattcatataaatatatatatatagatggagctcttttttgcaagtacccacttcattgggaattaaaggaaac

SEQ ID NO: 41215 - DNA, 201 bp, Bos taurus
ccatgttgcgcaaatggccttatttccttctttttagcgggtgaggaatattccattgtatacacgtaccgcatctttatccattccttcgtcaatgggcrtgtagatggttccatgccttggccactgtaaacagtgcttcagtaaacattgggagcatgtatctcttcaggccatgtttctctcaggatacacaccctg

SEQ ID NO: 41216 - DNA, 201 bp, Bos taurus
agcagacagaagccaccactgctgtttcaactcttctgacgtttccactgggccacaagcaaggacctcactccttgccacagccgacgaggcctgtaggrtgtggtccagccacacaggtctcacgtccagccacactgccttccagtgatgctgtgatccagttagactcacagcagagaaaaaagaatgtgaacattc

SEQ ID NO: 41217 - DNA, 201 bp, Bos taurus
aagtaagagaggaagagaaacagcggtgaaacaggagtcgtgggggactcaggcgataggaaccactgcaggctttgtgcagggggtgaaatgaacgcacrtatgattcaaccagtggagtccaccgacgcgtgtttcaaaaggatcacctctggccgcgtgttgagaattaaatgtctgggatggggttgaaagcaggaa

SEQ ID NO: 41218 - DNA, 201 bp, Bos taurus
ccacattggtttaaatgacagaaacaacacctacttcttgattattattatatgatgtaaatgagataatgtgtggaaaacacttaggatgctgcctggcrcacagtaggtgctcagttaatcgtaatttatatttgtggtgcccagtctggcatagagtaagtgctcagtatatttttagtgttactgaacttaggtctg

SEQ ID NO: 41219 - DNA, 201 bp, Bos taurus
gaatcaatacagccaacctgaatatttcactgaagaaaagcctactttttctcaagtgcagtcgccatcgtactctcagaaaaaaggtagggaccattttycttccgtttgatccaagtttccgtgtttgtctctggggtgttttaaagggaccctttgcatccgctttgtcaaatctttgactttgaacgcggaacgttt

SEQ ID NO: 41220 - DNA, 201 bp, Bos taurus
catttccacaagcagggagcctcccaggcccgcgcacgctcacgacggcggggcccccacaccgaggtctcctaactcgcggggcctcaaccggcagagcmgagtcccgtggtgaagtcaagcttccgtctgacagaacttccaccgcagagggtaccttcaggccctcagatccttgtggttacgcattacgtttatgtc

SEQ ID NO: 41221 - DNA, 201 bp, Bos taurus
tttttatgtcacttcagcttctggtcaacatggatgagacagggacaaaatgttcccaaacactgtgaacaacagagaaaaaatacatgaacaatgagttktaaacactggccatcaggcagctcagggcagtatttccagagaaagaaacacacacacacacacacacacacacacacgttccctatggtgcagagacag

SEQ ID NO: 41222 - DNA, 201 bp, Bos taurus
ggtattttgtgtttcgttgatgcttgaattagactgttccctggggaaataaatcatgacatggaagggcccctcctctgtaggggagtgccttcccaacmaccagtccagagggacactagctcgcatttgtgtcctagtctttcttatctctaaccctgattagcgctttatggttcaggaatgacctgcctgccaagg

SEQ ID NO: 41223 - DNA, 201 bp, Bos taurus
acacgtgactctgaaagggtcccccaggcctgctccttgagggggtggagagcatctccttaagagggggtggcgtggtatttgggtagacagctcttgcrtgggcccttggaggagaacatggtggaatcctgggttccgcactgtaactgggtctgagctccattcgttgaagtgccaaactcctttttacagggagac

SEQ ID NO: 41224 - DNA, 201 bp, Bos taurus
aaccactgccctctgagaggaagatgcatcagctaggtactgaaaggagacttccaggtggccagctctgcacgggggcccctgcaccctgctgtgtgccsggctgtctcatcccctgccacagaggactaagcggaggcttccaaaggctaaaggccacgccacgaccaccagctgagagaggaagcagtgggttggaat

SEQ ID NO: 41225 - DNA, 201 bp, Bos taurus
gaattgtgaaccaagaaaagattctaactgcatcttcatttaaacttttttaaggttaatcttattaaaagctttattttgtgttggaatacagtccgtgrgattgcaagagtcagacacaactcagccactaatcaacaacagcgaaatagttgtttcaaggcgctgcgttgctttcaggcatgcagcaaagtggttaag

SEQ ID NO: 41226 - DNA, 201 bp, Bos taurus
attgtccgttcagcgttggccacaatccgatgaagtaaatctcacaaactctattttgcaaggaagacactgaactttaaagtggccgtgcgaatttcccrggttcatacgatatccaagcgacagacgtggacctgaagatggtacccgtggaagctcagcccaaactctgaggcattgttctgttcactttcctgtaga

SEQ ID NO: 41227 - DNA, 201 bp, Bos taurus
ggtctagaggggccagtgagttaacaccccggggtaactgatgggcattggtaggaaaataccccaggttctcagccctgagctgggagaactcagatgcrttctgcacagactgcagggccccgggggactgagcccggggtcctcacatgagtgatccacttacatatgcaccttctggaggcttcctttctctacctc

SEQ ID NO: 41228 - DNA, 201 bp, Bos taurus
tctcattctggacgggtgaggaggagccatagagctccaggagcaggccgtggtcagcttgcggacgtccttctgattggttgttaatgaggtcatgggcrtcagcgtcatcaaccttccagttctaactggtttcgaggcttcctgcttggggacagcacacagtttctcccacctggtggaggtttcaggatctgcaaa

SEQ ID NO: 41229 - DNA, 201 bp, Bos taurus
ctttcatcacccactgctgaatttatggatgttagaaagtagagaaatgaaacagaaacacggtgcttctgactataggcgttattgattctgtgaagcayccgggagagctgaaacttacttagcaactggcttaggtccaaagagatgtttgctcagtttcctgttcctcaaactcaggtcccgtacaaccggtagaga

SEQ ID NO: 41230 - DNA, 201 bp, Bos taurus
agctactttggggtttaggcacatatgtatctctttgttattcttttgctacttctaaactctaaattgtgaaataggcattatttcattaaatataaacrtaaaattaaaactatgatcaaaagcagccaaggacagaatcaaaatccaaaaaaaaattaaataaacgatgtggaagatgagtttgaagagctgacaaaa

SEQ ID NO: 41231 - DNA, 201 bp, Bos taurus
gaccaggtgtgtggggccatggatcacctgtactgcaccagctgtccacagagagggcagcctatggattaccttctgccctcaaatacgatgggcaggcyggtgaagtcattcttcattccgcctgcagtctgcctaccctgaatatggatcctaacgatctttgtttgttgtttaggggacaaaaggcctggctgaggc

SEQ ID NO: 41232 - DNA, 201 bp, Bos taurus
ctttcacagcacagggatctaagacatgcaggtcaaagagcagaatccacgccccgccatcaacgcttccactgttcttggccatacctgttgtactcagrtcacagattgcttttgcttcgtcttccttgtgttgtagttgctttaacacaaggacaagatggatattagtagggtcatcagttactcagcaccaaggag

SEQ ID NO: 41233 - DNA, 201 bp, Bos taurus
gaccctcagggtttgctcatgaggcctgattggatgaagcctgtggacatcatggaggataatctgctttactcaaaggacagacgtcaatgttctcaggragatgacgtccccaggatggccccaccgattgccgctgatctccccacttcgcaaggagaaggtctcacagctgccctgagcccccgagagaccccagga

SEQ ID NO: 41234 - DNA, 201 bp, Bos taurus
gtatttccttgtccttggcccactgtttactacccctagcccaagttaaattgtcttgtcccagctccacattttatcattctttgtttggaaagtctatragatttggggccctacagcttcttcaggtcttcattttccttttttaagactctcttgtccatgtaaaaaatattaaataaaatgtgcatgcttttctct

SEQ ID NO: 41235 - DNA, 201 bp, Bos taurus
ttgtttttatcttctgattttagagtaagacaagtatagaacaatggctgggtggtctgaaatgtctttgcagcatctagcacaccaggtgcaggcaatayacattaagccataaaacgaatcagaattccaaacacaagaatatgttatagtcagctgcttttgcagcagggtgaattttagaaaaagactcaattggct

SEQ ID NO: 41236 - DNA, 201 bp, Bos taurus
gctgtggctttaatccaccaggttataaagaacttcagtaggagacctggcttagttagaaatttgttaccatctgtacctgagttctttcccttgagtcrtgtgcacacacttgaaatttttctagataggcctgtatggcttctaggaaagataaacactatactgatttcctgttgcattgttatcttggtcaaatgg

SEQ ID NO: 41237 - DNA, 201 bp, Bos taurus
ggagaatcagtgccgccaaagtttaaacccagaggtggttaaattttaacctcagccaaattttaacctcagctaaacgtggagggcctctcgggatgctrgggatggagcaatgctgtcaggaattctgtccacaggacactgcacgaacaatcacatctcgacccctcctgcaaacccaccctggggatggcactgccc

SEQ ID NO: 41238 - DNA, 201 bp, Bos taurus
cccatcatcacagcattaatatcaagcacccacctagtcctctactctgcccagttaatgaagttctgttctcaaagctttggaaagaagttttaataagkatggtcaggtctggccagcaggctcttgtcaagggatccaggcagaattttttccagtggaaggtctgcaacaatttattccggtcagactgctactaag

SEQ ID NO: 41239 - DNA, 201 bp, Bos taurus
gtgactaaatgtagggatggggatgggccaggaaaagggatggtgagcatggaaacaacaactgggaaacgggacccacagtgcttacttgagcaaaggcrataagaagttaacctccttgatggccctgtctccccagtgagtgatactgcaactttctatttctgacaaaaataaagattattatagatatggcagagg

SEQ ID NO: 41240 - DNA, 201 bp, Bos taurus
cattctcagcatccagggcactaaagaggagagcccacaggaaggcaaaggcgtcagtgccacgcacactgttcacgtgtgtgtttcctggtacacacacrtgagcccctcataagcagctaacgtctactgtgatcaaaactgcaactccctgggtcaactgtctaaattttataaagttactatcaaaaaagaagctct

SEQ ID NO: 41241 - DNA, 201 bp, Bos taurus
gaaggtttggccaggcagagtctgcacccaagctcaactgtgtggcggttggcagagttaggtcctcactggctcttggttggaggctgctctcagttcaytgccccaggggccacttggtagggcagatggcttccatctctcagcggtgccctgcagtgcctggcattttgggttcagtgaatgatgcctagttaccca

SEQ ID NO: 41242 - DNA, 201 bp, Bos taurus
acagataaaggaaccacacaaaacgagtcttcggggacaaacaatgcatattccgacaaacaggcccactatgtagcttcttaagagcaggatgtgcactygaacctgtgagcaaggactttcaagttaatgacaccaggaaggtgagagtggaggtaaaacaacaggaaaatgtctttgtgacttactttacaatcttca

SEQ ID NO: 41243 - DNA, 201 bp, Bos taurus
tgagattggacttccaatgattacccaccctcggcgatgtcctcggggtgcttctgtgagattgagcttctcctatgggggcctcagtggggcacaggggkcagggttccagttttctgggtgcagctgggctcccaggaggtgtgtgacaaaggccttgtttcccagctgccatgatggagatttgctacatcccaacat

SEQ ID NO: 41244 - DNA, 201 bp, Bos taurus
gacacatgagatggtgtttctaagatgaaaaggctggtgaacagcagcggtaggagcagaacctagccctgcaaccaccctggcaggcctggcaaggggaygcttcctgtgcgctgcagtgtctaaccttgggctctgcagagcaatatcctcacttcgctgacagggtggcagaaagggaggctgagaggagtcccagca

SEQ ID NO: 41245 - DNA, 201 bp, Bos taurus
acaaggagaagttggagctcgcgttgctgagctggaagcacagaaggcagtacccatgctgacctctgtgtatttggaggccacaaagccagatgccctcrtgtgacccatcccccgattccagcttcttccattaaaacctgctcattctgttcttccgggaggccacagaaataatgtgctgaacacctgtcaaagcca

SEQ ID NO: 41246 - DNA, 201 bp, Bos taurus
tccccacaatggcaaacccaacacaggaaaggatttgaattctgccaagaatcagccaggtccccaagcatcgcagccattcctgagcccaggacagaagrtactcttggtggccactgctctgcaagtctccaggtggctcctatcagccttgtgtgtgtgtctctctctcttttttttttttttaattatggtaaaata

SEQ ID NO: 41247 - DNA, 201 bp, Bos taurus
ggcaggaaatctagcaatatgtgcttttcacaagtgcccaatcacttaattagcataataaccccaatgcagcatctacaagaacttcagagattgaaggraggctttccaagaggcagaaattttcaaagggcaaaaataaacagacaggaaataacaggaaaagtacaaaggggtcatgaagcaataagaaaaatgtca

SEQ ID NO: 41248 - DNA, 201 bp, Bos taurus
taaggcaagcctttctttttccttactgaaataatttcagaaatgcactattggaatgttgtttaagatagacaaaatcatattcacaaaaaataccaatygttcacttcaaggaacactgtctttatagtgtacaaacataacgtacaattctttgggcaggttagttttttcatgtagatcataaaatatattggtcaa

SEQ ID NO: 41249 - DNA, 201 bp, Bos taurus
aatgatatgtataaagggcctggcctcatgagctgggaagagttttacaagtagaaaacacttaaatataaaccaggtcataagacacagagggcctgaasagctgcaggcagcttcttatcaaatggatcatttctgagctctgaacaggtgttatagacgttactggataagaagttactggatgaggtctatatttat

SEQ ID NO: 41250 - DNA, 201 bp, Bos taurus
caatttttccgtaaccatttggcaatcattaaagcttcgcagttgctggttttcctactggtgttttacaacctaaggtaaaaacagagagatggctcatkaaatcatacaacacttgggcactggcgaaagaaaaacacacgacatctgtgcagagttttacagactgaaaaacaatcagtggagacagcagcaccgtta

SEQ ID NO: 41251 - DNA, 201 bp, Bos taurus
gaaggaaattgcaacccactccagtattcttgtctgggaatcttcaggactgagaagtttggtgggctacagaccataggatcgcaaaacagtcagacacratttcctgacaaaacaacaacagattgactaatggtatctagcttcttttcatcagttaatttttgacttgtataacttctttggagaaaagtttactga

SEQ ID NO: 41252 - DNA, 201 bp, Bos taurus
cagaatcaggcctgccgcttcagctggatgacttgttccccgaggtcacctcctacctcttgggtctgtttcactcacagcctcatcttgaagacccaacmaagttctggccccttctcccacaaagcattttctgttttcttccacatcttccaaattagatcaactttctcctctgaacctctgatcaactgttaccgc

SEQ ID NO: 41253 - DNA, 201 bp, Bos taurus
acatgactgagcagctaacactttcactctccccaggctttggggagcaaaggtgttccctggcaggtctcacacaggctgtttctggaaatctggccaarccagccctcagcccctggctgctgctcccctggacctgttgctcctccttggaattcacgctactggacagcttgtttttcatacacattttgctttatc

SEQ ID NO: 41254 - DNA, 201 bp, Bos taurus
atgattttgagctaactgattttgagcattttctacatgtagaacttaagtgtttcatatacattccttctttcaattctcagatctaactacggtctacygaactcgatcaagaagaaaatttgcattatttggtgttggcccatgatagtgaaggacaggggagcctggagtgctgcagtccgtggggtcacaaagagc

SEQ ID NO: 41255 - DNA, 201 bp, Bos taurus
gagaatcccagggacagagaagcctagtggcctgccgtctatggggtcatacagagttggacacgactgaagcgacttagcagcagcagcagcagcagcakcagctcctgcatggcaggccgataattatttacatattcttcagttcagtcactcagttgtgtccgattctttgtgaccccatggactgcagcacaccag

SEQ ID NO: 41256 - DNA, 201 bp, Bos taurus
agtccatccaggaggaaggactctcctctgagatcagtgggacagtgtctggagactcatatcctgagagagggactcgtgaaggcaaaccagccagcagygtggcctcagactgtgcttccctgtccaggtctgacccttgataatggccccgatactttgggataggaggattatggaggtggatcaagaaagtaggta

SEQ ID NO: 41257 - DNA, 201 bp, Bos taurus
tggaaattcagagaatacagaatataaaagttgaaaaaagtctcagtaaatgggttgaatagccaagtggattcagttaaagaaccaattagtgagccagrcaactattcaaatactctgaaggcctgaggagcagacagagagaaggaaaaaaaaacagaagctaagcaaggtacagaatagagttatttgatcagtgtt

SEQ ID NO: 41258 - DNA, 201 bp, Bos taurus
ggaggactgggagcccaggagaggtgtggacacctggctcctactgcaggcttagcacaggtgaacttggccctgggtggcaccaaaggaagtgggcctgygcaagcttcacaacctttgaggctgctacctgtggacggggctttcctctttgctcgtcaagaactgtgcccctcacttttggctttggggatgaaggaa

SEQ ID NO: 41259 - DNA, 201 bp, Bos taurus
tctcactgtggcttcagcctgggctctggcaggactgggtgtctgggttcccacacccagaagttgggctccagcccagacacatgggagaggtttgctgycaggcccagaccaaaggtgggcatatattaatagttctgacccccagcctctcctggatgactcctgctggtacagagacccatctcctgccctatgcgt

SEQ ID NO: 41260 - DNA, 201 bp, Bos taurus
tgcacatcacaggtgatgaggactgactacccgagcaggcagcgaaagggtggggataagaagagccgatcaggcggccttgcccctctatgggggtgggkggtggtggcagtgaacaccattgctataactcagatacacaggagatcctcagacaggcccccagaatggtctgccctctgcagatcctgcttgttaccc

SEQ ID NO: 41261 - DNA, 201 bp, Bos taurus
gaagagtcaatctcagtttaacttcctcatttgacagacgaggtggaaatgaagtggattccttagtcacgctgaacccagaaagcccttttatgaggagyggtgagggccgaagaagagatttcccttctgtactacttagaaaggaacttcttgggtgattcagtaccccacggagggaatcagggcccagatggcctt

SEQ ID NO: 41262 - DNA, 201 bp, Bos taurus
gccccagtgctctctaacaccagtgtccaggccacagcgatgtctaaatcacgaacacgatgtcagctcagtgttaaaacatatgctacaaactttgagcwaataactggccagtcagaggagtctgttttcactgtgaatcaggtcagtgcaatgagactctcaacccgagacatttcctcacccctcaagtcacactgt

SEQ ID NO: 41263 - DNA, 201 bp, Bos taurus
caacttgatttttcatgtatgtcagttattccctttccatctcttagcaataaaaatgtacgatagttgtacggggaccctgaggaacaggggctgcacayacgcagtctctgcgttctggcagcatccctcatgaggctgataacatgctctgggcccctcaagagctgcagcgtggctcaaacagatgatcaaagtcct

SEQ ID NO: 41264 - DNA, 201 bp, Bos taurus
tctgttttggtgttatgaatagaaattcattaataactccaaatgtatgaagttattttcaccagtgcatatgtctatttggaaatatttatagaatacayattgcattggccaaaaatttcattcgagtttttgcatgttaaggaaccaaggctggagatttaggtgccttatctcttcatgcacacaaaggctattttt

SEQ ID NO: 41265 - DNA, 201 bp, Bos taurus
ggtgaaggacccagcccatttataaaggctgtggccttccccatgtgtcatagtgtgtgattttaattttgcaagaccctggccaggaaagaaagaataaygggtcaacatgacctcctatcttgtttaagtttgaaaaatctatttcaagaagctaagcacaaaatggccttcctcgaagagatttttctgcattagggt

SEQ ID NO: 41266 - DNA, 201 bp, Bos taurus
atatgcttgtgaggcgtgcgagaccagggcctggctccactgtcagggagtagtagtgttaaatagtatttaacttgtaagcacccaagggttaatcagartagtccatgggccaggctgggaggaaaggaaggggtcctggtggggaggatgagtgggtggaggtgcataggttataatttgggaagaggttgggggcaa

SEQ ID NO: 41267 - DNA, 201 bp, Bos taurus
tggcctagcatagctgggtgtgagtccagacttcacggaggaattcactctgaaaagcacccagtggacatacgcagagctcgcatgaagagctcaggctrgaagacatggtcagcaggacgaggcagagctgatgtggaggccgggtgtgcccaattgttctttcctcctccctgtagcagccacttcacacacagtatt

SEQ ID NO: 41268 - DNA, 201 bp, Bos taurus
atgcctgtttcatggaccaagagaagtccgcacatcaaataatcttagaaacagcctgccaggcagatggttttaacacacggtgcagaatgtagactcartaatgccagaatagccacgtgattcatataaaacccagcactacagtctatattatctttcaaagagaagcaattgtgttcagcatccaaatgtagaaaa

SEQ ID NO: 41269 - DNA, 201 bp, Bos taurus
agaggagaggtctccaggtggcccccacgcatttctgatttgcagaatcaccaggctttattctgttaagactctactgagagatgacaggctcccacccygaggccaacagctggagcagggaaacagggttacacctgagttattcaaggttggcctttgtggggactagaacagccaacacttggcccctttgtgcta

SEQ ID NO: 41270 - DNA, 201 bp, Bos taurus
ggctcagtcctggactccatcctcaccacaaatgcctggggaagacccctcagacccctgcctacacttgggtctcatccctccctactggatggccaggrctctggattccacattacctggaaccgtctttgttcattccaaaaccatgggctcctccagcggtaagtcatcacaggaaggcctgaggatccacagagc

SEQ ID NO: 41271 - DNA, 201 bp, Bos taurus
aatttgctagacaagccagcacaggagaaagctgagttctggggagaagcaggggttggggagaagagaccttatgtggcctaaggatgaacacgaggggraaagtgcccagtggtttgggctggagatccagaatataaatgtgctggaaaggatgaagagggccagattcatggactgcagacccctgctttgtagaca

SEQ ID NO: 41272 - DNA, 201 bp, Bos taurus
gcagggaggctccaaaatatacggttggccaaaaagttcattcagatttttctgtaagatgtaatgaaaaaaaacaaacaaacttttggccaatccactayagcacttgacaagccaaagcagcttggattttataatgtgacctcagcagaagtcgttcaatgcagagaaaggaagaggttcattcaggcctccaaaagt

SEQ ID NO: 41273 - DNA, 201 bp, Bos taurus
acatacagtacagcatatcttgagggcccagcttaacgcgttttacatatgatatgcctgtgacacctggacatatctgtcaccctagaagttccccgtgyggccctttcagttaatacccatctgtcccagtccctaggtcctgctccttttggatcaagagaagcagaggcaggcacaagtgtgactaagaggaataaa

SEQ ID NO: 41274 - DNA, 201 bp, Bos taurus
acagccgtgtgaggtggatattactgctgtttccatttcacagatgatgaagctgaggcacatcagcagggagtctgtgtaactggcccaggtaaccatcytacccagtgctcggactcaggctcctgagcttgtgtttttaacagcatttttcacctggttcccagcatcattgaagggccattgcaatgtcatgaaaac

SEQ ID NO: 41275 - DNA, 201 bp, Bos taurus
cagggatggtcctgggttaggggaagtgaagaggacaatgtgcgtgacagaaattctgagaacacagatcattactacacatctcttaaggttcattgtgrttttaaaaatgggtggaggacttgatcctaggttttggaagggcaagcctgactgaggggaagaaggagcaggaggtgaacagggaaaggcaggtcctag

SEQ ID NO: 41276 - DNA, 201 bp, Bos taurus
ggatatccagagcgcctgctgccacgtggctgtgggcttttccaaagttcacccgttggtccatttgcctgggctcccattgctcgaggctactaagaggkgtatctctttctctcaggcccctagggtaccactccagggagcgaaggcccagcaaaagtacaaagagagggaagctcagtgttacaatctttctaggtg

SEQ ID NO: 41277 - DNA, 201 bp, Bos taurus
acagagagagagcgagctgatgagcagggaggatgagctcaggggaaaatgtgttggttagtttccagtcagtgatgatatccacaagcagaaaggcccartgagcatttggacagtcaaaggttctgaagtcatttcagcgaacaaaagcaatgaaatggatgaggcctgtgagggatcagtgcaaatagaaaaaactag

SEQ ID NO: 41278 - DNA, 201 bp, Bos taurus
tgtgtgtgtttctcacgacatggccaggagggagccggtctcatcacccacaggcaggttatctcactcgtccaaggtcaccagagtgtgtcgcagcctgrgtttaaacccaggtcaggtggccctaatccattctctcagcaacggcaccattctataatttctctcttacacactttttacttcacagatttttttcct

SEQ ID NO: 41279 - DNA, 201 bp, Bos taurus
cacgtcactatttccaaaatatgctcaaagatgtgatctcaatcaagggaggatccatctttaccacacaccctttcctggtgttcaaaaccaaactgctrgaaacataaagataaaaggaatcaccagaaactgaggaggaactggtcaccctccagctccttgcataagcccacatgggctctgacatgggcggtgatg

SEQ ID NO: 41280 - DNA, 201 bp, Bos taurus
aactccaggccatggccttccccttctgggggttaagaaaagccagtacttctcgctcttggcacttcctctgaggacagttggagacaacgtttatcagyggagccctggcactgtggccaccacattccgccctctgatgacaaggacctggaggggtgcagcgggaagtagggctgggggaggggtgcctgggaggag

SEQ ID NO: 41281 - DNA, 201 bp, Bos taurus
gccctggggcctgtgctctgcaacaagagaagccaccaccgtgagaagcctgtgccccgcaactagagtagaccccgctgaccacagctagagagagcccrtgtacaacaatgaagagcctgtgcagccgaaaaaatttaaaaataaacttaaaaagataaaacaaaaataaaagcatagtattgaaaaaataaaattcta

SEQ ID NO: 41282 - DNA, 201 bp, Bos taurus
ccgggtttgaagaaagagaccatgtatcagaaccagagtcagctgtggcagatgctggaattataggacagggactttagagtaactggcaggcatcagcrcaatttctcttaatacttcagcatacaaatattgcctttttagttttcaaactaaaaaccatatcacttgcccagaaatctgaaactgaaaaagcaactg

SEQ ID NO: 41283 - DNA, 201 bp, Bos taurus
cccatgcaatggaaaatccatgtataacttcagactccccccacatttaaccactaatagttcgatgttaaccaaaagccttaccaataacatacaaagtygataaacatattttgtatatgtattttacactgtattcttacaataaagtaagccagagaaaagaaaatattattaagatcataagaaaaaggacataca

SEQ ID NO: 41284 - DNA, 201 bp, Bos taurus
agattgccttgggtagtatagtcattttaactgaattgattcttcaatccaagaacatggtatatttttctgtgtcatcttcaatgttttctttttctccyaccgcccccagccccaccaccttcagttcctttcatcatcatcatatagtttttagagtacaggttttttgcctcctttactagttttattcctaagtat

SEQ ID NO: 41285 - DNA, 201 bp, Bos taurus
ggaaaaaagttgctctaaggcttcgcttaactctgggtttccctcttctctcagattttggccttataattcttcagtgcctttttagctctctggtggtktaaaagatatatatatatatatgtgtgtgtgtgtgtatgtattttaaattgtgttaagttttacataactgaacttaacattttagtcacctttaattgt

SEQ ID NO: 41286 - DNA, 201 bp, Bos taurus
acccctggtgcagtgtcatctgtcactctggagagctgtcctggcaggaaagtatcaaatgcctgcccctggaagcacatctccagggtgataatggcccrcatcaagaccagagtctcttcgttatagtacctcgggtaagatgaattgctccacaggcttgtaccacagcttgttcacctgcacaccacagctcggagg

SEQ ID NO: 41287 - DNA, 201 bp, Bos taurus
gttctggctctgccacaacctattatccaaaagatcacagaattatgctatcatcctcagtacaatgtatttttcaaacattcaccttcatgaaatatggkagggctactacacctgcccctacaccaagtcatgactacatattcttaacttttaggcatttttaaaatatattatcgattctatgctttaagcagtgct

SEQ ID NO: 41288 - DNA, 201 bp, Bos taurus
ccccccgtccggcccccagactcgctcctgcgcttgcgcacttgcccgcctcacgcgtcccgagccccgcccctcgccggtaaggcagcgccagcgtcgcrgtcgtaacgcgtggaggccggagccaatgaggaagagaggaaggcaggccgagctctcggggtggggccggggccggggcccgggctttctcctcgcggc

SEQ ID NO: 41289 - DNA, 201 bp, Bos taurus
gaacaagaaggcagaggaagagggaattctttctttctccttgagctgggacaccaccttctccccttggacatcaggctttcagacttggactcagacgyacacctggttcccaggccttcagatttggactgaaccacaccaccagcctccagcttgcagatggcagactgtgggacttctcaacatctatcaaggagc

SEQ ID NO: 41290 - DNA, 201 bp, Bos taurus
ctgcctatattcttttgcgactatttttttaataggtaagaagtaaatttatcgagagagagagacacagagtgtgggccatctcgaaaagtgagagcttyctatgactacattttttgcccaatagactgttgagatttattcattaactctacttcattcatttaattaattaattttgggggccacactgtatggctt

SEQ ID NO: 41291 - DNA, 201 bp, Bos taurus
gaattctttacctctgtgctacctgagaagggccttgggaattaaactgacaaaagacttgtaggaattaagatgtgtttgagtttcacaaggaaaatatmctcgagattgtggccaagtgttgttgctgctgctgctaagtcgcttcagccatggccaagtgattgaggcttaaatactgttttagactaaagttaggaa

SEQ ID NO: 41292 - DNA, 201 bp, Bos taurus
agttatcttctccttagttttacaagtcataaagatgggactctttattagtgagctaagcatagacacataaagatgggccaaactgggatttcccagayagtcaagtggtttagactccttgcttccagtgtagggggctcgggttgaatccttggcctgggaactaagattccacatgctgtgcagtgctgtggaagg

SEQ ID NO: 41293 - DNA, 201 bp, Bos taurus
cttgcaaagggggcctcacccaggcctgggtgcatgagatgccccatattaccccccgcccctgaaaccaaagaccaagatgcctccaaaggaagagataktaaggccccactttcctttgtcatcaaataagtgccgtttcattttcatgctctttattttatgggaggagctaacatgaggttgaggccagggtagttc

SEQ ID NO: 41294 - DNA, 201 bp, Bos taurus
tggcctgagcatgcctgcacccttcaggacctgtggatagtaggacctttttgttttttcaaaagttccctgatagtaattgctgaggtgagtcttgcaaytgtgataagaatcgctagggccagtcaggccgtggccttggctccgccctggctcagcactgggggtaaggccccaggtgaatgcctcatgcatttccta

SEQ ID NO: 41295 - DNA, 201 bp, Bos taurus
agacaccttaagtagactgtcattttaatttgttgaataattctccctccaagacttctgacataatcaggagtggttgctcaggagactgatggcatagytgtcgctgtgatatgtccctccccatcatcctgacagttcttttcacctctctcatagctgtttagatttcagtttcctcatacttggtttaatctctta

SEQ ID NO: 41296 - DNA, 201 bp, Bos taurus
accattttccaaaggaattctttcagacctgtgaattaaagctgtacagtaaccgctaacattattaaacatttatagtgtggccagcactgcactaagcrctttacatggattttttatttaattctcatgaagtagatgttttcattatccccattttagaagcgaggatacgggaacaaagaggttagtaactcttga

SEQ ID NO: 41297 - DNA, 201 bp, Bos taurus
aaaaaaaaaaaaaatccgaacattatgcttcagaacaagatgtgtagctttataaggagcaaagatcaagttccagcttccaggcccctccctggagctaygtgttggcagcctgctctctcctaagcctctaccaactaagattaacttaacctggaagccggagtaggagccagggagggatggaggcaggggctggcc

SEQ ID NO: 41298 - DNA, 201 bp, Bos taurus
atctttgtgcaactgttatgttgaaaggccagagctgactagagacctatggaaagcaactttattcttttttctcactctctttaaaactatttaaaggyttgctttgggcctgtttccatgaatgaaatcttgaccctgtaatttagaggactctcctgtccctttcagttgcaggagtgtgttggttcagtgctcaaa

SEQ ID NO: 41299 - DNA, 201 bp, Bos taurus
caccagcaataagagagatactttctgcatgaatgtttttggaggcagaaagataagccaattaaacattttgttttctgatgcatatgtaacatttgtayacatggatgatctttttgaaatatgtgacttgctactgtttacagtgatatttagactgaaatctctcagggctggagcccagattttcaaattatttgg

SEQ ID NO: 41300 - DNA, 201 bp, Bos taurus
aatactgtctaatagctgctaaatattaggcttcaagcttcctttattgtttcaaaggtgtatttttaccattggttcgtttgaattaggcctcatatgarggtcactgttgtctattcttcacagttggagccattcattgtcacagatcttgcactgttgggtcagttgtaaaaatggccatgtaaaggactataacaa

SEQ ID NO: 41301 - DNA, 201 bp, Bos taurus
gagcagacttaactgctttagttcagatgcagcattttaattattgctgtgatccttttgtggaaactaatcatatggccctatatatacccaagacaaayagaaaatacagttgtgtgctcagaaaggagaaatagtttggtgcttaattggccacattatggatgaagtattcttgtttctataaaatacatgcccctt

SEQ ID NO: 41302 - DNA, 201 bp, Bos taurus
gtaatacaggtttgcttaagacatttgggttgtctatacagtttttactgattcattctttttggtagttaccaaccttctgcaagtttccatatcaagcrtatagtgggagcaacatatgtgttctatataactacctcatgaccacacataggaacatacatgggaacgagactaacctgagacactcaagcttttccc

SEQ ID NO: 41303 - DNA, 201 bp, Bos taurus
aatattttaataaattctttcttacttctttatgcaaagattacctggataaatacattttctataaccatgaagtaaaattaatgatatattctaaatgratggaaaaacatgatatttcattataatgtgtatggataaggcaattatggccaattaaatataaagatataagcaattcaaaactttttaaacatatca

SEQ ID NO: 41304 - DNA, 201 bp, Bos taurus
aaaaaaaaacttaaaaaaataatgaggttatttttaaaaagaagaaggaagtaaatgaaaatcaaagacttgccctaccagatgtccagacttattctgarattgtcatcatgaagaatttggtactgtcacagagacatacaaattgacaagtggaatacagaacagagaaacagatttgcacatgtgtaaaactgtagt

SEQ ID NO: 41305 - DNA, 201 bp, Bos taurus
gtaatctcaatgtttctgtattttcaaaattataaataaccatgcagcaagttctttcttatcttcactaagatttcatgttctgtgtcttgcctgagaawataattcctgaggtttgattgttcaggtttccacttcctggaaccaagaaagaaaatatatttcaaattagaaagacattttaacagagttaataggact

SEQ ID NO: 41306 - DNA, 201 bp, Bos taurus
ccatctgtgtccctgagagcatctcatttcctagggatgcctgctcccctgtatcagttatctccttgcccccctgccactcagcacacctgcccaaccasagctcggggccaagctgagtagcaacacccctgtgggagatctgccctccaaccagtattcaccttgaataaaagaggctgctaggcaggatcccacagt

SEQ ID NO: 41307 - DNA, 201 bp, Bos taurus
tgggatccagctccctgaccagggattgaaccaggctccctgctggaagtgtgtaatcttaaccactgcaccaccaactaagtccccatttcccagtattwaaaaaaaaaaagtgaaattgacgaacagttttcctttacttgtctgtatgtaaatctgcattctgactgcacagagaactcggctgtaatccgtaacttt

SEQ ID NO: 41308 - DNA, 201 bp, Bos taurus
gataacatgattgtctatgtagaaaattccagagaatcagcaacaaaaaattctcctgacactagaaaacagtcacagaaaggttaccgaatatgatgctsaggcaggtcatacaaagaaaggagctatcaagtaacagaggtacagaagaaccttagatgcatatggctaaatgagacaagtcaatcggaaaaggtttta

SEQ ID NO: 41309 - DNA, 201 bp, Bos taurus
cttttgttaaaggaggtcctagattataaaactgaccaccaggttttataatcgagtagtagtgttataattcagttctgcagacactttaaaagttggtrcaaaatatacagcattatgaaattacaaaacaagatattaaagtggcaatatatgttgataaattattgatggatatggttcatcaagatgtagaagata

SEQ ID NO: 41310 - DNA, 201 bp, Bos taurus
aagaggagggaaccagaggagatgacatcagagcccgggcagcggcggcagggggtcggagggagctaacagtccccctttccacccggggccccccaccstgttggaagtcaggctcgcttctcacttactgatgccctgcctgcccttggtgctaagattcggccttttccactctgtgaagttaggtaccgctcatcc

SEQ ID NO: 41311 - DNA, 201 bp, Bos taurus
cctctgttctgagcaaaagttaagattcccatgtggcctgtgaagctttcgaggctgctgctgccccaggctagaggaggcctcagtccacaccggctctmggctgtccacctgcagagctcttgcacactgaggagcagggtgtgtttaaggctggcctagagagctggccgaagtaggggtcgtatcaggaaccatggg

SEQ ID NO: 41312 - DNA, 201 bp, Bos taurus
aaccatcccttgctgtctgccttgactgattctctgtccatgaccctgggacctcacaggacaggggccgtcattgtggcccaggggttcttctctcaggkatccctcctgccactcaggctgctgtttatgggtctatctcaccctctagaacagaagctccgggggcagggctgtgtctgtcctattggccactggcac

SEQ ID NO: 41313 - DNA, 201 bp, Bos taurus
tactcagatcatgcaggttatcttcttgtgaatcattttggttagggatggttgtcaggaactcttcgagactcagggggataaatgagggttagatttamtttttttgtagcagatagcatgaaggccagaatgcggtagttgaagatgtattttcttaatgtaaaataaatattttatctgaagtattttatattcatt

SEQ ID NO: 41314 - DNA, 201 bp, Bos taurus
ccagaagtcttgcctagtacacaattctacctcctaagtgtaagtggaaggacttcagaattagtcacaccaaaaaaagaatatgtgaaatatagtagagraaatttatgctttgcacatgcatctctaatgtcagggatgatgacaacccgaggcacagacatgatattcaagtgcatgtcttatgtgttggaggaaggt

SEQ ID NO: 41315 - DNA, 201 bp, Bos taurus
gttccatccgtggtcgaggaactaagactgcacaagcctcccagtgcaaaataaaactacaagaaaataccaaggccctcctgaagaaggggaattttatyccacagcatggcaggtagagactgatcaggctgctcctgtttttttgtgtttctaaggaaaggttttggcaaaaagacaagccaagacattccacttctt

SEQ ID NO: 41316 - DNA, 201 bp, Bos taurus
cctcatgcatagaacctcttaggaaattcacggtagaaataatggtagttgacacttgtattttaggatgtagaagacgcttctttgaaaaatgcaacagrtagtgttgcctttgggagatataggatctctctctctcgctcctgaatttacttttaaaatttattttattttattttttactaactactgcctgtttta

SEQ ID NO: 41317 - DNA, 201 bp, Bos taurus
ctttgatttcagttttaggcaggttcacagaaagataatccagtgacctctccccaccccagtgagaaactctgactttagaatgatgctgtggtttacaraaatcccacttgtatagatttgatgttggcacaacacagatttatgtatgtatttaaaatagtggtgtttggggaggaacatgaaaacaaatgcctttag

SEQ ID NO: 41318 - DNA, 201 bp, Bos taurus
cgaaaaactcacacttacagtatgtatcttgattttgaagctcttgatcctttgaaagaaagcatgtaacaggttggatatatgttaaactgactagttartgctctttggtttaagtgcatttggtatttgtggttttttttttcatttctttttataattaccttctgtttttacttggaaaatttttattaagaaata

SEQ ID NO: 41319 - DNA, 201 bp, Bos taurus
gaggtagcttcaaatataaacttggtcttccttgaggcatttttgtggggttctgattatgtccttagctaagtctctctggccaacaggaaatgagataycacatttcttaagagataatcaggccttagcaataccaacacttgtaatgaaattgcaaggactcccaaccaaattaccaactctttcgtagggaaggac

SEQ ID NO: 41320 - DNA, 201 bp, Bos taurus
aacagtggtcagaggccaggtccggggggccttgtgtgctaataagcaaagatgttgacacaataacatcccgaaagctaaggtgaggtgaggaagggaayacaaagatcagaggcccctgtctaagtgtgtgtcttccaactggctctgtcacatgcagaggaccatggtgacttctctctaggactttggccctagttt

SEQ ID NO: 41321 - DNA, 201 bp, Bos taurus
ctgtcagccttcccactgggctggtgtcagaaggggcccagtggaaaccaggactcttcatcatagccaagggatgataataaggtgctaacccctgcagygccagtgaaggccacacaggaagcagtaataccgtctttctctttcagactttcttcacttagtatggcaatctctaggtccattgatgttgctgcaaat

SEQ ID NO: 41322 - DNA, 201 bp, Bos taurus
actatagagatcccactggctcctgtcaacctctccctagtaacaatgcatttgcctcaagcaaagcagtccacaattactctggtccagggccttccccrcagaggcaccttaatgcccatcactaaggaagaaagagagggtcatgcatcattctgttcacagcctgatctgaaggtcaaaagctctgcctcttgccat

SEQ ID NO: 41323 - DNA, 201 bp, Bos taurus
ttgccctcacccgccatagataaccaggtagtctcaagtccgtcaaggaaaacatcagaccactctgaagccggccaagaaaaagagatactctgtctaayaaactttttctcaaggacctccccacaggcatgattgagactgcttccaccaaatactttcatgtcaattggtctaataagttagaagaatagcattttc

SEQ ID NO: 41324 - DNA, 201 bp, Bos taurus
actaacattgttaagaggaaactgaaatcacagatggatcaggtggttgtagatgaggacctaggtgttctaaatgagtttcaagcagacaaagaacagtkcagggatcccagagaactgctgttggtaacctctgaggaatcagagaagaaaaagtataattatcatcccctttctcacaaaataaaggagtggattcta

SEQ ID NO: 41325 - DNA, 201 bp, Bos taurus
tgacagtggcctaaaggatctccattttccttcatttctcctgtcttgctcagggttcaggtgctttacttaagtgctctctgcttcttttagcaaggctytcaccaggatgtgatgctcaaattattggacccgtaagttttcttttcctatgttatattggacatctaatgccctagctttttttatatatgtatcttt

SEQ ID NO: 41326 - DNA, 201 bp, Bos taurus
agggttggtttggcatattacacacatttgcttttttcaagtcagtaaaacctacatgattcgcaccaatcaaccgtagacccgcctagcacgctgggagygggccaatgtaacaggaggcagaaattcagccctacacaaaggagtctacagtacttgggggtaaaattgtatggatacactcaaactcagctctgccaa

SEQ ID NO: 41327 - DNA, 201 bp, Bos taurus
cagcttattagcataaagcaaagaatacatcttagctcatcacattcatgaaactctgctttaaaaatattatattatagaatttaactgtactgttcccycaggaatgagttattcaaaagaactggagattggaatcacatgcaagtccactacttttgttctcatttttatttttggggatccatataaatatgcttt

SEQ ID NO: 41328 - DNA, 201 bp, Bos taurus
gtatgtagtactaagactgaaaaaagagctacatagaaaatggaagcttggggaggaagtctggctctccagttctttaagacaccatctggcataggccrggagaggtaagcaacaaagaacacatcactcagctaataaggttttatgaccagccaagcgcacccggggagcaggccggaggttctcagggttccctta

SEQ ID NO: 41329 - DNA, 201 bp, Bos taurus
catgcaaactcttagtcgcagcatgtggaaactagttcccagaccagggagcaaacccaggccccctgtattgggagcacagactttaaccactgggccaytagggaagtccttgaattttattttgagtcattggagggtttgaacaagggttccattgtggtagacagaaaataggcggtgataaagctgaagcaagaa

SEQ ID NO: 41330 - DNA, 201 bp, Bos taurus
atctcagtagacgcgtagagcatgatccagatacgtgttcattctgcacatgccaagagtcagaggctgagattgaagaccgttgggccacaggcatgttytgtttggtctatgtaactgttgtggttgtttagctgctcagttgtgtccaactgttttgcgaccccatggactgtggcccgccaggctcctctgtccatg

SEQ ID NO: 41331 - DNA, 201 bp, Bos taurus
atattatcttacagcatctcactgaaagtataaaaaaaaacctaaattcaaattacagtttcattggctatgtgaacctgaacaagtattttgaacccctktaggctcggattccttaatgcaagtgagggctaataaaacttaagattagggctttgaattaggactaaatgtaaactaggagtaagaatagttccaaaa

SEQ ID NO: 41332 - DNA, 201 bp, Bos taurus
agaatgcatgacagagctaggaaggacagaaatacagaagcaggagaagctagtgtgagtgagttcaggagatctgagatgtatgaatttgatctaggaakagacgctctagttaagactcctgtctacacagctagagccccacagcttgaaaaccactcattagacaaagcaatggattgtttccattgctccaaatta

SEQ ID NO: 41333 - DNA, 201 bp, Bos taurus
attttgaactaaatttaaacagcttactaaattgggacatttatttttctaaagacaacaaataccatatcattgtgaaaaccaaactatatagtaaagcycaaggttaaaatagcaaatcattctaggagttaggactacaaaactagaccaaaattttgattgcatctcaatgaaaaggagatgacaggtgatatttca

SEQ ID NO: 41334 - DNA, 201 bp, Bos taurus
ccccttccactgccattctctgtggccaagtatgaaacctgatcactcaattagttaacactctggacacagcattgcgtctaaaaatacccgccttgggraatgtaaaggtttcccctgactcctagtaaggaggcccaaactggtcagaatgtccctaagtattgaaacaaggggtgggtggaggcaaggatggccgat

SEQ ID NO: 41335 - DNA, 201 bp, Bos taurus
aaaaaccaaaactttgatttttcacaccttctctgctcagaatccttgggagtccttctcaaagcactatggtactctatcacttcatccagtgggcaaaytgcactgacatcctttttattcttaactaaatttacacagttgtaccacctacaccgtattttaccctctgggataatgatacccctaccctaccaatgc

SEQ ID NO: 41336 - DNA, 201 bp, Bos taurus
tttggagcttcataataaaaataaacgcttttctatcagaagacgtttttattgtaatagtaataggtggggcagaaaatataaaaagttaaacttttgtrtgcttgctcctgatattaaccatcctgggcttctgaggaatattcacaacatttcctatccttattttcagcaagctgaagaggatagccagctaaaaaa

SEQ ID NO: 41337 - DNA, 201 bp, Bos taurus
acgagctgatgagaaatgtgtagggttgtggaaagcaaatcagagaagctgagtgagtgaggagaaaataatggtccgtgtcagcaaagggatggcccagygtgagagatgaaagcctggtgagattttaaactgcccacatgcccattcctgcaggtttccgtgaacaaatagggccacatgtggtcacaccaaaaatat

SEQ ID NO: 41338 - DNA, 201 bp, Bos taurus
tgtggcccagtgctttgttcttctttggaacaccagagagtaagagacctactcacttggcaatgcggtttagcccccatcctactgtacctgggccatgyccaagctcagaaccacattctgcctcaactagggctaacactttagggataggtttgaattgtttgcttcaggccaaagccagtaaatgcattaggaagc

SEQ ID NO: 41339 - DNA, 201 bp, Bos taurus
ggcccagtggttacaactccacgcttccactacagggggcatgggttcaatcccaggttggggaaactaagatcctacatgccatgaggccaaaaaataaktatacaatgaaaataaaattgcctaagtgaggtcttgctgaaactcttgggttgataagtgcccttttctgaactctcataatatctcatgcaaaggcct

SEQ ID NO: 41340 - DNA, 201 bp, Bos taurus
aagggaaagctatgctgagagagtttaagtctttcctttgaaaacatggcaatctgcagtgtttatgcttacagtatggaacctgagatgaagtcagaacktgggaggtgggccttaggtggaaataaaaactctcagttctttctgagccttgattttggaggccttgggttgtgatggagatattcaggagtgcagtgg

SEQ ID NO: 41341 - DNA, 201 bp, Bos taurus
cacaggaaggtgaagtgatttacccagagtcacacagcagtttagtaacaaggcagggaataaacagaactaaatttctgacattaacgctcctctggcartgttataggttatatgttaatggcctattcagtagctgtttgcacttcacctcatgttctctcatcctgaaagaactaaaaaaattcataacaaaaaaac

SEQ ID NO: 41342 - DNA, 201 bp, Bos taurus
tgtagaatcttggtggctgtataaaatggactcacagtggtgagtgtccttgcacacatgaccatcatgttcagggtctcatctccatccgtgtgcagagrgaaaaagtgggagtagaaaccacatgttgctggtcaatctagtggccctgtaaatgtccccctgcccccccaccgcctttcctttctcatgcctcgagca

SEQ ID NO: 41343 - DNA, 201 bp, Bos taurus
ctacatgtcttctctttgatgtttctgccaaagaagggaagagtatactgagatctgtcccggaacccgaaccatttatgcttaggtcaaagaaaaggctraagctcttggctacaactgtgttgggtgatactggcagatttcattcattcttgctagttataggctgtgctcacacaattaagacagaaatgacaaggt

SEQ ID NO: 41344 - DNA, 201 bp, Bos taurus
tttatggtcactctgtattttaagccagtaatacatataactcttcaacactgtgtggaaaattaatcaaattatttgtgtggccataatgccatggaccrgagaaggcaatggcaccccactccagtactcttgcctggaaaatcccatggacggaggagcctggtaggctgcagtccatggggtcgctgagggtcggac

SEQ ID NO: 41345 - DNA, 201 bp, Bos taurus
ccttcctaccttctttctctgctacttctaagctattttgtagagagttttcaaagtagtcttcaggaaaatcaattgtatcacttcacttccctcctcasgaactaacagtggtttcccattggccacagactagaggccctcaactataagttggaagatttccataacatgattctttacatcataggcaagtagctg

SEQ ID NO: 41346 - DNA, 201 bp, Bos taurus
gcttatttgtactccagagtcctaaatatacctctatatccccaacgtcctagaattcaccaggaatggttcactttaccagggaaaaccaaaattgcctktatatgcctacagatcagctgtattcatatgggatagcaagatagttctaaacataaggatgttgatccagagttgagcaggatcataatactgcatgtt

SEQ ID NO: 41347 - DNA, 201 bp, Bos taurus
tccacaaaaggccatgcagcaacgaagacccagtacagccataaataaataagtagaattatatatatataaaatcctagcacatttttatagtaagaaayctaaaaaaaaataatgcgatactgaaaaaaagcacctgtaaatatgttgattaataaatatgagacatatggtaagccacagcttaacttaccctcctta

SEQ ID NO: 41348 - DNA, 201 bp, Bos taurus
ctaaaattattgattattgagaaaaccttatctacttaactttcttattgagttttgttttaagaagcacatgactctatgtgctatattttctgatttayaaattccaatttaaagatcaaatttaaccagatcacaaaagggaaggtgctcaaaccattctcacagtttcttcacggctctcataagcaccctcaccaa

SEQ ID NO: 41349 - DNA, 201 bp, Bos taurus
ttgcagctctggatctttgaggcctgatggaggcctgtagtttacctgactagggatggggaagaagccatcagtcctgtgagttcggggcagtccatccygtgggagaaggaggaggcccctgctgtagttaggctgcctaaagtaaccttccagagttatttctagacaattttgcttgtcacacatactaaccttaac

SEQ ID NO: 41350 - DNA, 201 bp, Bos taurus
cagtatgtaatcaactataaataagaaaaatggccgaactaataaataaaccaaacaccaaatctctgagcaaaccaataaaccagaaatgcagaagtcgraagcacaaattcataaaataataaatgatggaggaaaaatcatgatatttggaggaaattaaaagattgacaagaggctatgctgttcaactatgcaaaa

SEQ ID NO: 41351 - DNA, 201 bp, Bos taurus
aaccatcttagtagtcaccaatgggttgatatgaagtggcacagcttttaaatctagttctaaccttaccagatgagatactaatatgctgggaaggccaytgagacactttaggaaatgaagcaggcagccacatcacactgctgccttgctttggtgagttaatccatcatgtgtagctgcttttctaatagtacacca

SEQ ID NO: 41352 - DNA, 201 bp, Bos taurus
acttgattcaggccaactgggacctcatgacccaccctccccccaaagttggactcacgatgtctggtaatcacctttctcttctagagcagcagtcagcygtgccctgaaactccacagggaatgttctccaagacctcctgggcagctagcatctgtgtcatttaaacatcaccaaggtcttcccaagaccacagcttc

SEQ ID NO: 41353 - DNA, 201 bp, Bos taurus
ccttgaatgcacatgctgaatggtgaaaccatatagaaactcccttttagctttatgtcagggttaaaaccgagattttaataatataggatcatctgatygggcaattgtgaatgagtgaactgaataagcaaagggcctggaatagtgttttagtaagtgctcagtgaaagtgaaagagttagtcgatcagtcatgtcc

SEQ ID NO: 41354 - DNA, 201 bp, Bos taurus
ccaagttggagactcagacaggaggcgatttgtagcaggagcatgtgctaggggatggagagaagtggcagcaaggtccagtttctgaatgtggccagccygccgaggaagaataaaggctgaagaaagttggctggcaccaaggtgagcccagatggctcacggccacatgaagaccctgagaaaatgaaatattatggt

SEQ ID NO: 41355 - DNA, 201 bp, Bos taurus
ttattaggagaggacaaattcaaacatacacaaaagcattttgcctttttctcactttggtccaagatgaaggcaggtgataaaacagtgtgagctaaatycattttgaaagaggagtcttattgagtgatcctagacagacaaagggatcaagacctgttcatattaaataaatgctatttataaccaagccctttgaac

SEQ ID NO: 41356 - DNA, 201 bp, Bos taurus
cagcagcagcagtaagttaaaattctggaagactttcagggtgcctcatctaataagtgcaacttgttaacatgaaaccaggccaagaatgccaaacacayttcaaaagtgtagcttttctccctccctacacctgtgactttgataattaattttataccaattaatgaccttcctgttacacctgcttatggcctcaga

SEQ ID NO: 41357 - DNA, 201 bp, Bos taurus
gaggccctgctggaacatcttggttggactgagggagggggaggggaaggcctgagctccaggaagggggactctggagacaggaaagcctgagtgccctkaagttgcacctaagcccctaggccggagttcctgtgacaaaggatggtgaagactccctttcagtaagcagagcgggtgctcctgggccgggcctgggcc

SEQ ID NO: 41358 - DNA, 201 bp, Bos taurus
tgtactttccgcattgagttcccattgctcttttgtcagaaccagttgagtgtatgtatgtgtgtgggcctcctttgagctcactgttctgttttgttgayctgtgtgtctgttcttttgccagtaacatactgtgttaattattgccttgttatgtcttatactaagtcttgtgttgtataataaagaattcagctgact

SEQ ID NO: 41359 - DNA, 201 bp, Bos taurus
gtcagtctaaatctagtggattttgaaatctgcagtggattttattctttctttgcttatagaactaaataagagccctttttgtgttcacagaaaattcytttttggcagcttctgaaagtccttttccaacttcttctgatttcaactgcagttgttgtagtttatgacacacgatccccaaatatggcatcttggcat

SEQ ID NO: 41360 - DNA, 201 bp, Bos taurus
gaggccaaagatcctggtgctagtatgttgtattggggaggatattgacccatctcaagatgctggagctgaaggcaatcaatcaataactggctctgcartggaagaggttcagtatgctggccacttcagtcatgggttggactttggttttcaagtgccgccactttttctgctgttcctggttcccagaaaccaccc

SEQ ID NO: 41361 - DNA, 201 bp, Bos taurus
aatcgctaatgtacaaagcctgtagaaatcattttgcagctattaaagaagcaaaatgaaaatttatggtaatagaacttgaagctggccagtgcatggtyctgctggcacaattattcattgctggtggagtttgaagtggaaagaactcttttgaatggcattgcagacatatttagtaagggccataaaagtattcat

SEQ ID NO: 41362 - DNA, 201 bp, Bos taurus
ttacagaaagggtcacaatgaagctgtacactaagcagcggggacagcaccatcaaatcttgagatagaaacaattatctgaacctggccacccctctcaragcacattttgttttaataataagcttcctgcatgcattcattgaaagggaaagtttacttaagttgaacctgggtggaattaggaagggagggatgggc

SEQ ID NO: 41363 - DNA, 201 bp, Bos taurus
tcatccgtcagcgctgcatactccaccacggccacatcccacagaaaggcgtagttccccttctttgcctgaaagagcaaaatcaccttgcggttaggcaracctggcctcccgtaatagttttgagcagcgagaaatctcaatggctggatttggggaccctcctgaacggtcctcctgcccaatcagctggcacagcaa

SEQ ID NO: 41364 - DNA, 201 bp, Bos taurus
ccctctgttagttagctggcctctctgagcctcagtttccaagtccttaaataaaaaacaaaacacaacacacacaaacacaggattagaagtagagcccrtagcagaggttgctgtgaagatgaaatgaggtgacgtgtgttcagtccttagagcagggactgatgcaaactcagtggccgtcaccaggagcaggtgttc

SEQ ID NO: 41365 - DNA, 201 bp, Bos taurus
ctcaggaacacagagctttgatgagctgtcaggtaatggtaagcaaggctcttaatatcccagatcctctatttccacttcagtgaagtgggaataaattrgtacccacctcctagaaagctgggatgataatgagattatgaaccataatagcattatatttataatacatttactagcgagtttagcacatagtagttt

SEQ ID NO: 41366 - DNA, 201 bp, Bos taurus
gtgtacacgcagctgtagggggcccggctggttgggtgagccaccttagagatgcacgctggggtcctcttctgtgtcacacagcagagctctcactctaycactgtgcagcttggcctggggcctggcttgacctggcccagctctgcccactgctgaacccccagtggggacagcagcccatagacatagcatgtgctt

SEQ ID NO: 41367 - DNA, 201 bp, Bos taurus
caccaccaccaggggctcagaaagaaacacacaggcctttgaggtgcaagtccacgagccatgccctgtcctgtgacccatggggaagaccttatttggaracctccttggccagtgctgtttacaaggtggcatcctgaaatagggtggcagaaagagaaatgatagtttgctctctcccctggtggggccaccacggga

SEQ ID NO: 41368 - DNA, 201 bp, Bos taurus
tcaacaagtggcctggatgggggctgattaccctccaaacacagttctgcaaaggaatttctaagtcagcctcagtctccctgatggaggctgaatgctcyggacagcaggggcaagggcctcctgcgagtggctggggctccgcaccattgatgagttaatcaactgtttttctctggggcttattcagcggctcaacca

SEQ ID NO: 41369 - DNA, 201 bp, Bos taurus
ggctgccatctctggggtcacacagagtcggacatgactgaagtgacttagcagcagcagcattctatatgtaatatctagctcttcccactgaaaagacmtagaaacaatggccaaactagaagcaaggagcatccctaacatttcagtgttcagtatttaatattcaggattatttcctactaaaagaaaccaaggctt

SEQ ID NO: 41370 - DNA, 201 bp, Bos taurus
tttgaagatcattaaaaagggatcacctaccaacatcaatgtacccaaatataaggctctatttgcttttaaacatcactacccctaagaagcatactgtytggtaaaaaggctaagtatcataaaagccctagctctacatccaactgaaagacaaaaataaaactataaatgctgctgggattcaattaagtaaattat

SEQ ID NO: 41371 - DNA, 201 bp, Bos taurus
ttgcctctgccaaaagaatgtggcagaagtgataaatagttctgagcctgagccttcagaaaccttgaatgcttccacattttctcttggatccctgcctycaccatgagaacaggcctgggctagcctgctagaggatgagaagacatacggaaaagagctgaggtcatcctacaccagtcaacagctagcagatcccaa

SEQ ID NO: 41372 - DNA, 201 bp, Bos taurus
gattggaagtatacccctttgcctcgcctgttcgtccctggctccaaagttcatctgatcagctctattgcttcctgggaggcctctcttcttggtaggckgggtgtgaaaaaccttctttccctggcataactcgaaacaacttcccttgaagctcttccctccatcagcctgggaaggccggctggggttcagctgtgg

SEQ ID NO: 41373 - DNA, 201 bp, Bos taurus
cacaatgtcccttcatagtgctgtccctactgttactcttattacttgacaccaggatagctgcagtgggctttaacctcttcttttggagccccttcacygccacggacgcctttcaccaaaccctgccagattcacttccctgaagcatgtgtctgatcactccagagtgctgctcaagattcttctgaatgttcctgt

SEQ ID NO: 41374 - DNA, 201 bp, Bos taurus
aaagccaattgattccaggatggatcatagctgttcctgaaacaggctaccccacatgctgatttagtaccaaaggccctagatcaggccatgttgggtgytgggtaacggcattgtctggatgacattttgtgagtctcacatcctctctggggtccctcccttccctctgtcaccatattctttctgcttgttctctct

SEQ ID NO: 41375 - DNA, 201 bp, Bos taurus
ccctacccatcaaagcccatcaaggtctcacaccctccacagggccaaccccaagcaaaggtctctctctgactgatgtctcgaggtcttctctgagacayaccaggagcgctgtccacctggccctcccgtacataaatgacaggaaccaagataacacaggctgaagagagtcctgactcttggtctgaactgagcata

SEQ ID NO: 41376 - DNA, 201 bp, Bos taurus
ctctgcctcttcaactaacgttgaccggcactaattctgatgtcaatggcatctcctttgaggactcagtttggaaaagatatatggggaggctcacctcmccctggtggcccatcttggaagtcctttcaggacgaccaagcaggagactggagtcacactggatgggctgaagggtaggtctggcatgtgtttcctcac

SEQ ID NO: 41377 - DNA, 201 bp, Bos taurus
tctgactgaatgggagcttggggggaatccccagaggccctgcgcctgcctggcctgctctctagaaacatcacttacacaccaaggcctcctggccctgrcacccaagtacagctctgtcagtggtctgggggtgatggcgaggtcttgattcatgtcatccgggcggttgcctgggccacacttgtcagtcaggagaac

SEQ ID NO: 41378 - DNA, 201 bp, Bos taurus
gggccagagggcctgggccttcggggcctggagagacgtgctaaggcgcccccactttagattctaagtggcaagcagccctgggagcaaaggtgcttcargtgcagaaaggcccctttcctgctgcgtgggaaccattccttgtgggaacacggagcatgacttcaggacaggttcccactgaagctgtcttgagtggaa

SEQ ID NO: 41379 - DNA, 201 bp, Bos taurus
agagtctttagccactgaaccaccagggaagtccctgtccattttaaaaatcggttgttcatttttcattattgagttttgagagttctttacatcttatrtatgcttatcagatatacgctatgtaaatatctctcccagtctgcgccttttcttttcattctattaacagtgtgtttgtaagagcagaagtgttcagtt

SEQ ID NO: 41380 - DNA, 201 bp, Bos taurus
cagtccccatgagtctgagcaggttcagggaatggctgtgcctggcccagcggccagctgcagggaagggctgcagtctccagcccaagaggaactccagmggggagaaggtcttgtgtgtgcctgatctgagagaggaagctggctgggtgttgtggcttggctgaagccacaaaggagaagcttctgggttgagaccac

SEQ ID NO: 41381 - DNA, 201 bp, Bos taurus
aaaggtcaggtcagggtgggacagagaccatctagcaggagagggaaggatacagggctggaacgtctcaggttgacatcagtgtcacagaaggaggtccygtggccagtgacaacgtcttgagcaatcacgaaagcctatgagtaatgcagcctggaccacttcctccaaaccagaggaaggaaaaatgccccaaaggct

SEQ ID NO: 41382 - DNA, 201 bp, Bos taurus
ttctccaaacgggcccttggctcagagcgggctcagtcatcatcacccgcaggcaaaggaggagctagctgggatgacgcattctcctctttctcagcacrtacgggcccccagacagcccaggccaggagaagcctgctcagtccgcacccgcttcaggcttctcccactttatctgtctggggcacttgcccttggcta

SEQ ID NO: 41383 - DNA, 201 bp, Bos taurus
atcaatacacacacacacacacacacacacacacacacacacacacacacagacccctcctcgcctccagaaaagtgaaagtaagaagggccgctaaaggkgtttgctctttgcagtactcaaatggctgctattaaagaattctgtgttgatgcccagatggatgggcctgcagagaatttataaagaaaaagggaaact

SEQ ID NO: 41384 - DNA, 201 bp, Bos taurus
gaagagccctgctcaccctgcggccccagcggaatgccacatcctccacatgaacctctcccgttcccccgagtatgtgaccttgtcttttccgtactctyatgcaagtgtcagcctcctctatggccttttcagactttctatcagctatgtcagtaaagtctatccaatatatacccatatcgacatacttctccagat

SEQ ID NO: 41385 - DNA, 201 bp, Bos taurus
aaagaagtttggcatccatgcaggagtgagtaggccgggttaggagggaagggacaggttagtgggtagctggctgccccagtgcaggagaagatatggtrtctgggccaggagaaggggtgatcttgatggaggagggagataaccctgagaaactcattggattggggtgagaagtgagtggaaggggcagagacaaag

SEQ ID NO: 41386 - DNA, 201 bp, Bos taurus
gattcaaatcaaagaacaaactaagaaggccaggccatttctgtttaaaaaaagaatgctcttaagcagagagagagatgtcaggaactgtcagtgacaaygccggtggggccccaggcaaaggccagccgtcctctcactcctctgggcgactccacattttcgtgctctcagccacaaccagcaacacctcaaaaacca

SEQ ID NO: 41387 - DNA, 201 bp, Bos taurus
agtggaacaagtttggagttttgtgttgaggcctagatttaaatctgccacttagaactgttttgagtgtaggcaacttgttttaccttagttatttcctyctttgtcattcatgtaggggcctcagtaccaaccttgcaggattgttaagagagagaatatgcaaagatcttcattaattatctggcacttgaaacttgg

SEQ ID NO: 41388 - DNA, 201 bp, Bos taurus
tctctctgttattcctcattccagttcttgatactggtgttcggtaaactttccctcttctcatcggaaacctgacgctctttgactgtaggagggccggygtccccgctctgcccgctggtgcgcgcgcgcttccctgcgtcggtctcctcttccctagctgtgcgctcctcatcggaacgctgcttcaggcgctgctgt

SEQ ID NO: 41389 - DNA, 201 bp, Bos taurus
ctgccacggcccaccgcgtcccgctcccagccacagccctgcccatttgccgccttaactgggctgaacccctggccctgctctcagtccattctgttgtyagggattatctcctgtaccattttttcataaaaccaaaatcactaccatcaaatggcctttgtacctttaaaaaggtctgcttaaaattctgtttttaaa

SEQ ID NO: 41390 - DNA, 201 bp, Bos taurus
tgcatttcactcatttaaagcatatgtgtcaatggtgtttagtaatgtaatgttcagagagttctgagactttcaccacagtcaatttcagaatattttcwtcactccattagccgtcacttcccattggtggtggtggtttagtcgctaagttgtgtctgactcttgcgatcccgtggactgtagcctgtcaggctcctc

SEQ ID NO: 41391 - DNA, 201 bp, Bos taurus
actttcctgccttcctgggccctagggaggtgggggtcaaatgcataccttgatccttgatctccaaagagaaagacttcaggaagaagcacccccatcaytgtccctggggcaggcccaccatcatacttattaaaagtgcccagaatcctttcccaccaaggccgcccccggcaggggcgtggccatggggagggtggg

SEQ ID NO: 41392 - DNA, 201 bp, Bos taurus
caggcaagttgtctttgagttaaaccaaaattgggccagaggactgagaaattgttcaaggtctcacaggcatgatgcagtgctggcacgattgagacacragttcctccaactcctaaacctgtgcttgtgaataacacgcaatgttgaggatgtttagggaccagccatgagcgtgaggacctgcacacaggaacaccg

SEQ ID NO: 41393 - DNA, 201 bp, Bos taurus
gtgaatttaaacaatagttgtaataaggtgtgggagaaggagagtaagaaggatacaaacgtgagcctgcatttaaggtttcagccgtgaggcatttctcrttgtttgtcagggttggcccttggtacagatgtctggagttggatacagctgagcggcaagacgattgtgagttccatgagttggatcacccctccaaac

SEQ ID NO: 41394 - DNA, 201 bp, Bos taurus
catcctgccatctctgacacctttcaagtctgcatctggcgttgtttacgcctttcttcccagatcagcccctctgcacacactcttcagggtgaaggccktggttcaagtgtggcttgtgggtcattaacctgggaggaagtccccttcctgaatattccaggctccctcccctaaggcctgagggctgccgtgacaaag

SEQ ID NO: 41395 - DNA, 201 bp, Bos taurus
cccccaaggccagagattcgggactccagaggcttgtccccaccgagcaagcgccccttggatggacgccgggacagaatccactccactgtcagattacragggaaagaacagacggaggtggccggggaggcttgtgatcactagagaggatcaaaagggcacttttctcacccccgcgccttccagaccgcctgcttg

SEQ ID NO: 41396 - DNA, 201 bp, Bos taurus
ctgttcctcccccttcttaatgatagtctaaataattaatacacatcctcctacaattaatattcttttccattggccataggaaagccacagtgtatgarccaagaagtggtgtgcataggagatgagatcagtttttatattagctcatccatctgagccacctggtactcatgggccaggcttccttcctaaaacgtg

SEQ ID NO: 41397 - DNA, 201 bp, Bos taurus
aatagtgaatagaccgtgaaatatattataaaacttgcgtggctataaggctggaaggcttatatgctctgacaggcattcctgttccctggccagacacrtggaagtcatcctttatccttcttccctttcctacagaaatcatgttctgcacataacccttggcagggctctctcctttcttcactcccctggttccca

SEQ ID NO: 41398 - DNA, 201 bp, Bos taurus
cagggaggaatcccctcctggaggggctttgaggccaggcagggctgaagagggtggaaggacagaacagaacacagtagcacagacagaagacagacgtrggtgggtccacctgcggccggctgaggggtcagaaaacaaggaagccacagggacagccagaaggtggtgggcagggtagaaaggagtcaggaactcgct

SEQ ID NO: 41399 - DNA, 201 bp, Bos taurus
ggagggccttacctgagagccgggtcctgttctccacaggggctgtttagcgacggaggagtggatcacatcccacggctctggccccggagtatctcgcktgtgtgctttcttacttagtcgagctgttaaattgagttgttttccgttccccaaacctacctgccttctctatttctgtcgtgtggccagttcccgctt

SEQ ID NO: 41400 - DNA, 201 bp, Bos taurus
aaaggttgccagcactctggctacaaatgctccgcagagcagcttccccgggacagcgtgctttcactctctcggcccctcacactgaagtgggtgagaasgtgacactcttgcatcccccatggcagaggctgggcacgtagaagactccagaattcagaatattcctctcctcaggaacaggtggccagaaggagattg

SEQ ID NO: 41401 - DNA, 201 bp, Bos taurus
tcatatcagtcctcaaaagagagacacaggaagaatcagccccgaagatactgtgttgacagaagcagagactggagtcatgtgctttgaagacggaggamgaggccacaagccaaggaataggaatcctgaaagaggcaaggaaacagatcctccgtcttgacgtgggtcttgactttagctcagtgaaactcatttcag

SEQ ID NO: 41402 - DNA, 201 bp, Bos taurus
caggactcttcccttcactgatactcttttgcctaattaagtttttaaaaaaatattcctgctccatctccaaatctatctttctctatttttgcctaccktgaccaatggcatcaagagaatgggtttgttttttttaagtattctttaaaaattcggtattaagaatatgttcttgcttgtgtgacctcacttcattgc

SEQ ID NO: 41403 - DNA, 201 bp, Bos taurus
gtcaggatatgttctttccatggaaacagtagagatacaagatctaagccttgcttccattatatatccaaaatccgcaagtactatggccaaacccaaamgtcaaagatggaagaggacttatattcagcctttttagttgcagaagctgaagacttgcaaagaaaagggtgtggataatgggaggaacagggccaacaa

SEQ ID NO: 41404 - DNA, 201 bp, Bos taurus
ctcaaatggtatgactacattatgcaaaacttttgaaaaccagtatcttgctggttctttcaggcaaagaggaaagtctgggggccaggggactctgtatkgtgggggtggacatactccccacatcaggctgggaaatctcagagcttgtggggcagctggaaagtgagcctggagctgcgtggagaggaactactgggc

SEQ ID NO: 41405 - DNA, 201 bp, Bos taurus
ccaaggcgtcttcaggccttggctggaccgccactagagtctcctaactggtcttcttacatcacaatctgaccatctccctcctcctcttctccgcacakctgccagggtatcttgccaagaggcctgtctgatcagatatgaacttaagacgaggaccagacaaaccacagagccctgatggccccgcttggtctgatc

SEQ ID NO: 41406 - DNA, 201 bp, Bos taurus
ttggaatgttccagtgctgaccagttgctatgggcctgttggcgggggaggggcattggtggaactccagtgtttgtgaagtcttccatttccttggtagrggaacttgagacagcggggtggccagaggggagcagtcacagttgggctctaaagctagaactcagctagtggcctcgatccggcctgggctgcttgctg

SEQ ID NO: 41407 - DNA, 201 bp, Bos taurus
ttagttctgcagcacccccagactcttcttcaacttttgttttattggaagaatgggatttttataaagcctaagaagagtccacgatcggaacactgtcygcaagcctggtctttggcaggggcgtatggactggggcgggggcgggggcgtgcagccagctcacggggcagccccagcgcagcttccgggccaggtacc

SEQ ID NO: 41408 - DNA, 201 bp, Bos taurus
cacaaggccagatttcaatcgttcactgatccattcttctttttattcaaccagcattcactgaagactttccccctgacgttgggaagtattggtgacaygttaataaggcaccactcggcccttgttccccatgtgggggagagtgacaagctatgagacaaatcggcccaagtgcagctggaactacctgttctgact

SEQ ID NO: 41409 - DNA, 201 bp, Bos taurus
aataaggatgttcgtacttgcctaaagtgaaagaaaagagttttttcccagtaacaaagttttaattaaaacataacctatgaggataaatagtcaagtaytgaaatccacttcaacttctctgaatgaacgttaaaccgcattcaaggtggtagaaagagaaaacttgcaggcttaagccaccctgaaaggaatttaaga

SEQ ID NO: 41410 - DNA, 201 bp, Bos taurus
ttaaatgactgaattgacacatttttgcattccaaagtgacttttgaaccttgtatgagttaagggaagttctccaaatcatgttctccaagagttttcaycctggaaccactttacatgggccacaatctgcatgagcaaaagggaccttctgcgctatgccctcaatgtccaggaagctagtgaccggactctaggacc

SEQ ID NO: 41411 - DNA, 201 bp, Bos taurus
tctgtccctgagaagctggttccatcaatcaggaaagacaaacaaggaataacactgcggtgtgcagagtgttacaatagagccgatacaggctcccagayaccacagactggggctctgtaacctggtccgggtgcctgggaaggcatgcctgcaaaagccacactgaagcagaggcctgaagggttctgacctacatta

SEQ ID NO: 41412 - DNA, 201 bp, Bos taurus
ggggtaaggatggggaaagaatttgaaaatctcagtcttcatatgcacacacgatttttaaaattaacaaagaacctaggttgtctttggttttaaattayggctccagcatcacccagccctcagggtcatggtttatggttcttcctggctgcctcaggcaaggcgaaggaacttcagtgctgaaggtgcttcctgtct

SEQ ID NO: 41413 - DNA, 201 bp, Bos taurus
ctctcctgccaatcagcatttcacataaccagagcaccagtcagaaatatgtcagatgagaagagatgagaaggaggcctagtaaatgcagctaccttttmgagtcctgccttctaaaataatttctcttatagcagttcagggaccctcctgagcaatggcctttacaggaagctgaccactctggctaaaccacagttt

SEQ ID NO: 41414 - DNA, 201 bp, Bos taurus
gtagtggcactgaaggacagcaaagctcatttcaaatttctacgctccccttgtgatctgtgaagacccagcagagccagaaggcatgcagcatggcccgrtgcatgatgacggcacagggcatagaggagtctgggttatgtctctcctcggaagaggcaagagcttcatagggtcaaaagtgggcgaacaccgctgagg

SEQ ID NO: 41415 - DNA, 201 bp, Bos taurus
taccatcagtcaaagcagcagcttccaaataaggcagagagtgtaggcagcgagcttaggtggcatgtcccctcaaacgtgagacgctgttgcagaggccrtgaggacagctgcatatacttcccagcccacggcgtccatgcgctctaacacccgtgtttcttcaaagacagaagaatgacctcaggcccagaatagaaa

SEQ ID NO: 41416 - DNA, 201 bp, Bos taurus
gatgtaggcctctgtctctcaggaattctgcagaaggcagttggaaggggacttattcacgatcctggaggcactagggtaatgcatttcacaggacacgmctggtcctgttagagctccaggccccgagcgcagactgcgggccaggcaccctgtctgaggctgtgcacactgatctcattgccttctttatgaacagct

SEQ ID NO: 41417 - DNA, 201 bp, Bos taurus
aagagtatggagttatagcagcaaaattggttttacatgctgtgctcagacaaaagcaaggcagggaagcaggtgccagggcttggtgagaaatggcctcrtacccaggcagcttgtccttctgtgttcatgtctctactgctcaggaacattctcaaaaatctgaatgttctggaagtaaatcatgattagtcggttagg

SEQ ID NO: 41418 - DNA, 201 bp, Bos taurus
tatttctcgcctctctcctcctaatcgtcttcctggctgtaacatttccagtctctttcctcaaactccctcccctgttgactacggcttatatcaggctrttggaacattctggccagcccactattcctcttccctgaggtgaggggagaggcctggggcagctggagaggggccagttctccttgctcatctgggata

SEQ ID NO: 41419 - DNA, 201 bp, Bos taurus
gaagcagaagagaatagctgccaagtccatgccaagtccttcaatcatgcagtcaagaaatacattattttaatttcaacattcatggagccctgtgatayttctccccagatagtattttattttgatttatatatgatctctaggataataattctactttttccttcagttttctgtccactaccttacagttgcttt

SEQ ID NO: 41420 - DNA, 201 bp, Bos taurus
cagagccaccaaaaattcccaggtgggtgtgaccagtattccatttattagaagaaacaacatggggtatagcaaccagctacaaggtgaatgggcattamaaaggaaaagaaggtcaaaggtaactctataggggcactgcaggcccaaagaggcatgcctgcatttcagaagtggctttgaccagaatgagtctcaagt

SEQ ID NO: 41421 - DNA, 201 bp, Bos taurus
agagtcggaaagggtgcttctgctgcaggaggagaaaggaagctgaggaggttagaagggggagatcgcactcttctaaggcaggaggccattctgcctcwggagatgaaggaacgggagcaccagcaaggacgtcagaggcagtggacaagggttgggaaggccgtgagagcacttggtacaagggtatttaggaaaaag

SEQ ID NO: 41422 - DNA, 201 bp, Bos taurus
gtctggaacctaatagattctcacatttttggtggcactaacgttggctgcattggaatggctggccagactgtgtgggcatgggttgcagtgttttcctrtctctgcatttttcacctagcatctggcattggacttgcactgtaggtagggcttcaaatttcttggacacttgttcaatgaaatcaataagacttatga

SEQ ID NO: 41423 - DNA, 201 bp, Bos taurus
tcaaggttatcctactttttaaaaacactgtaacaaggtgatgtatttcaactggtcaatttgtgttcttttctttggccaaagcacaaatacagtcagcytgttatcaggggcagtttgactaaacagctattaccgtcaccaaatcttaggcctagcttgactaagaatgtcgtttaaataactgagttaagtgtaata

SEQ ID NO: 41424 - DNA, 201 bp, Bos taurus
caatattttgtcatacattaatttacatatttgtttaaggccatgttaaataaattacattaaagtcaaacagattatcggcttgttcttcagtctatacraaagtttcttaacttggccattattaacattttggacagaatagttcttgcctgtgaaggcttgtcctgggcacagtaggatgtttagcagaaccctggc

SEQ ID NO: 41425 - DNA, 201 bp, Bos taurus
gagccacttgagaattctgaaagtcacatagaaatttacttggctctcattatccaagaaaagcatattcccgttcctcagaaaaaaacaaatgggtataycaagaataagagtggaaggggaagggaaaagcaaattgtatctccctctgtttagattgtggaatcaagttatttacttgcctagcatgaatgtagactc

SEQ ID NO: 41426 - DNA, 201 bp, Bos taurus
tcagatttttaaattaaggatgaaagatagttggaaatttaaaagggtgtataagacatttcatggcgatagtaacaaactgatggagaatatttaggttktatactgcaatgtcccatgactggaacttgtgtatagttattttcagctttacctggattaatacaaaatgtatcagttgtgatcagaattggttacata

SEQ ID NO: 41427 - DNA, 201 bp, Bos taurus
gctggacaccaaaatctgttgggaacagtgaagtggtaattttaatgaagtgctgaaggctgagtgcagactaacacgagaatgggagactctagggaacrtcaagcccaagggacccctgcactgccatttgcttccgctctagtgaaacccaccagctgtagccgggaaacagagtgggttagcagagaacagcagcag

SEQ ID NO: 41428 - DNA, 201 bp, Bos taurus
agccagatattagataatgctacagaattatgtcatgtattagagaatggcacagatattgaaatgcagtagagattgttttattaaacattggagaggcmatttatgagtagaaataagaaatatgagaatatgtgtatcaattaagacaatatttattcagtaatattgacagagcatctgctattaatatatgtaaag

SEQ ID NO: 41429 - DNA, 201 bp, Bos taurus
agccaggcacaaacctttatcagcccatttaacacagcatcctcagtgccccactggtgggccacacacacgttgcagtctctgtaggttgtgcaatgtayagacattcacataagctacctgtgagtgcgccccctgcaattgaagagtgtcattttcctttctttactcaccatgctgctgctaagtcacatcagtcgt

SEQ ID NO: 41430 - DNA, 201 bp, Bos taurus
cctttgaaccaacctcttcccaatttctgcaaacttgtttttcactttgcatttctatgtgaaccaagttcctacccacatcccagattgtcaaaaccagmacttgagctatcataaatatcctcttccctcactatttccaatttataatcatcatccggtattatctaattttacctctccatatatttcttcacctaa

SEQ ID NO: 41431 - DNA, 201 bp, Bos taurus
caaaaatataaaccagatgttggagttaccagacaaggatgtttaaacaagtataaaatgattcaacaagcaatgttaaagtcacttgaaatgacaacaaycaacataaaatctcagcaaataaacagatgtttgaaaagagaaccaaagaaattatatagttgaaaactcaaacaatagaaaggaaaaatgaaaaatctt

SEQ ID NO: 41432 - DNA, 201 bp, Bos taurus
ctctttggcaaggtcactcatagtctccaagaggaaacagggcatgtagcatattcatctgttaacatatggccccatacattttaattttttgcatatgkaattctgttgcaaatagcagaaatatagttaacttcaaaagaaaggggtgcatttcccaaagatgacacagtctatagtgtgaagcaaacacgctcatga

SEQ ID NO: 41433 - DNA, 201 bp, Bos taurus
acagatgcaaccccagtgtcagagacaattcactcaataaatgcatttaaagagtaaatgaatgcatgacaatgcgcacaacttccacttcattattccaygccactggactggtaatccaaacctgagcactatctctgagaaagtccattcaggccaatatctgcttggtatctttccatctctcattcatagtctgga

SEQ ID NO: 41434 - DNA, 201 bp, Bos taurus
gaaagagaagcttgattctgtgcttgagttcagcatcccaggctctctgctgatccagagactcacaggaaggcccccagaatggccattcatacacaagragttcaatcccctaaaggcgtccatgaaagatggtatcacagaggaacccttgatctgccaatcagatgataataaaaaggccttgaaaatccaccctga

SEQ ID NO: 41435 - DNA, 201 bp, Bos taurus
aaaggtggggaaaggcaggggtctctagcctccaaatgtaaccttttgctcattatagccccattacaacgatattagccttacagatatgaagtaccacygatgccaagactagggatgtaaatccctccactcctcggggaggagaagctgggatgacaatcagggaggaagattcccaagcccctctctccccggtga

SEQ ID NO: 41436 - DNA, 201 bp, Bos taurus
aagcactgtgctaagtactttgtatggatttcacatgtacaactttgtgctgaatacctatgtgcttgataaagggccaagctcctccatctccctaattycctcacctaaggggctgtatatctcattgctggggtctttctgtgaacaggctaagtattgagtcacataattagaaatggccactagaaaccacattgg

SEQ ID NO: 41437 - DNA, 201 bp, Bos taurus
gtagtttaaaagatatcctattgctttatcttacattttcatgaatcatcatctagactctaaatatgacccattcagaccttgcaaggtattgaaaatgmaaataaactggaaaaataaagcatacatgacagaataactggaggatatattgatcttaaaatggataaaattagatctatatgttatagagaaggaatg

SEQ ID NO: 41438 - DNA, 201 bp, Bos taurus
aaaagaagataggattacaccactgaacagcattttctaacctgtgctcaaatggtctcttctaattactttgttactcagtgtagcccatttgtttctcytactaaatgtgaaatgttgagcttagtctattactttagctacattttagaaaatcttatcaatgatggaataatacttgtttatatgaagtctttattc

SEQ ID NO: 41439 - DNA, 201 bp, Bos taurus
gttcagtgcagttgctcagtcatgtccaactcttcgtgaccccaatagatatgttaatatgtgtaaaaagtgtgcaaacacttgtgttcagcaaaggttarcatggcaggcctgaggctgctgtttttcttatgaagtccttctggcaggattggccatctggaaacctaaatttcaggagcattcccaccaccctaactg

SEQ ID NO: 41440 - DNA, 201 bp, Bos taurus
ctgacaccgggcagggcagggcccctttgtttggcttgtaaaaactgcgaaacagaggcgccctcagtgacagccggcgagcagccccaagctggagtggsggcctgtgggctactgtgaggagcatcgatggtggaggtgacctcctgcccggcctcgcaccggctgccccgcaggtgtgaaaggagcctgttctgacat

SEQ ID NO: 41441 - DNA, 201 bp, Bos taurus
tgacagaggccagtcggaaggcagtggcttcctgccaccgttttgattccctacgtgtttcattgttctgagtcccgtgagactgagctagagctcatctrctggccttttgaggcagccaagaaatcattgtcgtgggttctatgcagccccccaccctacccccgtggggagctcagcttaggctttctgcagaatctt

SEQ ID NO: 41442 - DNA, 201 bp, Bos taurus
gtgtttcacatgtaggcctctaatctgttgaattcatttctgtttaaggaaatggtttaggttgaggtccatttttctgcttatgagtgtctgtttactcyagcatcatttgtcaaaaggccatccttcctctactgaattgcttttgcatttctgtcaaaaatttattggacatatttgtgtggttctatttctgaatat

SEQ ID NO: 41443 - DNA, 201 bp, Bos taurus
atttcacaggccatctgtataatacaaaatagtctccccatctcaatataattaatttagtcacatctgcaaaaaaaacccttttataaggtgatacttaygtgttgtaggtaccaggcccttgactcctttagatcatgattctgtttaccatggacttccctcatggcttagccggtaaggaatctgcctgcaatgcag

SEQ ID NO: 41444 - DNA, 201 bp, Bos taurus
agcccagttttgcctttgacccactcactagctcatccattaaacaagctcaggttttttctcttctgttattgggccaggagagactctccatgcagccrtaggtattagcttcaggagaattactgatttattattatggtgggtgacatggagtctggactagctacacatctggcacacaagtgcttgctggccttg

SEQ ID NO: 41445 - DNA, 201 bp, Bos taurus
ttattgtgatcatttcacagtgtatacaaatatcgaatcattatgttgtacacctaatataatgtcaattatatctcaatttaaaaaggataaagccccartgagcactaacaggtaaggtataggcgtaagcagagaggcttactcagaggatgaagaaggcagggggcagtgaggagcgggtcatgaagagtatattag

SEQ ID NO: 41446 - DNA, 201 bp, Bos taurus
atctggcttctgtctttacctctccaccaaaactccccaatcgtgttgccagattctaaaaacaattttaaatcctgtgtcctctgctagatctgacatcrccagctgtcttgtttcttgtaaagctcttgcctttcttggctttgtggtagcactgcactcgccctcactactctccataggcattctcttccctctaca

SEQ ID NO: 41447 - DNA, 201 bp, Bos taurus
aagaaggagagtttgaggcaaactaggtttctagttttctagtcttccaagcttggaagactagaaaaatggaagaatggagctgagaaaatacaaggccrgttcagataatggaaagtaaacttgtttcaaccagggtggaaatgtcatatggaacaacagataaggctgggccgtgaaagtgggaaaagatgtcttaag

SEQ ID NO: 41448 - DNA, 201 bp, Bos taurus
cgtacctgctgataaggccctctttcttatccactctcactccgtcccccagtcacttcgcagactcacaggcatgcatcatatttactctgcaaacatcrggggtggttctgtggccatcaagtccaaccagtcccagggaggggctaagggaagctcaagccaccacagaaaaccaggaacgtcagcctgcatctcact

SEQ ID NO: 41449 - DNA, 201 bp, Bos taurus
taaaggtggcaaagtagcacaaggcaaattatttttctgcaccaaatttgagctttgttttgaatgatcggactatcataaaacagaattaaaggagaaaytggtcgactaataaaacactttatgatgcaatgaagatatcagatagcgtaaaaacttggagaaaatgaagtcaaatgaccagagtggaaggagaggttt

SEQ ID NO: 41450 - DNA, 201 bp, Bos taurus
cttgaaattggccatagtggatatatttataccacagaaatcagaaaaaagctagctgctggcttgctttactgtttctttctctctctttctcttttttyctttctggccatataacagggcttgtggcatcttagttcccagaccaggggttgaaccttggtcctcggcagtaagagtgcagagtcctaagccctggat

SEQ ID NO: 41451 - DNA, 201 bp, Bos taurus
aaacgtttctcaaaatgacaagtgcatattctgtgtgactcagaaattacctctaagaattcatcttacagatttaactgcacatatgtgaaatgagagargcacagtgtggccttgttcggaaacagctccccacccatcaccattaataaagaactgctaaacctaagttggtgacatacatgtgtagctatttaaaag

SEQ ID NO: 41452 - DNA, 201 bp, Bos taurus
atttgtctatttagaatgagggccttggcctgctcttgccagagcattcccaagattgagaatcctatcttttgggcccatatcaatggctgatggagccycctgaccttctactccatttacctggtgccttcttgatactttttgcctgaatctctgaaggtacttcctttggattcatgctatggccagatccaatta

SEQ ID NO: 41453 - DNA, 201 bp, Bos taurus
ccaggggaagcagatgaagctgtgtaaatgcagcctgcttgttagagttgtagcccatcagtggaatcagccctggcattgatggatgactgctttgttayagactggctggtcaggcccctgaagaagcccaccctttgttcattgccttgtaataaagccccactcttcaatggcaccagccgaggctgtcacctgcca

SEQ ID NO: 41454 - DNA, 201 bp, Bos taurus
cctggccacttgccctgtctgctctgccttatttctctctgttccttgggatgcacactttgtgcaggctacgccaccctctttctgttggagaagcatgygtaactccctgttttgctaggcctttgcttatcccctctctggcttccctttctaaatattgtccaggcaccagcttgaaagcccacctcctgctccaca

SEQ ID NO: 41455 - DNA, 201 bp, Bos taurus
taaaagagatcccagaggccttatttgtcctttctgccatgtgaggtcacagtaaaaagatggccaccaatgaacccagaagtgggggcccaccagatcayggaacttcctagcttctagagctatgagaaataagtttctttgtttataagtcatccagtgtatgatattctgttgtagcagctcaaaaggactgtgata

SEQ ID NO: 41456 - DNA, 201 bp, Bos taurus
tggacaccgcagcaacagatcccgcatgacacagccaagacggccggatcaataaacagtaaaccgcagggagagtccaagggttcccagggcttggggaytgctgattcaaaggccacgctccccgcgggcacacctctctgccttgccgcggggctgcctcacccccactgcgagaagggcttgccatagcaagtggat

SEQ ID NO: 41457 - DNA, 201 bp, Bos taurus
aaagttttgtttattagctggtgtgtaatttggcctcttcctgcaggtgtctgaaagcccctgggaagcacgcttacccagaagggagaaataaagagctrggtttgcagggcagaggcacagccttgtcttctttttgctgatgcaattttcccccgtgggatttctgctgggtcagccaaccctctgaggtccagggtc

SEQ ID NO: 41458 - DNA, 201 bp, Bos taurus
attatatgtatgtatacatataaagagagaagtttattttgaggaattttgtctcatatgatcatggaggctgatgagtccaaactctgcatggtaggccmgcagactgagacccggtaagaatccgtgtcttggtccaagtctgaaggctgtcttctgctgcactccttgttcaggaggggtctgtgttattctactaag

SEQ ID NO: 41459 - DNA, 201 bp, Bos taurus
atctcagagtttgtaaattagaggccatgagaatctgaaccagattatgggcagtggtacggagatcagccaatgggtactttggactgagaaagcagagrtcttggtaattgatataaaggccagttgggaaacggggagccaggagtttttcattggttttgttcattcgtttgttttgtgttttggtcttgccttgca

SEQ ID NO: 41460 - DNA, 201 bp, Bos taurus
gggtgagacctccagagcagatgctgcttctcggccgggtttcctgcaggcacgccccctgtggtcgggctcggcaggggagcccagcacctccgctgggrgacaagaccgcctctctcctccttttcgtcggaaaccccctgggcatcacccactgtggtcttcgttcttctccacagccgtttcctggtattagattcc

SEQ ID NO: 41461 - DNA, 201 bp, Bos taurus
gcaaacatggcacagagacaaggaacagaggctgctgcggctggcgggagtccctgatcacacccggaagttcatccacccagacatctggtgccctggaragggccagggtggaacccgagaagccctcctcggcctccttccatcactcactgattttggcttacaatttgagcagcaaaagtcatttgcagagggttt

SEQ ID NO: 41462 - DNA, 201 bp, Bos taurus
gggcctggggcttccaagaaagagcaatgcccagggggcttcctgtgactctgcagcacctgggctgacctgaaggaaccgcctctcccactgtcactcamacctcctgtgctgggccaaggcagttctgtgccttgagctcctctctattcccccactgctgtctccatggggcagctggtcgtcacagggaatcgacgc

SEQ ID NO: 41463 - DNA, 201 bp, Bos taurus
gacaacttgcatgcctacaggcttgactctgtgaggccgagggaaagctgcttgttccatcacaggttctaggtacggagaactctgccaagggtcttggyggtggggcccgggggccagacggtcatctcagtccactctattgcaggcacagcctctgtggccgtggcagggatcctggctgctctgcggatcaccaag

SEQ ID NO: 41464 - DNA, 201 bp, Bos taurus
catcataggtaggaggagggggcggcccactgctcagcccagctaattctcttgacttgcaggcggagactgaggctcaacaagggggcttcagcaacccrtggagatgcagctctttcccctcacatccaattcagtgcttttattgagttattgacttattgctgcatgtgaaccatagaacggaggcaccacgctggg

SEQ ID NO: 41465 - DNA, 201 bp, Bos taurus
tccaagctctggggacctttaggaggcccactgagagggtcagccggagcacggagcagggtaaggggacctcgggagggcgggcccgcagagagtaaggragaagcgtgttgctaggacgcgacaaaggctcgctccgttgctagggagtcagaatagggccgtggcccagccccctaggtgtgtctggtcccaggtggc

SEQ ID NO: 41466 - DNA, 201 bp, Bos taurus
atacccacataaaccctcctcccacagaacaagcctccaggaccagctgggtttagaactgccatccacccacactgctcttcgaggccagatttctcccrtttgtcctaccctatgacctctgtgtctctgggtctctggtgttctttgaaggcactctgctcagcctcagggacagacaggtggcctccagtaaggtct

SEQ ID NO: 41467 - DNA, 201 bp, Bos taurus
cgcttgggaaggggccggagagaaatttgcccctccactcccctagaagaccccccttgccagccgatgtttcgaggtgggggtgaagggggcgctgcgcsaaggcctggccccttttgtgcacgttcagtgcccggcagtgtctcccagaccagcaacccccgaccctcctgtctccgcgtcttagagaagccagaatcg

SEQ ID NO: 41468 - DNA, 201 bp, Bos taurus
agcagaattttaattactatttggttataaagtttccagtgttatttttgaggcaaggacattgtacacttaatactcaatagcagccaagatactgtgarttagtgggactccttccctcaaaactggatagtttaaggtgatcttccagcttttggaacaaccatttctgacttcagccattcacttttatattccttc

SEQ ID NO: 41469 - DNA, 201 bp, Bos taurus
ttcacctgtttctcccttccctataatatttcctctgtcatactatgtcctttattagtgaagagtattgtctaagctgtcagttctctgattatagttcrgcataattacaactacgttaagcaattatttgttatgcatgttacctctagttgattgtgaggtgcttaaggggaggatacatgacttactgatcttgtc

SEQ ID NO: 41470 - DNA, 201 bp, Bos taurus
ctatgaacattttggtttgtgtcctgatgcgtatgtgtaagagtttatctataatatatactgagtagaagaaatgctggattacagaaaaaaaaaaaagkgtgaattttacaagacaatacaagattattttctaaagtggtcatggcaattcagactcaccaggaataaatgttaccattcattcatagattttttcct

SEQ ID NO: 41471 - DNA, 201 bp, Bos taurus
tgtgtgtgtgcgtggtaatgcatattattactgttgagatgtgtgcatcttacagacaggtgtgatgtaccttttctttttgaatgtggagtgcatgtgtrgagtgctactttagcttaattgaattgtttatctttagacagctagatcataagagctactatgtcttcatgacaactaatatttggtattattgtttct

SEQ ID NO: 41472 - DNA, 201 bp, Bos taurus
ttctcagctcctctgtatttgaatggtattaactagagaagagggcttctgcatgtggttgccattgcagtttctccgtactcatgtgctcagtcgtgtcygactctgcagccccatcaactcctctatcaactgccaggctcctctatccattgcagttttagtgctttttaatcctgtgaacattctgaagggtagatt

SEQ ID NO: 41473 - DNA, 201 bp, Bos taurus
ataccagcactctgtgaaataggaatagcgtgtcattgcacagttactgtgtcccaggcagatccacctataacatttgtagctcttgaagcaaaaatacrtagggaggccatgtgctaaatatttagaagttctaaatcaggctagtgaagcattgctcaatacagttagtcatcttaattcaatagatattctttcaca

SEQ ID NO: 41474 - DNA, 201 bp, Bos taurus
ccttaagaaaaaaagaaatatatatatatatgtatatataaatgtcagtgggatgtgggaggtacaggtggccgtggcctggtccagtttggaccagattyttggtccagtttggtttcggataaagattgttaacagtttgtactctacggtttcccagtggccggtttaggctcagatgaatggtgctgggacaataaa

SEQ ID NO: 41475 - DNA, 201 bp, Bos taurus
tcatttttgtggacctctgtttgtcaggctaaagagaaactcccatgatcttagaacaaaagtcaggccttttggaatgagactctgtgggccactgataycaccagttggttctaaggcagctgggagtgagctggctaagggaagacagcttcatctgggccataactatagcttcgtagcaacatggtacagttgaaa

SEQ ID NO: 41476 - DNA, 201 bp, Bos taurus
aattatcttaagtaattattttctctggaagctgtaatgaataagataaatatcattactttacactatacagtgtcatgttaaaatgatacagttggttrcaaagtaatgttttcaataaatattatgaggttttaccaacttcaagttcctcttgctggtttaagagacacttaactaatagtaaagaaagtaaatgaa

SEQ ID NO: 41477 - DNA, 201 bp, Bos taurus
gcagcgagacaggcctagagcatgcaaataggcctgttgtctaaaaccctttggcttccagataaattcaggaattgtcttttgagatttaacgtaactgygtctgtacttgtagcaggccagttgctgaggaagcaaagactccatctttagaaacaggcagataaggttaaaattcccaatctattgttgactatggag

SEQ ID NO: 41478 - DNA, 201 bp, Bos taurus
agcgagagacctagatggctcagaggaccaccgctcagctctgcacaggcagaaggcacaatagcaagaaaagggggagaggcccaggaggcctggaagaygggctccaccgaggtgaacccacagcatggagcctgaggaggcagcaaaacttctaggtgctgtccctagacaggacataagccctacatggcttaatgc

SEQ ID NO: 41479 - DNA, 201 bp, Bos taurus
actttgaggacatattagtatttttataacagtatttgatggccaaataatcctctttggttagaacctactgccagtgaggccagggtcaaggccatacyttctgtctttgatcttacacctgtttcatgttccaaagtcactcaagggcagcttgtcatgaggggcttggggacaaaggcaggtggttgagaacagctg

SEQ ID NO: 41480 - DNA, 201 bp, Bos taurus
tgtttcttgagtatgcctgggtttttttttttttttattaaagtcctaagataaatgtctgtactgttgaacccgctgagtcagacttttcttaaggcccrtctgtcactttaactcatcaggcagtctagccctaaatctagaacacatggcaaagataaattgcttagttggagttgaggacgacttggccacaaaggt

SEQ ID NO: 41481 - DNA, 201 bp, Bos taurus
tgagaatatttgcttattaatattaaatgttaatgattatacaaatataagccttttgatttattttacataatcagaatgcttaagagactgcatatgakaatacaaattctaatatatattcttcataatataagcagtattctcagtcccctaaacttatttgctggatataatttttatacattttaggcttttatt

SEQ ID NO: 41482 - DNA, 201 bp, Bos taurus
ttcatagaaggatattagtggatgttttactgtggcttatgtagcatataacacgaactagcagacagaaatcttcaaatgtgaactgcatttttatgtcmtttgaaaggagattctctctgatatttttaatttagttatttggttgcaagaggacattgtcagtatttcaagaagtctttgtcaagtctgtcgagggtt

SEQ ID NO: 41483 - DNA, 201 bp, Bos taurus
tgccctgatattagcatatttttgatatgcaaatttatcataattggagaagccattttcataggtactaagtaagagcgatgtaaatcttgactgggccrccctatggacgtgattctccgcttgtttctgcagggagccccgcaaggtggtcctgcataaaggctccactggcctgggcttcaacatcgtgggcggaga

SEQ ID NO: 41484 - DNA, 201 bp, Bos taurus
ggtcagtttgcttctgggtctccttgttcacacttgacaaactgcagaggaagcaggtatatggcagagcttcctctcatgtgtggcaaggggcgttcacrcccttgcccttgctccatccaagtgtccatcagtagctcaaagccttgcgatgataccgatggacaagatcactgatgttcctgaaaaaggcagcagcct

SEQ ID NO: 41485 - DNA, 201 bp, Bos taurus
tccaaggttctatgatgccatgaccctaaacctaactcactaaagaatgctctgaactgaaactcagttccaagaattctgggatgacaagaaatccaacmagttccctgtaggtggtcttgcaaaacctagtgttccaagaagagactggctagtcctttggattttgttctggcataaaattaaataaggataaggaaa

SEQ ID NO: 41486 - DNA, 201 bp, Bos taurus
atactctgcaggcattttgtgtggaaaccaaaatgacctattaacttgtctatctactcatgtgctaggaggatatggccagatccccaaacagctagcaygtgggtgttgtctgtgcttagcaaatatttgcgaatcaactaagtgaagcagtgagcacacagaggccctgttctgaatttttcccatcaggggctggca

SEQ ID NO: 41487 - DNA, 201 bp, Bos taurus
cttctgattactttgatggatgatccttactgttaagaaactcatactctggtagggtcagacatagataagcaaatgttgcaacaaagtaatagagatcmatacctgttgagagtggtattataggagggtgtgataagcaagtcatcaagagggcaggcagaggagagtatcttgagctggggtacagtgtctgtagat

SEQ ID NO: 41488 - DNA, 201 bp, Bos taurus
gcttttgatacccttaggcttcaccttctcagcttcacaaaagcacaggaaaagcctggaggagcccaaagcactgggagaaaccaagtgtctcctgagtrctgagggcaggacatacagcacacacatgctttctccaccagcctgtggagaagtggcggctgcagtaaccagcgggaatggcatcttggagaagggccc

SEQ ID NO: 41489 - DNA, 201 bp, Bos taurus
ctttcctctggcctatcctccccacccctactcccagctcagttcctagtttctcctgggcgcccctctttcaccactgacttgcacataattctcatctygggaggagggaacttcatctgggccaacttagggaatgtgattcactcacaaggaagctcattttcctcatctggaaaaggaaggttgtatcaactacca

SEQ ID NO: 41490 - DNA, 201 bp, Bos taurus
cgtgaatggtttgaaagcattttgtagacatgaaaatcactatacttatgtaaggaattagtattgattaaaaggggccaagcgggaggattgataaaaargctcttaaaattctatagttcagatcagttcagtcgctcatcatgcctgactctttgcgaccccatgaatcacagcatgctaggcctccctgtccatcac

SEQ ID NO: 41491 - DNA, 201 bp, Bos taurus
tatgtttccttagaattcgccctcttaaaggtttatgtgtacatgaaaattggtgcgaacaaaacttctcctttgatggttatgcattattataaccaccygcagataatcatgaccggcttcagtatagtgctgtttctgatggaacacttggcaagatagttctgtagctggaatcatcttgagagacttttaaagaca

SEQ ID NO: 41492 - DNA, 201 bp, Bos taurus
tattcttacaacttgatgaatcattgacagttcctcacatgtaagtcagccagtcaggaatgaaaacactccagtaaaaagtcttttatgtgccaaccaaycaaaaatttctccattaaagtatttaaatattcataatatgattcactgaaaatccaaccgaccaatttggtctaatacaggtgcctgaaaatccaccaa

SEQ ID NO: 41493 - DNA, 201 bp, Bos taurus
atgatgtatgtagtagcactttgtgggctattgagctctataaagagaggacaggatgattattgctgttcctatgggtttattaataattactgatgaayttaaagccctaggatagagttgggaatgatatcccaaatttcaaatctagagaactcttggaaggagagaaggagagatagatgaagaattttattaaga

SEQ ID NO: 41494 - DNA, 201 bp, Bos taurus
ccactatgtctggaatctgataatattttaataaattgtagctgctcttacaccattaaccaatttggttcagaaactgtatgcaacacattttagccagyagtgtataacatgactcatctagctcaaaatggttttagatggcaacatgccattccattcttatgggggaggacaagcttcaatctacctatacacatc

SEQ ID NO: 41495 - DNA, 201 bp, Bos taurus
atctcttattttttctcatttagtatttggcctccttgatctatcggtcctaggaaacttgctatcattcagcatttttttaagcatacacgaaaatcaayaattgtcttccttcttttaaaaataggaatatatctacctaaagaaactaaagacctatatatagaaaactataaaacactggtgaaagaaatcaaagag

SEQ ID NO: 41496 - DNA, 201 bp, Bos taurus
ttgatctcacatgtctggcacctagcttgaaatgttgcccgtctcactgtgttgagtacctggtcagcaagctgggcctcagttcccttatctctaaagcrggcattacaatgccagtcattcatataggtgtttaaagtatatgtagtggtagcagttttattttaggtggggcctctccttggagtttgaaaagtaatc

SEQ ID NO: 41497 - DNA, 201 bp, Bos taurus
gtgatcccatggactgtagcctaccaggctcctccatccatggaattttccaggcaagagtactggagtgggttgccatttccttctccagcttattcagwtatctttattgaatatctattagggatctccaactgaaactatcagcagctgatccctttatccccagatataaatctcatcttaccacagtattctcca

SEQ ID NO: 41498 - DNA, 201 bp, Bos taurus
attcaccacatagtattggggtgcccaaaaagttcatttgggtttttctgcaccatcttgtggaaaacatctttattgaagttatctctgcctccttttcrcctatttctttcaaggtgatttaccctagcatatcagtcttggggaagaaaatccttcttcacagagcaagaatggaagggcagaaataattatgcttaa

SEQ ID NO: 41499 - DNA, 201 bp, Bos taurus
ccatgtccgtgagggtgttagttgaaacacaagtgcacatttattcctcagatgcttctcaaaacaagaggagcctgtggagctttgagttacaacacagyacagactaataatgcgtcccaggaggaatagagtctgctgagagccacagaacagtatacacatgctggtaagtacaaggaagatggtagagatggtgga

SEQ ID NO: 41500 - DNA, 201 bp, Bos taurus
ttaggccctactgcacaatcatataatcatcaaattgtagtaataatgagagattattagctctgggagtacagcaaaacaacattttaagttgcaaacaygctgggccactctgagcagtgatcggaaaggcagttgattcctggtgtggagacggacgcatagcaatgtggcccctgaacttcatgtacttccttggca

SEQ ID NO: 41501 - DNA, 201 bp, Bos taurus
acccactcctggcttccaagtattatgccctccacgctgtatgggttggtatccaagagcatcatgttatccaggggcctattggatatggttgccaagtktctaggaatgtgtcatcaaatcaataaagttcttagacttcacatacaatggagtgaaagataagagctatcacaagcactatcagtgatcctttagtct

SEQ ID NO: 41502 - DNA, 201 bp, Bos taurus
agatgcaaaacttacatcttaatcttcactctccattccactcccaaccaggtttcttgagctataatcaaaacaaatggtaggccaggtgggggatgagrcatttactcttagttaagcacagactgcatttttttaatataggaaaatcttaaaatggcctcaaggcagtatttgatagggatctatcctggctttggg

SEQ ID NO: 41503 - DNA, 201 bp, Bos taurus
caggggcaaatttaagggccagaggactttaattaggactctgttacttaacctccttctttctcttactatatctgagtcatctgtgtggaaattcggartgtcaagcatttggcagtaaaactccaaaagtcatgaaatgcctggagagataactgttgcattttgtttctttgtttgttttttttttttcattgctac

SEQ ID NO: 41504 - DNA, 201 bp, Bos taurus
tccctctgtccctgcccccagcactcactgctctgcagggaatggaagaggggcgaggagtacacggaggtgtctgggcctcgccaagtccagaacagagytcttgaacccagggatcatctactcccaggcaccccaccctgcctcccccagccggccccttcctccattcagctctgtctataaacagctccaccacgg

SEQ ID NO: 41505 - DNA, 201 bp, Bos taurus
ccgagacctgaggctatagggtaactccctgtgtccacaggttgatgatcaatcatgctcacttactcacccatccttttcttcactcattgattaaatayttattgagcgtttgctatgtgccaagcactggaatccctgtcttagtcgcctttcctctgagggttcaaacccagtcttcagcctgggccaaagctgctg

SEQ ID NO: 41506 - DNA, 201 bp, Bos taurus
agaccgagaagaaagaaggggccccggagcaggggggatgcagagcttagtgctcacatctgggggtctcttgtgaaaggctgagagcagagctattcagyggccccgtgtctgctgggtgttaccagtttgactgggatgccccatggggatttgggactgagtggtacaaacgtgagactagtgttaacaggcacctct

SEQ ID NO: 41507 - DNA, 201 bp, Bos taurus
ggagctctccttgctggccggccctccccggcctggacgaggagagcagaagccctctgtcagctgagcagatgtgtattgagccccaagggttgggtccygggttgtgccctaggcccagggatttacaaatgaatggggtacagtcctcacccccccaccccagtgaagccatctccagcagagggtccaggcccttaa

SEQ ID NO: 41508 - DNA, 201 bp, Bos taurus
attgattgtagtaatccaaattttctggattttccctcgatgacttgtgagggaaaaactctcccctagtcttttctcaggactttctgtgagactccaarggcctcacatgttctcaacaagaagtccgctctggtccctttacatcacactccttgttaacattctctcttcccacaagcccataggaaggcggcacca

SEQ ID NO: 41509 - DNA, 201 bp, Bos taurus
acagctaagggctcactgtgcatttgagcatcctccagaaaggggtgacgcagggaagtgtacatccttcacagtgcgcagaccaaggccaggaaggtgaygtgagttttcggagggcatcccccggtgagaaggaatcaggaacgcgttctcctcttaggccatctctgtctcataccagtcaagccactgaaagaggat

SEQ ID NO: 41510 - DNA, 201 bp, Bos taurus
tttcaccatcgacagttcccgaatggccctagacttcattatcttgctgagagtctccttccttaactcaggcaatggctggccaagaactgaatggacarctgaagaatgaatcattttcattctttaggataatttttgatcttgcctgccattatccttaggaccaaaatatgagagatgggccatattttagaaaag

SEQ ID NO: 41511 - DNA, 201 bp, Bos taurus
gaaattgtattttttttcccaagatctcctgccccagttattcacctgagaagcctaggaattgagggcaagattcttaatatttagttcctctgttctgyctgttggtctcaccgtccttctgctctgttgacctcaggaattctgctgggccactgatgacctcctccccaccactgacatctgtctctcttctcctcc

SEQ ID NO: 41512 - DNA, 201 bp, Bos taurus
ttaagcctcttttttccctgtttctttatttcccttaagcatgtgtggtttataatggaaatttttaatttattggcaaaaataacaacaaaatgagttcytcaaattcagtgtgggactggagataatctggctcctggaaaagcagctgtgagctctttgggttggcaatgcttcctactaatcactagctgactcaga

SEQ ID NO: 41513 - DNA, 201 bp, Bos taurus
aggtaacaaaaaaattaagactgggtttcaagctcttgttagctcactgtgagtttgagcaagtaatttctacttcctaggcctattcctttgtgtgttcyaatccagtgattcttttcggggaatgtgatcctgctgtccaagtaccacgtatttctgtggcctagggaccatgcaaggttctgggttacagcttttttt

SEQ ID NO: 41514 - DNA, 201 bp, Bos taurus
tttggttccattaggaccaagaaattgcaatttttggctctttactgcatggatttttccatgtgtgttttcagagacccttctgctgagatcttgactgmaactcttggtggattcaatgcctgtcttcctgtaccctctaaaatttctctgctgatgtcctttttattctccctgagtttggagccctttaaaaataca

SEQ ID NO: 41515 - DNA, 201 bp, Bos taurus
agggcctgagcagttcttaccaggggggaagagtcctaccacggacacaggagggcacaactggggctgctggcgaaggcggcaatgaccaccatcttttycttggctccatgggcccacttgcctggttttcctcacatctcccttggtcctcccaggcttctctactcttctctacttccctgggctgcttctcaaccc

SEQ ID NO: 41516 - DNA, 201 bp, Bos taurus
atggctgtgagcatctggctattatagggagttgggaggtcatccatcttgtagccctgaaaacaacagcaagaagataaacagagcactgagagggacayggccgtccactcagacccagaacacagacaactcccaggaaactgcagtggacagaagcctggacaaagacaaatcctgccccccaccccctggcctcag

SEQ ID NO: 41517 - DNA, 201 bp, Bos taurus
gtcagctcactacctctggtgaatcatccttccctactcaaggaaggactctgagaacggagggcacctgtgcacctaagccggcccacagcccccatgcwgggcaggtggggtggggttagggtggggggtcaccaagccctgcagtccctgtgcaggcccagcagctcagcttatcaggaagtcctgcaggtgtgaatg

SEQ ID NO: 41518 - DNA, 201 bp, Bos taurus
atagactatgttccaataacagagtctaccctttgataaacgttttagggcagatagggagaaaagtataacaagaagaaatttgggaattccacaaagayggccaaacccagaaatcctgagatgggaggaggaacctaaattactcggctaggatgcagattttgttcaagaaaggcaacacatgccaagaggggttaa

SEQ ID NO: 41519 - DNA, 201 bp, Bos taurus
tttcccagtttaaaatggcccgctgcgcaggtgcttgtctttgattagagcattctctttcttgctatctgccattgcttcccaggtggagctgtatatgycccattcatatgaggtggcccatgctgtactgtgagatgcctgtttttaaaagtcatcacttcatagctggaataatttcttactcatggataattttta

SEQ ID NO: 41520 - DNA, 201 bp, Bos taurus
tttcccttcacttgaacacttagagtattgttattattattaattggcctaatttcaattttgttctgtctcaggaaatagggaggcccaaggagaggaaragagaagtggagacagtcagtcagtggagcagtcacataacacacacatttagcagttaagttcaatatctttataggcaaggttcaatactttggccac

SEQ ID NO: 41521 - DNA, 201 bp, Bos taurus
ccaaaacccaatacataggccagccccatagaatgtacaatgccaacagtgaacataccactctggtgggggatgctgataagggtgcaggctatgcatgygaggccaggaggtgcatggggaaatctccacatcttactttcagtttggctgtgaacattaaactgctctaaaattttttaataaaaaatagccatcgta

SEQ ID NO: 41522 - DNA, 201 bp, Bos taurus
caacaaacaattaaataacttgaggaaactaaaatcatttttaatttttttatctagaggttaaaattacacatatagagaggtgctgagaaatatgctgkaaagtttaaatgttttcattatgttttgatttatttaatgtgtttaaagtgcaaatacaacattcttaggagatacacaactaaaaaaggtgaaaatatc

SEQ ID NO: 41523 - DNA, 201 bp, Bos taurus
aaacatgtatccactgatttcaacattaatgagtttttattccaagaagattacagttttcaccaggtaattcagtcccttgggcagacaatattattaaytatgttttacaaagcatccttgtccctagactagaaactatgaaaaataaatatatgatcattaaaaaggattagtaatttcatcagtactaatgttagt

SEQ ID NO: 41524 - DNA, 201 bp, Bos taurus
acaataattctcaagttaagtatcattgaatcagaccagtgcataactttggatctggaatatattaaatgtcaagtcagagttcgagtaatctgcatacmttttgtcaaagattaaaagcaattttggaataactgggaacaaaagtataacaaggacttgacctagaaatgtgaaatcgtcttcacctcctagggcgtg

SEQ ID NO: 41525 - DNA, 201 bp, Bos taurus
ggaggcctggcgtgctgcagtccatgtggtcataaagagttagacatgactgagtgactgaatgaactgaattcagaaaaacgtgtaatgatgaactggtrgaatggccttctaaaatttctgttaaataccaactggaagaaaatgctacacaagataggagcatagtccaagagggcatggtatgcaccttatatgtgc

SEQ ID NO: 41526 - DNA, 201 bp, Bos taurus
aaaccttttgagtctttaccagagattggaagtgaggagtcccagtagtatgaaatctatttttttctagattctaccagataaacattaaaaaaaaactmatacttctgctaattaaatatattttattcccatatttgttaagctttctgtcatctatttttgtactttgacttaggacttattcatcattcaactcaa

SEQ ID NO: 41527 - DNA, 201 bp, Bos taurus
atattcctggcatggcctttactacttttcatgtgtgtagttttactgtctgcttgcaattttttcttttgtgaacttttagtattttggtgtagctgggrcagcagaatccttggggcccatctttagcgctttatgcttctgcttgatcccaagccacaagagatttagatttaagaagttccatttggctgctcacag

SEQ ID NO: 41528 - DNA, 201 bp, Bos taurus
cttcactaaagtaaacaaagagattatcttctttatagtcccacattctctctgcagaggtgtctagggtgttttgactctgtcctcaattatctataagyggccacagtcctgccttcctagttggcttttgtgaagcttgggcttgtttcctaaaatgtaaaattttactattaaagtcaaatatctcaaagacatttg

SEQ ID NO: 41529 - DNA, 201 bp, Bos taurus
ttttacttgattatttatcttttgatttctccccttgaatcaagttctagatgggtgaaaacctacgtctgtctttccttttgtagccagtcttccttatrcatagcagaagctcacaaacggtaatttaataggaataaaaggagtgtatctttgaaccggtatttcacaatacatacttacggtttatagaagtataaa

SEQ ID NO: 41530 - DNA, 201 bp, Bos taurus
cttatttgaaacttcaaagtccttgatgtgaggagtgctaggatccatttattcctgtatctgtgacctctagaggagtcatatggcaacatgaagttagraaaaatcctttgcccaataaagcaagacgttatttgactatatagtatatccctcaccacaccgtgagaattaagtattgtctgaaaatgaagagggact

SEQ ID NO: 41531 - DNA, 201 bp, Bos taurus
gcaaaattatttagagagaagtcttaaaaagtgaatttacattaatactaatttttatttggtttggttctatgcttattccataactttctgatcatccrgtggtttttttccagattaatacaatttttttaactcattttatttttaagataatatgagatttaagaattagtgttatagtcttttatctattactaa

SEQ ID NO: 41532 - DNA, 201 bp, Bos taurus
tgaggccctctgatggagacttggggctcctgcctgcagccctatgtgccatcttgaagtatgttccccaggcttacttaatctttcagatgactcaaccrtggccaacatcttgactgcaaaacgatgggaacccctcacaagagccaccctccaaggccactctcaaatttctgatccacaaaatatgagaggttttgt

SEQ ID NO: 41533 - DNA, 201 bp, Bos taurus
ttttctgagataacagataggattagatgcgccagagacttttggagaaactatatttgagaacaaatggaaaagggacaaggaaacagaaagaggcctcrgatctggggatggaggagaggggggtggagagagactaggaggaaggctccaagctgctgcacaggataagaaatcttctgccaagacaatgcaggccag

SEQ ID NO: 41534 - DNA, 201 bp, Bos taurus
gagggggattgttattagtttagttcttagtaagctacatgttcaagcacatctgaatttattcttatttatttcatttgccatttagaagtgacaccgcmatgtactcaaagatctgttgaaatgtgtcactggcaaagaacaaggaaataaaaataagttacaaggtcattaacagttctttcttcaccgtggatccta

SEQ ID NO: 41535 - DNA, 201 bp, Bos taurus
tcagatggaaacttgggtgcgaacctcccttgtctctcacagcctgtcactgcccctagcatccgccactccctccctgctctggagcctcaccagagggygggtagggcctttgtggacttgcagagtaattcagggaatgagctgtggggaagcagccaccatcagccaccttgggttgcttctgaggtgctgcttgtg

SEQ ID NO: 41536 - DNA, 201 bp, Bos taurus
tttggtttctactgagcaaggtgagtgataaaatctttaaacagtaagaagctctgttgtctgatagacagggactatgaagaagattatttatctttttmcaaggccttttgtttaaatgaataatactctgagaccttaacagataattttatagttagattggatcctcgtatcaagaaacttttccaggtctgaagt

SEQ ID NO: 41537 - DNA, 201 bp, Bos taurus
tgcaaagagtcggacacaactgagctactgatctgaactgaactgaatgcatggtacaagactatgctattgtgtgacactggcaagttttgaattttatktatacttctctttggctctgtcatcttagtgaagtttgaagttttcccaatcttagtttccttgtatgtaaaataggagaataaatgcacatgccttcta

SEQ ID NO: 41538 - DNA, 201 bp, Bos taurus
tggttattgcaaaatgaaatatttcttgccatattggtgggcaagaaatgtcacagccatcagcgatttctagcctccaaatgtgggagcctctagctccsaagagtgaacacaatgcctgcctaccatccagcagaggccccccatccccacaccccacccacagggattgctgagcagctggggggtggtgggtgaaaa

SEQ ID NO: 41539 - DNA, 201 bp, Bos taurus
gataaaatgtaacatacacacctccattcttgtgtgcatacatagacacacaataagaattacacaagaattataaagtcaaaagagagcaacagaattakctaacctccagaagactctatcaccaataccaagaaaaggaaatattaaaaatttttatctttcaacaataacattctaccttcattcttccagactatt

SEQ ID NO: 41540 - DNA, 201 bp, Bos taurus
gacgatcccattaacagaaaaggaaaatgaggtacagagatactgataagttagctccacagccagtaagtgataatcaaatctaattgatttcaaagtcyaagggtgcaccctttttttttcccttgtgaaccacctaccattctaggaatgcagatttcaatcaaatataaagcaagattttccaaaaattagttatac

SEQ ID NO: 41541 - DNA, 201 bp, Bos taurus
aaatatttatatagtaagttctgtcatacgagctagacataatttttagaaaaaaattattatgtgtgtgccatatagtcacaaccataggtgtcctaggrtggggagggggggaagacaagaagtcatagcaatgaatttccatttctcagcttcccctcatgcttgttcctcaatcattcctgtttttaaagacaaact

SEQ ID NO: 41542 - DNA, 201 bp, Bos taurus
taatcttctttaatcctggggaaatgtggactaaactgtactgcccctgcagcaactgctaatatttcatcacaagatcgaatgtttgcattaacactaayatggcctttaagcttcctatcccattgagtctcaaggaaatagaatcagggaaatgaccaagaaagtaagaatcaaaaagagaagttggtgctgcctagc

SEQ ID NO: 41543 - DNA, 201 bp, Bos taurus
aattatatttaattaaataaaattaatttatatttaattaaatcaaattaaactatatgactttctgaaaaaggcaaaattatgaagacagtaaaaacatyaatggttgccattggttatgggggtaagggtggatttgtggaggaggggtgaatagttgaagcacagaggatttttaggacagtgaaaatatgatatcgt

SEQ ID NO: 41544 - DNA, 201 bp, Bos taurus
aaatagaaaagtactcattgcttatcctctaagtccaccctcttgaacaagttggaaaattagccagcaagccagcatctgactgtggccttacctgtttmtgggtagccctctaagatttttcctttttttgcatttttaaaagattataaagaagaagacaattatgtgtaagagactatttgtggcccacaaaaccta

SEQ ID NO: 41545 - DNA, 201 bp, Bos taurus
ggtataatatttattagtaattatattaataattaaaatcattaatgttaagtgtgcaattaaataactttatgacataaatagttatgtaacaatcaccrcattcacaaactggaacatttgccaaaactattccacacatttgaagtcaattcctttatctaatccactagcctctggcaattactgatattctctcac

SEQ ID NO: 41546 - DNA, 201 bp, Bos taurus
tcaatttctcatttctaaattgggaaagagagcactgttgagatggaggcccttttcagcaaaaccatgattgtttctgtttgtctgttagtagcgttgaygcttgccaggtgcaggacttaaggccccaccatcagtgagcttcactaatttcttttgtaaaattgggatgataattctttataggatttttgtgaggat

SEQ ID NO: 41547 - DNA, 201 bp, Bos taurus
ataagggttctcctgtccactgcctttcaagccagtagaatgagattgagtttggttcaaagaatggagaggtgtgaactgatgcgctagagcacatactmtcttgataggccattgtcagagttgcttttaagggttcttatcatcagggagtgggtagagtttacctggggcagacatatgctcaaatcccagagcccc

SEQ ID NO: 41548 - DNA, 201 bp, Bos taurus
ctcacaagagtagagtcaaatttagtaacatattatcagagggtcattgattatttgcaaattcaataggatttagatgacagagcagttgagggcaataycttcaaatattttggctatagctcagctggtaaagaacctgcctgccaatgcaagagatacatgagatgtgggtttgatccctgggttgggaagattccc

SEQ ID NO: 41549 - DNA, 201 bp, Bos taurus
agaaatgctgggaaggtaatggcctcagtggatagccttaggtgctatcagattaattgtcaagaacctgccaccttgacatcctgcccctggtctagctrgagggcctaactacacagtccttgagtcccttagataaagcaatcccccaatctcttgattcagatggaacatagcaactctttgtccaggtttcactca

SEQ ID NO: 41550 - DNA, 201 bp, Bos taurus
acatcccattcccaaggtcgtcacagagcaccaaactgagctcgagctccctgcgtcgcatggcagctccccactagctagttattttatatgtcatagcrtgtatatgtcaatgcttctctctcaatgtatcccaccttcttcttgccctgctgtatccacaagtccattctttacatctgtgactctattcctacctta

SEQ ID NO: 41551 - DNA, 201 bp, Bos taurus
tgtgagcgggcctccagtcactaaccacgtcttcctgtgatcctgcacaggtcatatctgccaagactgtcacagacagagactagctcccctgaggagaygcatggcccccctggaactgtgcccttgtggcacatccaggagcctgagcagcttagacctgggacgtgcacaccgccgtgggtgtggcaaccccatgag

SEQ ID NO: 41552 - DNA, 201 bp, Bos taurus
gcgtgtccgaacacattcttgacatgcagttcaagcccgatgccgtgcccaggaatcatagtcacggagtgccatccgccatacatggctgctgggagagygctgtgtttaaaagagaagctcctcagtgaggtctcattgccaaggaaaatctcccaagaatggcctagaatagctggtgggaacatggccttcacagag

SEQ ID NO: 41553 - DNA, 201 bp, Bos taurus
aaaaaaagttatagtgaccttgctgggatatgctgaacaggtcttataagtcatatttcacagatgaaattggactttggagcatctatacatatatagakagtaagttgtatgtcaaagactcgaaccccaatatcctcgttctttctccttcattctttccaaaccccagagtattatgaagctattcaaatatctaca

SEQ ID NO: 41554 - DNA, 201 bp, Bos taurus
ccttgctctttgggtaacacacaaattttctagcaggacaagaggtgtctggggaaactgctaaaaccattaggaataactgggatcttgttgttaggtcytgggaccttagcctattctgggtgttgatcacagagcagatggtctcgtgggaaaactggacccaggatgtggctcaggtaggagggatatggatactct

SEQ ID NO: 41555 - DNA, 201 bp, Bos taurus
ccactgactccccagtgatgtcctgtatatactcctgactcaggatctaccctggtagaagaatcactctgtctcctcaacttccagaaacttaactttcrtaaatttacattatattgtcattattctgtattatctactccctttctgcaatggcttttttttcccaaacagagaagttatcttaggaacatttccatg

SEQ ID NO: 41556 - DNA, 201 bp, Bos taurus
gccccaggctggctggtggccttgtcagtaaccttggtcaccaatcagaaatcaacaaggagcacagcctcatgccctccccaaggccaggagagggatgycggaattgaaaggtcatctttcaataacaaaggggcacacaagggttcacaggctttccccccagataatcaaaatgtctaagtctccaaacccatcatt

SEQ ID NO: 41557 - DNA, 201 bp, Bos taurus
acactttgcctgagtcagaactaggtactttcttactctccatttggaaccttaactgaatttagccaaaacatgggaaaggtttctgggaaaataaaaamtgttggctgtaagccaaagccctctaagttcttatttcagactgcccttatttatcttatatgtatattactttttatatattctaactgcccagtattt

SEQ ID NO: 41558 - DNA, 201 bp, Bos taurus
tttagctttggattttaagtgtattggtaagttatttgggagttttaagtgtaagagtaatagtaatctggctgttgtatgtaggatggactgcagaggtmctaaagtagaaaatggattaccagttagatagcgatcacaatccaagcaagaaatgatggtagagtagggatgtggctatgaaaatgctgagaagtgacc

SEQ ID NO: 41559 - DNA, 201 bp, Bos taurus
agggccccacccggctcaggtgatcctgaccaagctgccagaatccaccatccaggcccatgtggaaccagattacatggagggcaccagaggcctcacamtcttgtccacgtgtctgggagaagacagaccgctccgtgtcgctgatgggtgtcacgtgggggcttggtgggggctgggaagcatgcccagcgggtgaaa

SEQ ID NO: 41560 - DNA, 201 bp, Bos taurus
ttgtactctatcccaaataacaatagaaataattctatataggtatctcctgcttttcaaaagttcactttacaccatgtcccttttaaaaaagacctacrttactatgttttccctaacagaaataaatttgaagaggatttttgcttttacaaaaaacggtgaaaagcaaaagtagcattcagtgtttgttctggagag

SEQ ID NO: 41561 - DNA, 201 bp, Bos taurus
tcccaacccagggatcgaacccaggcctcccacattgcaggcagacactttaacctctgagccaccaaggaagccctggtcctgccagaacactgatcaayaggcctgatgtggtggaaagcgtgaactttgaaatcagacagaagatttgaatcttggccacttaaatagcttatgtgaccttgggcaagtccaggtaga

SEQ ID NO: 41562 - DNA, 201 bp, Bos taurus
taactacataatactaaatttggacctgtttttcaaggtcccagaccaatttctgcatctttcattatgcccttcctgactccttcaaccctcactcaagyctcctgcttccaaaatcctaatacaatattcagtactgaattatacactgtttgcagtcctttagagtttctcctttcatcctccataatacctttccag

SEQ ID NO: 41563 - DNA, 201 bp, Bos taurus
ggctgcccctaattgccgcctggaatggcaggaactgggagaggccttgccgtccacacattctgattccccacgcactaaagggaggccgtgtggttccygggctaggggtagtcaggaaacactgagctagttcattacatagatgggaaaactatggccttgagaataggtggccctcatccgagggagacaccagga

SEQ ID NO: 41564 - DNA, 201 bp, Bos taurus
gaggcccacccacagggcagctgggggccaacagtactccccatgttcttcttatctttacagaaaatgggcacccagaacacaacagcccgcgagacacmgagccaaactgcagcaaaggccttggagagggcaaagagccagctgcgtggggagaaggggcagaggggagacaaaggtgagggccaagccgcgtggtgg

SEQ ID NO: 41565 - DNA, 201 bp, Bos taurus
gagctgaccaccaccccagatgttctctaagacccctctaagcaggaacacttatgcaagtctacacccctagatctcctgctgaaatccctctgcaagaraaaattcattcgccttgtggatttgagctccctctgtgtcctgctggggacagcccctgaatggactgtagactttctaggtgtcaggtgttatcctcaa

SEQ ID NO: 41566 - DNA, 201 bp, Bos taurus
ttagaactttacggcccttctaaaatattatcacttggttgtggacttgcaagcctaagtccaactgtggaagcccagacagggaagggacaggagagaaygcagaggaccggggccatctgcggaaggctcagcaggggcatcataactagatgccctgaccctgaaacagccttctgcttgctcaagagaacctgtctg

SEQ ID NO: 41567 - DNA, 201 bp, Bos taurus
gtaatgcctgaaatgccagctgctaatatcaactcttcccaatttaataaaccttggcatcacaaagttggcaattagatttcctgtaaaaggctaaatgyggcggccttctgcttcctggattctatatttcagtaagaaaggcattagtgtgtggcagctgggataatcatttaattgatcttttccatctatggaagt

SEQ ID NO: 41568 - DNA, 201 bp, Bos taurus
taaagacttaggaggagacagatggagaaagaaacagacgcaaagatgaaggcaaagaagaaggaggtgattttgcgacagagcctatgtggcccacaaarcctaaaacagtttctgtctggtgctttacagaagtttcagttcagttcagttcagtttagttgctcagtcgtgtccgactctttgtgaccccatgaactg

SEQ ID NO: 41569 - DNA, 201 bp, Bos taurus
ggcaatagcagccacagcttcccaggccctgttggggaactcgggctcctgggctgcccctgggggaactggtctggatcagggtaggggtgtggcctgcycgtggtgaatttgtctggatcagggcgccggtgcctctcgattctctgctatctggacaccaggactgaagtatcatcactcctactatctagagatagg

SEQ ID NO: 41570 - DNA, 201 bp, Bos taurus
catcatggagggagaaagagcaaaggctaggagtggccaaggccaagcctgagttgaacttctcacccctgctcggtgaggcctctcaaaggtatcccccrctcccggttctgctgttcagattccaggtgaccctggaaaagccatggatccctttcaggcctccgttttctcagctgcaaaataagggcctctcattct

SEQ ID NO: 41571 - DNA, 201 bp, Bos taurus
tctgtaaccaaggagcatccctgatttatttcttcacagagtccttcgtggagtatcaggttgtgatggcaaaaattcccagagaagaatgatgaggaagkaagtcattcaaggcctgggaaagctgagttcctttggagcctgccagcagcacctctccatcccagtaacctcccttgggagccatcggagcccttcttt

SEQ ID NO: 41572 - DNA, 201 bp, Bos taurus
ttaattcagagggtaaggctgatttcaagtgaggcgctggtgaggcccatggaaagaggggaacttgcaggcagtaaaggagacagatatgggtgcaattrgcttgcccagttcaggcctccctcctctttccccagatcacccctgaactcctccccacttgactcccctctactccattaaaccctcaagctagagtta

SEQ ID NO: 41573 - DNA, 201 bp, Bos taurus
gtatgttaatgacattaaatgctgagaagaaacacaaaggaaggaagggggttagggaatgttgcagatagtggttatgatggggagggcctgccaacatygccatgacatttgtgtccagaccttacaaaagtggagggagtaagccatgtgaatacatgagaaaagagttttccagatagagcaaatagtaagtacaaa

SEQ ID NO: 41574 - DNA, 201 bp, Bos taurus
acctcagaatagtagttttaagtaactttaaagcttgagctccttttgaatttcccaaagagtttctgcagtttctttcaaatgggcctcatcttcagggktcagctttacctttacgaggtctgtagtgccattctctccaggacgcatggaacactaggtatagtcttcatttattcagtagtggccctgaaagtaaag

SEQ ID NO: 41575 - DNA, 201 bp, Bos taurus
gggcctggagaattccatggactgtatagtccatgggtttgcaaagagtcagacaggactgagtgactttcactttctcttgatagagcgttatttctctygtataatcagttgaaacctttttactgttaactgccacagaattgaggtacctgctgtagaagaggaggactttggcagtcatgtaccactctttcacaa

SEQ ID NO: 41576 - DNA, 201 bp, Bos taurus
acttctgtcctgggccagaagtttcctccccggtgcatgaagtcaagaggacgtagagtgactgcaggccaccctcatgactgagagaggcccatccactrgggagaaagaagactgtgctttagggacatgagacgcatgtgatctcttgctaggagaggtgcgagggtggccaggccaggtgggtcagcagtggctcag

SEQ ID NO: 41577 - DNA, 201 bp, Bos taurus
ttggctgaatcacctgcccggctctgtagccagggtacaggatgcaatgggatagagactgaaaattctcaaaagtataggggagataaaagcctgttgtyaggagagaagtggtaggaaacatgctgataagtcaaaagaacttttagctataacttgaagtgtgtgtcttttagtacttgatatctgttcaaatgtcta

SEQ ID NO: 41578 - DNA, 201 bp, Bos taurus
ccaagtactttacattctttgtcatgtgttaggctttattgtcttgaatttacagagaaggctgagattcctgttaaagaactgttacattttgagtgttracagtgctgagtttcaaactaagactgttgaaatcagagccttaggtatttttttctttttccattgaagtggaactgtttctctggttacagtttttct

SEQ ID NO: 41579 - DNA, 201 bp, Bos taurus
tgtaatttcaagcagttagttttacttcagtctcttgatggtatatacaatgacaccaatatgtcttaagtaaagcaatattttgggccatgagttaactrtcctatgctacatgaatttttgcttcactccaaaactatcttcagtttttttcagacattctaaaatgacagatttctagatcatttttctgaaactgtc

SEQ ID NO: 41580 - DNA, 201 bp, Bos taurus
aggaaagcaaactaaagtaaaacaagttaattaaactggaatgagaaagagaatgagagaatggaggtcaattataaatctgtgtattagacagtggtaakttgaaggccaggaaccagttccaggaaactattcactgaaatattaaagtcactgaaaaagagtaagcagtatacattctccttaaagatggaaaaagct

SEQ ID NO: 41581 - DNA, 201 bp, Bos taurus
aggttctgaagtttggttccattgattttaagagaatgcagccaacatgtattatctgatttgacttcaaaatcttttagaaatatagatcacaatttctktttatgcctttcagtccacccaagcagcagagaaaaacaaacattcttcattattattattttcatcacttggtaagtcacagaagacttagtgtaatat

SEQ ID NO: 41582 - DNA, 201 bp, Bos taurus
atcttttagaaatatagatcataatttctgtttatgactttcagtccactcaagcagcagagaaaaataagcattcttattattatttttgccacttggtrgtcacagatttaatgtgagggtgatgctataatgtactcagttataaatgtggcagaagtttattcagtctcttccccagggaaacactctatgtataat

SEQ ID NO: 41583 - DNA, 201 bp, Bos taurus
ggacatctttgttcctcaaactgtagatgaaaggattcaccattggccccacaatggtgtaaaaaactgtggacactttctcttcatccagagactcagcrggaaaaggcttgagatacatgaatgcagatgatccaaagaaaagagaaaccacgattatgtgggagctgcaggtactgaaggctttggacctgccctctg

SEQ ID NO: 41584 - DNA, 201 bp, Bos taurus
agagaaggagtcatatccttgaggaggccagactgaatggcatctacaaccaaattgtggggtcaagtgtcttggggtgttttttctcccactccaggccyggctcttccttttctgtggtctcactagtcactgattgaactgggaaactattgtgtgtgcaagtgaaacatggtgagaaacaacactaaggaaccacca

SEQ ID NO: 41585 - DNA, 201 bp, Bos taurus
acagctgaattgcgctaagaagtttaaaacccagggaaaaactaaaaataaatccaaacgtcaaactaattaaatcaaaagttttaagatgggcctcgccygcagcagtattttttaaagttcttcaggtggtcctgaagggcagccaaggttgaggaacacggttgcaggcagctaaaactccaggtcctgggcctcatt

SEQ ID NO: 41586 - DNA, 201 bp, Bos taurus
aatctgaatgcatattttggccaactcaatattagcatttaatcctttttcttttgaattagcatttctctgtcataggaggatctgtaaaacagtgcccrtggccttttgtcttaagctggggaggcatatttatagagccagttctacttatccttccttgggggctgcccgagtgcatcactagagagtaagaacatt

SEQ ID NO: 41587 - DNA, 201 bp, Bos taurus
ttgtatcaaaaataaaacttccagtaacatcctgaaggtaaaatgaagccaataatgtaaaagctattaatacgtattccattctatagtgtagaagcacygccatattggccaccaggatcatgtgaccgtggtgttggcttctaggagttgtgtgatatacttgttcaagacttcatggttcaatcaggacttgtggaa

SEQ ID NO: 41588 - DNA, 201 bp, Bos taurus
ttttctctctggctgagacccctctccacaagaaagatcgggggccttcatttcctatcaaaggagagtcaccctgcagagcatcccctccagccactgtrtatcctttgttgaggattcagggcctggacgagagctggcctccctcctccacctgtgtgtctggcccagaactgcccctgctttccgtgaaacagcagc

SEQ ID NO: 41589 - DNA, 201 bp, Bos taurus
ctgtaggagttgatggccagaatcagcccagacctgcctcaggaggaaaggaattgagagcctgggatatagacatgggattcggtcaagtgtgattccargaatatgtcgaacaggccaaatttatacaaatccgtttagaaatattccttcgaagtcttcccagaggttgacctgctgtcccttagaacgaacgtcttt

SEQ ID NO: 41590 - DNA, 201 bp, Bos taurus
acgaggctgcatggggtctataagttcaactatgtggtgggcttgtgcctttgtggggaacagaagcaggcacaggagagtgacatggcctctgaaatgcrttggggtacagtcatcacacctcatttagatagtgattgacatgatccgagtgcgatccggactggcagcatcgcatcccctgggagctgtttggagaca

SEQ ID NO: 41591 - DNA, 201 bp, Bos taurus
ctatttctctttcctccccctacccttcagcgctggcctttctgcttcgctcatgaatattcagaagctcaagatgcgaacttgcagtaactcccagtgtrggtttctcactgggagggccgggcactgtagcttcaccatgaaagcgtaggcgggtggccgaatggatgggcggggtgcgcaggcggatgcccgcagtca

SEQ ID NO: 41592 - DNA, 201 bp, Bos taurus
gtaaacggtgccgattcagtcatgacttctgtttctcagccttctgctttctcttctgtgctcattccctgctttccttcatacactcctgccttttcttrtatgctgtgtttctccatttaattattcttttctctgttttcagtctttcctgtttgctttgcctctcttcctccaaccctctttttttctatgtgtttc

SEQ ID NO: 41593 - DNA, 201 bp, Bos taurus
atgtcatacttgagacattttgaaggacataccgttcctacagctaaagaacatgtcattaaatgagttcacgatagcagattcctattatctctagccamagtaccatatgttcactgatgggtcagtgaactgtcagagactgacagtgcctgaaccagtcatagttttcagtggtttacccatggtgaacctcacctg

SEQ ID NO: 41594 - DNA, 201 bp, Bos taurus
cgaagggccggcgtcccaggcctgggggcaggggcttgggagaccatggctggtgacatcgagccggagagcaggggccggcggctggggggcttggaccygggggtcctctacgccttccgcgtcctggctctgaatcatcgtacggctggccatccctctgaggtgaagacaccaggtgcctgggcttgcgtcgtggag

SEQ ID NO: 41595 - DNA, 201 bp, Bos taurus
tgagagccgcttgtctccagcctggccctctctaacaagctctttttactcggggcttctctgagtagagacctcaaacaatagcagctttcaaggggctyggcccctcctccggcggcttccctctcccgcccctcggccctgctccgccctgctccctggcctctctgccttgtccacctgaacgtcccacccagtccg

SEQ ID NO: 41596 - DNA, 201 bp, Bos taurus
agcccggggccaagaccagctcactccccaccggtcctgcgagatcatgctgtgatgtttaggacggagagtaggcacagtgcagcctgtgtctagctagyggtcaggccagatgggctggagtgggtatctgatctattaccactgcctcttcccctctctcttggcctgctctgtgacagtgaagttcccaacaattag

SEQ ID NO: 41597 - DNA, 201 bp, Bos taurus
tctttcgtgtgccctctgggttgggcacttcctagaggagtctgcctctaggtcttgttgccatcgcaaccagagctctccattgcctgggaaagccgaakgaaagccaggccaggaaccctgggttcccaaagcatcttctgagttcttggggtctccccttgtctcagcaggaacaaaagaacagaatggatctattgg

SEQ ID NO: 41598 - DNA, 201 bp, Bos taurus
caaaaacataatgctaactcgagaagccagacacaaaggccacttattttaagagtctatttgtatgaaatatccacacaaggcaaattcacggagacacraggctgatcagtggttgcctgggcctggagatgggtgcagagactgacaacagatcttttctaggaaatgacttaatagtgggttatggccatggttgta

SEQ ID NO: 41599 - DNA, 201 bp, Bos taurus
ccacgggctggttctaaccccctgttcttgtccaaggcgccttagggaaggtccactgtttccaggaagctccatggaagcccttgaccctgagggtcttraatgtgggtctgagaatgaggctgtgaccaggtattaggactaactcgctcacagcgcttggcaggcttagcaacctgtcagacacaagctcaccgcacc

SEQ ID NO: 41600 - DNA, 201 bp, Bos taurus
caggcttaggggggacccgccttgctaggaggccagcagggggtaggactctggtgcctgagccccagggagcgatgggatcacagggctgagatgggtcmgtggcctcctttcgcaggaaaggaaaccaaggccatcaactcccctgatcacattttggtgtcagatcatgtcagtctgtgatggtcggggatgcactct

SEQ ID NO: 41601 - DNA, 201 bp, Bos taurus
gtccatacggacgcagagtcagacacgatgcagtgactgaacagcaacaacctattaggttataggccaggagtctgcagagggcccacattcaccccagmggtaactccttggtctttcctggctttaaaaagacagctcaaccttccagatattaatcaggatggaagaacatgttgagagacatctctagctcactgg

SEQ ID NO: 41602 - DNA, 201 bp, Bos taurus
ggaaggaaaatgaaataattgcattcggactcgcttgaaacaattcatctgtgtgtccacgaagatcctgagggcctgtggacactgcaaagtaacacgcrggtttgttctgtggtttctgcctccctgtgtgcctggcaggaacggggaaagggagtatctcggagcaggtggatttctactccccattgtgcaaagctg

SEQ ID NO: 41603 - DNA, 201 bp, Bos taurus
gctcccttggggccatgagagccgcgtgggcaggtggctccagcaaacaggccagggacacaccagcagctatagagcggcccagggcctctcctccgcckggaaggtgggctggcaaaggtcttggcagcccattctctttatctgatcccactactttccatctaccattcttttataaagcacaacttttcaggaatt

SEQ ID NO: 41604 - DNA, 201 bp, Bos taurus
cctggagggtgggcacccgtgatctaagggacaccactgcaatgtgtggccctattctatactttcccagccctctgtgaattcagagtttttgattttayatcaacctgtcaatcaatctggcctcaaccaatcaactgatacattcttctgcacacctccagctatgaccctgaaccttttttctctctgcccttcaga

SEQ ID NO: 41605 - DNA, 201 bp, Bos taurus
ggtgggtgggcacccttcctgagatggatacaggccagccgggagatctagacaacctgttcctccctgagcagttacactcacaacatcacatgctgtaygttggccagttagtctgcaagatagcagaggccctggacttcaattgcccaggaggcctgtttgtggactgtgtggggagaaattttaaacatggtttca

SEQ ID NO: 41606 - DNA, 201 bp, Bos taurus
gcagacaagatcactgcttctctgtgcctttatatctgcaagacaaaggtattttgcatgcctctcaagttatctagcctacactaggtattaaaataaayaaacttcctcaagcaattctacatgactcttctttgcacatttgaaaagcttcctgcatgtgtagcaccagaggagagtctcgctgaaaatccccagaga

SEQ ID NO: 41607 - DNA, 201 bp, Bos taurus
aagtggggatatgaagctcttgactgtcttttgactggtttcactggtgtcattgggtattgtctttttctctggagtcattaagtaaaccttggctctcygaacacactattcacaggtaatgtgactggtgaggtcaaactaatctaaccccacggaaactgctttgtagctccccgctgtttcagaatgaactttggt

SEQ ID NO: 41608 - DNA, 201 bp, Bos taurus
tcttattttctgtttcctaagttgacttgagttacccttatgaagttatgagaatttatttaattagatttgtgtatgactcttatcaagaaacatatatyaatattttttccttttggatatcaagagtgcacagaatttcaggaaattaagagtacacattggtgattttaagcacagatacaaaaagattggtattga

SEQ ID NO: 41609 - DNA, 201 bp, Bos taurus
acaactgttcacaaaaccatgtcttcctgcctctattgtatactacttggctctgaaatacatttgggggcaagtgaaccacaacagttcctccagtaagrgagtgagcaaggtgagtgtgatcttatgtaacagtcacatcggaagcagctgggggaaacaagagcttggtataacccagaccagccacaggaaagatct

SEQ ID NO: 41610 - DNA, 201 bp, Bos taurus
ctgcagctcccgacaggcagtgggccagtctggggactagtgacagggtgagtaatgctcgaggtcagagggcagctgctcctgggatcgagtctccttayatgaggaggccgcctcgctgtgatcacccagtggaataagttcccagagctgatggcaagataaagcacattaacaaaacgtgccctctttgattttatg

SEQ ID NO: 41611 - DNA, 201 bp, Bos taurus
ccaaagagcacaggccaaggccaaagcctaagtggttgccatggaaatgggttaattacccaatcagacttttttctgagaatgttactataaatatcctyggccttttccactggccttgaagttgagatgtaagatctagagcctccgtatctacaagagccttgtataaactgtgcatggtatgtaggcaacagaagc

SEQ ID NO: 41612 - DNA, 201 bp, Bos taurus
ctgtaaccatgtcccttatgacatttggtgtgtcaggatgagaaaaatctcttaccaagaaaattctaaaactaaaatttgctttatttctctctaacttkgtgtttaaggaagttatgaggacctttgaaggactgtagaatttggaatgaaaagaaacaataatcctaaaaaaatctttgaacacatttatatgcctcc

SEQ ID NO: 41613 - DNA, 201 bp, Bos taurus
aaaaccagaggagcaaagaccttatatccttcggtgaaaataaaggactaggctgcagggcccacatgcccttgctgtggcctcccaagtgtggctttctragccatggttgagcaggacatgctctgagttacactttcagagccaccacctcctcctcgctccatgtggcagcccctggccctcctgtcacctgtccca

SEQ ID NO: 41614 - DNA, 201 bp, Bos taurus
aaaaacttaaaaaagaaaagagctgcttcgtgtctagcacaacaggtataaatatttctccaccaaccaggccccatttctctgaaatttcagaacaccayggacaaagggagggtctcgcttgttttcagaaaggaaagagaggacgggtgaaaggtccaggcgtgaatcctgctgtggacacctcaacaagacgatgga

SEQ ID NO: 41615 - DNA, 201 bp, Bos taurus
gaagcagcggcccaaggagcctccgtgaagaacagagtaagtcatctcacgcagaagaaagaccacaggcatagaagcgggggaacccaaaggacaaccargcagagaataaggaaacatattattgatgctgagcagagatgagaaatgggaaaaacaggttacaaacataaatgttctggtattttatggagcatctta

SEQ ID NO: 41616 - DNA, 201 bp, Bos taurus
gtggtttcttacaaacctaagcatgatctcaccacacaacacagcaagtgcactccatggtatttacctgaaggagctggaaacatttccacacaaaaatrcgcatgtggatatatacagcaatattattcataaatgccccaaactagaagcaaccaagatgcattttaataagtggatggaaaaacaaaattatggcac

SEQ ID NO: 41617 - DNA, 201 bp, Bos taurus
agaagaaactgctaataaactccttaaaactgactcctaaggaatccccttagcctctctattttgcagaggcattataaaatttaaagaggaaagagacracagctgaggatcccaaactcagtatccaaaaagagctccgctccaaatatattctgactctgagtcctctaccccatgcattcctcagtttatttaccc

SEQ ID NO: 41618 - DNA, 201 bp, Bos taurus
ttctcctttcattcactttccatccatagctgccaggcttgtgttctctacacccacagaaacactaggataaaggtggtcaatggccttcaatggccatrtgcagtggactcattcactgattcagtcaacaaagctttgtgtcttctctgcatcagatgctgttcctggcctgcagatccagcaatgtaaaggctttct

SEQ ID NO: 41619 - DNA, 201 bp, Bos taurus
gtctggctctgtgtggccaggagcagaaccgagcttccctagtcagtagctgcaacaaggtcctgtcccaggaggcccagttccctggcaggtagtggccycctggccacgcctgatgtcaagggagaatgatgcaccctcttaaatggatggggctgaactgggagaccaaacccttgtcagtcaagcaccaacagggca

SEQ ID NO: 41620 - DNA, 201 bp, Bos taurus
ttttgtttcttattgtagtaacattgctatacaacttggtgtgtgttgtaggtgaatccgagaggcaaggagttgaggccaaggaagagacttttaatccrggagtcagcaagttgagaagatggcaggctagcacctcaaaataaccattcttaccagggcctggttgccaggttcttttaaggatcagagatgagggga

SEQ ID NO: 41621 - DNA, 201 bp, Bos taurus
tggggtcaggctagctgtccagccctgacatgggggctgcacatcagtcatccctctatcttccaagtgcccgcagacgccctcgattcaagatgccagcygaggccccaagcagcgggtcagtatacaacagcagcccaggtagagggcagaggggtcagcagggccttctctggggcggctctgccctttcctctggga

SEQ ID NO: 41622 - DNA, 201 bp, Bos taurus
ctctaccataatgggccagtgcagaatgatcaacagaacaatctaccaggaaatgataaagattgttattttatccaaatcatgattctgactcaaaatayattttaagctgacagaattacctcaagaaatgaacattttatgggaaggaggtgggagggggtttcaggatggggaacagatgtacacccatggctgatt

SEQ ID NO: 41623 - DNA, 201 bp, Bos taurus
atggaaaaaatgccatacatccatgcaatggaatattatttggtcataaaatgagtgaagtatggatacattcttttagatacatgagcttcaaaaacatyatactgagtgaaagaagccagacacaaacgactgtataaggtttgattccatttataaaaactcttcgggatctgaaagtctatggatgtgtgtagctgc

SEQ ID NO: 41624 - DNA, 201 bp, Bos taurus
tttagaggcgagggctgggttctcaaggaactgtccaggagaagccccaaaggatgggtggaattcagccttggaaaaggacctggaggttggccaggacmcacagcgaaaggagcaacgtgtttgagcgggtggaggaatcgagttcacgtgattgaaagtccagggtgcttgggtgggggtggggggttggaggaggca

SEQ ID NO: 41625 - DNA, 201 bp, Bos taurus
ccttccctgacctgcaccctgctttctgcatcctcaatgaggcaggcagtgagcctcaacttaataactttccactctcggcctgctggcttttcatctcraaacaaaagtgatacatacaaataaataagcatcccaaacatgcaagcaaaccagtcgtgtccccttaaaatcaactgtctgggaggcccggtgcttcct

SEQ ID NO: 41626 - DNA, 201 bp, Bos taurus
tgacactgccagtaccagcgtccctgtggcaggaagagctctcataaacggctgctcagtatccatgtcctgagtgagtcctctcgcctctggcctctctyggagcctctgtgggatcagcaggtgggtctaatccagctgcccttcaagcgactgcttcttccctgggccctggaaccgggagattctgtgtgtgcccct

SEQ ID NO: 41627 - DNA, 201 bp, Bos taurus
gaaatccaagttggttccgggggaagtgaagagactagaggtctttgctgggaaagagaggagcccggggtgagggccccaaagtggccaaaaagatgctrcttggatgacacctggcaggagagggggtcgtttgataagagtaggggtatctgagctagtgatttgggggagatggagagattctgtttcttgacaagg

SEQ ID NO: 41628 - DNA, 201 bp, Bos taurus
aacatgtgtttagggctggccaaaatggcgttgcctgttaagttaggaactgttaacctttcttgattttttattttccaatccactcaagatggcccagrctattttgggttcattagtttgtgtaccatttcccctgcaggaagatgctttttgggttgaggaggaaggtggctgggaatgggccctggggagagaggc

SEQ ID NO: 41629 - DNA, 201 bp, Bos taurus
ctgccatcaggcctggctaggaggcagacacaggagaaagctgagtccaagtaccaggatggacaagtttaagatgttgcaggtggatggtgggataattytaggagtttcaggcagggaggccaaagcatctaaaccaagtaacaaggggcaactttagtgacttctggaaaactccagctggaattcatagatggacaa

SEQ ID NO: 41630 - DNA, 201 bp, Bos taurus
tttggaccccaaagctctcttctcttctggtctctcgaggaaggcagtttgcctcctcagccctgtctgtggctgtgtaagcaggaccgctcaggccagtyctggcgtgggacaccctccatgcgcaggcgatgcaaataattattacattggcagctcattgctttcagtcaaccagtattttaaagaggatggccattt

SEQ ID NO: 41631 - DNA, 201 bp, Bos taurus
ctgcgcttggacaccccagccactctacgtggagcttcctgggaccctccacagtcaggctggggtgtctggatcatccaggagttttggaagaagcaggraacaagtccaaaagggggaggctgaagagagattaaataaggactcagatagagtcacatgtttggcattaaggaaaagccttaggggatggagagacat

SEQ ID NO: 41632 - DNA, 201 bp, Bos taurus
cagcttgggactgttctcacagcaagggttgcatcacagctaaggccttgggacctgtgtctttcagaattaaaaggacccatctggaataccctcgactyccctggtgtccagagacacccaggcctgggtccataacctggtgtaggaatgtccagtcactggcttcccttcctccccaaacaccgcaggtcattcttt

SEQ ID NO: 41633 - DNA, 201 bp, Bos taurus
caggccaaatatgcattttcatctctgtcctgaatggggcagggagtcgctaagatggtttggagagcagtttgggatggcaaacgggacctccagccackcaaggccactggcagctgaagacggcagatgggctcaaaaggtgacttctgtggactcaggctcaatgatgatgctcctctgttatggactcagggagac

SEQ ID NO: 41634 - DNA, 201 bp, Bos taurus
aagatgcgagagtctgggctcactgaaattattcctttaatatccacctcagttatctgggagcagcatcctgtgttttctcatcctgagtttcttcaggrttcaccattctggcagctgtaattggcttgatggctccagcctcctttgttaactgacatggtagcaatactttagttctcaagtccaaaggtgagtgct

SEQ ID NO: 41635 - DNA, 201 bp, Bos taurus
ccactgagctcagatgcagggttggaggaaggaaggtgtctttgaggtgagacttggaggtgagcgggtgagggcataaacagaacatctgctttcattayccgaaaacaaatttagtgccaataaaaggtgttcaagtgagaagactggggatggaaattgacagtcaaaaacacagccatacatgatcctaactttaag

SEQ ID NO: 41636 - DNA, 201 bp, Bos taurus
tagtgaaggatagggaagcctggcgtgctgcagtccatggggccgcaaatagtcagacgtgatttagtgactggcaaccacagtagcattttctgatatcyactagggcaaatcagtctccctactctttttttcacgtattttctaggcaggttaccagcatttattcttctaaaattacgagatcgttttaaaaatgta

SEQ ID NO: 41637 - DNA, 201 bp, Bos taurus
aaactaagacagaaactaaaatcactcaaggccaaaaccctactcattccatcacatggggttgctgctgtcagtgacatggggacggcaggactctgatrggaaagaggccattgagtcactggtgcaggaagggtcccatccttgatggacatcagagctggatggacagagtcagtataaagagagaatgaaaatgat

SEQ ID NO: 41638 - DNA, 201 bp, Bos taurus
tatacatgtattatatatattgtaatatcttgttattatatatataaaacatgcttgtttttcaaagaattttctgtttcatcttggttgtcaaatttatyggcatacagattttattatacacccttatcatccatttgatgtctgtggaagctgtagtaatacccccattttctctctcttttggtaattgtcttttct

SEQ ID NO: 41639 - DNA, 201 bp, Bos taurus
atactgaagctaaaacaatattgtaaatcgactaaacttcaattaaaaaaaataaggttgcagagagagttccacatagataatcccattccacactttakaaactgctctccatcttttagcagaaaataaaatggaaaagaaaaaacacactgctctgagtttgctcctgtaattcctcttttcctgactgattctgcc

SEQ ID NO: 41640 - DNA, 201 bp, Bos taurus
tgtctattgggagagatggacgagggacaaagataggctttattgttagcacatttagatacagataggtcctgcctcttttgaaagaagacccctcaaakggccacctccagctgcttcctctcctcttattcctgctgtgctggaaaggagaggaaagggtgcaggcctgggggatgtgtagctgatgtgagcagaagc

SEQ ID NO: 41641 - DNA, 201 bp, Bos taurus
gggctgggtcgaccttctccgtggccacccctttcttgagtggctgggagccaaagttggcacgaaaataaagttgttcaggcctctgcccatgtgttggygtgttttgtgcccggtggggagggcacgctcctcgtggaggcgggggaggagctagcatgcgcggccgtgccctcgcctcaaagggaggcgggctcagcc

SEQ ID NO: 41642 - DNA, 201 bp, Bos taurus
cggggcggtgagcagcctggtctcccctggaaacccagggaacgacacaggccccacctcggcacctcagggtgcaggtgaggcatggagagccaggcacrtgggggctgttgccacctcaggcccgccccccagcacacaggcctccctgctcccacccaccggccagggtccgtggcacctcagcctgcagtcgtgacc

SEQ ID NO: 41643 - DNA, 201 bp, Bos taurus
tcaatatcgaaaaacgcccaaagaatgcaatcaacagacgggcagaagactcgaatagaaatctctgtcccaaagaaggcataccggtggccagcaggcaygaaatcgtcctcaacactgtgagttactaaagagaaaggcaaattgaaaccgcagtgagacgtcacttcacacctgtcagaacggccgtcgtcaaaagtc

SEQ ID NO: 41644 - DNA, 201 bp, Bos taurus
ctttaagctcgaaacgaggccagtttggagtcaagcgagttctgctcccgcacagaaagcggcgggaacctcggcgccccctggtgacgacccaagaaacmgcgcctgggacccggggccgcgtcgcccgaagccgggggcggggcgggtctcgccaactccaggacaaactcgcaagatactaacactagggccccaact

SEQ ID NO: 41645 - DNA, 201 bp, Bos taurus
aggccagcacacggcatcactgttacgtcggagcccaaggatgaaacagacccgctgagttacaaaacacagacagacgcacagactggaaagcaaatgcrtgctgcagtgcagtccagtgcaggccagttcaagccagtcgctcagtcgtgtccgactcttcatgaccccatgaatcgcagcacgcagggcctccctgtc

SEQ ID NO: 41646 - DNA, 201 bp, Bos taurus
cacgctgggctcggcagccatgcctcggagtggaagaaaaatgtggaaaccggagaggggcttccgagttgccggcctgctccttctggacggggcttgcygggtctccagagccctgatccacgccagctccaagaccttcatgctttttgtggcttgggtgagctcacctcgtcaggccctaacagctaccaggggctg

SEQ ID NO: 41647 - DNA, 201 bp, Bos taurus
ccgcccgagcagtgcccgctgccggcctggccctacccgcgtccagggccgcctctctttccctgtttccccacggggctgcctttattttcctgcactgygtgtctctgcgaggtgcccggccctgcgggatgaggcgagctctgaccgtgacggtccgaaccacccgccagtgacttcacacgaggcagacaaggcccc

SEQ ID NO: 41648 - DNA, 201 bp, Bos taurus
tagcgtccacctccagagctcacggcccccacagccaggctgggcacaggaagagctcagagcctgaggtaggtgcaggggtgggtccgaggctcccaaarccccgccgtggccatgcagctgggcgggcagcccccattgcctcagcgaacttctgcgccagggagggacgtagcagctctatggcgaacccaggcccac

SEQ ID NO: 41649 - DNA, 201 bp, Bos taurus; identical to SEQ ID NO: 1

SEQ ID NO: 41650 - DNA, 201 bp, Bos taurus; identical to SEQ ID NO: 2

SEQ ID NO: 41651 - DNA, 201 bp, Bos taurus
tttaacttgccgaggtggttttgagacgtgctctggcctcggagcaccaagcacacacgctggcccttgctgacgcggcctctggtaccagctgccgccccgtcaccaactactcgcttcagcctctgcccatgctacaaacccttcactacgtctcagcacacgctgagcccggcccccatcgccccacatgctttaatc

SEQ ID NO: 41652 - DNA, 201 bp, Bos taurus; identical to SEQ ID NO: 3

SEQ ID NO: 41653 - DNA, 201 bp, Bos taurus; identical to SEQ ID NO: 4

SEQ ID NO: 41654 - DNA, 201 bp, Bos taurus; identical to SEQ ID NO: 5

SEQ ID NO: 41655 - DNA, 201 bp, Bos taurus
aagtgaactatgtgacttccccacgagacccttaaatggcatcctactgcctggctcaagaaacaaccaagaggtatcttagatcatgcaaagggagccaagcaataagacagaaggatcatgggttcccagatactgagggctgctaggctgcttatactggggagattttgcgagaaagaacattcgatcaagttgaaa

SEQ ID NO: 41656 - DNA, 201 bp, Bos taurus; identical to SEQ ID NO: 6

SEQ ID NO: 41657 - DNA, 201 bp, Bos taurus; identical to SEQ ID NO: 7

SEQ ID NO: 41658 - DNA, 201 bp, Bos taurus; identical to SEQ ID NO: 8

SEQ ID NO: 41659 - DNA, 201 bp, Bos taurus
taggagatgggctcccatacgccaggaggcccgtgccactatttcattaattctgtatcatctcaggacgacattttatgcaactgaatttttagggcccaattaacaacagttgggagccacttccaatttgtaagcattgaaaataaactgagtctctgctcaatctctgatcaggagataccaaggcctggccaaagg

SEQ ID NO: 41660 - DNA, 201 bp, Bos taurus; identical to SEQ ID NO: 9

SEQ ID NO: 41661 - DNA, 201 bp, Bos taurus; identical to SEQ ID NO: 10

SEQ ID NO: 41662 - DNA, 201 bp, Bos taurus; identical to SEQ ID NO: 11

SEQ ID NO: 41663 - DNA, 201 bp, Bos taurus; identical to SEQ ID NO: 12

SEQ ID NO: 41664 - DNA, 201 bp, Bos taurus; identical to SEQ ID NO: 13

SEQ ID NO: 41665 - DNA, 201 bp, Bos taurus; identical to SEQ ID NO: 14

SEQ ID NO: 41666 - DNA, 201 bp, Bos taurus; identical to SEQ ID NO: 15

SEQ ID NO: 41667 - DNA, 201 bp, Bos taurus; identical to SEQ ID NO: 16

SEQ ID NO: 41668 - DNA, 201 bp, Bos taurus
gaccaggcctgagagcctctggaccataaggtgctgccacctggcaaagcttttctccatcatcatgacctccagccatgctccagctgagcaaaggacaaggagctggcctctgcaatgtgcatgattcactgcacttaccttttcatcagagccatttttccaatattgcacatggtaagtccatgagttataaatgtt

SEQ ID NO: 41669 - DNA, 201 bp, Bos taurus
ttgaagggattggctttctcagcactggtcagcttgcacatttagagtgtgggtggaagccgaaagacctcgaagaccaggtgaggagctggggtagacatcagggagtggtgacgactgtggcttagagtcatccttgcgtggctccaactctctgggcctgcagaagctgggctcatgtatggctgtgccttccaactt

SEQ ID NO: 41670 - DNA, 201 bp, Bos taurus; identical to SEQ ID NO: 17

SEQ ID NO: 41671 - DNA, 201 bp, Bos taurus; identical to SEQ ID NO: 18

SEQ ID NO: 41672 - DNA, 201 bp, Bos taurus; identical to SEQ ID NO: 19

SEQ ID NO: 41673 - DNA, 201 bp, Bos taurus; identical to SEQ ID NO: 20

SEQ ID NO: 41674 - DNA, 201 bp, Bos taurus
ttaaaccacagcagtggactgcctcacggtcctggaagctgggagtctgaggtcaaggtgtttgcaggtgcggtttcttctgaggccccccgccttggctcgcagatgtgggtcttcttgctgtggagggtctcagtcctcatctcctcttgcttcttggctgccttgggtctttgttgctgtgcacaggcctttctctag

SEQ ID NO: 41675 - DNA, 201 bp, Bos taurus
ggaaatattgaaggcaggaggagaaggggacgacagaggtggactgggtggactccaagagttggtaatggacagggggcctggcatgtcacggttttacggggtcgcaaagagtaggacatgactgagcgactgaactgaactgaactgagcaggggacggaggggagatgggagcatgaaggtgaaggcctaccacgcc

SEQ ID NO: 41676 - DNA, 201 bp, Bos taurus; identical to SEQ ID NO: 21

SEQ ID NO: 41677 - DNA, 201 bp, Bos taurus; identical to SEQ ID NO: 22

SEQ ID NO: 41678 - DNA, 201 bp, Bos taurus; identical to SEQ ID NO: 23

SEQ ID NO: 41679 - DNA, 201 bp, Bos taurus; identical to SEQ ID NO: 24

SEQ ID NO: 41680 - DNA, 201 bp, Bos taurus; identical to SEQ ID NO: 25

SEQ ID NO: 41681 - DNA, 201 bp, Bos taurus; identical to SEQ ID NO: 26

SEQ ID NO: 41682 - DNA, 201 bp, Bos taurus; identical to SEQ ID NO: 27

SEQ ID NO: 41683 - DNA, 201 bp, Bos taurus
gtttctttctagcattctaagatacaataactgttgctagtagttaatattaagaatctatggaaattactgcttgttattctatctatatgatttatgaatgactactgattaaaagaaggttggattaaaatttttgagtacaaaagaagtacatgcttttagggggaagaaatgcagataatacagaaagttctgaag

SEQ ID NO: 41684 - DNA, 201 bp, Bos taurus
tattctcctgagagtgaaatcagaggatctacaatatccacgatggcaacaccgtttttgtcagctgtcacattgcccaggtctccaacatgcctaacatcgaaaaagcagagggattaggactgatttctgtctatctaactttagttcataagctaaattaaaaatggatgagtcagatatataagggtgacttgagag

SEQ ID NO: 41685 - DNA, 201 bp, Bos taurus; identical to SEQ ID NO: 28

SEQ ID NO: 41686 - DNA, 201 bp, Bos taurus; identical to SEQ ID NO: 29

SEQ ID NO: 41687 - DNA, 201 bp, Bos taurus
gaattcagatgctttccagaaatagagacgcagatgcagagaataaatgtgagaataccaaggcaggaaggggagtggggtgagttgggagattgatactatataaaatatgtaactgatgagaacccactgcagagcacagggagctctgctcagtgctgtggtgaccctgagaaagaagggcacgtgtattcgtatggc

SEQ ID NO: 41688 - DNA, 201 bp, Bos taurus; identical to SEQ ID NO: 30

SEQ ID NO: 41689 - DNA, 201 bp, Bos taurus; identical to SEQ ID NO: 31

SEQ ID NO: 41690 - DNA, 201 bp, Bos taurus; identical to SEQ ID NO: 32

SEQ ID NO: 41691 - DNA, 201 bp, Bos taurus
acatcaagacaaaatggaaggtaattgctttccaagaggagattaaagattaaaaatttgcagctgagtctttaatgcttaaagaattaaaggggggagtgggaagtaaaatggataaaggtagtcagttacacgcttccaattataagctgattaagtcctaggtatgtaataaaaagatgagtctcctatacacacatt

SEQ ID NO: 41692 - DNA, 201 bp, Bos taurus; identical to SEQ ID NO: 33

SEQ ID NO: 41693 - DNA, 201 bp, Bos taurus; identical to SEQ ID NO: 34

SEQ ID NO: 41694 - DNA, 201 bp, Bos taurus; identical to SEQ ID NO: 35

SEQ ID NO: 41695 - DNA, 201 bp, Bos taurus; identical to SEQ ID NO: 36

SEQ ID NO: 41696 - DNA, 201 bp, Bos taurus; identical to SEQ ID NO: 37

SEQ ID NO: 41697 - DNA, 201 bp, Bos taurus
ttctgctgtctggctttcacactctaggccactatccacctcttcaaaccaccctaggaccacataccagataaccagggatagtcccaaggccccagagcctgctgaaattattcacactagccagtcctaagcctgtttaccctgcatctctgttccttcctgtggaaactataagaaagtctcttatccacattttta

SEQ ID NO: 41698 - DNA, 201 bp, Bos taurus; identical to SEQ ID NO: 38

SEQ ID NO: 41699 - DNA, 201 bp, Bos taurus; identical to SEQ ID NO: 39

SEQ ID NO: 41700 - DNA, 201 bp, Bos taurus; identical to SEQ ID NO: 40

SEQ ID NO: 41701 - DNA, 201 bp, Bos taurus
cctcactccttctgccacgtgagggcatgagaagacaacggtccatgaacgatgaaatggatctttaccagacactagatcttctggaaacttgatcttgtatttctagtctctagaactgtgagaaatatctgttgtttataagtcatccagtatatggtattctacgataggcagccttaatggataaacacttgaatt

SEQ ID NO: 41702 - DNA, 201 bp, Bos taurus
accatctggaaagttctcatcatattttcatgaacagctatgcttttatagctaaatttatggggattatttctctctgttagattaactaccccttattctgttttcttttatttttgttgttacagttttattatattgtatataatctcctgcttctcaatttataacttagttttactttgaggcaaatgaagaatg

SEQ ID NO: 41703 - DNA, 201 bp, Bos taurus; identical to SEQ ID NO: 41

SEQ ID NO: 41704 - DNA, 201 bp, Bos taurus; identical to SEQ ID NO: 42

SEQ ID NO: 41705 - DNA, 201 bp, Bos taurus; identical to SEQ ID NO: 43

SEQ ID NO: 41706 - DNA, 201 bp, Bos taurus; identical to SEQ ID NO: 44

SEQ ID NO: 41707 - DNA, 201 bp, Bos taurus; identical to SEQ ID NO: 45

SEQ ID NO: 41708 - DNA, 201 bp, Bos taurus; identical to SEQ ID NO: 46

SEQ ID NO: 41709 - DNA, 201 bp, Bos taurus; identical to SEQ ID NO: 47

SEQ ID NO: 41710 - DNA, 201 bp, Bos taurus
tctctgtatatttaaagaaagagttttatgcatttgatgaaactatttttattgtgtaggattgcagtatcataaccctacatgtttaatttgtcctgtcggctccattatccttctccacctctccagcaaggtacgtgcaaagaaaatgcacattacttcaaccacacaatcttgccaagcaaagtaaatacaagagat

SEQ ID NO: 41711 - DNA, 201 bp, Bos taurus
aaacagagtcacctgaaatatttctgtggttgagatgtgcaatgaatttagctggctgtttgaaaactctcctgattctgttagctgtttcccctgtcttcctgctggttctcatcattcctctctaattttgaatgtggttaaggggaagaaaggcaaaataaaagtctattttgaagcaaatgacaccacccatgacta

SEQ ID NO: 41712 - DNA, 201 bp, Bos taurus; identical to SEQ ID NO: 49

SEQ ID NO: 41713 - DNA, 201 bp, Bos taurus; identical to SEQ ID NO: 50

SEQ ID NO: 41714 - DNA, 201 bp, Bos taurus
tcttgcttggagaatcccatggacagaggagcctggcaggctacaatccatggggtcacaaagagtcgggcatgactgagggactaagcacacagcacagcgcaaaacattagaggtttttttcaaagagtaatcttaataccgaaagccacaagtactgtctggtacctgtgaacagacagtatccttgacatgtttgtg

SEQ ID NO: 41715 - DNA, 201 bp, Bos taurus; identical to SEQ ID NO: 51

SEQ ID NO: 41716 - DNA, 201 bp, Bos taurus; identical to SEQ ID NO: 52

SEQ ID NO: 41717 - DNA, 201 bp, Bos taurus; identical to SEQ ID NO: 53

SEQ ID NO: 41718 - DNA, 201 bp, Bos taurus; identical to SEQ ID NO: 54

SEQ ID NO: 41719 - DNA, 201 bp, Bos taurus
taaagatggtgaaaacatggcattaaaaggagctaggaaacatgagctatcggtatctatgtgctacagccaaagcaagacaagataggccgctaggggctggtccctgtgaagagccagtttaaagcataaaaaatgcagtgaagcggtctgtgaaagcagtagctgctgagtcacaggtgaggagaagggaggggacca

SEQ ID NO: 41720 - DNA, 201 bp, Bos taurus
gaacccgacaaataacatgaactgggtaaaaatgtttttctccatttcattctaaccccttctttctcatgttctaatccaggaggagtgactagcaggaagtacaaagaagagaaaggagtataagaaggaaagactgcacccctttcttagataatagctcaaacctgagccaggggaaaggagagaagctcagaattg

SEQ ID NO: 41721 - DNA, 201 bp, Bos taurus; identical to SEQ ID NO: 55

SEQ ID NO: 41722 - DNA, 201 bp, Bos taurus; identical to SEQ ID NO: 56

SEQ ID NO: 41723 - DNA, 201 bp, Bos taurus; identical to SEQ ID NO: 57

SEQ ID NO: 41724 - DNA, 201 bp, Bos taurus; identical to SEQ ID NO: 58

SEQ ID NO: 41725 - DNA, 201 bp, Bos taurus; identical to SEQ ID NO: 59

SEQ ID NO: 41726 - DNA, 201 bp, Bos taurus
taactgtaccaaagttgcccactagtgaccctgagatttataccaaaatcatccacctctgaagtctgtgttcttagccaccatgctctgttgcccctgcgtgttatgcttccttagggctaaagactctccttctgtgattttttagaaccaaaatcaaggagtgttgattttgaggaggggagagggataaatcaggac

SEQ ID NO: 41727 - DNA, 201 bp, Bos taurus; identical to SEQ ID NO: 60

SEQ ID NO: 41728 - DNA, 201 bp, Bos taurus; identical to SEQ ID NO: 61

SEQ ID NO: 41729 - DNA, 201 bp, Bos taurus; identical to SEQ ID NO: 62

SEQ ID NO: 41730 - DNA, 201 bp, Bos taurus; identical to SEQ ID NO: 63

SEQ ID NO: 41731 - DNA, 201 bp, Bos taurus; identical to SEQ ID NO: 64

SEQ ID NO: 41732 - DNA, 201 bp, Bos taurus
gacaagggaggggctgtcaaaagaaacactagtccagccttgggccaacgttctggttccccctccagggatacatataactatctttgagcagttttgcagatactgtaatccccaccagatgggagaaattaacagcctggtgcccacaagtccataggccccagacccaggaacaagaaggctgaagatgctgaatct

SEQ ID NO: 41733 - DNA, 201 bp, Bos taurus; identical to SEQ ID NO: 65

SEQ ID NO: 41734 - DNA, 201 bp, Bos taurus; identical to SEQ ID NO: 66

SEQ ID NO: 41735 - DNA, 201 bp, Bos taurus
aaatttttggccccacattcatttggaagagagtctgagtgttgtgttggtgaagtatgaaattgaagtgccctgttggctactcttagactcctctgctgcgttcctgctataaacttgaatggccagctaagcaaaacaaagaactccagacctatttttctaaggtcctttactgaggtctgttcttgcctaatcatg

SEQ ID NO: 41736 - DNA, 201 bp, Bos taurus; identical to SEQ ID NO: 67

SEQ ID NO: 41737 - DNA, 201 bp, Bos taurus; identical to SEQ ID NO: 68

SEQ ID NO: 41738 - DNA, 201 bp, Bos taurus
ttcctactccctcaaaataagatattatggccttgttgtgcctacagattcttcataacctgccttcactcgtttttctgccctcaacttgtgctgctctctaagtggtggcctcctggttgatcactgaatatactaagcatgattttactcacaacctttgcaaaatctgttcattctgcctggaattttcttctccaa

SEQ ID NO: 41739 - DNA, 201 bp, Bos taurus; identical to SEQ ID NO: 69

SEQ ID NO: 41740 - DNA, 201 bp, Bos taurus
ttaaatctgcatgagtcagactattttgatcactgctttgactctgctgtatgttatggtagccacacccacctggccttttgggatggaaagttgccatttcacccctgtcacctctgaatccaattactttcattgcttttattttcccaattcatggctgcagttcctactgtaaggcctgaactataggaaagagga

SEQ ID NO: 41741 - DNA, 201 bp, Bos taurus; identical to SEQ ID NO: 70

SEQ ID NO: 41742 - DNA, 201 bp, Bos taurus; identical to SEQ ID NO: 71

SEQ ID NO: 41743 - DNA, 201 bp, Bos taurus; identical to SEQ ID NO: 72

SEQ ID NO: 41744 - DNA, 201 bp, Bos taurus; identical to SEQ ID NO: 73

SEQ ID NO: 41745 - DNA, 201 bp, Bos taurus
tttgtaagtgatgctcagtgacattaccttaattcgaaaggggaaacatctaataggattgaagtggttctggagaataatagatatgaagcttgatgaagatagcacatgatattcccatcttagaaaagtgttagtttctgcagttaaccagcagtgacattgctggcaaagctcatcaagaagagacctcaggccaag

SEQ ID NO: 41746 - DNA, 201 bp, Bos taurus; identical to SEQ ID NO: 74

SEQ ID NO: 41747 - DNA, 201 bp, Bos taurus
ggtgcattgctggagatgaacttcaggatgggttttgaaaggtttggagcacatccatttgcaaagaggagaatagttctatatggatgagagaatgaccagggccagtcttcctttcttacactgttgtaaaacttgagttccgccaggagagggccatagatgggaaagaattctcagaaagtgagggagactctaact

SEQ ID NO: 41748 - DNA, 201 bp, Bos taurus
gagatggtgagggacagggaagcctggtgtgctgcagtccttggggccgcaatcgggcatgacttggcaactgaacaacaacaacaaagctagggccaagtaaaactacagaggctcaaaagtattcgctcttttccaatatcagatgcgataagtgaaagacttgaaaaaaggttctgtagtcaaggcctatgtaaattc

SEQ ID NO: 41749 - DNA, 201 bp, Bos taurus; identical to SEQ ID NO: 75

SEQ ID NO: 41750 - DNA, 201 bp, Bos taurus; identical to SEQ ID NO: 76

SEQ ID NO: 41751 - DNA, 201 bp, Bos taurus; identical to SEQ ID NO: 77

SEQ ID NO: 41752 - DNA, 201 bp, Bos taurus
cttatttattttggacgtgctgtgcagcttgtgggatctcagtcccccaactggggattgaacccaggccacagcagtcaaagtgccgaatcctaaccactagaccaccaggaaacgcccacttttcttccttttaaaatgaccagcttgacttcattacagtggctgcttagagaaggaagcccgaagattcagttcttg

SEQ ID NO: 41753 - DNA, 201 bp, Bos taurus
agaccccacaagaagatgttatggttactgaacaagaatgcccagggaaaccatctttggtttagagataaagatcactttatcaggccctgtcctctcatctctcttcagaaacatttgggacctctctggtggtccagtggctaagactctgagctctcaatgcagggggcccaggttcgatccctggttgaggaacta

SEQ ID NO: 41754 - DNA, 201 bp, Bos taurus
ttataatataaagtatagatcacttaaaaaaaaagattcagtgaaaattatggaattacatagatatcaaaaaaatgtttttacaaataaattagtttagataattctgttacaacagataaatcccaaatatttagtagttgcttatatttttacccatgtgaagtccaaatcagctttcctgataggcatacgactttc

SEQ ID NO: 41755 - DNA, 201 bp, Bos taurus; identical to SEQ ID NO: 78

SEQ ID NO: 41756 - DNA, 201 bp, Bos taurus
ccactggctgtgtactctgtggatacatttgttattcatcttgctctccccgtgagtagggttatataagctcaactcaaatagaaaattcatcacactggaatcatcaccctgcactcaaaccccactgtaccacctgcttttggagtctctgttatgtaggcaccagagagatggatcccttgatcatggggggtcttc

SEQ ID NO: 41757 - DNA, 201 bp, Bos taurus; identical to SEQ ID NO: 79

SEQ ID NO: 41758 - DNA, 201 bp, Bos taurus
ccatgctgaaaaccacccttttgcttggcctccttagagatcatgtggatgatggaaacttgaaagcccagcagtagagagaagccggaaatggctatcaatggatccattcttaggccagaagctgatacgaacatgtcattgatgatgctgacttcaaagtgttccttcagagtcctgaaaagaagcagtaagaaatag

SEQ ID NO: 41759 - DNA, 201 bp, Bos taurus; identical to SEQ ID NO: 80

SEQ ID NO: 41760 - DNA, 201 bp, Bos taurus; identical to SEQ ID NO: 81

SEQ ID NO: 41761 - DNA, 201 bp, Bos taurus
ttgctggagttattttacatgaaaattttcaatggaaatttgtgagtaaaatattattgtaactaacatttaagaatataaagtaattgatcattaaaacatggtgaagaattttaaaaagttaatgatattatcccaaattagaacaaaaagctccaattagacaaatagacattttaagtgcaagaaaggcagacagag

SEQ ID NO: 41762 - DNA, 201 bp, Bos taurus; identical to SEQ ID NO: 82

SEQ ID NO: 41763 - DNA, 201 bp, Bos taurus; identical to SEQ ID NO: 83

SEQ ID NO: 41764 - DNA, 201 bp, Bos taurus
aagtgaaagtcagtatgtgaaatattcatgactgaatatctttcaacatcactcctaaattgatgaagtaataaatatgaatccacacctatagctaaaggaatgaaacataaatgtttgggccaatgataacaactactgtcacacatgaattttaaaagcagcataatcagcatcagttgacttaggcatttggttaat

SEQ ID NO: 41765 - DNA, 201 bp, Bos taurus; identical to SEQ ID NO: 84

SEQ ID NO: 41766 - DNA, 201 bp, Bos taurus; identical to SEQ ID NO: 85

SEQ ID NO: 41767 - DNA, 201 bp, Bos taurus; identical to SEQ ID NO: 86

SEQ ID NO: 41768 - DNA, 201 bp, Bos taurus; identical to SEQ ID NO: 87

SEQ ID NO: 41769 - DNA, 201 bp, Bos taurus; identical to SEQ ID NO: 88

SEQ ID NO: 41770 - DNA, 201 bp, Bos taurus; identical to SEQ ID NO: 89

SEQ ID NO: 41771 - DNA, 201 bp, Bos taurus; identical to SEQ ID NO: 90

SEQ ID NO: 41772 - DNA, 201 bp, Bos taurus
caagacataagtcattataaagtcatgcgtgctagaaattaactcatttattcattcatgagtctatttagttatctacaattttaggttgagattttaactgagattgttaaagacccacatgaagattataaagagtaatacagagacatcccatgtacaccctacctaatattctccaatgataccatttaaaaaaaa

SEQ ID NO: 41773 - DNA, 201 bp, Bos taurus
ttaataatttaacagatacaaagagtttaattttggtcttagtacattaccagaactcagcaattctgattttaaatggtgctacatgtatacatcccgtgcacacatttattaacacatacaaaaagtcactccagcctggaatgcttttctaataaagaagtaacacacaatatagtatgtataagaaaaccaggcttg

SEQ ID NO: 41774 - DNA, 201 bp, Bos taurus
ctcatctccaagccttaatgtaatgcttagagcccacaatctggtccttcctctctttctggtacatttctgaatgtctgcctagccaaactcatccaaaggtcgtatttcaatctctttcccttgctgtgtttaatttacttggtgagaaaaagcatagagtaagtaacaaatttgttaaaatcaactgtgaaaaactca

SEQ ID NO: 41775 - DNA, 201 bp, Bos taurus
ataccttgcttcccacaaaatattggagagagtctaaacagtttgattcagaagcaggaggaataagtagttattttgtttcctgaggttctaaaattaatagcttctatgttgatttttatccaggaaagagcacttgcaggcataagttcatttgatagtgtttgttcagctactggggctacaaaggaaaagggactg

SEQ ID NO: 41776 - DNA, 201 bp, Bos taurus; identical to SEQ ID NO: 92

SEQ ID NO: 41777 - DNA, 201 bp, Bos taurus; identical to SEQ ID NO: 93

SEQ ID NO: 41778 - DNA, 201 bp, Bos taurus
gactttaggaagggatttttcccacagtgttttactaaaatttatttcaacttttattactatagttaatataaagagcaatttggtgatgtcttccacctcaggaaaattatctccttgatttacatgatgaatgcaggggttgaagtatcattaaccataaggagaataatttttgaaatcctggtttgtaagtagtta

SEQ ID NO: 41779 - DNA, 201 bp, Bos taurus; identical to SEQ ID NO: 94

SEQ ID NO: 41780 - DNA, 201 bp, Bos taurus
gaaatatttctaaataagaccagattacactgaagatgaagtttctactattttcaaatatatatattttacctcaagcagtaagtgtgttaatagatatgaaaaggaaagatggatgggcattagactgtggaagtcaattaataaagaaaacaatactttataaaatcaaatagaagttatcaactaaattctcatttt

SEQ ID NO: 41781 - DNA, 201 bp, Bos taurus
gcaaattattgtccagatttctgatttctaattgccaattctcagtcagtatggcccatataaaggaggaacagaagcagagagaatcttcctcagtcaacgataattttaagttgtttttgtaatggagtttccctgtaggtagctgaacatgaaaatatacaattcactacttaagctttgggtgaaggcatattttta

SEQ ID NO: 41782 - DNA, 201 bp, Bos taurus
caatggcgttttctagaaactggcatgtcaaaggtagctcatggcctgaggacacagaacaaagagctctgcttcatttgggcccaatagagttcacctgtctgctgaggaaatcaatgtctttactcacctttaacacactcactaccattatcaatttttcttgggccaagaatctctcttctacaaactatttatgta

SEQ ID NO: 41783 - DNA, 201 bp, Bos taurus
catggactgcagcctacaaggctactccatccatgggattttccaggcaagagtactggagtggggtgccattgccttctccataaaatgtcataaacaggattaaaataaaaatagcatataatatgcaaaaacatgacactgaaagttaataaaattaatcattaaaaacatggatatcaataaagaaatgcaaacaat

SEQ ID NO: 41784 - DNA, 201 bp, Bos taurus
cacagggatcgaactcgtgtctcttaagtctcctgcattagcagtagggttctttaccagtagcgctgcctgggaagccccaaccaatatgtagcacttacacatagcatttataaagtggttaaacttggacagttatacaacacttaaggtgaatggtgtcttttttttttttttttctgtattctcggagataatttt

SEQ ID NO: 41785 - DNA, 201 bp, Bos taurus; identical to SEQ ID NO: 95

SEQ ID NO: 41786 - DNA, 201 bp, Bos taurus; identical to SEQ ID NO: 96

SEQ ID NO: 41787 - DNA, 201 bp, Bos taurus; identical to SEQ ID NO: 97

SEQ ID NO: 41788 - DNA, 201 bp, Bos taurus
tcaattattttatcatcacttcatacattatacactaagatctaccgatacacatttgctcccatccaatataattatttcttagcttttaagcagaagcataccttccttgtgtattgaaaattgaagaaaatatgtcatcttcaacatttagaaaaatttctcaacctgtaaaatgcatctttacatttaagtattcgt

SEQ ID NO: 41789 - DNA, 201 bp, Bos taurus
catgaatatgcttgtatctgtcttgtataaagttatctaagtttgtgtaataatgggaaaactcaaagtacagtattgacctcatgtttattttagtctactactatacaagagtgagatatttagtaaagagaagcctagtaatatgtttgcagtctcatctaaattctaactttaaacaatttttaacatttacatcat

SEQ ID NO: 41790 - DNA, 201 bp, Bos taurus
aaaaagccctccctgtgttactctggttctagtgtccagtctcaccattctgccacttgaaataagagaaggtttcatccttttccaggccaaggctgatgtcagttcagttcagctcagtcactcagacatgtccaactctttgtgatcccatgaactgcagcacgccaggcctccctatccatcaacgattcccagaat

SEQ ID NO: 41791 - DNA, 201 bp, Bos taurus; identical to SEQ ID NO: 98

SEQ ID NO: 41792 - DNA, 201 bp, Bos taurus
aacactaccattaaaatcaactgtgtcatcatgtttagaatggcttaaagtgcctttgccaatttcttacagtcatttatataccagaagtaactgatacacatcttataaggccaatgaacagagatacttattgatcagttatatgatataaaattacatttgaaatgtatttcaaaaagtacttcttaaggattttat

SEQ ID NO: 41793 - DNA, 201 bp, Bos taurus
tattaataaaatatacatttccttatatttcaattgaatatgtctactctaaagaatttgtccattagacaacatgaatgcctgtgatcaaatacttaccatgtatgttctagaaacattgaattgctctgattgtgcttatcatctcacatggatcttgggtcatgtttcgtgttttttgatttggtcttttctaaaatt

SEQ ID NO: 41794 - DNA, 201 bp, Bos taurus; identical to SEQ ID NO: 99

SEQ ID NO: 41795 - DNA, 201 bp, Bos taurus; identical to SEQ ID NO: 100

SEQ ID NO: 41796 - DNA, 201 bp, Bos taurus; identical to SEQ ID NO: 101

SEQ ID NO: 41797 - DNA, 201 bp, Bos taurus; identical to SEQ ID NO: 102

SEQ ID NO: 41798 - DNA, 201 bp, Bos taurus
atgtccctcccctaaagatttcaaagccaaagtagagaacccacttgtatgagcctatgacacaggccacctcactgattttagggatcagtcaaaaggacttgatgtcccacccagttctctataaaataagcaaagtgagcctcctactcattttctgatgcctttcaaatgtattagagctcacagcttgcactaccc

SEQ ID NO: 41799 - DNA, 201 bp, Bos taurus
actccatccctaggtagctgcacaaagcaatgaaagtttataggacaaacttgatcaaagtgatttaaatcttcctggaaagcatttccaaggactatcccatggaagtcaggcctgaggtcatgattcccaacaactcagataaaagaagaggatattcttataatttcaagtttacattgatctttgtacagtctgaat

SEQ ID NO: 41800 - DNA, 201 bp, Bos taurus; identical to SEQ ID NO: 103

SEQ ID NO: 41801 - DNA, 201 bp, Bos taurus
tgtttagagtcaatgaaaatggctttaagcataactagatgtatgtgtatttaatacatatatgcatgaacatttttctttttggccataccatggggcacgggggattttagttccccaaccagggactgaacctaagccccctgcatgggaagcacggaggcttaccacggggccagcagggaagccactgtacacaca

SEQ ID NO: 41802 - DNA, 201 bp, Bos taurus; identical to SEQ ID NO: 104

SEQ ID NO: 41803 - DNA, 201 bp, Bos taurus
gttatgtttaaagttttctgcattgttttctttttgctgtttaaaaggagagcagacacttctgataaagtttgtgtcattagtctgcataattttcattttgtttgtttttgctaataatcatgattctgggatggttttcttatcacaaccagttagtgctgttatatatttcgcctgaggcttacgcggtgttctaca

SEQ ID NO: 41804 - DNA, 201 bp, Bos taurus
caattcaagtttcacagcaaaattgagcagaaagtacaaagatatccccttcctatacccctagccctagccccacacatgcactttttaatcacttctattgcacaaagggaagtgaatgcagaactagaagccaaatgttctacttctaaattctgtgttctttctactttatagcaaatagtcctctctaaacacagt

SEQ ID NO: 41805 - DNA, 201 bp, Bos taurus
ttcagtccatgaatttctggctaaacaggtcactgctaatccatggttcttcctatccaaaaagtttcttcagacatgcaacctctcatatttttttttcaggtatgtaggattattatactgttcctcatcacacacatcacaaagacttacagcataagaagctgcctaggacctcttgttacttccttgcttctccta

SEQ ID NO: 41806 - DNA, 201 bp, Bos taurus
taagtatcttttctcacttattttttcagatctgcctgcctattaactctttagtattcgctttatagaggcagaccccccaatgtgggagggcctgtggttgaaatagtaactgtgactgaccggattgctaacccttcctaatacagaagttaagccttatcaaggccacttacccagcgagatgtaagtttcattgac

SEQ ID NO: 41807 - DNA, 201 bp, Bos taurus; identical to SEQ ID NO: 106

SEQ ID NO: 41808 - DNA, 201 bp, Bos taurus
ctttttcctccttggataggggagtgggctctaatcatagtggctggtttttctgaggcacagcccccatcctgaagcaatctattccccccaaccaggagttatctcattaacatacaaaaggcagcaaatttctgtggcagaaaccaaaggaaaaggctaaatatttatttaatctttcactgtatcatttagattaaa

SEQ ID NO: 41809 - DNA, 201 bp, Bos taurus; identical to SEQ ID NO: 107

SEQ ID NO: 41810 - DNA, 201 bp, Bos taurus; identical to SEQ ID NO: 108

SEQ ID NO: 41811 - DNA, 201 bp, Bos taurus
tcgcctgggccacgccagccattctgcggcagtgtttgattgctaagttttagctaaaaggatagataaggaggagtatggggcaaattgttcagccagaatttggcctgaggaaagacttcaaaacttgcccctgcaacgctttatacagttttaagctctatcggaagctttgcataaagcgaaatctggggcccattc

SEQ ID NO: 41812 - DNA, 201 bp, Bos taurus; identical to SEQ ID NO: 109

SEQ ID NO: 41813 - DNA, 201 bp, Bos taurus; identical to SEQ ID NO: 110

SEQ ID NO: 41814 - DNA, 201 bp, Bos taurus; identical to SEQ ID NO: 111

SEQ ID NO: 41815 - DNA, 201 bp, Bos taurus; identical to SEQ ID NO: 112

SEQ ID NO: 41816 - DNA, 201 bp, Bos taurus
gcaagggcagaggccttcacttcaacaatctatagaaaacaatgctgtcaacaatcgctgagagagcttggaggaggattctcttcccagctaagccttcagatgagacctcagacttttgggccaatagcttgaatgcaaacctgaatcagaggatccccataagccatgctcatattcctgacacaaagaacttgtgaa

SEQ ID NO: 41817 - DNA, 201 bp, Bos taurus; identical to SEQ ID NO: 113

SEQ ID NO: 41818 - DNA, 201 bp, Bos taurus
attgacagttttggtcagagtaccttggacaaacactttccggaaatattttagatggccctgatctccttcctgtattgaaactgatattgagtacttcttatatactaatctctttaaattacttatgtggattaattttggaatgctcctaaatccccatgaaataagtaaacattttcatcacctttttgctgacgg

SEQ ID NO: 41819 - DNA, 201 bp, Bos taurus; identical to SEQ ID NO: 114

SEQ ID NO: 41820 - DNA, 201 bp, Bos taurus; identical to SEQ ID NO: 115

SEQ ID NO: 41821 - DNA, 201 bp, Bos taurus; identical to SEQ ID NO: 116

SEQ ID NO: 41822 - DNA, 201 bp, Bos taurus; identical to SEQ ID NO: 117

SEQ ID NO: 41823 - DNA, 201 bp, Bos taurus
gtggaatgtcagttccccaacaagggattgaacccatgctcctgcagtgggagcatggggtcttaatggctggacggccagggaagtcccattccacctttttcatgccagtattgtcagttctttcctgtctttgcctgcccagtaggcacctggagcaaaactccaactctgcacttatccctgttcaacggcttcagg

SEQ ID NO: 41824 - DNA, 201 bp, Bos taurus; identical to SEQ ID NO: 118

SEQ ID NO: 41825 - DNA, 201 bp, Bos taurus
gctgaactaagtgtctcatctccataaactcagaggcacaaggtttacagaaactgcaacttcaacattctttgacagtaaatatgactataaatcaaggggtacatttattttcttccagggttctggttttatgccatctgctcacgtggcatcttgcccatttggaacaatgtcagattgtgtaggatagaggtgttg

SEQ ID NO: 41826 - DNA, 201 bp, Bos taurus; identical to SEQ ID NO: 119

SEQ ID NO: 41827 - DNA, 201 bp, Bos taurus; identical to SEQ ID NO: 120

SEQ ID NO: 41828 - DNA, 201 bp, Bos taurus; identical to SEQ ID NO: 121

SEQ ID NO: 41829 - DNA, 201 bp, Bos taurus; identical to SEQ ID NO: 122

SEQ ID NO: 41830 - DNA, 201 bp, Bos taurus
ctatctcttaaaaaagaaaaagaaaaagaaaaaagcagatacaaaagcaaaattcctggtcctaatcacaatgatgtatagtaagccctgtctctgaattcgtggtcttatatctggagcacagtcctctggtcactgagaagtatgggatgtcaatactttctctttgtacttctatacaatgcataaggataagtgtta

SEQ ID NO: 41831 - DNA, 201 bp, Bos taurus; identical to SEQ ID NO: 123

SEQ ID NO: 41832 - DNA, 201 bp, Bos taurus; identical to SEQ ID NO: 124

SEQ ID NO: 41833 - DNA, 201 bp, Bos taurus; identical to SEQ ID NO: 125

SEQ ID NO: 41834 - DNA, 201 bp, Bos taurus; identical to SEQ ID NO: 126

SEQ ID NO: 41835 - DNA, 201 bp, Bos taurus; identical to SEQ ID NO: 127

SEQ ID NO: 41836 - DNA, 201 bp, Bos taurus; identical to SEQ ID NO: 128

SEQ ID NO: 41837 - DNA, 201 bp, Bos taurus; identical to SEQ ID NO: 129

SEQ ID NO: 41838 - DNA, 201 bp, Bos taurus; identical to SEQ ID NO: 130

SEQ ID NO: 41839 - DNA, 201 bp, Bos taurus
gcatctctccagtctccacctctcatcagaaccatgtccagcttgcagatacgtgaacacatgtttcccttcctccccagtactttctggatgtgttccagtccctctggattccaagtctgccttcactttagacactcttctgagttctgagtctcatagttttgagtctgctgtgtccaccctaaaggatttagttcc

SEQ ID NO: 41840 - DNA, 201 bp, Bos taurus
aaatagaccaaagtagtattttagatatattcactttggatagaaagatggtcaaatgatgtatttcctttatcctcgtttaagcaatgcatggatctgtgtctttgaaagaaagggttggagtgaagtagattgactacctttgatttctgttggactgtggagaaggtgaattgaatcaaatggatgtataactttcct

SEQ ID NO: 41841 - DNA, 201 bp, Bos taurus
agagacagaaaattaaaagataggcttgggagatgtctaaatttaggactccctgttactgcttcagatccttactctatgtactttttaaccttcattcgggacctatctagatgttgcccatagacagtaatataaaatagggtcctggcaagaaggaagaaaagatacaagcaattcactcaatcttgcttttctctt

SEQ ID NO: 41842 - DNA, 201 bp, Bos taurus; identical to SEQ ID NO: 131

SEQ ID NO: 41843 - DNA, 201 bp, Bos taurus; identical to SEQ ID NO: 132

SEQ ID NO: 41844 - DNA, 201 bp, Bos taurus
ttacattaaatttttgtccttaaaacaaaagaattaaaggagaatttaattgcaagaatatgaatcaccaaaaacttagtttaattatctcagatggctaaaaagtgttatcctaaatcagtgaaaatagatgtattttctgaacccctataagtactatggggtcaaattatgcaggagggacatgatgtcatactagtg

SEQ ID NO: 41845 - DNA, 201 bp, Bos taurus; identical to SEQ ID NO: 134

SEQ ID NO: 41846 - DNA, 201 bp, Bos taurus; identical to SEQ ID NO: 135

SEQ ID NO: 41847 - DNA, 201 bp, Bos taurus; identical to SEQ ID NO: 136

SEQ ID NO: 41848 - DNA, 201 bp, Bos taurus; identical to SEQ ID NO: 137

SEQ ID NO: 41849 - DNA, 201 bp, Bos taurus; identical to SEQ ID NO: 138

SEQ ID NO: 41850 - DNA, 201 bp, Bos taurus
aagtgccactcccctgagatccccgtgttatgagaagcctgggctatggtggggagaccctggaagatgaggctgcatgtggagagagaggccatggaaccctgagatggcagacatagagtgaagaatctaacttggaagtagatcttgcagccccaaagaccagaagaggccatgtgggttggtgatgaattacccagt

SEQ ID NO: 41851 - DNA, 201 bp, Bos taurus; identical to SEQ ID NO: 139

SEQ ID NO: 41852 - DNA, 201 bp, Bos taurus
ccttcctcatgttctgtacacttagatataatgggatattgctgttacctacccaagtctttcagagaaggcaaatgaatcttccatttggaactgggtcccatctagcagtttgattatatttgaaagagaggactaatcttaaaatgttagttcatttgtaagtcaagctgtgtgtgtgtgtgtgctcagtcatgtccg

SEQ ID NO: 41853 - DNA, 201 bp, Bos taurus
ggctcatactaccacctgagctccacctcctgacaggaggggcataataaatataatgcacttgaatcatcctaaaaccatcctccctgcctccccactcccaccagtccatggaaatattgtcttccatgaaaccggtccctgcagccaaaaagtttggagaccacagtcttagagaacccagtggaggaaatcagtaaa

SEQ ID NO: 41854 - DNA, 201 bp, Bos taurus
tcttagtagacacacacacacatttattgggccagacctctctgttgcctccctactatgggattctgtgagcctataatttcttcatttgattaccacacgaagggcctgcccttaaacatctttcttcataatgtttttgctacacttgttgccagaaagtctttctgaatacatatagcatgatcatgaaccaacgct

SEQ ID NO: 41855 - DNA, 201 bp, Bos taurus; identical to SEQ ID NO: 140

SEQ ID NO: 41856 - DNA, 201 bp, Bos taurus; identical to SEQ ID NO: 141

SEQ ID NO: 41857 - DNA, 201 bp, Bos taurus; identical to SEQ ID NO: 142

SEQ ID NO: 41858 - DNA, 201 bp, Bos taurus
atatttaagttttgtggatctgtgacttttacatcaattagaccactcaggttaaccacataataaatttagctaaaaaatgccattcttgataaattatagtttctttccatccattaaaatcaaagtattttatgatataccacaaaagtgaatcaaattttgtttcaataattaaacttctccagaattgacatggac

SEQ ID NO: 41859 - DNA, 201 bp, Bos taurus
cactcctttaaataaatactcctttaaatagaaatctccttcataaaatagaggaactctagctgtgagactaaaaaaatatcatagagacttcctgaaaaaaatatgaatctctaacaaaatttatatgggagtctatttttttctaaattcttcctttgaacatatggaaatgggataatttataaaagcctgacctca

SEQ ID NO: 41860 - DNA, 201 bp, Bos taurus
atatagacacgcacagagagaagactatgcgaatacagaagcaaagatcctagtgaggcagctataagccaaggaatgccaatggccacaagaaactagaagaagtgaggaaggattctcccctggagcctttagagggagtgtgaccctctcaacaccttggttcaagacctctgtctggcctctataactgtgatggaa

SEQ ID NO: 41861 - DNA, 201 bp, Bos taurus
ttaccttctccaggggatctttctgacccagggatccaacctgggtctgccgcattgcatgcagattctttactgtctgaaccactaagggatatcacatcttttaatgcagaaacatccctgtcattttgatggtttgttcttttattatcaaagatttagattgtatccttagctcatgttagtataagaagaactgat

SEQ ID NO: 41862 - DNA, 201 bp, Bos taurus; identical to SEQ ID NO: 144

SEQ ID NO: 41863 - DNA, 201 bp, Bos taurus; identical to SEQ ID NO: 145

SEQ ID NO: 41864 - DNA, 201 bp, Bos taurus; identical to SEQ ID NO: 146

SEQ ID NO: 41865 - DNA, 201 bp, Bos taurus
gcctgcgtatacttacctgagtagaaaaagatctttcacctattttatttaggctttcatttctcaaattttaactaggagctaagtgtaatttgaaactaggatgcactagttttgctccaaagaagtataattattcaaattatctgcattaaaagtgtaaaccttttaaagcaaagcgttacttaatttaaaagagag

SEQ ID NO: 41866 - DNA, 201 bp, Bos taurus; identical to SEQ ID NO: 148

SEQ ID NO: 41867 - DNA, 201 bp, Bos taurus; identical to SEQ ID NO: 149

SEQ ID NO: 41868 - DNA, 201 bp, Bos taurus; identical to SEQ ID NO: 150

SEQ ID NO: 41869 - DNA, 201 bp, Bos taurus; identical to SEQ ID NO: 151

SEQ ID NO: 41870 - DNA, 201 bp, Bos taurus; identical to SEQ ID NO: 152

SEQ ID NO: 41871 - DNA, 201 bp, Bos taurus; identical to SEQ ID NO: 153

SEQ ID NO: 41872 - DNA, 201 bp, Bos taurus; identical to SEQ ID NO: 154

SEQ ID NO: 41873 - DNA, 201 bp, Bos taurus; identical to SEQ ID NO: 155

SEQ ID NO: 41874 - DNA, 201 bp, Bos taurus; identical to SEQ ID NO: 157

SEQ ID NO: 41875 - DNA, 201 bp, Bos taurus; identical to SEQ ID NO: 158

SEQ ID NO: 41876 - DNA, 201 bp, Bos taurus; identical to SEQ ID NO: 159

SEQ ID NO: 41877 - DNA, 201 bp, Bos taurus; identical to SEQ ID NO: 160

SEQ ID NO: 41878 - DNA, 201 bp, Bos taurus; identical to SEQ ID NO: 161

SEQ ID NO: 41879 - DNA, 201 bp, Bos taurus; identical to SEQ ID NO: 162

SEQ ID NO: 41880 - DNA, 201 bp, Bos taurus; identical to SEQ ID NO: 163

SEQ ID NO: 41881 - DNA, 201 bp, Bos taurus; identical to SEQ ID NO: 164

SEQ ID NO: 41882 - DNA, 201 bp, Bos taurus; identical to SEQ ID NO: 168

SEQ ID NO: 41883 - DNA, 201 bp, Bos taurus; identical to SEQ ID NO: 169

SEQ ID NO: 41884 - DNA, 201 bp, Bos taurus; identical to SEQ ID NO: 170

SEQ ID NO: 41885 - DNA, 201 bp, Bos taurus; identical to SEQ ID NO: 171

SEQ ID NO: 41886 - DNA, 201 bp, Bos taurus; identical to SEQ ID NO: 173

SEQ ID NO: 41887 - DNA, 201 bp, Bos taurus
ctgacaatacttccatctcagaagttaaaatactgttagacagagaagaccttatgccctccaaagtaaagatttcagcatgtatccttcagataatagacaacacacacaaaaaaatcacatacaagtatgtatacaatagagaaaggttatggaacagggtcccatacattttaaaagtggtcttaaattgctactgct

SEQ ID NO: 41888 - DNA, 201 bp, Bos taurus
ttcatgttagactggaggctatttaaaacatattaactctaaaataggttagaaatgacaaatatgatcatgcatacagtcattctcaactttatgccagtggaaacaggatcaacatctgcagcacagtaatttctgagtctagacctggcttcagagtactactctgtacatcaaacagaggttagtccaaacaagtat

SEQ ID NO: 41889 - DNA, 201 bp, Bos taurus; identical to SEQ ID NO: 175

SEQ ID NO: 41890 - DNA, 201 bp, Bos taurus; identical to SEQ ID NO: 178

SEQ ID NO: 41891 - DNA, 201 bp, Bos taurus; identical to SEQ ID NO: 179

SEQ ID NO: 41892 - DNA, 201 bp, Bos taurus; identical to SEQ ID NO: 180

SEQ ID NO: 41893 - DNA, 201 bp, Bos taurus; identical to SEQ ID NO: 181

SEQ ID NO: 41894 - DNA, 201 bp, Bos taurus; identical to SEQ ID NO: 182

SEQ ID NO: 41895 - DNA, 201 bp, Bos taurus
cagaaataatcagtcaatgataatcagagataatttccagtgatcaaggtttttaattagaagcagcagttatgctatcaaaagtggtggtgtccttttgtagaggaaagatctggaagacaattctatagtttcatttttattgtagtattttagaataattttaggacctggggaatctaaggagtttatagtatctgc

SEQ ID NO: 41896 - DNA, 201 bp, Bos taurus; identical to SEQ ID NO: 183

SEQ ID NO: 41897 - DNA, 201 bp, Bos taurus; identical to SEQ ID NO: 186

SEQ ID NO: 41898 - DNA, 201 bp, Bos taurus; identical to SEQ ID NO: 187

SEQ ID NO: 41899 - DNA, 201 bp, Bos taurus
caggggtatcttattgtgaaaatcctgtgattgatagctgttgggaaacaggacaaggagattttttacatctgtttactgccttgaagtttctccattccatcccacactgactgttgtctttcatagaagagctagaatttctacccttccgatgcagatgccacagagccacaaagttgtagggcaaaatgaaatgat

SEQ ID NO: 41900 - DNA, 201 bp, Bos taurus; identical to SEQ ID NO: 188

SEQ ID NO: 41901 - DNA, 201 bp, Bos taurus; identical to SEQ ID NO: 190

SEQ ID NO: 41902 - DNA, 201 bp, Bos taurus; identical to SEQ ID NO: 191

SEQ ID NO: 41903 - DNA, 201 bp, Bos taurus
ggtttttaataccacagcacctagagtcttgtcaaatatcatcttgttaatttttctataaagattttttctaacggtaggaatgttactgtttagctgtgcacactgcttgttcatgtataataattattaaaaggcaacttgaatcaggaatctatgcaatttttaaaaatgtgtatttcaaaaacttgtatcagtgca

SEQ ID NO: 41904 - DNA, 201 bp, Bos taurus; identical to SEQ ID NO: 192

SEQ ID NO: 41905 - DNA, 201 bp, Bos taurus; identical to SEQ ID NO: 193

SEQ ID NO: 41906 - DNA, 201 bp, Bos taurus; identical to SEQ ID NO: 194

SEQ ID NO: 41907 - DNA, 201 bp, Bos taurus; identical to SEQ ID NO: 195

SEQ ID NO: 41908 - DNA, 201 bp, Bos taurus; identical to SEQ ID NO: 196

SEQ ID NO: 41909 - DNA, 201 bp, Bos taurus; identical to SEQ ID NO: 197

SEQ ID NO: 41910 - DNA, 201 bp, Bos taurus; identical to SEQ ID NO: 198

SEQ ID NO: 41911 - DNA, 201 bp, Bos taurus
aataccaaggtagtaattttgcctctcctttagtaaaacattttgaaattttatagaatatgacagtcaaaggaaaaagatcctctcaaactgttggccaaagtgtaacatcttgaggaaactatttgtaaatttatgttgagtaacatatcctaagagaattagaaagatcagtaaaaatatacctatgaagattttttt

SEQ ID NO: 41912 - DNA, 201 bp, Bos taurus
ttaactatcttaattttactcattgcagaagctgcaatcttgagaagttaagtaattatcattcatttattctacatacatgcttgtgggaaatttgctaattgttgcaaaagaacaaagaatacatgtactaaagttttgtaataaacactcaaaatattttcacataacagacaccttcttttaaatgaaaatagtctt

SEQ ID NO: 41913 - DNA, 201 bp, Bos taurus; identical to SEQ ID NO: 199

SEQ ID NO: 41914 - DNA, 201 bp, Bos taurus; identical to SEQ ID NO: 200

SEQ ID NO: 41915 - DNA, 201 bp, Bos taurus; identical to SEQ ID NO: 202

SEQ ID NO: 41916 - DNA, 201 bp, Bos taurus; identical to SEQ ID NO: 203

SEQ ID NO: 41917 - DNA, 201 bp, Bos taurus; identical to SEQ ID NO: 204

SEQ ID NO: 41918 - DNA, 201 bp, Bos taurus; identical to SEQ ID NO: 205

SEQ ID NO: 41919 - DNA, 201 bp, Bos taurus; identical to SEQ ID NO: 206

SEQ ID NO: 41920 - DNA, 201 bp, Bos taurus; identical to SEQ ID NO: 207

SEQ ID NO: 41921 - DNA, 201 bp, Bos taurus
tccaagctctcttgactatttcaatagtcttgatctctactaaatagtcttgaataaaatgttcattccctaactccatctgcttaaggcaatgtttctttgacaaaatgcaggactgacaaacaagtgaaaaaaactaatttgagagagggtaaaaagagctggtcagtttagtcagttcactctctcagtcgtgtccga

SEQ ID NO: 41922 - DNA, 201 bp, Bos taurus; identical to SEQ ID NO: 209

SEQ ID NO: 41923 - DNA, 201 bp, Bos taurus
taaagctggccttggtcccatcattcctctcttgcttgttcctcttcagccatgcatgccatcttgcaggttctgctgtactctatgcaaactacctcaccagggcctttgtacttgctcttgtctcttccatctgaagtgctcttgatgaaaatgtgcacatggttctccagctccatttcttgggtcttggctcaagga

SEQ ID NO: 41924 - DNA, 201 bp, Bos taurus; identical to SEQ ID NO: 212

SEQ ID NO: 41925 - DNA, 201 bp, Bos taurus; identical to SEQ ID NO: 215

SEQ ID NO: 41926 - DNA, 201 bp, Bos taurus; identical to SEQ ID NO: 216

SEQ ID NO: 41927 - DNA, 201 bp, Bos taurus; identical to SEQ ID NO: 217

SEQ ID NO: 41928 - DNA, 201 bp, Bos taurus
agtcaacaacaacaagaatataagaatatgatgaaagccaaaattgacattctacatgtgacaaattctacctgtacatatcatgagaaattaagctttggggatcatttttctttaagtattataattagtatgtctaagtacaatcagtcaaattctcctaggatttgatttcctatgatttcctactggagagaggga

SEQ ID NO: 41929 - DNA, 201 bp, Bos taurus; identical to SEQ ID NO: 218

SEQ ID NO: 41930 - DNA, 201 bp, Bos taurus; identical to SEQ ID NO: 219

SEQ ID NO: 41931 - DNA, 201 bp, Bos taurus; identical to SEQ ID NO: 220

SEQ ID NO: 41932 - DNA, 201 bp, Bos taurus
aaaagggtggcctcagaaccagtaatttatcaatctacccctcatacctcaaaagccagatacatccaattattccacaagctacacaaaggaaaaattaaacaaagccaaaaaacgggccatcaacagaaatctagaaggccatagatggctagttaatgaacatggacaatatttctttcttcaaatacagctttgtca

SEQ ID NO: 41933 - DNA, 201 bp, Bos taurus; identical to SEQ ID NO: 221

SEQ ID NO: 41934 - DNA, 201 bp, Bos taurus
ctggaagaacatggacatggggaaaccttaaagagtaaaacagattaaaattaaggagtggttatagaacaagaagtctgtacagttaatacatatcaaagcagaacattaagaaggaaacacattgagcattgtgcaatgcaatgcagaattgagaaacgcaacagctaactggttcacaagtggcaacctgaaagggta

SEQ ID NO: 41935 - DNA, 201 bp, Bos taurus
gaaaaataatgagaaaagagagcagatgctcatccaccacccatgaccaatatggtttatgcagactcttgatgacaaataagaggatcttgaaagtctccttataagctttcaaggatgcatttacttatgcttagtaaagtttatataaataaaatctaggtaccatatctcacctatatcccctttgatcgcttccaa

SEQ ID NO: 41936 - DNA, 201 bp, Bos taurus; identical to SEQ ID NO: 222

SEQ ID NO: 41937 - DNA, 201 bp, Bos taurus; identical to SEQ ID NO: 223

SEQ ID NO: 41938 - DNA, 201 bp, Bos taurus
ctggttacatacaagagaactctcataagactatcaactgacttagcagcagaaactttgcaggccagtaaagtttattgctggcaaggtatattaaagttcatgtagtcatctccaactccttgcaacccctttccaggctcttctgtccatggaattttcgaggcaagaatactggagtgggttaccatttccttctcc

SEQ ID NO: 41939 - DNA, 201 bp, Bos taurus
tcaaggccccattgatctggcacttgcctcctttctaggatcagttttgctaattgctatgcacacttcagttctaatcaaccacttaacctctccagagcaactccttctgcctggaatgttcctctctctcagaggccaatactttctgtttttaggttcaaattaagacttccctcctccacatagtattataactcc

SEQ ID NO: 41940 - DNA, 201 bp, Bos taurus; identical to SEQ ID NO: 227

SEQ ID NO: 41941 - DNA, 201 bp, Bos taurus; identical to SEQ ID NO: 230

SEQ ID NO: 41942 - DNA, 201 bp, Bos taurus; identical to SEQ ID NO: 231

SEQ ID NO: 41943 - DNA, 201 bp, Bos taurus
ttataataagccctgtgttatacccaaaatgagttgtagaaaacttcctgaacaccttttattctctcaagtacatgcttttgctaatgaaagtctctccgcagagaatctccccactatcaacaaccccatctttatttacaactgaaatggtggtctttctttcagatctttctcaaatgttatagctatcatgatgga

SEQ ID NO: 41944 - DNA, 201 bp, Bos taurus; identical to SEQ ID NO: 233

SEQ ID NO: 41945 - DNA, 201 bp, Bos taurus; identical to SEQ ID NO: 234

SEQ ID NO: 41946 - DNA, 201 bp, Bos taurus; identical to SEQ ID NO: 235

SEQ ID NO: 41947 - DNA, 201 bp, Bos taurus; identical to SEQ ID NO: 236

SEQ ID NO: 41948 - DNA, 201 bp, Bos taurus; identical to SEQ ID NO: 237

SEQ ID NO: 41949 - DNA, 201 bp, Bos taurus; identical to SEQ ID NO: 238

SEQ ID NO: 41950 - DNA, 201 bp, Bos taurus
tcttggagctttggcagtgggatctgttggcagctctgttatcctaggccgtctttgcctgtgtccttgagttcctagacaacctggaaaactgacatgcatatacccacagtctttgctgggcctttaatggggatattttctctgttaccattttttcccctccttccggttgacaaggtcttcccctgcctgtgactt

SEQ ID NO: 41951 - DNA, 201 bp, Bos taurus; identical to SEQ ID NO: 242

SEQ ID NO: 41952 - DNA, 201 bp, Bos taurus
ggaccataacgtactgtaaaatttgaggtatgctcaaacaccatggtgtctttaataacaagaaagcacgctgaactatagagccatatgttttatcacagcacattaatgaccacatgctagagaagaaattggaaaaaaaccatcagctatggcaatgactcaaacattctctattccagtcttcagaataccagtatg

SEQ ID NO: 41953 - DNA, 201 bp, Bos taurus
cgtcttaaataatgacttgaatcttggctgcaattataagataagatttttctcataaccttttcacaatggattttcatcagctcctttataaaggaaattaaaatttgcatttaactttaagctcatgtatccgaaactggacccaccattggcacattcagacatggtattttaaaaagaataaaatttgctttatag

SEQ ID NO: 41954 - DNA, 201 bp, Bos taurus; identical to SEQ ID NO: 244

SEQ ID NO: 41955 - DNA, 201 bp, Bos taurus; identical to SEQ ID NO: 246

SEQ ID NO: 41956 - DNA, 201 bp, Bos taurus; identical to SEQ ID NO: 247

SEQ ID NO: 41957 - DNA, 201 bp, Bos taurus; identical to SEQ ID NO: 248

SEQ ID NO: 41958 - DNA, 201 bp, Bos taurus; identical to SEQ ID NO: 250

SEQ ID NO: 41959 - DNA, 201 bp, Bos taurus; identical to SEQ ID NO: 251

SEQ ID NO: 41960 - DNA, 201 bp, Bos taurus
aactaataaggacctactgtatggcatagggagctctactcagtactcggtcatgaactacgggaaaagaattaaaatgaagagtgaatacatgtatgtgtataacagagtcaccatgctgtacacccaaaacgaacacaacagtgtaaagttattaaaaaaattttaactcttgtgttagacttgaataaatcacattct

SEQ ID NO: 41961 - DNA, 201 bp, Bos taurus; identical to SEQ ID NO: 253

SEQ ID NO: 41962 - DNA, 201 bp, Bos taurus; identical to SEQ ID NO: 254

SEQ ID NO: 41963 - DNA, 201 bp, Bos taurus; identical to SEQ ID NO: 256

SEQ ID NO: 41964 - DNA, 201 bp, Bos taurus; identical to SEQ ID NO: 257

SEQ ID NO: 41965 - DNA, 201 bp, Bos taurus; identical to SEQ ID NO: 258

SEQ ID NO: 41966 - DNA, 201 bp, Bos taurus; identical to SEQ ID NO: 259

SEQ ID NO: 41967 - DNA, 201 bp, Bos taurus; identical to SEQ ID NO: 260

SEQ ID NO: 41968 - DNA, 201 bp, Bos taurus
attaatgaagaaaacctggtcttctcactggggccatgtccccagaccttgattcaagcaggtaccaccagcatggatgataggctgattcctcctttagttgatgggaaaacaacccagaggccactgtcccctagtacatcatggaaacttctccaccacatcctcctttcatcctgtgaaaacagtgacatccatgcc

SEQ ID NO: 41969 - DNA, 201 bp, Bos taurus; identical to SEQ ID NO: 263

SEQ ID NO: 41970 - DNA, 201 bp, Bos taurus; identical to SEQ ID NO: 264

SEQ ID NO: 41971 - DNA, 201 bp, Bos taurus; identical to SEQ ID NO: 266

SEQ ID NO: 41972 - DNA, 201 bp, Bos taurus; identical to SEQ ID NO: 270

SEQ ID NO: 41973 - DNA, 201 bp, Bos taurus; identical to SEQ ID NO: 275

SEQ ID NO: 41974 - DNA, 201 bp, Bos taurus; identical to SEQ ID NO: 276

SEQ ID NO: 41975 - DNA, 201 bp, Bos taurus; identical to SEQ ID NO: 281

SEQ ID NO: 41976 - DNA, 201 bp, Bos taurus; identical to SEQ ID NO: 282

SEQ ID NO: 41977 - DNA, 201 bp, Bos taurus; identical to SEQ ID NO: 284

SEQ ID NO: 41978 - DNA, 201 bp, Bos taurus; identical to SEQ ID NO: 285

SEQ ID NO: 41979 - DNA, 201 bp, Bos taurus; identical to SEQ ID NO: 286

SEQ ID NO: 41980 - DNA, 201 bp, Bos taurus; identical to SEQ ID NO: 288

SEQ ID NO: 41981 - DNA, 201 bp, Bos taurus; identical to SEQ ID NO: 289

SEQ ID NO: 41982 - DNA, 201 bp, Bos taurus; identical to SEQ ID NO: 291

SEQ ID NO: 41983 - DNA, 201 bp, Bos taurus; identical to SEQ ID NO: 292

SEQ ID NO: 41984 - DNA, 201 bp, Bos taurus; identical to SEQ ID NO: 294

SEQ ID NO: 41985 - DNA, 201 bp, Bos taurus; identical to SEQ ID NO: 295

SEQ ID NO: 41986 - DNA, 201 bp, Bos taurus; identical to SEQ ID NO: 298

SEQ ID NO: 41987 - DNA, 201 bp, Bos taurus; identical to SEQ ID NO: 299

SEQ ID NO: 41988 - DNA, 201 bp, Bos taurus; identical to SEQ ID NO: 300

SEQ ID NO: 41989 - DNA, 201 bp, Bos taurus; identical to SEQ ID NO: 305

SEQ ID NO: 41990 - DNA, 201 bp, Bos taurus; identical to SEQ ID NO: 306

SEQ ID NO: 41991 - DNA, 201 bp, Bos taurus; identical to SEQ ID NO: 307

SEQ ID NO: 41992 - DNA, 201 bp, Bos taurus; identical to SEQ ID NO: 308

SEQ ID NO: 41993 - DNA, 201 bp, Bos taurus; identical to SEQ ID NO: 309

SEQ ID NO: 41994 - DNA, 201 bp, Bos taurus; identical to SEQ ID NO: 310

SEQ ID NO: 41995 - DNA, 201 bp, Bos taurus; identical to SEQ ID NO: 313

SEQ ID NO: 41996 - DNA, 201 bp, Bos taurus; identical to SEQ ID NO: 315

SEQ ID NO: 41997 - DNA, 201 bp, Bos taurus; identical to SEQ ID NO: 316

SEQ ID NO: 41998 - DNA, 201 bp, Bos taurus; identical to SEQ ID NO: 317

SEQ ID NO: 41999 - DNA, 201 bp, Bos taurus; identical to SEQ ID NO: 318

SEQ ID NO: 42000 - DNA, 201 bp, Bos taurus; identical to SEQ ID NO: 323

SEQ ID NO: 42001 - DNA, 201 bp, Bos taurus; identical to SEQ ID NO: 324

SEQ ID NO: 42002 - DNA, 201 bp, Bos taurus; identical to SEQ ID NO: 325

SEQ ID NO: 42003 - DNA, 201 bp, Bos taurus; identical to SEQ ID NO: 326

SEQ ID NO: 42004 - DNA, 201 bp, Bos taurus; identical to SEQ ID NO: 327

SEQ ID NO: 42005 - DNA, 201 bp, Bos taurus; identical to SEQ ID NO: 331

SEQ ID NO: 42006 - DNA, 201 bp, Bos taurus; identical to SEQ ID NO: 333

SEQ ID NO: 42007 - DNA, 201 bp, Bos taurus; identical to SEQ ID NO: 336

SEQ ID NO: 42008 - DNA, 201 bp, Bos taurus; identical to SEQ ID NO: 338

SEQ ID NO: 42009 - DNA, 201 bp, Bos taurus; identical to SEQ ID NO: 340

SEQ ID NO: 42010 - DNA, 201 bp, Bos taurus; identical to SEQ ID NO: 341

SEQ ID NO: 42011 - DNA, 201 bp, Bos taurus; identical to SEQ ID NO: 343

SEQ ID NO: 42012 - DNA, 201 bp, Bos taurus; identical to SEQ ID NO: 349

SEQ ID NO: 42013 - DNA, 201 bp, Bos taurus; identical to SEQ ID NO: 350

SEQ ID NO: 42014 - DNA, 201 bp, Bos taurus; identical to SEQ ID NO: 351

SEQ ID NO: 42015 - DNA, 201 bp, Bos taurus; identical to SEQ ID NO: 353

SEQ ID NO: 42016 - DNA, 201 bp, Bos taurus; identical to SEQ ID NO: 354

SEQ ID NO: 42017 - DNA, 201 bp, Bos taurus; identical to SEQ ID NO: 355

SEQ ID NO: 42018 - DNA, 201 bp, Bos taurus; identical to SEQ ID NO: 356

SEQ ID NO: 42019 - DNA, 201 bp, Bos taurus; identical to SEQ ID NO: 358

SEQ ID NO: 42020 - DNA, 201 bp, Bos taurus; identical to SEQ ID NO: 360

SEQ ID NO: 42021 - DNA, 201 bp, Bos taurus; identical to SEQ ID NO: 361

SEQ ID NO: 42022 - DNA, 201 bp, Bos taurus; identical to SEQ ID NO: 363

SEQ ID NO: 42023 - DNA, 201 bp, Bos taurus; identical to SEQ ID NO: 368

SEQ ID NO: 42024 - DNA, 201 bp, Bos taurus; identical to SEQ ID NO: 369

SEQ ID NO: 42025 - DNA, 201 bp, Bos taurus; identical to SEQ ID NO: 370

SEQ ID NO: 42026 - DNA, 201 bp, Bos taurus; identical to SEQ ID NO: 371

SEQ ID NO: 42027 - DNA, 201 bp, Bos taurus; identical to SEQ ID NO: 374

SEQ ID NO: 42028 - DNA, 201 bp, Bos taurus; identical to SEQ ID NO: 375

SEQ ID NO: 42029 - DNA, 201 bp, Bos taurus; identical to SEQ ID NO: 376

SEQ ID NO: 42030 - DNA, 201 bp, Bos taurus; identical to SEQ ID NO: 377

SEQ ID NO: 42031 - DNA, 201 bp, Bos taurus; identical to SEQ ID NO: 378

SEQ ID NO: 42032 - DNA, 201 bp, Bos taurus; identical to SEQ ID NO: 380

SEQ ID NO: 42033 - DNA, 201 bp, Bos taurus; identical to SEQ ID NO: 381

SEQ ID NO: 42034 - DNA, 201 bp, Bos taurus; identical to SEQ ID NO: 382

SEQ ID NO: 42035 - DNA, 201 bp, Bos taurus; identical to SEQ ID NO: 383

SEQ ID NO: 42036 - DNA, 201 bp, Bos taurus; identical to SEQ ID NO: 384

SEQ ID NO: 42037 - DNA, 201 bp, Bos taurus; identical to SEQ ID NO: 386

SEQ ID NO: 42038 - DNA, 201 bp, Bos taurus; identical to SEQ ID NO: 387

SEQ ID NO: 42039 - DNA, 201 bp, Bos taurus; identical to SEQ ID NO: 388

SEQ ID NO: 42040 - DNA, 201 bp, Bos taurus; identical to SEQ ID NO: 389

SEQ ID NO: 42041 - DNA, 201 bp, Bos taurus; identical to SEQ ID NO: 390

SEQ ID NO: 42042 - DNA, 201 bp, Bos taurus; identical to SEQ ID NO: 392

SEQ ID NO: 42043 - DNA, 201 bp, Bos taurus; identical to SEQ ID NO: 396

SEQ ID NO: 42044 - DNA, 201 bp, Bos taurus; identical to SEQ ID NO: 397

SEQ ID NO: 42045 - DNA, 201 bp, Bos taurus; identical to SEQ ID NO: 399

SEQ ID NO: 42046 - DNA, 201 bp, Bos taurus; identical to SEQ ID NO: 400

SEQ ID NO: 42047 - DNA, 201 bp, Bos taurus; identical to SEQ ID NO: 402

SEQ ID NO: 42048 - DNA, 201 bp, Bos taurus; identical to SEQ ID NO: 403

SEQ ID NO: 42049 - DNA, 201 bp, Bos taurus; identical to SEQ ID NO: 407

SEQ ID NO: 42050 - DNA, 201 bp, Bos taurus; identical to SEQ ID NO: 411

SEQ ID NO: 42051 - DNA, 201 bp, Bos taurus; identical to SEQ ID NO: 412

SEQ ID NO: 42052 - DNA, 201 bp, Bos taurus; identical to SEQ ID NO: 413

SEQ ID NO: 42053 - DNA, 201 bp, Bos taurus; identical to SEQ ID NO: 415

SEQ ID NO: 42054 - DNA, 201 bp, Bos taurus; identical to SEQ ID NO: 417

SEQ ID NO: 42055 - DNA, 201 bp, Bos taurus; identical to SEQ ID NO: 419

SEQ ID NO: 42056 - DNA, 201 bp, Bos taurus; identical to SEQ ID NO: 420

SEQ ID NO: 42057 - DNA, 201 bp, Bos taurus; identical to SEQ ID NO: 421

SEQ ID NO: 42058 - DNA, 201 bp, Bos taurus; identical to SEQ ID NO: 422

SEQ ID NO: 42059 - DNA, 201 bp, Bos taurus; identical to SEQ ID NO: 423

SEQ ID NO: 42060 - DNA, 201 bp, Bos taurus; identical to SEQ ID NO: 424

SEQ ID NO: 42061 - DNA, 201 bp, Bos taurus; identical to SEQ ID NO: 425

SEQ ID NO: 42062 - DNA, 201 bp, Bos taurus; identical to SEQ ID NO: 427

SEQ ID NO: 42063 - DNA, 201 bp, Bos taurus; identical to SEQ ID NO: 428

SEQ ID NO: 42064 - DNA, 201 bp, Bos taurus; identical to SEQ ID NO: 429

SEQ ID NO: 42065 - DNA, 201 bp, Bos taurus; identical to SEQ ID NO: 430

SEQ ID NO: 42066 - DNA, 201 bp, Bos taurus; identical to SEQ ID NO: 432

SEQ ID NO: 42067 - DNA, 201 bp, Bos taurus; identical to SEQ ID NO: 433

SEQ ID NO: 42068 - DNA, 201 bp, Bos taurus; identical to SEQ ID NO: 434

SEQ ID NO: 42069 - DNA, 201 bp, Bos taurus; identical to SEQ ID NO: 435

SEQ ID NO: 42070 - DNA, 201 bp, Bos taurus; identical to SEQ ID NO: 441

SEQ ID NO: 42071 - DNA, 201 bp, Bos taurus; identical to SEQ ID NO: 442

SEQ ID NO: 42072 - DNA, 201 bp, Bos taurus; identical to SEQ ID NO: 445

SEQ ID NO: 42073 - DNA, 201 bp, Bos taurus; identical to SEQ ID NO: 448

SEQ ID NO: 42074 - DNA, 201 bp, Bos taurus; identical to SEQ ID NO: 449

SEQ ID NO: 42075 - DNA, 201 bp, Bos taurus; identical to SEQ ID NO: 452

SEQ ID NO: 42076 - DNA, 201 bp, Bos taurus; identical to SEQ ID NO: 453

SEQ ID NO: 42077 - DNA, 201 bp, Bos taurus; identical to SEQ ID NO: 454

SEQ ID NO: 42078 - DNA, 201 bp, Bos taurus; identical to SEQ ID NO: 455

SEQ ID NO: 42079 - DNA, 201 bp, Bos taurus; identical to SEQ ID NO: 457

SEQ ID NO: 42080 - DNA, 201 bp, Bos taurus; identical to SEQ ID NO: 458

SEQ ID NO: 42081 - DNA, 201 bp, Bos taurus; identical to SEQ ID NO: 459

SEQ ID NO: 42082 - DNA, 201 bp, Bos taurus; identical to SEQ ID NO: 460

SEQ ID NO: 42083 - DNA, 201 bp, Bos taurus; identical to SEQ ID NO: 461

SEQ ID NO: 42084 - DNA, 201 bp, Bos taurus; identical to SEQ ID NO: 462

SEQ ID NO: 42085 - DNA, 201 bp, Bos taurus; identical to SEQ ID NO: 463

SEQ ID NO: 42086 - DNA, 201 bp, Bos taurus; identical to SEQ ID NO: 466

SEQ ID NO: 42087 - DNA, 201 bp, Bos taurus; identical to SEQ ID NO: 471

SEQ ID NO: 42088 - DNA, 201 bp, Bos taurus; identical to SEQ ID NO: 472

SEQ ID NO: 42089 - DNA, 201 bp, Bos taurus; identical to SEQ ID NO: 473

SEQ ID NO: 42090 - DNA, 201 bp, Bos taurus; identical to SEQ ID NO: 474

SEQ ID NO: 42091 - DNA, 201 bp, Bos taurus; identical to SEQ ID NO: 475

SEQ ID NO: 42092 - DNA, 201 bp, Bos taurus; identical to SEQ ID NO: 476

SEQ ID NO: 42093 - DNA, 201 bp, Bos taurus; identical to SEQ ID NO: 477

SEQ ID NO: 42094 - DNA, 201 bp, Bos taurus; identical to SEQ ID NO: 482

SEQ ID NO: 42095 - DNA, 201 bp, Bos taurus; identical to SEQ ID NO: 484

SEQ ID NO: 42096 - DNA, 201 bp, Bos taurus; identical to SEQ ID NO: 485

SEQ ID NO: 42097 - DNA, 201 bp, Bos taurus; identical to SEQ ID NO: 486

SEQ ID NO: 42098 - DNA, 201 bp, Bos taurus; identical to SEQ ID NO: 487

SEQ ID NO: 42099 - DNA, 201 bp, Bos taurus; identical to SEQ ID NO: 488

SEQ ID NO: 42100 - DNA, 201 bp, Bos taurus; identical to SEQ ID NO: 489

SEQ ID NO: 42101 - DNA, 201 bp, Bos taurus; identical to SEQ ID NO: 490

SEQ ID NO: 42102 - DNA, 201 bp, Bos taurus; identical to SEQ ID NO: 491

SEQ ID NO: 42103 - DNA, 201 bp, Bos taurus; identical to SEQ ID NO: 493

SEQ ID NO: 42104 - DNA, 201 bp, Bos taurus; identical to SEQ ID NO: 496

SEQ ID NO: 42105 - DNA, 201 bp, Bos taurus
aatgaggatggagtgctactgggcccccactggtacgactccaaagccataccattatttctaacattcagccagtagtaccccaatttcaaccctaagataaaggccacagagtctacactggatttcacaacaaggaggtcactagtgacctggaagagagccgcaccagcaggaggagtggtgggagagatgggaaga

SEQ ID NO: 42106 - DNA, 201 bp, Bos taurus; identical to SEQ ID NO: 497

SEQ ID NO: 42107 - DNA, 201 bp, Bos taurus
ctcctgcactatcaggatctgggacatagaaacacatttggaaagacagaggcttgactttatcacagaaatgaatcccccatgtggaattttaggttactgtttcactgtcaaaactatgaacaggcaactccaacccatactaagaataggccgcccttaagtcctcacttacacagaaactgcaattgaggaaaagtc

SEQ ID NO: 42108 - DNA, 201 bp, Bos taurus; identical to SEQ ID NO: 498

SEQ ID NO: 42109 - DNA, 201 bp, Bos taurus; identical to SEQ ID NO: 499

SEQ ID NO: 42110 - DNA, 201 bp, Bos taurus; identical to SEQ ID NO: 500

SEQ ID NO: 42111 - DNA, 201 bp, Bos taurus; identical to SEQ ID NO: 501

SEQ ID NO: 42112 - DNA, 201 bp, Bos taurus
tgtttcatcgttattattactattattattaaaaagaaaccatttcaacaagtagagatgttaaacttagactggaactgagaaagaacataagttctccggaggccaaaggaaatcccaccccttgtaacaacgtgaatgaaccttgagggcattgggctaagtgaaatcagtcaactagagaaagacaaatactgcgtg

SEQ ID NO: 42113 - DNA, 201 bp, Bos taurus
aagaaaaaggaagtatgactgacgtatgattctcagtagttagcccccaggctcctgtatcttctgtttgcctgcaggttaacagacaatatccttatggttcttccttctgaaacttcttgtaaagtttagcttcttattcctattcccaacttgctcaggaaagagcttggctctgggaataagaggcctttgctggtc

SEQ ID NO: 42114 - DNA, 201 bp, Bos taurus; identical to SEQ ID NO: 502

SEQ ID NO: 42115 - DNA, 201 bp, Bos taurus
cagagacaacaacattccttctcagagccctggtctgtgacaaaatgtgccccgtcctagagcaccccactggggggccagaaccagtggaatgacatatctagaaaacccttacagactgccagtccttcatttacaagaaagggaaactgagatccagtaagaagaaggcactcaaggccacacaatgagtgtagaaat

SEQ ID NO: 42116 - DNA, 201 bp, Bos taurus
aggttcacaggttctggcaggtgggaggcaaaaatgctgttgctactttcagtgggaaaaattgttcagggatgcctgctgcctccctcccaaggggcctatgtttaccaggagtgtgtgtacctggcaggctgaagagcttaccaactagtcatgcccacctatcgcttcctagttctgttggccacaagttcacacatg

SEQ ID NO: 42117 - DNA, 201 bp, Bos taurus
gcctgggcctgaggtttggagcacatggactgcagaaccccctgctcatatccaagtgagaagaaacagcaggtcaggagccagctactctgtaaagccagagccatgtgttttggcctctgtgaccagtgttggaaaggtctggagcatttcatttttacttgagatttttttctgctctgaggtaggagatctgctttg

SEQ ID NO: 42118 - DNA, 201 bp, Bos taurus; identical to SEQ ID NO: 503

SEQ ID NO: 42119 - DNA, 201 bp, Bos taurus; identical to SEQ ID NO: 504

SEQ ID NO: 42120 - DNA, 201 bp, Bos taurus
tgtaattgtgtagactttgatgagacagcttccataaatgttgcccatggagtaacactctcgggcagtgagttcccatttcccctaaggccatatttttataaagtagcagcaggggtatgactttcacatagaccccccataggaagtgctgtcatttcctgtgctgatttatccaacccctggcccacacctccagtt

SEQ ID NO: 42121 - DNA, 201 bp, Bos taurus
tggtggcagagctggaagagaccagggctcctacctcctcgctgaacctctgtaccacactctgcctgctgggcttccgagaagctccagggcctttctctagtctttccttcctgaggctacttaggagtcagtggttgcttgtttcctcttgatatctttgtggcaggactgctggtggggctgtgtgacaaagcagag

SEQ ID NO: 42122 - DNA, 201 bp, Bos taurus; identical to SEQ ID NO: 505

SEQ ID NO: 42123 - DNA, 201 bp, Bos taurus; identical to SEQ ID NO: 506

SEQ ID NO: 42124 - DNA, 201 bp, Bos taurus
tggtgctactgtgacagttatatggtccatggtgctactgtgacttcggcacccagtgctgaagttatgacattgacagatgctttgtctagtggccccagaccaaagaatccagaggacaggggtgcaggcttgtttctccctaccagaaccagaccagtggctcttatcagaaatacttaagcaatttattggccaaca

SEQ ID NO: 42125 - DNA, 201 bp, Bos taurus; identical to SEQ ID NO: 508

SEQ ID NO: 42126 - DNA, 201 bp, Bos taurus; identical to SEQ ID NO: 509

SEQ ID NO: 42127 - DNA, 201 bp, Bos taurus; identical to SEQ ID NO: 510

SEQ ID NO: 42128 - DNA, 201 bp, Bos taurus
actccaggttttactcgatgtgcttttacctgctgatgcaggccatggtggaaggctttggtgggaaggaggcggtgttgaggacactgaaggacaccccggtgatgatccatacaggcccctgctgctgctgttgcccctgctgcccccgaatcaagatcaccaggtgaggcgggagggagaggctgcctggagagcaga

SEQ ID NO: 42129 - DNA, 201 bp, Bos taurus; identical to SEQ ID NO: 511

SEQ ID NO: 42130 - DNA, 201 bp, Bos taurus
tttaaaactgtattcctaaagatgaacagcaaatagtttggaactgtaattttaaaaatatcccattcatgatagtgactaaaaatataaaatatatttacgtatagatttaacaaaaatgcaaaaggtcttgtaaagaaaatgataaactttattgataggcaataaatgaagaaatctactatatttgtgtgtaggaag

SEQ ID NO: 42131 - DNA, 201 bp, Bos taurus; identical to SEQ ID NO: 512

SEQ ID NO: 42132 - DNA, 201 bp, Bos taurus; identical to SEQ ID NO: 513

SEQ ID NO: 42133 - DNA, 201 bp, Bos taurus
gatttttaaagttgtatttctttctgcttcatttctggcacattattttttatctgactgcacttaaatttcatttacaaatcttctgttttgctatacagcttttaacatatgtatatgatgttcctaagaaaaatgttttacattgcctcttagttaccaatctttagtaaaacaagtctgaaagtattactctcattc

SEQ ID NO: 42134 - DNA, 201 bp, Bos taurus
ttacttgaaaaaaaatatttagcttctaaacttgtgacatttacacattcattttgttctgctctttctggcagcatcccttcctgaaactggccaagccgttatccagcttgacaccactgattatggcagctaaagaagcaatgaagagtaaccgttaacatcattgccgcggcctcatattcttttttccattttcta

SEQ ID NO: 42135 - DNA, 201 bp, Bos taurus; identical to SEQ ID NO: 514

SEQ ID NO: 42136 - DNA, 201 bp, Bos taurus
gggacacccccagggaagccgtgatcggacaggacacagccaaggaagaaactccccgaagcctgacagaaaaagataggctcggccctgattcaccgcgagcagagagccatggacctgagtacaaccggagagaggtttaacctcagcaaatgggactaaaactaatgatcgatgctgctgccgctgcattgatgtagc

SEQ ID NO: 42137 - DNA, 201 bp, Bos taurus; identical to SEQ ID NO: 515

SEQ ID NO: 42138 - DNA, 201 bp, Bos taurus
tccaactgttagcactgtatacctcatgcgtacattcagctcaaacagtggattagaaaatcaaattagaacagtctggcctgggcactgctgctcactcaaccccagtgcctccctctttttgctctgctcaccatgtgctcatccagtgcttggtgcctcgcacagcaagactcttgtgtctgctttctgggcccaaga

SEQ ID NO: 42139 - DNA, 201 bp, Bos taurus
tcaaagccttaactggtgtgtatgtgtgcttggggaaggttggagagggtgcactatacaagacattgtgacaataattagggaaagttaaatacagactgttttccagaatatattagagaaaaacttttttgtacaagacatacatgtgtgcaagagtatgtatatacttacgtagcagaacatatatttccatataca

SEQ ID NO: 42140 - DNA, 201 bp, Bos taurus; identical to SEQ ID NO: 516

SEQ ID NO: 42141 - DNA, 201 bp, Bos taurus; identical to SEQ ID NO: 517

SEQ ID NO: 42142 - DNA, 201 bp, Bos taurus; identical to SEQ ID NO: 518

SEQ ID NO: 42143 - DNA, 201 bp, Bos taurus; identical to SEQ ID NO: 519

SEQ ID NO: 42144 - DNA, 201 bp, Bos taurus; identical to SEQ ID NO: 520

SEQ ID NO: 42145 - DNA, 201 bp, Bos taurus; identical to SEQ ID NO: 521

SEQ ID NO: 42146 - DNA, 201 bp, Bos taurus
agaaatggtagatttcatcttataagtgcaaattagtgtgtgtgtgcaagccacattgctttgtgcatgtgtttccttgcacaaaggttgtgagttcatctctgcattcctggccttttctccttttcatatccttctcccgccatttgtcactctggagttgatcactgctccctggagccttcttccagtgtgatggat

SEQ ID NO: 42147 - DNA, 201 bp, Bos taurus; identical to SEQ ID NO: 522

SEQ ID NO: 42148 - DNA, 201 bp, Bos taurus; identical to SEQ ID NO: 523

SEQ ID NO: 42149 - DNA, 201 bp, Bos taurus; identical to SEQ ID NO: 524

SEQ ID NO: 42150 - DNA, 201 bp, Bos taurus; identical to SEQ ID NO: 525

SEQ ID NO: 42151 - DNA, 201 bp, Bos taurus; identical to SEQ ID NO: 526

SEQ ID NO: 42152 - DNA, 201 bp, Bos taurus; identical to SEQ ID NO: 527

SEQ ID NO: 42153 - DNA, 201 bp, Bos taurus; identical to SEQ ID NO: 528

SEQ ID NO: 42154 - DNA, 201 bp, Bos taurus; identical to SEQ ID NO: 529

SEQ ID NO: 42155 - DNA, 201 bp, Bos taurus
agaggccaccctgaggacattgcaaagcaggtgaccacctctgccctgactgcacacgcacagtattccagtggtgtctgccagacccaggcctttacttcagctaacctaccacggaccttcaagcaacaacttatggacaccaactctgcccttcttgctggcctcatttctcttaaaccaagaccaaaatctgggtcc

SEQ ID NO: 42156 - DNA, 201 bp, Bos taurus
tcaatgagttttaatggatttatacagttgtgcaaccacgaccacactcaagctttaaaacgctttcattactgcaaaaatgagcaatccctgatcccactgccagcccctgacaaccacagataagcttgtgtcatcacaattttgccatttctagaaatttcatagaaatagagtcatggagtcttctgtgtctggttt

SEQ ID NO: 42157 - DNA, 201 bp, Bos taurus; identical to SEQ ID NO: 530

SEQ ID NO: 42158 - DNA, 201 bp, Bos taurus
cttcctaataaacacacacaaaaatgaaaacgctttggtgaattgggtgggccagtgattagacatcacaggtgacctagaaagcaggtgttttgttagggatgaaagctagatcacaaaatgtgagcaaaggaatgtgtggatacagagctaaatgcaggacatgtgagctgttccacaagagaaatgagatggcagttt

SEQ ID NO: 42159 - DNA, 201 bp, Bos taurus; identical to SEQ ID NO: 532

SEQ ID NO: 42160 - DNA, 201 bp, Bos taurus; identical to SEQ ID NO: 533

SEQ ID NO: 42161 - DNA, 201 bp, Bos taurus; identical to SEQ ID NO: 534

SEQ ID NO: 42162 - DNA, 201 bp, Bos taurus; identical to SEQ ID NO: 535

SEQ ID NO: 42163 - DNA, 201 bp, Bos taurus
accagggaagtcaagattagagttgttatctctaccaaatactggtagagcaggcagcaagctgttgaatgaggactgaccatacattcaatagtgacttgacaggattgatttcagaggagctgtgggaatgtctaattggagttgatagaagttataacaagagttaaaggaaagaagaaagtaatattaaatgactct

SEQ ID NO: 42164 - DNA, 201 bp, Bos taurus; identical to SEQ ID NO: 536

SEQ ID NO: 42165 - DNA, 201 bp, Bos taurus; identical to SEQ ID NO: 537

SEQ ID NO: 42166 - DNA, 201 bp, Bos taurus; identical to SEQ ID NO: 538

SEQ ID NO: 42167 - DNA, 201 bp, Bos taurus
gcctggggacagggatttttaaaactccctaagtaatttgtgtcagccagggttgagaaacactaacttaagacataacctagagcagttctcctcaatattggccgcacattagaatgtccagggggacttttaaaaatactgttgccaaggccctgtccaagacccaattaaatcagaagctctgtttgaaatcagaag

SEQ ID NO: 42168 - DNA, 201 bp, Bos taurus; identical to SEQ ID NO: 539

SEQ ID NO: 42169 - DNA, 201 bp, Bos taurus
cttcattgatgaagactgtctcaggaactttactagatataatttgaaagccatcagttaagtctcttttctacaatagatccttcaccaagttggccctaaacaagtatgtcttatcttattctatgtcttagttcagttcagttcagtcactcagtcgagtctgactctttgcaaccccatgaactgtgacacgccagg

SEQ ID NO: 42170 - DNA, 201 bp, Bos taurus
tttggggttaaaaaatatgaattttggagggtttttgtttgtttgtttagaattccatgatttgctatgacatacatagtgcacaatcatttatacaagtcgaatgagaaatttacattaacaattttcatgaaagtgaaggtttctcagttatgtctgactctttgtgaccccatgtactatacagtccttggaattctc

SEQ ID NO: 42171 - DNA, 201 bp, Bos taurus; identical to SEQ ID NO: 540

SEQ ID NO: 42172 - DNA, 201 bp, Bos taurus; identical to SEQ ID NO: 546

SEQ ID NO: 42173 - DNA, 201 bp, Bos taurus; identical to SEQ ID NO: 549

SEQ ID NO: 42174 - DNA, 201 bp, Bos taurus; identical to SEQ ID NO: 550

SEQ ID NO: 42175 - DNA, 201 bp, Bos taurus; identical to SEQ ID NO: 553

SEQ ID NO: 42176 - DNA, 201 bp, Bos taurus; identical to SEQ ID NO: 557

SEQ ID NO: 42177 - DNA, 201 bp, Bos taurus
cccctgggctgtgagcggctgtgagccggggctctcaatgggccacttctgcatgctcagcattccctctcagccccagtaggccagcggcccccaccccctgaacgccctccccctccccggtgccccgggctgattggaggaaaggaaaaaaacaaaacaaaacaaagacttggccagatttcaggcctcgatgatgtt

SEQ ID NO: 42178 - DNA, 201 bp, Bos taurus
aggggcctaagactactagcctacttatctattggtatgtgcccaggggcaaaggagaacaaataggtattatttggttggagctgagaatgaatggacatggccagaaatgaacctgtatgtgaaaaatggttttaggaattgttgtttaccttagatcacataaattatgtacattattccataatatatccatgttta

SEQ ID NO: 42179 - DNA, 201 bp, Bos taurus; identical to SEQ ID NO: 560

SEQ ID NO: 42180 - DNA, 201 bp, Bos taurus; identical to SEQ ID NO: 561

SEQ ID NO: 42181 - DNA, 201 bp, Bos taurus; identical to SEQ ID NO: 562

SEQ ID NO: 42182 - DNA, 201 bp, Bos taurus; identical to SEQ ID NO: 563

SEQ ID NO: 42183 - DNA, 201 bp, Bos taurus; identical to SEQ ID NO: 564

SEQ ID NO: 42184 - DNA, 201 bp, Bos taurus; identical to SEQ ID NO: 565

SEQ ID NO: 42185 - DNA, 201 bp, Bos taurus; identical to SEQ ID NO: 566

SEQ ID NO: 42186 - DNA, 201 bp, Bos taurus; identical to SEQ ID NO: 567

SEQ ID NO: 42187 - DNA, 201 bp, Bos taurus; identical to SEQ ID NO: 568

SEQ ID NO: 42188 - DNA, 201 bp, Bos taurus
caccttaaaagggtgaattttatggtatgtgaattatatcttaataaaacttttattatagctaagtgaataatggggggaaacagcttgcattttgcctagttgtgctataatccactgtgccaattgacattcctaccaggtgtgccttagatggtttcaaggtggcacatttgccatcttggctgctttctttgaaat

SEQ ID NO: 42189 - DNA, 201 bp, Bos taurus; identical to SEQ ID NO: 569

SEQ ID NO: 42190 - DNA, 201 bp, Bos taurus; identical to SEQ ID NO: 570

SEQ ID NO: 42191 - DNA, 201 bp, Bos taurus
ctgtgcactgaggttggtggctcatgtctagggtacctgggagtcagtgagagccaagtgcaatcccctggagcctgcatgtctctgactcgaaatcctcgccaaagcagagctgctggaggtggctgtgcagagatgggaagactctcagggctaagccagcagtgccccacaaaggcaccaatgctgtgccccttccca

SEQ ID NO: 42192 - DNA, 201 bp, Bos taurus
cattcatattcttgatacacaaaaaacactaattttgaattatgaatcttgtattccatgttaccctttagacaaggactttttagttccatactatccctaccggtatttattacatcctcagcactggaattgactactggttgcctgttattatcattcttctattgtcaaacaattgtaaatgctattttttatgaa

SEQ ID NO: 42193 - DNA, 201 bp, Bos taurus; identical to SEQ ID NO: 571

SEQ ID NO: 42194 - DNA, 201 bp, Bos taurus; identical to SEQ ID NO: 572

SEQ ID NO: 42195 - DNA, 201 bp, Bos taurus; identical to SEQ ID NO: 573

SEQ ID NO: 42196 - DNA, 201 bp, Bos taurus; identical to SEQ ID NO: 574

SEQ ID NO: 42197 - DNA, 201 bp, Bos taurus; identical to SEQ ID NO: 575

SEQ ID NO: 42198 - DNA, 201 bp, Bos taurus; identical to SEQ ID NO: 576

SEQ ID NO: 42199 - DNA, 201 bp, Bos taurus; identical to SEQ ID NO: 577

SEQ ID NO: 42200 - DNA, 201 bp, Bos taurus
ataagaacttgagttctgcctataagccaacatctgatataagacatgtagttttaaaagcatagagcgtacttggtaggaaaatttggtggtgaaaaaaatttgtttttaaatatgtttgagaaatgttttggtgactcttgcactttctggtatttaagttgaggaaattgaaggccatatggattctgtttctgggct

SEQ ID NO: 42201 - DNA, 201 bp, Bos taurus; identical to SEQ ID NO: 578

SEQ ID NO: 42202 - DNA, 201 bp, Bos taurus; identical to SEQ ID NO: 579

SEQ ID NO: 42203 - DNA, 201 bp, Bos taurus; identical to SEQ ID NO: 580

SEQ ID NO: 42204 - DNA, 201 bp, Bos taurus; identical to SEQ ID NO: 581

SEQ ID NO: 42205 - DNA, 201 bp, Bos taurus; identical to SEQ ID NO: 584

SEQ ID NO: 42206 - DNA, 201 bp, Bos taurus; identical to SEQ ID NO: 585

SEQ ID NO: 42207 - DNA, 201 bp, Bos taurus; identical to SEQ ID NO: 586

SEQ ID NO: 42208 - DNA, 201 bp, Bos taurus; identical to SEQ ID NO: 587

SEQ ID NO: 42209 - DNA, 201 bp, Bos taurus; identical to SEQ ID NO: 588

SEQ ID NO: 42210 - DNA, 201 bp, Bos taurus; identical to SEQ ID NO: 589

SEQ ID NO: 42211 - DNA, 201 bp, Bos taurus; identical to SEQ ID NO: 590

SEQ ID NO: 42212 - DNA, 201 bp, Bos taurus; identical to SEQ ID NO: 591

SEQ ID NO: 42213 - DNA, 201 bp, Bos taurus; identical to SEQ ID NO: 592

SEQ ID NO: 42214 - DNA, 201 bp, Bos taurus; identical to SEQ ID NO: 593

SEQ ID NO: 42215 - DNA, 201 bp, Bos taurus; identical to SEQ ID NO: 594

SEQ ID NO: 42216 - DNA, 201 bp, Bos taurus; identical to SEQ ID NO: 595

SEQ ID NO: 42217 - DNA, 201 bp, Bos taurus; identical to SEQ ID NO: 597

SEQ ID NO: 42218 - DNA, 201 bp, Bos taurus
ctcagtcccaggttgctgaaatgacttgtaggcccaagaacacacattgtgtgtgcatgtatgtgtgtgtgtgtgtgtgtgagagagagagagagagagaaagatgaggccattttgtgagggacctgggggaaaggggagagctctgtaggagaaggaaccagttttctctcctggatccccatgacttgtatgctggag

SEQ ID NO: 42219 - DNA, 201 bp, Bos taurus
gtaaagctttttctgttatctcactgatcatttttatagaggagttgatttggccaaaattagcttaaagctgtttaatgcctggcatgttaaaaaagcaaacctttgttgagtaaatgaatgagggaataaacagttttgtgataccagagagagtcaactgcttatatgaaagaactttaaaggagaataatcctttct

SEQ ID NO: 42220 - DNA, 201 bp, Bos taurus; identical to SEQ ID NO: 600

SEQ ID NO: 42221 - DNA, 201 bp, Bos taurus; identical to SEQ ID NO: 601

SEQ ID NO: 42222 - DNA, 201 bp, Bos taurus; identical to SEQ ID NO: 602

SEQ ID NO: 42223 - DNA, 201 bp, Bos taurus; identical to SEQ ID NO: 603

SEQ ID NO: 42224 - DNA, 201 bp, Bos taurus; identical to SEQ ID NO: 604

SEQ ID NO: 42225 - DNA, 201 bp, Bos taurus; identical to SEQ ID NO: 605

SEQ ID NO: 42226 - DNA, 201 bp, Bos taurus; identical to SEQ ID NO: 606

SEQ ID NO: 42227 - DNA, 201 bp, Bos taurus
aagtcgctgatgccgtctccccttcaagaaccctggatcagccggggctggacctcggcataaagtgtatcatggagaagatgtttaatcaattgaagccggtattactatttctttatgttgtggctttgctgtttaagatacactatccatcattttttcttggtgatctgttatgatacagttcacaagctatggccc

SEQ ID NO: 42228 - DNA, 201 bp, Bos taurus; identical to SEQ ID NO: 608

SEQ ID NO: 42229 - DNA, 201 bp, Bos taurus; identical to SEQ ID NO: 609

SEQ ID NO: 42230 - DNA, 201 bp, Bos taurus
ataaaagtatacacctcaaaggatcgttgtgacctaggcgctgttgaaatatatgtaaggttttcagcacagtacctggtacattttacatgcccagtaagtgattgttattactactagtagtattactaggtacctgtctttgggcaagttattctttctgggtttcaagtacctctcttctaaaatgaggatataatt

SEQ ID NO: 42231 - DNA, 201 bp, Bos taurus; identical to SEQ ID NO: 610

SEQ ID NO: 42232 - DNA, 201 bp, Bos taurus; identical to SEQ ID NO: 611

SEQ ID NO: 42233 - DNA, 201 bp, Bos taurus; identical to SEQ ID NO: 612

SEQ ID NO: 42234 - DNA, 201 bp, Bos taurus; identical to SEQ ID NO: 613

SEQ ID NO: 42235 - DNA, 201 bp, Bos taurus; identical to SEQ ID NO: 614

SEQ ID NO: 42236 - DNA, 201 bp, Bos taurus; identical to SEQ ID NO: 615

SEQ ID NO: 42237 - DNA, 201 bp, Bos taurus; identical to SEQ ID NO: 616

SEQ ID NO: 42238 - DNA, 201 bp, Bos taurus; identical to SEQ ID NO: 617

SEQ ID NO: 42239 - DNA, 201 bp, Bos taurus; identical to SEQ ID NO: 618

SEQ ID NO: 42240 - DNA, 201 bp, Bos taurus; identical to SEQ ID NO: 619

SEQ ID NO: 42241 - DNA, 201 bp, Bos taurus; identical to SEQ ID NO: 620

SEQ ID NO: 42242 - DNA, 201 bp, Bos taurus; identical to SEQ ID NO: 621

SEQ ID NO: 42243 - DNA, 201 bp, Bos taurus; identical to SEQ ID NO: 622

SEQ ID NO: 42244 - DNA, 201 bp, Bos taurus; identical to SEQ ID NO: 623

SEQ ID NO: 42245 - DNA, 201 bp, Bos taurus; identical to SEQ ID NO: 624

SEQ ID NO: 42246 - DNA, 201 bp, Bos taurus; identical to SEQ ID NO: 625

SEQ ID NO: 42247 - DNA, 201 bp, Bos taurus; identical to SEQ ID NO: 626

SEQ ID NO: 42248 - DNA, 201 bp, Bos taurus; identical to SEQ ID NO: 627

SEQ ID NO: 42249 - DNA, 201 bp, Bos taurus; identical to SEQ ID NO: 628

SEQ ID NO: 42250 - DNA, 201 bp, Bos taurus; identical to SEQ ID NO: 629

SEQ ID NO: 42251 - DNA, 201 bp, Bos taurus; identical to SEQ ID NO: 630

SEQ ID NO: 42252 - DNA, 201 bp, Bos taurus; identical to SEQ ID NO: 631

SEQ ID NO: 42253 - DNA, 201 bp, Bos taurus; identical to SEQ ID NO: 632

SEQ ID NO: 42254 - DNA, 201 bp, Bos taurus; identical to SEQ ID NO: 633

SEQ ID NO: 42255 - DNA, 201 bp, Bos taurus; identical to SEQ ID NO: 634

SEQ ID NO: 42256 - DNA, 201 bp, Bos taurus; identical to SEQ ID NO: 635

SEQ ID NO: 42257 - DNA, 201 bp, Bos taurus; identical to SEQ ID NO: 636

SEQ ID NO: 42258 - DNA, 201 bp, Bos taurus
cgtgcctccattttgtcagtaatgcctaacgtggctcccgacagatattattttctttccattttgtgggtgaaaatacaaaaaaaaaaaaaaaagcttacgaagagaacctgcaatggttatcagctattcgttttcagatttattatgtatagcctgtgtcattctgtaactccaactcatattactagagttgcttcc

SEQ ID NO: 42259 - DNA, 201 bp, Bos taurus; identical to SEQ ID NO: 637

SEQ ID NO: 42260 - DNA, 201 bp, Bos taurus
ccattttctttggttcatcctttttccaggtcacttaaagaacaggacatttgagggcattttgataacacaactgaatggaactgccttaccaaaatatcccagagttaataaatattgaattttacaggattttctttagacttagtacactctgactatatacatttgggaatatagttgaaattctgtgtgaatgta

SEQ ID NO: 42261 - DNA, 201 bp, Bos taurus; identical to SEQ ID NO: 638

SEQ ID NO: 42262 - DNA, 201 bp, Bos taurus
tttcaaatattttctcacatcattggccatcatgtttttatcaaacctgttttccccccttagaatatattgattggaatggaattattgggtcaaaatgagattactttaaggccttcaatacatactgacaaatcatcctacaaaacactagtatcaatgttatcaatgtatattttcaagactatcttaaaattctgg

SEQ ID NO: 42263 - DNA, 201 bp, Bos taurus; identical to SEQ ID NO: 639

SEQ ID NO: 42264 - DNA, 201 bp, Bos taurus; identical to SEQ ID NO: 640

SEQ ID NO: 42265 - DNA, 201 bp, Bos taurus; identical to SEQ ID NO: 641

SEQ ID NO: 42266 - DNA, 201 bp, Bos taurus; identical to SEQ ID NO: 642

SEQ ID NO: 42267 - DNA, 201 bp, Bos taurus
ccatgaaattcaagatggataaaagtcaatgtttcaggctcatctacttccagctttctttctataatgaggtaaaaacaagctttaagtgtgtttaaagactcttctagtttaaaaaagaaagaaaaagaaaaatagctttatcagtttctgtatcaagttctaaaagatagtttctattccaatatgctaaagattatt

SEQ ID NO: 42268 - DNA, 201 bp, Bos taurus; identical to SEQ ID NO: 643

SEQ ID NO: 42269 - DNA, 201 bp, Bos taurus; identical to SEQ ID NO: 644

SEQ ID NO: 42270 - DNA, 201 bp, Bos taurus
atcacacggaaaaacagaaacttggtatttctttggcaagctagactcagaccactatgacaagaaggagaaggaggattaagatggccaggagagaggacactcagaggacagtgaggacatgggtgagatgaatgattacaatgagtagcctgatgatggagaatcattgagacggacacgaaagcaacagaaagaatt

SEQ ID NO: 42271 - DNA, 201 bp, Bos taurus; identical to SEQ ID NO: 645

SEQ ID NO: 42272 - DNA, 201 bp, Bos taurus; identical to SEQ ID NO: 646

SEQ ID NO: 42273 - DNA, 201 bp, Bos taurus; identical to SEQ ID NO: 647

SEQ ID NO: 42274 - DNA, 201 bp, Bos taurus; identical to SEQ ID NO: 648

SEQ ID NO: 42275 - DNA, 201 bp, Bos taurus; identical to SEQ ID NO: 650

SEQ ID NO: 42276 - DNA, 201 bp, Bos taurus
ttaaactggcaatactgtggagcagaaatccccaaagtaatgggcttataccccaccacaagaggaccagatgagagaagggaagtaaatagttgaacttttatgtattataattttttataaagcataaagagaacaaaactaagcttgataatatgtatacatggtttcataccagtgacctcacacagttgtatgttg

SEQ ID NO: 42277 - DNA, 201 bp, Bos taurus; identical to SEQ ID NO: 652

SEQ ID NO: 42278 - DNA, 201 bp, Bos taurus; identical to SEQ ID NO: 653

SEQ ID NO: 42279 - DNA, 201 bp, Bos taurus; identical to SEQ ID NO: 654

SEQ ID NO: 42280 - DNA, 201 bp, Bos taurus; identical to SEQ ID NO: 655

SEQ ID NO: 42281 - DNA, 201 bp, Bos taurus
tatattcccaaatattctaattggtttttcatttatattttaggatcatttttgtggctttccatgatgtctcaaagcatgggtgatgataactttagtagtttagatgctaatgaagcagaaatcgaaccagaaaacatgagagaaaagttcttcagaagcttagcagtgttactggaaaacaagagtaataacaccaag

SEQ ID NO: 42282 - DNA, 201 bp, Bos taurus; identical to SEQ ID NO: 656

SEQ ID NO: 42283 - DNA, 201 bp, Bos taurus; identical to SEQ ID NO: 657

SEQ ID NO: 42284 - DNA, 201 bp, Bos taurus
gtgcttgtatggtggttaatggtcataattttccctgtcttgtgcctggcaagcatgcttagtctgagtggaggcaatagtggtggcctcgctgggaaattagcctgcttgctgggtctatagcaggatgccattgtcgtcctcctctggactttcatgaaaacttgagcctgtaaccagctggctcgaatgttggcccac

SEQ ID NO: 42285 - DNA, 201 bp, Bos taurus; identical to SEQ ID NO: 658

SEQ ID NO: 42286 - DNA, 201 bp, Bos taurus; identical to SEQ ID NO: 659

SEQ ID NO: 42287 - DNA, 201 bp, Bos taurus; identical to SEQ ID NO: 660

SEQ ID NO: 42288 - DNA, 201 bp, Bos taurus
ttctaaaaataaaccatctcatgaaaaatactatgagagtcatggttcaaagattaataaatatttacattgcgtgtgtgtgtgtgcattttagacacacgtttagaagacaaaatgtcaaagaagagcctcgagagatgccagctttgccccgcacatctgaaaacatgatccaacaagaagaacagttcttcagtagaa

SEQ ID NO: 42289 - DNA, 201 bp, Bos taurus; identical to SEQ ID NO: 662

SEQ ID NO: 42290 - DNA, 201 bp, Bos taurus; identical to SEQ ID NO: 663

SEQ ID NO: 42291 - DNA, 201 bp, Bos taurus; identical to SEQ ID NO: 664

SEQ ID NO: 42292 - DNA, 201 bp, Bos taurus; identical to SEQ ID NO: 665

SEQ ID NO: 42293 - DNA, 201 bp, Bos taurus; identical to SEQ ID NO: 666

SEQ ID NO: 42294 - DNA, 201 bp, Bos taurus; identical to SEQ ID NO: 667

SEQ ID NO: 42295 - DNA, 201 bp, Bos taurus; identical to SEQ ID NO: 668

SEQ ID NO: 42296 - DNA, 201 bp, Bos taurus; identical to SEQ ID NO: 669

SEQ ID NO: 42297 - DNA, 201 bp, Bos taurus; identical to SEQ ID NO: 670

SEQ ID NO: 42298 - DNA, 201 bp, Bos taurus; identical to SEQ ID NO: 673

SEQ ID NO: 42299 - DNA, 201 bp, Bos taurus; identical to SEQ ID NO: 674

SEQ ID NO: 42300 - DNA, 201 bp, Bos taurus; identical to SEQ ID NO: 675

SEQ ID NO: 42301 - DNA, 201 bp, Bos taurus; identical to SEQ ID NO: 676

SEQ ID NO: 42302 - DNA, 201 bp, Bos taurus; identical to SEQ ID NO: 677

SEQ ID NO: 42303 - DNA, 201 bp, Bos taurus; identical to SEQ ID NO: 678

SEQ ID NO: 42304 - DNA, 201 bp, Bos taurus; identical to SEQ ID NO: 679

SEQ ID NO: 42305 - DNA, 201 bp, Bos taurus; identical to SEQ ID NO: 680

SEQ ID NO: 42306 - DNA, 201 bp, Bos taurus; identical to SEQ ID NO: 681

SEQ ID NO: 42307 - DNA, 201 bp, Bos taurus; identical to SEQ ID NO: 683

SEQ ID NO: 42308 - DNA, 201 bp, Bos taurus; identical to SEQ ID NO: 684

SEQ ID NO: 42309 - DNA, 201 bp, Bos taurus
gccttcttttaaaatttttctatttggacttcagagaaggcagaaagagaaagtaaaggaggcagttctagctgtgaatatgacacttcattctgattccaagtaacctaaatctaaagcccattttactaactggccaaacgatgctgttccaagagtggacctgatacaattggatggtcagattctctctctagagaa

SEQ ID NO: 42310 - DNA, 201 bp, Bos taurus; identical to SEQ ID NO: 688

SEQ ID NO: 42311 - DNA, 201 bp, Bos taurus; identical to SEQ ID NO: 689

SEQ ID NO: 42312 - DNA, 201 bp, Bos taurus; identical to SEQ ID NO: 690

SEQ ID NO: 42313 - DNA, 201 bp, Bos taurus; identical to SEQ ID NO: 691

SEQ ID NO: 42314 - DNA, 201 bp, Bos taurus; identical to SEQ ID NO: 692

SEQ ID NO: 42315 - DNA, 201 bp, Bos taurus; identical to SEQ ID NO: 693

SEQ ID NO: 42316 - DNA, 201 bp, Bos taurus; identical to SEQ ID NO: 694

SEQ ID NO: 42317 - DNA, 201 bp, Bos taurus; identical to SEQ ID NO: 695

SEQ ID NO: 42318 - DNA, 201 bp, Bos taurus; identical to SEQ ID NO: 696

SEQ ID NO: 42319 - DNA, 201 bp, Bos taurus; identical to SEQ ID NO: 697

SEQ ID NO: 42320 - DNA, 201 bp, Bos taurus; identical to SEQ ID NO: 698

SEQ ID NO: 42321 - DNA, 201 bp, Bos taurus; identical to SEQ ID NO: 699

SEQ ID NO: 42322 - DNA, 201 bp, Bos taurus; identical to SEQ ID NO: 700

SEQ ID NO: 42323 - DNA, 201 bp, Bos taurus; identical to SEQ ID NO: 701

SEQ ID NO: 42324 - DNA, 201 bp, Bos taurus; identical to SEQ ID NO: 702

SEQ ID NO: 42325 - DNA, 201 bp, Bos taurus; identical to SEQ ID NO: 703

SEQ ID NO: 42326 - DNA, 201 bp, Bos taurus; identical to SEQ ID NO: 704

SEQ ID NO: 42327 - DNA, 201 bp, Bos taurus; identical to SEQ ID NO: 705

SEQ ID NO: 42328 - DNA, 201 bp, Bos taurus; identical to SEQ ID NO: 707

SEQ ID NO: 42329 - DNA, 201 bp, Bos taurus; identical to SEQ ID NO: 709

SEQ ID NO: 42330 - DNA, 201 bp, Bos taurus
catttctaaaacctcccatttggaattaagcttctctcttaaacattttattaccactttgtattatagaacttactacagtattgtttcacattctgaatatacagtgacttgtgtgtctcttttattgtgtgtgtgtgtgtttgtcacttatttgtgtctgactctttgtgaccccatggactgtagcccgccagactc

SEQ ID NO: 42331 - DNA, 201 bp, Bos taurus; identical to SEQ ID NO: 710

SEQ ID NO: 42332 - DNA, 201 bp, Bos taurus; identical to SEQ ID NO: 711

SEQ ID NO: 42333 - DNA, 201 bp, Bos taurus; identical to SEQ ID NO: 714

SEQ ID NO: 42334 - DNA, 201 bp, Bos taurus; identical to SEQ ID NO: 715

SEQ ID NO: 42335 - DNA, 201 bp, Bos taurus; identical to SEQ ID NO: 716

SEQ ID NO: 42336 - DNA, 201 bp, Bos taurus
cactgtgcctccatctctcactccacatctagtcttctggaaaatctgttgtcttttaagataaatgcatcatatggccacatttcactatgtccactatatcccaatccaactatgcagtgatcttttcgtctgcatgtgtgagtgtgaagtcccttcagttgtgtccgactctttgagactctatggacagtagctggc

SEQ ID NO: 42337 - DNA, 201 bp, Bos taurus
cttttttctaacctgatagaattgaaacagcaacctgattattgacattagtgatgaatttgagcatatgtttcttggcccctttactgatcactgccttattgtggcaaaagggcacataactcaatgaagctatgaaccatgccatgtagggccacccaagatagatgggtcttagaggggagttctgaaaaaatgtga

SEQ ID NO: 42338 - DNA, 201 bp, Bos taurus; identical to SEQ ID NO: 719

SEQ ID NO: 42339 - DNA, 201 bp, Bos taurus; identical to SEQ ID NO: 720

SEQ ID NO: 42340 - DNA, 201 bp, Bos taurus
tactggagtagggtgccactgccttctccaacaggcctccctggccctcacccatctcccaaagtttgctcaagttcatgttcattgcatcagtgatgccgtctagctatcttgtcctttgatggcctcttctccttctgtcctcaatctttcccagcatcaggaacttttccaatgagttgtctcttcgcaacagatgac

SEQ ID NO: 42341 - DNA, 201 bp, Bos taurus
tttaaatatacaaaactagttcaaaggaaaacgtgatacttttcaagccagtgaaaatatgtcttcaggtggaatgtagcaggaatgccagtttggtccacgtgtttttcactctgtcctttcacacttgcagctgaactgtgtcctctacagtcaacattccaagcctcccctgtactgttccttctgaaagcctagatt

SEQ ID NO: 42342 - DNA, 201 bp, Bos taurus; identical to SEQ ID NO: 721

SEQ ID NO: 42343 - DNA, 201 bp, Bos taurus; identical to SEQ ID NO: 722

SEQ ID NO: 42344 - DNA, 201 bp, Bos taurus; identical to SEQ ID NO: 724

SEQ ID NO: 42345 - DNA, 201 bp, Bos taurus; identical to SEQ ID NO: 725

SEQ ID NO: 42346 - DNA, 201 bp, Bos taurus
cttttcagatatttactggccttgtagatttcctcttctgtaaattacttcctcatatcctttgtgaatttttctacaagtctaaacagggctatttgcacgggcctggaaactgcatagtcacacagggccctgcacttaaaagggcactgtattttgtataatgttctgctgttattgttttgaaattcttagtaattt

SEQ ID NO: 42347 - DNA, 201 bp, Bos taurus
gtttgagtgggcagtcccttggcagaccctgtgcccatgggaagaggcaactcatgggtcttataaagtcaaaggagggcccaacaagaacgggtaccattgctctgtatttaaggtaaatgacaggcacagaacttgcactcggatagtctcccctcacatctaacctttcttccacgtttgcaagtccttacccctcct

SEQ ID NO: 42348 - DNA, 201 bp, Bos taurus
cccaaaagcagacacccttattacaacataagaaaaggtcaacaataaacaccagaaccagaactctgccatcacattgtaactgcttgctgctttgattttgaaaaatatggatgggttttctattttaaaaggggcataaattatttgggtcaataataaggtgaacgacctcaatatagtcctaggagcagtgcactg

SEQ ID NO: 42349 - DNA, 201 bp, Bos taurus; identical to SEQ ID NO: 726

SEQ ID NO: 42350 - DNA, 201 bp, Bos taurus
cattgatcaccaaagagtctcttggtttccaaacttatttagaatccggacttccccagaactggtccatgcaagtccatctgcatcaagaggcactctcctgtcaaagtccagggcctgggtggactccaaaccccacttgagatgtggtgttagaggtgagaaaatgtgcttccagggggcaatatttatttcacatac

SEQ ID NO: 42351 - DNA, 201 bp, Bos taurus; identical to SEQ ID NO: 727

SEQ ID NO: 42352 - DNA, 201 bp, Bos taurus
ttgcccttggactggcattcaggaactggtgacttagaaacagcacgtgcaggcttagattccccaggtgtggggagatgctcgctctctgctgatgtgcgggcggcgattctaatgaggataaataaccacctttctaaaggtagctgctgcccagtgaatttcctaaatgccagtgctgctctgtttattttgagaaga

SEQ ID NO: 42353 - DNA, 201 bp, Bos taurus; identical to SEQ ID NO: 728

SEQ ID NO: 42354 - DNA, 201 bp, Bos taurus; identical to SEQ ID NO: 729

SEQ ID NO: 42355 - DNA, 201 bp, Bos taurus; identical to SEQ ID NO: 730

SEQ ID NO: 42356 - DNA, 201 bp, Bos taurus; identical to SEQ ID NO: 732

SEQ ID NO: 42357 - DNA, 201 bp, Bos taurus; identical to SEQ ID NO: 733

SEQ ID NO: 42358 - DNA, 201 bp, Bos taurus; identical to SEQ ID NO: 734

SEQ ID NO: 42359 - DNA, 201 bp, Bos taurus; identical to SEQ ID NO: 735

SEQ ID NO: 42360 - DNA, 201 bp, Bos taurus; identical to SEQ ID NO: 736

SEQ ID NO: 42361 - DNA, 201 bp, Bos taurus; identical to SEQ ID NO: 737

SEQ ID NO: 42362 - DNA, 201 bp, Bos taurus; identical to SEQ ID NO: 738

SEQ ID NO: 42363 - DNA, 201 bp, Bos taurus; identical to SEQ ID NO: 740

SEQ ID NO: 42364 - DNA, 201 bp, Bos taurus; identical to SEQ ID NO: 742

SEQ ID NO: 42365 - DNA, 201 bp, Bos taurus; identical to SEQ ID NO: 743

SEQ ID NO: 42366 - DNA, 201 bp, Bos taurus
tctaatttgtagcatttctccccttcctgattatacaagatgggttcattcattattaatctggtttgtcaaacagcacggccctccaagtgtcaggcttccttgtttttagccagtgagtttgtgtagaagcagtgaaatttcagaatgtacagatcagcaagctcttgtctgcacctgattaaagttagatagactaac

SEQ ID NO: 42367 - DNA, 201 bp, Bos taurus; identical to SEQ ID NO: 745

SEQ ID NO: 42368 - DNA, 201 bp, Bos taurus
agccactaagatcaaatggcttcttaagcagtgatagataaatgacaaagatgcttgtttcttggttatgagataataataaaacctaatgtttattggttccggcaacagatgacaaacttacagtactttctcatttaacccttaaaatgagcccttgaagtaggtattacttatgaatcccattttgttgatgaacaa

SEQ ID NO: 42369 - DNA, 201 bp, Bos taurus
accaaagatatgcttaaaaattctttgtccaaatgcttacaagtactatgtaagccctaacagaaaatctttaaggaagagtgaattcttccaaggggccggatggaggacatatttccactaatacacacttagaagcagactttcaaacttgaggggtgggagctcccacctctgtccatctccaggtcacatggcctg

SEQ ID NO: 42370 - DNA, 201 bp, Bos taurus; identical to SEQ ID NO: 746

SEQ ID NO: 42371 - DNA, 201 bp, Bos taurus
gtcacagcttaggaatccttagtacataaggattctcatgtactatgggttcgttcagtgtaaacaagcatatggatcctctaggtcagcctacgtctccgggccttgtacttaggacagtgaggtggtctcaagcactgccttcccttggagcaatggctctcagaccttcatggatgtcagatcacctggaggacctgt

SEQ ID NO: 42372 - DNA, 201 bp, Bos taurus
agcaccctgcactctatactttgggggagaccctgaggtgagatgtcctaccctttctcaccaacaggtcggtggctgggagccaggcccacccctttccttgctctccctttttgctctggcaagcctgtactgtggagaagatgactttctccccattatgctcctttccagggttcctatgaccatgggcctgtatta

SEQ ID NO: 42373 - DNA, 201 bp, Bos taurus; identical to SEQ ID NO: 747

SEQ ID NO: 42374 - DNA, 201 bp, Bos taurus; identical to SEQ ID NO: 748

SEQ ID NO: 42375 - DNA, 201 bp, Bos taurus
ccagagtggggacgtttggaatcaagaatggagagggcttgcaggaggacctgtgcccaaagattggaacatgtgagcatttgaatcagaaaggccagaatgctggaggtcaacgaagagcctggaaagagtgttgtcagtgtccttggtgtgtttggaccaaggccaggctggagctgactgaagactgggcatgaggaa

SEQ ID NO: 42376 - DNA, 201 bp, Bos taurus; identical to SEQ ID NO: 749

SEQ ID NO: 42377 - DNA, 201 bp, Bos taurus; identical to SEQ ID NO: 750

SEQ ID NO: 42378 - DNA, 201 bp, Bos taurus
aattgtcttgctccttgttaaacagggtttcaaacctgtcaaagagactgcatccaggactgagcctcccaagccttccttccacagaagagtgggagagcgctgtggggtacagccagggccctctccctgaactccctgctaatgtagcaccatctcagcatagtctcaactgcctgcagagcttcaagcacgcagcag

SEQ ID NO: 42379 - DNA, 201 bp, Bos taurus; identical to SEQ ID NO: 752

SEQ ID NO: 42380 - DNA, 201 bp, Bos taurus; identical to SEQ ID NO: 755

SEQ ID NO: 42381 - DNA, 201 bp, Bos taurus; identical to SEQ ID NO: 756

SEQ ID NO: 42382 - DNA, 201 bp, Bos taurus; identical to SEQ ID NO: 760

SEQ ID NO: 42383 - DNA, 201 bp, Bos taurus; identical to SEQ ID NO: 761

SEQ ID NO: 42384 - DNA, 201 bp, Bos taurus; identical to SEQ ID NO: 762

SEQ ID NO: 42385 - DNA, 201 bp, Bos taurus; identical to SEQ ID NO: 764

SEQ ID NO: 42386 - DNA, 201 bp, Bos taurus; identical to SEQ ID NO: 766

SEQ ID NO: 42387 - DNA, 201 bp, Bos taurus; identical to SEQ ID NO: 767

SEQ ID NO: 42388 - DNA, 201 bp, Bos taurus; identical to SEQ ID NO: 768

SEQ ID NO: 42389 - DNA, 201 bp, Bos taurus; identical to SEQ ID NO: 769

SEQ ID NO: 42390 - DNA, 201 bp, Bos taurus
atgcaggtaggtgcccagaagagagaaaagaatagcttggataggaaacaatgagaactatgacaaaacctagcaatttaccacttctgtacactaacttgcacatcagtgcttaaaatgacaattacagtttccacaaactcaccatgcatttccaaggggaattctatataagcagattattcaatgcctatctgccta

SEQ ID NO: 42391 - DNA, 201 bp, Bos taurus; identical to SEQ ID NO: 771

SEQ ID NO: 42392 - DNA, 201 bp, Bos taurus; identical to SEQ ID NO: 772

SEQ ID NO: 42393 - DNA, 201 bp, Bos taurus; identical to SEQ ID NO: 773

SEQ ID NO: 42394 - DNA, 201 bp, Bos taurus
tcctcatcacctcatgaaacccatgtgtctctaaacccacatatgtcatagtccagctgattagaatacttggcccataagctctatctaccttgcaccaaagttaacagagttaaccgttaggatttccatctgtaatacttctgaactcagtttttgtatatagacttcatcaacacttgattttatctcatctgtctt

SEQ ID NO: 42395 - DNA, 201 bp, Bos taurus; identical to SEQ ID NO: 777

SEQ ID NO: 42396 - DNA, 201 bp, Bos taurus; identical to SEQ ID NO: 779

SEQ ID NO: 42397 - DNA, 201 bp, Bos taurus
gtggttctgccataggaaaacataagtttgttttgatgtgtttcctgaaaaaccagttgtcatatatgccttaatttaaaaataattagtctttttttttgggggggggtaattggaaacatgaggaggaacattgtaaaacaccccaaagtaaacaaacccagttggcagagtaaattagttttgatttacatgcaattt

SEQ ID NO: 42398 - DNA, 201 bp, Bos taurus; identical to SEQ ID NO: 781

SEQ ID NO: 42399 - DNA, 201 bp, Bos taurus
agcaaatacatctcttatgaaaaccagagccctctggacttgggggccatactctggaaaccatgtcaagtttgagcactgtggaatctcaggccagctgcgagattttttttcccctcaagttggcatacaggttcaggagaaccaaaactggacagagtcatttttgccaaatctggcaaacagttggatcgattccac

SEQ ID NO: 42400 - DNA, 201 bp, Bos taurus
atataaaggctgactgggggaaaggcatatgcacacaaataccccccaggctggcaacatacattattctctaagagtagaaagaaagagttttcgtagagagcaactggactttataaaaaagaaaatctaaaatttatgagtgataaattacacatgaaatgaaaattaacatatcacattttatgaaaaacaaatttc

SEQ ID NO: 42401 - DNA, 201 bp, Bos taurus
aatatacactcatccctatgttcatagcagcactgttcacaagaaacaagacatggaagcaacctaacgtccaatgacagaggaatggataaagaagatatggtacgtatatacaaagaactatcactcacccataaaaaagaatgaaataatgccatctgcagcaacatggatgaacctagagattatcatactaagtga

SEQ ID NO: 42402 - DNA, 201 bp, Bos taurus; identical to SEQ ID NO: 783

SEQ ID NO: 42403 - DNA, 201 bp, Bos taurus; identical to SEQ ID NO: 784

SEQ ID NO: 42404 - DNA, 201 bp, Bos taurus
tcttctcaagatagaatctgacttgctttcttagtctgatttttccatgcaagcatatctgaaaaatactcagggtttggcccagttgttcatatctttagaaaacccaagtgtatctgagctctcaacagggctctggttgcagggtgctccggtggggactttctctgaaatttctccacctgatactgcatggcccag

SEQ ID NO: 42405 - DNA, 201 bp, Bos taurus; identical to SEQ ID NO: 786

SEQ ID NO: 42406 - DNA, 201 bp, Bos taurus; identical to SEQ ID NO: 787

SEQ ID NO: 42407 - DNA, 201 bp, Bos taurus; identical to SEQ ID NO: 788

SEQ ID NO: 42408 - DNA, 201 bp, Bos taurus; identical to SEQ ID NO: 789

SEQ ID NO: 42409 - DNA, 201 bp, Bos taurus; identical to SEQ ID NO: 790

SEQ ID NO: 42410 - DNA, 201 bp, Bos taurus; identical to SEQ ID NO: 791

SEQ ID NO: 42411 - DNA, 201 bp, Bos taurus; identical to SEQ ID NO: 792

SEQ ID NO: 42412 - DNA, 201 bp, Bos taurus; identical to SEQ ID NO: 793

SEQ ID NO: 42413 - DNA, 201 bp, Bos taurus; identical to SEQ ID NO: 796

SEQ ID NO: 42414 - DNA, 201 bp, Bos taurus; identical to SEQ ID NO: 798

SEQ ID NO: 42415 - DNA, 201 bp, Bos taurus; identical to SEQ ID NO: 799

SEQ ID NO: 42416 - DNA, 201 bp, Bos taurus; identical to SEQ ID NO: 800

SEQ ID NO: 42417 - DNA, 201 bp, Bos taurus
agaggagcctggcgggcccacagtctatggggtctctaagagttggatacaactgagcgactaaacaacaacaacaacggtttaacaattgggtcagttgattattctgggcaaaccattgtctcaacttgagtgctacctcaaaaacgatggatgaggattaaatagaggactcttcactgttaaaggaccagatgatat

SEQ ID NO: 42418 - DNA, 201 bp, Bos taurus; identical to SEQ ID NO: 802

SEQ ID NO: 42419 - DNA, 201 bp, Bos taurus; identical to SEQ ID NO: 803

SEQ ID NO: 42420 - DNA, 201 bp, Bos taurus; identical to SEQ ID NO: 804

SEQ ID NO: 42421 - DNA, 201 bp, Bos taurus; identical to SEQ ID NO: 805

SEQ ID NO: 42422 - DNA, 201 bp, Bos taurus; identical to SEQ ID NO: 806

SEQ ID NO: 42423 - DNA, 201 bp, Bos taurus; identical to SEQ ID NO: 807

SEQ ID NO: 42424 - DNA, 201 bp, Bos taurus; identical to SEQ ID NO: 808

SEQ ID NO: 42425 - DNA, 201 bp, Bos taurus; identical to SEQ ID NO: 809

SEQ ID NO: 42426 - DNA, 201 bp, Bos taurus
ggacccagtactgtatctgaataaggtgagttaggccagtgctgggacttgtggaggttgtggatcaggagctgtctgtatacctgactggcttcctagatagtctcagtgtgtgtctggcccacaaaaaccctcctgttccagcgttgcttcctccaaggcaaaggtacagttggtgggagcagagagagtgcaaacatg

SEQ ID NO: 42427 - DNA, 201 bp, Bos taurus; identical to SEQ ID NO: 812

SEQ ID NO: 42428 - DNA, 201 bp, Bos taurus; identical to SEQ ID NO: 813

SEQ ID NO: 42429 - DNA, 201 bp, Bos taurus; identical to SEQ ID NO: 815

SEQ ID NO: 42430 - DNA, 201 bp, Bos taurus; identical to SEQ ID NO: 817

SEQ ID NO: 42431 - DNA, 201 bp, Bos taurus; identical to SEQ ID NO: 818

SEQ ID NO: 42432 - DNA, 201 bp, Bos taurus; identical to SEQ ID NO: 820

SEQ ID NO: 42433 - DNA, 201 bp, Bos taurus; identical to SEQ ID NO: 825

SEQ ID NO: 42434 - DNA, 201 bp, Bos taurus; identical to SEQ ID NO: 826

SEQ ID NO: 42435 - DNA, 201 bp, Bos taurus; identical to SEQ ID NO: 828

SEQ ID NO: 42436 - DNA, 201 bp, Bos taurus; identical to SEQ ID NO: 830

SEQ ID NO: 42437 - DNA, 201 bp, Bos taurus; identical to SEQ ID NO: 831

SEQ ID NO: 42438 - DNA, 201 bp, Bos taurus; identical to SEQ ID NO: 832

SEQ ID NO: 42439 - DNA, 201 bp, Bos taurus; identical to SEQ ID NO: 834

SEQ ID NO: 42440 - DNA, 201 bp, Bos taurus; identical to SEQ ID NO: 836

SEQ ID NO: 42441 - DNA, 201 bp, Bos taurus; identical to SEQ ID NO: 837

SEQ ID NO: 42442 - DNA, 201 bp, Bos taurus; identical to SEQ ID NO: 841

SEQ ID NO: 42443 - DNA, 201 bp, Bos taurus; identical to SEQ ID NO: 843

SEQ ID NO: 42444 - DNA, 201 bp, Bos taurus; identical to SEQ ID NO: 844

SEQ ID NO: 42445 - DNA, 201 bp, Bos taurus; identical to SEQ ID NO: 845

SEQ ID NO: 42446 - DNA, 201 bp, Bos taurus; identical to SEQ ID NO: 846

SEQ ID NO: 42447 - DNA, 201 bp, Bos taurus; identical to SEQ ID NO: 847

SEQ ID NO: 42448 - DNA, 201 bp, Bos taurus; identical to SEQ ID NO: 848

SEQ ID NO: 42449 - DNA, 201 bp, Bos taurus; identical to SEQ ID NO: 849

SEQ ID NO: 42450 - DNA, 201 bp, Bos taurus; identical to SEQ ID NO: 853

SEQ ID NO: 42451 - DNA, 201 bp, Bos taurus; identical to SEQ ID NO: 855

SEQ ID NO: 42452 - DNA, 201 bp, Bos taurus; identical to SEQ ID NO: 856

SEQ ID NO: 42453 - DNA, 201 bp, Bos taurus
aaaatttataacctgaaatattgagcattcagagagatttactcttcacaggatgtaggtaggagagctcgggtgttgctgatggaagttcttgccggcacagaagaggagcagatatctgatgggaagcctgcagactcagtggggtgatgcgactaaatgtatcaagcgttgacagtttggaagccgtttatttatgta

SEQ ID NO: 42454 - DNA, 201 bp, Bos taurus
aagcaatttatcttgctcggctccaagtaaatggctgtgtctcttggggttcagtcaagggtaattaaagtaagcacttgcaattaaattattttgtagcggaattaagcaatgttcatttaaaattcagttctcccaaaagaaggcagaaccagaggattcttcaatatatttacaacctaaataaatatgataaatatg

SEQ ID NO: 42455 - DNA, 201 bp, Bos taurus
acatgctacaacacagatgaaccttgaagacatcatgctacatgaaataagccagtcacagaaaaacaaatattatatgattctacttatatacgttacctagtgtaaccaaactcatacaaacagaaagtagaatggcggtagtcccagaggacaggggttggggaaaggtggactgttgaggagttagtttttaacagt

SEQ ID NO: 42456 - DNA, 201 bp, Bos taurus
ccaattgttaaagcaggacttgtggcctctttctctgtacttctttattacgctcctctgaagaaggaaaaacgatttctcttattcatgagaaggtaagagtcttgggtcccctgaacctcctagctccactgcaatgattctcaaactttaattgcaagagaataaggagggctaagtaaaacacagactcttgggccc

SEQ ID NO: 42457 - DNA, 201 bp, Bos taurus
actaggaatctttcacaggttatgttcccttgagacctaaccttttctactgatccagcttcaggagcaatgaaagtagggcgaaggctgtatctatagcagaatgggccactggaatgactagcaatgatcactttggaatatgatttgcaggttacaaagtgcttccacctagagtgtcacaaacaagagagtattttc

SEQ ID NO: 42458 - DNA, 201 bp, Bos taurus
gctatctggcatgcccccctcccccaaaaaagaggaattgaatgaagaatttaaaaagagaaatggacaaaaaagcaaggtatgaaacaagaggtgactggactgaagaaagaaattgaagaaatgaaggttaaattataaggagcatacaggaggaatatatatgactaaaactttaggaaggagcattgaagaaaggca

SEQ ID NO: 42459 - DNA, 201 bp, Bos taurus; identical to SEQ ID NO: 859

SEQ ID NO: 42460 - DNA, 201 bp, Bos taurus
atatgaaaactgtataaacattctgtaatttctaaagatgctaccatactaaaagtgcaccagaatgcagaatcctgtagtttgggggaaaagcagtacgcaacatttcatgaggttttaaaacctaaacaattttaataataaatttgggggtatgttttattacagaagatttaaaataattcatagtaattacaaagc

SEQ ID NO: 42461 - DNA, 201 bp, Bos taurus; identical to SEQ ID NO: 860

SEQ ID NO: 42462 - DNA, 201 bp, Bos taurus; identical to SEQ ID NO: 864

SEQ ID NO: 42463 - DNA, 201 bp, Bos taurus
ctgcttctattactttgactatgattactttgcagagatccagctacagaattcctaaatcccagactttcagagtcttagctatggggccataacatatcgtggaaagcagaacaaggttgttaatacttactgagaggagagatgcagaagggaatccctatctggctgccaaatgcggtgagaggccaattgctcctt

SEQ ID NO: 42464 - DNA, 201 bp, Bos taurus
actccaaggtctgaggactcctggcccagtgctcactgcaccatgtctcaactgtttcttaaactaaacaacagcaggaagggagactgtagatagcagactggccagggctcaaatctcagtttatctgctgtgtggcctcaaacaggtgtcctcacctctctgggcctctgtcctctcaactgtgaaatggatggttct

SEQ ID NO: 42465 - DNA, 201 bp, Bos taurus; identical to SEQ ID NO: 866

SEQ ID NO: 42466 - DNA, 201 bp, Bos taurus
tgagcaaacatttaattcagattttaatttggcccctatttcctagacagaccctgggtcaattttctgcagagggatttttttctcttccttgtcattctcagcatctttggagattagggacagaaataaactccaagtgatctgcaatagttcagtaagacaccactcctgaacaactgagcttttgacaatacaatg

SEQ ID NO: 42467 - DNA, 201 bp, Bos taurus; identical to SEQ ID NO: 867

SEQ ID NO: 42468 - DNA, 201 bp, Bos taurus; identical to SEQ ID NO: 870

SEQ ID NO: 42469 - DNA, 201 bp, Bos taurus; identical to SEQ ID NO: 871

SEQ ID NO: 42470 - DNA, 201 bp, Bos taurus; identical to SEQ ID NO: 873

SEQ ID NO: 42471 - DNA, 201 bp, Bos taurus; identical to SEQ ID NO: 875

SEQ ID NO: 42472 - DNA, 201 bp, Bos taurus; identical to SEQ ID NO: 876

SEQ ID NO: 42473 - DNA, 201 bp, Bos taurus; identical to SEQ ID NO: 877

SEQ ID NO: 42474 - DNA, 201 bp, Bos taurus
ggccatgccacatggcatgtgggatcttatttccctgactagggatcaaacccatgccccttgcactggaccaccagggcagtccccaggcttctgtatttgagcacagtggacccaggcctgcaaaagaagagagggcctcagaacaggagaatgcatggagtcctttaatcatgtcagaaaaaaaagccacttcaagtc

SEQ ID NO: 42475 - DNA, 201 bp, Bos taurus; identical to SEQ ID NO: 878

SEQ ID NO: 42476 - DNA, 201 bp, Bos taurus; identical to SEQ ID NO: 879

SEQ ID NO: 42477 - DNA, 201 bp, Bos taurus; identical to SEQ ID NO: 880

SEQ ID NO: 42478 - DNA, 201 bp, Bos taurus; identical to SEQ ID NO: 881

SEQ ID NO: 42479 - DNA, 201 bp, Bos taurus; identical to SEQ ID NO: 883

SEQ ID NO: 42480 - DNA, 201 bp, Bos taurus; identical to SEQ ID NO: 884

SEQ ID NO: 42481 - DNA, 201 bp, Bos taurus; identical to SEQ ID NO: 887

SEQ ID NO: 42482 - DNA, 201 bp, Bos taurus
tgcacccagccagccagctcagaagactgaggctaggtgaacaggaagtgtctaaagtggctggaggaggtaggagtggccagatctcggttcttgggaatgaacagcagaggacctactggaaggggaggagaggggcagacctctgcctggagcatgaggggaccactctgggcatgcaaagagccagcagtgacttgg

SEQ ID NO: 42483 - DNA, 201 bp, Bos taurus
agaggtgcacaggtgtgagttctcatttcttggcttcaccagccaggccacaaatgctgctgcacagccgagagactccagctgtctgaagcctgggaccggtgacctgttgtacatgaggggtgagcactgggtatttgctggacagtgttctgtatgggtccaggggttctgtgggagcccaaccagacaaaaatgagg

SEQ ID NO: 42484 - DNA, 201 bp, Bos taurus; identical to SEQ ID NO: 888

SEQ ID NO: 42485 - DNA, 201 bp, Bos taurus; identical to SEQ ID NO: 889

SEQ ID NO: 42486 - DNA, 201 bp, Bos taurus; identical to SEQ ID NO: 890

SEQ ID NO: 42487 - DNA, 201 bp, Bos taurus
ttcacagcccaaggaccttgagaataaagaggcagggctgaagatagtagagttcacacacttgccaccaacagttcttccagcttgggacagggcccaacgctgatcctcagccatgtcaaaaccaaagttctggggtgggggagaccccaaagtagagggcagggcctggggctcccctaatcagagagggaaggtagc

SEQ ID NO: 42488 - DNA, 201 bp, Bos taurus; identical to SEQ ID NO: 891

SEQ ID NO: 42489 - DNA, 201 bp, Bos taurus
attaaacttgataagcaaaggactgattaaagagctgaaacttttaagtattttggaaagattttctagctttgagagacaattctgggtttgcatactacctggacatcaggactggacagaatatagttttatcttttatttccttactaaagtacaaaagaatgtgcgaaaaatctgttatgagagaaatagtttgga

SEQ ID NO: 42490 - DNA, 201 bp, Bos taurus
tgtaattttggggttttgatggccccaccctagccctttcaatcctgagagcacagaggctctgttccaccacagagtgagcacatgtttcttgggtgctggggccaggctatgcatgctagccttagccctgcccactgctccagatggtactctgggtacattatgaagagcacagaaagcagagcccatggtgcacaa

SEQ ID NO: 42491 - DNA, 201 bp, Bos taurus
cagagaacggagggtggtaagtggccaggccagcaggtccctcccctgccccgccagtgtcctccctgttcctgaaaagcttcagtaaatgcccacctcaggggaggtgcaaggcccactgggaagtctttgaggaagtcatcctcttcatccagaacacttcagtgtctcacctatttctcgctcatccccacttcatct

SEQ ID NO: 42492 - DNA, 201 bp, Bos taurus
ttgtgcagccctgccaatctcctttcctacttacaaactaaagctttttgaaagaataatctataataatatctatagtttagaataatctataataatatctatagtttaatttatccaggcctaagtggcactgcacaaagtgggcactcaaagaacgcttatgaattaagagaaataatgattttccaaaattatact

SEQ ID NO: 42493 - DNA, 201 bp, Bos taurus
gttgctttctgccagttcactttttaaaaagagctttattggatttttatttccatatcaaaaaattcacctgttttaagtgtagaattcagtgattcttagtaaatttctggagttgtgcaaacatcatatataatccaattttagaacatttccatcaccccaaaagatcctgtgtgcctctttgatgtcagtctgtgt

SEQ ID NO: 42494 - DNA, 201 bp, Bos taurus; identical to SEQ ID NO: 894

SEQ ID NO: 42495 - DNA, 201 bp, Bos taurus; identical to SEQ ID NO: 896

SEQ ID NO: 42496 - DNA, 201 bp, Bos taurus; identical to SEQ ID NO: 897

SEQ ID NO: 42497 - DNA, 201 bp, Bos taurus; identical to SEQ ID NO: 899

SEQ ID NO: 42498 - DNA, 201 bp, Bos taurus; identical to SEQ ID NO: 900

SEQ ID NO: 42499 - DNA, 201 bp, Bos taurus; identical to SEQ ID NO: 903

SEQ ID NO: 42500 - DNA, 201 bp, Bos taurus; identical to SEQ ID NO: 904

SEQ ID NO: 42501 - DNA, 201 bp, Bos taurus; identical to SEQ ID NO: 905

SEQ ID NO: 42502 - DNA, 201 bp, Bos taurus; identical to SEQ ID NO: 906

SEQ ID NO: 42503 - DNA, 201 bp, Bos taurus; identical to SEQ ID NO: 907

SEQ ID NO: 42504 - DNA, 201 bp, Bos taurus; identical to SEQ ID NO: 908

SEQ ID NO: 42505 - DNA, 201 bp, Bos taurus; identical to SEQ ID NO: 911

SEQ ID NO: 42506 - DNA, 201 bp, Bos taurus; identical to SEQ ID NO: 914

SEQ ID NO: 42507 - DNA, 201 bp, Bos taurus; identical to SEQ ID NO: 915

SEQ ID NO: 42508 - DNA, 201 bp, Bos taurus; identical to SEQ ID NO: 916

SEQ ID NO: 42509 - DNA, 201 bp, Bos taurus; identical to SEQ ID NO: 917

SEQ ID NO: 42510 - DNA, 201 bp, Bos taurus; identical to SEQ ID NO: 918

SEQ ID NO: 42511 - DNA, 201 bp, Bos taurus; identical to SEQ ID NO: 921

SEQ ID NO: 42512 - DNA, 201 bp, Bos taurus; identical to SEQ ID NO: 923

SEQ ID NO: 42513 - DNA, 201 bp, Bos taurus; identical to SEQ ID NO: 924

SEQ ID NO: 42514 - DNA, 201 bp, Bos taurus; identical to SEQ ID NO: 925

SEQ ID NO: 42515 - DNA, 201 bp, Bos taurus; identical to SEQ ID NO: 926

SEQ ID NO: 42516 - DNA, 201 bp, Bos taurus; identical to SEQ ID NO: 927

SEQ ID NO: 42517 - DNA, 201 bp, Bos taurus; identical to SEQ ID NO: 933

SEQ ID NO: 42518 - DNA, 201 bp, Bos taurus; identical to SEQ ID NO: 934

SEQ ID NO: 42519 - DNA, 201 bp, Bos taurus
aggtacaaagagatggaaggatcttggatttgattgacgatgcttggcgagaagacaagctgccttatgaggatgttgcaataccactggtaggctgtaacgtgtgctgagggtgatgggttaaaggtctgatctggtagaccctagtagctgtaggttatcaatggacaaataaactgaagtcaaagaaatcaaaactat

SEQ ID NO: 42520 - DNA, 201 bp, Bos taurus
tcaggccgactacaggataaggtcagccagacctgctcctgctcctttgctattgcaacactggcctggtattcagtaagctgaatgataggatgaggcccaggagtccaggtggggaccctatgggcacacacctcctcacaggtgaacatcccagcagtgggaaaggaggaacgcattatgctcacgtctgacacctga

SEQ ID NO: 42521 - DNA, 201 bp, Bos taurus; identical to SEQ ID NO: 935

SEQ ID NO: 42522 - DNA, 201 bp, Bos taurus; identical to SEQ ID NO: 936

SEQ ID NO: 42523 - DNA, 201 bp, Bos taurus; identical to SEQ ID NO: 937

SEQ ID NO: 42524 - DNA, 201 bp, Bos taurus; identical to SEQ ID NO: 939

SEQ ID NO: 42525 - DNA, 201 bp, Bos taurus; identical to SEQ ID NO: 940

SEQ ID NO: 42526 - DNA, 201 bp, Bos taurus; identical to SEQ ID NO: 941

SEQ ID NO: 42527 - DNA, 201 bp, Bos taurus
accccaggataaaataatgcccacaggctcaaggtaatggcccaagactgggcagctctacagtgttcattctgagcttcctccagggaaatttcagttcttagagaaccagagatcttgttcatcctcagctataagagttgaattatcagtacatatgcttccatttagaaaaccaggtttatccatcaacaatgttgt

SEQ ID NO: 42528 - DNA, 201 bp, Bos taurus; identical to SEQ ID NO: 942

SEQ ID NO: 42529 - DNA, 201 bp, Bos taurus
tgtaaagccttttgtaattacagggctttaaacaatccataagccttgacaagactgtttttcacagaagcaaattatctcttcaatctctcctaaaagattcgactctgaatatctgattccccatcttcatgattaatggatggcaagaaggagacaagatgcataaaaacaacaacaacaacaacaacaaaaacagcc

SEQ ID NO: 42530 - DNA, 201 bp, Bos taurus
caaactattaatttttgcaacacatgaaataactacaaaagatatgaagtaggaagcttagtaattccagtcctacctcctggaggaactgatttgatactaacacaaacaaccttcaaagtgcaaatttcatttctctcctaatgctgctttctattctccctctttcctttttgtgacccagtactgacgtgaacagta

SEQ ID NO: 42531 - DNA, 201 bp, Bos taurus
cgtctggaatgacgaggaacttggcaagaagacaacgctgcataagctctgctgtggccactcaccggagggaagcaaagccggccaccctgaaggtgtttattggcacgtgggagggacggaagactcaggaagttatttttgtcgcctctcccttagctgcctaaaaggatttagacagagggcctattccaggaaaaa

SEQ ID NO: 42532 - DNA, 201 bp, Bos taurus; identical to SEQ ID NO: 944

SEQ ID NO: 42533 - DNA, 201 bp, Bos taurus
tgataaaactagcttattccctaagagtaaaaggtgagagagaataagaggaagcaacctgccctggagtcactgccgctgaaggtcactgcctttctaacggcctccccttggtgctttgagaaagacttctgtctttgtgagcgcctgtcactcacgcgccaacctggatccacaccttggaaagaggcaaagccggaa

SEQ ID NO: 42534 - DNA, 201 bp, Bos taurus; identical to SEQ ID NO: 945

SEQ ID NO: 42535 - DNA, 201 bp, Bos taurus
attggagatggctgccttcttgctgcgtcctcacatggccttttctctttgggtgcacctctgtgttgtctcttcctcttcttataagaatccaagtcctgttggattagggcccactccactgacctcagttaaccttaattatcactttaaagaccctgtctccaaatatagtcaccttgtgagcaactgagggttagg

SEQ ID NO: 42536 - DNA, 201 bp, Bos taurus; identical to SEQ ID NO: 947

SEQ ID NO: 42537 - DNA, 201 bp, Bos taurus; identical to SEQ ID NO: 948

SEQ ID NO: 42538 - DNA, 201 bp, Bos taurus; identical to SEQ ID NO: 949

SEQ ID NO: 42539 - DNA, 201 bp, Bos taurus; identical to SEQ ID NO: 950

SEQ ID NO: 42540 - DNA, 201 bp, Bos taurus; identical to SEQ ID NO: 951

SEQ ID NO: 42541 - DNA, 201 bp, Bos taurus; identical to SEQ ID NO: 952

SEQ ID NO: 42542 - DNA, 201 bp, Bos taurus; identical to SEQ ID NO: 953

SEQ ID NO: 42543 - DNA, 201 bp, Bos taurus; identical to SEQ ID NO: 954

SEQ ID NO: 42544 - DNA, 201 bp, Bos taurus; identical to SEQ ID NO: 955

SEQ ID NO: 42545 - DNA, 201 bp, Bos taurus
ctaaaagatcccacatgtcacaacttagacctagtacagccaaataaataaaatcaataaaaataaacattaatggaggccccagacctactggtacctacagattgatgatgttaactgctctgttatctcaaaatcaaccaatcaaagaatcaagcaggagctgatcacacaccctagaaccaccctctctcacttggc

SEQ ID NO: 42546 - DNA, 201 bp, Bos taurus; identical to SEQ ID NO: 956

SEQ ID NO: 42547 - DNA, 201 bp, Bos taurus; identical to SEQ ID NO: 957

SEQ ID NO: 42548 - DNA, 201 bp, Bos taurus; identical to SEQ ID NO: 959

SEQ ID NO: 42549 - DNA, 201 bp, Bos taurus; identical to SEQ ID NO: 960

SEQ ID NO: 42550 - DNA, 201 bp, Bos taurus; identical to SEQ ID NO: 961

SEQ ID NO: 42551 - DNA, 201 bp, Bos taurus; identical to SEQ ID NO: 962

SEQ ID NO: 42552 - DNA, 201 bp, Bos taurus; identical to SEQ ID NO: 963

SEQ ID NO: 42553 - DNA, 201 bp, Bos taurus; identical to SEQ ID NO: 964

SEQ ID NO: 42554 - DNA, 201 bp, Bos taurus
ccaacaccaggaggatttacttaactagtcccgcatgaccaaactgtgaactagcagagctataattcagcccaagcctgcctctgcagtccaaggccaacatcatggtctgatacctgttttttgaaacaccactcttaattcccagattcagtggctccttttgaattcatactatgcttagtccctcagcagcatttc

SEQ ID NO: 42555 - DNA, 201 bp, Bos taurus; identical to SEQ ID NO: 965

SEQ ID NO: 42556 - DNA, 201 bp, Bos taurus
gattgaactgtgagttggaaagtgctttgggatttagacctcaggagagaaggctgagtgagtgtttttagtctcttgcaaagatttgtcctcttgcggtgtgtgggtcttcacatatcttccttggtgggtaccttttagaatgtgagcaggctggccatctggtgaaagtcagccttggaagagaagcaagggaaggat

SEQ ID NO: 42557 - DNA, 201 bp, Bos taurus; identical to SEQ ID NO: 967

SEQ ID NO: 42558 - DNA, 201 bp, Bos taurus; identical to SEQ ID NO: 968

SEQ ID NO: 42559 - DNA, 201 bp, Bos taurus; identical to SEQ ID NO: 969

SEQ ID NO: 42560 - DNA, 201 bp, Bos taurus; identical to SEQ ID NO: 972

SEQ ID NO: 42561 - DNA, 201 bp, Bos taurus; identical to SEQ ID NO: 973

SEQ ID NO: 42562 - DNA, 201 bp, Bos taurus
tcttatcatttgttactgaaggccctcaatcctggttatttcaagatgcttcacctcctctccaaaggagctcttaggatttcaagctgattattgcaggcgcttaaagacaaagcctcatttggcctattattgaacaggtgggatatgcatgtggtctttgcaactttctatttgtctcagtagctaaaatttgtattg

SEQ ID NO: 42563 - DNA, 201 bp, Bos taurus; identical to SEQ ID NO: 974

SEQ ID NO: 42564 - DNA, 201 bp, Bos taurus; identical to SEQ ID NO: 975

SEQ ID NO: 42565 - DNA, 201 bp, Bos taurus; identical to SEQ ID NO: 976

SEQ ID NO: 42566 - DNA, 201 bp, Bos taurus; identical to SEQ ID NO: 978

SEQ ID NO: 42567 - DNA, 201 bp, Bos taurus; identical to SEQ ID NO: 979

SEQ ID NO: 42568 - DNA, 201 bp, Bos taurus; identical to SEQ ID NO: 980

SEQ ID NO: 42569 - DNA, 201 bp, Bos taurus; identical to SEQ ID NO: 981

SEQ ID NO: 42570 - DNA, 201 bp, Bos taurus
gggggtgggcctcatgtttgctctgctgcctagcagagggtgataccagttcctaccttgtctgatgaaaggacctcagagaagcacagcctgacctcctcttaggcctggaaaagaacacctgtcccttttgccactgggacccctgacagtaaggacggtagcaggtttagggaaggggcttccagtggtgtctgtccc

SEQ ID NO: 42571 - DNA, 201 bp, Bos taurus; identical to SEQ ID NO: 983

SEQ ID NO: 42572 - DNA, 201 bp, Bos taurus
acctgttaaggatttccaacagagaggcccctagagcttccctggtgatccagtggtgaaaaatccacctgccaatgcaaagaacataagtttgatccctggtctgggaatagcccatgtgccacagctaccaaagcccatatgtcctaaagccaatgctctgcaataagaaaagccattgccaagagaagcctgcccact

SEQ ID NO: 42573 - DNA, 201 bp, Bos taurus
ccaggcaggctacagtccacagggtcaaaaagaattggacatgactgagcgacaaacactttcgctttcattaaccattttcatctggcctccctttctgctgttgttattgttactgtgtggtcacaaacaccctcacatatctctgtgcaagcgtgtctgttgggctgtttcctaggcaaaaatatccactttttaaag

SEQ ID NO: 42574 - DNA, 201 bp, Bos taurus; identical to SEQ ID NO: 984

SEQ ID NO: 42575 - DNA, 201 bp, Bos taurus; identical to SEQ ID NO: 986

SEQ ID NO: 42576 - DNA, 201 bp, Bos taurus; identical to SEQ ID NO: 987

SEQ ID NO: 42577 - DNA, 201 bp, Bos taurus
gcagctgatggagaggcaatgacttgaagatgtgtttatactccccacccaggagacagagccaatgctcacatgcatgcatacacacacacacacacaccccctaagtgggcccatagagagggagggaggaccagagagagaccatgaagaggtgccacgtggaaaggaccacgggaatgacaagaccagaagagggtt

SEQ ID NO: 42578 - DNA, 201 bp, Bos taurus
tccgtgcatataaacaatccatggtgaagggacggaccgcgctgaccctttaccgggtggtgctgtgttccatgcacatcaccttactaattaccacaatcacctccaagaggagactcacacccagctggggacctactggcggaggtgagaaacggggcccccagtcctggccaaatgggtcccgggcagcccctccca

SEQ ID NO: 42579 - DNA, 201 bp, Bos taurus; identical to SEQ ID NO: 988

SEQ ID NO: 42580 - DNA, 201 bp, Bos taurus
cttgtcatgatcaggcccagaggctttctggaggcagaggagtaatcttcatcagtggttgcatcttgtcttcagttcagatgaaaaacaaggtctaggtcggcctcaccaacttctccacgcaggaagctttgtcctgttcaccccattgctccacggtgaccctgctcgctgcacatcttctccagctcccgtcccagt

SEQ ID NO: 42581 - DNA, 201 bp, Bos taurus
ttctaactgaaagaaaggttgggaaagtgagtctttccattgttctttatagggtgaggtcagggaagaaagagggaaataatggatagtagtcacggggaaatgggcctgctgtgtcctgggagaaagcccttctctcaggagctgggggatgtagggagcacaaggagctggggcggaccagctgggcctcaagaaggg

SEQ ID NO: 42582 - DNA, 201 bp, Bos taurus
tcaggagaggcgcaatgtgcaggatacatggccgtttgttaatcactccttgtgcatgtacgactttgacctcccgtgtaggtggtacggctggcagagctcgtgtcactctcaggccctctcagacttgcagcaatgactccaagactcctagaagacaaggctaaataagatcgcagaatcataggatgatttatggtt

SEQ ID NO: 42583 - DNA, 201 bp, Bos taurus
caatccaggaggcctctccaggagaagagaggaggaaatcagctccagcagtttcctcggctcctggcagaagccctcctatttagaagagggaggcaacagacagtttctgtggccaactacagcattcatgctgttgaccacttttctaatactgtttgcaagctttgtataatatcactaggttttctgcaattctca

SEQ ID NO: 42584 - DNA, 201 bp, Bos taurus
gcaagtactgtggaagagataattaaattgaaaataagcacctgaaatcaattatgatacacccatacaatagaatacttgaagtttttaaaaatgatcacgaggaggtatttatgcactgatgtaaaaaaacacaaggtaaattgcagaacaatgtgtataggatagtactaactgtggggaacagatgaattaaaacat

SEQ ID NO: 42585 - DNA, 201 bp, Bos taurus; identical to SEQ ID NO: 990

SEQ ID NO: 42586 - DNA, 201 bp, Bos taurus; identical to SEQ ID NO: 992

SEQ ID NO: 42587 - DNA, 201 bp, Bos taurus
gaaaagaccagaaacctaccctcgagaaccacagtcagcagtttgttctagcaagtgaattttctgtcctaacttcgtgactatagagagtaatcaggaacaactttgacctgcagttaactttaaagttacgacccaggtcaaggagggtgagaaggaagaacagtcaggacctttcagagtcaggtgagaaaaggagag

SEQ ID NO: 42588 - DNA, 201 bp, Bos taurus; identical to SEQ ID NO: 993

SEQ ID NO: 42589 - DNA, 201 bp, Bos taurus; identical to SEQ ID NO: 995

SEQ ID NO: 42590 - DNA, 201 bp, Bos taurus; identical to SEQ ID NO: 996

SEQ ID NO: 42591 - DNA, 201 bp, Bos taurus; identical to SEQ ID NO: 998

SEQ ID NO: 42592 - DNA, 201 bp, Bos taurus; identical to SEQ ID NO: 999

SEQ ID NO: 42593 - DNA, 201 bp, Bos taurus; identical to SEQ ID NO: 1000

SEQ ID NO: 42594 - DNA, 201 bp, Bos taurus; identical to SEQ ID NO: 1001

SEQ ID NO: 42595 - DNA, 201 bp, Bos taurus; identical to SEQ ID NO: 1002

SEQ ID NO: 42596 - DNA, 201 bp, Bos taurus; identical to SEQ ID NO: 1003

SEQ ID NO: 42597 - DNA, 201 bp, Bos taurus; identical to SEQ ID NO: 1004

SEQ ID NO: 42598 - DNA, 201 bp, Bos taurus; identical to SEQ ID NO: 1005

SEQ ID NO: 42599 - DNA, 201 bp, Bos taurus; identical to SEQ ID NO: 1006

SEQ ID NO: 42600 - DNA, 201 bp, Bos taurus; identical to SEQ ID NO: 1007

SEQ ID NO: 42601 - DNA, 201 bp, Bos taurus; identical to SEQ ID NO: 1008

SEQ ID NO: 42602 - DNA, 201 bp, Bos taurus; identical to SEQ ID NO: 1010

SEQ ID NO: 42603 - DNA, 201 bp, Bos taurus; identical to SEQ ID NO: 1011

SEQ ID NO: 42604 - DNA, 201 bp, Bos taurus; identical to SEQ ID NO: 1013

SEQ ID NO: 42605 - DNA, 201 bp, Bos taurus; identical to SEQ ID NO: 1014

SEQ ID NO: 42606 - DNA, 201 bp, Bos taurus; identical to SEQ ID NO: 1015

SEQ ID NO: 42607 - DNA, 201 bp, Bos taurus; identical to SEQ ID NO: 1016

SEQ ID NO: 42608 - DNA, 201 bp, Bos taurus; identical to SEQ ID NO: 1017

SEQ ID NO: 42609 - DNA, 201 bp, Bos taurus
cctcaaggtcactgagggtcaacgggcccctccccagaggccactgcttcttcaggactcaccctccacagtttcctctgggttcctgcagatgtacctcactgtccctggtgttatcacccagagtgccctgcgtcctgtattgggttccttacacactccccacatccctgtaaataatctcttcttagaattatctac

SEQ ID NO: 42610 - DNA, 201 bp, Bos taurus; identical to SEQ ID NO: 1019

SEQ ID NO: 42611 - DNA, 201 bp, Bos taurus; identical to SEQ ID NO: 1020

SEQ ID NO: 42612 - DNA, 201 bp, Bos taurus; identical to SEQ ID NO: 1021

SEQ ID NO: 42613 - DNA, 201 bp, Bos taurus; identical to SEQ ID NO: 1023

SEQ ID NO: 42614 - DNA, 201 bp, Bos taurus; identical to SEQ ID NO: 1024

SEQ ID NO: 42615 - DNA, 201 bp, Bos taurus; identical to SEQ ID NO: 1025

SEQ ID NO: 42616 - DNA, 201 bp, Bos taurus
ttttaagagcacagctcagccgtgtgaaacatgttcacccagctgtggaccacctccagagccttttcatctcctgaactgaagctctgcccccgaaacacggactccctggcccctccccagccccggcccccaggcccaccatctaccttcggtctctatggatctgactcccccagggacctcgggtaagggaattgt

SEQ ID NO: 42617 - DNA, 201 bp, Bos taurus; identical to SEQ ID NO: 1026

SEQ ID NO: 42618 - DNA, 201 bp, Bos taurus; identical to SEQ ID NO: 1027

SEQ ID NO: 42619 - DNA, 201 bp, Bos taurus
ctgcactccattttacagagaagccccgcttcagctgacatattgtgtgtagtcaccagccatataacacataggacacagccctctggctgaagtggggaaggccccgggcccctaaattcctgccccaggttggagaggcccagtgtgccctgtggaggtggcctggaagaccctggggcccggtggtgctccggaggg

SEQ ID NO: 42620 - DNA, 201 bp, Bos taurus; identical to SEQ ID NO: 1029

SEQ ID NO: 42621 - DNA, 201 bp, Bos taurus; identical to SEQ ID NO: 1030

SEQ ID NO: 42622 - DNA, 201 bp, Bos taurus
ctgcttgtggaaagtcttcagcgcctgcatcactgctgaggtgcactccacgtacgtgtagtcaatcatgatgtcccctggaaaacggaaggaaagactcaggcaatccaggccaaaccatgagacaggagagtgccgtaacacacggtgcctgactgtcctccagaggaaaggaggagatgtcaccggcgaccagcctgg

SEQ ID NO: 42623 - DNA, 201 bp, Bos taurus; identical to SEQ ID NO: 1031

SEQ ID NO: 42624 - DNA, 201 bp, Bos taurus
gtttgaggtcagaagtggtcagacattgggaattcacatgaatcagtgatagttccttcccttgaggaaatcgcagggccactgtattagagaccattcagaacacacggtgagggtgtgagacgctgatggggagggcagggtggcaggcggaggacagaggggcctctgcaagcttcccatgcaggtcagacttctgac

SEQ ID NO: 42625 - DNA, 201 bp, Bos taurus
gtcctgggcctggatgtggtgggtgtagcgcctggccccagagcgtgtcatccacctgagaacgcctcttactccctgggttgtctcccctgagcttcctctctgctgtcgtcttcattcttattgaccacatgttggacctcctggacttaaaactttctctttttccacatctttgttttcttgttctcatattcaaga

SEQ ID NO: 42626 - DNA, 201 bp, Bos taurus; identical to SEQ ID NO: 1032

SEQ ID NO: 42627 - DNA, 201 bp, Bos taurus
ccaccaccatgagactaatgggttgattgaggtgaaggggtacagcgtctgggcctggcgccaggcatcttccacactgggtgcctgacggccttccgcttagctctcgtgtccactctgtctcatgcagggtccatatcctcctgtgatgcgttcctcaacgtcttccaggccagagggctgaggccagaggtcatctgc

SEQ ID NO: 42628 - DNA, 201 bp, Bos taurus
cttcctgtgcctggggggctgctctccaaggacaggaaggggcttagctgcagggcctggggaccggcatctttcaggtggccgcccaggtgctgggcacctggtgttccttctctcacttgctcgcagtgttcctgggtctgcagccccatttgcacccactgatgctgcctggtgcccgggcctaggtctgccctgtaa

SEQ ID NO: 42629 - DNA, 201 bp, Bos taurus
ttctaaagtcttcgggaacgtggcaaagacgcactagcaagctcattgaaagtcctcaggaagagggctttccttttgtcacatggacttggccacagtatgccaacacaacagcttctggacatcagagcaacacggactgatacaaactcagtccatggtctgtatagaatggagctgtgtacctcatggggccgtgtt

SEQ ID NO: 42630 - DNA, 201 bp, Bos taurus
actcagacaattgattctcaatgatatcagagtattgactcactcaatctgaccacaacgtaaaaacattagtctcagaacggtgccggtgcccatactcccgggactggtggtttcctcctgttagtgttgtgatagtcgtgccattatgggaatgtttcaatatgcaggaaggcctgcattttcctggcacacagatat

SEQ ID NO: 42631 - DNA, 201 bp, Bos taurus
tatctgcattgttcatttttgagatatttctttataaattaatctgtaacctcctgcagatgcaggccaatctgggataagaaggccaggctaaataaataaaacagctcaattccagatcagttttccagtgtctcgcattaacttctaggagagctctgcagggaaggcctgctcttgaggctaaggtcagcaggaggg

SEQ ID NO: 42632 - DNA, 201 bp, Bos taurus
tccaagggcacatccagccctggcctcactgccaacaacctccagagacacagccgcgggggttccctcccgcctctgctattcctgaaggcacagaggatccatgtggtcaccgaaccaggggccaccgtcctggatagtaccagagagtgctctgagactacttagccagcttaggtgaaaatgtactctgtaccctct

SEQ ID NO: 42633 - DNA, 201 bp, Bos taurus
atgacagaggatgagacggttggatgatatcactgactcaatgcacatgagtttgggtaaactccgggagttggtgatggacagggaggcctgcagaagtgtatctgaaagtgcagattgccatactgcagttaccagaagaggtgacattcaactggaaatgggccagcagctagccattgagagccgcctgcttgcctc

SEQ ID NO: 42634 - DNA, 201 bp, Bos taurus; identical to SEQ ID NO: 1033

SEQ ID NO: 42635 - DNA, 201 bp, Bos taurus
tatgtatgaagggcgctggtatacctattgtacagatgaggagagtgaggccacacacctaagtgtgcaagcagcaagcaggccacctgctcatactttgtcacactaccttccaaagagctgcagaatcggcacaaacagatgcatgtgtagttatcaggaaacggaggactatcaattgggacatgatggctgtggggg

SEQ ID NO: 42636 - DNA, 201 bp, Bos taurus
tcctctgtccatggaatttttacctgcaacctacttcctatggtcacttgcaattcaaaactgtttgaaagcttctggcctaaaatgtcttttttccttgatacttattttgttaaagtgactcagagggggagcctgtatgagtctctgtgggtcccctaacctggctgtgcctctgttaccaccctggccaagtctaga

SEQ ID NO: 42637 - DNA, 201 bp, Bos taurus
aggctacagctctgcaaagagagggtatgagaacacatctggccaggatcatctggtgactgatgagcagacacagatggcagtctgaaatgagtttgagcggtgacatcccagctgtctccaggccctgctaatcatcttgaaagtgactggtgagccctacaggactctaacgtgtgggtatcacatgtctcctgagct

SEQ ID NO: 42638 - DNA, 201 bp, Bos taurus; identical to SEQ ID NO: 1034

SEQ ID NO: 42639 - DNA, 201 bp, Bos taurus
gaagaaaacaagatattttccccgctcgcttggagctgcagttggggagggcacacacgctataaattacaggcgacaagaaatgaccacagtgcggggcactgctcatggccaggctcggggaacagggtaccagctgcgaggagaatacggactttaatagagagtagggcaattcttctagcgtcgcgctctaaggca

SEQ ID NO: 42640 - DNA, 201 bp, Bos taurus; identical to SEQ ID NO: 1035

SEQ ID NO: 42641 - DNA, 201 bp, Bos taurus
gcagggttttcttcctctcctagccccgtggcccactgccccacaccctatccctgttgattgatcgagccttccttccagcgctcagctctgtctcatttccaggcacacaggccctgtaagcacagcggactgaggatccccaggacccagctgcacaaaagacccgggcctgtgagaaggctcagagcaacatctgcc

SEQ ID NO: 42642 - DNA, 201 bp, Bos taurus; identical to SEQ ID NO: 1036

SEQ ID NO: 42643 - DNA, 201 bp, Bos taurus; identical to SEQ ID NO: 1037

SEQ ID NO: 42644 - DNA, 201 bp, Bos taurus; identical to SEQ ID NO: 1038

SEQ ID NO: 42645 - DNA, 201 bp, Bos taurus; identical to SEQ ID NO: 1039

SEQ ID NO: 42646 - DNA, 201 bp, Bos taurus
tgtatgagcagggagcagacagcagcaaagaatccttttcagttgaggacagcatgatgggacttcaggaagaaagtggcccttgaacctcttaaaggatgagcaggactcagatggtgagtgacaaagaagggcaccctgatcagagcagggagacaggatggccagcatgcatggctcattccaggagaagcatgggac

SEQ ID NO: 42647 - DNA, 201 bp, Bos taurus
tttaaaaatacatactatataattaaataaaaccataaaacacaaatcaatagtgaaagtccgaagatggaagaaaggagggttcaaaaaggggccagatcaaaggattaccaagggaaatgagaaacttcttagggtgataaataccgttcacatcttgaccttggtaatggcctcctgtgtgtatacatatgtcaaatt

SEQ ID NO: 42648 - DNA, 201 bp, Bos taurus; identical to SEQ ID NO: 1040

SEQ ID NO: 42649 - DNA, 201 bp, Bos taurus; identical to SEQ ID NO: 1041

SEQ ID NO: 42650 - DNA, 201 bp, Bos taurus; identical to SEQ ID NO: 1042

SEQ ID NO: 42651 - DNA, 201 bp, Bos taurus
acccacgttagaagtactgttataagtaaaccggaagtagaaatctccagtttgtttatgagtaagccttatattcatggccttcttaaggcttttgtgagtacttttcagttttttttccctttggctatttagaaaaattatttttggccatgctgggtgtttgttgcagcaagggcattctctagttgcggggagcag

SEQ ID NO: 42652 - DNA, 201 bp, Bos taurus; identical to SEQ ID NO: 1043

SEQ ID NO: 42653 - DNA, 201 bp, Bos taurus; identical to SEQ ID NO: 1044

SEQ ID NO: 42654 - DNA, 201 bp, Bos taurus; identical to SEQ ID NO: 1045

SEQ ID NO: 42655 - DNA, 201 bp, Bos taurus; identical to SEQ ID NO: 1046

SEQ ID NO: 42656 - DNA, 201 bp, Bos taurus; identical to SEQ ID NO: 1047

SEQ ID NO: 42657 - DNA, 201 bp, Bos taurus; identical to SEQ ID NO: 1048

SEQ ID NO: 42658 - DNA, 201 bp, Bos taurus; identical to SEQ ID NO: 1049

SEQ ID NO: 42659 - DNA, 201 bp, Bos taurus
acagcaggtcacaggcccgcagttcaggaagggaacgtcagacctaggtggagagggggtgtttgagggtgagcaaggccaggtctcccaaggatagactgggaagccccccagcatgggggcagtggtcccgagagcaggacctcagccttggctcctggccaggatgagagaaaggaaccgtgtctctgaaaataagag

SEQ ID NO: 42660 - DNA, 201 bp, Bos taurus; identical to SEQ ID NO: 1050

SEQ ID NO: 42661 - DNA, 201 bp, Bos taurus; identical to SEQ ID NO: 1051

SEQ ID NO: 42662 - DNA, 201 bp, Bos taurus; identical to SEQ ID NO: 1052

SEQ ID NO: 42663 - DNA, 201 bp, Bos taurus; identical to SEQ ID NO: 1053

SEQ ID NO: 42664 - DNA, 201 bp, Bos taurus
gcacttccggtgcggggtggttctgagatgggggtgctccgccgccatcccccgaaagagcccctcctctctgtccacagcagaagagccacccaagctccgtggggatgtcagggcctcgtcccttgcttcttcttttctccttcctctaaagggaccctgtccccaggtgagggtttatcaggggaccagagtgaacca

SEQ ID NO: 42665 - DNA, 201 bp, Bos taurus; identical to SEQ ID NO: 1054

SEQ ID NO: 42666 - DNA, 201 bp, Bos taurus; identical to SEQ ID NO: 1055

SEQ ID NO: 42667 - DNA, 201 bp, Bos taurus; identical to SEQ ID NO: 1056

SEQ ID NO: 42668 - DNA, 201 bp, Bos taurus
gggaccatttctctgttgggggttgataattctgagtcaagatgctaggtcttcttccctatcaatgtccagctgtttccagtatttcttttcaagtttgccttgcccgaggctgacggacgaaagtgacaaagtaaaatctgtatgctcccctctgccccccaaccaaagccactccttgagatctaagactcaaggtcc

SEQ ID NO: 42669 - DNA, 201 bp, Bos taurus
gaagtattcaccttagggattagctggtccctttttggtttctgtgagccttattctgaccctaatcaacacaccctgggctacctttacgatctaaacatgttgactcatttctacttgccaacttttgggtgggctgctcttctgaccacacagaagcctttgacactaattcttgtatctttagcttgtgtcttacct

SEQ ID NO: 42670 - DNA, 201 bp, Bos taurus
atgggaggatggtttgaaatagcaattttcctcaagttttttgtttttgtctctgcttgtatctgtcccctacatacagcaaaacacacaatcagcaaccaattgcacaaattctcttcctatggcttctggcatgtgcagtggtacattattttatagtccctgtgtttgtattgatgtctcacatggtggcctcttaag

SEQ ID NO: 42671 - DNA, 201 bp, Bos taurus; identical to SEQ ID NO: 1057

SEQ ID NO: 42672 - DNA, 201 bp, Bos taurus; identical to SEQ ID NO: 1058

SEQ ID NO: 42673 - DNA, 201 bp, Bos taurus; identical to SEQ ID NO: 1059

SEQ ID NO: 42674 - DNA, 201 bp, Bos taurus; identical to SEQ ID NO: 1060

SEQ ID NO: 42675 - DNA, 201 bp, Bos taurus; identical to SEQ ID NO: 1061

SEQ ID NO: 42676 - DNA, 201 bp, Bos taurus; identical to SEQ ID NO: 1063

SEQ ID NO: 42677 - DNA, 201 bp, Bos taurus
ttccatggacagagaagcctggcgggctccagtgcatggggccccagagagtgagacatgactgagtgactttcatcatttcatcatcataaaggatgcagagggaggaggccacgtgaagatggagcaaagatgggagagaggtgactacatgccaaggaacacctggagccatcagaagccggaagaggcaggaagcgt

SEQ ID NO: 42678 - DNA, 201 bp, Bos taurus; identical to SEQ ID NO: 1064

SEQ ID NO: 42679 - DNA, 201 bp, Bos taurus
agtgtgtctttgagggtatggtcacatattaagcatgggagtcagaggggaagggcagaggcaggaatacacaagaatgggaggaggaggaaagcgtaagtccagagcaggtagagttagcttcaggtgagacagcaacgctaaggagcaggcgttctcacagtggccaagagtgggaaatagtcttagacgtctcatcag

SEQ ID NO: 42680 - DNA, 201 bp, Bos taurus; identical to SEQ ID NO: 1065

SEQ ID NO: 42681 - DNA, 201 bp, Bos taurus
ataaacagctcatacaactcaatattaaaaaacaactcagtgaaaaaataagcagaagacaaggagaactttgtacaaagatgacatacagatggccaacgggcactggaaagatgctaaacattgctaatcatcagagaaatatagatcaaaaccacagtgggatatcacttcacacctgtcagaatggccatcatcaaa

SEQ ID NO: 42682 - DNA, 201 bp, Bos taurus; identical to SEQ ID NO: 1068

SEQ ID NO: 42683 - DNA, 201 bp, Bos taurus; identical to SEQ ID NO: 1070

SEQ ID NO: 42684 - DNA, 201 bp, Bos taurus
gaatgctctcaggtaaaaaatgctcattttttaaactgagttttctatttctactaagcttgtttgttcattcagtctttaaggttttcttcttcctttcctcttaccattttaacattaatcttcatttttaaagtctcccaaagatttgcaccaatgaaataattcattgaattcacatgagtctgcctaagtcaggtt

SEQ ID NO: 42685 - DNA, 201 bp, Bos taurus; identical to SEQ ID NO: 1072

SEQ ID NO: 42686 - DNA, 201 bp, Bos taurus; identical to SEQ ID NO: 1073

SEQ ID NO: 42687 - DNA, 201 bp, Bos taurus; identical to SEQ ID NO: 1075

SEQ ID NO: 42688 - DNA, 201 bp, Bos taurus; identical to SEQ ID NO: 1076

SEQ ID NO: 42689 - DNA, 201 bp, Bos taurus; identical to SEQ ID NO: 1077

SEQ ID NO: 42690 - DNA, 201 bp, Bos taurus
cagccagtaaccattacttgccctccacccagatataaatgaaacagttcttttatttgttttatatattgggcttcccaagaacattgtcttaggccaaacttcctggaagcagaacctgagacagttttagatgcgtacaggttattgaggggttccctggaaagaagcctgtgagggagtaaggggagcaggccgtga

SEQ ID NO: 42691 - DNA, 201 bp, Bos taurus; identical to SEQ ID NO: 1079

SEQ ID NO: 42692 - DNA, 201 bp, Bos taurus; identical to SEQ ID NO: 1081

SEQ ID NO: 42693 - DNA, 201 bp, Bos taurus; identical to SEQ ID NO: 1082

SEQ ID NO: 42694 - DNA, 201 bp, Bos taurus; identical to SEQ ID NO: 1083

SEQ ID NO: 42695 - DNA, 201 bp, Bos taurus; identical to SEQ ID NO: 1085

SEQ ID NO: 42696 - DNA, 201 bp, Bos taurus; identical to SEQ ID NO: 1086

SEQ ID NO: 42697 - DNA, 201 bp, Bos taurus; identical to SEQ ID NO: 1087

SEQ ID NO: 42698 - DNA, 201 bp, Bos taurus; identical to SEQ ID NO: 1088

SEQ ID NO: 42699 - DNA, 201 bp, Bos taurus; identical to SEQ ID NO: 1091

SEQ ID NO: 42700 - DNA, 201 bp, Bos taurus; identical to SEQ ID NO: 1092

SEQ ID NO: 42701 - DNA, 201 bp, Bos taurus; identical to SEQ ID NO: 1093

SEQ ID NO: 42702 - DNA, 201 bp, Bos taurus; identical to SEQ ID NO: 1094

SEQ ID NO: 42703 - DNA, 201 bp, Bos taurus; identical to SEQ ID NO: 1096

SEQ ID NO: 42704 - DNA, 201 bp, Bos taurus; identical to SEQ ID NO: 1097

SEQ ID NO: 42705 - DNA, 201 bp, Bos taurus; identical to SEQ ID NO: 1098

SEQ ID NO: 42706 - DNA, 201 bp, Bos taurus; identical to SEQ ID NO: 1100

SEQ ID NO: 42707 - DNA, 201 bp, Bos taurus; identical to SEQ ID NO: 1101

SEQ ID NO: 42708 - DNA, 201 bp, Bos taurus
tgtccatcttagtttgtgtcaagaaggccctctttctactctggaatgtgtccttcacgggtcatctcaagactcactttggaaaagggtgaagctgaagggttacttcacaggccccacaatccgccccttttcttgggcatcccagggctcatctttctgagtttgcttctgaggctgccgcgccatgggcgtcacaca

SEQ ID NO: 42709 - DNA, 201 bp, Bos taurus
cagagcagctgagcctgtgcaccacatttaagcctgtgatctagcgcctgggagtggcaactaccgagcactgaggcctaggtgcctggatcccacgctccacacaagagaacccactgcagcttgacgcctcttcttcctggactgtgtgagcctgtaatccacctcccaggatccacagtccctccttccttgacggcc

SEQ ID NO: 42710 - DNA, 201 bp, Bos taurus
gaaggacagggaggcctggcatgctgcagtccatggggtcgcaaagagtcagacaggacttagcgactgaacaacagcaaagttaatgaaaaggctgcagtgctcaatgggaggcccttttgtattgcaggtggaatatcccaaggctgtcgcagcaatgcaagaagagccatcatatcttgggacattttagtgtcctct

SEQ ID NO: 42711 - DNA, 201 bp, Bos taurus
acctaaaacaacggggttccttggaaactagctggataggaatgccaagaagacaggttagtatttgatttttagaattggccaaggggcctttttacataagttaggatgagatcagagcatggcatgactttcttttccaacgtgaaccactagagaaattctcctctcactgtaatacacagtgggaataagcaaggt

SEQ ID NO: 42712 - DNA, 201 bp, Bos taurus; identical to SEQ ID NO: 1102

SEQ ID NO: 42713 - DNA, 201 bp, Bos taurus; identical to SEQ ID NO: 1104

SEQ ID NO: 42714 - DNA, 201 bp, Bos taurus; identical to SEQ ID NO: 1105

SEQ ID NO: 42715 - DNA, 201 bp, Bos taurus; identical to SEQ ID NO: 1106

SEQ ID NO: 42716 - DNA, 201 bp, Bos taurus; identical to SEQ ID NO: 1107

SEQ ID NO: 42717 - DNA, 201 bp, Bos taurus
accttaggggttaagtaggagtttgctagatatacatgtgggtgggtatctttggcagtattcacagcataaccaaaggcaggggggagcttttgtgctcaggaagtgctgttgtactcacggaacttagctcccctgctgtgatcatggtattgaaatatgtgtgtgttagggtcagggtgtgttggtgtcagctcacac

SEQ ID NO: 42718 - DNA, 201 bp, Bos taurus; identical to SEQ ID NO: 1109

SEQ ID NO: 42719 - DNA, 201 bp, Bos taurus; identical to SEQ ID NO: 1110

SEQ ID NO: 42720 - DNA, 201 bp, Bos taurus; identical to SEQ ID NO: 1111

SEQ ID NO: 42721 - DNA, 201 bp, Bos taurus; identical to SEQ ID NO: 1112

SEQ ID NO: 42722 - DNA, 201 bp, Bos taurus; identical to SEQ ID NO: 1113

SEQ ID NO: 42723 - DNA, 201 bp, Bos taurus; identical to SEQ ID NO: 1114

SEQ ID NO: 42724 - DNA, 201 bp, Bos taurus; identical to SEQ ID NO: 1115

SEQ ID NO: 42725 - DNA, 201 bp, Bos taurus; identical to SEQ ID NO: 1116

SEQ ID NO: 42726 - DNA, 201 bp, Bos taurus; identical to SEQ ID NO: 1117

SEQ ID NO: 42727 - DNA, 201 bp, Bos taurus; identical to SEQ ID NO: 1118

SEQ ID NO: 42728 - DNA, 201 bp, Bos taurus; identical to SEQ ID NO: 1119

SEQ ID NO: 42729 - DNA, 201 bp, Bos taurus; identical to SEQ ID NO: 1120

SEQ ID NO: 42730 - DNA, 201 bp, Bos taurus; identical to SEQ ID NO: 1121

SEQ ID NO: 42731 - DNA, 201 bp, Bos taurus; identical to SEQ ID NO: 1122

SEQ ID NO: 42732 - DNA, 201 bp, Bos taurus; identical to SEQ ID NO: 1123

SEQ ID NO: 42733 - DNA, 201 bp, Bos taurus; identical to SEQ ID NO: 1124

SEQ ID NO: 42734 - DNA, 201 bp, Bos taurus; identical to SEQ ID NO: 1125

SEQ ID NO: 42735 - DNA, 201 bp, Bos taurus; identical to SEQ ID NO: 1126

SEQ ID NO: 42736 - DNA, 201 bp, Bos taurus; identical to SEQ ID NO: 1127

SEQ ID NO: 42737 - DNA, 201 bp, Bos taurus; identical to SEQ ID NO: 1128

SEQ ID NO: 42738 - DNA, 201 bp, Bos taurus; identical to SEQ ID NO: 1129

SEQ ID NO: 42739 - DNA, 201 bp, Bos taurus; identical to SEQ ID NO: 1130

SEQ ID NO: 42740 - DNA, 201 bp, Bos taurus; identical to SEQ ID NO: 1131

SEQ ID NO: 42741 - DNA, 201 bp, Bos taurus; identical to SEQ ID NO: 1132

SEQ ID NO: 42742 - DNA, 201 bp, Bos taurus; identical to SEQ ID NO: 1133

SEQ ID NO: 42743 - DNA, 201 bp, Bos taurus; identical to SEQ ID NO: 1134

SEQ ID NO: 42744 - DNA, 201 bp, Bos taurus; identical to SEQ ID NO: 1135

SEQ ID NO: 42745 - DNA, 201 bp, Bos taurus; identical to SEQ ID NO: 1136

SEQ ID NO: 42746 - DNA, 201 bp, Bos taurus; identical to SEQ ID NO: 1137

SEQ ID NO: 42747 - DNA, 201 bp, Bos taurus; identical to SEQ ID NO: 1138

SEQ ID NO: 42748 - DNA, 201 bp, Bos taurus; identical to SEQ ID NO: 1145

SEQ ID NO: 42749 - DNA, 201 bp, Bos taurus; identical to SEQ ID NO: 1146

SEQ ID NO: 42750 - DNA, 201 bp, Bos taurus; identical to SEQ ID NO: 1147

SEQ ID NO: 42751 - DNA, 201 bp, Bos taurus; identical to SEQ ID NO: 1148

SEQ ID NO: 42752 - DNA, 201 bp, Bos taurus; identical to SEQ ID NO: 1149

SEQ ID NO: 42753 - DNA, 201 bp, Bos taurus; identical to SEQ ID NO: 1150

SEQ ID NO: 42754 - DNA, 201 bp, Bos taurus; identical to SEQ ID NO: 1151

SEQ ID NO: 42755 - DNA, 201 bp, Bos taurus; identical to SEQ ID NO: 1152

SEQ ID NO: 42756 - DNA, 201 bp, Bos taurus; identical to SEQ ID NO: 1153

SEQ ID NO: 42757 - DNA, 201 bp, Bos taurus; identical to SEQ ID NO: 1154

SEQ ID NO: 42758 - DNA, 201 bp, Bos taurus; identical to SEQ ID NO: 1155

SEQ ID NO: 42759 - DNA, 201 bp, Bos taurus; identical to SEQ ID NO: 1156

SEQ ID NO: 42760 - DNA, 201 bp, Bos taurus; identical to SEQ ID NO: 1157

SEQ ID NO: 42761 - DNA, 201 bp, Bos taurus; identical to SEQ ID NO: 1158

SEQ ID NO: 42762 - DNA, 201 bp, Bos taurus; identical to SEQ ID NO: 1159

SEQ ID NO: 42763 - DNA, 201 bp, Bos taurus; identical to SEQ ID NO: 1161

SEQ ID NO: 42764 - DNA, 201 bp, Bos taurus; identical to SEQ ID NO: 1162

SEQ ID NO: 42765 - DNA, 201 bp, Bos taurus; identical to SEQ ID NO: 1163

SEQ ID NO: 42766 - DNA, 201 bp, Bos taurus; identical to SEQ ID NO: 1166

SEQ ID NO: 42767 - DNA, 201 bp, Bos taurus; identical to SEQ ID NO: 1167

SEQ ID NO: 42768 - DNA, 201 bp, Bos taurus; identical to SEQ ID NO: 1168

SEQ ID NO: 42769 - DNA, 201 bp, Bos taurus; identical to SEQ ID NO: 1175

SEQ ID NO: 42770 - DNA, 201 bp, Bos taurus; identical to SEQ ID NO: 1176

SEQ ID NO: 42771 - DNA, 201 bp, Bos taurus; identical to SEQ ID NO: 1178

SEQ ID NO: 42772 - DNA, 201 bp, Bos taurus
tttttctgtgattgctctcaccccctcccttggctttaatcccggaatatttaaggatgcccccaacccctctctccagggcagctcctctcctggtgccggacccatgtggccaattccacagggtgtttgtttcacaggcgcccatctaccacccctcccccactggcttttacttctgggttcccaaaccgccctggg

SEQ ID NO: 42773 - DNA, 201 bp, Bos taurus; identical to SEQ ID NO: 1179

SEQ ID NO: 42774 - DNA, 201 bp, Bos taurus; identical to SEQ ID NO: 1180

SEQ ID NO: 42775 - DNA, 201 bp, Bos taurus
cacttcctcgcccccacagccattggcggtcgatgtctgttgctgggcaaattatcctcatttccagtttgcagaagcagagagtgagacatgttcccaggagcaaatcagtgtcaggccctgtcatagctgagacagcagtactcaaagaggggttctgaaggatgctggttaactcgttgagaccctgtgtcttggttg

SEQ ID NO: 42776 - DNA, 201 bp, Bos taurus; identical to SEQ ID NO: 1182

SEQ ID NO: 42777 - DNA, 201 bp, Bos taurus; identical to SEQ ID NO: 1183

SEQ ID NO: 42778 - DNA, 201 bp, Bos taurus
taaacaaatatttgctgagcactctgtgctaagctctactaaactttggccttaaccaattgaataagatgaattggaccttgccctaatttttattttaataggcgacagagagcatagaaagacagttatgacaatagcgtgttttaagtgcagtggtaatggaggcacagtgtatgtataaatctagaggatgcagat

SEQ ID NO: 42779 - DNA, 201 bp, Bos taurus
ctccacagttgagcatgttcaggtgcagagctagatgggccagctgaaggttagtgcagtggtgcaggccagtgagagaagatagggcctgatccaggcctaccaatagctgctttgtgtgtctgcatgctttcccatggctgttgccttcccctgggcatttacaaggcactggagaccagtgctcagctggagggacta

SEQ ID NO: 42780 - DNA, 201 bp, Bos taurus; identical to SEQ ID NO: 1185

SEQ ID NO: 42781 - DNA, 201 bp, Bos taurus; identical to SEQ ID NO: 1186

SEQ ID NO: 42782 - DNA, 201 bp, Bos taurus; identical to SEQ ID NO: 1187

SEQ ID NO: 42783 - DNA, 201 bp, Bos taurus; identical to SEQ ID NO: 1190

SEQ ID NO: 42784 - DNA, 201 bp, Bos taurus; identical to SEQ ID NO: 1191

SEQ ID NO: 42785 - DNA, 201 bp, Bos taurus
acagcagcaaaggaaaactataaagacattatgtttgagaataactcattaaagaagtagaagttgctgatgcgttacttcaaagggaaatatgtttaatatatttggaagatgaaagaatttgcagcagaaggagttagctataggctgtatttaagtcttacacacccaccttaatattgggtatagaactgtaatatc

SEQ ID NO: 42786 - DNA, 201 bp, Bos taurus
attaaattatgaagacactgtgaggatgaccagtttgcattggtcagtagcacagatacagtagcacagttacttcttagaatgggttactttgcagtatcaaatatagtcaagaagtgtgccccattttactaagccttatatataagtctcattcttcagtagtggatgaagcattttttctccagtggatagatcttt

SEQ ID NO: 42787 - DNA, 201 bp, Bos taurus; identical to SEQ ID NO: 1193

SEQ ID NO: 42788 - DNA, 201 bp, Bos taurus; identical to SEQ ID NO: 1195

SEQ ID NO: 42789 - DNA, 201 bp, Bos taurus
gagatggttagatagcatcactgacttaatggacatgaattggagcaaaagccaagaaacagtggaggatagaggagcctgaggtactacaggccataggattgcaaagagttgaacatgactttgtgactgagcaaaatatagattaaaaataaatggatggcatgaattgctctagtaattatctatgctggacatctt

SEQ ID NO: 42790 - DNA, 201 bp, Bos taurus; identical to SEQ ID NO: 1196

SEQ ID NO: 42791 - DNA, 201 bp, Bos taurus
aacctcaagtcccagctattagcatataatttcagtgatttcatagaatcatggacaccaaactacacctgtggatgacctaggagtacttaaccttccacatatatccttagcttacattttcagcaatgttgaatggatattatgttgcttctaaattctacttatattttcttctctcagaccccagctagcaggcat

SEQ ID NO: 42792 - DNA, 201 bp, Bos taurus
ctagaatatatatacaccatattcataacatacctatgcaaagataaaacaaagagatttagggagatgtttctaattaacacaatgccaacttttaaatacattttaaacacccaaattcactgtgggaattttcaggaagaattacatgctccgtgctattttcagaatatgaagtttaagctagtacatctgttaaat

SEQ ID NO: 42793 - DNA, 201 bp, Bos taurus
cccaagatatttgtgtgcatattctctatgtaacccccccaaaaaaactttgatatgcacagaagttcatataacaacatattcttattttctattattactgaagtcatatttcttgattcaaaaatcttagcatacagttttgtattgcttgcttccctctggtttctgatcatataatgattatatttaagatccaaa

SEQ ID NO: 42794 - DNA, 201 bp, Bos taurus; identical to SEQ ID NO: 1197

SEQ ID NO: 42795 - DNA, 201 bp, Bos taurus; identical to SEQ ID NO: 1198

SEQ ID NO: 42796 - DNA, 201 bp, Bos taurus; identical to SEQ ID NO: 1199

SEQ ID NO: 42797 - DNA, 201 bp, Bos taurus; identical to SEQ ID NO: 1202

SEQ ID NO: 42798 - DNA, 201 bp, Bos taurus
agtccaaaatctctaacaatatgctattagttatttgttctgctattgaagtactgtcacatgccagattaccaccacaggtcacttttgatttatattgctgtaaaacaccataataaactgagtcaacaatcctactaacggtttctttatggattggtggaaaacatagcctttcttcagaattccgtaaaacagtga

SEQ ID NO: 42799 - DNA, 201 bp, Bos taurus
aatggggaaccttatgtagattttattgccaggctaagtcaaaatttaaataaaatagtctcacaaccaggtttgagagatatgctgatgcaagttcttatttatgacaatgctaactcaaaatgtaaaaaggtgattcagcctctcaaaacacagggtgcccctctagaaaaatatcttaaagttttccaggatattggg

SEQ ID NO: 42800 - DNA, 201 bp, Bos taurus; identical to SEQ ID NO: 1204

SEQ ID NO: 42801 - DNA, 201 bp, Bos taurus
agtaaacctttaatccaattttctgttgatgggtggaggtgtgttccctgcctgctgtttacctggtgccaaactatggtggaggttatgaagataatggcgacctcctttgaaatatcccatgaatgcactgctatactcactgccccaaccctgcagcaggccaccactgacccccgcctccactggaatctcctagac

SEQ ID NO: 42802 - DNA, 201 bp, Bos taurus
gctgtttgctgatcacttacatgtcatttttatagtttgtatagtttagcaatagttccgatactacacttaagaattattctatatattagtgtaaaccaatatccaatgcttccaggggaaataaattagtggagaataaacagatgaacaggtaaaaaaaatacaagatagggtaaagtaaatgcatttttcaggtgg

SEQ ID NO: 42803 - DNA, 201 bp, Bos taurus
aaacttttggagtagttgatggacagggaggcctggcatgctgtagcccatggggtcacaaagagtcagacatgactgagcaactaatctgaaccaaatagcaactaaaccaaataaacaagtggccctttgaagcccatatattttgtcactgcaaataattgtttactgctgtagatagtctctcttcatgaatcattt

SEQ ID NO: 42804 - DNA, 201 bp, Bos taurus
tctgatgaaagaccacaatgtgggaagaaaaatccaagaggtggtcttctaattccccttgggaggaaggatgtctttgtttgacaaaaaaaaataatgtgtcattttatttggaaagattgttctcagggtagcacttgaataactcaaagaacaaacttttgagaaaaaaaaaataaagaataatgtaggggttagtag

SEQ ID NO: 42805 - DNA, 201 bp, Bos taurus
aaaataaagaacacatctgaatcagttctaatgaaatacatgaaactggaatctgttacagagagagaagtaaatcagaaagagaaacgccaatacagtgtattaagaaatatatatgaaacttagaaagacagtaatggcgaccctatatgcaagacagcaaaagaaatacagatgtaaagaacagacttttggactatg

SEQ ID NO: 42806 - DNA, 201 bp, Bos taurus; identical to SEQ ID NO: 1206

SEQ ID NO: 42807 - DNA, 201 bp, Bos taurus; identical to SEQ ID NO: 1207

SEQ ID NO: 42808 - DNA, 201 bp, Bos taurus; identical to SEQ ID NO: 1208

SEQ ID NO: 42809 - DNA, 201 bp, Bos taurus; identical to SEQ ID NO: 1209

SEQ ID NO: 42810 - DNA, 201 bp, Bos taurus
ttaccaactcaggccactgagagccagaaggccttcacagcagtgtttaaagtgactctcatctcttagggccaaaggccggactgagactggaactgaattgtgacggtagacaagatgcaaaagaggtggagagaatagccaagacaggtctaagttggagtcagggccctgagagtgaggacttgagaaataggatga

SEQ ID NO: 42811 - DNA, 201 bp, Bos taurus; identical to SEQ ID NO: 1213

SEQ ID NO: 42812 - DNA, 201 bp, Bos taurus; identical to SEQ ID NO: 1214

SEQ ID NO: 42813 - DNA, 201 bp, Bos taurus; identical to SEQ ID NO: 1217

SEQ ID NO: 42814 - DNA, 201 bp, Bos taurus
ttaaatagattatttaactgtcgtatgttgcaaatatttcttcccagttggattttgtttatgacttctatttatgggtctttaggaccttattggcattaaataacctttatgttatgcatctcagtctatgtctgcctttattgccgtactatggctttactagtttatggttatataaagttctttgtaatctagaaa

SEQ ID NO: 42815 - DNA, 201 bp, Bos taurus; identical to SEQ ID NO: 1218

SEQ ID NO: 42816 - DNA, 201 bp, Bos taurus; identical to SEQ ID NO: 1220

SEQ ID NO: 42817 - DNA, 201 bp, Bos taurus
ctgaacttatgtaggcttgtttaactgttaggacaaatctgtaaaagtcccaagaggctctcaagctctttagattggtaatactcaaacattttaaaatactgtttcttctgggaattttttccagggcatagttttaggctttgctaaggcaggtctaaagcaagccttattctgaagcatgtttttttacttctaagg

SEQ ID NO: 42818 - DNA, 201 bp, Bos taurus; identical to SEQ ID NO: 1222

SEQ ID NO: 42819 - DNA, 201 bp, Bos taurus
cttcctgagtctagtgtcctcgccttgccgtgctccttcagtgagcacacttctggtgtctgactcctgccatgtgcagcagctcacaggaccagtggccagaatcttcccccaagacccctgagacttatcttcacagccaagcacgatggtggaagcatctccctagggatgacttcccctggtaccttctccggcccc

SEQ ID NO: 42820 - DNA, 201 bp, Bos taurus; identical to SEQ ID NO: 1223

SEQ ID NO: 42821 - DNA, 201 bp, Bos taurus; identical to SEQ ID NO: 1224

SEQ ID NO: 42822 - DNA, 201 bp, Bos taurus; identical to SEQ ID NO: 1225

SEQ ID NO: 42823 - DNA, 201 bp, Bos taurus
cccaccatatccaacgtctttacctcctcttcattacctcttttatctccctttggaagaaaagttccttgaaaccaactgaaatactactatttcattcgaatttatattcacttgctaaattcacattatatccatacccaactatgtgcagttctattgcttgatcagtgccacattcattgatgatcttaaattatt

SEQ ID NO: 42824 - DNA, 201 bp, Bos taurus; identical to SEQ ID NO: 1226

SEQ ID NO: 42825 - DNA, 201 bp, Bos taurus; identical to SEQ ID NO: 1227

SEQ ID NO: 42826 - DNA, 201 bp, Bos taurus; identical to SEQ ID NO: 1228

SEQ ID NO: 42827 - DNA, 201 bp, Bos taurus; identical to SEQ ID NO: 1229

SEQ ID NO: 42828 - DNA, 201 bp, Bos taurus; identical to SEQ ID NO: 1230

SEQ ID NO: 42829 - DNA, 201 bp, Bos taurus; identical to SEQ ID NO: 1231

SEQ ID NO: 42830 - DNA, 201 bp, Bos taurus
acagctgtttgacaggtcttccgtctcttcacgttttgtctgtaccaagtaaacccaccgtgtatgctagcataggttggcaaaccctcaaattgagatcaccgctcaaaaatacccccatattgggaaatattaacctgtatggtttactttggcttgatgaaccttattttcttagttgtgagaaactttttttttttt

SEQ ID NO: 42831 - DNA, 201 bp, Bos taurus; identical to SEQ ID NO: 1232

SEQ ID NO: 42832 - DNA, 201 bp, Bos taurus; identical to SEQ ID NO: 1233

SEQ ID NO: 42833 - DNA, 201 bp, Bos taurus; identical to SEQ ID NO: 1234

SEQ ID NO: 42834 - DNA, 201 bp, Bos taurus; identical to SEQ ID NO: 1235

SEQ ID NO: 42835 - DNA, 201 bp, Bos taurus; identical to SEQ ID NO: 1236

SEQ ID NO: 42836 - DNA, 201 bp, Bos taurus; identical to SEQ ID NO: 1237

SEQ ID NO: 42837 - DNA, 201 bp, Bos taurus; identical to SEQ ID NO: 1238

SEQ ID NO: 42838 - DNA, 201 bp, Bos taurus; identical to SEQ ID NO: 1239

SEQ ID NO: 42839 - DNA, 201 bp, Bos taurus; identical to SEQ ID NO: 1240

SEQ ID NO: 42840 - DNA, 201 bp, Bos taurus; identical to SEQ ID NO: 1241

SEQ ID NO: 42841 - DNA, 201 bp, Bos taurus
aagactgtctggagtggggcgagactgaaaggggaggctaattacgaggccataataaataattctaagaaaagagtatctgggtttcccgataaccccatataaagatgccaccaaggctgctattttggggaaatgggggaaggattccataatagatggaaagaatttctgctccattctgggcatcgtgtggtatga

SEQ ID NO: 42842 - DNA, 201 bp, Bos taurus; identical to SEQ ID NO: 1243

SEQ ID NO: 42843 - DNA, 201 bp, Bos taurus; identical to SEQ ID NO: 1244

SEQ ID NO: 42844 - DNA, 201 bp, Bos taurus
agatgacagattttgctgaatatctaggccttacagctgttttccagggaaaacaaagaaaggatacaggcagacccaacactcccacatatatttcatcaatcagaggaatgtcacacggccacccaacatgataacccctagtggcagggagcctgccaattgggtttttgattttcaaactctatcagtaagttatga

SEQ ID NO: 42845 - DNA, 201 bp, Bos taurus; identical to SEQ ID NO: 1246

SEQ ID NO: 42846 - DNA, 201 bp, Bos taurus; identical to SEQ ID NO: 1247

SEQ ID NO: 42847 - DNA, 201 bp, Bos taurus; identical to SEQ ID NO: 1248

SEQ ID NO: 42848 - DNA, 201 bp, Bos taurus
ctgcatcagccagagggaataaaacatgtctgcagttcctacaactcctcgtattttctttcagcttcccagctcatgcgttgcctaccctgggttcagcgatcagtgagacactggtttattttaaaaacatggcatgatacaagctaaacaataatcactttctatctttttaattggattgtaagtttttttcctcca

SEQ ID NO: 42849 - DNA, 201 bp, Bos taurus
taattgtacaatttttcctttagaacattggctttacaaagggtctataagcagccactggctttccacaagttcagtgttactacatcagaaatggatcttacttttcattggcttatttgctcctaagacctactcagagatgtggagtccagttattattgactcacttcctttcctatgcttagggagataaacctg

SEQ ID NO: 42850 - DNA, 201 bp, Bos taurus; identical to SEQ ID NO: 1250

SEQ ID NO: 42851 - DNA, 201 bp, Bos taurus; identical to SEQ ID NO: 1251

SEQ ID NO: 42852 - DNA, 201 bp, Bos taurus; identical to SEQ ID NO: 1252

SEQ ID NO: 42853 - DNA, 201 bp, Bos taurus; identical to SEQ ID NO: 1253

SEQ ID NO: 42854 - DNA, 201 bp, Bos taurus; identical to SEQ ID NO: 1254

SEQ ID NO: 42855 - DNA, 201 bp, Bos taurus
ttgttttaataattggaaaatttcaactcaggaggaaaactggccaagggaaaaagcctacatctaaactcagtttgggaagctctggattttccttgatctggagaccgcagggcagctttctgtcggcctctaaccttcctttgactggctctggaattttgtttaaaatatttcaagattcgaaagacagcaacaact

SEQ ID NO: 42856 - DNA, 201 bp, Bos taurus
accatatttacaggagaacactgtttagaaaaaattcttattggtagagacagtcctctcaatcttagaacataatcaccatcagtttgataggtcctctttgaaaatgaagacaatatgtcctctcaagcttgatttggagggtcactcactatttctgattacttgcaaaattctttactatcatctgattacttcata

SEQ ID NO: 42857 - DNA, 201 bp, Bos taurus; identical to SEQ ID NO: 1255

SEQ ID NO: 42858 - DNA, 201 bp, Bos taurus; identical to SEQ ID NO: 1257

SEQ ID NO: 42859 - DNA, 201 bp, Bos taurus; identical to SEQ ID NO: 1259

SEQ ID NO: 42860 - DNA, 201 bp, Bos taurus; identical to SEQ ID NO: 1260

SEQ ID NO: 42861 - DNA, 201 bp, Bos taurus; identical to SEQ ID NO: 1261

SEQ ID NO: 42862 - DNA, 201 bp, Bos taurus; identical to SEQ ID NO: 1262

SEQ ID NO: 42863 - DNA, 201 bp, Bos taurus; identical to SEQ ID NO: 1263

SEQ ID NO: 42864 - DNA, 201 bp, Bos taurus; identical to SEQ ID NO: 1264

SEQ ID NO: 42865 - DNA, 201 bp, Bos taurus; identical to SEQ ID NO: 1265

SEQ ID NO: 42866 - DNA, 201 bp, Bos taurus; identical to SEQ ID NO: 1266

SEQ ID NO: 42867 - DNA, 201 bp, Bos taurus; identical to SEQ ID NO: 1267

SEQ ID NO: 42868 - DNA, 201 bp, Bos taurus; identical to SEQ ID NO: 1269

SEQ ID NO: 42869 - DNA, 201 bp, Bos taurus; identical to SEQ ID NO: 1270

SEQ ID NO: 42870 - DNA, 201 bp, Bos taurus; identical to SEQ ID NO: 1271

SEQ ID NO: 42871 - DNA, 201 bp, Bos taurus; identical to SEQ ID NO: 1272

SEQ ID NO: 42872 - DNA, 201 bp, Bos taurus
gttcttttcggaaactgaaagtaaaaggtaactttatatttgcaggaaaaaaatttggtttctttttcactgcatggttactctgatgtaactgatataacagagtggacattagtatataagatgatcaaatgagtcatgcgatggaacatctgcctcagaaagccctttcagacatcatatgctatgccgttgaagtgt

SEQ ID NO: 42873 - DNA, 201 bp, Bos taurus; identical to SEQ ID NO: 1276

SEQ ID NO: 42874 - DNA, 201 bp, Bos taurus
gtttatccccataacaatctatccagatgtttagaacattaatgtgatttttagattttatttaactcctacaaaaaacaagtggagagagaaaaaactatattcccttcagacagtaatcagaagaataaagaacatctcaccagggcccttgtctcaatatgatgtcagaaatgcaccctaacgagtaacatttcaaat

SEQ ID NO: 42875 - DNA, 201 bp, Bos taurus
tttctgtgttcctcctatggcaggaggcatttctgtccactgcttttctataatatcctaatcatgtaaacgttcagagtcagatacaggcattgggccattttctaccagcaagtgttgctcttatgccctaaaatacctgaaccaatgcgctttggcaccttctgcttcttttctcaatttggcagcaaacctgggtgg

SEQ ID NO: 42876 - DNA, 201 bp, Bos taurus; identical to SEQ ID NO: 1278

SEQ ID NO: 42877 - DNA, 201 bp, Bos taurus; identical to SEQ ID NO: 1279

SEQ ID NO: 42878 - DNA, 201 bp, Bos taurus; identical to SEQ ID NO: 1281

SEQ ID NO: 42879 - DNA, 201 bp, Bos taurus; identical to SEQ ID NO: 1282

SEQ ID NO: 42880 - DNA, 201 bp, Bos taurus; identical to SEQ ID NO: 1283

SEQ ID NO: 42881 - DNA, 201 bp, Bos taurus
gatgttgataatccgcccacggcccttcatctcagcgcctgtccttggaagtttggactcaggcaaaccagggtaatcaccttcagctccagattgtgccggggggccagactgcatcgagtcttggggagcagcgagtccaggcggctgcagctgcatttccccccagtgccaggaaaggttctaattcaaaaacaaatg

SEQ ID NO: 42882 - DNA, 201 bp, Bos taurus
gcccaaaagagatacttacagatgactcttcaacttgtgatttaaagtattttaaagcagtattttatttcttccctttgtaccagattgtagtctgacaaattttgctaataatggcccttcaaaactggaccccagctcttaacagctgagaaataaaaacaccatgctcatacacatgcagttcttgatccttgtccc

SEQ ID NO: 42883 - DNA, 201 bp, Bos taurus; identical to SEQ ID NO: 1284

SEQ ID NO: 42884 - DNA, 201 bp, Bos taurus
acctttactaagcattctcaacttattactactactaataataacatcttccattcatcagtattatccaacagttctcagagtgtggtccagaaacctacgggggtccctagacactttcagaggctccatgaggtcaaaattgttttcacaataaagcaaaagctttatttgcctttttcactgtcagtctctcaaaaa

SEQ ID NO: 42885 - DNA, 201 bp, Bos taurus
gaaacatcaaatcttagaatacttagttagagctcaatccttttaatgcctccatggtcctgataattttacttttaaggagagtgaatttgggtagttcgtaagaggacacacctatacttcttggagacccagttttgtatgctttcgggtcaccttgaaagataaagggaaaaaaatgttttccactgaggtagataa

SEQ ID NO: 42886 - DNA, 201 bp, Bos taurus; identical to SEQ ID NO: 1286

SEQ ID NO: 42887 - DNA, 201 bp, Bos taurus; identical to SEQ ID NO: 1287

SEQ ID NO: 42888 - DNA, 201 bp, Bos taurus; identical to SEQ ID NO: 1289

SEQ ID NO: 42889 - DNA, 201 bp, Bos taurus
ctgtttcattgtggcttcttcattttccttggatgtggggtatcttcttttggtgggtttcagtgtcttcatgttgatggttgttcgccagccagttgcggttttggtgctctggcagcggaagatatgtgcatgtccttttactactctgccatctcaaataagtcttggctcattttgttgatggatgtacttgctgtt

SEQ ID NO: 42890 - DNA, 201 bp, Bos taurus; identical to SEQ ID NO: 1290

SEQ ID NO: 42891 - DNA, 201 bp, Bos taurus; identical to SEQ ID NO: 1292

SEQ ID NO: 42892 - DNA, 201 bp, Bos taurus; identical to SEQ ID NO: 1293

SEQ ID NO: 42893 - DNA, 201 bp, Bos taurus
agtgccccttcattccagacatcctacaaactaatcgtcttttttctgactcaagggctcagtcaaggcctgcaggcaggttcacttttctgatctgcagttgcaccttgggtaaatgccatgagtttctgatctgaattcctaaataaaagagaagtgactcttcaaccacattcagaagcatactctgagccaagagga

SEQ ID NO: 42894 - DNA, 201 bp, Bos taurus
gcaaattaaaacacacagatataaagaagcagtaaaactttaaataaatcacacccactctaaatatcaatgaaaagcagatatgcactgttgggagaatcattttaaaatgattttgtcaacaagttgtgcttcttatcaattgtggacttaaacaaaaaaaggaccactaaagaatggtttaacttgttacttgttatg

SEQ ID NO: 42895 - DNA, 201 bp, Bos taurus; identical to SEQ ID NO: 1298

SEQ ID NO: 42896 - DNA, 201 bp, Bos taurus; identical to SEQ ID NO: 1299

SEQ ID NO: 42897 - DNA, 201 bp, Bos taurus; identical to SEQ ID NO: 1300

SEQ ID NO: 42898 - DNA, 201 bp, Bos taurus; identical to SEQ ID NO: 1301

SEQ ID NO: 42899 - DNA, 201 bp, Bos taurus; identical to SEQ ID NO: 1305

SEQ ID NO: 42900 - DNA, 201 bp, Bos taurus; identical to SEQ ID NO: 1306

SEQ ID NO: 42901 - DNA, 201 bp, Bos taurus; identical to SEQ ID NO: 1307

SEQ ID NO: 42902 - DNA, 201 bp, Bos taurus; identical to SEQ ID NO: 1308

SEQ ID NO: 42903 - DNA, 201 bp, Bos taurus; identical to SEQ ID NO: 1309

SEQ ID NO: 42904 - DNA, 201 bp, Bos taurus; identical to SEQ ID NO: 1310

SEQ ID NO: 42905 - DNA, 201 bp, Bos taurus; identical to SEQ ID NO: 1311

SEQ ID NO: 42906 - DNA, 201 bp, Bos taurus; identical to SEQ ID NO: 1312

SEQ ID NO: 42907 - DNA, 201 bp, Bos taurus; identical to SEQ ID NO: 1313

SEQ ID NO: 42908 - DNA, 201 bp, Bos taurus; identical to SEQ ID NO: 1316

SEQ ID NO: 42909 - DNA, 201 bp, Bos taurus; identical to SEQ ID NO: 1317

SEQ ID NO: 42910 - DNA, 201 bp, Bos taurus; identical to SEQ ID NO: 1318

SEQ ID NO: 42911 - DNA, 201 bp, Bos taurus; identical to SEQ ID NO: 1320

SEQ ID NO: 42912 - DNA, 201 bp, Bos taurus; identical to SEQ ID NO: 1321

SEQ ID NO: 42913 - DNA, 201 bp, Bos taurus; identical to SEQ ID NO: 1322

SEQ ID NO: 42914 - DNA, 201 bp, Bos taurus; identical to SEQ ID NO: 1328

SEQ ID NO: 42915 - DNA, 201 bp, Bos taurus; identical to SEQ ID NO: 1329

SEQ ID NO: 42916 - DNA, 201 bp, Bos taurus; identical to SEQ ID NO: 1334

SEQ ID NO: 42917 - DNA, 201 bp, Bos taurus; identical to SEQ ID NO: 1335

SEQ ID NO: 42918 - DNA, 201 bp, Bos taurus
tcattggaagaaggggaattgataaaagcaaagatttttttaacatataaatactaatttactaatgtacatgtcatgtattatgctatttttattcttagtgtattttaagattatactgaatacttttgttttaggctgccacccagctggaaaacttaggaaatgcgttggatgccgtggaaccacagaatgctcaac

SEQ ID NO: 42919 - DNA, 201 bp, Bos taurus
attaaaaaatagcagttatcttaattgcatgtaccaaataccctatcttgtctctgaataacttcgataaacggaaatgcttacacacttaatgaaaatttaaattcttactgtgttgttgtattgttctatgtctaagaagagtctccagttattctacagttctttaacctttctttaggccactttttaatcataaat

SEQ ID NO: 42920 - DNA, 201 bp, Bos taurus; identical to SEQ ID NO: 1336

SEQ ID NO: 42921 - DNA, 201 bp, Bos taurus; identical to SEQ ID NO: 1337

SEQ ID NO: 42922 - DNA, 201 bp, Bos taurus; identical to SEQ ID NO: 1338

SEQ ID NO: 42923 - DNA, 201 bp, Bos taurus; identical to SEQ ID NO: 1339

SEQ ID NO: 42924 - DNA, 201 bp, Bos taurus
tttatactcccggatatatcataagtgctcagtacatacattgagttaaattcctcagtcttcttagcgatccatttcagtaacatacactgaatacttacaattactgatttatttattaagatgactgaaaactctttttttttttttgatcaactcttgatcaatgtctttcaaataaatatttttgtttatacagat

SEQ ID NO: 42925 - DNA, 201 bp, Bos taurus; identical to SEQ ID NO: 1340

SEQ ID NO: 42926 - DNA, 201 bp, Bos taurus; identical to SEQ ID NO: 1341

SEQ ID NO: 42927 - DNA, 201 bp, Bos taurus; identical to SEQ ID NO: 1342

SEQ ID NO: 42928 - DNA, 201 bp, Bos taurus; identical to SEQ ID NO: 1345

SEQ ID NO: 42929 - DNA, 201 bp, Bos taurus; identical to SEQ ID NO: 1346

SEQ ID NO: 42930 - DNA, 201 bp, Bos taurus; identical to SEQ ID NO: 1349

SEQ ID NO: 42931 - DNA, 201 bp, Bos taurus; identical to SEQ ID NO: 1351

SEQ ID NO: 42932 - DNA, 201 bp, Bos taurus; identical to SEQ ID NO: 1352

SEQ ID NO: 42933 - DNA, 201 bp, Bos taurus; identical to SEQ ID NO: 1353

SEQ ID NO: 42934 - DNA, 201 bp, Bos taurus; identical to SEQ ID NO: 1354

SEQ ID NO: 42935 - DNA, 201 bp, Bos taurus; identical to SEQ ID NO: 1356

SEQ ID NO: 42936 - DNA, 201 bp, Bos taurus
tccaaggaggggcaaacaggactttcacgctttcccaccactctgagcatccactgtctctcctgttgttttggcacttgattatatttagcctattggtatatactgactctcaaatacttttcttaaatcacaagcatgtgaggaaaggggcactgcatatgaaaatctctctcgttgagggaacgggacatcagatca

SEQ ID NO: 42937 - DNA, 201 bp, Bos taurus; identical to SEQ ID NO: 1360

SEQ ID NO: 42938 - DNA, 201 bp, Bos taurus; identical to SEQ ID NO: 1361

SEQ ID NO: 42939 - DNA, 201 bp, Bos taurus; identical to SEQ ID NO: 1362

SEQ ID NO: 42940 - DNA, 201 bp, Bos taurus; identical to SEQ ID NO: 1363

SEQ ID NO: 42941 - DNA, 201 bp, Bos taurus; identical to SEQ ID NO: 1364

SEQ ID NO: 42942 - DNA, 201 bp, Bos taurus; identical to SEQ ID NO: 1365

SEQ ID NO: 42943 - DNA, 201 bp, Bos taurus; identical to SEQ ID NO: 1366

SEQ ID NO: 42944 - DNA, 201 bp, Bos taurus; identical to SEQ ID NO: 1367

SEQ ID NO: 42945 - DNA, 201 bp, Bos taurus; identical to SEQ ID NO: 1368

SEQ ID NO: 42946 - DNA, 201 bp, Bos taurus; identical to SEQ ID NO: 1369

SEQ ID NO: 42947 - DNA, 201 bp, Bos taurus; identical to SEQ ID NO: 1370

SEQ ID NO: 42948 - DNA, 201 bp, Bos taurus; identical to SEQ ID NO: 1371

SEQ ID NO: 42949 - DNA, 201 bp, Bos taurus; identical to SEQ ID NO: 1372

SEQ ID NO: 42950 - DNA, 201 bp, Bos taurus; identical to SEQ ID NO: 1373

SEQ ID NO: 42951 - DNA, 201 bp, Bos taurus; identical to SEQ ID NO: 1374

SEQ ID NO: 42952 - DNA, 201 bp, Bos taurus; identical to SEQ ID NO: 1375

SEQ ID NO: 42953 - DNA, 201 bp, Bos taurus; identical to SEQ ID NO: 1376

SEQ ID NO: 42954 - DNA, 201 bp, Bos taurus; identical to SEQ ID NO: 1377

SEQ ID NO: 42955 - DNA, 201 bp, Bos taurus; identical to SEQ ID NO: 1378

SEQ ID NO: 42956 - DNA, 201 bp, Bos taurus; identical to SEQ ID NO: 1380

SEQ ID NO: 42957 - DNA, 201 bp, Bos taurus; identical to SEQ ID NO: 1381

SEQ ID NO: 42958 - DNA, 201 bp, Bos taurus; identical to SEQ ID NO: 1382

SEQ ID NO: 42959 - DNA, 201 bp, Bos taurus; identical to SEQ ID NO: 1383

SEQ ID NO: 42960 - DNA, 201 bp, Bos taurus; identical to SEQ ID NO: 1384

SEQ ID NO: 42961 - DNA, 201 bp, Bos taurus; identical to SEQ ID NO: 1385

SEQ ID NO: 42962 - DNA, 201 bp, Bos taurus; identical to SEQ ID NO: 1386

SEQ ID NO: 42963 - DNA, 201 bp, Bos taurus
gtattcttgtctggaaaactccatagacagaagagcctggcagcctagagtcacagggtcacaaagagtcaaacacaaccaagtaactgagcacccacagtctatggacaaatagcttgaaaaatcatactcttaagcttatcaaatgatctcatagacagtcacttatttgtgcaagcttggtgaaaagaactatttacc

SEQ ID NO: 42964 - DNA, 201 bp, Bos taurus
gcaatagatagaggtcttcatggcgccttgaggctaggctagacggaaagaagggggtatttacttctagggctcctataaggtccttgtttgaagactgcgtgtttgtttattttttatggaaaactgattaatttttgtgatcttcaaactatccactgaaaatatgtcaaaatatagcataaaaacgttatgatttgc

SEQ ID NO: 42965 - DNA, 201 bp, Bos taurus
acaaactgtttaaaaggtgtccctctgtaggcatatcagttaccaaaaggtatttgtgtcttagtttgagtcaaagttagctaagaggggcctgggctaggtttcctactgatacggtgccctcttgggtaatgatgccttatgtagcgtgaaacagtcctactgtgcaaatgtatggtaaggaattcctgataattgggg

SEQ ID NO: 42966 - DNA, 201 bp, Bos taurus; identical to SEQ ID NO: 1388

SEQ ID NO: 42967 - DNA, 201 bp, Bos taurus; identical to SEQ ID NO: 1390

SEQ ID NO: 42968 - DNA, 201 bp, Bos taurus; identical to SEQ ID NO: 1392

SEQ ID NO: 42969 - DNA, 201 bp, Bos taurus; identical to SEQ ID NO: 1393

SEQ ID NO: 42970 - DNA, 201 bp, Bos taurus; identical to SEQ ID NO: 1395

SEQ ID NO: 42971 - DNA, 201 bp, Bos taurus; identical to SEQ ID NO: 1396

SEQ ID NO: 42972 - DNA, 201 bp, Bos taurus
aaatgatgtcatagtgtggggccctaatccaatgactgatgaccttatagatcatcagggatacatcagggatacacatgcatagaggaaagactatgtggggtctcagcagaaggtggccgtctgcaagccaaagagagagacctcaggagaaacaaaacttgttaacaccttgatcttggacttccagcctccagaaac

SEQ ID NO: 42973 - DNA, 201 bp, Bos taurus
atagggcctttaagaaaataattaagattaaataaaatcataaggatgtgacccttaggaataggaatagtgtccttgtaagaaaaggaagagactccagtgatatgtgtacacagtaaaaaggccatgtgaagacacagggaaaaactgctaccaaaaaaaaaggagagaagcattaaaagataccaaatgtgctgccac

SEQ ID NO: 42974 - DNA, 201 bp, Bos taurus; identical to SEQ ID NO: 1398

SEQ ID NO: 42975 - DNA, 201 bp, Bos taurus; identical to SEQ ID NO: 1399

SEQ ID NO: 42976 - DNA, 201 bp, Bos taurus; identical to SEQ ID NO: 1401

SEQ ID NO: 42977 - DNA, 201 bp, Bos taurus; identical to SEQ ID NO: 1402

SEQ ID NO: 42978 - DNA, 201 bp, Bos taurus; identical to SEQ ID NO: 1403

SEQ ID NO: 42979 - DNA, 201 bp, Bos taurus; identical to SEQ ID NO: 1404

SEQ ID NO: 42980 - DNA, 201 bp, Bos taurus; identical to SEQ ID NO: 1405

SEQ ID NO: 42981 - DNA, 201 bp, Bos taurus
atttcctcaatcctttactgagcttgccttaaaaattcctgatatgatcaattattaatttcccaaaagcttggtgaggtgaggtttcaatgttacatgaagaagaatttcagtagtattgtatattttagtagaggattgaaccaaaagacaaatgattgataataataagtaatagaataataggtaaattaaaaatta

SEQ ID NO: 42982 - DNA, 201 bp, Bos taurus
aattgactacctcaagaagcctgagaatgagcttttctgtgtgtttaataggagaactttgggctctgagcatccctctttagctccagattgctgcatgggtatgcaggatgaggaaagtatacttagatctatacagatgttaatccttcttccctcctctagttctggagcccttgtcagggggaaaagttcagcctg

SEQ ID NO: 42983 - DNA, 201 bp, Bos taurus
cgcaaatttagacaaactatttaaaacacattgctggtgttcattcagtagcttaaattcataccttatacctagtagtagcttgaacatagtgtgtgtcgcaccagatgtgtttgtgtgctttacagaatcagttcagttcagtcagttcagtcgctcagtcatgtccgactctttgcagtcccatgaatcgtagcacgc

SEQ ID NO: 42984 - DNA, 201 bp, Bos taurus; identical to SEQ ID NO: 1406

SEQ ID NO: 42985 - DNA, 201 bp, Bos taurus; identical to SEQ ID NO: 1407

SEQ ID NO: 42986 - DNA, 201 bp, Bos taurus
tatcaagttctagtgtacctaagtcccctacaatgatttatatttctaaaacaaagtacatctcagtgtagcatatgtttatgaggttaaacattacatggatgactatccaacataatatctattctcatattttgcttttgtgaactagaaagttcaaatgaagaagtatagttatcaaaatgactaagccttagggta

SEQ ID NO: 42987 - DNA, 201 bp, Bos taurus; identical to SEQ ID NO: 1408

SEQ ID NO: 42988 - DNA, 201 bp, Bos taurus; identical to SEQ ID NO: 1409

SEQ ID NO: 42989 - DNA, 201 bp, Bos taurus; identical to SEQ ID NO: 1410

SEQ ID NO: 42990 - DNA, 201 bp, Bos taurus
taatttaggacagccagcagcagcagacaggccaggaatcctctacttctgagcatcctccaacattgatcagccccaaaaactccaccagggcccctgctgaagccccaggcagcacgtggatcaacacccagtgactgatgcaggtttacacacccaagtgggacaaccagggcaccaggaatgacctctggctacatg

SEQ ID NO: 42991 - DNA, 201 bp, Bos taurus
ttccttgaatatcataattttatatccctttgtcctctgtgatgagaaggctctcctggggttgccaagcagctctctccccatgtcacttccacatcattacttcttctagcagacaatacattttccacggactgaacaaaatagttccttttccgtacttttattgagaaaaaatggctagaaacataatctttcatt

SEQ ID NO: 42992 - DNA, 201 bp, Bos taurus; identical to SEQ ID NO: 1411

SEQ ID NO: 42993 - DNA, 201 bp, Bos taurus; identical to SEQ ID NO: 1412

SEQ ID NO: 42994 - DNA, 201 bp, Bos taurus; identical to SEQ ID NO: 1416

SEQ ID NO: 42995 - DNA, 201 bp, Bos taurus
ctcccaacctgctgtgtcccacagcagtgccagctgcgtggagatacgtccacacagcacaggagggctcctgctgggggttctgtgggccaaattaaggcatctgggcgccccaccactgcattgtgtcctggttgcttcagacacagctgtcttgcaaacatgtcaatacgtttggcctttcttaggagctccttacct

SEQ ID NO: 42996 - DNA, 201 bp, Bos taurus; identical to SEQ ID NO: 1417

SEQ ID NO: 42997 - DNA, 201 bp, Bos taurus; identical to SEQ ID NO: 1418

SEQ ID NO: 42998 - DNA, 201 bp, Bos taurus; identical to SEQ ID NO: 1420

SEQ ID NO: 42999 - DNA, 201 bp, Bos taurus; identical to SEQ ID NO: 1421

SEQ ID NO: 43000 - DNA, 201 bp, Bos taurus; identical to SEQ ID NO: 1422

SEQ ID NO: 43001 - DNA, 201 bp, Bos taurus; identical to SEQ ID NO: 1424

SEQ ID NO: 43002 - DNA, 201 bp, Bos taurus; identical to SEQ ID NO: 1425

SEQ ID NO: 43003 - DNA, 201 bp, Bos taurus; identical to SEQ ID NO: 1426

SEQ ID NO: 43004 - DNA, 201 bp, Bos taurus; identical to SEQ ID NO: 1427

SEQ ID NO: 43005 - DNA, 201 bp, Bos taurus; identical to SEQ ID NO: 1428

SEQ ID NO: 43006 - DNA, 201 bp, Bos taurus; identical to SEQ ID NO: 1429

SEQ ID NO: 43007 - DNA, 201 bp, Bos taurus; identical to SEQ ID NO: 1430

SEQ ID NO: 43008 - DNA, 201 bp, Bos taurus; identical to SEQ ID NO: 1431

SEQ ID NO: 43009 - DNA, 201 bp, Bos taurus; identical to SEQ ID NO: 1432

SEQ ID NO: 43010 - DNA, 201 bp, Bos taurus; identical to SEQ ID NO: 1435

SEQ ID NO: 43011 - DNA, 201 bp, Bos taurus; identical to SEQ ID NO: 1437

SEQ ID NO: 43012 - DNA, 201 bp, Bos taurus; identical to SEQ ID NO: 1438

SEQ ID NO: 43013 - DNA, 201 bp, Bos taurus; identical to SEQ ID NO: 1439

SEQ ID NO: 43014 - DNA, 201 bp, Bos taurus; identical to SEQ ID NO: 1440

SEQ ID NO: 43015 - DNA, 201 bp, Bos taurus; identical to SEQ ID NO: 1441

SEQ ID NO: 43016 - DNA, 201 bp, Bos taurus; identical to SEQ ID NO: 1442

SEQ ID NO: 43017 - DNA, 201 bp, Bos taurus; identical to SEQ ID NO: 1444

SEQ ID NO: 43018 - DNA, 201 bp, Bos taurus; identical to SEQ ID NO: 1446

SEQ ID NO: 43019 - DNA, 201 bp, Bos taurus; identical to SEQ ID NO: 1447

SEQ ID NO: 43020 - DNA, 201 bp, Bos taurus; identical to SEQ ID NO: 1448

SEQ ID NO: 43021 - DNA, 201 bp, Bos taurus; identical to SEQ ID NO: 1449

SEQ ID NO: 43022 - DNA, 201 bp, Bos taurus; identical to SEQ ID NO: 1450

SEQ ID NO: 43023 - DNA, 201 bp, Bos taurus; identical to SEQ ID NO: 1451

SEQ ID NO: 43024 - DNA, 201 bp, Bos taurus; identical to SEQ ID NO: 1452

SEQ ID NO: 43025 - DNA, 201 bp, Bos taurus; identical to SEQ ID NO: 1453

SEQ ID NO: 43026 - DNA, 201 bp, Bos taurus; identical to SEQ ID NO: 1454

SEQ ID NO: 43027 - DNA, 201 bp, Bos taurus; identical to SEQ ID NO: 1455

SEQ ID NO: 43028 - DNA, 201 bp, Bos taurus; identical to SEQ ID NO: 1456

SEQ ID NO: 43029 - DNA, 201 bp, Bos taurus; identical to SEQ ID NO: 1457

SEQ ID NO: 43030 - DNA, 201 bp, Bos taurus; identical to SEQ ID NO: 1458

SEQ ID NO: 43031 - DNA, 201 bp, Bos taurus; identical to SEQ ID NO: 1459

SEQ ID NO: 43032 - DNA, 201 bp, Bos taurus; identical to SEQ ID NO: 1460

SEQ ID NO: 43033 - DNA, 201 bp, Bos taurus; identical to SEQ ID NO: 1461

SEQ ID NO: 43034 - DNA, 201 bp, Bos taurus; identical to SEQ ID NO: 1462

SEQ ID NO: 43035 - DNA, 201 bp, Bos taurus; identical to SEQ ID NO: 1463

SEQ ID NO: 43036 - DNA, 201 bp, Bos taurus; identical to SEQ ID NO: 1464

SEQ ID NO: 43037 - DNA, 201 bp, Bos taurus; identical to SEQ ID NO: 1465

SEQ ID NO: 43038 - DNA, 201 bp, Bos taurus; identical to SEQ ID NO: 1466

SEQ ID NO: 43039 - DNA, 201 bp, Bos taurus; identical to SEQ ID NO: 1467

SEQ ID NO: 43040 - DNA, 201 bp, Bos taurus; identical to SEQ ID NO: 1468

SEQ ID NO: 43041 - DNA, 201 bp, Bos taurus; identical to SEQ ID NO: 1469

SEQ ID NO: 43042 - DNA, 201 bp, Bos taurus; identical to SEQ ID NO: 1470

SEQ ID NO: 43043 - DNA, 201 bp, Bos taurus; identical to SEQ ID NO: 1471

SEQ ID NO: 43044 - DNA, 201 bp, Bos taurus; identical to SEQ ID NO: 1472

SEQ ID NO: 43045 - DNA, 201 bp, Bos taurus; identical to SEQ ID NO: 1473

SEQ ID NO: 43046 - DNA, 201 bp, Bos taurus
gattaaccaaggagtaaaaatggaatgcattctgaaatatgtatgtgtcaatctgtacaaattagagtaaaatggtattaggattttgttgccttcttacatcaagccatactttcatattttcagaaagtatagtagcttacagctgtagttaactaaaagaaaatatgtttatgaagaatgtgttctgttggaaaagta

SEQ ID NO: 43047 - DNA, 201 bp, Bos taurus; identical to SEQ ID NO: 1474

SEQ ID NO: 43048 - DNA, 201 bp, Bos taurus; identical to SEQ ID NO: 1475

SEQ ID NO: 43049 - DNA, 201 bp, Bos taurus; identical to SEQ ID NO: 1476

SEQ ID NO: 43050 - DNA, 201 bp, Bos taurus; identical to SEQ ID NO: 1477

SEQ ID NO: 43051 - DNA, 201 bp, Bos taurus; identical to SEQ ID NO: 1478

SEQ ID NO: 43052 - DNA, 201 bp, Bos taurus; identical to SEQ ID NO: 1479

SEQ ID NO: 43053 - DNA, 201 bp, Bos taurus; identical to SEQ ID NO: 1480

SEQ ID NO: 43054 - DNA, 201 bp, Bos taurus; identical to SEQ ID NO: 1481

SEQ ID NO: 43055 - DNA, 201 bp, Bos taurus; identical to SEQ ID NO: 1482

SEQ ID NO: 43056 - DNA, 201 bp, Bos taurus; identical to SEQ ID NO: 1483

SEQ ID NO: 43057 - DNA, 201 bp, Bos taurus; identical to SEQ ID NO: 1484

SEQ ID NO: 43058 - DNA, 201 bp, Bos taurus; identical to SEQ ID NO: 1485

SEQ ID NO: 43059 - DNA, 201 bp, Bos taurus; identical to SEQ ID NO: 1486

SEQ ID NO: 43060 - DNA, 201 bp, Bos taurus; identical to SEQ ID NO: 1487

SEQ ID NO: 43061 - DNA, 201 bp, Bos taurus; identical to SEQ ID NO: 1488

SEQ ID NO: 43062 - DNA, 201 bp, Bos taurus; identical to SEQ ID NO: 1489

SEQ ID NO: 43063 - DNA, 201 bp, Bos taurus; identical to SEQ ID NO: 1490

SEQ ID NO: 43064 - DNA, 201 bp, Bos taurus; identical to SEQ ID NO: 1491

SEQ ID NO: 43065 - DNA, 201 bp, Bos taurus; identical to SEQ ID NO: 1492

SEQ ID NO: 43066 - DNA, 201 bp, Bos taurus; identical to SEQ ID NO: 1493

SEQ ID NO: 43067 - DNA, 201 bp, Bos taurus; identical to SEQ ID NO: 1494

SEQ ID NO: 43068 - DNA, 201 bp, Bos taurus; identical to SEQ ID NO: 1495

SEQ ID NO: 43069 - DNA, 201 bp, Bos taurus; identical to SEQ ID NO: 1497

SEQ ID NO: 43070 - DNA, 201 bp, Bos taurus; identical to SEQ ID NO: 1499

SEQ ID NO: 43071 - DNA, 201 bp, Bos taurus
taagaacacttagggcaggaatccagctgacctaaagtgagacacaaggggtataactcacccagaaatggaaaatcacaatctcaaaacctaaatctgatcccatctcttaattatttaaatttagacatcatcaatatttaataaatcagaaaagtatgtgtgcttcaatatgatgagaccctacctaggctaacaaag

SEQ ID NO: 43072 - DNA, 201 bp, Bos taurus; identical to SEQ ID NO: 1503

SEQ ID NO: 43073 - DNA, 201 bp, Bos taurus; identical to SEQ ID NO: 1504

SEQ ID NO: 43074 - DNA, 201 bp, Bos taurus; identical to SEQ ID NO: 1505

SEQ ID NO: 43075 - DNA, 201 bp, Bos taurus
gtgccatattccagagagaatccatcaatactacgatggtctcacggccatggcagaggaaagatcataatctggggcccagtataccatgtggggtccgcagcagcctttgtgattatattaaagagtttcagttggaccttcagtgttccttaagagtgatccatccagatgttgtcagagcacagccctgataaacca

SEQ ID NO: 43076 - DNA, 201 bp, Bos taurus; identical to SEQ ID NO: 1507

SEQ ID NO: 43077 - DNA, 201 bp, Bos taurus; identical to SEQ ID NO: 1508

SEQ ID NO: 43078 - DNA, 201 bp, Bos taurus; identical to SEQ ID NO: 1509

SEQ ID NO: 43079 - DNA, 201 bp, Bos taurus; identical to SEQ ID NO: 1510

SEQ ID NO: 43080 - DNA, 201 bp, Bos taurus
gtcaaatggcactttctgggtgacagaacccataagtggagctcctctcagatatggtaaaagcaccatgcccaaataagctttctttaaaaagaccttccaactgaatttaaatttaaaggtgatggccttcttaaatcagcctaattgacatcatttggagctaaaattgaaaagttaccaataatcccaattctttca

SEQ ID NO: 43081 - DNA, 201 bp, Bos taurus; identical to SEQ ID NO: 1511

SEQ ID NO: 43082 - DNA, 201 bp, Bos taurus; identical to SEQ ID NO: 1512

SEQ ID NO: 43083 - DNA, 201 bp, Bos taurus; identical to SEQ ID NO: 1513

SEQ ID NO: 43084 - DNA, 201 bp, Bos taurus; identical to SEQ ID NO: 1514

SEQ ID NO: 43085 - DNA, 201 bp, Bos taurus; identical to SEQ ID NO: 1515

SEQ ID NO: 43086 - DNA, 201 bp, Bos taurus; identical to SEQ ID NO: 1516

SEQ ID NO: 43087 - DNA, 201 bp, Bos taurus; identical to SEQ ID NO: 1517

SEQ ID NO: 43088 - DNA, 201 bp, Bos taurus; identical to SEQ ID NO: 1518

SEQ ID NO: 43089 - DNA, 201 bp, Bos taurus
attccactgcctgattctccaaggcaacggttactaatacccagccccttttctaggcactggtagaaagtactggagaagaggccatatcatcccatatctcgttgaccttataacctgaacaaatgaactagatttacatataaaaactaagcactcttaaacaacaggtatgtaattaggcaatcatgggcctagtac

SEQ ID NO: 43090 - DNA, 201 bp, Bos taurus; identical to SEQ ID NO: 1519

SEQ ID NO: 43091 - DNA, 201 bp, Bos taurus; identical to SEQ ID NO: 1520

SEQ ID NO: 43092 - DNA, 201 bp, Bos taurus
gagaaatctcttaaaggaatattaatatactatatatagaaaaccacacaggttaccaattccaagttaatactaaatccagaaataaattaactttattccaaactggccaacaagactttctctgaaaggcatattacccctcccaggaatacctatcccatttgttctaggaaacaaagcattccatgcctcccagaa

SEQ ID NO: 43093 - DNA, 201 bp, Bos taurus
accatgcgtgtcctctcaaagggactggaggatgagtcctctttttcatcccccctcaacttaaagccgttttcacctttcaagtatcttagatgttttatactaatgttcaggcctcatcagaaacacaatgccaactttaattttggggttgttgagcccagcaccaggagttaagacaagagggtggctttgaatcat

SEQ ID NO: 43094 - DNA, 201 bp, Bos taurus
ctctgaccacttgtcaacccaggatagctcttagaggggcaatttttgagcacctggtgtgtgctggcattaatgaggcccttcacctactatggtccatagaagaggcaaatatattgacttggagtgtgggctggtagttggctgattgggttcaaatattgggccccatgcctcacaagctgtctgctcttggatatg

SEQ ID NO: 43095 - DNA, 201 bp, Bos taurus; identical to SEQ ID NO: 1521

SEQ ID NO: 43096 - DNA, 201 bp, Bos taurus
actgagcattcactgagagagggcaggggaaaaagaagatcaagagacgtttctctaagttcaccctctattaggcctggccttagaagagtgcagacttccaaagaagctggaggctgcatgtactgacctcggaaaaatctctcaggccccactgttgtcagcagtgatttaaattcaagtgcccaactgataaaagtt

SEQ ID NO: 43097 - DNA, 201 bp, Bos taurus; identical to SEQ ID NO: 1522

SEQ ID NO: 43098 - DNA, 201 bp, Bos taurus; identical to SEQ ID NO: 1523

SEQ ID NO: 43099 - DNA, 201 bp, Bos taurus; identical to SEQ ID NO: 1524

SEQ ID NO: 43100 - DNA, 201 bp, Bos taurus; identical to SEQ ID NO: 1525

SEQ ID NO: 43101 - DNA, 201 bp, Bos taurus; identical to SEQ ID NO: 1526

SEQ ID NO: 43102 - DNA, 201 bp, Bos taurus; identical to SEQ ID NO: 1527

SEQ ID NO: 43103 - DNA, 201 bp, Bos taurus; identical to SEQ ID NO: 1528

SEQ ID NO: 43104 - DNA, 201 bp, Bos taurus
cctatctaatgaactcattaaagaacatgctttaaaaaaaaatttaaaagaaagatctctttaccccactccacgctcctcccaggcctactctccttttctaaaaatgcaaaaaggaaatgcacatggtaaaagatgtctccacatgtgagcgtttctactacctggctccatcctctccatcaaatacctgagctgatg

SEQ ID NO: 43105 - DNA, 201 bp, Bos taurus
caactgtgcctccaagggagtgactcacaatgctgtgcaccttgggctttttgtatctcactggagaaaccacaggccccgggggcctctcagtgtgctgctgtgcttccggggaaggggtgacgggatcagtatatagccattactcttacccttctaatgagggccttatcaatctctgtggtctagaggggagcttcc

SEQ ID NO: 43106 - DNA, 201 bp, Bos taurus; identical to SEQ ID NO: 1530

SEQ ID NO: 43107 - DNA, 201 bp, Bos taurus; identical to SEQ ID NO: 1531

SEQ ID NO: 43108 - DNA, 201 bp, Bos taurus; identical to SEQ ID NO: 1532

SEQ ID NO: 43109 - DNA, 201 bp, Bos taurus; identical to SEQ ID NO: 1533

SEQ ID NO: 43110 - DNA, 201 bp, Bos taurus; identical to SEQ ID NO: 1534

SEQ ID NO: 43111 - DNA, 201 bp, Bos taurus; identical to SEQ ID NO: 1535

SEQ ID NO: 43112 - DNA, 201 bp, Bos taurus; identical to SEQ ID NO: 1537

SEQ ID NO: 43113 - DNA, 201 bp, Bos taurus; identical to SEQ ID NO: 1541

SEQ ID NO: 43114 - DNA, 201 bp, Bos taurus
cccagcagtggttttcaaacatgagcatgcattcaaactattatacctggcaggtttgttaaaactcaggctgctgtatcctacttccagaatttgtgattcagtagtctggggtagggccagggatttacctttttaaaacattcccaaaggttgctaatgtttgggatgcacaggtggaaaccagtaccttagcctgtg

SEQ ID NO: 43115 - DNA, 201 bp, Bos taurus; identical to SEQ ID NO: 1542

SEQ ID NO: 43116 - DNA, 201 bp, Bos taurus; identical to SEQ ID NO: 1543

SEQ ID NO: 43117 - DNA, 201 bp, Bos taurus; identical to SEQ ID NO: 1544

SEQ ID NO: 43118 - DNA, 201 bp, Bos taurus; identical to SEQ ID NO: 1545

SEQ ID NO: 43119 - DNA, 201 bp, Bos taurus; identical to SEQ ID NO: 1551

SEQ ID NO: 43120 - DNA, 201 bp, Bos taurus; identical to SEQ ID NO: 1552

SEQ ID NO: 43121 - DNA, 201 bp, Bos taurus; identical to SEQ ID NO: 1555

SEQ ID NO: 43122 - DNA, 201 bp, Bos taurus; identical to SEQ ID NO: 1556

SEQ ID NO: 43123 - DNA, 201 bp, Bos taurus; identical to SEQ ID NO: 1559

SEQ ID NO: 43124 - DNA, 201 bp, Bos taurus; identical to SEQ ID NO: 1560

SEQ ID NO: 43125 - DNA, 201 bp, Bos taurus; identical to SEQ ID NO: 1561

SEQ ID NO: 43126 - DNA, 201 bp, Bos taurus; identical to SEQ ID NO: 1562

SEQ ID NO: 43127 - DNA, 201 bp, Bos taurus; identical to SEQ ID NO: 1563

SEQ ID NO: 43128 - DNA, 201 bp, Bos taurus; identical to SEQ ID NO: 1564

SEQ ID NO: 43129 - DNA, 201 bp, Bos taurus
ctaccatccctggcctctacgcactagatgccataacatctccccaatacagttataactactaaaaatatctccagaagttgtaaaatgttcctgaggacacaactggccttggttgagaaccactgtttaaaataaagtcaagaggtcaaaggacagaaccctgaagttcaccaatatttaaaagtaaggtagaaaaag

SEQ ID NO: 43130 - DNA, 201 bp, Bos taurus
tgtaagacctctttctttctttactctctctgtttagctgcttttagatacatatttatatttgcatgatgcatacatgattaaggagaggtaatctttacgacccagataatcacgatggtgtgatcactcacctagagccagacatcttggaatgtgaagtcaagtgggctttagaaagcatcactatgaacaaagcta

SEQ ID NO: 43131 - DNA, 201 bp, Bos taurus; identical to SEQ ID NO: 1566

SEQ ID NO: 43132 - DNA, 201 bp, Bos taurus
ggtaagcacagttcacatagaaacaaacgccttttaatcacctagtcctggtggccagaagggcttatgttcctgggccccacaggactgaataattaaaaacagtgctgagtaggctgttgcacccagaacattgcagagacagcagactgaaatgcactgccagcctgcctgtgaaaaaggcccatttatttgtcttgg

SEQ ID NO: 43133 - DNA, 201 bp, Bos taurus
tctccgttcctttttcattttttacctttcataactagtattactcaaaacacaagatctttaaagatgcttctatccttaaaatcttttgatttacaaatagaaagtgcttttcccttatgaatgagggggaggaaatggccaggtcagagaactcccagcttccagtttcttaagtgatttaacacataaataaaggtg

SEQ ID NO: 43134 - DNA, 201 bp, Bos taurus; identical to SEQ ID NO: 1567

SEQ ID NO: 43135 - DNA, 201 bp, Bos taurus; identical to SEQ ID NO: 1568

SEQ ID NO: 43136 - DNA, 201 bp, Bos taurus; identical to SEQ ID NO: 1569

SEQ ID NO: 43137 - DNA, 201 bp, Bos taurus; identical to SEQ ID NO: 1570

SEQ ID NO: 43138 - DNA, 201 bp, Bos taurus
gggatcaaatctaaaaagactgggtaggattcttccccaagcctctgatgtcacatatatttatctgcctccagcaccagccaccagggccccacgtgcccgggcaaaggcaggtctcatctttccgaggacaaggctttctgccctcactcttcccgcactctgccaggtctctcttctctgcccaacccttggccccac

SEQ ID NO: 43139 - DNA, 201 bp, Bos taurus
acatgtatccattaggagattgattttcatcagggctggcctggtggtctggggcaggggtcggggtgtaggtatggggtgagggcctctctcagttgttgtccatcagcctcccctctccagacaagggagagaaggtgggtagcctgcctctcgcccttactcctccttttggttctccccctagagacgttccgcttt

SEQ ID NO: 43140 - DNA, 201 bp, Bos taurus
ctacccacagcaggccgagtccaattttgcagagtgaacccccctagcatctagtcaggagtgcctggagggctaagaccgtatctaagtcatctctaccgtcatctgtatccccagtggcctccagaggggccagcttggagcaggtgcttttgttaccgagtacaagttcactcttctctccacacaacatgccaatta

SEQ ID NO: 43141 - DNA, 201 bp, Bos taurus
tccctggtccagaaagattccacctgcagaggagcagctaagcctgagagctgcagactgagcctgcgctctagaccccgagagccacagctgctgaagcctgcactctcgagggccctcaagcctagaactaatgaaactactgaagctcgtgtgcttagaacccctgctccacaacgagagacgccaccacaatgagaa

SEQ ID NO: 43142 - DNA, 201 bp, Bos taurus; identical to SEQ ID NO: 1571

SEQ ID NO: 43143 - DNA, 201 bp, Bos taurus; identical to SEQ ID NO: 1572

SEQ ID NO: 43144 - DNA, 201 bp, Bos taurus; identical to SEQ ID NO: 1573

SEQ ID NO: 43145 - DNA, 201 bp, Bos taurus; identical to SEQ ID NO: 1574

SEQ ID NO: 43146 - DNA, 201 bp, Bos taurus
agaccattgccaagttgctgcttgaaccctggcaccatgaatggagaagaaacacgtgaagtacactgaagctcctggtgggactcagggccgtgcagttggctcagcacacttttacatgcatttttagattaacttgaaaatgaacacatgccgttttttaatcctcaagaagctcctgaccccagtctgagggccaac

SEQ ID NO: 43147 - DNA, 201 bp, Bos taurus
aaggacaagtgggcctcagggcaaggcccaggggatcctgtatggtcatccacacactcccttgggcaggagatgatggagtttgtggcagctgagccctgtgggggtgaaggggacagggccaaagctgcaggagaagtgaggggctttcttctctatgcatacctcgcaaggcccaccatctttgcccaaagggaagga

SEQ ID NO: 43148 - DNA, 201 bp, Bos taurus; identical to SEQ ID NO: 1576

SEQ ID NO: 43149 - DNA, 201 bp, Bos taurus; identical to SEQ ID NO: 1577

SEQ ID NO: 43150 - DNA, 201 bp, Bos taurus; identical to SEQ ID NO: 1579

SEQ ID NO: 43151 - DNA, 201 bp, Bos taurus; identical to SEQ ID NO: 1581

SEQ ID NO: 43152 - DNA, 201 bp, Bos taurus; identical to SEQ ID NO: 1583

SEQ ID NO: 43153 - DNA, 201 bp, Bos taurus; identical to SEQ ID NO: 1584

SEQ ID NO: 43154 - DNA, 201 bp, Bos taurus; identical to SEQ ID NO: 1585

SEQ ID NO: 43155 - DNA, 201 bp, Bos taurus; identical to SEQ ID NO: 1591

SEQ ID NO: 43156 - DNA, 201 bp, Bos taurus
tgaatacttttcatgggatcttgaaagtaaacatggattataaaaattattcatatggtatataggactcaaaccaagtttggactctggttagcttcacggtttgcagttgttgtatattattctaacctcagcagatgagctgtcccagtaaagcatatagtagatttaaggaacagtggtatcttagtgaattatctc

SEQ ID NO: 43157 - DNA, 201 bp, Bos taurus; identical to SEQ ID NO: 1593

SEQ ID NO: 43158 - DNA, 201 bp, Bos taurus; identical to SEQ ID NO: 1595

SEQ ID NO: 43159 - DNA, 201 bp, Bos taurus; identical to SEQ ID NO: 1597

SEQ ID NO: 43160 - DNA, 201 bp, Bos taurus; identical to SEQ ID NO: 1598

SEQ ID NO: 43161 - DNA, 201 bp, Bos taurus; identical to SEQ ID NO: 1599

SEQ ID NO: 43162 - DNA, 201 bp, Bos taurus; identical to SEQ ID NO: 1602

SEQ ID NO: 43163 - DNA, 201 bp, Bos taurus
gcataaatatggcctgattttaacttaattccttctttaaatgccttatctccaaatacagtcctatttgaagtatgggatttaggggtccaatagaagaattctatagaaatgggcctccctgatggctcagacagtaaagagtccacctgcaatgcaggaaggagatatgggtttgatttctgggtcaggaagatcccc

SEQ ID NO: 43164 - DNA, 201 bp, Bos taurus; identical to SEQ ID NO: 1603

SEQ ID NO: 43165 - DNA, 201 bp, Bos taurus; identical to SEQ ID NO: 1605

SEQ ID NO: 43166 - DNA, 201 bp, Bos taurus
ttctagactgtgagtcattgtcaactgggagcatccatttcgtttttaataatgtagaagataaagcaaaatgtttgttgaatgagtgaataagtgataaacctttcttatattcatagacttttccccccttcaggttaggcattcagcattgtgagttttatcttgtgaacactactatgaatatgaagctgcagaata

SEQ ID NO: 43167 - DNA, 201 bp, Bos taurus
tcacacaattatgttagttttaggtgtaaaacatagtggttcaatattctgatagattgcacttcataaattattacaaatattggctatattacttattcttacaacatatctgttttgtatatattatttattttatacatagttgtttgtatctcttaatcccataacactatctcaccccctctcagcttcaaatgt

SEQ ID NO: 43168 - DNA, 201 bp, Bos taurus
attgagataaatactgttgaaataaagtgtaaacctatgaaactgatgccaggggttagaagcaccacccagaggatgtgacaaaccaaccaagttgcccgggggctgggtcaaagctagggggcatgggtgacaatacccatgtgacaatggacacatgtgacaatggacacattccaggcagattgtattggagagaga

SEQ ID NO: 43169 - DNA, 201 bp, Bos taurus
tgacaactcaaaatgtcagccatatgattccaaacccaaatgtgaacagctgaggccgtactggaggcttgttcaaagccaaaccaaagaagacaggtccgtttagacatgatccctattacttggcaagaatattgattataggacaaaccgaaagaacattgtctatatttctttttgtggaatcctccgaatcctagt

SEQ ID NO: 43170 - DNA, 201 bp, Bos taurus
ttttgcagtcaagattattttttgaagtattatttcttaaaaaaaaaaaacaaagaaaactttcttttattttcatgtataatagtgacttttttgatgagtcttttttatcatcttatccatttttaagtttacaatataagagtgtggactgtatccatttacttttggggagacataccaattttactctcattaata

SEQ ID NO: 43171 - DNA, 201 bp, Bos taurus; identical to SEQ ID NO: 1608

SEQ ID NO: 43172 - DNA, 201 bp, Bos taurus; identical to SEQ ID NO: 1610

SEQ ID NO: 43173 - DNA, 201 bp, Bos taurus; identical to SEQ ID NO: 1611

SEQ ID NO: 43174 - DNA, 201 bp, Bos taurus; identical to SEQ ID NO: 1612

SEQ ID NO: 43175 - DNA, 201 bp, Bos taurus; identical to SEQ ID NO: 1613

SEQ ID NO: 43176 - DNA, 201 bp, Bos taurus; identical to SEQ ID NO: 1614

SEQ ID NO: 43177 - DNA, 201 bp, Bos taurus; identical to SEQ ID NO: 1615

SEQ ID NO: 43178 - DNA, 201 bp, Bos taurus; identical to SEQ ID NO: 1616

SEQ ID NO: 43179 - DNA, 201 bp, Bos taurus
ctttgaaatagtcacaaatggggagaaagattgacacttaaatttactaaaagtattaatctattaaagccattgacagtttatgcccaccagataactttaggaaattttttaggctttttttttagctaataaatagatgtctgtaaaattttacaaataatataggatagaacatgaagatatattatcttataattt

SEQ ID NO: 43180 - DNA, 201 bp, Bos taurus; identical to SEQ ID NO: 1617

SEQ ID NO: 43181 - DNA, 201 bp, Bos taurus
tgcataaatatgttaatatcctttggagaataaggcttatgcatatggattgagatccattattcaaaagacaggtataataatgaagtgatgtagaaaggcttagtattagaaaggtcttgaatagagtttctgtgtcctgtctcttatatgttacaaggccctttattcactgtaacaaaatttatgattctttgttgc

SEQ ID NO: 43182 - DNA, 201 bp, Bos taurus; identical to SEQ ID NO: 1618

SEQ ID NO: 43183 - DNA, 201 bp, Bos taurus; identical to SEQ ID NO: 1620

SEQ ID NO: 43184 - DNA, 201 bp, Bos taurus; identical to SEQ ID NO: 1621

SEQ ID NO: 43185 - DNA, 201 bp, Bos taurus; identical to SEQ ID NO: 1622

SEQ ID NO: 43186 - DNA, 201 bp, Bos taurus; identical to SEQ ID NO: 1623

SEQ ID NO: 43187 - DNA, 201 bp, Bos taurus
actgggtttacttagtgatgcattttccaaaatgttatccatggagcaatccttctttagaatgttatgtatttcatggggaaaaaattagttccatattcaaagtgattttaatgctacatttttaataactttatttgtttatgtttggctgtgctgggtcttcagtgcttcaggggcttttttgctggtcgtggtgag

SEQ ID NO: 43188 - DNA, 201 bp, Bos taurus
aagtccctgcagagggcccattgtcaggcttgggggttgcagaaatttgcatatcatcaattattatctaaattatacagtattcaaagtaaccattttttgtgacaacttctggcctatgttgaacagctatgtattaatgtgttagaagtatgtttgtgtgtgtgtgtgtgtgtgtattgggatgaatattaaaaaaaa

SEQ ID NO: 43189 - DNA, 201 bp, Bos taurus; identical to SEQ ID NO: 1626

SEQ ID NO: 43190 - DNA, 201 bp, Bos taurus
tctgaccagcgccagctctggaggataaatggagctcctgaggggttgtagaatccatgaatgtttagtgggcatagaatctggatcatattgagaaaaaccttactagtactgagatctgaaaggaaagccagtggacctaatcaaagagttcaagtatatattaaaaaataaattttattatttttaggctgagagcta

SEQ ID NO: 43191 - DNA, 201 bp, Bos taurus
aaatgcctctacatgtggtttctgtttgaaaagagaaaactgacatttgaacaggacttttaatttgttcacatctcttatcattgcttttaaaacagtaagaaagagtaattcttattttagaaaaagtaacagaagcagtccagcaaagttatatattcctttttctgataagcatcatatatgatcctagatatgcta

SEQ ID NO: 43192 - DNA, 201 bp, Bos taurus
tttgaaaggcagaagagaggccatggctgtcactttctgagggtctttttggagtcccgtgtagtgaaggatgggcaaagcttatcctcactctgctctgtatccagacaactggccatgctgaccagcagccccgagccccttgccagataccaggctacagacccacagcagaaacaaaggccagagctccctgaaaac

SEQ ID NO: 43193 - DNA, 201 bp, Bos taurus; identical to SEQ ID NO: 1627

SEQ ID NO: 43194 - DNA, 201 bp, Bos taurus
gtgtacttcctcatgtggtatcacatgaaatacatagaaccacctgtgaagtatccacgtcaaaaatgttagctctgtatttaatcaagtctttataactgaattctagttacagaaagatagatgatagaaaacaaattggaaaaaaaatcagcaagttatgaactgttatggaacaactgacccaggtcactgcttgag

SEQ ID NO: 43195 - DNA, 201 bp, Bos taurus; identical to SEQ ID NO: 1628

SEQ ID NO: 43196 - DNA, 201 bp, Bos taurus; identical to SEQ ID NO: 1629

SEQ ID NO: 43197 - DNA, 201 bp, Bos taurus
gttcatttttttgtctctagtggaacaagaattcacacttcttccaaaggcctgtttactcagtatggagctcttggcctctgaccctgctcctgaccacgtctctgtcttatctttcaccccctgacctgaatccctgagtttccctttacacttggccatcaaccctggtcagttgaacctgcgtcatcatttaactta

SEQ ID NO: 43198 - DNA, 201 bp, Bos taurus; identical to SEQ ID NO: 1631

SEQ ID NO: 43199 - DNA, 201 bp, Bos taurus; identical to SEQ ID NO: 1632

SEQ ID NO: 43200 - DNA, 201 bp, Bos taurus; identical to SEQ ID NO: 1634

SEQ ID NO: 43201 - DNA, 201 bp, Bos taurus
atagtggtgtgtatatatcaatctcaatctcctagtcattctctccccccagtcttctccttctatacatcaggaattgtgaatgatctgagatttttaccccgcttgctaactgacaagctggtctggtacaagttcaaagattttgatggaaatatggggatcctatgtagagccaagggaatccattactcgaagaac

SEQ ID NO: 43202 - DNA, 201 bp, Bos taurus; identical to SEQ ID NO: 1635

SEQ ID NO: 43203 - DNA, 201 bp, Bos taurus; identical to SEQ ID NO: 1636

SEQ ID NO: 43204 - DNA, 201 bp, Bos taurus; identical to SEQ ID NO: 1639

SEQ ID NO: 43205 - DNA, 201 bp, Bos taurus; identical to SEQ ID NO: 1640

SEQ ID NO: 43206 - DNA, 201 bp, Bos taurus; identical to SEQ ID NO: 1641

SEQ ID NO: 43207 - DNA, 201 bp, Bos taurus; identical to SEQ ID NO: 1642

SEQ ID NO: 43208 - DNA, 201 bp, Bos taurus; identical to SEQ ID NO: 1645

SEQ ID NO: 43209 - DNA, 201 bp, Bos taurus; identical to SEQ ID NO: 1646

SEQ ID NO: 43210 - DNA, 201 bp, Bos taurus; identical to SEQ ID NO: 1647

SEQ ID NO: 43211 - DNA, 201 bp, Bos taurus; identical to SEQ ID NO: 1649

SEQ ID NO: 43212 - DNA, 201 bp, Bos taurus; identical to SEQ ID NO: 1650

SEQ ID NO: 43213 - DNA, 201 bp, Bos taurus; identical to SEQ ID NO: 1651

SEQ ID NO: 43214 - DNA, 201 bp, Bos taurus; identical to SEQ ID NO: 1652

SEQ ID NO: 43215 - DNA, 201 bp, Bos taurus; identical to SEQ ID NO: 1653

SEQ ID NO: 43216 - DNA, 201 bp, Bos taurus; identical to SEQ ID NO: 1654

SEQ ID NO: 43217 - DNA, 201 bp, Bos taurus; identical to SEQ ID NO: 1655

SEQ ID NO: 43218 - DNA, 201 bp, Bos taurus; identical to SEQ ID NO: 1656

SEQ ID NO: 43219 - DNA, 201 bp, Bos taurus; identical to SEQ ID NO: 1657

SEQ ID NO: 43220 - DNA, 201 bp, Bos taurus
agtttttatagctgttctacttaagatctctctataaactccagtgtcttcttgagcctttctcttcacattaacttcattgttgtgtgatgtgaacataatattacagaatctaagtgtggagatcttttgatgattatagggaaagggttgttgtgtgaggaatcaaccagagagaatggaaacaaattgatagttgct

SEQ ID NO: 43221 - DNA, 201 bp, Bos taurus
gagtaaagatatccttaatctagaataagaatttgtatacatcttatacttccaaagcagcaatccacaaaatcacctctgtgatccttatatgtagttacgagatacataaggaatttaactatataattagatgccatgtagttaaactttaaacctgattttattatataaaattttatagaaatggtcaagcaaata

SEQ ID NO: 43222 - DNA, 201 bp, Bos taurus
catttccaaccagctcccaggtgaagctgatgatgctgatgggaacttcacatttgcagaaccactgatccagaaaacagaagattgttttacttagcaactttctttgctatgctacaggaaacaggaattggagacttgagatttaggttctgactgttagattttagttctggtacctaaaaacagtttgtattattt

SEQ ID NO: 43223 - DNA, 201 bp, Bos taurus; identical to SEQ ID NO: 1659

SEQ ID NO: 43224 - DNA, 201 bp, Bos taurus; identical to SEQ ID NO: 1660

SEQ ID NO: 43225 - DNA, 201 bp, Bos taurus; identical to SEQ ID NO: 1667

SEQ ID NO: 43226 - DNA, 201 bp, Bos taurus; identical to SEQ ID NO: 1670

SEQ ID NO: 43227 - DNA, 201 bp, Bos taurus; identical to SEQ ID NO: 1671

SEQ ID NO: 43228 - DNA, 201 bp, Bos taurus; identical to SEQ ID NO: 1672

SEQ ID NO: 43229 - DNA, 201 bp, Bos taurus; identical to SEQ ID NO: 1673

SEQ ID NO: 43230 - DNA, 201 bp, Bos taurus; identical to SEQ ID NO: 1674

SEQ ID NO: 43231 - DNA, 201 bp, Bos taurus; identical to SEQ ID NO: 1675

SEQ ID NO: 43232 - DNA, 201 bp, Bos taurus; identical to SEQ ID NO: 1676

SEQ ID NO: 43233 - DNA, 201 bp, Bos taurus; identical to SEQ ID NO: 1678

SEQ ID NO: 43234 - DNA, 201 bp, Bos taurus; identical to SEQ ID NO: 1679

SEQ ID NO: 43235 - DNA, 201 bp, Bos taurus; identical to SEQ ID NO: 1680

SEQ ID NO: 43236 - DNA, 201 bp, Bos taurus; identical to SEQ ID NO: 1681

SEQ ID NO: 43237 - DNA, 201 bp, Bos taurus; identical to SEQ ID NO: 1682

SEQ ID NO: 43238 - DNA, 201 bp, Bos taurus; identical to SEQ ID NO: 1683

SEQ ID NO: 43239 - DNA, 201 bp, Bos taurus; identical to SEQ ID NO: 1684

SEQ ID NO: 43240 - DNA, 201 bp, Bos taurus; identical to SEQ ID NO: 1685

SEQ ID NO: 43241 - DNA, 201 bp, Bos taurus; identical to SEQ ID NO: 1686

SEQ ID NO: 43242 - DNA, 201 bp, Bos taurus; identical to SEQ ID NO: 1689

SEQ ID NO: 43243 - DNA, 201 bp, Bos taurus
ataatgtagtgaagactaaaaagttaaataaaaaaacctcattggtgatacggaaatgagaaaagaagaaaaattctactgttagccaaatcaggcctaaatcacctgctagatctgaaatgcacacacacaccagcacatacagtattgtcacaggtgatgatgcccttggcttctgcagtctgccaaccgcactgaggt

SEQ ID NO: 43244 - DNA, 201 bp, Bos taurus; identical to SEQ ID NO: 1691

SEQ ID NO: 43245 - DNA, 201 bp, Bos taurus; identical to SEQ ID NO: 1692

SEQ ID NO: 43246 - DNA, 201 bp, Bos taurus; identical to SEQ ID NO: 1696

SEQ ID NO: 43247 - DNA, 201 bp, Bos taurus; identical to SEQ ID NO: 1697

SEQ ID NO: 43248 - DNA, 201 bp, Bos taurus; identical to SEQ ID NO: 1698

SEQ ID NO: 43249 - DNA, 201 bp, Bos taurus
ggctcagactaaggtaggtgagtgagatgtctactgtccaacactgaaggaagttctcactacaaggctgacagtgtggcctctttgatgttgtgccctcggcatctcactcgcctcccctggtcccagccctggatcagaagctaagaatactgggtgaggaaatgccaaaagaactggtgctggtcttggcctcatgca

SEQ ID NO: 43250 - DNA, 201 bp, Bos taurus; identical to SEQ ID NO: 1699

SEQ ID NO: 43251 - DNA, 201 bp, Bos taurus; identical to SEQ ID NO: 1701

SEQ ID NO: 43252 - DNA, 201 bp, Bos taurus; identical to SEQ ID NO: 1704

SEQ ID NO: 43253 - DNA, 201 bp, Bos taurus
aaaatcatatccattgagtcggtattttgtattttgtactctggaggttagcaaaaactttaactccttccagagatatcacagagtaggccatatcttctatttcaaaaatttgggtggaattttcagagcagatacaactgattaggataaaggactcttctgtatgtcaattaatattatgtattattaatagctgtg

SEQ ID NO: 43254 - DNA, 201 bp, Bos taurus; identical to SEQ ID NO: 1706

SEQ ID NO: 43255 - DNA, 201 bp, Bos taurus
atattttcaaatagtcttccaggatcactgggcctgttgtctttgagggcttttgagactgtgaggcacaaagtccttaggctcttccagttgatggcctctcttttgtctaatctgtttggttttattgattttacaggtttctgtgtcagtcttaaggcatgcctaccataggacagacattccttgcatgaatggcac

SEQ ID NO: 43256 - DNA, 201 bp, Bos taurus; identical to SEQ ID NO: 1707

SEQ ID NO: 43257 - DNA, 201 bp, Bos taurus
ttttcccagcaccagttattgaagagactattttatccattgtagatttttgcctcctttgttgtagataaattgaccacaaaggcagggtgtttctttttttttgtctgacttctctattcttctccattgtcttatgctggtacatactgttttaattactgtggctttgtagtatggttttaggtcagagaggttata

SEQ ID NO: 43258 - DNA, 201 bp, Bos taurus; identical to SEQ ID NO: 1709

SEQ ID NO: 43259 - DNA, 201 bp, Bos taurus
ggatttgtgtttcacttaaatgttctttaattatggagatctgttcaattatagcatatactggtacagtatcaaatttaatccaacaaagaggctcctgcgtcaccattactaatggctcagaacaatttttcccttatctgttctgagaggctgggttatccacctgcttcactgaccatcatgctaaactctagggct

SEQ ID NO: 43260 - DNA, 201 bp, Bos taurus; identical to SEQ ID NO: 1710

SEQ ID NO: 43261 - DNA, 201 bp, Bos taurus; identical to SEQ ID NO: 1711

SEQ ID NO: 43262 - DNA, 201 bp, Bos taurus; identical to SEQ ID NO: 1712

SEQ ID NO: 43263 - DNA, 201 bp, Bos taurus; identical to SEQ ID NO: 1713

SEQ ID NO: 43264 - DNA, 201 bp, Bos taurus
tctaaattatgaatggttgatttgacaaagacatcctgcagacttagacaaatgaatattaaaagtctttaagactactctgttattactcagctccagtcatgggaaaattcaggcccagcactgcaattgtcttccaatctagattttcatgtgcaacttttaaaaaaattacttttaaaatcctgttgtctgaaaaaa

SEQ ID NO: 43265 - DNA, 201 bp, Bos taurus; identical to SEQ ID NO: 1717

SEQ ID NO: 43266 - DNA, 201 bp, Bos taurus; identical to SEQ ID NO: 1718

SEQ ID NO: 43267 - DNA, 201 bp, Bos taurus; identical to SEQ ID NO: 1719

SEQ ID NO: 43268 - DNA, 201 bp, Bos taurus; identical to SEQ ID NO: 1720

SEQ ID NO: 43269 - DNA, 201 bp, Bos taurus; identical to SEQ ID NO: 1721

SEQ ID NO: 43270 - DNA, 201 bp, Bos taurus; identical to SEQ ID NO: 1722

SEQ ID NO: 43271 - DNA, 201 bp, Bos taurus; identical to SEQ ID NO: 1723

SEQ ID NO: 43272 - DNA, 201 bp, Bos taurus; identical to SEQ ID NO: 1724

SEQ ID NO: 43273 - DNA, 201 bp, Bos taurus; identical to SEQ ID NO: 1725

SEQ ID NO: 43274 - DNA, 201 bp, Bos taurus; identical to SEQ ID NO: 1726

SEQ ID NO: 43275 - DNA, 201 bp, Bos taurus; identical to SEQ ID NO: 1727

SEQ ID NO: 43276 - DNA, 201 bp, Bos taurus; identical to SEQ ID NO: 1728

SEQ ID NO: 43277 - DNA, 201 bp, Bos taurus; identical to SEQ ID NO: 1729

SEQ ID NO: 43278 - DNA, 201 bp, Bos taurus; identical to SEQ ID NO: 1730

SEQ ID NO: 43279 - DNA, 201 bp, Bos taurus; identical to SEQ ID NO: 1731

SEQ ID NO: 43280 - DNA, 201 bp, Bos taurus; identical to SEQ ID NO: 1732

SEQ ID NO: 43281 - DNA, 201 bp, Bos taurus; identical to SEQ ID NO: 1733

SEQ ID NO: 43282 - DNA, 201 bp, Bos taurus; identical to SEQ ID NO: 1734

SEQ ID NO: 43283 - DNA, 201 bp, Bos taurus; identical to SEQ ID NO: 1735

SEQ ID NO: 43284 - DNA, 201 bp, Bos taurus; identical to SEQ ID NO: 1737

SEQ ID NO: 43285 - DNA, 201 bp, Bos taurus; identical to SEQ ID NO: 1738

SEQ ID NO: 43286 - DNA, 201 bp, Bos taurus; identical to SEQ ID NO: 1739

SEQ ID NO: 43287 - DNA, 201 bp, Bos taurus; identical to SEQ ID NO: 1740

SEQ ID NO: 43288 - DNA, 201 bp, Bos taurus; identical to SEQ ID NO: 1741

SEQ ID NO: 43289 - DNA, 201 bp, Bos taurus; identical to SEQ ID NO: 1742

SEQ ID NO: 43290 - DNA, 201 bp, Bos taurus; identical to SEQ ID NO: 1743

SEQ ID NO: 43291 - DNA, 201 bp, Bos taurus; identical to SEQ ID NO: 1744

SEQ ID NO: 43292 - DNA, 201 bp, Bos taurus; identical to SEQ ID NO: 1745

SEQ ID NO: 43293 - DNA, 201 bp, Bos taurus; identical to SEQ ID NO: 1746

SEQ ID NO: 43294 - DNA, 201 bp, Bos taurus; identical to SEQ ID NO: 1747

SEQ ID NO: 43295 - DNA, 201 bp, Bos taurus; identical to SEQ ID NO: 1748

SEQ ID NO: 43296 - DNA, 201 bp, Bos taurus; identical to SEQ ID NO: 1749

SEQ ID NO: 43297 - DNA, 201 bp, Bos taurus; identical to SEQ ID NO: 1750

SEQ ID NO: 43298 - DNA, 201 bp, Bos taurus; identical to SEQ ID NO: 1751

SEQ ID NO: 43299 - DNA, 201 bp, Bos taurus; identical to SEQ ID NO: 1752

SEQ ID NO: 43300 - DNA, 201 bp, Bos taurus; identical to SEQ ID NO: 1753

SEQ ID NO: 43301 - DNA, 201 bp, Bos taurus; identical to SEQ ID NO: 1754

SEQ ID NO: 43302 - DNA, 201 bp, Bos taurus; identical to SEQ ID NO: 1755

SEQ ID NO: 43303 - DNA, 201 bp, Bos taurus; identical to SEQ ID NO: 1756

SEQ ID NO: 43304 - DNA, 201 bp, Bos taurus; identical to SEQ ID NO: 1757

SEQ ID NO: 43305 - DNA, 201 bp, Bos taurus; identical to SEQ ID NO: 1758

SEQ ID NO: 43306 - DNA, 201 bp, Bos taurus; identical to SEQ ID NO: 1759

SEQ ID NO: 43307 - DNA, 201 bp, Bos taurus; identical to SEQ ID NO: 1760

SEQ ID NO: 43308 - DNA, 201 bp, Bos taurus; identical to SEQ ID NO: 1761

SEQ ID NO: 43309 - DNA, 201 bp, Bos taurus; identical to SEQ ID NO: 1762

SEQ ID NO: 43310 - DNA, 201 bp, Bos taurus; identical to SEQ ID NO: 1763

SEQ ID NO: 43311 - DNA, 201 bp, Bos taurus; identical to SEQ ID NO: 1764

SEQ ID NO: 43312 - DNA, 201 bp, Bos taurus; identical to SEQ ID NO: 1765

SEQ ID NO: 43313 - DNA, 201 bp, Bos taurus; identical to SEQ ID NO: 1766

SEQ ID NO: 43314 - DNA, 201 bp, Bos taurus; identical to SEQ ID NO: 1767

SEQ ID NO: 43315 - DNA, 201 bp, Bos taurus; identical to SEQ ID NO: 1772

SEQ ID NO: 43316 - DNA, 201 bp, Bos taurus; identical to SEQ ID NO: 1773

SEQ ID NO: 43317 - DNA, 201 bp, Bos taurus; identical to SEQ ID NO: 1774

SEQ ID NO: 43318 - DNA, 201 bp, Bos taurus
ctctgtgataaggaagcaatgacatccagacgaccagaagactagtaggaccttctccttatgcaaataagaaaagccctaaaaggccaaaggaatttccgcaaatctcaaaacgactcagtgacaggcaggaattactccctgcttggtagcctgccacctcctgaatacgtaactttggccaaaaaactcaacttctcc

SEQ ID NO: 43319 - DNA, 201 bp, Bos taurus
tgacatagctaaatttctcaggagtatgtgtcttctctaatgcagaaaacaaaccccttagcaaaccagcgccctcagatattgcagtaatcatgtacacgagtggatccacaggaattccaaagggggtcatgatctctcatagtaacattattgctggtataactgggatggcggaaaggattccagaactcgggtatg

SEQ ID NO: 43320 - DNA, 201 bp, Bos taurus; identical to SEQ ID NO: 1775

SEQ ID NO: 43321 - DNA, 201 bp, Bos taurus; identical to SEQ ID NO: 1776

SEQ ID NO: 43322 - DNA, 201 bp, Bos taurus
agcttatttggagaaaggatcattgcaaatttaattaaattaaggattttgagataagatcatcccaggttatctgtgtgggccctaaatccaaagacacgtgcttttataagagacactcagagaaaatgctcagaagaggaggcagtgtgaccacacagtcagtgatgtgaagtgatgtggccacaagccaagaacacc

SEQ ID NO: 43323 - DNA, 201 bp, Bos taurus
tctttctgagctccagatcaggtgcccttggattttcaccaaatctaatgaatccatagggtcaacaccctgacttcagtagtttcttgagggaagaacattggccatagccttcctggaagttaatgcagaactaaaatcattgccttgattttgagatttaagaaacttaattttctttctttttttttggtgagtcaa

SEQ ID NO: 43324 - DNA, 201 bp, Bos taurus; identical to SEQ ID NO: 1777

SEQ ID NO: 43325 - DNA, 201 bp, Bos taurus; identical to SEQ ID NO: 1779

SEQ ID NO: 43326 - DNA, 201 bp, Bos taurus
ttcatctatgtattctttatgactgcttttgattctgcaatggtagagttgagaagctgccacagagactgtctggcccacaaagtctaatatttatgtctggtcctttgtaggagaagtctgtggacccaccccacactgtggtgagcagcccagttctggagttggatgcacatggactggaattccaacctctggcct

SEQ ID NO: 43327 - DNA, 201 bp, Bos taurus; identical to SEQ ID NO: 1781

SEQ ID NO: 43328 - DNA, 201 bp, Bos taurus; identical to SEQ ID NO: 1782

SEQ ID NO: 43329 - DNA, 201 bp, Bos taurus; identical to SEQ ID NO: 1783

SEQ ID NO: 43330 - DNA, 201 bp, Bos taurus
gcctaaaaggattgagttataaaacatttaagggacttctttatcatgtaaattccacctttgtaatgcaaatcccattgtacggcccctgccaggagaaggagagcaatattaatttacttactgtttaattattctcctctctccaacagcccctgggatgatgtaaggattccagggccaagaagagaatcttccact

SEQ ID NO: 43331 - DNA, 201 bp, Bos taurus; identical to SEQ ID NO: 1786

SEQ ID NO: 43332 - DNA, 201 bp, Bos taurus; identical to SEQ ID NO: 1787

SEQ ID NO: 43333 - DNA, 201 bp, Bos taurus; identical to SEQ ID NO: 1788

SEQ ID NO: 43334 - DNA, 201 bp, Bos taurus; identical to SEQ ID NO: 1790

SEQ ID NO: 43335 - DNA, 201 bp, Bos taurus; identical to SEQ ID NO: 1791

SEQ ID NO: 43336 - DNA, 201 bp, Bos taurus; identical to SEQ ID NO: 1794

SEQ ID NO: 43337 - DNA, 201 bp, Bos taurus
taatcttgaatttattttttgttactatgtttgaagggagtattggtacctcacgccttaccttggtaatacatttcctggagcctcaaagttcatctgccgtagtgaaagttgctcagttgtgtctgactctttgtgaccccatgaactatacagtccatggaattctccaggccagaagactgagtgggtaacctttac

SEQ ID NO: 43338 - DNA, 201 bp, Bos taurus
tgaacctgggaagctgtcccactctgttgccacctgaggttggccttttcagctttgctggcaaaatacaagctcacggccacggctggttagtgacggactcagctctatagaagaaatatagagtaagaaagaattttggtaggaaaaaaagaaacaagggagacgaagaaagcaggccacgcggaggaattggcatct

SEQ ID NO: 43339 - DNA, 201 bp, Bos taurus
tttcaagctgctgtatttgtgataatctgttattgtagcgatagaaaaagaatccattttactaaattattgggcagaaaaagtggggtaaaattcattggcaaagcacatagcttacagcctggagaagagcagatcctcagcaaccttgctgtccttttcagtgtgtgcgtgctcagtctcttcagtcatgtctgactc

SEQ ID NO: 43340 - DNA, 201 bp, Bos taurus; identical to SEQ ID NO: 1795

SEQ ID NO: 43341 - DNA, 201 bp, Bos taurus; identical to SEQ ID NO: 1796

SEQ ID NO: 43342 - DNA, 201 bp, Bos taurus; identical to SEQ ID NO: 1797

SEQ ID NO: 43343 - DNA, 201 bp, Bos taurus; identical to SEQ ID NO: 1798

SEQ ID NO: 43344 - DNA, 201 bp, Bos taurus; identical to SEQ ID NO: 1799

SEQ ID NO: 43345 - DNA, 201 bp, Bos taurus
catgaatgagatttttcagacgattgtccaggtgttaaaccctatagtacaaaagacaatttgaaagggaaagaacatgtgagaaggaatagtgaatcacactgataaaataagcctctttattaaaatcaagtttgatcaggaaagtaatagactactcttctagaaatcatggaggtatctacgttaccatgttaccat

SEQ ID NO: 43346 - DNA, 201 bp, Bos taurus; identical to SEQ ID NO: 1800

SEQ ID NO: 43347 - DNA, 201 bp, Bos taurus; identical to SEQ ID NO: 1801

SEQ ID NO: 43348 - DNA, 201 bp, Bos taurus; identical to SEQ ID NO: 1802

SEQ ID NO: 43349 - DNA, 201 bp, Bos taurus; identical to SEQ ID NO: 1803

SEQ ID NO: 43350 - DNA, 201 bp, Bos taurus; identical to SEQ ID NO: 1804

SEQ ID NO: 43351 - DNA, 201 bp, Bos taurus
tcaatccccacatttatagatggtcaagtggccatggtatttataataaaaaagtgtccactgcaagctacatgtgactttgattccacatagaaacccccactgtaagaagaatataattatatatcatcattgttgccaatatcttctcttagcttccacttgcccgcttaaaaatctacaatggtattttaaccaatt

SEQ ID NO: 43352 - DNA, 201 bp, Bos taurus
ttgatggtggtaccttctttagtcgcttgattatatgactcttcactggcccaatgcaggcataatgcagttggtgatttttaacgtatgcaaatgttcatggctggtctgcttggctttgcaggcgtgctggaggccaggacagagatgcacagctcattctgtgtgaccacttaactttttttttttaagtaatttggt

SEQ ID NO: 43353 - DNA, 201 bp, Bos taurus; identical to SEQ ID NO: 1805

SEQ ID NO: 43354 - DNA, 201 bp, Bos taurus
tattttaacaagcttctccaggtgatttctgattgagaagaactgttctaggcaaacatccaagaaactattctacagacagttaccagttaaggccaaccaatattactccatccatagctctctttaaagtcgaaaatcacaagtgacctcaaggtcatctaattttactagtaagttaaagccttatattggtgctaa

SEQ ID NO: 43355 - DNA, 201 bp, Bos taurus; identical to SEQ ID NO: 1808

SEQ ID NO: 43356 - DNA, 201 bp, Bos taurus; identical to SEQ ID NO: 1809

SEQ ID NO: 43357 - DNA, 201 bp, Bos taurus
ctggcaaatgcatgccttcagtcaccaggacaaccagacaatagagtgtccatctaaatcagttgctatcattgagccttagatgaagctgaacaatgggtgagtcgtgttcatgctggaggtagccctctggtgctggtgctgtctgtccctaaaccattgataatccgagaacagttcttacttcgtaggacaagtgaa

SEQ ID NO: 43358 - DNA, 201 bp, Bos taurus
gtttcattttcagcagtagagcactggtgggcagaagaatacagaagaaatggcatgtcatgtacaggcacaaagagaacaagggcgggccctgaagttatgtcaaagaatttcaggaaagcaaaagcatttgtgaccatgattcggttttcaagttttttcaatatgtggattgtctgcagtggctggggtgtcttgttg

SEQ ID NO: 43359 - DNA, 201 bp, Bos taurus; identical to SEQ ID NO: 1810

SEQ ID NO: 43360 - DNA, 201 bp, Bos taurus
caggctacagtccattggactgcaaagagtcggccatgactgagcgactaacactttttcactggtccataatggttgcagaagtagaggcttggggttcactggccgattctggacctctgtctgtggtctgctttgtcttaacagtcacgttcctgtctcggaaactctgaaacagacctgcccctaagtgatttacag

SEQ ID NO: 43361 - DNA, 201 bp, Bos taurus
tgtgagtgtctccttgaagcctggccctggaagtccaggaggagtgaagagataccttggtaatcctctaatccataggtgacatcttttcttaaaaaatattttttattttatttttggccatggtgagtcttcattgttgtacatgggtattttctagttgtggtgagcaggggctactctctagttgcagtgtgaggg

SEQ ID NO: 43362 - DNA, 201 bp, Bos taurus
tagtctccatctcttggcaggcaggaagattttgttttaaaacagagatttccttcagcatccctaaggcatctttatggagaatggggccatctaaccattaaatctgttaaagtgcctccgtcagcatcctcactagtgttttcttattctctctccctcctgaaacttcttacgtgaagattgtgatgcgtcagccaa

SEQ ID NO: 43363 - DNA, 201 bp, Bos taurus; identical to SEQ ID NO: 1813

SEQ ID NO: 43364 - DNA, 201 bp, Bos taurus
agttcttaattgtggcaggtgggatgtttagttacagcctgagaactctcagctgtggcatatgggatctagttgtcagaccagggactgaacccaggccccctgccttaggtgtgaagagtcttagccactggatcaccatggaactccccagtgctttgcattttgaaagatttttataccagtgtaagcattactatt

SEQ ID NO: 43365 - DNA, 201 bp, Bos taurus; identical to SEQ ID NO: 1814

SEQ ID NO: 43366 - DNA, 201 bp, Bos taurus; identical to SEQ ID NO: 1815

SEQ ID NO: 43367 - DNA, 201 bp, Bos taurus; identical to SEQ ID NO: 1816

SEQ ID NO: 43368 - DNA, 201 bp, Bos taurus; identical to SEQ ID NO: 1817

SEQ ID NO: 43369 - DNA, 201 bp, Bos taurus; identical to SEQ ID NO: 1819

SEQ ID NO: 43370 - DNA, 201 bp, Bos taurus; identical to SEQ ID NO: 1820

SEQ ID NO: 43371 - DNA, 201 bp, Bos taurus; identical to SEQ ID NO: 1821

SEQ ID NO: 43372 - DNA, 201 bp, Bos taurus; identical to SEQ ID NO: 1822

SEQ ID NO: 43373 - DNA, 201 bp, Bos taurus; identical to SEQ ID NO: 1823

SEQ ID NO: 43374 - DNA, 201 bp, Bos taurus; identical to SEQ ID NO: 1824

SEQ ID NO: 43375 - DNA, 201 bp, Bos taurus; identical to SEQ ID NO: 1827

SEQ ID NO: 43376 - DNA, 201 bp, Bos taurus; identical to SEQ ID NO: 1830

SEQ ID NO: 43377 - DNA, 201 bp, Bos taurus; identical to SEQ ID NO: 1831

SEQ ID NO: 43378 - DNA, 201 bp, Bos taurus; identical to SEQ ID NO: 1832

SEQ ID NO: 43379 - DNA, 201 bp, Bos taurus; identical to SEQ ID NO: 1833

SEQ ID NO: 43380 - DNA, 201 bp, Bos taurus; identical to SEQ ID NO: 1834

SEQ ID NO: 43381 - DNA, 201 bp, Bos taurus; identical to SEQ ID NO: 1835

SEQ ID NO: 43382 - DNA, 201 bp, Bos taurus; identical to SEQ ID NO: 1836

SEQ ID NO: 43383 - DNA, 201 bp, Bos taurus; identical to SEQ ID NO: 1837

SEQ ID NO: 43384 - DNA, 201 bp, Bos taurus; identical to SEQ ID NO: 1838

SEQ ID NO: 43385 - DNA, 201 bp, Bos taurus
gcacctaacaaggccattagctctgggtctttctctctggggtggcagcaggaatagaaaacaacagagataaggtctcctagcagcacagtctcagctcagggctctggggatgggcctcccctcctgccggagaggccatcccaggaggctgactgctcacacctgggcagcattcctggcttcatcccctcctgtctg

SEQ ID NO: 43386 - DNA, 201 bp, Bos taurus
ggtgtggtctgggcagggtgaccagtgtgggaggacgaggttggagggaggcaggcagagccaacggggagaacaagaaggccgatgtggatttatattcaacgctgcaggttgtgggagatggtttgatggaatcgcaagagggaaaaggacatggtcagatgtgcatcttgaaggcaaggcctaagtgcttgtcactcc

SEQ ID NO: 43387 - DNA, 201 bp, Bos taurus
ctccttgaggccaattccaaggagcttttctcagtcttcattttgattccttcaggaagcagattatattattgttcatgaatgttcactgctcctcctaccggggccctcccagtgagagaaatatatcccagtctccttggctgctgtatggccgggagacttgcttttgcaaataaaatgtgagtgcatgtgacctgt

SEQ ID NO: 43388 - DNA, 201 bp, Bos taurus
ctcagccaaggcagcagtggctgtagcattccagcctggtccccccacatcttcacctccaggccaggctcagtgggtctaagagctgttttggtacttttgtccttgagaccagtcccattttaagaacttggagattgatttcttttcccttctaaaaaatgagtcttgcattcttcttaaaatgatatttgagggtgg

SEQ ID NO: 43389 - DNA, 201 bp, Bos taurus; identical to SEQ ID NO: 1839

SEQ ID NO: 43390 - DNA, 201 bp, Bos taurus
cctcagatagaaagatggtggcatagaggtcaagagtcaatccatgtatctgtcacttcatcccacaggcagtcatgctggaggccccatatgggcagaacacaaaacatggaaaacagcaggtgccaaagggtgtgagatgaatccagtgaaaatataatagcctgacaccacgttaaaatcctagagcatatggcctga

SEQ ID NO: 43391 - DNA, 201 bp, Bos taurus
tgtcaatcccactgtgcagaggaacaaacagatgtgaagttaactgacttgcccaaggctatataaccaggcagtggtagaaccagagtccaggtgtcttgactcccacagttcagtgctctttctactacaacaaatgacaactggaggaaagttatttcaggcctaaaagggtaaaagtacaaactaacacataatgtg

SEQ ID NO: 43392 - DNA, 201 bp, Bos taurus; identical to SEQ ID NO: 1840

SEQ ID NO: 43393 - DNA, 201 bp, Bos taurus; identical to SEQ ID NO: 1842

SEQ ID NO: 43394 - DNA, 201 bp, Bos taurus; identical to SEQ ID NO: 1843

SEQ ID NO: 43395 - DNA, 201 bp, Bos taurus; identical to SEQ ID NO: 1844

SEQ ID NO: 43396 - DNA, 201 bp, Bos taurus
accctgggctccctcagcccaggctgggtggagtgggcgcaggggcctcaaatgtcctgacctctcaatggcgatgtggtttctgggccgggaatgggcatcctgaagtgaagaaaaataaaacaaacgtaaacaaccccaatgtcacccttctgtgaggcctccccagagtgtgacggggcatgcgatacagcctgagac

SEQ ID NO: 43397 - DNA, 201 bp, Bos taurus; identical to SEQ ID NO: 1845

SEQ ID NO: 43398 - DNA, 201 bp, Bos taurus; identical to SEQ ID NO: 1846

SEQ ID NO: 43399 - DNA, 201 bp, Bos taurus; identical to SEQ ID NO: 1847

SEQ ID NO: 43400 - DNA, 201 bp, Bos taurus; identical to SEQ ID NO: 1848

SEQ ID NO: 43401 - DNA, 201 bp, Bos taurus; identical to SEQ ID NO: 1849

SEQ ID NO: 43402 - DNA, 201 bp, Bos taurus; identical to SEQ ID NO: 1851

SEQ ID NO: 43403 - DNA, 201 bp, Bos taurus
atctgcacctgaagcctcgcagaggcctccaaaatgatgtcttcgctgccagagtccctctccctgtttcatcagcacccaggtacctttcccaaacgcacggccctgttgaaacaagaaaaggcactgaggtcctgtggtccacatgttgaaatgaaaactctgtccccagcattccagacccctcctactctgaatcct

SEQ ID NO: 43404 - DNA, 201 bp, Bos taurus; identical to SEQ ID NO: 1852

SEQ ID NO: 43405 - DNA, 201 bp, Bos taurus; identical to SEQ ID NO: 1855

SEQ ID NO: 43406 - DNA, 201 bp, Bos taurus; identical to SEQ ID NO: 1857

SEQ ID NO: 43407 - DNA, 201 bp, Bos taurus
gggagatggggcctccgatgacctggaagagatgagattggaagaaagcaggggtaggtgggggaacagttggagactgaaccattcccaaatctgggacgtgggtggattagggacacagctggcctgaagccccagtgatagggctcatggaaagcatttgttggttatgggggtagcaagagatgaagaaggctttga

SEQ ID NO: 43408 - DNA, 201 bp, Bos taurus
agcttctcataaccaccctgtgagggttgggatctcacaggggtctatttctactcccattttacagatgagaaaactgaggccaagaaaggtcatgcatccatctcccaagctccctctcttagtaaatgcgattcccagatcagtctggctctgacatccaggctctcaagtgctgttacctcatgcagaggcctaaga

SEQ ID NO: 43409 - DNA, 201 bp, Bos taurus; identical to SEQ ID NO: 1858

SEQ ID NO: 43410 - DNA, 201 bp, Bos taurus; identical to SEQ ID NO: 1859

SEQ ID NO: 43411 - DNA, 201 bp, Bos taurus; identical to SEQ ID NO: 1860

SEQ ID NO: 43412 - DNA, 201 bp, Bos taurus; identical to SEQ ID NO: 1861

SEQ ID NO: 43413 - DNA, 201 bp, Bos taurus; identical to SEQ ID NO: 1862

SEQ ID NO: 43414 - DNA, 201 bp, Bos taurus; identical to SEQ ID NO: 1863

SEQ ID NO: 43415 - DNA, 201 bp, Bos taurus
gtttcccaaggtcactgaaagtgatacagggtctcagttgtagttacacagtatgagggagggaattccagctgtgacagacgtcgctgccgtattcacttccatattcatctatactctggctcctcccctcctgagagacagaaggcccatgcctagaactgtttctctcggaaatgtagggttggaaggaaatgcctg

SEQ ID NO: 43416 - DNA, 201 bp, Bos taurus; identical to SEQ ID NO: 1864

SEQ ID NO: 43417 - DNA, 201 bp, Bos taurus
aggagatctcacagacagttttcattacggagtgcaatgtttttactatatacaccaaagaaaaataactgcactcaacaatagggccttgaacttaaaacgttatctgagcaagcaaacctaaaattggttgaagacatggagactcacaactggatggccacagtgggcttaatccccatttcttggtaaataaatggc

SEQ ID NO: 43418 - DNA, 201 bp, Bos taurus; identical to SEQ ID NO: 1865

SEQ ID NO: 43419 - DNA, 201 bp, Bos taurus; identical to SEQ ID NO: 1866

SEQ ID NO: 43420 - DNA, 201 bp, Bos taurus; identical to SEQ ID NO: 1867

SEQ ID NO: 43421 - DNA, 201 bp, Bos taurus; identical to SEQ ID NO: 1868

SEQ ID NO: 43422 - DNA, 201 bp, Bos taurus
tcccatgatcattgtaaaatagggagggaaggaaggcgttgcaagtcttggctgctctctgtggatcatttcttgggttgagggggtggtaaaactgtgcacccccgttccctgcaaagcctcgctgtgaagcaaagaggccttctcggaagtggtggcattcggaaacacgggagggacctgggctcccttcggaatgcc

SEQ ID NO: 43423 - DNA, 201 bp, Bos taurus; identical to SEQ ID NO: 1869

SEQ ID NO: 43424 - DNA, 201 bp, Bos taurus; identical to SEQ ID NO: 1870

SEQ ID NO: 43425 - DNA, 201 bp, Bos taurus
cgaggcactctgggaagctactacaaaggtatggccccactggggtcacacagggttcccagacacttgaactgagacttaagaacaaacagcacatggcatggaagaccaggacgtgtcccggccgcgatcccaggaggaaaaacacagggtttgggagccgaggctccggggccatgggaccctctgcctcagtttccg

SEQ ID NO: 43426 - DNA, 201 bp, Bos taurus; identical to SEQ ID NO: 1871

SEQ ID NO: 43427 - DNA, 201 bp, Bos taurus; identical to SEQ ID NO: 1872

SEQ ID NO: 43428 - DNA, 201 bp, Bos taurus
tcacagccctgtccacagaccagtgagtcggatccacatgcctgtctcttttcttcctctctctccttctaggcttaggcctcagcttcaccccttgaagggctgtggcataggagaacgcctgaaagtagggagaggggtgggagctctgagggcatcgtgcccgttttactgatgaagaaacaaaggccctgaaattca

SEQ ID NO: 43429 - DNA, 201 bp, Bos taurus; identical to SEQ ID NO: 1873

SEQ ID NO: 43430 - DNA, 201 bp, Bos taurus; identical to SEQ ID NO: 1874

SEQ ID NO: 43431 - DNA, 201 bp, Bos taurus; identical to SEQ ID NO: 1875

SEQ ID NO: 43432 - DNA, 201 bp, Bos taurus; identical to SEQ ID NO: 1876

SEQ ID NO: 43433 - DNA, 201 bp, Bos taurus; identical to SEQ ID NO: 1877

SEQ ID NO: 43434 - DNA, 201 bp, Bos taurus; identical to SEQ ID NO: 1878

SEQ ID NO: 43435 - DNA, 201 bp, Bos taurus; identical to SEQ ID NO: 1879

SEQ ID NO: 43436 - DNA, 201 bp, Bos taurus; identical to SEQ ID NO: 1880

SEQ ID NO: 43437 - DNA, 201 bp, Bos taurus; identical to SEQ ID NO: 1881

SEQ ID NO: 43438 - DNA, 201 bp, Bos taurus
acggaggagcctgtaggctacagtccatggggtcacaaagagtcggacacgaccgagcgacttcactttcactttggtgattcagaggtaaagaatacctctgagtcttttactgtctcttgcattgacaggattctttacactagcgccacctgggaaacacaaaagtttccttcttcccacaccgggagtcgaacccgg

SEQ ID NO: 43439 - DNA, 201 bp, Bos taurus
gctccaaaatgaaatcaactcaacaaatatttgatttaaacattttttatttttagacatttaagcatttaatatctttcattgattcagtggccaaataaggcaccatctgctcagtgcggaaaggcacctgtcagaaacaaaatacaactgtgttgcaagacacctgtctcaggaggccagctgcagactccctgagag

SEQ ID NO: 43440 - DNA, 201 bp, Bos taurus; identical to SEQ ID NO: 1882

SEQ ID NO: 43441 - DNA, 201 bp, Bos taurus; identical to SEQ ID NO: 1883

SEQ ID NO: 43442 - DNA, 201 bp, Bos taurus; identical to SEQ ID NO: 1884

SEQ ID NO: 43443 - DNA, 201 bp, Bos taurus; identical to SEQ ID NO: 1888

SEQ ID NO: 43444 - DNA, 201 bp, Bos taurus; identical to SEQ ID NO: 1889

SEQ ID NO: 43445 - DNA, 201 bp, Bos taurus; identical to SEQ ID NO: 1890

SEQ ID NO: 43446 - DNA, 201 bp, Bos taurus; identical to SEQ ID NO: 1891

SEQ ID NO: 43447 - DNA, 201 bp, Bos taurus
gtctgtaagcggagttagtgaatttacacagaaaagaaatagcctagaaaatttgaaaaggtttttaaagatgacatattttatgtggcccttgtaaggactatgcctatgggacagttctttcttcaggggaccatggtggtaataggctctacctactcatcacagttgatggcctccctagtcatcgatttggcagcg

SEQ ID NO: 43448 - DNA, 201 bp, Bos taurus
caggtagagaatgacaatgactggatataccgggggcccaggaagccatggctgtcgctgccatcattgttattagttttagagtcacagacaagagccaacctagaggatgctgagggcccggcccagctctgaaaatctaaatcctgtggttgcagctgggggagtgactccaggaggcacctggtaagaggtggctcc

SEQ ID NO: 43449 - DNA, 201 bp, Bos taurus
tgtatcatcccgggagggggtggagagacggatgcagaagtgaccttggggcttcttattaaggaaccctgcattagaacccacactggctttgtagcctcgagggcctgggcctcggaagatgggagcgtggtgggcccctcagcaataggacttccttcccctgaaagcttacttttcaagtcactgatatttccttac

SEQ ID NO: 43450 - DNA, 201 bp, Bos taurus; identical to SEQ ID NO: 1893

SEQ ID NO: 43451 - DNA, 201 bp, Bos taurus; identical to SEQ ID NO: 1894

SEQ ID NO: 43452 - DNA, 201 bp, Bos taurus
ctcattaatgacccccttcaccacatgcagtcactgttctgacttccaccatcgttgacgagttctgcctggttttgaagttttggaaagagaacctttccatacagattctctggtgcctggccacttgctcagagccatgattttgagattcactcatcatgctttgtgttatcagcaatttgtgtgtgtgtttttttt

SEQ ID NO: 43453 - DNA, 201 bp, Bos taurus; identical to SEQ ID NO: 1898

SEQ ID NO: 43454 - DNA, 201 bp, Bos taurus; identical to SEQ ID NO: 1899

SEQ ID NO: 43455 - DNA, 201 bp, Bos taurus; identical to SEQ ID NO: 1900

SEQ ID NO: 43456 - DNA, 201 bp, Bos taurus; identical to SEQ ID NO: 1901

SEQ ID NO: 43457 - DNA, 201 bp, Bos taurus; identical to SEQ ID NO: 1902

SEQ ID NO: 43458 - DNA, 201 bp, Bos taurus; identical to SEQ ID NO: 1903

SEQ ID NO: 43459 - DNA, 201 bp, Bos taurus; identical to SEQ ID NO: 1904

SEQ ID NO: 43460 - DNA, 201 bp, Bos taurus; identical to SEQ ID NO: 1905

SEQ ID NO: 43461 - DNA, 201 bp, Bos taurus; identical to SEQ ID NO: 1907

SEQ ID NO: 43462 - DNA, 201 bp, Bos taurus; identical to SEQ ID NO: 1908

SEQ ID NO: 43463 - DNA, 201 bp, Bos taurus
ttcaggttctttggggcgagcgtgtgttcaccccagaggcttaaatgaagcacattagcagccactcgggcggatggcctctgcaacaggaaggggagccagagcttagaacacctgtgacagtcttcacccacagcccgctttgttagcacagcctgtctcagggtcttcccttctttggccctgagcatactcttcacc

SEQ ID NO: 43464 - DNA, 201 bp, Bos taurus
cccggaaggcagtctgtgcgagaatgtgtctagggcctgggatggggtttgtatcacatcccctggtgagtgcggagagatacttatttaatctgaccctggtcccctacctgcagggccttgggagaggcagatgtggcgtcagacgagtcccctgcccaagccgctgtgccgtcaggttccttgctcgaggtgccaatc

SEQ ID NO: 43465 - DNA, 201 bp, Bos taurus; identical to SEQ ID NO: 1910

SEQ ID NO: 43466 - DNA, 201 bp, Bos taurus; identical to SEQ ID NO: 1912

SEQ ID NO: 43467 - DNA, 201 bp, Bos taurus
ctgtggccttagaggccccattaatgggtgttgagtggaatggacaagtgcaggaagtgaatgagtaaggaccgctcttctagaaaatttagcctggattcctctgctgggtacccaaggcagagcgcaccgctgataagaaggatctcgtgtctgggagaggtggacatcaagactgcacgtttcatggtaatgtcacat

SEQ ID NO: 43468 - DNA, 201 bp, Bos taurus
tcccttgggagagtaactgcccgctggacttgccagccaaagccagaacggctgtcttgggtcaagaactgtgcttttggacaatagactcacccctgccgtggatatagcatagctattaataaactctttggggctggggaacgaactacttgaacgggacaaaggaagggggtctcctgttccttttagtccaatgcc

SEQ ID NO: 43469 - DNA, 201 bp, Bos taurus; identical to SEQ ID NO: 1913

SEQ ID NO: 43470 - DNA, 201 bp, Bos taurus
acaaagagcccacaggctgcacagtgaggccaaaaaaaaaaaaaaaaaggcaacgggggggctcataggattagaacaccacacacaggtgaccttaaccgaggccccagttgggaaaaatcggcctcccatcagagtgggggcccccaggttctgttcctctctgctcctgcactcgccttcccccaccaccctgtcttt

SEQ ID NO: 43471 - DNA, 201 bp, Bos taurus; identical to SEQ ID NO: 1915

SEQ ID NO: 43472 - DNA, 201 bp, Bos taurus
cttttgaaatgggcaaggggatgacaatccaggagatagctcaagagagtgtgttccgaggccacttctcagaacaaagacagacttctgtacaaggccaatgcagcctgataaaggttcccccagtgggtccccaaacaccaaagacattcacgtaaatgagttcaaaatacatattgctctgggccaaatcacacagtg

SEQ ID NO: 43473 - DNA, 201 bp, Bos taurus; identical to SEQ ID NO: 1917

SEQ ID NO: 43474 - DNA, 201 bp, Bos taurus; identical to SEQ ID NO: 1918

SEQ ID NO: 43475 - DNA, 201 bp, Bos taurus; identical to SEQ ID NO: 1919

SEQ ID NO: 43476 - DNA, 201 bp, Bos taurus; identical to SEQ ID NO: 1920

SEQ ID NO: 43477 - DNA, 201 bp, Bos taurus; identical to SEQ ID NO: 1921

SEQ ID NO: 43478 - DNA, 201 bp, Bos taurus; identical to SEQ ID NO: 1922

SEQ ID NO: 43479 - DNA, 201 bp, Bos taurus; identical to SEQ ID NO: 1924

SEQ ID NO: 43480 - DNA, 201 bp, Bos taurus; identical to SEQ ID NO: 1925

SEQ ID NO: 43481 - DNA, 201 bp, Bos taurus; identical to SEQ ID NO: 1929

SEQ ID NO: 43482 - DNA, 201 bp, Bos taurus; identical to SEQ ID NO: 1930

SEQ ID NO: 43483 - DNA, 201 bp, Bos taurus; identical to SEQ ID NO: 1931

SEQ ID NO: 43484 - DNA, 201 bp, Bos taurus; identical to SEQ ID NO: 1932

SEQ ID NO: 43485 - DNA, 201 bp, Bos taurus; identical to SEQ ID NO: 1934

SEQ ID NO: 43486 - DNA, 201 bp, Bos taurus
ccttggagcagagtggctgacaaggggcagacagacagggacaggtcctggaggcagtgggggcaggaagccccagtgcaaccccacagaagggctgcccatctccactgaaggcctggagtcaagttccttctcgggcgacatttttttcctctatgcctgtatgactatcagacaaggagatggtgccatgaaatgaac

SEQ ID NO: 43487 - DNA, 201 bp, Bos taurus; identical to SEQ ID NO: 1935

SEQ ID NO: 43488 - DNA, 201 bp, Bos taurus; identical to SEQ ID NO: 1936

SEQ ID NO: 43489 - DNA, 201 bp, Bos taurus; identical to SEQ ID NO: 1937

SEQ ID NO: 43490 - DNA, 201 bp, Bos taurus
gcagacggtgatggtccacgggactccagcgagcccctctctgcgagttactcaccacctgcttccacccttgagactctggctgtttcacttgaggaactagtacctgccacgctgtgtggcctcaggccagttgcttaacctctctgcgtctcaggaacctcttcagtcaagagaaatgagcagagtttgggaagcacg

SEQ ID NO: 43491 - DNA, 201 bp, Bos taurus; identical to SEQ ID NO: 1942

SEQ ID NO: 43492 - DNA, 201 bp, Bos taurus; identical to SEQ ID NO: 1943

SEQ ID NO: 43493 - DNA, 201 bp, Bos taurus
gcatttagaggaactgacagagatgcccttagcttcccttcatttttgaatggggaaactgaggctcggggcagagccgtaactggcctgaggtcattgttgagttggtgcagaacccagacaggagtctgccttcttggctccccgtgagcagtctccatctcccggcaggggcccggggcagcgttcacagctttggtt

SEQ ID NO: 43494 - DNA, 201 bp, Bos taurus; identical to SEQ ID NO: 1944

SEQ ID NO: 43495 - DNA, 201 bp, Bos taurus; identical to SEQ ID NO: 1946

SEQ ID NO: 43496 - DNA, 201 bp, Bos taurus; identical to SEQ ID NO: 1947

SEQ ID NO: 43497 - DNA, 201 bp, Bos taurus; identical to SEQ ID NO: 1949

SEQ ID NO: 43498 - DNA, 201 bp, Bos taurus; identical to SEQ ID NO: 1952

SEQ ID NO: 43499 - DNA, 201 bp, Bos taurus; identical to SEQ ID NO: 1953

SEQ ID NO: 43500 - DNA, 201 bp, Bos taurus; identical to SEQ ID NO: 1955

SEQ ID NO: 43501 - DNA, 201 bp, Bos taurus; identical to SEQ ID NO: 1956

SEQ ID NO: 43502 - DNA, 201 bp, Bos taurus; identical to SEQ ID NO: 1957

SEQ ID NO: 43503 - DNA, 201 bp, Bos taurus; identical to SEQ ID NO: 1958

SEQ ID NO: 43504 - DNA, 201 bp, Bos taurus; identical to SEQ ID NO: 1959

SEQ ID NO: 43505 - DNA, 201 bp, Bos taurus; identical to SEQ ID NO: 1960

SEQ ID NO: 43506 - DNA, 201 bp, Bos taurus; identical to SEQ ID NO: 1961

SEQ ID NO: 43507 - DNA, 201 bp, Bos taurus; identical to SEQ ID NO: 1962

SEQ ID NO: 43508 - DNA, 201 bp, Bos taurus; identical to SEQ ID NO: 1963

SEQ ID NO: 43509 - DNA, 201 bp, Bos taurus; identical to SEQ ID NO: 1964

SEQ ID NO: 43510 - DNA, 201 bp, Bos taurus; identical to SEQ ID NO: 1965

SEQ ID NO: 43511 - DNA, 201 bp, Bos taurus; identical to SEQ ID NO: 1966

SEQ ID NO: 43512 - DNA, 201 bp, Bos taurus; identical to SEQ ID NO: 1967

SEQ ID NO: 43513 - DNA, 201 bp, Bos taurus; identical to SEQ ID NO: 1968

SEQ ID NO: 43514 - DNA, 201 bp, Bos taurus; identical to SEQ ID NO: 1969

SEQ ID NO: 43515 - DNA, 201 bp, Bos taurus; identical to SEQ ID NO: 1970

SEQ ID NO: 43516 - DNA, 201 bp, Bos taurus; identical to SEQ ID NO: 1971

SEQ ID NO: 43517 - DNA, 201 bp, Bos taurus; identical to SEQ ID NO: 1972

SEQ ID NO: 43518 - DNA, 201 bp, Bos taurus; identical to SEQ ID NO: 1973

SEQ ID NO: 43519 - DNA, 201 bp, Bos taurus; identical to SEQ ID NO: 1974

SEQ ID NO: 43520 - DNA, 201 bp, Bos taurus; identical to SEQ ID NO: 1975

SEQ ID NO: 43521 - DNA, 201 bp, Bos taurus; identical to SEQ ID NO: 1976

SEQ ID NO: 43522 - DNA, 201 bp, Bos taurus; identical to SEQ ID NO: 1978

SEQ ID NO: 43523 - DNA, 201 bp, Bos taurus; identical to SEQ ID NO: 1979

SEQ ID NO: 43524 - DNA, 201 bp, Bos taurus; identical to SEQ ID NO: 1980

SEQ ID NO: 43525 - DNA, 201 bp, Bos taurus; identical to SEQ ID NO: 1981

SEQ ID NO: 43526 - DNA, 201 bp, Bos taurus; identical to SEQ ID NO: 1982

SEQ ID NO: 43527 - DNA, 201 bp, Bos taurus; identical to SEQ ID NO: 1983

SEQ ID NO: 43528 - DNA, 201 bp, Bos taurus; identical to SEQ ID NO: 1985

SEQ ID NO: 43529 - DNA, 201 bp, Bos taurus; identical to SEQ ID NO: 1986

SEQ ID NO: 43530 - DNA, 201 bp, Bos taurus; identical to SEQ ID NO: 1987

SEQ ID NO: 43531 - DNA, 201 bp, Bos taurus; identical to SEQ ID NO: 1988

SEQ ID NO: 43532 - DNA, 201 bp, Bos taurus; identical to SEQ ID NO: 1989

SEQ ID NO: 43533 - DNA, 201 bp, Bos taurus; identical to SEQ ID NO: 1990

SEQ ID NO: 43534 - DNA, 201 bp, Bos taurus; identical to SEQ ID NO: 1991

SEQ ID NO: 43535 - DNA, 201 bp, Bos taurus; identical to SEQ ID NO: 1992

SEQ ID NO: 43536 - DNA, 201 bp, Bos taurus; identical to SEQ ID NO: 1993

SEQ ID NO: 43537 - DNA, 201 bp, Bos taurus; identical to SEQ ID NO: 1994

SEQ ID NO: 43538 - DNA, 201 bp, Bos taurus; identical to SEQ ID NO: 1996

SEQ ID NO: 43539 - DNA, 201 bp, Bos taurus; identical to SEQ ID NO: 1997

SEQ ID NO: 43540 - DNA, 201 bp, Bos taurus; identical to SEQ ID NO: 1998

SEQ ID NO: 43541 - DNA, 201 bp, Bos taurus; identical to SEQ ID NO: 1999

SEQ ID NO: 43542 - DNA, 201 bp, Bos taurus; identical to SEQ ID NO: 2000

SEQ ID NO: 43543 - DNA, 201 bp, Bos taurus; identical to SEQ ID NO: 2001

SEQ ID NO: 43544 - DNA, 201 bp, Bos taurus; identical to SEQ ID NO: 2002

SEQ ID NO: 43545 - DNA, 201 bp, Bos taurus; identical to SEQ ID NO: 2003

SEQ ID NO: 43546 - DNA, 201 bp, Bos taurus; identical to SEQ ID NO: 2004

SEQ ID NO: 43547 - DNA, 201 bp, Bos taurus; identical to SEQ ID NO: 2005

SEQ ID NO: 43548 - DNA, 201 bp, Bos taurus; identical to SEQ ID NO: 2006

SEQ ID NO: 43549 - DNA, 201 bp, Bos taurus; identical to SEQ ID NO: 2007

SEQ ID NO: 43550 - DNA, 201 bp, Bos taurus; identical to SEQ ID NO: 2008

SEQ ID NO: 43551 - DNA, 201 bp, Bos taurus; identical to SEQ ID NO: 2009

SEQ ID NO: 43552 - DNA, 201 bp, Bos taurus; identical to SEQ ID NO: 2010

SEQ ID NO: 43553 - DNA, 201 bp, Bos taurus; identical to SEQ ID NO: 2011

SEQ ID NO: 43554 - DNA, 201 bp, Bos taurus; identical to SEQ ID NO: 2012

SEQ ID NO: 43555 - DNA, 201 bp, Bos taurus; identical to SEQ ID NO: 2013

SEQ ID NO: 43556 - DNA, 201 bp, Bos taurus; identical to SEQ ID NO: 2014

SEQ ID NO: 43557 - DNA, 201 bp, Bos taurus; identical to SEQ ID NO: 2015

SEQ ID NO: 43558 - DNA, 201 bp, Bos taurus; identical to SEQ ID NO: 2016

SEQ ID NO: 43559 - DNA, 201 bp, Bos taurus; identical to SEQ ID NO: 2017

SEQ ID NO: 43560 - DNA, 201 bp, Bos taurus; identical to SEQ ID NO: 2018

SEQ ID NO: 43561 - DNA, 201 bp, Bos taurus; identical to SEQ ID NO: 2019

SEQ ID NO: 43562 - DNA, 201 bp, Bos taurus; identical to SEQ ID NO: 2020

SEQ ID NO: 43563 - DNA, 201 bp, Bos taurus; identical to SEQ ID NO: 2021

SEQ ID NO: 43564 - DNA, 201 bp, Bos taurus; identical to SEQ ID NO: 2022

SEQ ID NO: 43565 - DNA, 201 bp, Bos taurus
tactgtaaagataggtgttgttgaaataaccagcagagggctgataactgcctctggaggtgagggaggccccagtgaaggagatggggaagtatgggacatgggagtaaatcacattgcattcttacctggagtcaattcagtgaacaatccccagtgtttgctttgggaggggagaagttgcagagggcgccatggtgc

SEQ ID NO: 43566 - DNA, 201 bp, Bos taurus; identical to SEQ ID NO: 2024

SEQ ID NO: 43567 - DNA, 201 bp, Bos taurus; identical to SEQ ID NO: 2025

SEQ ID NO: 43568 - DNA, 201 bp, Bos taurus
tttggaaaatcccacacaccaaggcactctttgacttcagggtcattctcagctgggttctccttcttccttacaggaggccccaaggactcagcctctttaaagcttctctgaaccacagagccctacactccttcagaaggatacttttgtccctaaaagtgacatgattttctttaataatgataataatcatggcca

SEQ ID NO: 43569 - DNA, 201 bp, Bos taurus; identical to SEQ ID NO: 2026

SEQ ID NO: 43570 - DNA, 201 bp, Bos taurus; identical to SEQ ID NO: 2027

SEQ ID NO: 43571 - DNA, 201 bp, Bos taurus; identical to SEQ ID NO: 2028

SEQ ID NO: 43572 - DNA, 201 bp, Bos taurus; identical to SEQ ID NO: 2030

SEQ ID NO: 43573 - DNA, 201 bp, Bos taurus; identical to SEQ ID NO: 2031

SEQ ID NO: 43574 - DNA, 201 bp, Bos taurus; identical to SEQ ID NO: 2033

SEQ ID NO: 43575 - DNA, 201 bp, Bos taurus; identical to SEQ ID NO: 2037

SEQ ID NO: 43576 - DNA, 201 bp, Bos taurus
agctcaaaaagatcttagaaaaagtggagtccagaatcaggtctttcctaaaaatggacattgagacttggaataaagaaaggcctagaataggtcaattgagttactcagttttcttttgctccactctgttgctgacttcaccagtcacaggccatattctctgtagaggaaaaggatgaagacatcacatgcactggt

SEQ ID NO: 43577 - DNA, 201 bp, Bos taurus; identical to SEQ ID NO: 2040

SEQ ID NO: 43578 - DNA, 201 bp, Bos taurus; identical to SEQ ID NO: 2041

SEQ ID NO: 43579 - DNA, 201 bp, Bos taurus; identical to SEQ ID NO: 2045

SEQ ID NO: 43580 - DNA, 201 bp, Bos taurus; identical to SEQ ID NO: 2046

SEQ ID NO: 43581 - DNA, 201 bp, Bos taurus; identical to SEQ ID NO: 2048

SEQ ID NO: 43582 - DNA, 201 bp, Bos taurus; identical to SEQ ID NO: 2051

SEQ ID NO: 43583 - DNA, 201 bp, Bos taurus; identical to SEQ ID NO: 2052

SEQ ID NO: 43584 - DNA, 201 bp, Bos taurus; identical to SEQ ID NO: 2053

SEQ ID NO: 43585 - DNA, 201 bp, Bos taurus; identical to SEQ ID NO: 2054

SEQ ID NO: 43586 - DNA, 201 bp, Bos taurus; identical to SEQ ID NO: 2055

SEQ ID NO: 43587 - DNA, 201 bp, Bos taurus; identical to SEQ ID NO: 2056

SEQ ID NO: 43588 - DNA, 201 bp, Bos taurus; identical to SEQ ID NO: 2057

SEQ ID NO: 43589 - DNA, 201 bp, Bos taurus; identical to SEQ ID NO: 2058

SEQ ID NO: 43590 - DNA, 201 bp, Bos taurus; identical to SEQ ID NO: 2059

SEQ ID NO: 43591 - DNA, 201 bp, Bos taurus; identical to SEQ ID NO: 2061

SEQ ID NO: 43592 - DNA, 201 bp, Bos taurus; identical to SEQ ID NO: 2062

SEQ ID NO: 43593 - DNA, 201 bp, Bos taurus; identical to SEQ ID NO: 2063

SEQ ID NO: 43594 - DNA, 201 bp, Bos taurus; identical to SEQ ID NO: 2064

SEQ ID NO: 43595 - DNA, 201 bp, Bos taurus; identical to SEQ ID NO: 2065

SEQ ID NO: 43596 - DNA, 201 bp, Bos taurus; identical to SEQ ID NO: 2066

SEQ ID NO: 43597 - DNA, 201 bp, Bos taurus; identical to SEQ ID NO: 2067

SEQ ID NO: 43598 - DNA, 201 bp, Bos taurus; identical to SEQ ID NO: 2068

SEQ ID NO: 43599 - DNA, 201 bp, Bos taurus; identical to SEQ ID NO: 2069

SEQ ID NO: 43600 - DNA, 201 bp, Bos taurus; identical to SEQ ID NO: 2070

SEQ ID NO: 43601 - DNA, 201 bp, Bos taurus; identical to SEQ ID NO: 2071

SEQ ID NO: 43602 - DNA, 201 bp, Bos taurus; identical to SEQ ID NO: 2072

SEQ ID NO: 43603 - DNA, 201 bp, Bos taurus; identical to SEQ ID NO: 2073

SEQ ID NO: 43604 - DNA, 201 bp, Bos taurus; identical to SEQ ID NO: 2074

SEQ ID NO: 43605 - DNA, 201 bp, Bos taurus; identical to SEQ ID NO: 2075

SEQ ID NO: 43606 - DNA, 201 bp, Bos taurus; identical to SEQ ID NO: 2076

SEQ ID NO: 43607 - DNA, 201 bp, Bos taurus
tgtcagacatagcatagcaggcaaggttagaatgggacctagggtctcaggaggcatttagagacctcagtggcagggggcatgaccatatcgccataagtttgtcacaggaagagctatgcttacattggaccatggactctgggtcaaaaaatgttgtctccatagaggcagggtggggtagaatggaggagcacggac

SEQ ID NO: 43608 - DNA, 201 bp, Bos taurus; identical to SEQ ID NO: 2077

SEQ ID NO: 43609 - DNA, 201 bp, Bos taurus; identical to SEQ ID NO: 2079

SEQ ID NO: 43610 - DNA, 201 bp, Bos taurus; identical to SEQ ID NO: 2080

SEQ ID NO: 43611 - DNA, 201 bp, Bos taurus; identical to SEQ ID NO: 2081

SEQ ID NO: 43612 - DNA, 201 bp, Bos taurus; identical to SEQ ID NO: 2082

SEQ ID NO: 43613 - DNA, 201 bp, Bos taurus; identical to SEQ ID NO: 2083

SEQ ID NO: 43614 - DNA, 201 bp, Bos taurus; identical to SEQ ID NO: 2084

SEQ ID NO: 43615 - DNA, 201 bp, Bos taurus; identical to SEQ ID NO: 2086

SEQ ID NO: 43616 - DNA, 201 bp, Bos taurus; identical to SEQ ID NO: 2087

SEQ ID NO: 43617 - DNA, 201 bp, Bos taurus; identical to SEQ ID NO: 2088

SEQ ID NO: 43618 - DNA, 201 bp, Bos taurus; identical to SEQ ID NO: 2089

SEQ ID NO: 43619 - DNA, 201 bp, Bos taurus; identical to SEQ ID NO: 2090

SEQ ID NO: 43620 - DNA, 201 bp, Bos taurus; identical to SEQ ID NO: 2091

SEQ ID NO: 43621 - DNA, 201 bp, Bos taurus
tattgatccctgtatagtattgtcttcatggaaatgtgctttggtgagatgctatcattctgtgtcaagggaacaataagaaacaatcccacaaaactcattgctgtgactactgaaaagatgttcattatattactctatcctctttatgaggacccttgggaggaatttgtctgttcacttgagaaatggtgtgcttct

SEQ ID NO: 43622 - DNA, 201 bp, Bos taurus
agtaactcaagagtgcctgttcttttttttaattctgctgtatatgcagggtctgaattcagaatttcccagagagggccacattaaggaaatcctaagacagccgtatgtctcctttttattttgcacctcttctcttctagtaattcatcaatatatcagcatgctaccagaaaaggccagagtgatgtgcctaaaact

SEQ ID NO: 43623 - DNA, 201 bp, Bos taurus; identical to SEQ ID NO: 2092

SEQ ID NO: 43624 - DNA, 201 bp, Bos taurus; identical to SEQ ID NO: 2093

SEQ ID NO: 43625 - DNA, 201 bp, Bos taurus
tgtttttctattgcaggatcccactttctaagtgggatcacatgccctttattattagtctgctttagactgtgacagtctcttacactttccttgtttttgatgacttgacagttttgaggagtactagttaagtattttgtagactatcccttaatttgtgattgtctgatattttcccctcatgattaggctagggtt

SEQ ID NO: 43626 - DNA, 201 bp, Bos taurus; identical to SEQ ID NO: 2095

SEQ ID NO: 43627 - DNA, 201 bp, Bos taurus; identical to SEQ ID NO: 2097

SEQ ID NO: 43628 - DNA, 201 bp, Bos taurus
ttcacagaccagctccctcccctccattcctactgccacggccttcatctaggcccacatcatctcttggttggtctctctgttctcctgacttcctgccttatcatccttgaatccatcttcctctcccaccagaaggatctagcatgtttcctgcttaagtatggagtcctgccccaaggccacaggtgcgaggccttg

SEQ ID NO: 43629 - DNA, 201 bp, Bos taurus; identical to SEQ ID NO: 2098

SEQ ID NO: 43630 - DNA, 201 bp, Bos taurus
ggggagttctaggcagcagggaaagcagaacaagtcaaggaactggcccaccagtatttcaataacacttactgtgtgccaggcatgcgataaccatgctaaacaagtcatgtgaggccactgccctcagggaactcacagccagtgagtgagcacatgtgctgtgtgtttcatctgtactggacagtgaggaaagcctct

SEQ ID NO: 43631 - DNA, 201 bp, Bos taurus; identical to SEQ ID NO: 2101

SEQ ID NO: 43632 - DNA, 201 bp, Bos taurus
aggagtattttggcttcaggcataatcaacaatagcataaggatttgcttgtgatagtattccgccccccccacacatcttttctcagttctgcttcttccgttagcttatcccttgcacagcaacagaatctatcctgttggtacatgttgatcttgtatccaccatgatctgccactctctaaaccacaatgactaagg

SEQ ID NO: 43633 - DNA, 201 bp, Bos taurus; identical to SEQ ID NO: 2102

SEQ ID NO: 43634 - DNA, 201 bp, Bos taurus; identical to SEQ ID NO: 2103

SEQ ID NO: 43635 - DNA, 201 bp, Bos taurus; identical to SEQ ID NO: 2104

SEQ ID NO: 43636 - DNA, 201 bp, Bos taurus; identical to SEQ ID NO: 2105

SEQ ID NO: 43637 - DNA, 201 bp, Bos taurus; identical to SEQ ID NO: 2106

SEQ ID NO: 43638 - DNA, 201 bp, Bos taurus
cggcggtggggcactcatagaaattcaggtgctcctccaccctaaagaccggccccaaatccccctgcttcgtctgctgctaggaccacgaaggcctctgccgggaccagacaaatccaaggagccgagcagaggcgttcgaccgcagcgcacctaaggtacctacctgggcctccacgcggctcggagcagattaaaccc

SEQ ID NO: 43639 - DNA, 201 bp, Bos taurus; identical to SEQ ID NO: 2107

SEQ ID NO: 43640 - DNA, 201 bp, Bos taurus; identical to SEQ ID NO: 2108

SEQ ID NO: 43641 - DNA, 201 bp, Bos taurus; identical to SEQ ID NO: 2109

SEQ ID NO: 43642 - DNA, 201 bp, Bos taurus; identical to SEQ ID NO: 2110

SEQ ID NO: 43643 - DNA, 201 bp, Bos taurus; identical to SEQ ID NO: 2111

SEQ ID NO: 43644 - DNA, 201 bp, Bos taurus; identical to SEQ ID NO: 2112

SEQ ID NO: 43645 - DNA, 201 bp, Bos taurus; identical to SEQ ID NO: 2113

SEQ ID NO: 43646 - DNA, 201 bp, Bos taurus; identical to SEQ ID NO: 2114

SEQ ID NO: 43647 - DNA, 201 bp, Bos taurus; identical to SEQ ID NO: 2115

SEQ ID NO: 43648 - DNA, 201 bp, Bos taurus; identical to SEQ ID NO: 2116

SEQ ID NO: 43649 - DNA, 201 bp, Bos taurus; identical to SEQ ID NO: 2117

SEQ ID NO: 43650 - DNA, 201 bp, Bos taurus; identical to SEQ ID NO: 2118

SEQ ID NO: 43651 - DNA, 201 bp, Bos taurus; identical to SEQ ID NO: 2119

SEQ ID NO: 43652 - DNA, 201 bp, Bos taurus; identical to SEQ ID NO: 2120

SEQ ID NO: 43653 - DNA, 201 bp, Bos taurus; identical to SEQ ID NO: 2121

SEQ ID NO: 43654 - DNA, 201 bp, Bos taurus; identical to SEQ ID NO: 2122

SEQ ID NO: 43655 - DNA, 201 bp, Bos taurus; identical to SEQ ID NO: 2123

SEQ ID NO: 43656 - DNA, 201 bp, Bos taurus; identical to SEQ ID NO: 2124

SEQ ID NO: 43657 - DNA, 201 bp, Bos taurus; identical to SEQ ID NO: 2125

SEQ ID NO: 43658 - DNA, 201 bp, Bos taurus; identical to SEQ ID NO: 2126

SEQ ID NO: 43659 - DNA, 201 bp, Bos taurus; identical to SEQ ID NO: 2127

SEQ ID NO: 43660 - DNA, 201 bp, Bos taurus; identical to SEQ ID NO: 2128

SEQ ID NO: 43661 - DNA, 201 bp, Bos taurus; identical to SEQ ID NO: 2129

SEQ ID NO: 43662 - DNA, 201 bp, Bos taurus; identical to SEQ ID NO: 2130

SEQ ID NO: 43663 - DNA, 201 bp, Bos taurus; identical to SEQ ID NO: 2131

SEQ ID NO: 43664 - DNA, 201 bp, Bos taurus; identical to SEQ ID NO: 2132

SEQ ID NO: 43665 - DNA, 201 bp, Bos taurus; identical to SEQ ID NO: 2133

SEQ ID NO: 43666 - DNA, 201 bp, Bos taurus; identical to SEQ ID NO: 2134

SEQ ID NO: 43667 - DNA, 201 bp, Bos taurus; identical to SEQ ID NO: 2135

SEQ ID NO: 43668 - DNA, 201 bp, Bos taurus; identical to SEQ ID NO: 2136

SEQ ID NO: 43669 - DNA, 201 bp, Bos taurus; identical to SEQ ID NO: 2137

SEQ ID NO: 43670 - DNA, 201 bp, Bos taurus; identical to SEQ ID NO: 2138

SEQ ID NO: 43671 - DNA, 201 bp, Bos taurus; identical to SEQ ID NO: 2139

SEQ ID NO: 43672 - DNA, 201 bp, Bos taurus; identical to SEQ ID NO: 2140

SEQ ID NO: 43673 - DNA, 201 bp, Bos taurus; identical to SEQ ID NO: 2141

SEQ ID NO: 43674 - DNA, 201 bp, Bos taurus; identical to SEQ ID NO: 2142

SEQ ID NO: 43675 - DNA, 201 bp, Bos taurus; identical to SEQ ID NO: 2143

SEQ ID NO: 43676 - DNA, 201 bp, Bos taurus; identical to SEQ ID NO: 2144

SEQ ID NO: 43677 - DNA, 201 bp, Bos taurus; identical to SEQ ID NO: 2145

SEQ ID NO: 43678 - DNA, 201 bp, Bos taurus; identical to SEQ ID NO: 2146

SEQ ID NO: 43679 - DNA, 201 bp, Bos taurus; identical to SEQ ID NO: 2147

SEQ ID NO: 43680 - DNA, 201 bp, Bos taurus; identical to SEQ ID NO: 2148

SEQ ID NO: 43681 - DNA, 201 bp, Bos taurus; identical to SEQ ID NO: 2149

SEQ ID NO: 43682 - DNA, 201 bp, Bos taurus; identical to SEQ ID NO: 2151

SEQ ID NO: 43683 - DNA, 201 bp, Bos taurus; identical to SEQ ID NO: 2152

SEQ ID NO: 43684 - DNA, 201 bp, Bos taurus; identical to SEQ ID NO: 2154

SEQ ID NO: 43685 - DNA, 201 bp, Bos taurus; identical to SEQ ID NO: 2155

SEQ ID NO: 43686 - DNA, 201 bp, Bos taurus; identical to SEQ ID NO: 2156

SEQ ID NO: 43687 - DNA, 201 bp, Bos taurus; identical to SEQ ID NO: 2157

SEQ ID NO: 43688 - DNA, 201 bp, Bos taurus; identical to SEQ ID NO: 2158

SEQ ID NO: 43689 - DNA, 201 bp, Bos taurus; identical to SEQ ID NO: 2159

SEQ ID NO: 43690 - DNA, 201 bp, Bos taurus; identical to SEQ ID NO: 2160

SEQ ID NO: 43691 - DNA, 201 bp, Bos taurus; identical to SEQ ID NO: 2161

SEQ ID NO: 43692 - DNA, 201 bp, Bos taurus; identical to SEQ ID NO: 2162

SEQ ID NO: 43693 - DNA, 201 bp, Bos taurus; identical to SEQ ID NO: 2165

SEQ ID NO: 43694 - DNA, 201 bp, Bos taurus; identical to SEQ ID NO: 2166

SEQ ID NO: 43695 - DNA, 201 bp, Bos taurus; identical to SEQ ID NO: 2167

SEQ ID NO: 43696 - DNA, 201 bp, Bos taurus; identical to SEQ ID NO: 2168

SEQ ID NO: 43697 - DNA, 201 bp, Bos taurus; identical to SEQ ID NO: 2169

SEQ ID NO: 43698 - DNA, 201 bp, Bos taurus; identical to SEQ ID NO: 2170

SEQ ID NO: 43699 - DNA, 201 bp, Bos taurus; identical to SEQ ID NO: 2171

SEQ ID NO: 43700 - DNA, 201 bp, Bos taurus; identical to SEQ ID NO: 2172

SEQ ID NO: 43701 - DNA, 201 bp, Bos taurus; identical to SEQ ID NO: 2173

SEQ ID NO: 43702 - DNA, 201 bp, Bos taurus; identical to SEQ ID NO: 2174

SEQ ID NO: 43703 - DNA, 201 bp, Bos taurus; identical to SEQ ID NO: 2175

SEQ ID NO: 43704 - DNA, 201 bp, Bos taurus; identical to SEQ ID NO: 2176

SEQ ID NO: 43705 - DNA, 201 bp, Bos taurus; identical to SEQ ID NO: 2177

SEQ ID NO: 43706 - DNA, 201 bp, Bos taurus; identical to SEQ ID NO: 2178

SEQ ID NO: 43707 - DNA, 201 bp, Bos taurus; identical to SEQ ID NO: 2179

SEQ ID NO: 43708 - DNA, 201 bp, Bos taurus; identical to SEQ ID NO: 2180

SEQ ID NO: 43709 - DNA, 201 bp, Bos taurus; identical to SEQ ID NO: 2181

SEQ ID NO: 43710 - DNA, 201 bp, Bos taurus; identical to SEQ ID NO: 2182

SEQ ID NO: 43711 - DNA, 201 bp, Bos taurus
tttcattataacttctttcaaacaatgagttgccattgagctataaaaatgttctctgttcagtctttgcattgaagggatccattttcacagccttttctttgttgttgttttttcctctttttcttgccttgaaagttctataaaattatcttcaagtgaaatgaatataaagtaggaagttggtcatttagggtctgt

SEQ ID NO: 43712 - DNA, 201 bp, Bos taurus; identical to SEQ ID NO: 2183

SEQ ID NO: 43713 - DNA, 201 bp, Bos taurus
ctcgtgggctaggacttctcaaataggatagattcaggacctttacctcagaattatgtaaactgtgattgtgttttagaaaagttacttgctaaaaccagttaagtttttgtatatgtgtaaatgatcatgaaattgagttttataagatgttctgtatagtgaagttacacactcaaggtgtctcttggagtggattct

SEQ ID NO: 43714 - DNA, 201 bp, Bos taurus
gtaaaacactgcatgctttttgccttttttcccctgttgtttaacttcaaaaggccatcaggctatttttctgtgactgtttcatgaggactgttaacatatgaattaactgaatttgtaggtctttataaagaggaagctgtagacactgctcatttctgcccatgtcacaaatgatacctattttttagttttaagcca

SEQ ID NO: 43715 - DNA, 201 bp, Bos taurus
aggcctgacgtgctgcaattcatggagtcgcaaagagtaggacacgactgagcgactgaactgaactgagggcaggggatgcagctcagaatgaaggcctcgcattttaattgcagattcatctcttccaagatctctgatcttaagctggtttattttggcttctgtagaaaatggagataatgttaatacttacctgag

SEQ ID NO: 43716 - DNA, 201 bp, Bos taurus
aatgaagactacaaaacggtttattaaatatgtttcatttgcttcagttttcttttcaaaaagtaaaacccagttgtctgctttgtattgattaaggaaagtaaatttcctgtcaaatgttaaatatgtttatataaattaactcttcctataagataatattcagaaaagtttacaaggaaccaaacttctatattcaga

SEQ ID NO: 43717 - DNA, 201 bp, Bos taurus; identical to SEQ ID NO: 2185

SEQ ID NO: 43718 - DNA, 201 bp, Bos taurus; identical to SEQ ID NO: 2186

SEQ ID NO: 43719 - DNA, 201 bp, Bos taurus
tcctctcatatcccttttctcctccttccccttaaggaaattatcctaaaaatgtttggtaactgtttcctcctcacaactcagtcaccctggtttagtctttggagaagaggacatgttattgaacatatgattacaaaatcttaacacagaagctgaaagaattcaatctgattcacagtttccaaattaaatattgca

SEQ ID NO: 43720 - DNA, 201 bp, Bos taurus; identical to SEQ ID NO: 2187

SEQ ID NO: 43721 - DNA, 201 bp, Bos taurus; identical to SEQ ID NO: 2188

SEQ ID NO: 43722 - DNA, 201 bp, Bos taurus; identical to SEQ ID NO: 2189

SEQ ID NO: 43723 - DNA, 201 bp, Bos taurus; identical to SEQ ID NO: 2190

SEQ ID NO: 43724 - DNA, 201 bp, Bos taurus; identical to SEQ ID NO: 2191

SEQ ID NO: 43725 - DNA, 201 bp, Bos taurus; identical to SEQ ID NO: 2192

SEQ ID NO: 43726 - DNA, 201 bp, Bos taurus; identical to SEQ ID NO: 2193

SEQ ID NO: 43727 - DNA, 201 bp, Bos taurus; identical to SEQ ID NO: 2194

SEQ ID NO: 43728 - DNA, 201 bp, Bos taurus; identical to SEQ ID NO: 2195

SEQ ID NO: 43729 - DNA, 201 bp, Bos taurus; identical to SEQ ID NO: 2196

SEQ ID NO: 43730 - DNA, 201 bp, Bos taurus; identical to SEQ ID NO: 2197

SEQ ID NO: 43731 - DNA, 201 bp, Bos taurus; identical to SEQ ID NO: 2198

SEQ ID NO: 43732 - DNA, 201 bp, Bos taurus; identical to SEQ ID NO: 2199

SEQ ID NO: 43733 - DNA, 201 bp, Bos taurus; identical to SEQ ID NO: 2200

SEQ ID NO: 43734 - DNA, 201 bp, Bos taurus; identical to SEQ ID NO: 2201

SEQ ID NO: 43735 - DNA, 201 bp, Bos taurus; identical to SEQ ID NO: 2202

SEQ ID NO: 43736 - DNA, 201 bp, Bos taurus; identical to SEQ ID NO: 2203

SEQ ID NO: 43737 - DNA, 201 bp, Bos taurus; identical to SEQ ID NO: 2204

SEQ ID NO: 43738 - DNA, 201 bp, Bos taurus; identical to SEQ ID NO: 2205

SEQ ID NO: 43739 - DNA, 201 bp, Bos taurus; identical to SEQ ID NO: 2206

SEQ ID NO: 43740 - DNA, 201 bp, Bos taurus; identical to SEQ ID NO: 2207

SEQ ID NO: 43741 - DNA, 201 bp, Bos taurus; identical to SEQ ID NO: 2208

SEQ ID NO: 43742 - DNA, 201 bp, Bos taurus; identical to SEQ ID NO: 2209

SEQ ID NO: 43743 - DNA, 201 bp, Bos taurus; identical to SEQ ID NO: 2210

SEQ ID NO: 43744 - DNA, 201 bp, Bos taurus; identical to SEQ ID NO: 2211

SEQ ID NO: 43745 - DNA, 201 bp, Bos taurus; identical to SEQ ID NO: 2212

SEQ ID NO: 43746 - DNA, 201 bp, Bos taurus; identical to SEQ ID NO: 2213

SEQ ID NO: 43747 - DNA, 201 bp, Bos taurus; identical to SEQ ID NO: 2214

SEQ ID NO: 43748 - DNA, 201 bp, Bos taurus; identical to SEQ ID NO: 2215

SEQ ID NO: 43749 - DNA, 201 bp, Bos taurus; identical to SEQ ID NO: 2216

SEQ ID NO: 43750 - DNA, 201 bp, Bos taurus; identical to SEQ ID NO: 2217

SEQ ID NO: 43751 - DNA, 201 bp, Bos taurus; identical to SEQ ID NO: 2218

SEQ ID NO: 43752 - DNA, 201 bp, Bos taurus; identical to SEQ ID NO: 2220

SEQ ID NO: 43753 - DNA, 201 bp, Bos taurus; identical to SEQ ID NO: 2221

SEQ ID NO: 43754 - DNA, 201 bp, Bos taurus; identical to SEQ ID NO: 2222

SEQ ID NO: 43755 - DNA, 201 bp, Bos taurus; identical to SEQ ID NO: 2223

SEQ ID NO: 43756 - DNA, 201 bp, Bos taurus; identical to SEQ ID NO: 2224

SEQ ID NO: 43757 - DNA, 201 bp, Bos taurus; identical to SEQ ID NO: 2225

SEQ ID NO: 43758 - DNA, 201 bp, Bos taurus; identical to SEQ ID NO: 2226

SEQ ID NO: 43759 - DNA, 201 bp, Bos taurus; identical to SEQ ID NO: 2227

SEQ ID NO: 43760 - DNA, 201 bp, Bos taurus; identical to SEQ ID NO: 2228

SEQ ID NO: 43761 - DNA, 201 bp, Bos taurus; identical to SEQ ID NO: 2229

SEQ ID NO: 43762 - DNA, 201 bp, Bos taurus; identical to SEQ ID NO: 2230

SEQ ID NO: 43763 - DNA, 201 bp, Bos taurus; identical to SEQ ID NO: 2231

SEQ ID NO: 43764 - DNA, 201 bp, Bos taurus; identical to SEQ ID NO: 2232

SEQ ID NO: 43765 - DNA, 201 bp, Bos taurus; identical to SEQ ID NO: 2233

SEQ ID NO: 43766 - DNA, 201 bp, Bos taurus; identical to SEQ ID NO: 2235

SEQ ID NO: 43767 - DNA, 201 bp, Bos taurus; identical to SEQ ID NO: 2236

SEQ ID NO: 43768 - DNA, 201 bp, Bos taurus; identical to SEQ ID NO: 2237

SEQ ID NO: 43769 - DNA, 201 bp, Bos taurus; identical to SEQ ID NO: 2238

SEQ ID NO: 43770 - DNA, 201 bp, Bos taurus; identical to SEQ ID NO: 2239

SEQ ID NO: 43771 - DNA, 201 bp, Bos taurus; identical to SEQ ID NO: 2240

SEQ ID NO: 43772 - DNA, 201 bp, Bos taurus; identical to SEQ ID NO: 2241

SEQ ID NO: 43773 - DNA, 201 bp, Bos taurus; identical to SEQ ID NO: 2242

SEQ ID NO: 43774 - DNA, 201 bp, Bos taurus; identical to SEQ ID NO: 2243

SEQ ID NO: 43775 - DNA, 201 bp, Bos taurus; identical to SEQ ID NO: 2244

SEQ ID NO: 43776 - DNA, 201 bp, Bos taurus; identical to SEQ ID NO: 2245

SEQ ID NO: 43777 - DNA, 201 bp, Bos taurus; identical to SEQ ID NO: 2246

SEQ ID NO: 43778 - DNA, 201 bp, Bos taurus; identical to SEQ ID NO: 2247

SEQ ID NO: 43779 - DNA, 201 bp, Bos taurus; identical to SEQ ID NO: 2248

SEQ ID NO: 43780 - DNA, 201 bp, Bos taurus; identical to SEQ ID NO: 2249

SEQ ID NO: 43781 - DNA, 201 bp, Bos taurus; identical to SEQ ID NO: 2250

SEQ ID NO: 43782 - DNA, 201 bp, Bos taurus; identical to SEQ ID NO: 2251

SEQ ID NO: 43783 - DNA, 201 bp, Bos taurus; identical to SEQ ID NO: 2252

SEQ ID NO: 43784 - DNA, 201 bp, Bos taurus; identical to SEQ ID NO: 2253

SEQ ID NO: 43785 - DNA, 201 bp, Bos taurus
ggacctaccaagggagggcctgttggaacaggtttgggggagtataaaggttttgtaactcttttttgtggcgttcaattttgtctctaggttctttgacgctgtgctggactatgtccgtttcattaacaaaatagcagcagtcctctcctaggaaaaggcaggtccctcccttttctgcagtgagaaggttctgcattt

SEQ ID NO: 43786 - DNA, 201 bp, Bos taurus; identical to SEQ ID NO: 2254

SEQ ID NO: 43787 - DNA, 201 bp, Bos taurus; identical to SEQ ID NO: 2255

SEQ ID NO: 43788 - DNA, 201 bp, Bos taurus; identical to SEQ ID NO: 2256

SEQ ID NO: 43789 - DNA, 201 bp, Bos taurus; identical to SEQ ID NO: 2257

SEQ ID NO: 43790 - DNA, 201 bp, Bos taurus; identical to SEQ ID NO: 2258

SEQ ID NO: 43791 - DNA, 201 bp, Bos taurus; identical to SEQ ID NO: 2259

SEQ ID NO: 43792 - DNA, 201 bp, Bos taurus; identical to SEQ ID NO: 2260

SEQ ID NO: 43793 - DNA, 201 bp, Bos taurus; identical to SEQ ID NO: 2261

SEQ ID NO: 43794 - DNA, 201 bp, Bos taurus; identical to SEQ ID NO: 2262

SEQ ID NO: 43795 - DNA, 201 bp, Bos taurus; identical to SEQ ID NO: 2263

SEQ ID NO: 43796 - DNA, 201 bp, Bos taurus; identical to SEQ ID NO: 2264

SEQ ID NO: 43797 - DNA, 201 bp, Bos taurus; identical to SEQ ID NO: 2265

SEQ ID NO: 43798 - DNA, 201 bp, Bos taurus; identical to SEQ ID NO: 2266

SEQ ID NO: 43799 - DNA, 201 bp, Bos taurus; identical to SEQ ID NO: 2267

SEQ ID NO: 43800 - DNA, 201 bp, Bos taurus; identical to SEQ ID NO: 2269

SEQ ID NO: 43801 - DNA, 201 bp, Bos taurus; identical to SEQ ID NO: 2270

SEQ ID NO: 43802 - DNA, 201 bp, Bos taurus; identical to SEQ ID NO: 2271

SEQ ID NO: 43803 - DNA, 201 bp, Bos taurus; identical to SEQ ID NO: 2272

SEQ ID NO: 43804 - DNA, 201 bp, Bos taurus; identical to SEQ ID NO: 2274

SEQ ID NO: 43805 - DNA, 201 bp, Bos taurus; identical to SEQ ID NO: 2276

SEQ ID NO: 43806 - DNA, 201 bp, Bos taurus; identical to SEQ ID NO: 2277

SEQ ID NO: 43807 - DNA, 201 bp, Bos taurus; identical to SEQ ID NO: 2279

SEQ ID NO: 43808 - DNA, 201 bp, Bos taurus; identical to SEQ ID NO: 2280

SEQ ID NO: 43809 - DNA, 201 bp, Bos taurus; identical to SEQ ID NO: 2281

SEQ ID NO: 43810 - DNA, 201 bp, Bos taurus; identical to SEQ ID NO: 2282

SEQ ID NO: 43811 - DNA, 201 bp, Bos taurus; identical to SEQ ID NO: 2284

SEQ ID NO: 43812 - DNA, 201 bp, Bos taurus; identical to SEQ ID NO: 2286

SEQ ID NO: 43813 - DNA, 201 bp, Bos taurus; identical to SEQ ID NO: 2287

SEQ ID NO: 43814 - DNA, 201 bp, Bos taurus; identical to SEQ ID NO: 2288

SEQ ID NO: 43815 - DNA, 201 bp, Bos taurus; identical to SEQ ID NO: 2289

SEQ ID NO: 43816 - DNA, 201 bp, Bos taurus; identical to SEQ ID NO: 2290

SEQ ID NO: 43817 - DNA, 201 bp, Bos taurus; identical to SEQ ID NO: 2291

SEQ ID NO: 43818 - DNA, 201 bp, Bos taurus; identical to SEQ ID NO: 2292

SEQ ID NO: 43819 - DNA, 201 bp, Bos taurus; identical to SEQ ID NO: 2293

SEQ ID NO: 43820 - DNA, 201 bp, Bos taurus; identical to SEQ ID NO: 2294

SEQ ID NO: 43821 - DNA, 201 bp, Bos taurus; identical to SEQ ID NO: 2295

SEQ ID NO: 43822 - DNA, 201 bp, Bos taurus; identical to SEQ ID NO: 2296

SEQ ID NO: 43823 - DNA, 201 bp, Bos taurus; identical to SEQ ID NO: 2297

SEQ ID NO: 43824 - DNA, 201 bp, Bos taurus; identical to SEQ ID NO: 2298

SEQ ID NO: 43825 - DNA, 201 bp, Bos taurus; identical to SEQ ID NO: 2299

SEQ ID NO: 43826 - DNA, 201 bp, Bos taurus; identical to SEQ ID NO: 2300

SEQ ID NO: 43827 - DNA, 201 bp, Bos taurus; identical to SEQ ID NO: 2301

SEQ ID NO: 43828 - DNA, 201 bp, Bos taurus; identical to SEQ ID NO: 2302

SEQ ID NO: 43829 - DNA, 201 bp, Bos taurus; identical to SEQ ID NO: 2303

SEQ ID NO: 43830 - DNA, 201 bp, Bos taurus; identical to SEQ ID NO: 2304

SEQ ID NO: 43831 - DNA, 201 bp, Bos taurus; identical to SEQ ID NO: 2305

SEQ ID NO: 43832 - DNA, 201 bp, Bos taurus; identical to SEQ ID NO: 2306

SEQ ID NO: 43833 - DNA, 201 bp, Bos taurus; identical to SEQ ID NO: 2307

SEQ ID NO: 43834 - DNA, 201 bp, Bos taurus; identical to SEQ ID NO: 2308

SEQ ID NO: 43835 - DNA, 201 bp, Bos taurus; identical to SEQ ID NO: 2309

SEQ ID NO: 43836 - DNA, 201 bp, Bos taurus; identical to SEQ ID NO: 2310

SEQ ID NO: 43837 - DNA, 201 bp, Bos taurus; identical to SEQ ID NO: 2311

SEQ ID NO: 43838 - DNA, 201 bp, Bos taurus; identical to SEQ ID NO: 2312

SEQ ID NO: 43839 - DNA, 201 bp, Bos taurus; identical to SEQ ID NO: 2313

SEQ ID NO: 43840 - DNA, 201 bp, Bos taurus; identical to SEQ ID NO: 2314

SEQ ID NO: 43841 - DNA, 201 bp, Bos taurus; identical to SEQ ID NO: 2315

SEQ ID NO: 43842 - DNA, 201 bp, Bos taurus; identical to SEQ ID NO: 2316

SEQ ID NO: 43843 - DNA, 201 bp, Bos taurus; identical to SEQ ID NO: 2317

SEQ ID NO: 43844 - DNA, 201 bp, Bos taurus; identical to SEQ ID NO: 2318

SEQ ID NO: 43845 - DNA, 201 bp, Bos taurus; identical to SEQ ID NO: 2319

SEQ ID NO: 43846 - DNA, 201 bp, Bos taurus; identical to SEQ ID NO: 2320

SEQ ID NO: 43847 - DNA, 201 bp, Bos taurus; identical to SEQ ID NO: 2322

SEQ ID NO: 43848 - DNA, 201 bp, Bos taurus; identical to SEQ ID NO: 2323

SEQ ID NO: 43849 - DNA, 201 bp, Bos taurus; identical to SEQ ID NO: 2324

SEQ ID NO: 43850 - DNA, 201 bp, Bos taurus; identical to SEQ ID NO: 2325

SEQ ID NO: 43851 - DNA, 201 bp, Bos taurus; identical to SEQ ID NO: 2327

SEQ ID NO: 43852 - DNA, 201 bp, Bos taurus; identical to SEQ ID NO: 2328

SEQ ID NO: 43853 - DNA, 201 bp, Bos taurus; identical to SEQ ID NO: 2330

SEQ ID NO: 43854 - DNA, 201 bp, Bos taurus; identical to SEQ ID NO: 2331

SEQ ID NO: 43855 - DNA, 201 bp, Bos taurus; identical to SEQ ID NO: 2332

SEQ ID NO: 43856 - DNA, 201 bp, Bos taurus; identical to SEQ ID NO: 2333

SEQ ID NO: 43857 - DNA, 201 bp, Bos taurus; identical to SEQ ID NO: 2334

SEQ ID NO: 43858 - DNA, 201 bp, Bos taurus; identical to SEQ ID NO: 2335

SEQ ID NO: 43859 - DNA, 201 bp, Bos taurus; identical to SEQ ID NO: 2336

SEQ ID NO: 43860 - DNA, 201 bp, Bos taurus; identical to SEQ ID NO: 2337

SEQ ID NO: 43861 - DNA, 201 bp, Bos taurus; identical to SEQ ID NO: 2338

SEQ ID NO: 43862 - DNA, 201 bp, Bos taurus; identical to SEQ ID NO: 2340

SEQ ID NO: 43863 - DNA, 201 bp, Bos taurus; identical to SEQ ID NO: 2341

SEQ ID NO: 43864 - DNA, 201 bp, Bos taurus; identical to SEQ ID NO: 2342

SEQ ID NO: 43865 - DNA, 201 bp, Bos taurus; identical to SEQ ID NO: 2343

SEQ ID NO: 43866 - DNA, 201 bp, Bos taurus; identical to SEQ ID NO: 2344

SEQ ID NO: 43867 - DNA, 201 bp, Bos taurus; identical to SEQ ID NO: 2345

SEQ ID NO: 43868 - DNA, 201 bp, Bos taurus; identical to SEQ ID NO: 2347

SEQ ID NO: 43869 - DNA, 201 bp, Bos taurus; identical to SEQ ID NO: 2348

SEQ ID NO: 43870 - DNA, 201 bp, Bos taurus; identical to SEQ ID NO: 2349

SEQ ID NO: 43871 - DNA, 201 bp, Bos taurus; identical to SEQ ID NO: 2350

SEQ ID NO: 43872 - DNA, 201 bp, Bos taurus; identical to SEQ ID NO: 2351

SEQ ID NO: 43873 - DNA, 201 bp, Bos taurus; identical to SEQ ID NO: 2352

SEQ ID NO: 43874 - DNA, 201 bp, Bos taurus; identical to SEQ ID NO: 2354

SEQ ID NO: 43875 - DNA, 201 bp, Bos taurus; identical to SEQ ID NO: 2355

SEQ ID NO: 43876 - DNA, 201 bp, Bos taurus; identical to SEQ ID NO: 2356

SEQ ID NO: 43877 - DNA, 201 bp, Bos taurus; identical to SEQ ID NO: 2357

SEQ ID NO: 43878 - DNA, 201 bp, Bos taurus; identical to SEQ ID NO: 2358

SEQ ID NO: 43879 - DNA, 201 bp, Bos taurus; identical to SEQ ID NO: 2359

SEQ ID NO: 43880 - DNA, 201 bp, Bos taurus; identical to SEQ ID NO: 2360

SEQ ID NO: 43881 - DNA, 201 bp, Bos taurus; identical to SEQ ID NO: 2361

SEQ ID NO: 43882 - DNA, 201 bp, Bos taurus; identical to SEQ ID NO: 2362

SEQ ID NO: 43883 - DNA, 201 bp, Bos taurus; identical to SEQ ID NO: 2363

SEQ ID NO: 43884 - DNA, 201 bp, Bos taurus; identical to SEQ ID NO: 2364

SEQ ID NO: 43885 - DNA, 201 bp, Bos taurus; identical to SEQ ID NO: 2365

SEQ ID NO: 43886 - DNA, 201 bp, Bos taurus; identical to SEQ ID NO: 2367

SEQ ID NO: 43887 - DNA, 201 bp, Bos taurus; identical to SEQ ID NO: 2368

SEQ ID NO: 43888 - DNA, 201 bp, Bos taurus; identical to SEQ ID NO: 2369

SEQ ID NO: 43889 - DNA, 201 bp, Bos taurus; identical to SEQ ID NO: 2370

SEQ ID NO: 43890 - DNA, 201 bp, Bos taurus; identical to SEQ ID NO: 2371

SEQ ID NO: 43891 - DNA, 201 bp, Bos taurus; identical to SEQ ID NO: 2372

SEQ ID NO: 43892 - DNA, 201 bp, Bos taurus; identical to SEQ ID NO: 2373

SEQ ID NO: 43893 - DNA, 201 bp, Bos taurus; identical to SEQ ID NO: 2374

SEQ ID NO: 43894 - DNA, 201 bp, Bos taurus; identical to SEQ ID NO: 2375

SEQ ID NO: 43895 - DNA, 201 bp, Bos taurus; identical to SEQ ID NO: 2376

SEQ ID NO: 43896 - DNA, 201 bp, Bos taurus; identical to SEQ ID NO: 2377

SEQ ID NO: 43897 - DNA, 201 bp, Bos taurus; identical to SEQ ID NO: 2378

SEQ ID NO: 43898 - DNA, 201 bp, Bos taurus; identical to SEQ ID NO: 2379

SEQ ID NO: 43899 - DNA, 201 bp, Bos taurus; identical to SEQ ID NO: 2380

SEQ ID NO: 43900 - DNA, 201 bp, Bos taurus; identical to SEQ ID NO: 2381

SEQ ID NO: 43901 - DNA, 201 bp, Bos taurus; identical to SEQ ID NO: 2382

SEQ ID NO: 43902 - DNA, 201 bp, Bos taurus; identical to SEQ ID NO: 2383

SEQ ID NO: 43903 - DNA, 201 bp, Bos taurus; identical to SEQ ID NO: 2384

SEQ ID NO: 43904 - DNA, 201 bp, Bos taurus; identical to SEQ ID NO: 2385

SEQ ID NO: 43905 - DNA, 201 bp, Bos taurus; identical to SEQ ID NO: 2386

SEQ ID NO: 43906 - DNA, 201 bp, Bos taurus; identical to SEQ ID NO: 2388

SEQ ID NO: 43907 - DNA, 201 bp, Bos taurus; identical to SEQ ID NO: 2389

SEQ ID NO: 43908 - DNA, 201 bp, Bos taurus; identical to SEQ ID NO: 2390

SEQ ID NO: 43909 - DNA, 201 bp, Bos taurus; identical to SEQ ID NO: 2391

SEQ ID NO: 43910 - DNA, 201 bp, Bos taurus; identical to SEQ ID NO: 2392

SEQ ID NO: 43911 - DNA, 201 bp, Bos taurus; identical to SEQ ID NO: 2394

SEQ ID NO: 43912 - DNA, 201 bp, Bos taurus; identical to SEQ ID NO: 2395

SEQ ID NO: 43913 - DNA, 201 bp, Bos taurus; identical to SEQ ID NO: 2396

SEQ ID NO: 43914 - DNA, 201 bp, Bos taurus; identical to SEQ ID NO: 2397

SEQ ID NO: 43915 - DNA, 201 bp, Bos taurus; identical to SEQ ID NO: 2398

SEQ ID NO: 43916 - DNA, 201 bp, Bos taurus; identical to SEQ ID NO: 2399

SEQ ID NO: 43917 - DNA, 201 bp, Bos taurus; identical to SEQ ID NO: 2400

SEQ ID NO: 43918 - DNA, 201 bp, Bos taurus; identical to SEQ ID NO: 2401

SEQ ID NO: 43919 - DNA, 201 bp, Bos taurus; identical to SEQ ID NO: 2402

SEQ ID NO: 43920 - DNA, 201 bp, Bos taurus; identical to SEQ ID NO: 2403

SEQ ID NO: 43921 - DNA, 201 bp, Bos taurus; identical to SEQ ID NO: 2404

SEQ ID NO: 43922 - DNA, 201 bp, Bos taurus; identical to SEQ ID NO: 2405

SEQ ID NO: 43923 - DNA, 201 bp, Bos taurus; identical to SEQ ID NO: 2406

SEQ ID NO: 43924 - DNA, 201 bp, Bos taurus; identical to SEQ ID NO: 2407

SEQ ID NO: 43925 - DNA, 201 bp, Bos taurus; identical to SEQ ID NO: 2409

SEQ ID NO: 43926 - DNA, 201 bp, Bos taurus; identical to SEQ ID NO: 2410

SEQ ID NO: 43927 - DNA, 201 bp, Bos taurus; identical to SEQ ID NO: 2411

SEQ ID NO: 43928 - DNA, 201 bp, Bos taurus; identical to SEQ ID NO: 2412

SEQ ID NO: 43929 - DNA, 201 bp, Bos taurus; identical to SEQ ID NO: 2413

SEQ ID NO: 43930 - DNA, 201 bp, Bos taurus; identical to SEQ ID NO: 2414

SEQ ID NO: 43931 - DNA, 201 bp, Bos taurus; identical to SEQ ID NO: 2415

SEQ ID NO: 43932 - DNA, 201 bp, Bos taurus; identical to SEQ ID NO: 2416

SEQ ID NO: 43933 - DNA, 201 bp, Bos taurus; identical to SEQ ID NO: 2417

SEQ ID NO: 43934 - DNA, 201 bp, Bos taurus; identical to SEQ ID NO: 2418

SEQ ID NO: 43935 - DNA, 201 bp, Bos taurus; identical to SEQ ID NO: 2419

SEQ ID NO: 43936 - DNA, 201 bp, Bos taurus; identical to SEQ ID NO: 2420

SEQ ID NO: 43937 - DNA, 201 bp, Bos taurus; identical to SEQ ID NO: 2421

SEQ ID NO: 43938 - DNA, 201 bp, Bos taurus; identical to SEQ ID NO: 2422

SEQ ID NO: 43939 - DNA, 201 bp, Bos taurus; identical to SEQ ID NO: 2423

SEQ ID NO: 43940 - DNA, 201 bp, Bos taurus; identical to SEQ ID NO: 2424

SEQ ID NO: 43941 - DNA, 201 bp, Bos taurus; identical to SEQ ID NO: 2425

SEQ ID NO: 43942 - DNA, 201 bp, Bos taurus; identical to SEQ ID NO: 2426

SEQ ID NO: 43943 - DNA, 201 bp, Bos taurus; identical to SEQ ID NO: 2427

SEQ ID NO: 43944 - DNA, 201 bp, Bos taurus; identical to SEQ ID NO: 2428

SEQ ID NO: 43945 - DNA, 201 bp, Bos taurus; identical to SEQ ID NO: 2429

SEQ ID NO: 43946 - DNA, 201 bp, Bos taurus; identical to SEQ ID NO: 2430

SEQ ID NO: 43947 - DNA, 201 bp, Bos taurus; identical to SEQ ID NO: 2431

SEQ ID NO: 43948 - DNA, 201 bp, Bos taurus; identical to SEQ ID NO: 2432

SEQ ID NO: 43949 - DNA, 201 bp, Bos taurus; identical to SEQ ID NO: 2433

SEQ ID NO: 43950 - DNA, 201 bp, Bos taurus; identical to SEQ ID NO: 2434

SEQ ID NO: 43951 - DNA, 201 bp, Bos taurus; identical to SEQ ID NO: 2435

SEQ ID NO: 43952 - DNA, 201 bp, Bos taurus; identical to SEQ ID NO: 2436

SEQ ID NO: 43953 - DNA, 201 bp, Bos taurus; identical to SEQ ID NO: 2437

SEQ ID NO: 43954 - DNA, 201 bp, Bos taurus; identical to SEQ ID NO: 2438

SEQ ID NO: 43955 - DNA, 201 bp, Bos taurus; identical to SEQ ID NO: 2439

SEQ ID NO: 43956 - DNA, 201 bp, Bos taurus; identical to SEQ ID NO: 2440

SEQ ID NO: 43957 - DNA, 201 bp, Bos taurus; identical to SEQ ID NO: 2441

SEQ ID NO: 43958 - DNA, 201 bp, Bos taurus; identical to SEQ ID NO: 2442

SEQ ID NO: 43959 - DNA, 201 bp, Bos taurus; identical to SEQ ID NO: 2443

SEQ ID NO: 43960 - DNA, 201 bp, Bos taurus; identical to SEQ ID NO: 2444

SEQ ID NO: 43961 - DNA, 201 bp, Bos taurus; identical to SEQ ID NO: 2445

SEQ ID NO: 43962 - DNA, 201 bp, Bos taurus; identical to SEQ ID NO: 2446

SEQ ID NO: 43963 - DNA, 201 bp, Bos taurus; identical to SEQ ID NO: 2447

SEQ ID NO: 43964 - DNA, 201 bp, Bos taurus; identical to SEQ ID NO: 2448

SEQ ID NO: 43965 - DNA, 201 bp, Bos taurus; identical to SEQ ID NO: 2449

SEQ ID NO: 43966 - DNA, 201 bp, Bos taurus; identical to SEQ ID NO: 2450

SEQ ID NO: 43967 - DNA, 201 bp, Bos taurus; identical to SEQ ID NO: 2451

SEQ ID NO: 43968 - DNA, 201 bp, Bos taurus; identical to SEQ ID NO: 2452

SEQ ID NO: 43969 - DNA, 201 bp, Bos taurus; identical to SEQ ID NO: 2453

SEQ ID NO: 43970 - DNA, 201 bp, Bos taurus; identical to SEQ ID NO: 2454

SEQ ID NO: 43971 - DNA, 201 bp, Bos taurus; identical to SEQ ID NO: 2455

SEQ ID NO: 43972 - DNA, 201 bp, Bos taurus; identical to SEQ ID NO: 2456

SEQ ID NO: 43973 - DNA, 201 bp, Bos taurus; identical to SEQ ID NO: 2457

SEQ ID NO: 43974 - DNA, 201 bp, Bos taurus; identical to SEQ ID NO: 2458

SEQ ID NO: 43975 - DNA, 201 bp, Bos taurus; identical to SEQ ID NO: 2459

SEQ ID NO: 43976 - DNA, 201 bp, Bos taurus; identical to SEQ ID NO: 2460

SEQ ID NO: 43977 - DNA, 201 bp, Bos taurus; identical to SEQ ID NO: 2461

SEQ ID NO: 43978 - DNA, 201 bp, Bos taurus; identical to SEQ ID NO: 2462

SEQ ID NO: 43979 - DNA, 201 bp, Bos taurus; identical to SEQ ID NO: 2463

SEQ ID NO: 43980 - DNA, 201 bp, Bos taurus; identical to SEQ ID NO: 2464

SEQ ID NO: 43981 - DNA, 201 bp, Bos taurus; identical to SEQ ID NO: 2465

SEQ ID NO: 43982 - DNA, 201 bp, Bos taurus; identical to SEQ ID NO: 2466

SEQ ID NO: 43983 - DNA, 201 bp, Bos taurus; identical to SEQ ID NO: 2467

SEQ ID NO: 43984 - DNA, 201 bp, Bos taurus; identical to SEQ ID NO: 2468

SEQ ID NO: 43985 - DNA, 201 bp, Bos taurus; identical to SEQ ID NO: 2469

SEQ ID NO: 43986 - DNA, 201 bp, Bos taurus; identical to SEQ ID NO: 2470

SEQ ID NO: 43987 - DNA, 201 bp, Bos taurus; identical to SEQ ID NO: 2471

SEQ ID NO: 43988 - DNA, 201 bp, Bos taurus; identical to SEQ ID NO: 2472

SEQ ID NO: 43989 - DNA, 201 bp, Bos taurus; identical to SEQ ID NO: 2473

SEQ ID NO: 43990 - DNA, 201 bp, Bos taurus; identical to SEQ ID NO: 2474

SEQ ID NO: 43991 - DNA, 201 bp, Bos taurus; identical to SEQ ID NO: 2475

SEQ ID NO: 43992 - DNA, 201 bp, Bos taurus; identical to SEQ ID NO: 2476

SEQ ID NO: 43993 - DNA, 201 bp, Bos taurus; identical to SEQ ID NO: 2477

SEQ ID NO: 43994 - DNA, 201 bp, Bos taurus; identical to SEQ ID NO: 2478

SEQ ID NO: 43995 - DNA, 201 bp, Bos taurus; identical to SEQ ID NO: 2479

SEQ ID NO: 43996 - DNA, 201 bp, Bos taurus; identical to SEQ ID NO: 2480

SEQ ID NO: 43997 - DNA, 201 bp, Bos taurus; identical to SEQ ID NO: 2481

SEQ ID NO: 43998 - DNA, 201 bp, Bos taurus; identical to SEQ ID NO: 2482

SEQ ID NO: 43999 - DNA, 201 bp, Bos taurus; identical to SEQ ID NO: 2483

SEQ ID NO: 44000 - DNA, 201 bp, Bos taurus; identical to SEQ ID NO: 2484

SEQ ID NO: 44001 - DNA, 201 bp, Bos taurus; identical to SEQ ID NO: 2485

SEQ ID NO: 44002 - DNA, 201 bp, Bos taurus; identical to SEQ ID NO: 2486

SEQ ID NO: 44003 - DNA, 201 bp, Bos taurus; identical to SEQ ID NO: 2487

SEQ ID NO: 44004 - DNA, 201 bp, Bos taurus; identical to SEQ ID NO: 2488

SEQ ID NO: 44005 - DNA, 201 bp, Bos taurus; identical to SEQ ID NO: 2489

SEQ ID NO: 44006 - DNA, 201 bp, Bos taurus; identical to SEQ ID NO: 2490

SEQ ID NO: 44007 - DNA, 201 bp, Bos taurus; identical to SEQ ID NO: 2491

SEQ ID NO: 44008 - DNA, 201 bp, Bos taurus; identical to SEQ ID NO: 2492

SEQ ID NO: 44009 - DNA, 201 bp, Bos taurus; identical to SEQ ID NO: 2493

SEQ ID NO: 44010 - DNA, 201 bp, Bos taurus; identical to SEQ ID NO: 2494

SEQ ID NO: 44011 - DNA, 201 bp, Bos taurus; identical to SEQ ID NO: 2495

SEQ ID NO: 44012 - DNA, 201 bp, Bos taurus; identical to SEQ ID NO: 2497

SEQ ID NO: 44013 - DNA, 201 bp, Bos taurus; identical to SEQ ID NO: 2498

SEQ ID NO: 44014 - DNA, 201 bp, Bos taurus; identical to SEQ ID NO: 2499

SEQ ID NO: 44015 - DNA, 201 bp, Bos taurus
ctttatccctgttggttttggaccaaggcttggccccaatcatgttgcttcttggtgacacagtaaccaaaactctaatatagaaccaattttctagccaggaaaagtgaaaagatggcccctgcatggcaaggaatgtgggtaaaactctgagagagatagcaagctgaaaaagatcttttaaatatgtatataaatcta

SEQ ID NO: 44016 - DNA, 201 bp, Bos taurus; identical to SEQ ID NO: 2500

SEQ ID NO: 44017 - DNA, 201 bp, Bos taurus; identical to SEQ ID NO: 2501

SEQ ID NO: 44018 - DNA, 201 bp, Bos taurus; identical to SEQ ID NO: 2502

SEQ ID NO: 44019 - DNA, 201 bp, Bos taurus; identical to SEQ ID NO: 2503

SEQ ID NO: 44020 - DNA, 201 bp, Bos taurus; identical to SEQ ID NO: 2505

SEQ ID NO: 44021 - DNA, 201 bp, Bos taurus
atatcccaaatcacacccaacctttattctctgctgatggcctagcctcatgcttcgttcaaaaaccaatagccattttattggtttctcaagaaagaaagaaagtaaaagcaatcataggccatcaccataggccatctgatggcctgtatgctagcacagtcaatggttacataattattactatcttactcaacttca

SEQ ID NO: 44022 - DNA, 201 bp, Bos taurus; identical to SEQ ID NO: 2506

SEQ ID NO: 44023 - DNA, 201 bp, Bos taurus; identical to SEQ ID NO: 2507

SEQ ID NO: 44024 - DNA, 201 bp, Bos taurus; identical to SEQ ID NO: 2508

SEQ ID NO: 44025 - DNA, 201 bp, Bos taurus; identical to SEQ ID NO: 2509

SEQ ID NO: 44026 - DNA, 201 bp, Bos taurus; identical to SEQ ID NO: 2510

SEQ ID NO: 44027 - DNA, 201 bp, Bos taurus; identical to SEQ ID NO: 2511

SEQ ID NO: 44028 - DNA, 201 bp, Bos taurus; identical to SEQ ID NO: 2512

SEQ ID NO: 44029 - DNA, 201 bp, Bos taurus; identical to SEQ ID NO: 2513

SEQ ID NO: 44030 - DNA, 201 bp, Bos taurus; identical to SEQ ID NO: 2514

SEQ ID NO: 44031 - DNA, 201 bp, Bos taurus; identical to SEQ ID NO: 2515

SEQ ID NO: 44032 - DNA, 201 bp, Bos taurus; identical to SEQ ID NO: 2516

SEQ ID NO: 44033 - DNA, 201 bp, Bos taurus; identical to SEQ ID NO: 2517

SEQ ID NO: 44034 - DNA, 201 bp, Bos taurus
taagcaataaaatgtttaaatcagtctgtttctcctttaagatccatgaaggtcaacccatggggactgcaccttgtgtttctaaaacaactctgcttcaattaatcaggcctagaagaatgttcctgacttactacaagctgtctgtgcttcttaacttttgccagtttctgctggaatctgcctctgaaccatgacaca

SEQ ID NO: 44035 - DNA, 201 bp, Bos taurus; identical to SEQ ID NO: 2518

SEQ ID NO: 44036 - DNA, 201 bp, Bos taurus; identical to SEQ ID NO: 2519

SEQ ID NO: 44037 - DNA, 201 bp, Bos taurus; identical to SEQ ID NO: 2520

SEQ ID NO: 44038 - DNA, 201 bp, Bos taurus; identical to SEQ ID NO: 2521

SEQ ID NO: 44039 - DNA, 201 bp, Bos taurus; identical to SEQ ID NO: 2522

SEQ ID NO: 44040 - DNA, 201 bp, Bos taurus
ttgttcatgggattattcagtgctatgcttttacagcatatagagaaaggggctgtcatctcctttaatatctttaaaatccagaagcttcttagtccatcctcaaatgaagcaaggagggatatcagtcctttgatgaggagctatgtgaatgcaacattaaaaatttattttcggagtcttggactgccttatgaagtc

SEQ ID NO: 44041 - DNA, 201 bp, Bos taurus
tagctcgagtcccatgagcataattcacgtaagataatcaataatgattgcttagccacaatttcattgattagaatattctgataatggtctactcaagggtaaaaaactgtatgctatagttttaaaacatattatattatagccttctgattggaaagtttgagctttaattatgctttgatttgaagcctttgaggg

SEQ ID NO: 44042 - DNA, 201 bp, Bos taurus; identical to SEQ ID NO: 2523

SEQ ID NO: 44043 - DNA, 201 bp, Bos taurus; identical to SEQ ID NO: 2524

SEQ ID NO: 44044 - DNA, 201 bp, Bos taurus; identical to SEQ ID NO: 2525

SEQ ID NO: 44045 - DNA, 201 bp, Bos taurus; identical to SEQ ID NO: 2526

SEQ ID NO: 44046 - DNA, 201 bp, Bos taurus; identical to SEQ ID NO: 2527

SEQ ID NO: 44047 - DNA, 201 bp, Bos taurus; identical to SEQ ID NO: 2528

SEQ ID NO: 44048 - DNA, 201 bp, Bos taurus
ttgcaagaagtaaactaagattaggagagaagaaatactatatgatataaccataattgggttgtttgtgatatttacagaggagtttcactgcaatggcaaagactataatcattccgtaaaaggttgaagtatgaatgaaacactctattagattgttttttccaaaagtgagcacagcaatatttctgatattaagtt

SEQ ID NO: 44049 - DNA, 201 bp, Bos taurus; identical to SEQ ID NO: 2529

SEQ ID NO: 44050 - DNA, 201 bp, Bos taurus; identical to SEQ ID NO: 2530

SEQ ID NO: 44051 - DNA, 201 bp, Bos taurus; identical to SEQ ID NO: 2531

SEQ ID NO: 44052 - DNA, 201 bp, Bos taurus
tggcaagcggcttgtttcttcctaataaagaccagatttttgaagcttgagttctgatgtctaatgatatatgggtgagtacagggagagagatttgaagaatgtcagagaaattagaagatgaagtttgaaaggtttgtcttctaaatcataaacatctttgttcctttttcctctcacatctaaagcaagggtcataga

SEQ ID NO: 44053 - DNA, 201 bp, Bos taurus; identical to SEQ ID NO: 2532

SEQ ID NO: 44054 - DNA, 201 bp, Bos taurus; identical to SEQ ID NO: 2534

SEQ ID NO: 44055 - DNA, 201 bp, Bos taurus; identical to SEQ ID NO: 2535

SEQ ID NO: 44056 - DNA, 201 bp, Bos taurus; identical to SEQ ID NO: 2536

SEQ ID NO: 44057 - DNA, 201 bp, Bos taurus; identical to SEQ ID NO: 2537

SEQ ID NO: 44058 - DNA, 201 bp, Bos taurus; identical to SEQ ID NO: 2539

SEQ ID NO: 44059 - DNA, 201 bp, Bos taurus; identical to SEQ ID NO: 2540

SEQ ID NO: 44060 - DNA, 201 bp, Bos taurus; identical to SEQ ID NO: 2541

SEQ ID NO: 44061 - DNA, 201 bp, Bos taurus; identical to SEQ ID NO: 2542

SEQ ID NO: 44062 - DNA, 201 bp, Bos taurus
tggggaaggctgagcctgagataattacatcccagctcccccggccaaaagaaattattgcacatagccaacagtgactgagagttgggatcaaaagctcgttgaagttcctgacctgaaggccagctagacttagcatgcgccgtaggtcctgaatatcgctgttgaatacaagagaggtgaatgtggatgtggagaaaa

SEQ ID NO: 44063 - DNA, 201 bp, Bos taurus; identical to SEQ ID NO: 2544

SEQ ID NO: 44064 - DNA, 201 bp, Bos taurus; identical to SEQ ID NO: 2545

SEQ ID NO: 44065 - DNA, 201 bp, Bos taurus; identical to SEQ ID NO: 2546

SEQ ID NO: 44066 - DNA, 201 bp, Bos taurus; identical to SEQ ID NO: 2547

SEQ ID NO: 44067 - DNA, 201 bp, Bos taurus
gtcatttactctgtgcctgtggttatagtaaaaaccaagattgaaacggggctcaaagaaaagtacttccaagtgtgcctagtaggtagtaaaatgttcaataaatgttacccattgttattgttgtttttgatggaagtgcacccaaattcagaaattcttgaacaaaccagagttagccggaggaagggtatagaaatc

SEQ ID NO: 44068 - DNA, 201 bp, Bos taurus
gttaataatgggtgttgtcagcctgggctgggaggctttgcagcgagaaggaaggaaactcagaccagaccagaaaatgggccaattgcagtcccagtcaacacagcgccggctcggctcagccgtgcggtgggtggctttggagcctgtgcagttacaagtggcgctgttttgcttttcctttcccacgccttccctccg

SEQ ID NO: 44069 - DNA, 201 bp, Bos taurus; identical to SEQ ID NO: 2548

SEQ ID NO: 44070 - DNA, 201 bp, Bos taurus; identical to SEQ ID NO: 2549

SEQ ID NO: 44071 - DNA, 201 bp, Bos taurus; identical to SEQ ID NO: 2550

SEQ ID NO: 44072 - DNA, 201 bp, Bos taurus; identical to SEQ ID NO: 2551

SEQ ID NO: 44073 - DNA, 201 bp, Bos taurus
ggccttccttctgctggaaatgcacctgaggatctgaagttagtcttctttgaattttctttcttaacgattgccttttcttcatgaggctaccattactgctttggccaaagaggacatctttggcactaaagaaatgtgtgtggcttcaaagtgtattggtttctacatgggctttcctgagagctcatgggatgaagt

SEQ ID NO: 44074 - DNA, 201 bp, Bos taurus; identical to SEQ ID NO: 2552

SEQ ID NO: 44075 - DNA, 201 bp, Bos taurus
cttatcccaaccttagggatcagggaagtatctattagaggtcacctggtatgaatcttgaaggatgtaagagaaaactagggtggagaatccttggtaaggggtataggctgcacaaacaatgggttaataaataggatttgccagacatctttgtccatcctggctcataggttttaaagctcatacaatcagtgattt

SEQ ID NO: 44076 - DNA, 201 bp, Bos taurus
atgcttgaaggccttcatatttaacttgaaagcaataccccagaacaagaaaatcatccccataaggactggtcatgactctctttaagaactgatttccggttttatcttattacatcctctgtgttgtttaaaatcctgtattaaatattaccttattaaaatattcagtatttttgcagccataaaaagctaccatag

SEQ ID NO: 44077 - DNA, 201 bp, Bos taurus; identical to SEQ ID NO: 2553

SEQ ID NO: 44078 - DNA, 201 bp, Bos taurus; identical to SEQ ID NO: 2554

SEQ ID NO: 44079 - DNA, 201 bp, Bos taurus; identical to SEQ ID NO: 2555

SEQ ID NO: 44080 - DNA, 201 bp, Bos taurus; identical to SEQ ID NO: 2556

SEQ ID NO: 44081 - DNA, 201 bp, Bos taurus
aaagtatcaattcttcagcgctctgctttctttatagtccaactcgcaaagactatatctgtatatatatcctttataaggtatttttgtaaatataccccttacagataaagaaactgaattaaagaattaaggatgaactatccaagatgatccagtctgtaaggatttgaacccaaagtcactgaaattcaaaactca

SEQ ID NO: 44082 - DNA, 201 bp, Bos taurus
cttacaactgtatgtgatacataagaaaaagattatgtctattttgcaaatagagctattgattgaaaaaaggtcaattcattgtccatgtcactctccaaattaatagtaagacctgattagaaatggagctattgtctccgcatgcaaaagataccatactgaacacataagaaatttaatagcaaactctgttctata

SEQ ID NO: 44083 - DNA, 201 bp, Bos taurus
gtcatatgggatgcaggggtagaagggtagggggagagtgggtgaattcatatgaaaaaaaaaaacaatgttaccgctgaaaccaggaaaggccagggatcgtggtagcatacctagcagatgaatggatttatccaaatgtaggaaaatgaagaaaataatgtgagatgaccctggaaagaagactagggccacacactc

SEQ ID NO: 44084 - DNA, 201 bp, Bos taurus
gagatgtaaaacatatcattacaggccttttagaaaattcaaatgtaaccatcccttctatgaaaaatatattattttccacttgctatcaagaaccccatttgaaaaaagaaagaatcccatccagagttatcctccagccttagcttttgggccactttgtgttcttttaactttcttctcagaagagagggaaaaacc

SEQ ID NO: 44085 - DNA, 201 bp, Bos taurus; identical to SEQ ID NO: 2557

SEQ ID NO: 44086 - DNA, 201 bp, Bos taurus
ggggcctggattcaatccctggtcaaggaactagatcccacatggcacaacttacagatcccatatgccacaactaagatcgaagctcccacatgtcccaataagacctggtgtggccaaaaataaataaatattctttaaaaagatgtcactgaaacatgattacaatctctacttggacgcctccagtaatgggacgct

SEQ ID NO: 44087 - DNA, 201 bp, Bos taurus
ggccatcccacccactcacaaggctctgaacagagtatcaatgcctttgcctgtatagagcagtcctgaaggttttacagcagcatggtagctccctggaatctgacaggccacagtaactttctcaaagaaggagttagtcgtatctggaggatgatgcagataaaaatggtggcaagtgaattattttgttatggaagg

SEQ ID NO: 44088 - DNA, 201 bp, Bos taurus; identical to SEQ ID NO: 2558

SEQ ID NO: 44089 - DNA, 201 bp, Bos taurus; identical to SEQ ID NO: 2559

SEQ ID NO: 44090 - DNA, 201 bp, Bos taurus; identical to SEQ ID NO: 2560

SEQ ID NO: 44091 - DNA, 201 bp, Bos taurus; identical to SEQ ID NO: 2561

SEQ ID NO: 44092 - DNA, 201 bp, Bos taurus
aggaacttcagaggactgacagttgtagatgcagcttcattaagatgacagataatcaagctaaacagacacctacaacttctagaagaggagaccaaaggacatgctaaaagagaaatggcactcaattactacagcattctaactgcttaatagctggctctggttttgctgctagaggtaacctcaactctcagaaat

SEQ ID NO: 44093 - DNA, 201 bp, Bos taurus; identical to SEQ ID NO: 2562

SEQ ID NO: 44094 - DNA, 201 bp, Bos taurus
aagatttgttgttgttttaataggagagtgacatggtcagatttgtgctttgggtcgctctctcagggaagtggaacaggatgggctaaaatatagaagacagcacagtaatgagagtaggcaacaaacagaaaagttgcaaatttgtgcaagaaatgaaacggatatgaaccagagttgaagctatgagaacacagaggg

SEQ ID NO: 44095 - DNA, 201 bp, Bos taurus
ctccatttcacaaccagcctcgcatcttcacaaatgtggtgttgcggctgtttcacttgtttggacacatgttaacaggcaggaagatgagttcaatgactccggacaaagcacggacacaagtggatttgatgctggctcttcttccctccagcacactcggcagctgccagatcccgccttctgatggaggcgaggggg

SEQ ID NO: 44096 - DNA, 201 bp, Bos taurus
tagattaacatctataacatagagagcaaagagggcactgtaagcaacagatgaattctattaggctctaacagacctcagaaggatccagaaagcctctacagtttgcttctgagaagtgtgcattccagtaattgcttctaagtgctcctccatactggtgtaggccagggcatgcaaagtcagaagtcctacttctac

SEQ ID NO: 44097 - DNA, 201 bp, Bos taurus; identical to SEQ ID NO: 2565

SEQ ID NO: 44098 - DNA, 201 bp, Bos taurus; identical to SEQ ID NO: 2566

SEQ ID NO: 44099 - DNA, 201 bp, Bos taurus
attaactaagtcattgacttcctctgagcatcaatctgcaaagtgaacaataatccctgccttgcctactctatagggaagattccatgagattcccttattcataaccagcacgattggcaactagtttgtagtggggacaagcctggactagggccagactccctggcttcaaatctagtcaaatgcttaccgactagc

SEQ ID NO: 44100 - DNA, 201 bp, Bos taurus; identical to SEQ ID NO: 2567

SEQ ID NO: 44101 - DNA, 201 bp, Bos taurus; identical to SEQ ID NO: 2568

SEQ ID NO: 44102 - DNA, 201 bp, Bos taurus
tctgttttaaattcccagctctggaggaagaagcaaattttcagttacaataggttattaacattaatttttataggtaaatcataggtgcttaagtttttgactcaattttgaaagtaatagggcaatacctgaatgtactaattcattcatttatttaaataataattatggacatctaaaatttaaggctaacatttt

SEQ ID NO: 44103 - DNA, 201 bp, Bos taurus; identical to SEQ ID NO: 2569

SEQ ID NO: 44104 - DNA, 201 bp, Bos taurus; identical to SEQ ID NO: 2570

SEQ ID NO: 44105 - DNA, 201 bp, Bos taurus
acacaacattcttggccttgattccttcctcccaccagcacctcagtggagaagcccacagccaggtgtgtcagctccaccaaagcaaagtcacactctgctctccttagatgggcaggcaggccacatctcccaacagctccggggttagtcagcctgagcattactccagccctcagttcacaatcatcccacatctag

SEQ ID NO: 44106 - DNA, 201 bp, Bos taurus; identical to SEQ ID NO: 2571

SEQ ID NO: 44107 - DNA, 201 bp, Bos taurus; identical to SEQ ID NO: 2572

SEQ ID NO: 44108 - DNA, 201 bp, Bos taurus; identical to SEQ ID NO: 2573

SEQ ID NO: 44109 - DNA, 201 bp, Bos taurus; identical to SEQ ID NO: 2574

SEQ ID NO: 44110 - DNA, 201 bp, Bos taurus; identical to SEQ ID NO: 2575

SEQ ID NO: 44111 - DNA, 201 bp, Bos taurus; identical to SEQ ID NO: 2577

SEQ ID NO: 44112 - DNA, 201 bp, Bos taurus; identical to SEQ ID NO: 2579

SEQ ID NO: 44113 - DNA, 201 bp, Bos taurus; identical to SEQ ID NO: 2580

SEQ ID NO: 44114 - DNA, 201 bp, Bos taurus
caagatatccacttcatccaaaggcctgtggttacaagatagctatcaaaccttctaaggtgattcctccttcgcactaagggatagagaatcctccattgttccaggattccaagcaaaagttctgacactcattctggttggaatggtttaggtcatgtgcctgcactaaacctcccttggggccacctggaccataac

SEQ ID NO: 44115 - DNA, 201 bp, Bos taurus; identical to SEQ ID NO: 2581

SEQ ID NO: 44116 - DNA, 201 bp, Bos taurus
caagttataactatgatatttagagatatcctccataaaaagtatggcaaaaagattggtcagattgaatttagccagaaagttaatcacagtatcacctatggaaatatatttgtcagagaatcctgataaattaaacagatttcaatgagctaccagtagatggctctcttaatttgctattttatttcagttcagctt

SEQ ID NO: 44117 - DNA, 201 bp, Bos taurus; identical to SEQ ID NO: 2582

SEQ ID NO: 44118 - DNA, 201 bp, Bos taurus; identical to SEQ ID NO: 2583

SEQ ID NO: 44119 - DNA, 201 bp, Bos taurus; identical to SEQ ID NO: 2584

SEQ ID NO: 44120 - DNA, 201 bp, Bos taurus; identical to SEQ ID NO: 2585

SEQ ID NO: 44121 - DNA, 201 bp, Bos taurus; identical to SEQ ID NO: 2586

SEQ ID NO: 44122 - DNA, 201 bp, Bos taurus
gagtcggacacgactgagcaactttcaccttcactttcacttttcatgaaggccaggctgcaccatgcagagaactctcaaaagcagaaaggccattgtttggaaatgtattaccaaagtttgcctgtcttcttcttgaggcaacctgcagactccaggctgattaggcctcattacgcatccatatacagcaaccacaat

SEQ ID NO: 44123 - DNA, 201 bp, Bos taurus
agcaaccatgctggccgctgtccaatctgatcactcactacagttcaactacagtttagagtcccctccaaagccccccgtggcttcccactgccgtaagtggagagaccatctcatcagagtggcctggttcttgtcatccgctccggtttagttcccacctcaccagttctggcaaccgtgaatgttgagaatgtcagt

SEQ ID NO: 44124 - DNA, 201 bp, Bos taurus
tatgaataactattatatcctgtaggctgtaaaaataaaagtgaaataagaacagaatcaatagaaagagtatagaagataacaccatcagcagagataatcaagaaaggtttccctgcaagaagaaaagacggcagggttggagctttggtatgaaagtctgcttgctgtctaactaaacagaggctgctatgttcatat

SEQ ID NO: 44125 - DNA, 201 bp, Bos taurus
tcttcaggactcctttacatgaaagaaatcaagccccagttgactaaagccacactaacagctgtggggggaggcgtgtgggaataaagagggaggttcagtttataagcagctgaatgcaatcactgaatgatatacccatgattccaccaatttaagtcttcattttatcatgtcatattattattttttgcacatgta

SEQ ID NO: 44126 - DNA, 201 bp, Bos taurus
atatgtatatcacatgtacaggttttagcactttaaatatatcaatttatttaatatatttattaatatattaatatatattctaagaagtaggtggccttaataaccctattttacagataagtaacagatgcacggtaatttgctcaaagttacataactagtcagttacagacccagaatttgagtcctggccatctg

SEQ ID NO: 44127 - DNA, 201 bp, Bos taurus
acagacaccagtttcttatgtggtaggctaatttaaaaaaatttgtaatgtgttggttgacctgtaagcttaaaaacatgatatctaaagaaattttatatgcatgtataagatgtttatttcacctacaattcttttgagtttatttttacctcagtcatacaatgaaatcacagtcctgagttttaaagcagagaacaa

SEQ ID NO: 44128 - DNA, 201 bp, Bos taurus
gtaatggcaccatccgtgaacaccaataaccctttcctagaaaaatcaaagttggctgaacaatctgagggtatatggctgagctgttggagaaaaaaagggagaattatcaacagaaacctacagacaagaagtatttctatttactaaatattatattttatctctcacatgtataatggcatgctaaatatatacctg

SEQ ID NO: 44129 - DNA, 201 bp, Bos taurus; identical to SEQ ID NO: 2587

SEQ ID NO: 44130 - DNA, 201 bp, Bos taurus; identical to SEQ ID NO: 2588

SEQ ID NO: 44131 - DNA, 201 bp, Bos taurus; identical to SEQ ID NO: 2589

SEQ ID NO: 44132 - DNA, 201 bp, Bos taurus; identical to SEQ ID NO: 2590

SEQ ID NO: 44133 - DNA, 201 bp, Bos taurus; identical to SEQ ID NO: 2591

SEQ ID NO: 44134 - DNA, 201 bp, Bos taurus; identical to SEQ ID NO: 2592

SEQ ID NO: 44135 - DNA, 201 bp, Bos taurus
tggtagttgaaggcctgatggagcttgggctcacatctcccaaagcgccatgggatggatggagccccactcctctacacgactccactaagtcaactctcgccaactcttcttcttggcctttggtttctactgctaaagggaccctgaatcatttctggacagtgtggccttctccacagtactctcttaccccctgga

SEQ ID NO: 44136 - DNA, 201 bp, Bos taurus; identical to SEQ ID NO: 2593

SEQ ID NO: 44137 - DNA, 201 bp, Bos taurus; identical to SEQ ID NO: 2594

SEQ ID NO: 44138 - DNA, 201 bp, Bos taurus; identical to SEQ ID NO: 2595

SEQ ID NO: 44139 - DNA, 201 bp, Bos taurus
gaactttctcatggctaagtagttatgccttgattgttggaagagtaagcacaccttgattgcttacataattttgaattaattatattacttccagattcgtttgttattaaggagggtgcttatcaactgattctaattaatgtataacaactttgtgatataatagaggctttaaacatttaagatattacagtcccc

SEQ ID NO: 44140 - DNA, 201 bp, Bos taurus; identical to SEQ ID NO: 2596

SEQ ID NO: 44141 - DNA, 201 bp, Bos taurus; identical to SEQ ID NO: 2597

SEQ ID NO: 44142 - DNA, 201 bp, Bos taurus; identical to SEQ ID NO: 2598

SEQ ID NO: 44143 - DNA, 201 bp, Bos taurus; identical to SEQ ID NO: 2599

SEQ ID NO: 44144 - DNA, 201 bp, Bos taurus; identical to SEQ ID NO: 2600

SEQ ID NO: 44145 - DNA, 201 bp, Bos taurus; identical to SEQ ID NO: 2601

SEQ ID NO: 44146 - DNA, 201 bp, Bos taurus
agaacctttaagagcgtgatttatcctttcccttttcacttctgttatggtccataataggacttatctagatgaactttcagtcagtgtggatccctgcatgactgggtgattaatatccctgctgacctacactttccatgtggcatgagcaagccatacactttcataataatgtaaagccactgagatttcggtggg

SEQ ID NO: 44147 - DNA, 201 bp, Bos taurus; identical to SEQ ID NO: 2602

SEQ ID NO: 44148 - DNA, 201 bp, Bos taurus
gggccccaggttctccagatatttctctttcccaacaactgctacaaatagcacctaagatgagcagcacctggagcccacgtagatcttttttggtacacggccaccttttgcctgcctcaaaaaaaagtaccacatcactttccaggaacacagctctcagagatcagggcaatcatatagctgctgatttttcaccca

SEQ ID NO: 44149 - DNA, 201 bp, Bos taurus; identical to SEQ ID NO: 2603

SEQ ID NO: 44150 - DNA, 201 bp, Bos taurus
acatggaataatattctctacctgacaaagtattctcagatgactgtggctcacacatttatatccatgtaaagcaattggcccagtgactggcatgacatgcttaagaattggtagacattaccatcatcaataccagggcttcaggactcatctgacctatccatgtttacacagtaccattacagtgtttgatccagt

SEQ ID NO: 44151 - DNA, 201 bp, Bos taurus; identical to SEQ ID NO: 2604

SEQ ID NO: 44152 - DNA, 201 bp, Bos taurus; identical to SEQ ID NO: 2605

SEQ ID NO: 44153 - DNA, 201 bp, Bos taurus; identical to SEQ ID NO: 2606

SEQ ID NO: 44154 - DNA, 201 bp, Bos taurus
ccctgtggctcaagtttataaagttaaattctgactccaagcaattcaatgttaatttccaccaagccctggtgtcccagaaagccagtgcaccacaggcacagcttaggaatctgtcctagtctcttttacccagtgcctgccccaataaaaatgacttcaagtaagatagagaagacagcttggagagaaggatggctg

SEQ ID NO: 44155 - DNA, 201 bp, Bos taurus; identical to SEQ ID NO: 2607

SEQ ID NO: 44156 - DNA, 201 bp, Bos taurus; identical to SEQ ID NO: 2608

SEQ ID NO: 44157 - DNA, 201 bp, Bos taurus; identical to SEQ ID NO: 2609

SEQ ID NO: 44158 - DNA, 201 bp, Bos taurus
gcatgataatcttgttctcccctttccctgcctctcttatagctacaagtgatgatgcaacctaattctacccagtgatacctaagcagaagtcaagtagaagagctcttggaaaagcttttactctgctcattaaaaaaaaaaaagaagaaaaaaaaaggagacactgctttcttcatttcttccccattcttctaccat

SEQ ID NO: 44159 - DNA, 201 bp, Bos taurus; identical to SEQ ID NO: 2610

SEQ ID NO: 44160 - DNA, 201 bp, Bos taurus; identical to SEQ ID NO: 2611

SEQ ID NO: 44161 - DNA, 201 bp, Bos taurus; identical to SEQ ID NO: 2612

SEQ ID NO: 44162 - DNA, 201 bp, Bos taurus
cctctgcagatacaaagtagaaagtgattaaatgtgaaagaaaagtacacatataatacaatggcagctcagagaatggggtgaattctttggcctgagatggtaagagaagacttgatggaagagatggaatttcagccagatattgattgatgagtaagagatgatgggaaaaggccatatgtaaggaataaagaatat

SEQ ID NO: 44163 - DNA, 201 bp, Bos taurus; identical to SEQ ID NO: 2613

SEQ ID NO: 44164 - DNA, 201 bp, Bos taurus; identical to SEQ ID NO: 2614

SEQ ID NO: 44165 - DNA, 201 bp, Bos taurus
acacacccacgcgtgtggggtcttggttcaccgaccagggatcaaacccacgccccccccccaccaaccccgccttctttggaaggtgaattctgaaccattggctcaccatgaaagtccccaggctaagctctttaaatacattgtttcatataattctcctcacaattctaagagataaatattaagatcagtccatat

SEQ ID NO: 44166 - DNA, 201 bp, Bos taurus
gtggccatgggcaagtaacttcccctccctggacctcagcctccttccacaaaaagaggagatcatactgcctgcctcatagacctgaagtgagactagacaccaagcactggccatccctgtgcccctgttagagagttaatgaaaaatccccctggggaccatgagtatacccagcatgcttttgaaactagccagtag

SEQ ID NO: 44167 - DNA, 201 bp, Bos taurus
aggaagacatggacagtgaggtatgggaggccgtatctccagagatctctcccaacctcccttcccaacagttgaccagacattaccagcccatcttcaaatatgtgaaactgaggcccagagagccgaagctggtgaaatatcatcacaggccagaggggactgcgctctaacacagcagttgttcagaacgtacactgc

SEQ ID NO: 44168 - DNA, 201 bp, Bos taurus
caaggtctgccagtgcatggcttgttacatgagaaagaaagatacttctgcagtatttaagcctttttatttatgtctctgcaggagatgtcaaatgtctatcacacctaacaaaatggccatatgctctttatcccacaggttccaatgtgattttatcctgcaatcagtctaggtcaacccaaggagatatgttaatgg

SEQ ID NO: 44169 - DNA, 201 bp, Bos taurus
ccacacttctccagtgagatagcatccctgtcttcttacttctgaaggactaataacagtgattcacaggaccttttgcttttccaaagttttgggccatcattatttagatatacatcatcacacacccacagcctcaatagcccatttgcttctggggaggaagctgagatcaggcagcagcaaagctgggaagagaaa

SEQ ID NO: 44170 - DNA, 201 bp, Bos taurus; identical to SEQ ID NO: 2615

SEQ ID NO: 44171 - DNA, 201 bp, Bos taurus
gactgctgatcatcatgtgatctctggtgttaccaaattccagccaaaagaaagatttgtgattttaattagtctgtgtggcctaattatatgagagaaaatataaaatttttagttaagttctttgaaagattccagtaacatctttacaggccacaaggggcctgggacctcttcccaggaggtttacagtcagattca

SEQ ID NO: 44172 - DNA, 201 bp, Bos taurus
tttgaaatgagaagtggtctttacattgtagtcacaatttaaaaaaaattgttgtaccaaaacatgtaacaaatgtacccttttgataattaacaagggtacatttacagtattgttaactacatgcacgttgttggacagcagatccatggaactctttcttcttgcatgactgatactctatacctgttgaacataact

SEQ ID NO: 44173 - DNA, 201 bp, Bos taurus; identical to SEQ ID NO: 2616

SEQ ID NO: 44174 - DNA, 201 bp, Bos taurus; identical to SEQ ID NO: 2617

SEQ ID NO: 44175 - DNA, 201 bp, Bos taurus; identical to SEQ ID NO: 2618

SEQ ID NO: 44176 - DNA, 201 bp, Bos taurus; identical to SEQ ID NO: 2619

SEQ ID NO: 44177 - DNA, 201 bp, Bos taurus; identical to SEQ ID NO: 2620

SEQ ID NO: 44178 - DNA, 201 bp, Bos taurus; identical to SEQ ID NO: 2621

SEQ ID NO: 44179 - DNA, 201 bp, Bos taurus
ccctccaaagccatcctgtacacaaccaccagggcaatcacccacacccttaaagctgattgtgtcagaactctacagtggttcctcagcacctgcggattgagctgggcctgaggaacttgctttacgagggtctttagtatttttttaatcacacaggcacacatatattctttctcactatggtttatcacagggtat

SEQ ID NO: 44180 - DNA, 201 bp, Bos taurus; identical to SEQ ID NO: 2622

SEQ ID NO: 44181 - DNA, 201 bp, Bos taurus; identical to SEQ ID NO: 2623

SEQ ID NO: 44182 - DNA, 201 bp, Bos taurus
aaagaagataatatagcttctaaccgcttagagtttataaactacctgcaaataaacatctcattcacccttttcaataaactcatcaagtgagaattttcgagttttgtgtttgagacaacagaactagaatgtccttgtccaaggacccttaaacctgttggggtgaggctgtgactagtacatgggaccctggacctc

SEQ ID NO: 44183 - DNA, 201 bp, Bos taurus
ccactgctctccagataagctgttcctggggaaggagagtggcatctacagtagtaacaggtctagtaattagcagccgccccggggccttacaacatttctaaagaagacgaggtgattcagtaagatctgtcaccactgctgagagtctcccagatggagagacaggtggggatccccaatgctaatgacagggaggcc

SEQ ID NO: 44184 - DNA, 201 bp, Bos taurus
agacgatggacatgggaatgatgctgtgatggatagccgtgagtgctggagtcaggctggacttaggaaaggtagcttgatgcttgatggcagacgggaaatgtgtaactgtctcaggtcgcttttagcccttgcttcctaagctctgcaagacttgtccctgctgtcttagttgagtatccaatggcttttggtcaggct

SEQ ID NO: 44185 - DNA, 201 bp, Bos taurus; identical to SEQ ID NO: 2624

SEQ ID NO: 44186 - DNA, 201 bp, Bos taurus
ccttagcactctagatctgctattaatatgctgggccttcagccacacagttcacccagcgcttggactcatctcccacctgctgactctgtaccctcccattctctgttgtggccagcccctacccatccctattcctgccacttttcactggccagactaggtcctcgggttcccagtgctgccttttctgtagctcag

SEQ ID NO: 44187 - DNA, 201 bp, Bos taurus
gttatacccaggatccgggtgagaaagctgagtcacagaaaaggtttgtgcctaacccaggggtcagagcccatgaatagagaggccaggccttgaactcgggctccagagcctgggctcttaaccttaaccactgagtcatcccctccctttgctctgtgcagactgccttgcattcctgggccatagtgaatgaggtca

SEQ ID NO: 44188 - DNA, 201 bp, Bos taurus; identical to SEQ ID NO: 2625

SEQ ID NO: 44189 - DNA, 201 bp, Bos taurus
accaggtcagcagccccctgctgggccagctcagatgcttcgccttttctctctgagcttcagttcttcgtatgtaaaatgggtggttgcttcctccagacacagcggtgaggccaacctacgctgtatagtagaggcagtgcagatatgtagtagcataattataccaacgacaataacaaaaactgccataaagagaca

SEQ ID NO: 44190 - DNA, 201 bp, Bos taurus
aagtttgacaacaaagaataacaaagtagacttttcctcaaagactatacaagccaaagataatggagtgatatattcaaagtaatgtggaagggaaagatggaacttttcatgtagaatttcatatttgtcaaagatatccttcaaaaaaggcaagataaagagctcttctgactaataaaaacgggtcattctctcacc

SEQ ID NO: 44191 - DNA, 201 bp, Bos taurus
gttttcccaccccttccatacacacaaaaaaaggtactttgttactctttctctctttttttgatcttgagaaaaacatttggccagtaggaggcatgactggagataggatgggaggaagggagacaccaggctaattgcctcttttctgtagaagccctaggaggttaatgtgccaatggccatttctctctcaccctc

SEQ ID NO: 44192 - DNA, 201 bp, Bos taurus; identical to SEQ ID NO: 2626

SEQ ID NO: 44193 - DNA, 201 bp, Bos taurus; identical to SEQ ID NO: 2627

SEQ ID NO: 44194 - DNA, 201 bp, Bos taurus; identical to SEQ ID NO: 2628

SEQ ID NO: 44195 - DNA, 201 bp, Bos taurus; identical to SEQ ID NO: 2629

SEQ ID NO: 44196 - DNA, 201 bp, Bos taurus; identical to SEQ ID NO: 2630

SEQ ID NO: 44197 - DNA, 201 bp, Bos taurus; identical to SEQ ID NO: 2631

SEQ ID NO: 44198 - DNA, 201 bp, Bos taurus; identical to SEQ ID NO: 2632

SEQ ID NO: 44199 - DNA, 201 bp, Bos taurus; identical to SEQ ID NO: 2633

SEQ ID NO: 44200 - DNA, 201 bp, Bos taurus; identical to SEQ ID NO: 2634

SEQ ID NO: 44201 - DNA, 201 bp, Bos taurus; identical to SEQ ID NO: 2635

SEQ ID NO: 44202 - DNA, 201 bp, Bos taurus; identical to SEQ ID NO: 2636

SEQ ID NO: 44203 - DNA, 201 bp, Bos taurus; identical to SEQ ID NO: 2637

SEQ ID NO: 44204 - DNA, 201 bp, Bos taurus; identical to SEQ ID NO: 2638

SEQ ID NO: 44205 - DNA, 201 bp, Bos taurus; identical to SEQ ID NO: 2639

SEQ ID NO: 44206 - DNA, 201 bp, Bos taurus; identical to SEQ ID NO: 2640

SEQ ID NO: 44207 - DNA, 201 bp, Bos taurus; identical to SEQ ID NO: 2641

SEQ ID NO: 44208 - DNA, 201 bp, Bos taurus; identical to SEQ ID NO: 2642

SEQ ID NO: 44209 - DNA, 201 bp, Bos taurus; identical to SEQ ID NO: 2643

SEQ ID NO: 44210 - DNA, 201 bp, Bos taurus; identical to SEQ ID NO: 2644

SEQ ID NO: 44211 - DNA, 201 bp, Bos taurus
gtgatgtaaaaattaaaatcaaagttttgctttttgaatgcatggtctgtaacccacagaaaatgagcaaattgtttggtcaggatcttgtttaagaagccaaaaatttaagaatcaaaatatgtacaccattaaaaatactaattctgagtattatatatctaaaaattaaatcaccctgtccagcaagtttcaaaaaat

SEQ ID NO: 44212 - DNA, 201 bp, Bos taurus; identical to SEQ ID NO: 2645

SEQ ID NO: 44213 - DNA, 201 bp, Bos taurus; identical to SEQ ID NO: 2646

SEQ ID NO: 44214 - DNA, 201 bp, Bos taurus; identical to SEQ ID NO: 2648

SEQ ID NO: 44215 - DNA, 201 bp, Bos taurus
cagggcaggtctgggtgcccttggagcctgcttgtgctatgctgctctatggaaaatctttgcaaagcctcagggagggcctccaccctcaaagggtggaggaagtgggacacttagatccaggacaccagcgactctcattttccactcttgactcagagtgccctgcccagaaaggccattggaccccaggctgcccac

SEQ ID NO: 44216 - DNA, 201 bp, Bos taurus; identical to SEQ ID NO: 2649

SEQ ID NO: 44217 - DNA, 201 bp, Bos taurus
taatgtgcagcccaagggcaggaactgagttttattcaacctcaaacctgctgtgcccagaataggactggctcgtggtagagaattgatgagcatgaactgaccgattaaacgaatgaaagacccttttcttcaaagagcttctgtgactcgatatgatatttttcctagaacttgtggttttcaggccagaaggtgact

SEQ ID NO: 44218 - DNA, 201 bp, Bos taurus; identical to SEQ ID NO: 2650

SEQ ID NO: 44219 - DNA, 201 bp, Bos taurus
ccctttcagttggcaggcataggcaaacctagaaataagagggtagcagcactccatggaagcaatagacaaatgcttccttttttttcatcacttgggtagacaattctgaagttcttagagggtcccaatggaaaagccccaatcacccaccatggtgatcagctcaataacacaacctgacattgaccttcctttcat

SEQ ID NO: 44220 - DNA, 201 bp, Bos taurus
tatagcagagagggctagacatggattagtggaacacctctactctcagagttcagggtgggcaaatggttacccagcctttctcaggcttctttgcagcctggtatggctattttctcaccaagacattataaaggggaattgcttgccctccgttccctcttttccccctcttccatggactggaactcgtgtgtggtg

SEQ ID NO: 44221 - DNA, 201 bp, Bos taurus
ccattaggctgcagtgcttccagctacactatgatgtttctcgccaaatattagcgactattctaatatgtctgcagtctgacaggcccctgcaaccctgcctagtctttgcttttggaccaacaccttccctgaatccaagcccacaagcaggagctcagagctcttgctcggcctcccagagagccctgcctgctccct

SEQ ID NO: 44222 - DNA, 201 bp, Bos taurus
tcagacccagcatatgaagtaaataaaatccatttaccatctctgagctagatcaagtagatcagacccagcacatgaagtaaataaaatctgtttaccaactctgagctagatgatttttatccgttttgacactgtacaacccatgaaagatagaagcatgaaaacagagactaggaaacctgaggcctagagaccacc

SEQ ID NO: 44223 - DNA, 201 bp, Bos taurus
caattactctaaacaggaagagatttctgcctacatctctgacaggcaggtgttctctacaattcaccaggaagaagaaaactctgtgagaggacaaccccgtcaatcagaaactgtagcagttcaaccaatgaacaatctccatgctttggactcccagctttctccagtgaactttttggttattacagcccttccaaa

SEQ ID NO: 44224 - DNA, 201 bp, Bos taurus
gtaagaactgtataaaaagttctaagggagaaaacccagataaatgtcagaatcttatctcatgggtccagaactactgttgccagcctcttgtggacatcgctgtgtccagaacttctgacacagcgacagcctagcacagtgtcctctgacccaccttgtcacagaagtggctatagacttggggttgacgagcactgt

SEQ ID NO: 44225 - DNA, 201 bp, Bos taurus; identical to SEQ ID NO: 2651

SEQ ID NO: 44226 - DNA, 201 bp, Bos taurus; identical to SEQ ID NO: 2652

SEQ ID NO: 44227 - DNA, 201 bp, Bos taurus; identical to SEQ ID NO: 2653

SEQ ID NO: 44228 - DNA, 201 bp, Bos taurus; identical to SEQ ID NO: 2654

SEQ ID NO: 44229 - DNA, 201 bp, Bos taurus; identical to SEQ ID NO: 2655

SEQ ID NO: 44230 - DNA, 201 bp, Bos taurus; identical to SEQ ID NO: 2656

SEQ ID NO: 44231 - DNA, 201 bp, Bos taurus; identical to SEQ ID NO: 2658

SEQ ID NO: 44232 - DNA, 201 bp, Bos taurus
tataaagcatttggaatcatgtgggcaggctgtgaacgctgcaaaaatctctttgaaggggtaggcccaacgcctgtgggaggttttgcgggtctttaataagaaacccctcagggatggagttgcccctgtggaggctgtcctgcttctcgtcactgcacctaaacagctgcaagtaacaacagacattttgataaagcc

SEQ ID NO: 44233 - DNA, 201 bp, Bos taurus
agttggccatgaggcacgttggctttcatggagctgatcactagatcatcaaaagtcagcaaattggcatggttctgtcacaggagttggcatgaggtagcctcacagtaaacatgagctgattctcattgcttttatcatcagtggtcacttagtgaatgtttgctgaataaaccaaggtcatttctgcactgcagttta

SEQ ID NO: 44234 - DNA, 201 bp, Bos taurus; identical to SEQ ID NO: 2659

SEQ ID NO: 44235 - DNA, 201 bp, Bos taurus
tggcctttgtgtttgaagacagttctgcagcaaggttcctgatgacaaggcaggctccttgggggtgtggtgctacacgtggtgtgaatccccaggaaagagtgcagactgtctccagggcctgatctgctggggagcatagttgggaatgctggaggtacttataacccccagaagtttgggaggacaggcttgactgaa

SEQ ID NO: 44236 - DNA, 201 bp, Bos taurus
gggcacacgatggtggagggtggacgtggacactgggctccttgctctcaggctcggtgctgcctcagaagcccactagggttgggatgcggccatgctgtggaaaaaagggagggtgatcacgttcagaattggcatggctacttacagactccatgatctgcagtgacccctgttagcctgagggacagacctgggctc

SEQ ID NO: 44237 - DNA, 201 bp, Bos taurus; identical to SEQ ID NO: 2660

SEQ ID NO: 44238 - DNA, 201 bp, Bos taurus
ttcaaagaatcgaatgttcctggtaatcaagtgggaaggcttgatgaataggacctgatgcatgctgggctgctgggcaccttctggggccctgccttctctctctccacatatcttcctgtgggaaggaggagcagataacccggagcgggtaggttacccaacgggcctgttggggaaagaacctcagaaccacatcct

SEQ ID NO: 44239 - DNA, 201 bp, Bos taurus
ggcccttccctcatcaactacttcttatttctgtccgacccttcagagctcagttttcaaaacagcagttcacactcatctactgtctttcccttcctgcctcaccatcactccagagccctcttgttcttaaatccacttgactttcatgtgcgttctaagtcacttcagtcgtgtccaactgtttgcgaccctatggac

SEQ ID NO: 44240 - DNA, 201 bp, Bos taurus
gctcccctgttctcttatccccatccctggccgacagctctattctcaaggctcccagatgctacctctgtgactactacagtgcctgctcagacccacatggccagcatcccactggacgagtgcccgaatgccacaggcagctaaaccacacttttccaaagctggaagccggtgtctgcacacaccctctctttctcc

SEQ ID NO: 44241 - DNA, 201 bp, Bos taurus
tgaaggggaggttcagggctcctgcgccggcccaccccgcgccccctgcaggctgtttcgagtccgcattagcgtgttaattacaccagctgcccgggcggggctggggaggcggcggcctggggatggtgtcactcttgggttcaaagaaccacggaagaaccgtggggcagggagaacaggctggggtcacggctgaaa

SEQ ID NO: 44242 - DNA, 201 bp, Bos taurus
accacagggcctggcccagagccaaggcatttgagtggtatgtgaatgaatgaatggactgaggaaatgtcccccacttttgagagtgggaatctagtattagtcagatatgggggacccaggggcctctgagaagcccctgaggggtccttgaggctggaaaagggagctgggtgtcctttagggaccatagtaaggtcc

SEQ ID NO: 44243 - DNA, 201 bp, Bos taurus; identical to SEQ ID NO: 2661

SEQ ID NO: 44244 - DNA, 201 bp, Bos taurus; identical to SEQ ID NO: 2662

SEQ ID NO: 44245 - DNA, 201 bp, Bos taurus
ccgttgagcagccacaggtcatggtgggccagcaacaggtctgggacaccacaggtctgaggtgtcccagcacctcagattgccattccaggatcttcagaacatggccctgcctctcctgcagctcccacattcacctgccctgcttattgtctgtttcgtgttcctccctccaggccttgggatgtgctgttccttctg

SEQ ID NO: 44246 - DNA, 201 bp, Bos taurus
ggactgacaaatgacgatggactcctgatggattcaagtactgagaatactgtactcaaaactgataagcctcaatttatagtccatggttgaagatttacgttatttttcctactttagtgtcttgttttggaacatccaaggtatttccaatatgatgtcatttgtataaatacaactaaattcaacaaaggctatttc

SEQ ID NO: 44247 - DNA, 201 bp, Bos taurus
gtacagggctctatgggacagtcaggagaatcagaacttctcctagaagatctgaattgatcttttaaaaaatgcaaacaagggggtggtcctaagatggtggaggaataggacagggagaccactttctcccccacaaattcatcaaaagaacatttaaacgcccagtaaattccacaacttctgaatgctggtagagga

SEQ ID NO: 44248 - DNA, 201 bp, Bos taurus; identical to SEQ ID NO: 2663

SEQ ID NO: 44249 - DNA, 201 bp, Bos taurus
acctggccgctttctgatgtcgcactgttctgctcagagtgttgtggcagcaaggcaggggcaagctatagcaaccccgctcagccatcagttggcacaacgtgggcccctctcctgaagcgagcaactgtcaacatgcaaccattagtgatcctgctcagccactggtcagtgccaagtgagcccctctcccctcctgta

SEQ ID NO: 44250 - DNA, 201 bp, Bos taurus
ccgagggcctcagttccatccctggtcagaaactaagatctcatgaagggcagaacacagaccaaaaaaaaaaaaaaaaaatctgttttaaaaacctcaaatataggcctgactcaaaaagacaacaaaaatctaaacacactaggacccatgatgtttagcttacaataaaatataagaaatggtaagaagcaggaaaga

SEQ ID NO: 44251 - DNA, 201 bp, Bos taurus
gaaactggaaaaattagtagccacaggcctgaaggaatcaccatcatcaccattatttttagttgggagagcttaaaaaaatcaaagtatcttgatttacgtaatagcgggtttaaggagctaagaacagttaaatagtcaggactgccacctgctgacttatgcagtcattggtgtgggctgctttttttgtttttagag

SEQ ID NO: 44252 - DNA, 201 bp, Bos taurus
tgagtaggagttagctggatgatgaactggaaaaatgaacgcgaagagacagtgggagtggcattggcatgtggggaggcccataggccttaagagcccagtgttattcagagaactgagaggtatatcttgactggagcatgtcgtatgggacatgagacaaagctgagagactgctggaggccagctcatctaagactt

SEQ ID NO: 44253 - DNA, 201 bp, Bos taurus
cggcctgtgtagatttagggatgattcaggcacatcacattcattgtgcactttatttctattattattatgtaagctccacctccagtcgtgaggaggttgggggcctctccaatagatcacctttggagaccaggcaatcttatataagggaatagctctggtttgattccattttctgagtcccattcagaagaatgg

SEQ ID NO: 44254 - DNA, 201 bp, Bos taurus; identical to SEQ ID NO: 2664

SEQ ID NO: 44255 - DNA, 201 bp, Bos taurus; identical to SEQ ID NO: 2665

SEQ ID NO: 44256 - DNA, 201 bp, Bos taurus
aagaaccaaaattaagtaataccaagagggagccatatatacaaacagaaaatagaattgagattcaaaattacttattcgaagatccctccttaaaagtataattcggtactctggtactcaataaaacctaaccaattctaaaatctctgtagttacaccagtttcttccccaaagattttaacagaagagagctatta

SEQ ID NO: 44257 - DNA, 201 bp, Bos taurus; identical to SEQ ID NO: 2666

SEQ ID NO: 44258 - DNA, 201 bp, Bos taurus; identical to SEQ ID NO: 2667

SEQ ID NO: 44259 - DNA, 201 bp, Bos taurus
ttacaatatagtaaatgagaagaaaaagactcagctggccatttgtttttctctataagcagtaaaaggaaataggtccttaatctaactctcttgagcattgttctagctagctttgactgacattatacaactagttgaaaatctaatcctataacaactgccacatataacagtggcatatttaagaatatgctctgc

SEQ ID NO: 44260 - DNA, 201 bp, Bos taurus; identical to SEQ ID NO: 2668

SEQ ID NO: 44261 - DNA, 201 bp, Bos taurus; identical to SEQ ID NO: 2669

SEQ ID NO: 44262 - DNA, 201 bp, Bos taurus; identical to SEQ ID NO: 2670

SEQ ID NO: 44263 - DNA, 201 bp, Bos taurus; identical to SEQ ID NO: 2672

SEQ ID NO: 44264 - DNA, 201 bp, Bos taurus; identical to SEQ ID NO: 2674

SEQ ID NO: 44265 - DNA, 201 bp, Bos taurus
ccccccactcccctgccgccaacgcacagaaaacagcaaatgtggcaccacctttatgcgtcacatgggctcccagccactcccagacctgcagactgctgtagggccctgtaatttgtcctgacttcctctactcattggccgtgctagcagcaacatgcgggcacaaactacgtcttattctctttagcttcctcacag

SEQ ID NO: 44266 - DNA, 201 bp, Bos taurus; identical to SEQ ID NO: 2675

SEQ ID NO: 44267 - DNA, 201 bp, Bos taurus; identical to SEQ ID NO: 2676

SEQ ID NO: 44268 - DNA, 201 bp, Bos taurus; identical to SEQ ID NO: 2677

SEQ ID NO: 44269 - DNA, 201 bp, Bos taurus; identical to SEQ ID NO: 2679

SEQ ID NO: 44270 - DNA, 201 bp, Bos taurus; identical to SEQ ID NO: 2681

SEQ ID NO: 44271 - DNA, 201 bp, Bos taurus; identical to SEQ ID NO: 2683

SEQ ID NO: 44272 - DNA, 201 bp, Bos taurus; identical to SEQ ID NO: 2684

SEQ ID NO: 44273 - DNA, 201 bp, Bos taurus; identical to SEQ ID NO: 2685

SEQ ID NO: 44274 - DNA, 201 bp, Bos taurus; identical to SEQ ID NO: 2688

SEQ ID NO: 44275 - DNA, 201 bp, Bos taurus; identical to SEQ ID NO: 2689

SEQ ID NO: 44276 - DNA, 201 bp, Bos taurus; identical to SEQ ID NO: 2691

SEQ ID NO: 44277 - DNA, 201 bp, Bos taurus; identical to SEQ ID NO: 2692

SEQ ID NO: 44278 - DNA, 201 bp, Bos taurus; identical to SEQ ID NO: 2694

SEQ ID NO: 44279 - DNA, 201 bp, Bos taurus; identical to SEQ ID NO: 2696

SEQ ID NO: 44280 - DNA, 201 bp, Bos taurus; identical to SEQ ID NO: 2697

SEQ ID NO: 44281 - DNA, 201 bp, Bos taurus; identical to SEQ ID NO: 2698

SEQ ID NO: 44282 - DNA, 201 bp, Bos taurus; identical to SEQ ID NO: 2701

SEQ ID NO: 44283 - DNA, 201 bp, Bos taurus; identical to SEQ ID NO: 2702

SEQ ID NO: 44284 - DNA, 201 bp, Bos taurus; identical to SEQ ID NO: 2703

SEQ ID NO: 44285 - DNA, 201 bp, Bos taurus; identical to SEQ ID NO: 2704

SEQ ID NO: 44286 - DNA, 201 bp, Bos taurus; identical to SEQ ID NO: 2705

SEQ ID NO: 44287 - DNA, 201 bp, Bos taurus; identical to SEQ ID NO: 2707

SEQ ID NO: 44288 - DNA, 201 bp, Bos taurus; identical to SEQ ID NO: 2708

SEQ ID NO: 44289 - DNA, 201 bp, Bos taurus; identical to SEQ ID NO: 2709

SEQ ID NO: 44290 - DNA, 201 bp, Bos taurus; identical to SEQ ID NO: 2710

SEQ ID NO: 44291 - DNA, 201 bp, Bos taurus; identical to SEQ ID NO: 2711

SEQ ID NO: 44292 - DNA, 201 bp, Bos taurus; identical to SEQ ID NO: 2713

SEQ ID NO: 44293 - DNA, 201 bp, Bos taurus; identical to SEQ ID NO: 2714

SEQ ID NO: 44294 - DNA, 201 bp, Bos taurus; identical to SEQ ID NO: 2715

SEQ ID NO: 44295 - DNA, 201 bp, Bos taurus; identical to SEQ ID NO: 2717

SEQ ID NO: 44296 - DNA, 201 bp, Bos taurus; identical to SEQ ID NO: 2718

SEQ ID NO: 44297 - DNA, 201 bp, Bos taurus; identical to SEQ ID NO: 2719

SEQ ID NO: 44298 - DNA, 201 bp, Bos taurus; identical to SEQ ID NO: 2720

SEQ ID NO: 44299 - DNA, 201 bp, Bos taurus; identical to SEQ ID NO: 2722

SEQ ID NO: 44300 - DNA, 201 bp, Bos taurus; identical to SEQ ID NO: 2723

SEQ ID NO: 44301 - DNA, 201 bp, Bos taurus; identical to SEQ ID NO: 2724

SEQ ID NO: 44302 - DNA, 201 bp, Bos taurus; identical to SEQ ID NO: 2725

SEQ ID NO: 44303 - DNA, 201 bp, Bos taurus; identical to SEQ ID NO: 2726

SEQ ID NO: 44304 - DNA, 201 bp, Bos taurus; identical to SEQ ID NO: 2727

SEQ ID NO: 44305 - DNA, 201 bp, Bos taurus; identical to SEQ ID NO: 2729

SEQ ID NO: 44306 - DNA, 201 bp, Bos taurus; identical to SEQ ID NO: 2730

SEQ ID NO: 44307 - DNA, 201 bp, Bos taurus; identical to SEQ ID NO: 2731

SEQ ID NO: 44308 - DNA, 201 bp, Bos taurus; identical to SEQ ID NO: 2732

SEQ ID NO: 44309 - DNA, 201 bp, Bos taurus; identical to SEQ ID NO: 2733

SEQ ID NO: 44310 - DNA, 201 bp, Bos taurus; identical to SEQ ID NO: 2734

SEQ ID NO: 44311 - DNA, 201 bp, Bos taurus; identical to SEQ ID NO: 2735

SEQ ID NO: 44312 - DNA, 201 bp, Bos taurus; identical to SEQ ID NO: 2736

SEQ ID NO: 44313 - DNA, 201 bp, Bos taurus; identical to SEQ ID NO: 2737

SEQ ID NO: 44314 - DNA, 201 bp, Bos taurus; identical to SEQ ID NO: 2740

SEQ ID NO: 44315 - DNA, 201 bp, Bos taurus; identical to SEQ ID NO: 2741

SEQ ID NO: 44316 - DNA, 201 bp, Bos taurus
ctgctgcctttttcttacctggtgagggaagaagaagagacagacacataagctgggctatacgtggagagaaacgccacgtcccaatcctccaccccaagcctctgctgcctcctagggcttcttggcctggaggaagggtgagcctgagggtctcagagcccatgaacattattccgctttgcagctccagaggctgtg

SEQ ID NO: 44317 - DNA, 201 bp, Bos taurus; identical to SEQ ID NO: 2742

SEQ ID NO: 44318 - DNA, 201 bp, Bos taurus; identical to SEQ ID NO: 2743

SEQ ID NO: 44319 - DNA, 201 bp, Bos taurus
aaatagaattctgcaggcctgtgatcctcttcccccttcttcccttcgactctgcctccattctagagtcagccaaatggcaaaggaagaaggaatctgtcccaggggcctgggctcagagagactccggaattaagaagctaggtaaggttaaaactcaagccccatgagtatatcagaaaggagtggtcatcagctcct

SEQ ID NO: 44320 - DNA, 201 bp, Bos taurus
ctggaaatgggatggccttctcgcagtagtctctcctggagtgatcattagcttcatgctatggttatctcctaggtggtcctgaaagctctgcatctctatgaatcacagttgcttggcctctgccccctgagggtcctggatctcagtgatacttgtaaatatgtggtttcaattgagggagaaagttctcccgctttg

SEQ ID NO: 44321 - DNA, 201 bp, Bos taurus; identical to SEQ ID NO: 2746

SEQ ID NO: 44322 - DNA, 201 bp, Bos taurus
gcttactactcctgaaccacattccagtaaataggaggcccagctgaaaggttgtttcccaagagattctcaagtctctcttatatccttgaaataactcacaaccactcaaggccacctgaataaagccccaaagcctaaaacaatatagatgggaacagagccctggatgggggtgtgaatctgctgggcaatgtgcgg

SEQ ID NO: 44323 - DNA, 201 bp, Bos taurus
ggcagccctggagatggccagcacctggtcactttctgggtgtggacctctgctcagggccttcctggctgagaatgaaggtgtacaggcctaggcctccgtggctgtctctgtaacagcctgagtcactctactgagaaactgaagactggaggaaggggctctcctggcccagaagttagaactcacccctcccagcga

SEQ ID NO: 44324 - DNA, 201 bp, Bos taurus
cggaacatcagaagacttggactatttttaagattattatattaataagattaggattataaggtgctctccaataggaactcctcttataagtgttctcagatacctagtatggcgctaggcacatgggctttcagtaagtacataacaactgatatccaaagacatgtcaaaatagttatttttcgttggtaactctct

SEQ ID NO: 44325 - DNA, 201 bp, Bos taurus; identical to SEQ ID NO: 2748

SEQ ID NO: 44326 - DNA, 201 bp, Bos taurus; identical to SEQ ID NO: 2750

SEQ ID NO: 44327 - DNA, 201 bp, Bos taurus
gggctaggccccctgctggatagggtatctccagcatgtatcactttgccaacatcttttgatttagaaagagctgggtttcccaacatttaacactgaatttggccttgggccccaattgtatgggaagtagagaaatgcccaatttctcaacccaggttctttctagcttttgattctccctgtttgacttctccagga

SEQ ID NO: 44328 - DNA, 201 bp, Bos taurus; identical to SEQ ID NO: 2751

SEQ ID NO: 44329 - DNA, 201 bp, Bos taurus; identical to SEQ ID NO: 2752

SEQ ID NO: 44330 - DNA, 201 bp, Bos taurus
ttggggcacagagagctcattagtaaggcactgggttttcctcataggaattaaggcccccaggaggagcgcttcaaaggaaatatcctcagactcctgacccatcccttacacagagcccaacagcaggtaaagaatggcgggggtgcaacagcggggcccaaggtttggggcatcccgtcttctgcctgccctagtttt

SEQ ID NO: 44331 - DNA, 201 bp, Bos taurus
tgtgagaccaactgacacagcaggactgttagaggaaatgcctatcatatgctcagtgtgaagtgtggcatgtactagtcattcagtacatgacagctgcaattaactgctgaagacactatatgctagccctgtaaagaaggcaagaatgaaaaagattccttatatgatcttgttaaaaattcaattaaaaaaatggta

SEQ ID NO: 44332 - DNA, 201 bp, Bos taurus
ctctgcactttgacggccgtctcatggtatgccaccctggtgacccaggagttcttcaaccccagcacacctgtcaacgccaggtgagtgccaggacatggcttgagccatggctgggcctctcgctccaccttctctgaggccactggccttcgtccagcagggtgcccggaggggaaacaagggacaggccccaggagc

SEQ ID NO: 44333 - DNA, 201 bp, Bos taurus
tattttttatacatatttctggttaaaagtgtaatcccctcctacccattagactagctatcaccaaaaagacaagagataacaaatgctggagaaaatatgggaaaaagggaacgcttctggactgttggtgggaatgtaaattggtacagccactgtggaagacagtatggaggttcctaaaaaaattaaaaagagaac

SEQ ID NO: 44334 - DNA, 201 bp, Bos taurus; identical to SEQ ID NO: 2754

SEQ ID NO: 44335 - DNA, 201 bp, Bos taurus
ggaagatagtgaagaacaggggagcctggcgtgctatagtccatggggtcacagagctggacacgacttagcgactgaacaacaattcacctttgaagccccaaaatcctgagggcctaccacacagtaggtatcaacaaaataagcattgccattcaggcatccatcatcctttttatagtgtgaagaaggctgatattc

SEQ ID NO: 44336 - DNA, 201 bp, Bos taurus
tttttagagtttaaaaaaatgtttatattctctgacctagtcatcacaccatgaagggaataaccttatataatagggaaaaaagctttatgcacaaatacgctgacggcacaattattcaaaatactggaaaatcaaaatactggtatacagtagtcatttgatatttgttgatgagtaaataaaatattatcatctaag

SEQ ID NO: 44337 - DNA, 201 bp, Bos taurus; identical to SEQ ID NO: 2756

SEQ ID NO: 44338 - DNA, 201 bp, Bos taurus; identical to SEQ ID NO: 2757

SEQ ID NO: 44339 - DNA, 201 bp, Bos taurus; identical to SEQ ID NO: 2758

SEQ ID NO: 44340 - DNA, 201 bp, Bos taurus; identical to SEQ ID NO: 2759

SEQ ID NO: 44341 - DNA, 201 bp, Bos taurus; identical to SEQ ID NO: 2760

SEQ ID NO: 44342 - DNA, 201 bp, Bos taurus; identical to SEQ ID NO: 2761

SEQ ID NO: 44343 - DNA, 201 bp, Bos taurus; identical to SEQ ID NO: 2762

SEQ ID NO: 44344 - DNA, 201 bp, Bos taurus
ttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccagg

SEQ ID NO: 44345 - DNA, 201 bp, Bos taurus; identical to SEQ ID NO: 2767

SEQ ID NO: 44346 - DNA, 201 bp, Bos taurus
gcctttccagagagaccgtcggtctatacctgtcaggccatctgatgacaactgcccaggcctcctgaaaaggcctgggagtccccagcacaggcccagacacccacacagtggctggagacaggtccaagagaggatgagacagagaatggaagaggaggaggagaagcaagaggaggtggcagccccggggggccccta

SEQ ID NO: 44347 - DNA, 201 bp, Bos taurus; identical to SEQ ID NO: 2769

SEQ ID NO: 44348 - DNA, 201 bp, Bos taurus; identical to SEQ ID NO: 2770

SEQ ID NO: 44349 - DNA, 201 bp, Bos taurus; identical to SEQ ID NO: 2771

SEQ ID NO: 44350 - DNA, 201 bp, Bos taurus
gacagcccccacagcaaggccgtctctacaggggctcaaccggagaaccccctgaccactccttaaaattagaaggcacacatcactactcaactctgaacgcataaataacccatcagtctaacagcaacaccaaaattcacattgtctcgttataaaaaattttataaccctgaaaatttaagacccaaatgcccaaca

SEQ ID NO: 44351 - DNA, 201 bp, Bos taurus
tgacttcacccccagtgctttcgcaaactctgaatcacagcatcccaggcccctcagaaggccctgctgctgccgtaggccgctggggggacacttggaacgcagaaagaatcgagcgttcagcgcaggggaagtggatgagggctgcagagggcagtgaagaccggcccgagccggctcccaggtcatcacacctgatgg

SEQ ID NO: 44352 - DNA, 201 bp, Bos taurus; identical to SEQ ID NO: 2772

SEQ ID NO: 44353 - DNA, 201 bp, Bos taurus
aatacaatatataatgaacttgtttttgttctaagtttccaatttcagtttgctgggagaaattaactaggtgtcttagatatccaaacagagaccttttctgaggccaaatcaacccacctgtaaagactgaaggaagagtacccaggcttcacatggcagttcactttcagacactgaaagcagtaattcaaaacaact

SEQ ID NO: 44354 - DNA, 201 bp, Bos taurus; identical to SEQ ID NO: 2773

SEQ ID NO: 44355 - DNA, 201 bp, Bos taurus; identical to SEQ ID NO: 2774

SEQ ID NO: 44356 - DNA, 201 bp, Bos taurus
atataccataaatagtacaataggtagccactgccttcagcaaataaggtgagtttaattctgggattgatttatatatgtgtgtttgttaaaattggccattttaaggggctccagaaaatatacctaaaagcagaatataggatgaaaatgtatctacaaatttatctacatatctgatagaatgtgctggtagagact

SEQ ID NO: 44357 - DNA, 201 bp, Bos taurus; identical to SEQ ID NO: 2775

SEQ ID NO: 44358 - DNA, 201 bp, Bos taurus; identical to SEQ ID NO: 2776

SEQ ID NO: 44359 - DNA, 201 bp, Bos taurus; identical to SEQ ID NO: 2777

SEQ ID NO: 44360 - DNA, 201 bp, Bos taurus; identical to SEQ ID NO: 2778

SEQ ID NO: 44361 - DNA, 201 bp, Bos taurus; identical to SEQ ID NO: 2779

SEQ ID NO: 44362 - DNA, 201 bp, Bos taurus; identical to SEQ ID NO: 2780

SEQ ID NO: 44363 - DNA, 201 bp, Bos taurus; identical to SEQ ID NO: 2781

SEQ ID NO: 44364 - DNA, 201 bp, Bos taurus; identical to SEQ ID NO: 2782

SEQ ID NO: 44365 - DNA, 201 bp, Bos taurus; identical to SEQ ID NO: 2783

SEQ ID NO: 44366 - DNA, 201 bp, Bos taurus; identical to SEQ ID NO: 2784

SEQ ID NO: 44367 - DNA, 201 bp, Bos taurus; identical to SEQ ID NO: 2785

SEQ ID NO: 44368 - DNA, 201 bp, Bos taurus; identical to SEQ ID NO: 2786

SEQ ID NO: 44369 - DNA, 201 bp, Bos taurus
cacatgtgatcaagcccctctgatgtcacttccaaacacacagagttgttaaatgaataagtgggtgggcagcaggggtgactgtgctcctggccaagccggcatcaccacccttcctctccaggctcttagctgatctgcctcatgctccctgcccccaagggatggcttagccccttccctgtcctttgtgagatctgc

SEQ ID NO: 44370 - DNA, 201 bp, Bos taurus; identical to SEQ ID NO: 2790

SEQ ID NO: 44371 - DNA, 201 bp, Bos taurus; identical to SEQ ID NO: 2794

SEQ ID NO: 44372 - DNA, 201 bp, Bos taurus; identical to SEQ ID NO: 2795

SEQ ID NO: 44373 - DNA, 201 bp, Bos taurus; identical to SEQ ID NO: 2796

SEQ ID NO: 44374 - DNA, 201 bp, Bos taurus; identical to SEQ ID NO: 2798

SEQ ID NO: 44375 - DNA, 201 bp, Bos taurus; identical to SEQ ID NO: 2799

SEQ ID NO: 44376 - DNA, 201 bp, Bos taurus; identical to SEQ ID NO: 2800

SEQ ID NO: 44377 - DNA, 201 bp, Bos taurus; identical to SEQ ID NO: 2803

SEQ ID NO: 44378 - DNA, 201 bp, Bos taurus; identical to SEQ ID NO: 2804

SEQ ID NO: 44379 - DNA, 201 bp, Bos taurus; identical to SEQ ID NO: 2805

SEQ ID NO: 44380 - DNA, 201 bp, Bos taurus; identical to SEQ ID NO: 2806

SEQ ID NO: 44381 - DNA, 201 bp, Bos taurus; identical to SEQ ID NO: 2807

SEQ ID NO: 44382 - DNA, 201 bp, Bos taurus; identical to SEQ ID NO: 2808

SEQ ID NO: 44383 - DNA, 201 bp, Bos taurus; identical to SEQ ID NO: 2809

SEQ ID NO: 44384 - DNA, 201 bp, Bos taurus; identical to SEQ ID NO: 2811

SEQ ID NO: 44385 - DNA, 201 bp, Bos taurus; identical to SEQ ID NO: 2812

SEQ ID NO: 44386 - DNA, 201 bp, Bos taurus; identical to SEQ ID NO: 2813

SEQ ID NO: 44387 - DNA, 201 bp, Bos taurus
aggtggccaaagtattggagcttcagctacagcatcagtccttccaatgaatattcagggttgatgtcctttcggattgactggtttgatctcagttggtgttggtggagtgcaagaaggcctgaatgaatgtgtgaataatgagtctcttcttcagcttccttgctgacccctcaaagcatttcagaccccatctccttt

SEQ ID NO: 44388 - DNA, 201 bp, Bos taurus; identical to SEQ ID NO: 2814

SEQ ID NO: 44389 - DNA, 201 bp, Bos taurus; identical to SEQ ID NO: 2815

SEQ ID NO: 44390 - DNA, 201 bp, Bos taurus
gctcagcttctcctgtccacaaggttggccggtatgggctgagcttggccaggcagattggctctgcttctcatgttctcatcctcctggggccagccacgtctcctcccagtgatggctgagattcaagtcagcacgcctaatctgtcaggcaccctacaagcctttggacatgttaaggcctccataatgaccaaaccc

SEQ ID NO: 44391 - DNA, 201 bp, Bos taurus; identical to SEQ ID NO: 2816

SEQ ID NO: 44392 - DNA, 201 bp, Bos taurus; identical to SEQ ID NO: 2822

SEQ ID NO: 44393 - DNA, 201 bp, Bos taurus; identical to SEQ ID NO: 2823

SEQ ID NO: 44394 - DNA, 201 bp, Bos taurus; identical to SEQ ID NO: 2824

SEQ ID NO: 44395 - DNA, 201 bp, Bos taurus; identical to SEQ ID NO: 2825

SEQ ID NO: 44396 - DNA, 201 bp, Bos taurus; identical to SEQ ID NO: 2826

SEQ ID NO: 44397 - DNA, 201 bp, Bos taurus
ttgtgaatgaaccttagttttaaattctcatgtgtgaactttgcttcctgagaatcccatccaggtggaattacctgacaaagactgtgcggagttgaactgcctgattaatatctgtaaggtatgcagagcagcgcaaggcacctcggaagtgcatttttagcattaactatttattagaaacattcttgtcgtacttgt

SEQ ID NO: 44398 - DNA, 201 bp, Bos taurus; identical to SEQ ID NO: 2828

SEQ ID NO: 44399 - DNA, 201 bp, Bos taurus; identical to SEQ ID NO: 2830

SEQ ID NO: 44400 - DNA, 201 bp, Bos taurus; identical to SEQ ID NO: 2833

SEQ ID NO: 44401 - DNA, 201 bp, Bos taurus; identical to SEQ ID NO: 2835

SEQ ID NO: 44402 - DNA, 201 bp, Bos taurus; identical to SEQ ID NO: 2837

SEQ ID NO: 44403 - DNA, 201 bp, Bos taurus
accccttggagccatacttagctgctgggggaccacagtggtggttacccatagatggcagggacacagcagactctgctcctaagggcccatgagagagctggagatgcttgggtccctgcctgcatctgggaagtagcaccttgttcctcctctgcaaggttgatgctctcttgttctcagaggtaggccactgggctc

SEQ ID NO: 44404 - DNA, 201 bp, Bos taurus; identical to SEQ ID NO: 2838

SEQ ID NO: 44405 - DNA, 201 bp, Bos taurus; identical to SEQ ID NO: 2840

SEQ ID NO: 44406 - DNA, 201 bp, Bos taurus; identical to SEQ ID NO: 2841

SEQ ID NO: 44407 - DNA, 201 bp, Bos taurus
tggggctcctggcaagcaggtatgctcagcagagccaaacaactcctatgtccttgtcctgagagacagtggagagctgagggcatcagaggctgcactgcggccccagatcccagctcagggctccagtccagtttttccagtacaaaaggctgattcattacatccggatgtccaaattctatgtgtgactttcaactg

SEQ ID NO: 44408 - DNA, 201 bp, Bos taurus; identical to SEQ ID NO: 2845

SEQ ID NO: 44409 - DNA, 201 bp, Bos taurus; identical to SEQ ID NO: 2846

SEQ ID NO: 44410 - DNA, 201 bp, Bos taurus
tatagagcttatgcaaatataaatgaagattccttaggtaaaggaataaaatgaatctgagatgccagtgtttgaacaaacaagcagagagtgagcacagggatgaaaatgagatagaaacgtccatttctatgaccgtgtcgtgggggtggtttagactgtgactagaagaagcctgtgtggtggtgtccgtggggcaac

SEQ ID NO: 44411 - DNA, 201 bp, Bos taurus; identical to SEQ ID NO: 2847

SEQ ID NO: 44412 - DNA, 201 bp, Bos taurus; identical to SEQ ID NO: 2849

SEQ ID NO: 44413 - DNA, 201 bp, Bos taurus; identical to SEQ ID NO: 2850

SEQ ID NO: 44414 - DNA, 201 bp, Bos taurus; identical to SEQ ID NO: 2851

SEQ ID NO: 44415 - DNA, 201 bp, Bos taurus; identical to SEQ ID NO: 2852

SEQ ID NO: 44416 - DNA, 201 bp, Bos taurus
agtgaatcccctgacagacgaaagactttcctaatgcagaggcggacagaataaatgtgcaatttgtccacgacaaagactgtgccaccaaaggccttcatcttctacaggaacgagactagtcagggaccatacttgtggggaccacagcctgtgtgcggggtgagcaagaaaagggccgcttcaggggaggcttctggg

SEQ ID NO: 44417 - DNA, 201 bp, Bos taurus; identical to SEQ ID NO: 2854

SEQ ID NO: 44418 - DNA, 201 bp, Bos taurus; identical to SEQ ID NO: 2855

SEQ ID NO: 44419 - DNA, 201 bp, Bos taurus; identical to SEQ ID NO: 2856

SEQ ID NO: 44420 - DNA, 201 bp, Bos taurus; identical to SEQ ID NO: 2857

SEQ ID NO: 44421 - DNA, 201 bp, Bos taurus
cctatgctaatgacagttacccagttcctctcagccctggggttctgtcctgtctccttcacagatccagccactggggcaggacagctggccaggagacctcccgaagagttgtattctcaagcagatgctaggctgtgcatcccagggagtgtgggcagggcccctcgggttgctggccgcctctcaacaaaccatcta

SEQ ID NO: 44422 - DNA, 201 bp, Bos taurus; identical to SEQ ID NO: 2858

SEQ ID NO: 44423 - DNA, 201 bp, Bos taurus
acttcctgcttccagagaagagaatcgtgtggtcagcttgcatcatgttgaataaatgcctttcgggtcactgaccagtgtgccactgaaggccatttcgcactaaattccttacaagggtcttgaccgtgaagcttgggagtgctcagaaggtgaccaaggatccaaagagggtccccaaagtccctgcgggaaactccc

SEQ ID NO: 44424 - DNA, 201 bp, Bos taurus
actggggtgaggaggtcgatcatgaatgtgggaagccacagctcagctcaaaacaacccagaaggtcaggagggaccttctctgggcttggccccagcgctgcacaagaattccaagtgtttcctcacataatcccagcgtgctccgtatgccagcgagtcatcagtcctgagctgaaggcccagaggaatgtgccagagg

SEQ ID NO: 44425 - DNA, 201 bp, Bos taurus; identical to SEQ ID NO: 2860

SEQ ID NO: 44426 - DNA, 201 bp, Bos taurus; identical to SEQ ID NO: 2861

SEQ ID NO: 44427 - DNA, 201 bp, Bos taurus
gacgaagagggtcaggtccacagacacatgtagcaccatattgataggttacgcggcagaggcttcctcccaagtccgggtgtaaatcaaagcatgagacggtacagtgcgagggaatctacacccagagctcctacaaagacaacggcgatggctgactccttcttcttcaagaggtatgtgtcgctggtcggccacgcc

SEQ ID NO: 44428 - DNA, 201 bp, Bos taurus
ctcctttccccggggtgccctcttcaccaccagagattaggagagtcccagcccagccctcaaagggacttgcctgcccagctaccccaagagacagggacattaaagggccctcccgtgggacccaccttccacgctgatcttcctgaagtcatggacgagacagccatcccgccttgcttgtccggtccacttcaaatc

SEQ ID NO: 44429 - DNA, 201 bp, Bos taurus
ggtggaccgaggttacaggactggccaaggcgggcaccacgttcttggcagagcgcagctccccgcacgggcagtgtcggtcccagacctgatcgttccttctcggtgcctctccctgcagaaaaaaatcagacggtgacgctgacaataataattagcttttcactgacttcagtgctaatcctccttcaagtcgctttg

SEQ ID NO: 44430 - DNA, 201 bp, Bos taurus; identical to SEQ ID NO: 2863

SEQ ID NO: 44431 - DNA, 201 bp, Bos taurus; identical to SEQ ID NO: 2864

SEQ ID NO: 44432 - DNA, 201 bp, Bos taurus; identical to SEQ ID NO: 2865

SEQ ID NO: 44433 - DNA, 201 bp, Bos taurus; identical to SEQ ID NO: 2866

SEQ ID NO: 44434 - DNA, 201 bp, Bos taurus; identical to SEQ ID NO: 2867

SEQ ID NO: 44435 - DNA, 201 bp, Bos taurus; identical to SEQ ID NO: 2868

SEQ ID NO: 44436 - DNA, 201 bp, Bos taurus; identical to SEQ ID NO: 2869

SEQ ID NO: 44437 - DNA, 201 bp, Bos taurus
acacggcctccttccaggccttaatgctgcccccccaccccgcaaaaaaaactccacaatcaaaactgttgataacacacgttcgtctggccacagatttatttttatcctttataggagtggaagcacggagcatatatgttttgtgtctggcttcactcactcactttgtatatgtgcggtttgtatgtgtagacgtag

SEQ ID NO: 44438 - DNA, 201 bp, Bos taurus
tgcgaggctggcgggctgccagggaagagtggccagtccagaacccccagttctcagtgtctgcactgctctggctctctgcatttgccctgagacacatgaacacctgtcctgcaggcccatcaggtaggtgtctttcggtcagagttagtgaccacggggggcaggggaccgggctctgcaggggcggctgtcaccatg

SEQ ID NO: 44439 - DNA, 201 bp, Bos taurus
gccctgcaccccactcttctttgcaggagccaagcgtcctcctgccggcccagcccatccacaccatatccgggccaggccccctcagagggaaacctctgtgtttccacctgacacgtgaagccggtccgcctagtcgcacagggttaagtggtggaggtttagtccctaagtcgtgccaactcttgcgaccccatggac

SEQ ID NO: 44440 - DNA, 201 bp, Bos taurus; identical to SEQ ID NO: 2871

SEQ ID NO: 44441 - DNA, 201 bp, Bos taurus
acgacgggcctggccaccatgcacctcaccggtaggaccaatttcaaatcgcagggcttccaagaccgactgcctcagcaccactaaggcggtgaatggacgtgtgtggagatccctctctggggtcacagagtcactgagcaggagaaagaggacaaggggcccaaacccgttaggtgtgagaggtaaactcaaagggtg

SEQ ID NO: 44442 - DNA, 201 bp, Bos taurus; identical to SEQ ID NO: 2873

SEQ ID NO: 44443 - DNA, 201 bp, Bos taurus; identical to SEQ ID NO: 2874

SEQ ID NO: 44444 - DNA, 201 bp, Bos taurus; identical to SEQ ID NO: 2875

SEQ ID NO: 44445 - DNA, 201 bp, Bos taurus; identical to SEQ ID NO: 2876

SEQ ID NO: 44446 - DNA, 201 bp, Bos taurus; identical to SEQ ID NO: 2878

SEQ ID NO: 44447 - DNA, 201 bp, Bos taurus; identical to SEQ ID NO: 2879

SEQ ID NO: 44448 - DNA, 201 bp, Bos taurus; identical to SEQ ID NO: 2880

SEQ ID NO: 44449 - DNA, 201 bp, Bos taurus; identical to SEQ ID NO: 2881

SEQ ID NO: 44450 - DNA, 201 bp, Bos taurus
cagggagcaaaggcggacggcttctcccagaccaggacccggaagggcgccggctgccgccttctctgcgcggctgcacagcactgcagtccagccagagcggccagcaagacacaaaagggacccacacgggaacggaagcggcacaactgtttctgcagatggtcatacgtgacatcctaaggcttcctttagctcgta

SEQ ID NO: 44451 - DNA, 201 bp, Bos taurus; identical to SEQ ID NO: 2882

SEQ ID NO: 44452 - DNA, 201 bp, Bos taurus
tgagcacctctggggcgtcctttacctccttaggctggcttctgggcagcatgaatgtcttgcactctcttcccaacactgggggtgtccaggagacctcggagcagcagagggcccaagggtccccagggaactcaggacagccagtctcttgggagccaggaggcgcccccccccattgctgccttcactgtcagcccc

SEQ ID NO: 44453 - DNA, 201 bp, Bos taurus; identical to SEQ ID NO: 2883

SEQ ID NO: 44454 - DNA, 201 bp, Bos taurus; identical to SEQ ID NO: 2884

SEQ ID NO: 44455 - DNA, 201 bp, Bos taurus; identical to SEQ ID NO: 2885

SEQ ID NO: 44456 - DNA, 201 bp, Bos taurus; identical to SEQ ID NO: 2886

SEQ ID NO: 44457 - DNA, 201 bp, Bos taurus; identical to SEQ ID NO: 2887

SEQ ID NO: 44458 - DNA, 201 bp, Bos taurus; identical to SEQ ID NO: 2889

SEQ ID NO: 44459 - DNA, 201 bp, Bos taurus; identical to SEQ ID NO: 2890

SEQ ID NO: 44460 - DNA, 201 bp, Bos taurus; identical to SEQ ID NO: 2891

SEQ ID NO: 44461 - DNA, 201 bp, Bos taurus; identical to SEQ ID NO: 2892

SEQ ID NO: 44462 - DNA, 201 bp, Bos taurus; identical to SEQ ID NO: 2893

SEQ ID NO: 44463 - DNA, 201 bp, Bos taurus; identical to SEQ ID NO: 2894

SEQ ID NO: 44464 - DNA, 201 bp, Bos taurus; identical to SEQ ID NO: 2895

SEQ ID NO: 44465 - DNA, 201 bp, Bos taurus; identical to SEQ ID NO: 2896

SEQ ID NO: 44466 - DNA, 201 bp, Bos taurus; identical to SEQ ID NO: 2897

SEQ ID NO: 44467 - DNA, 201 bp, Bos taurus; identical to SEQ ID NO: 2899

SEQ ID NO: 44468 - DNA, 201 bp, Bos taurus; identical to SEQ ID NO: 2902

SEQ ID NO: 44469 - DNA, 201 bp, Bos taurus; identical to SEQ ID NO: 2904

SEQ ID NO: 44470 - DNA, 201 bp, Bos taurus; identical to SEQ ID NO: 2905

SEQ ID NO: 44471 - DNA, 201 bp, Bos taurus; identical to SEQ ID NO: 2906

SEQ ID NO: 44472 - DNA, 201 bp, Bos taurus; identical to SEQ ID NO: 2907

SEQ ID NO: 44473 - DNA, 201 bp, Bos taurus; identical to SEQ ID NO: 2908

SEQ ID NO: 44474 - DNA, 201 bp, Bos taurus; identical to SEQ ID NO: 2911

SEQ ID NO: 44475 - DNA, 201 bp, Bos taurus; identical to SEQ ID NO: 2912

SEQ ID NO: 44476 - DNA, 201 bp, Bos taurus; identical to SEQ ID NO: 2914

SEQ ID NO: 44477 - DNA, 201 bp, Bos taurus; identical to SEQ ID NO: 2915

SEQ ID NO: 44478 - DNA, 201 bp, Bos taurus; identical to SEQ ID NO: 2916

SEQ ID NO: 44479 - DNA, 201 bp, Bos taurus; identical to SEQ ID NO: 2917

SEQ ID NO: 44480 - DNA, 201 bp, Bos taurus; identical to SEQ ID NO: 2918

SEQ ID NO: 44481 - DNA, 201 bp, Bos taurus; identical to SEQ ID NO: 2921

SEQ ID NO: 44482 - DNA, 201 bp, Bos taurus
cttagggtataataggcagcaactagacgtggtggcaataaggatatccttcttcccttagagccatcatgaccgctgctcttctggttgaggccacagaaaaatcactgtgggaccccctttactgatccttgtacctcattccgtagaaactcttctgaattgtcatcacactcaacaattctgtcatcggcctcaatc

SEQ ID NO: 44483 - DNA, 201 bp, Bos taurus; identical to SEQ ID NO: 2923

SEQ ID NO: 44484 - DNA, 201 bp, Bos taurus
agacattatttaaaaaggaataataattgtaaaacaaagagatgagcctggtggttctcaatatcagaaatactctggcagcttaaaacagggcccctcccctgctgtgaagtcgtgctttctctggtcaggggtgcagcccagtcctggagtttcaggagctccctgaaggggtttgcggcacagcccagtggtggggcc

SEQ ID NO: 44485 - DNA, 201 bp, Bos taurus; identical to SEQ ID NO: 2924

SEQ ID NO: 44486 - DNA, 201 bp, Bos taurus
gagaccttgggcgacactcctacccggaggcccagggaggagacaagccttcaccctacttttcccacttcttcctgttctccacccaaaagcactggcatcggaggccaggatgggggaggacccggcagaaagtaggaggcaacctgggtctggggacgggcagggctgaggttggaggccgggatacacatgcagggg

SEQ ID NO: 44487 - DNA, 201 bp, Bos taurus
gagcatttcctgacctaaacacacaaaagtaggtgatccagggagtgtcattcatatcctgggtcaaacgggaggtccactgctacaggccagtctggcttcacgttgggaaggaagatggatcatgagccctgccaggaggaagcaaagtgaaaatttcctttttccttggggccccaggcccccagcagcagagcagta

SEQ ID NO: 44488 - DNA, 201 bp, Bos taurus; identical to SEQ ID NO: 2928

SEQ ID NO: 44489 - DNA, 201 bp, Bos taurus
gcctctttaccgcactcctcctcctttggggagcttaggggagatacccacgccgtttctcttcgcatgtgcagctctgccttctgtcaactaaacagagtttctctatgtgcgctcccacttgttctcgtactctgtctttaataataagctttgtacttgcatttaccatttctgcctccatgataaacgtctttttca

SEQ ID NO: 44490 - DNA, 201 bp, Bos taurus; identical to SEQ ID NO: 2929

SEQ ID NO: 44491 - DNA, 201 bp, Bos taurus; identical to SEQ ID NO: 2930

SEQ ID NO: 44492 - DNA, 201 bp, Bos taurus; identical to SEQ ID NO: 2931

SEQ ID NO: 44493 - DNA, 201 bp, Bos taurus
gcctcaaacagcaggactgtggtcactcagggggcaggatccaggaggcccaggggccagcagggggagggttcacatgtcggtgtcctgtttgtcccccggcctttgtgcagctttagccaagcccagctcatcagatgcacacctggacatatactgtttcctgggaataaactgcacttcagtaacgttgactgacag

SEQ ID NO: 44494 - DNA, 201 bp, Bos taurus; identical to SEQ ID NO: 2932

SEQ ID NO: 44495 - DNA, 201 bp, Bos taurus; identical to SEQ ID NO: 2934

SEQ ID NO: 44496 - DNA, 201 bp, Bos taurus; identical to SEQ ID NO: 2935

SEQ ID NO: 44497 - DNA, 201 bp, Bos taurus; identical to SEQ ID NO: 2936

SEQ ID NO: 44498 - DNA, 201 bp, Bos taurus; identical to SEQ ID NO: 2939

SEQ ID NO: 44499 - DNA, 201 bp, Bos taurus
tatttatgtaaaaaccttatatgttttagtacaaacacaagtcttatgtgacagggattagaaaaggagaagcaaagactgagatgcaaataggttgttcggttcagttcagtcactcagtcctgtcagactctttgcaaccccatgaatcacagcacgctaggcctccctgtccgtcaccaactcccagagttcactcaa

SEQ ID NO: 44500 - DNA, 201 bp, Bos taurus
tctaaaagcgttgcccagaagaacagcagcagttgtagagtgaatgagagggagatgcaggaagatgaagtggagcataatgtagtgcaggccagaagagatgctagccacgagccaagatagagactggggggcggaagagtgactgggtttggtctatagttaccaggcacctagtctaaagatattccttttattttt

SEQ ID NO: 44501 - DNA, 201 bp, Bos taurus; identical to SEQ ID NO: 2940

SEQ ID NO: 44502 - DNA, 201 bp, Bos taurus; identical to SEQ ID NO: 2941

SEQ ID NO: 44503 - DNA, 201 bp, Bos taurus
tttttcccccctaaatattaggctacttaattcatttcagttaagatatatcttttttttgtgtgtgtcattttatggccccttgacagatttgcttcttaaattctatgttctattggattgcacattgtatgtaagaaagctgtgaacatttttacaaatcttataatttgtcattttactgaattttcttgttttata

SEQ ID NO: 44504 - DNA, 201 bp, Bos taurus; identical to SEQ ID NO: 2944

SEQ ID NO: 44505 - DNA, 201 bp, Bos taurus; identical to SEQ ID NO: 2945

SEQ ID NO: 44506 - DNA, 201 bp, Bos taurus; identical to SEQ ID NO: 2946

SEQ ID NO: 44507 - DNA, 201 bp, Bos taurus; identical to SEQ ID NO: 2947

SEQ ID NO: 44508 - DNA, 201 bp, Bos taurus
acttcctaggctataaagagctccttcaaaggttatatataacctcctctgaaaactctaaccaagtaccttctcatgataagcaaacagaggcctcaaaatgggaactttagagaaacataaaatcctcacatttacccctccaacttatctgactgactggtgggaaaacatagtatgattattgcaaagctggccaag

SEQ ID NO: 44509 - DNA, 201 bp, Bos taurus
agaggacccagggttcttttctcacgacaatccaactgtatttcctctgggagaaggatgctccctacgaatatgtggggttggaaccggaggccgtttagagctaaggaggggatgtttttgatgtctggagagttccaaccatgattagatttttgggtgcaaagactgcactgcgcattctcttcacggagcaatgtg

SEQ ID NO: 44510 - DNA, 201 bp, Bos taurus; identical to SEQ ID NO: 2950

SEQ ID NO: 44511 - DNA, 201 bp, Bos taurus
ccgttgatgagcactggcaatctacctgtctccctcacctcctcgtgggaaaaccttcctgctttccctgcagtgttcctcttcctcctatgctctgaattgcctgcattccagcttcctcaagtcctgccctcactctaccattgcccttcctactgtatctgggacttccccttctcttgtcccttgaccatgaacaac

SEQ ID NO: 44512 - DNA, 201 bp, Bos taurus; identical to SEQ ID NO: 2952

SEQ ID NO: 44513 - DNA, 201 bp, Bos taurus; identical to SEQ ID NO: 2953

SEQ ID NO: 44514 - DNA, 201 bp, Bos taurus; identical to SEQ ID NO: 2955

SEQ ID NO: 44515 - DNA, 201 bp, Bos taurus; identical to SEQ ID NO: 2957

SEQ ID NO: 44516 - DNA, 201 bp, Bos taurus
ttaaaaaatttcagcctactgccccatttaaaaatatatctattgtaatcaaattttggtgccaatccaatttggatgtccccttacaagagtggtgtgtggagtagactgacgcttgttggagtgtggcatttttgtgaccgaagctccagaatcatatcagcagttccagagactctgtacatcatctataaaacgtgt

SEQ ID NO: 44517 - DNA, 201 bp, Bos taurus
caagttaattgttcttaataatatgccatggggaaccattgactttatctgtgaagtttagtaagcaagaattaaagtgatgagtataaaatttctatttggacaagcagtgattacaaagtcagtccatgaactattgtaggagagcataagtaacacaaagagggtaacccatgatattagtaagtttactcatgacat

SEQ ID NO: 44518 - DNA, 201 bp, Bos taurus
aaatgtccttaaatgatttggcccctgcctgcctgtctaaccacatttctctctcctgtcattctaagtccctaccactggtcttaggtctttaagcatattgagctccttctggccctaaactttaactcttaatggcctttcagcctggaatattttccctctcagtaactcctacttaagtcctgtttatctttatac

SEQ ID NO: 44519 - DNA, 201 bp, Bos taurus; identical to SEQ ID NO: 2958

SEQ ID NO: 44520 - DNA, 201 bp, Bos taurus
gtaagccattcattccattcccaaatttctgtcttcctaagtttttccattttaatcttctgtatttagaaagaatttctgtcatatgaactttatttagtatacacagtcactgaggtattaggtaatcatctgagcaaatcatctgtcctatttgagatgatttgttgaatccaagatctcaggttaataaatttggct

SEQ ID NO: 44521 - DNA, 201 bp, Bos taurus; identical to SEQ ID NO: 2959

SEQ ID NO: 44522 - DNA, 201 bp, Bos taurus
atatcttccttaaaagccaagttttagaacagaggcaaatggttagtgattcattattgaaaactgtagtgcttttggcattttatttcaaaaactatttcacatctaggccacatgaaggacatattttaaaagccattagctactttctttaactttaaaaaaatcttaagtaggcctattggcttattgagtcactct

SEQ ID NO: 44523 - DNA, 201 bp, Bos taurus; identical to SEQ ID NO: 2960

SEQ ID NO: 44524 - DNA, 201 bp, Bos taurus
cctaccttgttgagtttctttttacagtgaattgacattgaattttatcaaatgccttttgtgcatcttttaaaatgatcacgtgctttgtcatttatttcgctaatgtgatcaattacaatgattgattgccttatgttacaactgttgcacaccgccagtaggatatacgtcagttactcatgatgtgttgtatattac

SEQ ID NO: 44525 - DNA, 201 bp, Bos taurus; identical to SEQ ID NO: 2962

SEQ ID NO: 44526 - DNA, 201 bp, Bos taurus; identical to SEQ ID NO: 2964

SEQ ID NO: 44527 - DNA, 201 bp, Bos taurus
aaaacgtggccactttgggtgaatcaaaacagacatctctatgcaccccagtcatttagcaaatcataccagtgcttggctagacaaatcctgcttgtccatagtaagactgtttgcagggtggggctcagaagttggagcatctagggatcccataggcatatttgcatttgtcagtgaggaaaggaagcaatgctacct

SEQ ID NO: 44528 - DNA, 201 bp, Bos taurus; identical to SEQ ID NO: 2965

SEQ ID NO: 44529 - DNA, 201 bp, Bos taurus
gaccccatgaatcgcagcacgccaggcctccccgtccatcaccaactcacggaggtcactcagactcatgtccatagtgatatgctttaatcgagtaactgctaggtgctacgtgccttgtatatcatttctgattcagtcctcaaaataatcttcacaggtggaaatatcactgtcctcattttacagaagaatacactg

SEQ ID NO: 44530 - DNA, 201 bp, Bos taurus
ctgccactccagtcttgtccatttgaccccaagtcttgcttgccacccacagggccaccccttcatcactgaggggccgtttgtcctgctaaggaaggcggatcatcaggtgatcatctcttcttgattagaaccttccccgcaaggccaaagtcacaatggggcggagcccccggcactgggagctggttcctgttgccc

SEQ ID NO: 44531 - DNA, 201 bp, Bos taurus
gtttacatttatttcctctgctcagtgatccaatggggaagtcaagtagccatttctttaccattctggcatacttttcaatgggattctaccatagaggactcatctgaagagagggaaagttgcatgccaaagactagaggggagagaaaatttcactttcactaaattttgctgattttcattgattcttccctgagc

SEQ ID NO: 44532 - DNA, 201 bp, Bos taurus; identical to SEQ ID NO: 2966

SEQ ID NO: 44533 - DNA, 201 bp, Bos taurus; identical to SEQ ID NO: 2967

SEQ ID NO: 44534 - DNA, 201 bp, Bos taurus; identical to SEQ ID NO: 2968

SEQ ID NO: 44535 - DNA, 201 bp, Bos taurus; identical to SEQ ID NO: 2969

SEQ ID NO: 44536 - DNA, 201 bp, Bos taurus; identical to SEQ ID NO: 2970

SEQ ID NO: 44537 - DNA, 201 bp, Bos taurus; identical to SEQ ID NO: 2971

SEQ ID NO: 44538 - DNA, 201 bp, Bos taurus; identical to SEQ ID NO: 2972

SEQ ID NO: 44539 - DNA, 201 bp, Bos taurus; identical to SEQ ID NO: 2974

SEQ ID NO: 44540 - DNA, 201 bp, Bos taurus; identical to SEQ ID NO: 2975

SEQ ID NO: 44541 - DNA, 201 bp, Bos taurus; identical to SEQ ID NO: 2976

SEQ ID NO: 44542 - DNA, 201 bp, Bos taurus; identical to SEQ ID NO: 2977

SEQ ID NO: 44543 - DNA, 201 bp, Bos taurus; identical to SEQ ID NO: 2979

SEQ ID NO: 44544 - DNA, 201 bp, Bos taurus; identical to SEQ ID NO: 2981

SEQ ID NO: 44545 - DNA, 201 bp, Bos taurus; identical to SEQ ID NO: 2982

SEQ ID NO: 44546 - DNA, 201 bp, Bos taurus; identical to SEQ ID NO: 2983

SEQ ID NO: 44547 - DNA, 201 bp, Bos taurus; identical to SEQ ID NO: 2984

SEQ ID NO: 44548 - DNA, 201 bp, Bos taurus
tgaggcaatgagaggttaggtgcctgaccatggccactaagcaagctgagagcaggacagaagcttcctgtgcaaatctaaggttcgtgttacccactccgtaaggccaaattgctacctcagaaactgcctttgccttagtttcctcagctgtaaatatatggtcatctcctttaaaaggcatttactcttagagctaag

SEQ ID NO: 44549 - DNA, 201 bp, Bos taurus
cacccatcatcttcatctctcctgggtgactaaggaagttgtagagaaaacctggtttggattcatgaaaagccccacagaaggcccctctacaggggaaagagagcctgccggggtcttctgcccacaggaagccaggctgcttcccctgctctagggctcggaacagccacaccttgctcacccgcctgagatctgcag

SEQ ID NO: 44550 - DNA, 201 bp, Bos taurus
cagattccagtgagactcctgccctgggatccctacgagtgcttggttttccttctccctcacgtgaactcttatggaaagttcccctatgctcttgctagcttgagtatggccatgctctttttaatctaaatgaaccgaaacagcacagaaaatgtgaatatggaaccatctgggcaaagcaagcactcttaagtcaaa

SEQ ID NO: 44551 - DNA, 201 bp, Bos taurus; identical to SEQ ID NO: 2985

SEQ ID NO: 44552 - DNA, 201 bp, Bos taurus
aaaggcaaatgctcccctggtggcctgctctgcagtgaggctctgcaagtcactcctaagaactcaacctgaagttcctttcttcacctttccaacaaattccatatgccatttaacaccctgtaataaatttccctctgcttaaaccagctagagtggattctgttctctgcaagtggaccttgactgatacaatcagta

SEQ ID NO: 44553 - DNA, 201 bp, Bos taurus
agaggatgaagtgtaagttgaccggtcaccagctgctttgtcttgtcctgacagccgccctccccataagtgattcaggccattcttgtccctatccccagaccaccctctccccgaccacttaaaagtagctggtgctgaattttgactgaaggggccctgttatgggttgtgtctccctccagtcctaatcaccctgac

SEQ ID NO: 44554 - DNA, 201 bp, Bos taurus; identical to SEQ ID NO: 2987

SEQ ID NO: 44555 - DNA, 201 bp, Bos taurus
cacgctctgtggccaggagggcaggcagttttcaacaggaaatgcgtccctgagcagtatccctgcacgctgcgatggagtccaggtgaggccccgggcccggggaacagcagctgggtctaaaggtcaggaaggaggctcagtgaccatggcgtgcgtggtttggtgggcaggggattccaggaagctctgttgataaca

SEQ ID NO: 44556 - DNA, 201 bp, Bos taurus; identical to SEQ ID NO: 2992

SEQ ID NO: 44557 - DNA, 201 bp, Bos taurus; identical to SEQ ID NO: 2993

SEQ ID NO: 44558 - DNA, 201 bp, Bos taurus
cctcaagtctgtggctcctccttgagggccatgacctggatgtaatatgtcattgtaatcgcagtgcctgggatagagtcagtgtttcttttctttaaaagaaaaaaaacatatttatttacttggccacactggcccttggttgcagcatgcaggatctagttgcctgaccagggatcgaacccaggccacctgcattgg

SEQ ID NO: 44559 - DNA, 201 bp, Bos taurus
gggggcataagagaagtccttgtgattgaaacagcaaaacagaaatggggagaaaagatgtaagccactggttctggaaatagagaaaggggccataaaataaggaatacaaagaaggtggctccagattctggaaaagccaaagtaatagaatcccctccccaccacacctcacctcccggcctctggactccctgtcag

SEQ ID NO: 44560 - DNA, 201 bp, Bos taurus
acgatttgagctgctgttagtcaggatatttgttactagatagcagaagcagttcagttaatacggtctacgaggtggcaggcccatcatggagcttgggcgttatacaactgaacgtgaccacggcactcaaactcctgcttttcaccagtgaggaaacggagtcccagagggattatctggcctgcacaaactcacacc

SEQ ID NO: 44561 - DNA, 201 bp, Bos taurus; identical to SEQ ID NO: 2994

SEQ ID NO: 44562 - DNA, 201 bp, Bos taurus; identical to SEQ ID NO: 2995

SEQ ID NO: 44563 - DNA, 201 bp, Bos taurus; identical to SEQ ID NO: 2996

SEQ ID NO: 44564 - DNA, 201 bp, Bos taurus; identical to SEQ ID NO: 2997

SEQ ID NO: 44565 - DNA, 201 bp, Bos taurus
aattattttgttaactagcattttcacttatttatacttactattaaataaagcaaccccatcagcattgtagtgatataaatctcgctattccccaatgcgtgcagaaagttcactgcttgcaatagcatgactctccaagtccaattatccaggctgtttgatgcaacattcatctgactagtattaaagacaatgatt

SEQ ID NO: 44566 - DNA, 201 bp, Bos taurus; identical to SEQ ID NO: 2998

SEQ ID NO: 44567 - DNA, 201 bp, Bos taurus; identical to SEQ ID NO: 2999

SEQ ID NO: 44568 - DNA, 201 bp, Bos taurus
cccctgccccttgccgaccaactgctcatctgggttttgagatcatagataagtttacacctttgaaaggaaggattcatacaaagttgacagtgttgaggacttcattaatattgacctccagcaaattagcccaaaggttaacaagttgaagaagccttcagaatcaaagagcaaagaggagttgatgaagaatccata

SEQ ID NO: 44569 - DNA, 201 bp, Bos taurus; identical to SEQ ID NO: 3000

SEQ ID NO: 44570 - DNA, 201 bp, Bos taurus; identical to SEQ ID NO: 3001

SEQ ID NO: 44571 - DNA, 201 bp, Bos taurus; identical to SEQ ID NO: 3004

SEQ ID NO: 44572 - DNA, 201 bp, Bos taurus
gttgttgtcttctcatcagagagtagaagacgtgcaaacacttttaaaggcaaagctggttttttcagcagagaattaaaattaaaagcagacacaggcccggataataagtagcaataaaagctttcgctgacatagcttcaatttacaaatcactggcttttcctggcagcgcttggggaaggagggtgaggaagtatc

SEQ ID NO: 44573 - DNA, 201 bp, Bos taurus
gattcatgggcctaacattccaggttcctatgcaatattgttctttacagcaatggattttactttcactaccagtgaaattttacatccacagctgagcgtcatttccactttgcctcggccactttcttctttctggagctattagcaaatgccctctgctcttccccattagcatactggacactttctgacctggag

SEQ ID NO: 44574 - DNA, 201 bp, Bos taurus
agtcattgttagtcagtagacagttacctggggcagatactaacatgctatgctttctggaagaggaggcaagttgccaaaccccaggaatgacagacttgccatttagttaacttctcagacctacttgactagtctgtgtgtatctacccccaaagagcagaggttttcagcttgggcagaatgccatttcccctttat

SEQ ID NO: 44575 - DNA, 201 bp, Bos taurus; identical to SEQ ID NO: 3008

SEQ ID NO: 44576 - DNA, 201 bp, Bos taurus; identical to SEQ ID NO: 3009

SEQ ID NO: 44577 - DNA, 201 bp, Bos taurus
tatatgtgaaaagcagttttccagtaccgcaacagataactgtttcaaaggatgcatgagtgctaatgtgctatgggagctgatgttttaattggccctcgattctctgaaagatattctttcttgagaagggctggaacctctgaaaagctgctgggtagctacggcctgaaatcacctcaacctcactgccatcataga

SEQ ID NO: 44578 - DNA, 201 bp, Bos taurus; identical to SEQ ID NO: 3013

SEQ ID NO: 44579 - DNA, 201 bp, Bos taurus; identical to SEQ ID NO: 3017

SEQ ID NO: 44580 - DNA, 201 bp, Bos taurus
tgttaatgatatagctggatttctactattcattcagtgagcatatgaagttaagggttcagggaagaaacatctgttattttcctatgtacaaggccattacagagattatagatactacttcacaacactgtgttcaattatctgatgcaccaagaaacacaaattccacttctcccaaggccaagatacttgtgctat

SEQ ID NO: 44581 - DNA, 201 bp, Bos taurus; identical to SEQ ID NO: 3019

SEQ ID NO: 44582 - DNA, 201 bp, Bos taurus; identical to SEQ ID NO: 3020

SEQ ID NO: 44583 - DNA, 201 bp, Bos taurus; identical to SEQ ID NO: 3021

SEQ ID NO: 44584 - DNA, 201 bp, Bos taurus
tcagatgattcttaatattacatgtcaaatatgtaagaattgatacggaagttttgaagaaaatagtgaggacctaccatagcagaaattaaaggaaaatgtaattattgtgataaaagaagcatgccacaatgaatacataaatcagtagatggaatagaaagcttagaaataagaatttcatatatgatatatattatc

SEQ ID NO: 44585 - DNA, 201 bp, Bos taurus; identical to SEQ ID NO: 3022

SEQ ID NO: 44586 - DNA, 201 bp, Bos taurus; identical to SEQ ID NO: 3024

SEQ ID NO: 44587 - DNA, 201 bp, Bos taurus
tcaacccactaaaccttgcatttgcagagcaaagaaatgcagttacagcacatttgttaacacaggataggattagcagtcctactgcgtgacaagtaatgcaaaataatcccaacagaaaatactagtttctagccggcccttcagaaatgtttgttttacaagacagcataatacttgttaaaacaagatgatgtcagc

SEQ ID NO: 44588 - DNA, 201 bp, Bos taurus; identical to SEQ ID NO: 3025

SEQ ID NO: 44589 - DNA, 201 bp, Bos taurus
cttgagaaaagcccagtggtctggtactatattcattttaagagtttgaggtcagcttttatttttctgagctctgtggaatttgtctgcgacaagctaggtatgacaaccggatctgactttcccagactcctttttcctggttatccttgtgcttcaaatattctctaagttggcaaagattagaatatacaggttcat

SEQ ID NO: 44590 - DNA, 201 bp, Bos taurus
tttaggtcatacctgaatggtctagttgttttccctatcttcttcaatttaagtctgaatttggctctaagacctactgagtcagaaaatctgggcctggttcccctcccagctacccgtgttgagcaagtcctcctggtgactctggagcagactaatggttgagaaatgtggcttttccctttcttttctattttgtgt

SEQ ID NO: 44591 - DNA, 201 bp, Bos taurus
catgttcctttgtgaaagctatagtatccagtcagataaatcctatcaataaaactgataaacagcaagagatagcaagacacagcaatctttgttttctagcaaatgacataaataacacacaaatgttttcatgacatgatgtcaaaatttagtcacgagaagtctcaaagatgcagatcaaactgaccatctgcacag

SEQ ID NO: 44592 - DNA, 201 bp, Bos taurus; identical to SEQ ID NO: 3030

SEQ ID NO: 44593 - DNA, 201 bp, Bos taurus; identical to SEQ ID NO: 3031

SEQ ID NO: 44594 - DNA, 201 bp, Bos taurus; identical to SEQ ID NO: 3032

SEQ ID NO: 44595 - DNA, 201 bp, Bos taurus; identical to SEQ ID NO: 3035

SEQ ID NO: 44596 - DNA, 201 bp, Bos taurus; identical to SEQ ID NO: 3036

SEQ ID NO: 44597 - DNA, 201 bp, Bos taurus; identical to SEQ ID NO: 3037

SEQ ID NO: 44598 - DNA, 201 bp, Bos taurus
tgggtgggtggcaatttcaatgtgtgcaactcaccatagtgaaggttccagaataggaaaaggagtcaggttaaatatatgctaagtttaagttttcatccggctgcaatcttcctttgacttgggaaattcttgtttagaaatagaatccagtatgtctttcacattgtaaaatattggcaaggtatcttaatttccccc

SEQ ID NO: 44599 - DNA, 201 bp, Bos taurus; identical to SEQ ID NO: 3039

SEQ ID NO: 44600 - DNA, 201 bp, Bos taurus
aaaaatactgcctatcccttatataagaagatgggaaacagacaaaagttgtatactactgatcaagaccacacttaaaggccctatctggctgactcccagaaagatggctctgtatggaaaatggaaataaattttgatggtgaccttgatttctttagaaggaaaacaagcttaagggtgcatagaactggcccactt

SEQ ID NO: 44601 - DNA, 201 bp, Bos taurus; identical to SEQ ID NO: 3043

SEQ ID NO: 44602 - DNA, 201 bp, Bos taurus; identical to SEQ ID NO: 3044

SEQ ID NO: 44603 - DNA, 201 bp, Bos taurus
aattcatattgatgtatggcaaaacccgttacaatagtgtaaagtaattatcctccaattaaaattaattaataaaaaataaaacaggaaaaaattctttatctttaagaaatctaggcccacctttcttttcttatttctgtgctcttagccatttccccctttcctcattccacctttttatatatcctatattctcac

SEQ ID NO: 44604 - DNA, 201 bp, Bos taurus
ttatctagccaatgctaaaagagattcaaaatttcctctgtcattaaatttttcaccaaaatatcatcctcagggtaacctgggagaatctggatctatttaaggatgccttgacccttttcttccagacataagggtgtagtgatcaattgtgttaataatagcaattgtcagagtgctttttagaatttccacagtata

SEQ ID NO: 44605 - DNA, 201 bp, Bos taurus; identical to SEQ ID NO: 3045

SEQ ID NO: 44606 - DNA, 201 bp, Bos taurus; identical to SEQ ID NO: 3046

SEQ ID NO: 44607 - DNA, 201 bp, Bos taurus; identical to SEQ ID NO: 3047

SEQ ID NO: 44608 - DNA, 201 bp, Bos taurus; identical to SEQ ID NO: 3050

SEQ ID NO: 44609 - DNA, 201 bp, Bos taurus
tcctattaattcatataattctttcataatgtactggtattaccatatgacttttaaatagattgaggtaagtcattatactgatggactttgggatattacaactatctcttattttacaaagatctctgtatctgtatttatataggagttcaggctacatttttgtttttatatgctaacttcataaggtttcatatt

SEQ ID NO: 44610 - DNA, 201 bp, Bos taurus
aatgctggaaatgagatgaacaaaatagtccctgactgcctggatttcagagtatagaagaaaatccaaaattataatcacaatgtgtctgtgtattcattcactcagtcatgtctgattctttgcgacgccatggactgtagcctggcaggctccactgcctatggtattttctaggcaagaatactgcagtgggttgcc

SEQ ID NO: 44611 - DNA, 201 bp, Bos taurus
agacccttaacttagtgacatcttttgccatacgatataatattcattcttttgcttcatatggtagtattcagttggggtcattttttttttggcctactatctgctgccttactctttctttgcaatctttggcttattctatctatctggatttttttgttgtttgttgattattctatattctggcccaccttgtaa

SEQ ID NO: 44612 - DNA, 201 bp, Bos taurus; identical to SEQ ID NO: 3055

SEQ ID NO: 44613 - DNA, 201 bp, Bos taurus; identical to SEQ ID NO: 3056

SEQ ID NO: 44614 - DNA, 201 bp, Bos taurus; identical to SEQ ID NO: 3059

SEQ ID NO: 44615 - DNA, 201 bp, Bos taurus
gtcttaacatattttatcactgtgtctttttaagaaagcaaattaatcagaccactaataactttaccatccttgggtgacttaaaagtgccaccatctgcctttcttttacttaaataggacagctgaaaggcatagacatgttttgcatgtattatataaaaacaatgaaatcccaaactgaaatgtagtattaaaata

SEQ ID NO: 44616 - DNA, 201 bp, Bos taurus; identical to SEQ ID NO: 3060

SEQ ID NO: 44617 - DNA, 201 bp, Bos taurus; identical to SEQ ID NO: 3061

SEQ ID NO: 44618 - DNA, 201 bp, Bos taurus; identical to SEQ ID NO: 3062

SEQ ID NO: 44619 - DNA, 201 bp, Bos taurus; identical to SEQ ID NO: 3063

SEQ ID NO: 44620 - DNA, 201 bp, Bos taurus; identical to SEQ ID NO: 3064

SEQ ID NO: 44621 - DNA, 201 bp, Bos taurus; identical to SEQ ID NO: 3066

SEQ ID NO: 44622 - DNA, 201 bp, Bos taurus; identical to SEQ ID NO: 3067

SEQ ID NO: 44623 - DNA, 201 bp, Bos taurus; identical to SEQ ID NO: 3068

SEQ ID NO: 44624 - DNA, 201 bp, Bos taurus; identical to SEQ ID NO: 3069

SEQ ID NO: 44625 - DNA, 201 bp, Bos taurus; identical to SEQ ID NO: 3070

SEQ ID NO: 44626 - DNA, 201 bp, Bos taurus; identical to SEQ ID NO: 3071

SEQ ID NO: 44627 - DNA, 201 bp, Bos taurus; identical to SEQ ID NO: 3072

SEQ ID NO: 44628 - DNA, 201 bp, Bos taurus; identical to SEQ ID NO: 3073

SEQ ID NO: 44629 - DNA, 201 bp, Bos taurus; identical to SEQ ID NO: 3074

SEQ ID NO: 44630 - DNA, 201 bp, Bos taurus; identical to SEQ ID NO: 3075

SEQ ID NO: 44631 - DNA, 201 bp, Bos taurus; identical to SEQ ID NO: 3076

SEQ ID NO: 44632 - DNA, 201 bp, Bos taurus; identical to SEQ ID NO: 3077

SEQ ID NO: 44633 - DNA, 201 bp, Bos taurus; identical to SEQ ID NO: 3078

SEQ ID NO: 44634 - DNA, 201 bp, Bos taurus; identical to SEQ ID NO: 3079

SEQ ID NO: 44635 - DNA, 201 bp, Bos taurus; identical to SEQ ID NO: 3080

SEQ ID NO: 44636 - DNA, 201 bp, Bos taurus; identical to SEQ ID NO: 3081

SEQ ID NO: 44637 - DNA, 201 bp, Bos taurus; identical to SEQ ID NO: 3082

SEQ ID NO: 44638 - DNA, 201 bp, Bos taurus; identical to SEQ ID NO: 3083

SEQ ID NO: 44639 - DNA, 201 bp, Bos taurus; identical to SEQ ID NO: 3084

SEQ ID NO: 44640 - DNA, 201 bp, Bos taurus; identical to SEQ ID NO: 3085

SEQ ID NO: 44641 - DNA, 201 bp, Bos taurus; identical to SEQ ID NO: 3086

SEQ ID NO: 44642 - DNA, 201 bp, Bos taurus; identical to SEQ ID NO: 3087

SEQ ID NO: 44643 - DNA, 201 bp, Bos taurus; identical to SEQ ID NO: 3088

SEQ ID NO: 44644 - DNA, 201 bp, Bos taurus; identical to SEQ ID NO: 3089

SEQ ID NO: 44645 - DNA, 201 bp, Bos taurus; identical to SEQ ID NO: 3090

SEQ ID NO: 44646 - DNA, 201 bp, Bos taurus; identical to SEQ ID NO: 3091

SEQ ID NO: 44647 - DNA, 201 bp, Bos taurus; identical to SEQ ID NO: 3092

SEQ ID NO: 44648 - DNA, 201 bp, Bos taurus; identical to SEQ ID NO: 3093

SEQ ID NO: 44649 - DNA, 201 bp, Bos taurus; identical to SEQ ID NO: 3094

SEQ ID NO: 44650 - DNA, 201 bp, Bos taurus; identical to SEQ ID NO: 3095

SEQ ID NO: 44651 - DNA, 201 bp, Bos taurus; identical to SEQ ID NO: 3096

SEQ ID NO: 44652 - DNA, 201 bp, Bos taurus; identical to SEQ ID NO: 3097

SEQ ID NO: 44653 - DNA, 201 bp, Bos taurus; identical to SEQ ID NO: 3098

SEQ ID NO: 44654 - DNA, 201 bp, Bos taurus; identical to SEQ ID NO: 3099

SEQ ID NO: 44655 - DNA, 201 bp, Bos taurus; identical to SEQ ID NO: 3100

SEQ ID NO: 44656 - DNA, 201 bp, Bos taurus; identical to SEQ ID NO: 3101

SEQ ID NO: 44657 - DNA, 201 bp, Bos taurus; identical to SEQ ID NO: 3103

SEQ ID NO: 44658 - DNA, 201 bp, Bos taurus; identical to SEQ ID NO: 3104

SEQ ID NO: 44659 - DNA, 201 bp, Bos taurus; identical to SEQ ID NO: 3105

SEQ ID NO: 44660 - DNA, 201 bp, Bos taurus; identical to SEQ ID NO: 3106

SEQ ID NO: 44661 - DNA, 201 bp, Bos taurus; identical to SEQ ID NO: 3107

SEQ ID NO: 44662 - DNA, 201 bp, Bos taurus; identical to SEQ ID NO: 3108

SEQ ID NO: 44663 - DNA, 201 bp, Bos taurus; identical to SEQ ID NO: 3109

SEQ ID NO: 44664 - DNA, 201 bp, Bos taurus; identical to SEQ ID NO: 3110

SEQ ID NO: 44665 - DNA, 201 bp, Bos taurus; identical to SEQ ID NO: 3111

SEQ ID NO: 44666 - DNA, 201 bp, Bos taurus; identical to SEQ ID NO: 3112

SEQ ID NO: 44667 - DNA, 201 bp, Bos taurus; identical to SEQ ID NO: 3113

SEQ ID NO: 44668 - DNA, 201 bp, Bos taurus; identical to SEQ ID NO: 3114

SEQ ID NO: 44669 - DNA, 201 bp, Bos taurus; identical to SEQ ID NO: 3115

SEQ ID NO: 44670 - DNA, 201 bp, Bos taurus; identical to SEQ ID NO: 3116

SEQ ID NO: 44671 - DNA, 201 bp, Bos taurus; identical to SEQ ID NO: 3117

SEQ ID NO: 44672 - DNA, 201 bp, Bos taurus; identical to SEQ ID NO: 3118

SEQ ID NO: 44673 - DNA, 201 bp, Bos taurus; identical to SEQ ID NO: 3119

SEQ ID NO: 44674 - DNA, 201 bp, Bos taurus; identical to SEQ ID NO: 3120

SEQ ID NO: 44675 - DNA, 201 bp, Bos taurus; identical to SEQ ID NO: 3121

SEQ ID NO: 44676 - DNA, 201 bp, Bos taurus; identical to SEQ ID NO: 3123

SEQ ID NO: 44677 - DNA, 201 bp, Bos taurus
tcatgcttgcttcctctctatccaaatccttattaaacttacctaaaaaggggaataacttttggatttatctttactggtaacccctattgccttgcacgtttgtacactatgaactaattagtatgttctcatttttcacatgttctgagcactcagaaatgtttggaatgattaagatataggcctttgcccttttga

SEQ ID NO: 44678 - DNA, 201 bp, Bos taurus; identical to SEQ ID NO: 3124

SEQ ID NO: 44679 - DNA, 201 bp, Bos taurus; identical to SEQ ID NO: 3125

SEQ ID NO: 44680 - DNA, 201 bp, Bos taurus; identical to SEQ ID NO: 3127

SEQ ID NO: 44681 - DNA, 201 bp, Bos taurus; identical to SEQ ID NO: 3129

SEQ ID NO: 44682 - DNA, 201 bp, Bos taurus; identical to SEQ ID NO: 3133

SEQ ID NO: 44683 - DNA, 201 bp, Bos taurus; identical to SEQ ID NO: 3137

SEQ ID NO: 44684 - DNA, 201 bp, Bos taurus; identical to SEQ ID NO: 3138

SEQ ID NO: 44685 - DNA, 201 bp, Bos taurus; identical to SEQ ID NO: 3139

SEQ ID NO: 44686 - DNA, 201 bp, Bos taurus; identical to SEQ ID NO: 3140

SEQ ID NO: 44687 - DNA, 201 bp, Bos taurus
tttccccagctgactcagcctcccctccaagttagtctggattcctcctgatcttcatcctaccatcttgtagcagaggccactgtaactacactgcctggtgttcacccagcctttcacacaaggtctctggtacctccagcaggtgcctacataggccagggaaagtaagacggtaatccccatgtggcagaacctaat

SEQ ID NO: 44688 - DNA, 201 bp, Bos taurus; identical to SEQ ID NO: 3142

SEQ ID NO: 44689 - DNA, 201 bp, Bos taurus; identical to SEQ ID NO: 3143

SEQ ID NO: 44690 - DNA, 201 bp, Bos taurus; identical to SEQ ID NO: 3144

SEQ ID NO: 44691 - DNA, 201 bp, Bos taurus
tcaagattgtgatgcaataaacataatcaataaatgtgagaaaatggagagaatttaatttttctttcattaaaaaataatgttaaaccaaacaggtcaacaatgtagttgcttacaggttcaacatctaagtacgtgctatgttcttcttcatttggacttacgccttcaataggttctgcaatttctggacttgcatat

SEQ ID NO: 44692 - DNA, 201 bp, Bos taurus; identical to SEQ ID NO: 3145

SEQ ID NO: 44693 - DNA, 201 bp, Bos taurus; identical to SEQ ID NO: 3146

SEQ ID NO: 44694 - DNA, 201 bp, Bos taurus; identical to SEQ ID NO: 3147

SEQ ID NO: 44695 - DNA, 201 bp, Bos taurus
acttgattttccatacatggtatggcaagagtccaatttctttcttttttttttcttttttgcatgtggcttttctaggtgccatttgttgaacaggccaccctctctctcacggaatgatcttggcactcttgttgagtgtcagctgaccataaacatatggattgacttctggactgtcggttatattctgttgatttc

SEQ ID NO: 44696 - DNA, 201 bp, Bos taurus
caaaaggctatgttattttaaatctgcacttagaagctttaggggcaagagatcagaggtggagtctcagggagaagaaagggtgccctatactgcttccatgctttctttcctctctaccttcagccagaagaactctttaatcattagacattaggatgagtttctttctgaagaaacagatacatagttaaaactagt

SEQ ID NO: 44697 - DNA, 201 bp, Bos taurus
tggaaggatcatgataacagacaacctacctggtgctgaaatgacaacttcgggaaatctaggctggcagtgatgagtatggtctggaagtaaatgtttatagtgcatcgacccaagaacgtgactgaatttgacacagattgcctgaagcaccaaacaactggtgtaatatttacctttgccatttcccatcatttacag

SEQ ID NO: 44698 - DNA, 201 bp, Bos taurus; identical to SEQ ID NO: 3148

SEQ ID NO: 44699 - DNA, 201 bp, Bos taurus
atctcagtttaatacctattcccctattttacttgtgagtttgatttcttaagaaacaatcatggtaaaatatggcaatatctcagagagctgtccaaaccctcaccacatgggttatcactgatctactatgtatttgatattaaagtcacctttattattcagaaatttggagctttaacttttttaaactggaaacta

SEQ ID NO: 44700 - DNA, 201 bp, Bos taurus
tcagggcactggatctcgcatgccacaactaagtcacatttcaaaagatcccacatgccacaaccaggacctggcacaccagataaatacgtatttaaaacagaaaatgtgctcaacagagaagtttgcctaaaagataacttatttgcctgacccaacccatacgtgtagataaatccctcctctgagagtttatattcg

SEQ ID NO: 44701 - DNA, 201 bp, Bos taurus
ggaaccagtggaactgagtaaaggctgttaggtaactaaatagcaatagctattatgcaaataaataaacaaatcatagtcatcacttggtcactccaagtatgctttctgctttgttgttgtttgagaaagttataatttaaggatttatggttttaaaaatggctataatatttaatgcatttatgtgtatctctttga

SEQ ID NO: 44702 - DNA, 201 bp, Bos taurus
tgcagagaaaatgtctcttattacttcattctgttctaacatttttcccttgaataccgcaatagtctaacacagaggaaagaacatgcttccaaaggagaagggtgaaagttattaacatatgtacatatatataaacataactgagtaaatatatacacacagagaaagagaggtacaactctttatgagcctaatgca

SEQ ID NO: 44703 - DNA, 201 bp, Bos taurus; identical to SEQ ID NO: 3151

SEQ ID NO: 44704 - DNA, 201 bp, Bos taurus; identical to SEQ ID NO: 3153

SEQ ID NO: 44705 - DNA, 201 bp, Bos taurus
cacagtatatgggatgttttaaatagtctctaatgcatgagtgggaagtggggaggtgtagaaagtgagagaagagcatgaacaaaggtgggagagggtgaaaatgacactcctatgcagagaagtaaatacagatcagtgaggctagtgaaaggggtagctgagtaaacttgttattaaccgaggatttttccagaaatt

SEQ ID NO: 44706 - DNA, 201 bp, Bos taurus
tcctgtgatacaaaaatcccacttgactatttcatataggagcaaccaaacattttgttgttgtattcagtctccaaatcatgtctgactctttgccaccccatctattccagcacaccaatccttcaccaatccctgtccttcaccatctcctggagtttgcccaagtttatgtccatttaatcaatgatgctatcccat

SEQ ID NO: 44707 - DNA, 201 bp, Bos taurus; identical to SEQ ID NO: 3154

SEQ ID NO: 44708 - DNA, 201 bp, Bos taurus
tcaaatgtattatcagagaggagtcatcaatggagaggatctggtgcagtatggataaaagtaaaaatgtaaacagaacatacagattctatgttctcctcctttgttaatataacactggtttaggcaataatataattgctgagtaacaggtaatgtcaaatgttagttttttaaacattaagtccagatctttcttcc

SEQ ID NO: 44709 - DNA, 201 bp, Bos taurus; identical to SEQ ID NO: 3155

SEQ ID NO: 44710 - DNA, 201 bp, Bos taurus; identical to SEQ ID NO: 3156

SEQ ID NO: 44711 - DNA, 201 bp, Bos taurus
tcaaagccaggaagacattaagtggaataagaagttggggtaagagtctaggtggttcatgaatattgagaggaactagtgagtacaaggtaacccagctagaaggcaaaagtgcagagaccaaggtatctaagaaaatattaggaagtcaatagagttgctcagtcatgtcggactctttgcgaccccgtggactgtagg

SEQ ID NO: 44712 - DNA, 201 bp, Bos taurus
ccgggagctggtgatggacagggaggcctggcatgctgcgattcatggggtcgcaaagagtctgacacgactgagcgactgaactgaagtgaatatacgactgactacctagggcctatttatctattgggtttttttttttcccccacatttttcttctcatttagaaatgctctttgtatattatctttagtctgtcac

SEQ ID NO: 44713 - DNA, 201 bp, Bos taurus
taggcatttaaaattccaatacttttaatgatcatcaaaagaagccttgagggttcctgtgaagtcacatttttctgtgataaaaataaaaccaataaaagataaaaccaacttatgtttccaatacggttctatataaatattaaatgaaacaaaagtaggcagcaaacagtgggactcaaacccacatctgattttttt

SEQ ID NO: 44714 - DNA, 201 bp, Bos taurus; identical to SEQ ID NO: 3157

SEQ ID NO: 44715 - DNA, 201 bp, Bos taurus
agtagggctgactagcaaccttccaaaaggacttatgccgacacgcacctccgtggactgctgccaccagtgaccctatccctggcggaggctacttccaactgaggccacttctgagccacgcctctgcaggagaccctcagacactcacaggcaggtctgacacagtctcttgtggggtcaccacttctttctggcgtg

SEQ ID NO: 44716 - DNA, 201 bp, Bos taurus; identical to SEQ ID NO: 3158

SEQ ID NO: 44717 - DNA, 201 bp, Bos taurus; identical to SEQ ID NO: 3159

SEQ ID NO: 44718 - DNA, 201 bp, Bos taurus; identical to SEQ ID NO: 3160

SEQ ID NO: 44719 - DNA, 201 bp, Bos taurus; identical to SEQ ID NO: 3161

SEQ ID NO: 44720 - DNA, 201 bp, Bos taurus; identical to SEQ ID NO: 3162

SEQ ID NO: 44721 - DNA, 201 bp, Bos taurus; identical to SEQ ID NO: 3163

SEQ ID NO: 44722 - DNA, 201 bp, Bos taurus; identical to SEQ ID NO: 3164

SEQ ID NO: 44723 - DNA, 201 bp, Bos taurus
ctaaatgaagttccctgaatgcattatattgtatactattcctcagtcttccatatataatttcttctttaaaaaaatgtttctttctcctctctcttctgtcctttatatttgtcattcaaaactcagttcaagtatcaccttatgctccagcccttgcagttaaggcaacatgtttgtgaatgaaaaagtcaacttgga

SEQ ID NO: 44724 - DNA, 201 bp, Bos taurus
ttccaaaagaggaaagaatagcttaaggcttaaggcttataacatctggaaatcagaattctagcacagggattaagacacatatgttaaaatggcctcatcctaagaggctcaaaaccacaggttatttgtccatactatataaaacacagcacaatctgccagtctcaatagtctctgctcagtaacaaggcccagaat

SEQ ID NO: 44725 - DNA, 201 bp, Bos taurus; identical to SEQ ID NO: 3165

SEQ ID NO: 44726 - DNA, 201 bp, Bos taurus; identical to SEQ ID NO: 3166

SEQ ID NO: 44727 - DNA, 201 bp, Bos taurus
ttaaaaaatcttaatcagaacaataattccatttgaatttttctttcaaaataaatccagccaagttctaatatatagcaaattatttgcatattaataagccatatttagaaaacctaatcaaggagttcatctttatatgcaaattttcctacgtaattacttaaaatttccataaaactttcaggttaattgacaatt

SEQ ID NO: 44728 - DNA, 201 bp, Bos taurus
tccaggatgcttcagtcacgtctggatccttcactatttatcaatgtctttcttaaaatgtgccactaaaaaatactccataagttaagaaatcactagtctaatggtcttgacacttctttttttaagatagaatgatgttctatgagatgttttcatgaaaaacaacctgtctccaaaccacactttttttgatgaaaa

SEQ ID NO: 44729 - DNA, 201 bp, Bos taurus
atggtgaggaagctactttctcacatatactttaacttttaggatttcgtccttttctggccagggagcctgtgaaaggaaattcaagggttgtaggttctgaatatatgatgtctatgtgggcccaacaggagtagtaaatttggtacttgaatctgagtattagcatagttcttgattcatcattggcttcaatgtttc

SEQ ID NO: 44730 - DNA, 201 bp, Bos taurus
cctgaaataataataaactgccgacatttctcccacaaaacagagtttatttgggatcagcagagaagtgcagtcaggctctgcaattatgatgagccacgtgcaagtctcccaagggcaagggaaggagcctctcttttagaggggaaaagaaagttgggagggctcagtaaacaaagagcccatggtttttcattggtg

SEQ ID NO: 44731 - DNA, 201 bp, Bos taurus; identical to SEQ ID NO: 3167

SEQ ID NO: 44732 - DNA, 201 bp, Bos taurus
tttcctagcgggcgagttaagcttctgctgattaacacactcaggatcccgattaactttgtggcatgaagctaacataattacataattggccttaaaatgaaactcttactttcagagatgctccaaaggtaagtgttttacttttttctggagcctgagaccttcacaaagacaacctggcccacctgttgtgtgaaa

SEQ ID NO: 44733 - DNA, 201 bp, Bos taurus; identical to SEQ ID NO: 3168

SEQ ID NO: 44734 - DNA, 201 bp, Bos taurus
actatcctctgcaattatcctctaactctcctgtgttcaaatcagtatgtcagatggaaatgaaattagaaagagacagaaagaaaaagagcaagaaaggcagagaatataaaggctaaaaagtaggagaagggaaaaaaagacgagggaaaatgaactgggcctgtctcagaaattttgcatttcctagatacctctgta

SEQ ID NO: 44735 - DNA, 201 bp, Bos taurus
aaatagtggcaatggtcatgaagaggaggtgaacctccccttcatcaaggggaggtgaaccaaaagataacggacatacttatggacataacagacaccaactgttgaaatgagatggttcctgggttttgacaaggtgtagatcatactgtttgcatcatatttttaaagataaaatacaagcattttgccttgtcacta

SEQ ID NO: 44736 - DNA, 201 bp, Bos taurus; identical to SEQ ID NO: 3169

SEQ ID NO: 44737 - DNA, 201 bp, Bos taurus; identical to SEQ ID NO: 3170

SEQ ID NO: 44738 - DNA, 201 bp, Bos taurus
aaagaaccctgggttttaccactaagagcaatccagagctttattacagcttggtgtcacgaatttaatacactgctatgtatttaaactttaacagaaggggggtgggtgacgactgcctcactttcaccagtttctctacggagaacaagactggacctctcagtcatgacctccagggacgaatgggatgggaatgaa

SEQ ID NO: 44739 - DNA, 201 bp, Bos taurus
ttttgccatctgtattcggaaaaatgtcatttcaaattccctgtccatttttcaattgggttgtctttgttgttgagttgtgagagttctttatatgttctggataacagacccttatcagatgtatgatttacaaacattttatgggttgtcgtttcactatctttatagtgccctttaacacaaaaaagttttaaatct

SEQ ID NO: 44740 - DNA, 201 bp, Bos taurus
tcgaatgcaatgttctgaccttgtctgtatcatgatttaaacgagtcctctgtatgcaaaaggcatttctgaaacaatgaggggaaaactgaacatgcactgggtatgagatattaagaaattattattgattttgtcaggaggtgataatggtttagggctttagtccttttctatcagatatatgctgaagtagttaca

SEQ ID NO: 44741 - DNA, 201 bp, Bos taurus
accattgccagattgtgccaagcctgacatatccagcccattcagaattaggagtttttcagtcataggtggcaagaacccagattaatgctggcctgatgtggggagtggggtggcatgaggtgaggaacttgtttgtgtaactggaaggattaggcatggctgctctcaagttattcatttctggcttcactcataggc

SEQ ID NO: 44742 - DNA, 201 bp, Bos taurus; identical to SEQ ID NO: 3171

SEQ ID NO: 44743 - DNA, 201 bp, Bos taurus
cttggttccctgcagggcagtttcaattgtgtctgcttagagtatgtctcccgtggaaactgagaggacctgctggcctgtttgtatattccttagtgattggacctcagaatctcaacaggcttcctgggttctgagagtctgccagatgggagcttctcagaagaccaccacttccagaggccaggccattttgatcag

SEQ ID NO: 44744 - DNA, 201 bp, Bos taurus
ctgaccacagattccaacccactttatgcataactctcctgggaagatggggaggggaagcgagggtgggtgatgccagggggcctaattcctctaagaggaagtcagtaagcaacacgcaaaacctatacatcaggaaatccggcatcagcatctaatttatggaggtcaagagaattcccttatgatctagtggttagg

SEQ ID NO: 44745 - DNA, 201 bp, Bos taurus; identical to SEQ ID NO: 3172

SEQ ID NO: 44746 - DNA, 201 bp, Bos taurus; identical to SEQ ID NO: 3173

SEQ ID NO: 44747 - DNA, 201 bp, Bos taurus; identical to SEQ ID NO: 3174

SEQ ID NO: 44748 - DNA, 201 bp, Bos taurus
ataggagtgaatttttaatattttggataatttcttattgaactaataagaaaaaaatttactctccctaatctaatctgctggggaactagaactctgtcgactagtactggctataaaaatctaagtaacacttttttaaagtatgtatttggatagtataaagtataagtttccatctcctttgatcttcctttgaat

SEQ ID NO: 44749 - DNA, 201 bp, Bos taurus; identical to SEQ ID NO: 3175

SEQ ID NO: 44750 - DNA, 201 bp, Bos taurus; identical to SEQ ID NO: 3176

SEQ ID NO: 44751 - DNA, 201 bp, Bos taurus
taaaatctgcagtttgagggtcaggcttctaatttaacacaaatctgggggctgactacatctctcctgagattggaaagcaccaccttcatgccacccctcaacaagtcaccagtatttccctaaaaaatcttgtgtaagtatctggtgccatggcctctgcagctgttacccagggtacaatagcccttgactgcctgg

SEQ ID NO: 44752 - DNA, 201 bp, Bos taurus; identical to SEQ ID NO: 3177

SEQ ID NO: 44753 - DNA, 201 bp, Bos taurus
aagctggaggccacggtggtaagtaagcccaatggttttagttgccctgggatgtaggctgtttttcccaaccaaggagtttggattttaatagtcatttgggaaaggaaggccaaggcttgaactaactccagataaaaagctggaacttaaatgcctgtattaggggaaaagagcagaggggagcagaaaaaaactgat

SEQ ID NO: 44754 - DNA, 201 bp, Bos taurus
ataacaatggctggattttttttagtaggctttgaagatgcaaggcaatcaaaattctcattgctggtaggaatgcaagatggtacctttgaaaaagagactggcaatttcttaagcatacactcatcatatacctcagtaatccttctctgaaagtgtttacctaagagaagtaaaaacattatgtcctgtaaacaaatg

SEQ ID NO: 44755 - DNA, 201 bp, Bos taurus
tgagacgttcatgccttcctcacctccatttcaacacgtagttattaatctttttctctgacgacaaaccagaaagtaagatggagctgtctatcactgatcttagagcctagcagcggggacaaacaattaaacaagcaattataataaactgtgtgtggtggtgcaaagacaggcaagcgcacgtggaagatcctcaca

SEQ ID NO: 44756 - DNA, 201 bp, Bos taurus; identical to SEQ ID NO: 3178

SEQ ID NO: 44757 - DNA, 201 bp, Bos taurus; identical to SEQ ID NO: 3180

SEQ ID NO: 44758 - DNA, 201 bp, Bos taurus; identical to SEQ ID NO: 3181

SEQ ID NO: 44759 - DNA, 201 bp, Bos taurus; identical to SEQ ID NO: 3182

SEQ ID NO: 44760 - DNA, 201 bp, Bos taurus; identical to SEQ ID NO: 3183

SEQ ID NO: 44761 - DNA, 201 bp, Bos taurus
gttcctataaataaagtgcatgatcttttggtttgatattttgatagtctggtgaattaaaagagtaaggaactaagagtctttgtcctctgtcatcatccatttctgtggccctggggcagaggggggttctcctatagtgtaagtgttagctgttcagttgtgtctgactctttgtgaccccgtgattgtagtccacca

SEQ ID NO: 44762 - DNA, 201 bp, Bos taurus
atcacaattgtccttagttgtgaatgcacctaaaaacttgtttataaagctgcacaaacggtaagtcttttaaaagatcccaccaaaacattcaccaaatgacacagaacacttacagtattactcatcattattcttccaagctctcactggttaactatacagatagagcacatcgctacacataacttgactccgaat

SEQ ID NO: 44763 - DNA, 201 bp, Bos taurus; identical to SEQ ID NO: 3184

SEQ ID NO: 44764 - DNA, 201 bp, Bos taurus
atagccaggcgctggctcagtgcagctgcgacctgtgacgtgggggcgacagtcacactgcccgttcttgggtgagcacctgtggggaaacaaacccaccccgtgaaataaaagtggaggtggggggcaagtgtaagataagggcttaggggtgctggggtaagtgccctctggatttgagtccattctttgagtccatca

SEQ ID NO: 44765 - DNA, 201 bp, Bos taurus; identical to SEQ ID NO: 3185

SEQ ID NO: 44766 - DNA, 201 bp, Bos taurus
tttagagatggaacaaactgacacttggattaaatgccgtatctaaagaaatcaaaggtaagggctaagttgacagcaaaactaagtctcttgattccagatgagttcacattcaacctagatttcaatcatgttttaatggagtaggcagaagagggaccctgagaaagccttactacaatcgatcatggtttcacataa

SEQ ID NO: 44767 - DNA, 201 bp, Bos taurus; identical to SEQ ID NO: 3186

SEQ ID NO: 44768 - DNA, 201 bp, Bos taurus; identical to SEQ ID NO: 3187

SEQ ID NO: 44769 - DNA, 201 bp, Bos taurus
cttgctttaccagggaacttcaggaacgcaaacatgaactattttgactgataaggttccaaaataaaatctaagggtaccttggccattgcatgagtcagtattccagataaacacatttagcattttaggctctgaactttatttttggtggtgattttgctaaaatgtgtcacacttcatggccttcagggtcatcac

SEQ ID NO: 44770 - DNA, 201 bp, Bos taurus; identical to SEQ ID NO: 3188

SEQ ID NO: 44771 - DNA, 201 bp, Bos taurus
gagcatagttatcttagtctgatccttgaaaattgtctaaaaatataaatcaggtattaaaagtgatgtacgagaataaaatacatgaagggatagtaaggtgtttgttattttagataaataatttaagaaagacagctatccacccatgtccacattatgatcgataacttcccacttataatgaaaaggttctttgtt

SEQ ID NO: 44772 - DNA, 201 bp, Bos taurus; identical to SEQ ID NO: 3189

SEQ ID NO: 44773 - DNA, 201 bp, Bos taurus; identical to SEQ ID NO: 3190

SEQ ID NO: 44774 - DNA, 201 bp, Bos taurus
gaaatggagcaatcccttcacacccaaccagttcctcagggagagatgagcaagcacattgattcctaatattattgataagctatgatttctctagatagaagaatgttttattaatagattatgcatagaaataaaggtaaattatggcatagtgcagctcatttcattagtctagctcagttatagaccaaagcatga

SEQ ID NO: 44775 - DNA, 201 bp, Bos taurus; identical to SEQ ID NO: 3191

SEQ ID NO: 44776 - DNA, 201 bp, Bos taurus; identical to SEQ ID NO: 3192

SEQ ID NO: 44777 - DNA, 201 bp, Bos taurus
taaaacacacagagtactaactattcagtgctccgcctgcctaatcagaatggatcacttgttcccctctagtctcatagcatttttgtttccaatcactttcaacatgttctaattctatatggaccttttttaactagtctgagattctttaaagtggagctatttcacctttatcttctcctttttgctcttcaatta

SEQ ID NO: 44778 - DNA, 201 bp, Bos taurus; identical to SEQ ID NO: 3194

SEQ ID NO: 44779 - DNA, 201 bp, Bos taurus; identical to SEQ ID NO: 3195

SEQ ID NO: 44780 - DNA, 201 bp, Bos taurus
aatctacagaatttgtaaagtgttcataaacagtagctttcttttagtctgtgtcttccctttccattactatgtagtaaggacttatttagtttttttaattatatatcattatgtagaaattattaagttgagaatattttagagaatgcagagtatagataaaatgtgaaaatttttaatcatttattaaaaacagga

SEQ ID NO: 44781 - DNA, 201 bp, Bos taurus; identical to SEQ ID NO: 3196

SEQ ID NO: 44782 - DNA, 201 bp, Bos taurus
taacgtaaaatataatttgttagatataagacctataggccatggggttgctgaaaaatcgcacttggtgggaaccgcaagagagtgacagttactgactggtcaccatggccaaaaaaccaattcttaacaggctctctcactgggtttttctcagataactggagagaaaacagaacccttgaattacgacatctaacc

SEQ ID NO: 44783 - DNA, 201 bp, Bos taurus
ttgacctcaataattcttttttcatggaaaggcattttattttaaatatagcagtgtgaacatgtcaataattctttaaatgtactaaaaatgcttacttgataaagaatattttataaagtaaaaaaaaatcatgtaacataaacaatcacttcctaacatccattttataagcaaatatatttattttggggagagagt

SEQ ID NO: 44784 - DNA, 201 bp, Bos taurus
tgtacttcctaaatcaccttcactgaagatactttgtttataacaagaaaagttatttattattaaaagaataagaacagataagaataattactttccccggaaatgtaactatattacatccaatgtcaggtggaaggttacaaaggttacctccaaaagtctttctggtgatttacatgggaaaaaaaatcaactgaa

SEQ ID NO: 44785 - DNA, 201 bp, Bos taurus
atattacagaacttcttaagtcctacagacagaagtgatgaagtcaccttcccatccactgctcctctaactgtaactggatccttgggaggaaaattaaagtaatacaatagatgaagtgtatacaaactcttggacttccctagtggctcagacagtaaagtgtctgtttacaatgtgatagacctgggttggaaagat

SEQ ID NO: 44786 - DNA, 201 bp, Bos taurus
agttattttacttataactgagaaagttcactaagagaatgcctgtaatgggttgatattttaatatttcatctcttgccaactgttttaaaagtaatgagtaatttgtgtctttcaatcccctggggacaagtgaggactcttaaccatactaccttatccttgagttattcttccaaaagaatcctagtcaacacgctt

SEQ ID NO: 44787 - DNA, 201 bp, Bos taurus; identical to SEQ ID NO: 3197

SEQ ID NO: 44788 - DNA, 201 bp, Bos taurus
tgatttcttgttatcatatgagcatttttcaaaactataatccttgacatatctatcactaccacattggatccctttctgttgtataatcaaaggaatacagatattcttggacacagaataaaagttctcatccacatttgtcccttacagttcatggggacaaagcagaagccaaatttgcaacattagcttcctggg

SEQ ID NO: 44789 - DNA, 201 bp, Bos taurus
gctgataacagtggctgagtcttgataaactgtttacaaaaacaggcagcaggccatagttttccagtccctggactaggaggatttgaagaccaaatgtcgcctatgctatctaagtagactcttttgttataatagtttccaaatagagatcccaagggcctgatattagtcagcactaatgaagagttaacatccttt

SEQ ID NO: 44790 - DNA, 201 bp, Bos taurus; identical to SEQ ID NO: 3198

SEQ ID NO: 44791 - DNA, 201 bp, Bos taurus
agtgggagagccatttgtacaagagagagtatgtgacacagtcaggagaaaaacaagtagttgaacctagagaagtagggaaaacaagaagggcaaatgagggagataaaagtacttgatcaacattccaagagagcaaaacgaggcatttccaagagccctgaaatgtaagagaagactctctttctgagacagcaggag

SEQ ID NO: 44792 - DNA, 201 bp, Bos taurus; identical to SEQ ID NO: 3199

SEQ ID NO: 44793 - DNA, 201 bp, Bos taurus
taaatacttttgcttgatacccaaactgcttgtggaatagcaaagaaagctgtttaaataccttgtgacctgtgagaaaatgtcaagccaattcttatagcggcatcttgctgattggggcattgcttaggataattaaatgtgaaatagaatagcatgagtaagtgttttctctctgcttttaagttcgagtaaatgaat

SEQ ID NO: 44794 - DNA, 201 bp, Bos taurus; identical to SEQ ID NO: 3200

SEQ ID NO: 44795 - DNA, 201 bp, Bos taurus; identical to SEQ ID NO: 3201

SEQ ID NO: 44796 - DNA, 201 bp, Bos taurus; identical to SEQ ID NO: 3202

SEQ ID NO: 44797 - DNA, 201 bp, Bos taurus; identical to SEQ ID NO: 3203

SEQ ID NO: 44798 - DNA, 201 bp, Bos taurus; identical to SEQ ID NO: 3204

SEQ ID NO: 44799 - DNA, 201 bp, Bos taurus; identical to SEQ ID NO: 3205

SEQ ID NO: 44800 - DNA, 201 bp, Bos taurus; identical to SEQ ID NO: 3207

SEQ ID NO: 44801 - DNA, 201 bp, Bos taurus; identical to SEQ ID NO: 3208

SEQ ID NO: 44802 - DNA, 201 bp, Bos taurus
aggaaatggattgattctatcagtgtgagttcaccttccaggtctactccaaatgttttcttctcttttcattcatttaagtctaacacaagggagaagaaagtaagttcaaattatttctgcctgaacacagcatcaatcttaactcttcatgtagtttttatgagaggcaaacactgatataaaataggaaaaagtgaa

SEQ ID NO: 44803 - DNA, 201 bp, Bos taurus; identical to SEQ ID NO: 3209

SEQ ID NO: 44804 - DNA, 201 bp, Bos taurus; identical to SEQ ID NO: 3210

SEQ ID NO: 44805 - DNA, 201 bp, Bos taurus
aaggatttttacatatatgttcatgagaaatatttctctgcattttttgctttccctgcaatgtcttagtctggttttcatattaggtagtggtggcccagtagaataatttgggaagtattccttatgctcttatcttgtgaataaattatagagaattggtataatttctttcttaaatttctgatggaattcactaat

SEQ ID NO: 44806 - DNA, 201 bp, Bos taurus; identical to SEQ ID NO: 3211

SEQ ID NO: 44807 - DNA, 201 bp, Bos taurus
agttattggaagttcccatacagagctggcatcatatataatatattgaaaagtcaatctatcccctaagaaatacgtgataaagatttggaagcgagtaccctgtagtgaaaagatggtgggagttaaccatcagggagctgaatcttgactgagatatttctgcaagtccataagcaactacataaaatctgagactat

SEQ ID NO: 44808 - DNA, 201 bp, Bos taurus; identical to SEQ ID NO: 3212

SEQ ID NO: 44809 - DNA, 201 bp, Bos taurus; identical to SEQ ID NO: 3213

SEQ ID NO: 44810 - DNA, 201 bp, Bos taurus; identical to SEQ ID NO: 3214

SEQ ID NO: 44811 - DNA, 201 bp, Bos taurus; identical to SEQ ID NO: 3215

SEQ ID NO: 44812 - DNA, 201 bp, Bos taurus; identical to SEQ ID NO: 3216

SEQ ID NO: 44813 - DNA, 201 bp, Bos taurus
ggagctgaggtctgtccagcagtcagctgtattccaggttggaaagaaacgaagacaaaaaaccatttgcacctcagaggcaccgtactcaccctcataactgacacctccggctccaccacggttgccatcactgtcctccccttgggtagcagccccctgggtcttgggagcagccattactcggctgaggaaaaaaaa

SEQ ID NO: 44814 - DNA, 201 bp, Bos taurus; identical to SEQ ID NO: 3218

SEQ ID NO: 44815 - DNA, 201 bp, Bos taurus; identical to SEQ ID NO: 3219

SEQ ID NO: 44816 - DNA, 201 bp, Bos taurus; identical to SEQ ID NO: 3220

SEQ ID NO: 44817 - DNA, 201 bp, Bos taurus; identical to SEQ ID NO: 3221

SEQ ID NO: 44818 - DNA, 201 bp, Bos taurus
tattactgtgagatttagtgttcttaacacaataactggtacagaataggttcctcagtaaagagcagttccttttcattcctttaggtcctggccatgagaacaaagactccccctcttatatctaggcttatggctccagctgaagggaattacctttggaagctgggccttagtgggatggagaaaggggtatagaga

SEQ ID NO: 44819 - DNA, 201 bp, Bos taurus
ttgcatttgtgtttatttcttatatttaatctttgaattatctggaatttatctttttatgatgagtaaaatgaatatccgccttttttttctccctccaaaccctgattatttaacatcattggttaatttaagctcctctctatcagtgtgaaagtctttatcatatacccaatttctttgtgtctttgtatttatttc

SEQ ID NO: 44820 - DNA, 201 bp, Bos taurus
tacatataaaaatgcttagtgattggtatcatattatttaacaacaaataatcatcaagcagtaactgttgctttcttttggtgaacaaccaggcttatacttgtttagtatgatgcaatactaataaaagacactgtttaaagtatctttttagtttcatgagcaaaaatgctttctggacacatgtccttacattagaa

SEQ ID NO: 44821 - DNA, 201 bp, Bos taurus; identical to SEQ ID NO: 3222

SEQ ID NO: 44822 - DNA, 201 bp, Bos taurus; identical to SEQ ID NO: 3223

SEQ ID NO: 44823 - DNA, 201 bp, Bos taurus; identical to SEQ ID NO: 3224

SEQ ID NO: 44824 - DNA, 201 bp, Bos taurus; identical to SEQ ID NO: 3225

SEQ ID NO: 44825 - DNA, 201 bp, Bos taurus; identical to SEQ ID NO: 3226

SEQ ID NO: 44826 - DNA, 201 bp, Bos taurus; identical to SEQ ID NO: 3227

SEQ ID NO: 44827 - DNA, 201 bp, Bos taurus; identical to SEQ ID NO: 3228

SEQ ID NO: 44828 - DNA, 201 bp, Bos taurus; identical to SEQ ID NO: 3229

SEQ ID NO: 44829 - DNA, 201 bp, Bos taurus; identical to SEQ ID NO: 3230

SEQ ID NO: 44830 - DNA, 201 bp, Bos taurus
cacaacgtgcatctttataagtggccttttaaagactgcacttaacctgatagagaatgttgggaaaaaacaccctttgtaaatgcatatttgtggtaatgtaatgtcttctgaagggcaagaggccatctctttggggtttcccagatggcacagtggtaaagaatccacctgccaatgcaggagacacaggaaatctgg

SEQ ID NO: 44831 - DNA, 201 bp, Bos taurus
attacttgtcagttctatgggtgtgtgtgtctgtgtgaagagcagcggtgtggtaaaaatgacttttggagaaatacattatagcccccaaagaagaatacgtatttttcaagcaccatttgacattgggtatttcctacccttatgtgagtgtgcatgttaagtcacttcaatcgtatccaactctttgcgaccctatgg

SEQ ID NO: 44832 - DNA, 201 bp, Bos taurus; identical to SEQ ID NO: 3232

SEQ ID NO: 44833 - DNA, 201 bp, Bos taurus; identical to SEQ ID NO: 3233

SEQ ID NO: 44834 - DNA, 201 bp, Bos taurus; identical to SEQ ID NO: 3234

SEQ ID NO: 44835 - DNA, 201 bp, Bos taurus
gccatattttcctgaagagtaggcatgtatgcatttattcaataaattatgcattgaagataccatatatgctggaaatacagtggttcaaagcccatacctggactttatgttgggagtggtagacaatgtttaattcaatgaataaatcaataggtaagtgtaattaacatttactgagaaattaatatgtctcagtaa

SEQ ID NO: 44836 - DNA, 201 bp, Bos taurus
tagggaggcctggtatgctgcagttcatgggatggcaaagagttggacacaactgagtgactgaactgaactaaagcaaatagatgaatgaatcaaaatatcaagtccaaggataggcccaaggatatgaggaaaccacatataaccaaaggagtgatggataatgaatgtttcacaaccagctctctggagcagagatgg

SEQ ID NO: 44837 - DNA, 201 bp, Bos taurus; identical to SEQ ID NO: 3235

SEQ ID NO: 44838 - DNA, 201 bp, Bos taurus
aatacagctgttaaaatttgtaattttggcttctcttcatctttccttctattcatgaacaatttggactcaaaatcatgagacagggaagagaaaggtaagcattttaatatctgtatattgaaaactaaaattttgttccagtatcttcaaatctagtctaataccacagagtctattttactttatccctttccagtt

SEQ ID NO: 44839 - DNA, 201 bp, Bos taurus; identical to SEQ ID NO: 3236

SEQ ID NO: 44840 - DNA, 201 bp, Bos taurus; identical to SEQ ID NO: 3237

SEQ ID NO: 44841 - DNA, 201 bp, Bos taurus
cacattccacatatttcttgagactacagcataatgttctgaatcagttttgttttagcttgagtgaccacataatttgtcatccaaaccagcgtatttttggggttaggaggtattcataatcatgacaaggcaactgatatagctggctgttttagattaggctcctcagaaacagttcctaatttatattaaagtgat

SEQ ID NO: 44842 - DNA, 201 bp, Bos taurus; identical to SEQ ID NO: 3238

SEQ ID NO: 44843 - DNA, 201 bp, Bos taurus; identical to SEQ ID NO: 3239

SEQ ID NO: 44844 - DNA, 201 bp, Bos taurus
cacaatctgactaaagctttccatcacttcaattcttggcatttcttactgtttctcaattgtttcttaaatctcttaattatttccatactttggtttctgacttttcccttccaaaccaatgtcttcttcatgatttacttatcccataatactcttaataccaaggtttgatatatgtaccaaactctacataccaaa

SEQ ID NO: 44845 - DNA, 201 bp, Bos taurus
cagaaacatgtacacaatgctcatgataaagtgaaatggcatgctttaactgagattattatacaactccatcagctgaaaataaaggatattaaatgacaaacaggattgcttttcttacaaaactgcccagtcatcttggtaacaggtacattacctgttattattgttgcttagcatccatgcttataattctcttat

SEQ ID NO: 44846 - DNA, 201 bp, Bos taurus; identical to SEQ ID NO: 3240

SEQ ID NO: 44847 - DNA, 201 bp, Bos taurus; identical to SEQ ID NO: 3241

SEQ ID NO: 44848 - DNA, 201 bp, Bos taurus; identical to SEQ ID NO: 3242

SEQ ID NO: 44849 - DNA, 201 bp, Bos taurus
tactgagaactcatagtcaggttaaagagccacccttaatagggccttttagataccatggtttaaatggacaatttctcccctcaaaagtatataatacatgaagtatttaggccaccttaaaccatcaaggaattctccataggatatatcacaaactaaaaaatacatctctattggtggaagaccagtagcaagaaa

SEQ ID NO: 44850 - DNA, 201 bp, Bos taurus; identical to SEQ ID NO: 3243

SEQ ID NO: 44851 - DNA, 201 bp, Bos taurus
accgaatctgcacctctgaggatttcctgagtgcccgaacctgagcagcttagaactgggaggtgcatgcagcccaggtctggcctcagatggttctgagcagagcaacatagagcctgagcagtgtgggcagggagggcacacacgccgtgagtgagggcaggcccagtgtggctgagacactgcgagcacatgccagtg

SEQ ID NO: 44852 - DNA, 201 bp, Bos taurus; identical to SEQ ID NO: 3244

SEQ ID NO: 44853 - DNA, 201 bp, Bos taurus
gccaagttaaaggggatacaaagggcttctgcccttgaaagctatttcccagctaaggaggatatgaggaagaattttatagcaataatttaagggcaagtttgcagataagattagggtgtgagtagggccagccctcctataatctggcttcagttaatcttattaatgagcttctgtggttccattagtctggcctca

SEQ ID NO: 44854 - DNA, 201 bp, Bos taurus
gggtagagatttctaggaattgggccactgcccactgcttggtcttttgacagtgccttggaactgtcatggaacctttggtgctttagtaactaagtcatgtctgactcttgtgactccatggccctagcctgctggtctcctctgtctgtggaattctccaggcaagaatactggagtgggttgccatttgcttctcca

SEQ ID NO: 44855 - DNA, 201 bp, Bos taurus; identical to SEQ ID NO: 3245

SEQ ID NO: 44856 - DNA, 201 bp, Bos taurus; identical to SEQ ID NO: 3246

SEQ ID NO: 44857 - DNA, 201 bp, Bos taurus; identical to SEQ ID NO: 3247

SEQ ID NO: 44858 - DNA, 201 bp, Bos taurus; identical to SEQ ID NO: 3248

SEQ ID NO: 44859 - DNA, 201 bp, Bos taurus; identical to SEQ ID NO: 3249

SEQ ID NO: 44860 - DNA, 201 bp, Bos taurus; identical to SEQ ID NO: 3250

SEQ ID NO: 44861 - DNA, 201 bp, Bos taurus; identical to SEQ ID NO: 3251

SEQ ID NO: 44862 - DNA, 201 bp, Bos taurus; identical to SEQ ID NO: 3252

SEQ ID NO: 44863 - DNA, 201 bp, Bos taurus
tcctggaaatttctggccattacctgccaggaatagcatccttttataaattaaggtcttatcttttgcagcagcagcatctagcccagagagggctggcgcggcccagctcagagaggatccaagagcctgggagctatgtatagaaggcagggttgctcttccagcctttggaaatgttcaagcactgagagagtcacg

SEQ ID NO: 44864 - DNA, 201 bp, Bos taurus
ccatggtggctgacaggttctcctttaaagataataaatagctcacaattgctttactttggaaagtgctcttctgccctgggactctgtaataaccaaccgtggaaaaggaaaggcctggggatttatgagatgtcccaatttacaaccatctgggagaaatacagcagggcgttggtacatcagtgttttaaccagagt

SEQ ID NO: 44865 - DNA, 201 bp, Bos taurus
gtttttttggccacgaggcatgtgggatcttagctcctcaaccagggattgaacgtgcattggaagtcttaaccactggaccacgagggaagtccctagaatataggtttttaaacataggccatggactggtagtgactgtcatatatctgcttcactctgtcccgcactcactgtggagtgtgaaaggcttttgtccac

SEQ ID NO: 44866 - DNA, 201 bp, Bos taurus; identical to SEQ ID NO: 3253

SEQ ID NO: 44867 - DNA, 201 bp, Bos taurus
ttaactataatagaaatttttgaaagagtgatttcaaaagtttctattttagtgttacatatgtcatatagagggatacatttccctccttttattagaggacatcattccaatttttaatactttctggaatttcaaagaatcattaaagaatggagatattgtgattccattgggactatttcttaggatttatctaca

SEQ ID NO: 44868 - DNA, 201 bp, Bos taurus; identical to SEQ ID NO: 3254

SEQ ID NO: 44869 - DNA, 201 bp, Bos taurus; identical to SEQ ID NO: 3255

SEQ ID NO: 44870 - DNA, 201 bp, Bos taurus; identical to SEQ ID NO: 3256

SEQ ID NO: 44871 - DNA, 201 bp, Bos taurus
agacaaggcccagatccaaactattcatgagtcttaattttagaatgctcctctgctgaccttttgctcacttccaaagctcatcaacagaaatggattgaattgaccacattcctcccatagtgcctgtctcttttgcaatggcctctggaaacactcttactaatgctgcaacactgccatttaagacataagtcatgc

SEQ ID NO: 44872 - DNA, 201 bp, Bos taurus; identical to SEQ ID NO: 3257

SEQ ID NO: 44873 - DNA, 201 bp, Bos taurus; identical to SEQ ID NO: 3258

SEQ ID NO: 44874 - DNA, 201 bp, Bos taurus
ctctttttgctgccttgggaagctggagatcatctgatattaatgctacataaatttcattctgttcaaattatcacccattccttttgtcttctttccagcctctgaagacttttcccaatttccttctgaggctagtgtttccatctctcctatcctctcctccctccctaggtccttcttgactttgagccccttcca

SEQ ID NO: 44875 - DNA, 201 bp, Bos taurus
tgcatccagagggagcatgtggattttaacctgggaactaaataaataaactgtcagagctgaaagaaatgttccataggtcagatcctaaaaatagagttgatgggtagagtatgaaagcagatgtaattatgagattgagcagtctcaatctcgtcttttcatttaggagttggacaggggagaactggagccacagaa

SEQ ID NO: 44876 - DNA, 201 bp, Bos taurus; identical to SEQ ID NO: 3259

SEQ ID NO: 44877 - DNA, 201 bp, Bos taurus; identical to SEQ ID NO: 3260

SEQ ID NO: 44878 - DNA, 201 bp, Bos taurus
agccctgattaaatggcggggcagccaagggaaggcccccgccgccgccagagccaccgtcaccgcgccgactaggcagggactggcagtggcgggggctgtaactttaatgtctgcgtcccggccgcagggactgcggcggttggagctgagggtactgtcttgggcctcgggtcctgggttggagccgcgtgtgcggga

SEQ ID NO: 44879 - DNA, 201 bp, Bos taurus
actgccagataatttcttcagcaaaattaggtttactggggatcagcagaggattgcactttgaagtttaccaccatggtgagccacatgcaagtccctgtacagcaaggagaagagaacacttttatggaagggaaaacaaagttgtgagagctatagtaaacaaaaaagttcatggcttttcattggctgactacttgc

SEQ ID NO: 44880 - DNA, 201 bp, Bos taurus
tattctaaaaaggcaacactatagtgtggaaggaagatcagtacttacctaggctgatgtttcagggaggggattgactataaaagagtacaagggaacttgttgagatgatggaaattttctgtcttatgattatgatggtgttcacacacatacacgtttacccatgcttatgaaaatttacacataaactgggtgaat

SEQ ID NO: 44881 - DNA, 201 bp, Bos taurus; identical to SEQ ID NO: 3261

SEQ ID NO: 44882 - DNA, 201 bp, Bos taurus; identical to SEQ ID NO: 3262

SEQ ID NO: 44883 - DNA, 201 bp, Bos taurus; identical to SEQ ID NO: 3263

SEQ ID NO: 44884 - DNA, 201 bp, Bos taurus; identical to SEQ ID NO: 3264

SEQ ID NO: 44885 - DNA, 201 bp, Bos taurus; identical to SEQ ID NO: 3265

SEQ ID NO: 44886 - DNA, 201 bp, Bos taurus; identical to SEQ ID NO: 3266

SEQ ID NO: 44887 - DNA, 201 bp, Bos taurus; identical to SEQ ID NO: 3267

SEQ ID NO: 44888 - DNA, 201 bp, Bos taurus; identical to SEQ ID NO: 3268

SEQ ID NO: 44889 - DNA, 201 bp, Bos taurus
ttgcttaactctctgagcttggtttcttcattttaaaaaggaagaagtttcactaggtgacctttaaaaaaatttctccactctaactttgtgtgatttgccagggctaattacaaaacatttaggccagcagcacaacctttattaaaataaagatgtaaacagcaatgtgagagagaaggttagtgtgtgcagaagtca

SEQ ID NO: 44890 - DNA, 201 bp, Bos taurus
ttgcagacatttattttaaaatatgtcctcatctcaccaaatctcatcaaataaaccaaataaagaaggcaaggaaatttcaaagcgagagaacattaacccaaaaccagaggaggggagggaatgaaactgtaggataagagctaacaaataaatagctgttggggtgggataccataatcactgatttgaaacataaat

SEQ ID NO: 44891 - DNA, 201 bp, Bos taurus; identical to SEQ ID NO: 3269

SEQ ID NO: 44892 - DNA, 201 bp, Bos taurus; identical to SEQ ID NO: 3270

SEQ ID NO: 44893 - DNA, 201 bp, Bos taurus; identical to SEQ ID NO: 3271

SEQ ID NO: 44894 - DNA, 201 bp, Bos taurus; identical to SEQ ID NO: 3272

SEQ ID NO: 44895 - DNA, 201 bp, Bos taurus; identical to SEQ ID NO: 3273

SEQ ID NO: 44896 - DNA, 201 bp, Bos taurus; identical to SEQ ID NO: 3274

SEQ ID NO: 44897 - DNA, 201 bp, Bos taurus; identical to SEQ ID NO: 3275

SEQ ID NO: 44898 - DNA, 201 bp, Bos taurus; identical to SEQ ID NO: 3278

SEQ ID NO: 44899 - DNA, 201 bp, Bos taurus; identical to SEQ ID NO: 3279

SEQ ID NO: 44900 - DNA, 201 bp, Bos taurus; identical to SEQ ID NO: 3281

SEQ ID NO: 44901 - DNA, 201 bp, Bos taurus; identical to SEQ ID NO: 3282

SEQ ID NO: 44902 - DNA, 201 bp, Bos taurus; identical to SEQ ID NO: 3284

SEQ ID NO: 44903 - DNA, 201 bp, Bos taurus; identical to SEQ ID NO: 3288

SEQ ID NO: 44904 - DNA, 201 bp, Bos taurus; identical to SEQ ID NO: 3289

SEQ ID NO: 44905 - DNA, 201 bp, Bos taurus; identical to SEQ ID NO: 3290

SEQ ID NO: 44906 - DNA, 201 bp, Bos taurus; identical to SEQ ID NO: 3291

SEQ ID NO: 44907 - DNA, 201 bp, Bos taurus; identical to SEQ ID NO: 3292

SEQ ID NO: 44908 - DNA, 201 bp, Bos taurus; identical to SEQ ID NO: 3293

SEQ ID NO: 44909 - DNA, 201 bp, Bos taurus; identical to SEQ ID NO: 3294

SEQ ID NO: 44910 - DNA, 201 bp, Bos taurus; identical to SEQ ID NO: 3296

SEQ ID NO: 44911 - DNA, 201 bp, Bos taurus; identical to SEQ ID NO: 3297

SEQ ID NO: 44912 - DNA, 201 bp, Bos taurus; identical to SEQ ID NO: 3298

SEQ ID NO: 44913 - DNA, 201 bp, Bos taurus; identical to SEQ ID NO: 3302

SEQ ID NO: 44914 - DNA, 201 bp, Bos taurus; identical to SEQ ID NO: 3303

SEQ ID NO: 44915 - DNA, 201 bp, Bos taurus; identical to SEQ ID NO: 3304

SEQ ID NO: 44916 - DNA, 201 bp, Bos taurus; identical to SEQ ID NO: 3306

SEQ ID NO: 44917 - DNA, 201 bp, Bos taurus; identical to SEQ ID NO: 3307

SEQ ID NO: 44918 - DNA, 201 bp, Bos taurus; identical to SEQ ID NO: 3308

SEQ ID NO: 44919 - DNA, 201 bp, Bos taurus; identical to SEQ ID NO: 3309

SEQ ID NO: 44920 - DNA, 201 bp, Bos taurus; identical to SEQ ID NO: 3310

SEQ ID NO: 44921 - DNA, 201 bp, Bos taurus; identical to SEQ ID NO: 3312

SEQ ID NO: 44922 - DNA, 201 bp, Bos taurus; identical to SEQ ID NO: 3314

SEQ ID NO: 44923 - DNA, 201 bp, Bos taurus; identical to SEQ ID NO: 3319

SEQ ID NO: 44924 - DNA, 201 bp, Bos taurus; identical to SEQ ID NO: 3320

SEQ ID NO: 44925 - DNA, 201 bp, Bos taurus; identical to SEQ ID NO: 3322

SEQ ID NO: 44926 - DNA, 201 bp, Bos taurus; identical to SEQ ID NO: 3323

SEQ ID NO: 44927 - DNA, 201 bp, Bos taurus; identical to SEQ ID NO: 3325

SEQ ID NO: 44928 - DNA, 201 bp, Bos taurus; identical to SEQ ID NO: 3327

SEQ ID NO: 44929 - DNA, 201 bp, Bos taurus; identical to SEQ ID NO: 3328

SEQ ID NO: 44930 - DNA, 201 bp, Bos taurus; identical to SEQ ID NO: 3329

SEQ ID NO: 44931 - DNA, 201 bp, Bos taurus; identical to SEQ ID NO: 3331

SEQ ID NO: 44932 - DNA, 201 bp, Bos taurus; identical to SEQ ID NO: 3332

SEQ ID NO: 44933 - DNA, 201 bp, Bos taurus; identical to SEQ ID NO: 3335

SEQ ID NO: 44934 - DNA, 201 bp, Bos taurus; identical to SEQ ID NO: 3336

SEQ ID NO: 44935 - DNA, 201 bp, Bos taurus; identical to SEQ ID NO: 3337

SEQ ID NO: 44936 - DNA, 201 bp, Bos taurus; identical to SEQ ID NO: 3338

SEQ ID NO: 44937 - DNA, 201 bp, Bos taurus; identical to SEQ ID NO: 3339

SEQ ID NO: 44938 - DNA, 201 bp, Bos taurus; identical to SEQ ID NO: 3340

SEQ ID NO: 44939 - DNA, 201 bp, Bos taurus; identical to SEQ ID NO: 3341

SEQ ID NO: 44940 - DNA, 201 bp, Bos taurus; identical to SEQ ID NO: 3344

SEQ ID NO: 44941 - DNA, 201 bp, Bos taurus; identical to SEQ ID NO: 3345

SEQ ID NO: 44942 - DNA, 201 bp, Bos taurus; identical to SEQ ID NO: 3346

SEQ ID NO: 44943 - DNA, 201 bp, Bos taurus; identical to SEQ ID NO: 3347

SEQ ID NO: 44944 - DNA, 201 bp, Bos taurus; identical to SEQ ID NO: 3348

SEQ ID NO: 44945 - DNA, 201 bp, Bos taurus; identical to SEQ ID NO: 3352

SEQ ID NO: 44946 - DNA, 201 bp, Bos taurus; identical to SEQ ID NO: 3353

SEQ ID NO: 44947 - DNA, 201 bp, Bos taurus; identical to SEQ ID NO: 3354

SEQ ID NO: 44948 - DNA, 201 bp, Bos taurus; identical to SEQ ID NO: 3356

SEQ ID NO: 44949 - DNA, 201 bp, Bos taurus; identical to SEQ ID NO: 3357

SEQ ID NO: 44950 - DNA, 201 bp, Bos taurus; identical to SEQ ID NO: 3359

SEQ ID NO: 44951 - DNA, 201 bp, Bos taurus; identical to SEQ ID NO: 3360

SEQ ID NO: 44952 - DNA, 201 bp, Bos taurus; identical to SEQ ID NO: 3362

SEQ ID NO: 44953 - DNA, 201 bp, Bos taurus; identical to SEQ ID NO: 3363

SEQ ID NO: 44954 - DNA, 201 bp, Bos taurus; identical to SEQ ID NO: 3364

SEQ ID NO: 44955 - DNA, 201 bp, Bos taurus; identical to SEQ ID NO: 3365

SEQ ID NO: 44956 - DNA, 201 bp, Bos taurus; identical to SEQ ID NO: 3367

SEQ ID NO: 44957 - DNA, 201 bp, Bos taurus; identical to SEQ ID NO: 3368

SEQ ID NO: 44958 - DNA, 201 bp, Bos taurus; identical to SEQ ID NO: 3371

SEQ ID NO: 44959 - DNA, 201 bp, Bos taurus; identical to SEQ ID NO: 3372

SEQ ID NO: 44960 - DNA, 201 bp, Bos taurus; identical to SEQ ID NO: 3378

SEQ ID NO: 44961 - DNA, 201 bp, Bos taurus; identical to SEQ ID NO: 3379

SEQ ID NO: 44962 - DNA, 201 bp, Bos taurus; identical to SEQ ID NO: 3380

SEQ ID NO: 44963 - DNA, 201 bp, Bos taurus; identical to SEQ ID NO: 3382

SEQ ID NO: 44964 - DNA, 201 bp, Bos taurus; identical to SEQ ID NO: 3383

SEQ ID NO: 44965 - DNA, 201 bp, Bos taurus; identical to SEQ ID NO: 3384

SEQ ID NO: 44966 - DNA, 201 bp, Bos taurus; identical to SEQ ID NO: 3386

SEQ ID NO: 44967 - DNA, 201 bp, Bos taurus; identical to SEQ ID NO: 3387

SEQ ID NO: 44968 - DNA, 201 bp, Bos taurus; identical to SEQ ID NO: 3388

SEQ ID NO: 44969 - DNA, 201 bp, Bos taurus; identical to SEQ ID NO: 3389

SEQ ID NO: 44970 - DNA, 201 bp, Bos taurus; identical to SEQ ID NO: 3390

SEQ ID NO: 44971 - DNA, 201 bp, Bos taurus; identical to SEQ ID NO: 3393

SEQ ID NO: 44972 - DNA, 201 bp, Bos taurus; identical to SEQ ID NO: 3394

SEQ ID NO: 44973 - DNA, 201 bp, Bos taurus; identical to SEQ ID NO: 3395

SEQ ID NO: 44974 - DNA, 201 bp, Bos taurus; identical to SEQ ID NO: 3396

SEQ ID NO: 44975 - DNA, 201 bp, Bos taurus; identical to SEQ ID NO: 3397

SEQ ID NO: 44976 - DNA, 201 bp, Bos taurus; identical to SEQ ID NO: 3399

SEQ ID NO: 44977 - DNA, 201 bp, Bos taurus; identical to SEQ ID NO: 3401

SEQ ID NO: 44978 - DNA, 201 bp, Bos taurus; identical to SEQ ID NO: 3402

SEQ ID NO: 44979 - DNA, 201 bp, Bos taurus; identical to SEQ ID NO: 3403

SEQ ID NO: 44980 - DNA, 201 bp, Bos taurus; identical to SEQ ID NO: 3404

SEQ ID NO: 44981 - DNA, 201 bp, Bos taurus; identical to SEQ ID NO: 3405

SEQ ID NO: 44982 - DNA, 201 bp, Bos taurus; identical to SEQ ID NO: 3406

SEQ ID NO: 44983 - DNA, 201 bp, Bos taurus; identical to SEQ ID NO: 3407

SEQ ID NO: 44984 - DNA, 201 bp, Bos taurus; identical to SEQ ID NO: 3408

SEQ ID NO: 44985 - DNA, 201 bp, Bos taurus; identical to SEQ ID NO: 3409

SEQ ID NO: 44986 - DNA, 201 bp, Bos taurus; identical to SEQ ID NO: 3410

SEQ ID NO: 44987 - DNA, 201 bp, Bos taurus; identical to SEQ ID NO: 3411

SEQ ID NO: 44988 - DNA, 201 bp, Bos taurus; identical to SEQ ID NO: 3412

SEQ ID NO: 44989 - DNA, 201 bp, Bos taurus; identical to SEQ ID NO: 3413

SEQ ID NO: 44990 - DNA, 201 bp, Bos taurus; identical to SEQ ID NO: 3414

SEQ ID NO: 44991 - DNA, 201 bp, Bos taurus; identical to SEQ ID NO: 3415

SEQ ID NO: 44992 - DNA, 201 bp, Bos taurus
gcagcacttaatctcccgaagttcctggccccccgctgtggcccaactctaggagtcaccacctctccctgtcctctctctcctacaaagtccagggagccgcagggtgggggtgacgtcccaggacaaaagagggagaccactgagtgcaggaccacgtgtgggtggagcccctggagaagaggagcagttcctgaccat

SEQ ID NO: 44993 - DNA, 201 bp, Bos taurus; identical to SEQ ID NO: 3417

SEQ ID NO: 44994 - DNA, 201 bp, Bos taurus; identical to SEQ ID NO: 3418

SEQ ID NO: 44995 - DNA, 201 bp, Bos taurus
aagctatagtgccaccttctggaagacaaaaagaggtttcctgcagccggcgcggtgagctatgagaacaagaggagacactcagaaggaagaattccaccccaggagagaacgagagtggagcaagtctaccccttataaacctaggatccctggagaagcaacaccgaagaacagtacctcatcaaagataaccagtaa

SEQ ID NO: 44996 - DNA, 201 bp, Bos taurus; identical to SEQ ID NO: 3421

SEQ ID NO: 44997 - DNA, 201 bp, Bos taurus; identical to SEQ ID NO: 3422

SEQ ID NO: 44998 - DNA, 201 bp, Bos taurus; identical to SEQ ID NO: 3423

SEQ ID NO: 44999 - DNA, 201 bp, Bos taurus; identical to SEQ ID NO: 3424

SEQ ID NO: 45000 - DNA, 201 bp, Bos taurus; identical to SEQ ID NO: 3425

SEQ ID NO: 45001 - DNA, 201 bp, Bos taurus; identical to SEQ ID NO: 3427

SEQ ID NO: 45002 - DNA, 201 bp, Bos taurus; identical to SEQ ID NO: 3428

SEQ ID NO: 45003 - DNA, 201 bp, Bos taurus
cactgagaacaggagggaagccatcaaaacacagggttttgattaatttcttgatgatacagacagaggtaggactgcaaaagagagcagtagctaagaacatgcttaggaagggctacagtaaaagtgggaaacactgattatcctcagtggaaccagacagcctccaagtccaaagtcagaaagtacagaagtagatgt

SEQ ID NO: 45004 - DNA, 201 bp, Bos taurus
gccaggatactggagtgggtagccattcccttctccaggggatcttcccagcccagggatcgaacccaggtctcccatattgcaggtggtttctttaccaactccaggggacatcagtcaggccctacccattgacttgtgcaccatggcaaccttcagaaaagaaggcctatagtctttcactattgtgatctgttgggc

SEQ ID NO: 45005 - DNA, 201 bp, Bos taurus
ggagaaaagatctacgtatgtatatattttcccagagtattttttttttaaaggaagaaattttcacgaatgcaattacagtgtttggtgctttttttttaaagtcatcagcaaattcctcaagagcacttcattctcttaagaggactggattcctaaactatgctggtgcagaaaacaatctggcactgcccacttgtc

SEQ ID NO: 45006 - DNA, 201 bp, Bos taurus; identical to SEQ ID NO: 3430

SEQ ID NO: 45007 - DNA, 201 bp, Bos taurus; identical to SEQ ID NO: 3431

SEQ ID NO: 45008 - DNA, 201 bp, Bos taurus
taggagtcaattactttggtatctgcacggaaacagtaatatgggcagctctctccctccactggacttcagtctagactgccaagaaaatcccatggccctagagatgaaaggaacacagaaatggcaattaacaatgtcgctaaatatataacattccattccaagcacaataggcaactggaacatttcttgtactct

SEQ ID NO: 45009 - DNA, 201 bp, Bos taurus
tctcatgacacctaagaaggagacagtgagggcagagaaaccatcaacaccaccaagcagatcaaccaaactaactcttacagaagcttactatgagctgggaactctactaagcacttttttaagttgcctttgaatatttatgaaaaaaaacaaaaaacaaaaaacatagccaatgtttactgaatgcatgctgtatgt

SEQ ID NO: 45010 - DNA, 201 bp, Bos taurus; identical to SEQ ID NO: 3433

SEQ ID NO: 45011 - DNA, 201 bp, Bos taurus; identical to SEQ ID NO: 3434

SEQ ID NO: 45012 - DNA, 201 bp, Bos taurus; identical to SEQ ID NO: 3435

SEQ ID NO: 45013 - DNA, 201 bp, Bos taurus; identical to SEQ ID NO: 3437

SEQ ID NO: 45014 - DNA, 201 bp, Bos taurus
tcccaagaatttttgttttctcaaatttttcacaagattttgttggatttggttgcagaggttagagtcttaaatatccataagacagaaataggaacttgacttgctattaatctaagtagcaataaaacagggagaaactagtttttatgctagagtactcactactttgcacacaatacaattttatacaaatgacca

SEQ ID NO: 45015 - DNA, 201 bp, Bos taurus; identical to SEQ ID NO: 3442

SEQ ID NO: 45016 - DNA, 201 bp, Bos taurus; identical to SEQ ID NO: 3443

SEQ ID NO: 45017 - DNA, 201 bp, Bos taurus
ccagggaaaaagaaatggggttcttgtgaaggaagctggacttgattaaaattgaaaacttcagctctgcaaaagacaattaggagaataaaaagacaagacagactggggatgatctttttaaaatgtatctgataaggtctggtatacaacacatgtgctttcctggtggctcaaacggtaaagaatctgcctgcaatg

SEQ ID NO: 45018 - DNA, 201 bp, Bos taurus
actctaagatttgtttagctcacagctcctagtttttgttctttacccagcctcgtatagtttcattttacatacgtttagatgattattctgccaaatactcaaggaaatccctaggcagagtttctgatctccttctttacatatctcccttctcttttgtgtttcaccccagatggcagccacctcagtcttccaagt

SEQ ID NO: 45019 - DNA, 201 bp, Bos taurus; identical to SEQ ID NO: 3444

SEQ ID NO: 45020 - DNA, 201 bp, Bos taurus; identical to SEQ ID NO: 3445

SEQ ID NO: 45021 - DNA, 201 bp, Bos taurus; identical to SEQ ID NO: 3450

SEQ ID NO: 45022 - DNA, 201 bp, Bos taurus; identical to SEQ ID NO: 3451

SEQ ID NO: 45023 - DNA, 201 bp, Bos taurus; identical to SEQ ID NO: 3452

SEQ ID NO: 45024 - DNA, 201 bp, Bos taurus; identical to SEQ ID NO: 3453

SEQ ID NO: 45025 - DNA, 201 bp, Bos taurus; identical to SEQ ID NO: 3454

SEQ ID NO: 45026 - DNA, 201 bp, Bos taurus
agaagcaatattgtttaaaaaaatttcaataaggacttaaaaagagataggaggggaataacacaagggtttgaatcccaggaggtagcttgtctcagaggatgtccatcacagctcatttgcccctcacaaacttctcatccaaaaagtaatcactgttaatagtttcttatgagtctttacagaggaaaaaaattggat

SEQ ID NO: 45027 - DNA, 201 bp, Bos taurus; identical to SEQ ID NO: 3456

SEQ ID NO: 45028 - DNA, 201 bp, Bos taurus; identical to SEQ ID NO: 3457

SEQ ID NO: 45029 - DNA, 201 bp, Bos taurus
ggtaaccaggtaaaaggtggagtctgtgatgcctgcaaatgaagagttaaatgtttaaaattcatattatattggtgttaataatggagctagagagacttatgtttcatgattattagtggttttcagtctgggtgatggagtaagggttatactgacactggaggatgagatttttaattaccaattgtgaatgagtta

SEQ ID NO: 45030 - DNA, 201 bp, Bos taurus; identical to SEQ ID NO: 3458

SEQ ID NO: 45031 - DNA, 201 bp, Bos taurus
taaagcattttagaaaaggatttactcttcacatgtccaaatttttgctttatgtctgaacactgttgtggaaacaagaggcccaagtttgttgagaaccccagatgcagggcagggtctctgtttgctgtgactgtggctgcctctgctggcctgcctgtccctatatcagctgcccagctactccatccagtcctctgc

SEQ ID NO: 45032 - DNA, 201 bp, Bos taurus; identical to SEQ ID NO: 3460

SEQ ID NO: 45033 - DNA, 201 bp, Bos taurus; identical to SEQ ID NO: 3461

SEQ ID NO: 45034 - DNA, 201 bp, Bos taurus; identical to SEQ ID NO: 3462

SEQ ID NO: 45035 - DNA, 201 bp, Bos taurus; identical to SEQ ID NO: 3463

SEQ ID NO: 45036 - DNA, 201 bp, Bos taurus
agccatttgtttacgttccaggggttgtaaacctagagaccttctcctttctccagactatttatttatattccataacagacatcaatttctttccatctctagagagttagatgtaccaaccacccagtttcacagtttagtggttactctcctgtgacacataccctgcatctgttttcatcccatcatcaccctatg

SEQ ID NO: 45037 - DNA, 201 bp, Bos taurus; identical to SEQ ID NO: 3465

SEQ ID NO: 45038 - DNA, 201 bp, Bos taurus; identical to SEQ ID NO: 3466

SEQ ID NO: 45039 - DNA, 201 bp, Bos taurus
tagttatattttttaaaatttactcattggtttaagtgggaccacctaaaaaaatctgagagaatgcacacacacacacacaaaatccaagattatgatcatcaaggactctttctaggtgcccagcagtgttggcaacaagcaaacacaaagtatactgtaaagaaaaattgacaatgtgatttcatgtttttatttatt

SEQ ID NO: 45040 - DNA, 201 bp, Bos taurus; identical to SEQ ID NO: 3467

SEQ ID NO: 45041 - DNA, 201 bp, Bos taurus; identical to SEQ ID NO: 3468

SEQ ID NO: 45042 - DNA, 201 bp, Bos taurus; identical to SEQ ID NO: 3469

SEQ ID NO: 45043 - DNA, 201 bp, Bos taurus; identical to SEQ ID NO: 3470

SEQ ID NO: 45044 - DNA, 201 bp, Bos taurus; identical to SEQ ID NO: 3471

SEQ ID NO: 45045 - DNA, 201 bp, Bos taurus; identical to SEQ ID NO: 3472

SEQ ID NO: 45046 - DNA, 201 bp, Bos taurus
aagattttctaacaaggccatatcagcacagcaaacacactgagttaattttccaggaacagagagaattatgtgttggagcgtgcatcatctctcactcatccccctttttgaacaaggcctgccaacattctcaaggttgctgatcagggctgtagtcacatgtacagcaactaattggcccatagtccacatcctaga

SEQ ID NO: 45047 - DNA, 201 bp, Bos taurus; identical to SEQ ID NO: 3474

SEQ ID NO: 45048 - DNA, 201 bp, Bos taurus; identical to SEQ ID NO: 3475

SEQ ID NO: 45049 - DNA, 201 bp, Bos taurus; identical to SEQ ID NO: 3476

SEQ ID NO: 45050 - DNA, 201 bp, Bos taurus; identical to SEQ ID NO: 3477

SEQ ID NO: 45051 - DNA, 201 bp, Bos taurus
atcaccatttcacctctgtttctctgagtttatcttttttccacatgtaagtgatatcatatagtatttcaaagttccctttatatggccttattaaaaattgttgctgctgtatggtgttgtatacatatgcatatgaagtcctggataatatacatgaatctatctcagaggttaggctgagagatttggtgggaagat

SEQ ID NO: 45052 - DNA, 201 bp, Bos taurus
taaatagagaacactggagggacacggtcacaagaaaggggcttcctgtcccagatatgatgtgcttctgccttcagcatcattcagtgtgcagctgcaagtggtatcaacctctcagtgaatcttgccaccaccccagccagtggctgtccagtaagtcatgaaggcatcccagtgcttggtttcccactggaaagcttc

SEQ ID NO: 45053 - DNA, 201 bp, Bos taurus; identical to SEQ ID NO: 3478

SEQ ID NO: 45054 - DNA, 201 bp, Bos taurus; identical to SEQ ID NO: 3479

SEQ ID NO: 45055 - DNA, 201 bp, Bos taurus; identical to SEQ ID NO: 3480

SEQ ID NO: 45056 - DNA, 201 bp, Bos taurus; identical to SEQ ID NO: 3481

SEQ ID NO: 45057 - DNA, 201 bp, Bos taurus; identical to SEQ ID NO: 3482

SEQ ID NO: 45058 - DNA, 201 bp, Bos taurus; identical to SEQ ID NO: 3484

SEQ ID NO: 45059 - DNA, 201 bp, Bos taurus; identical to SEQ ID NO: 3485

SEQ ID NO: 45060 - DNA, 201 bp, Bos taurus
cctgaaagggactcctagggcttccggctgaaaatggcttctaggccacagtatcacaggaaccttttagtcaaactcaataaaatatattctgtccaaagatctcaaaatatcaccagatttctaactaccactaatatacacagattttaaccttctgatacataaacatgggtggggtcttgagaaggctcagtaatt

SEQ ID NO: 45061 - DNA, 201 bp, Bos taurus; identical to SEQ ID NO: 3486

SEQ ID NO: 45062 - DNA, 201 bp, Bos taurus
aaactgcaaaatggggggtgggggggggggtaggctctgaaaataactgcagtataaaaagggattaacagtcatcttaatgtatgaagaacacttgtaaatcagtatttaaaagatgaacgtccaaatggacaaaaaggacttgaacagataattcagaaagatataaatacgaatgactggtatggaaatgctgaactt

SEQ ID NO: 45063 - DNA, 201 bp, Bos taurus
tttataattctagataatcctgacatacatgccccaagaaatcggctgaaatttcaaaggattcaacagttctcttattaatactctttttttggacatttaatctctagttgcatgttttaaaagtaactaacaactactaagtacttgcatgtgtatgtgctgagtggcttcagccgtgtctgattctctgtgacccta

SEQ ID NO: 45064 - DNA, 201 bp, Bos taurus; identical to SEQ ID NO: 3487

SEQ ID NO: 45065 - DNA, 201 bp, Bos taurus; identical to SEQ ID NO: 3488

SEQ ID NO: 45066 - DNA, 201 bp, Bos taurus; identical to SEQ ID NO: 3489

SEQ ID NO: 45067 - DNA, 201 bp, Bos taurus; identical to SEQ ID NO: 3490

SEQ ID NO: 45068 - DNA, 201 bp, Bos taurus; identical to SEQ ID NO: 3491

SEQ ID NO: 45069 - DNA, 201 bp, Bos taurus; identical to SEQ ID NO: 3492

SEQ ID NO: 45070 - DNA, 201 bp, Bos taurus; identical to SEQ ID NO: 3493

SEQ ID NO: 45071 - DNA, 201 bp, Bos taurus
ttccccacaatagaaatttccagctgcactctcatggtatggttcactgttttcctgtgtcatctgtacgacccacaaattggcaggtggatcagaaagcttgaacatactcagattcaataccgtaaatttggacttggagccctcagaacagtgagaccaaaaaaagaaaaaagtatgttgtcttaagttacccaattt

SEQ ID NO: 45072 - DNA, 201 bp, Bos taurus; identical to SEQ ID NO: 3495

SEQ ID NO: 45073 - DNA, 201 bp, Bos taurus; identical to SEQ ID NO: 3496

SEQ ID NO: 45074 - DNA, 201 bp, Bos taurus; identical to SEQ ID NO: 3497

SEQ ID NO: 45075 - DNA, 201 bp, Bos taurus; identical to SEQ ID NO: 3499

SEQ ID NO: 45076 - DNA, 201 bp, Bos taurus; identical to SEQ ID NO: 3503

SEQ ID NO: 45077 - DNA, 201 bp, Bos taurus; identical to SEQ ID NO: 3504

SEQ ID NO: 45078 - DNA, 201 bp, Bos taurus; identical to SEQ ID NO: 3505

SEQ ID NO: 45079 - DNA, 201 bp, Bos taurus; identical to SEQ ID NO: 3506

SEQ ID NO: 45080 - DNA, 201 bp, Bos taurus; identical to SEQ ID NO: 3507

SEQ ID NO: 45081 - DNA, 201 bp, Bos taurus; identical to SEQ ID NO: 3508

SEQ ID NO: 45082 - DNA, 201 bp, Bos taurus; identical to SEQ ID NO: 3509

SEQ ID NO: 45083 - DNA, 201 bp, Bos taurus; identical to SEQ ID NO: 3510

SEQ ID NO: 45084 - DNA, 201 bp, Bos taurus; identical to SEQ ID NO: 3511

SEQ ID NO: 45085 - DNA, 201 bp, Bos taurus
aatactagattctctaactttttcccagacaagagtaaatataaacaacataaaatcaattctaccatttttgtgcctagcattgcatattatccctgatccttaaaaagtccacatagcctttgggttataacaactttaatacagtagtgcctgttaggggaaagttatgcccctaaaacaccattatttttaaaatat

SEQ ID NO: 45086 - DNA, 201 bp, Bos taurus; identical to SEQ ID NO: 3512

SEQ ID NO: 45087 - DNA, 201 bp, Bos taurus; identical to SEQ ID NO: 3513

SEQ ID NO: 45088 - DNA, 201 bp, Bos taurus
ttcccctgggttttgtgtgttcaggttattcttaactggcttactcttgggaggaaactgaggcaagccgggagctgctggtgcagagtcattgttgagagcctgggcttctattcattctctgggtgacagcgagctgcccacttaactcttgatcatttgttgccatcagatgctggagggatgtttgatttcaagtcc

SEQ ID NO: 45089 - DNA, 201 bp, Bos taurus; identical to SEQ ID NO: 3514

SEQ ID NO: 45090 - DNA, 201 bp, Bos taurus; identical to SEQ ID NO: 3515

SEQ ID NO: 45091 - DNA, 201 bp, Bos taurus; identical to SEQ ID NO: 3516

SEQ ID NO: 45092 - DNA, 201 bp, Bos taurus
actgaaaatctcaggccatggccaggcccctccctggtagtgacactgaagtgaaccaaaaaagacttgatgtctgtgtccaggtgaataaattaattagtgttaagtttggccacgtttagcagagatccaaaataacagtggcttcaccaagacagagccgacgtctctcacacactcagcacaagtccagggataggt

SEQ ID NO: 45093 - DNA, 201 bp, Bos taurus
atgtcatagtctctgtgccgctggcaccacgctgactcctccaccgatggggaggactcaggctggccggagaggcgaacacactgcaaggcagggccccaggaggcagcccccctcccagcccagctgttccctcagactgggctgagcaagaggtaaggtcccacctggctgtccccaaacccttagcaccccaactta

SEQ ID NO: 45094 - DNA, 201 bp, Bos taurus
aggccaaacttcttgatatgagctcccaaagtagagattctgatttaatatgttagctcaagttgctagaaatggctcttagagtttgtttggttacttaactgaaatacagaacttaagatggcccaggactgaagttcctgaatggactgactgaattttcccttgtgaactatagagcagggcttctccaccttggcg

SEQ ID NO: 45095 - DNA, 201 bp, Bos taurus; identical to SEQ ID NO: 3519

SEQ ID NO: 45096 - DNA, 201 bp, Bos taurus; identical to SEQ ID NO: 3520

SEQ ID NO: 45097 - DNA, 201 bp, Bos taurus; identical to SEQ ID NO: 3523

SEQ ID NO: 45098 - DNA, 201 bp, Bos taurus; identical to SEQ ID NO: 3524

SEQ ID NO: 45099 - DNA, 201 bp, Bos taurus
agacttcctgctgctgccctttctggtggccctttttgcccaatgcttttgaaaagttctgtgtcattgtcagacctctgtatagcaaattgcctgttgcaaatggatgctgaacaggccacaggggcttcatctttgtggaaagaaggaagtggctggagggtagacttaagaggctacccttccaggcactgcagccta

SEQ ID NO: 45100 - DNA, 201 bp, Bos taurus; identical to SEQ ID NO: 3525

SEQ ID NO: 45101 - DNA, 201 bp, Bos taurus; identical to SEQ ID NO: 3526

SEQ ID NO: 45102 - DNA, 201 bp, Bos taurus; identical to SEQ ID NO: 3527

SEQ ID NO: 45103 - DNA, 201 bp, Bos taurus; identical to SEQ ID NO: 3528

SEQ ID NO: 45104 - DNA, 201 bp, Bos taurus; identical to SEQ ID NO: 3529

SEQ ID NO: 45105 - DNA, 201 bp, Bos taurus; identical to SEQ ID NO: 3530

SEQ ID NO: 45106 - DNA, 201 bp, Bos taurus; identical to SEQ ID NO: 3531

SEQ ID NO: 45107 - DNA, 201 bp, Bos taurus; identical to SEQ ID NO: 3533

SEQ ID NO: 45108 - DNA, 201 bp, Bos taurus; identical to SEQ ID NO: 3534

SEQ ID NO: 45109 - DNA, 201 bp, Bos taurus; identical to SEQ ID NO: 3535

SEQ ID NO: 45110 - DNA, 201 bp, Bos taurus; identical to SEQ ID NO: 3536

SEQ ID NO: 45111 - DNA, 201 bp, Bos taurus; identical to SEQ ID NO: 3537

SEQ ID NO: 45112 - DNA, 201 bp, Bos taurus; identical to SEQ ID NO: 3538

SEQ ID NO: 45113 - DNA, 201 bp, Bos taurus; identical to SEQ ID NO: 3539

SEQ ID NO: 45114 - DNA, 201 bp, Bos taurus; identical to SEQ ID NO: 3540

SEQ ID NO: 45115 - DNA, 201 bp, Bos taurus
cccagacccaaggggccagcgatgcccattcctccagcaaagtggaccgtgccacacgtcacaggctcacctccctgccttgaatcccagggcttcgaattcgagcagggcccctgcttctgcattcaccctgcttaagccgccccagaatagcacagtgagggtgctttgttttgatttcctgattctagccaggagaaa

SEQ ID NO: 45116 - DNA, 201 bp, Bos taurus
ggccgggttgtgagaatatttttcaagaaagagtgacccaacatattcagaatttggtaagttctttcaggctaactttattttgaatgtttctcagggtccctaaattgagattatataaaggccactaaggcattacttcagccttagtgaagtaattatttattatacttatttattactctaacctcatattaaaag

SEQ ID NO: 45117 - DNA, 201 bp, Bos taurus
ggcctgagcatcggcatcacacaggcataaaggaaccctccgtgagcacgtgtgacatgaatgaatgaatccatccaccacagatttttcctttggcttccatgtggctttgaggagaccagctcgtcttgctctgcctcttactatccctcttccccataacatcagaaaaatcattcctgccgttaaggaatttatgag

SEQ ID NO: 45118 - DNA, 201 bp, Bos taurus; identical to SEQ ID NO: 3542

SEQ ID NO: 45119 - DNA, 201 bp, Bos taurus
ctaagtgcccatgacctggaagatacaggaagacccagaggtggggaccacgatgatgagggcacgtactgtcaccagagcagggccagcaggcttaggacgggagtcgaaggagagggcgggagggcaaagtggggttagcaagagccaggagaaagccaagggctctgtgggcggaaggctggaggccagcccacggga

SEQ ID NO: 45120 - DNA, 201 bp, Bos taurus
tctggagggaactgtcaacagtccctgttttggaacctgccgagcaccaggaaagcgtgcctgccacagccctgccttactgtacccactcacgggcccataagccaatcaacagctctctggtttgcaagaggcgagatgaggaagcctgtaattataaatttactgagcagaaaggtgccaggcctcattccccatctt

SEQ ID NO: 45121 - DNA, 201 bp, Bos taurus; identical to SEQ ID NO: 3543

SEQ ID NO: 45122 - DNA, 201 bp, Bos taurus
cctgatcctgaccctccctgcactgccaggcagcggggaggcccaaggtctcaagagaagacacaggaggaagagaccggaaacagaagacggccatttcccctccactcggtgccgtaaggacgtccgcccatcaccagcttcgaggaatctcctcagccctctgcagcttctggagaacaagacagcgcctgagggtcg

SEQ ID NO: 45123 - DNA, 201 bp, Bos taurus; identical to SEQ ID NO: 3544

SEQ ID NO: 45124 - DNA, 201 bp, Bos taurus; identical to SEQ ID NO: 3545

SEQ ID NO: 45125 - DNA, 201 bp, Bos taurus
tgtgctacagcttaatttttaaaatagtctacctgggaaatgctttcccgaaacaaacaagcaaacaatcccccaaactacaggtgtgggccatcattacgttttctgacttttgtgcctttaatgtgtttcaagtctctctgaggtgcatgatacgtgtgatttgtttgagtttcagccattatggcctttacatataat

SEQ ID NO: 45126 - DNA, 201 bp, Bos taurus; identical to SEQ ID NO: 3548

SEQ ID NO: 45127 - DNA, 201 bp, Bos taurus
atgaaatgactatggcttcctttttgcttgtttcaaacctgactgctctccaatcattacacgtctctcatgattcccaagagatttcagctgctaatgtattgtgttggccaaaaagttcattagaatttttccataaggtgctatagaaaatcccaaaggaactttttggccagcccagtgattgcacacttcaattca

SEQ ID NO: 45128 - DNA, 201 bp, Bos taurus; identical to SEQ ID NO: 3552

SEQ ID NO: 45129 - DNA, 201 bp, Bos taurus; identical to SEQ ID NO: 3553

SEQ ID NO: 45130 - DNA, 201 bp, Bos taurus; identical to SEQ ID NO: 3554

SEQ ID NO: 45131 - DNA, 201 bp, Bos taurus; identical to SEQ ID NO: 3555

SEQ ID NO: 45132 - DNA, 201 bp, Bos taurus; identical to SEQ ID NO: 3556

SEQ ID NO: 45133 - DNA, 201 bp, Bos taurus; identical to SEQ ID NO: 3557

SEQ ID NO: 45134 - DNA, 201 bp, Bos taurus; identical to SEQ ID NO: 3558

SEQ ID NO: 45135 - DNA, 201 bp, Bos taurus
aactctgccttgacacacaggtaaaaagatgaacacatggctggtttctgactaacaaaattcaaaggacaaatcacgtaagttgtgaggggctagtgtggaatttgaacacttgtcgatactgatttgctggccttaagctggactattctgagtaactactgattcgctcaatcataaagagcccgaggacaatggatt

SEQ ID NO: 45136 - DNA, 201 bp, Bos taurus
agggccccaaacagcaaggtgacatgaacgcaggccgtaacaagtggccagggcgcaggaaaacagaacagacaaatcccaggctcttaattggcactgtaagcagggggctcacttcacaacgcagcacaccctatgccgtgtttaatcatttgttcagctggctgtggaggtggcctgtatccagcacagcacccatga

SEQ ID NO: 45137 - DNA, 201 bp, Bos taurus
cccaaaatgaatttttaaaaggcccctcgtgatctctcaacctggtttcatcctctcattcaagctttcttcattccacatctaccggctaagtttctctcttgtgtacaggccatgctctatcctcaggtttttgaccaagactaaacaactctctccaggttttcctttgttaatttctatttatctgttgaataaatc

SEQ ID NO: 45138 - DNA, 201 bp, Bos taurus
acccccttttctctgccagaggaactgattatcttttcctttctgctaaaacaatgtgactatatgacataatcgactcttcacccgtctacagcaaattgtggatcatttaatggcaaatttagaaccaggtcctggacctcagatatgagtgtcaaaatcttcaagttccaactaagtatttgaaataaatgaaaccat

SEQ ID NO: 45139 - DNA, 201 bp, Bos taurus; identical to SEQ ID NO: 3559

SEQ ID NO: 45140 - DNA, 201 bp, Bos taurus; identical to SEQ ID NO: 3560

SEQ ID NO: 45141 - DNA, 201 bp, Bos taurus; identical to SEQ ID NO: 3562

SEQ ID NO: 45142 - DNA, 201 bp, Bos taurus; identical to SEQ ID NO: 3564

SEQ ID NO: 45143 - DNA, 201 bp, Bos taurus; identical to SEQ ID NO: 3565

SEQ ID NO: 45144 - DNA, 201 bp, Bos taurus; identical to SEQ ID NO: 3566

SEQ ID NO: 45145 - DNA, 201 bp, Bos taurus; identical to SEQ ID NO: 3568

SEQ ID NO: 45146 - DNA, 201 bp, Bos taurus; identical to SEQ ID NO: 3569

SEQ ID NO: 45147 - DNA, 201 bp, Bos taurus
cccacaggtgatcgccaggcggggtcgcccccttcctgccgcccggagtcttccacagggttccccgccaccggcagcacgcccacctcttcctgggctcgatgaacacggagggcacgctggccgtggggtccaggatcttgtcgatctgcatctgcgccctgcggtacacgcggtgccgctcccgcgtgtcgcccgatg

SEQ ID NO: 45148 - DNA, 201 bp, Bos taurus; identical to SEQ ID NO: 3570

SEQ ID NO: 45149 - DNA, 201 bp, Bos taurus
tcgctgagtggtggggggctgggcatggcctggcgtctcccttcattagcctcagtgaagcctgtcattccaggccttatttcacccacctggggcctggcagtttctgggtttggtgggcggtgtgtgggcacctcaagctgatttagaaagcccatggcacccagcatggtggcctaaagggcacagtcagagcccagt

SEQ ID NO: 45150 - DNA, 201 bp, Bos taurus
ccgtagcccgccaggctcctctggccatgggattctccaggcaagaatactggaatgggttgccatgtccttctccaggggatcttcccaaaccaaggatcgaacccaggtaggccacatgctactctttttaatttaaaaagccctctacaaagcaggggagtctggtactggccagcctggccgccctctgggtcagcg

SEQ ID NO: 45151 - DNA, 201 bp, Bos taurus
gaaaagttttcattggttaacacttagcttccactggcccgtagtgagttctcagaaatgcttctcagggctggactgaaccagcacgaggctggagagcaagtatgctgtactgcgtggggccccctgatgcccagctcttggcaagtgaatggtaccaaagtcaaggctcgtccttgggttatttcccttcttatggca

SEQ ID NO: 45152 - DNA, 201 bp, Bos taurus
caaggcagggttgtcacaaactttcaatttgtaaaaaccacactatctgtgaagtacaatcaatcatggtatgttggtatttacagtcttagttgaaaatgacacatttgtgatttaacattatgatatactgttctgcatttttgtaaaaagatttttattaattcttataatttgtctatagctcacttattcattcat

SEQ ID NO: 45153 - DNA, 201 bp, Bos taurus
ccctagcctgcccaatactcagtgcgtgttatctccaaggcctgaaatgaaccagtgctcaggctgggcctatgcgtccctgtcctgtgatgctggcctcggctgaagctgggacgctcttagtccttaaactcgaagacttacaatcccgagggatgacacacagaaacccttacagaaacacacggatcaatcagaaca

SEQ ID NO: 45154 - DNA, 201 bp, Bos taurus; identical to SEQ ID NO: 3572

SEQ ID NO: 45155 - DNA, 201 bp, Bos taurus
gctactgtgtcattctgacaaaaacaaatccaggtgccacaaagaccctgaaatgtcaaaccactgaagagacagaaattgttgcaaattaaaactaatccataaaatagtgtctgggaactctgtgcctgatgccaatctgcagcaaagtcaacaacgagtaaaaaataaaactttaacacccaagtaaaaagcaataat

SEQ ID NO: 45156 - DNA, 201 bp, Bos taurus; identical to SEQ ID NO: 3573

SEQ ID NO: 45157 - DNA, 201 bp, Bos taurus; identical to SEQ ID NO: 3575

SEQ ID NO: 45158 - DNA, 201 bp, Bos taurus; identical to SEQ ID NO: 3576

SEQ ID NO: 45159 - DNA, 201 bp, Bos taurus; identical to SEQ ID NO: 3577

SEQ ID NO: 45160 - DNA, 201 bp, Bos taurus; identical to SEQ ID NO: 3578

SEQ ID NO: 45161 - DNA, 201 bp, Bos taurus; identical to SEQ ID NO: 3579

SEQ ID NO: 45162 - DNA, 201 bp, Bos taurus; identical to SEQ ID NO: 3581

SEQ ID NO: 45163 - DNA, 201 bp, Bos taurus; identical to SEQ ID NO: 3582

SEQ ID NO: 45164 - DNA, 201 bp, Bos taurus
gtgagacagaaaaagggctccactgtgagcctgttggtctgtcggcccctctccctgctgggctgagcgggtcaagactggaaagatgtggaggaacggggacttatgcaggaggagcagctggcctgcacttccgcgtgaagtccggacttctgtctccttccccttttgggtgtctgggccctctctcctgcatagcag

SEQ ID NO: 45165 - DNA, 201 bp, Bos taurus
tgtgtgagagagagacagagaggacggagcgagagtgcgtgtcagagagagggaggctgtacctctcttgaccctgaagccctggtcctcacatcatctacggagccaacaaccataatcttcaaaccgtagctccaatgaaaataacattctttatgcccctacagtcttctctgattcttcctacagatgctcaacccc

SEQ ID NO: 45166 - DNA, 201 bp, Bos taurus
ccagaattagagaagctgcctgtgcaatagaggttctgagagaaaatatctacatacctctgatttcctcatgtgccagaggccttacttcatattcaataaacagtcatgataggaactgacaattggagctcagaggctaataggcagtaactgggtcagtggtggcctgggcagctggcagcacagttctcatggaga

SEQ ID NO: 45167 - DNA, 201 bp, Bos taurus; identical to SEQ ID NO: 3583

SEQ ID NO: 45168 - DNA, 201 bp, Bos taurus; identical to SEQ ID NO: 3584

SEQ ID NO: 45169 - DNA, 201 bp, Bos taurus; identical to SEQ ID NO: 3585

SEQ ID NO: 45170 - DNA, 201 bp, Bos taurus; identical to SEQ ID NO: 3586

SEQ ID NO: 45171 - DNA, 201 bp, Bos taurus
ggacatggcatggggtaccaagaaggaggtggccaggtcctggggcagggagagaggaaggaggcagctgctggcacagaatgaccatcagagaagcatccttgaggccacttgctcaccgtactcatagtatccctaggaatcccaaactcctttgaaaggaatagaaatgaacctcgctttgcacacagcgagtgtaac

SEQ ID NO: 45172 - DNA, 201 bp, Bos taurus; identical to SEQ ID NO: 3587

SEQ ID NO: 45173 - DNA, 201 bp, Bos taurus
cagaaagaccgctgtgtttgcttggaagggcacacagacttcctcgatgtggggtgtgggttccttagaggttgtttctatgctgtgtgagccccagtctaaacttagggccaccttgggtcagtgtccccaggccatggggtgactcctaaaccccagcctagactgatcctacctcccctgcctactgaacctcttttt

SEQ ID NO: 45174 - DNA, 201 bp, Bos taurus
aggattcagaagaatgaaaaatctgcctagccatgtggactgccatggagaagagcactacagaacgtgagtttaggcaatgtaaggccactagaaatgagccaagtcattctaacaggggacagaggctcttacctctctacctgagcagatggtggcccaaaacatgagccggccccctctgccccctaccttcacccc

SEQ ID NO: 45175 - DNA, 201 bp, Bos taurus
agcacattcttctaaagagggcagattaggaggctttgcccaagtggtgaccaagagcatgcggtcgctcacaaaacctctgggtgatcctagagcaggtgctcctgaaggccagggcagaacccacagcaacagactggggacaccttgaatcctcagcatgtatattccttagcactgctaagaaccacacacctgatg

SEQ ID NO: 45176 - DNA, 201 bp, Bos taurus
ttgatccctggtctgggaagatcccacacgctgtggagcaactaagtccttgggccacaactattaagcctgtgctctagagcctgcgagtgatgacttctgaagcccatgtacccttgagcttgtgctctgaaacaagagaagcccctcacaaagagaaacacgtgcactgcagctagagagaagcccagcccaacacaa

SEQ ID NO: 45177 - DNA, 201 bp, Bos taurus
ttatcctttctctgccctcctccagttagcttctagtttttgttgttgttgctttgttttgctactagttctgtgccctgtttggccaagggttaatggcgaagctagaaatgggtccaaaggggcttctaacccgagtgcagtccactccctgcttcctaggacataagtggggaggccagtcagtggcagccccaaaga

SEQ ID NO: 45178 - DNA, 201 bp, Bos taurus; identical to SEQ ID NO: 3588

SEQ ID NO: 45179 - DNA, 201 bp, Bos taurus; identical to SEQ ID NO: 3589

SEQ ID NO: 45180 - DNA, 201 bp, Bos taurus; identical to SEQ ID NO: 3590

SEQ ID NO: 45181 - DNA, 201 bp, Bos taurus; identical to SEQ ID NO: 3591

SEQ ID NO: 45182 - DNA, 201 bp, Bos taurus; identical to SEQ ID NO: 3592

SEQ ID NO: 45183 - DNA, 201 bp, Bos taurus; identical to SEQ ID NO: 3593

SEQ ID NO: 45184 - DNA, 201 bp, Bos taurus; identical to SEQ ID NO: 3594

SEQ ID NO: 45185 - DNA, 201 bp, Bos taurus; identical to SEQ ID NO: 3595

SEQ ID NO: 45186 - DNA, 201 bp, Bos taurus; identical to SEQ ID NO: 3596

SEQ ID NO: 45187 - DNA, 201 bp, Bos taurus; identical to SEQ ID NO: 3597

SEQ ID NO: 45188 - DNA, 201 bp, Bos taurus; identical to SEQ ID NO: 3599

SEQ ID NO: 45189 - DNA, 201 bp, Bos taurus
acttgtggatccttgttacaaataagtttattaatatctgttcagatattttatctgcctgcaatgcaggagacctgagttcaattattttcagaactacctggggactcatattcatgttgattatcttcagtaatttggcaggttacttatttcacgtagatagtcaagtttcaaaattctgaaatcttcttaatctgg

SEQ ID NO: 45190 - DNA, 201 bp, Bos taurus; identical to SEQ ID NO: 3600

SEQ ID NO: 45191 - DNA, 201 bp, Bos taurus; identical to SEQ ID NO: 3601

SEQ ID NO: 45192 - DNA, 201 bp, Bos taurus; identical to SEQ ID NO: 3602

SEQ ID NO: 45193 - DNA, 201 bp, Bos taurus; identical to SEQ ID NO: 3603

SEQ ID NO: 45194 - DNA, 201 bp, Bos taurus
gattaagtttatgatgagctactgtccaaaatccattgggtccctatattagccaaagagttgagttattcaactccaatataataggaactaacaccccggcatctttcaggtatttactcttggtattaatctttggaattcctctagaaatgtgtatatttatttattattatttattctggaagaagtagttatctt

SEQ ID NO: 45195 - DNA, 201 bp, Bos taurus; identical to SEQ ID NO: 3604

SEQ ID NO: 45196 - DNA, 201 bp, Bos taurus; identical to SEQ ID NO: 3605

SEQ ID NO: 45197 - DNA, 201 bp, Bos taurus; identical to SEQ ID NO: 3607

SEQ ID NO: 45198 - DNA, 201 bp, Bos taurus; identical to SEQ ID NO: 3608

SEQ ID NO: 45199 - DNA, 201 bp, Bos taurus
gccatcattcatttaacaaatatctgctgtccatatacaggaaagtaacacttaagctgagatctgaaaaatgagtaagaatgggacatttttttaaaaaggggggccataggtggttaggactgagatagaataaataagcttgtcagttgatgaatgactgaagaatcttggaacaagcaatagtaaacagaggattaa

SEQ ID NO: 45200 - DNA, 201 bp, Bos taurus; identical to SEQ ID NO: 3610

SEQ ID NO: 45201 - DNA, 201 bp, Bos taurus; identical to SEQ ID NO: 3611

SEQ ID NO: 45202 - DNA, 201 bp, Bos taurus
actaaaacatcttgaggcccccaaatttctgagatgtgaggacattgaggagggcatctgtggggggatcccaggacagtgggtacagtgcatattgggactagattcaggggccttattcagtagctctttaccagttgaacaaagctattctatattttatccattcatctcaccccctcttcccctctccccatgttc

SEQ ID NO: 45203 - DNA, 201 bp, Bos taurus; identical to SEQ ID NO: 3612

SEQ ID NO: 45204 - DNA, 201 bp, Bos taurus; identical to SEQ ID NO: 3613

SEQ ID NO: 45205 - DNA, 201 bp, Bos taurus
ctgagcttcttccagggacccccagagcagcccagtctggctcccagtgtgcagatctctctggcgaaggaagcaacatgcttgtgcatcaaagctgatggacctgcgctctcagggtctgggaggtttccaggctgttcctgctggctgaagcctgagtcaggagtgaaggcgatttcttggcagactttcctcatgtcc

SEQ ID NO: 45206 - DNA, 201 bp, Bos taurus; identical to SEQ ID NO: 3617

SEQ ID NO: 45207 - DNA, 201 bp, Bos taurus; identical to SEQ ID NO: 3618

SEQ ID NO: 45208 - DNA, 201 bp, Bos taurus
gatctgattccccaggccagaattgaggtccagaaatctgtgtattatacaaacacagacacacgccctccatctcgggtttatcagtgtctgaacaattaccaggtcaatggctccatcctggcccatcagaacaggtgggagagggacttctctggcaatccagtggttaagactctgcacctccaaggcagtggacac

SEQ ID NO: 45209 - DNA, 201 bp, Bos taurus; identical to SEQ ID NO: 3621

SEQ ID NO: 45210 - DNA, 201 bp, Bos taurus; identical to SEQ ID NO: 3622

SEQ ID NO: 45211 - DNA, 201 bp, Bos taurus; identical to SEQ ID NO: 3623

SEQ ID NO: 45212 - DNA, 201 bp, Bos taurus; identical to SEQ ID NO: 3625

SEQ ID NO: 45213 - DNA, 201 bp, Bos taurus; identical to SEQ ID NO: 3626

SEQ ID NO: 45214 - DNA, 201 bp, Bos taurus; identical to SEQ ID NO: 3627

SEQ ID NO: 45215 - DNA, 201 bp, Bos taurus
agaaataatatagatcatcagtgtcatgacttaggaacaaaagagcatcaaaaaggaatagaaagatttgaaaaagaaggaaacaccatacctagaaactttttattgaaacttcaaatttaatagaatagggaaagcagattgtacacaactgagacagaaactgggtaaccagttggataattatgttggataattatg

SEQ ID NO: 45216 - DNA, 201 bp, Bos taurus
acatgagtccaaaaggggccacgcgtgaggatgtccactttaacatcctttatcgggacaaccgcagagccctccccaagaggggacaggtaaaaggagctgggagcacaccagagaatatggggccctagacttagtgtcaagcaacaagctggctggactcagaggcggactcccgggcagcaaaagtgaacaccagaa

SEQ ID NO: 45217 - DNA, 201 bp, Bos taurus; identical to SEQ ID NO: 3629

SEQ ID NO: 45218 - DNA, 201 bp, Bos taurus; identical to SEQ ID NO: 3630

SEQ ID NO: 45219 - DNA, 201 bp, Bos taurus; identical to SEQ ID NO: 3632

SEQ ID NO: 45220 - DNA, 201 bp, Bos taurus; identical to SEQ ID NO: 3633

SEQ ID NO: 45221 - DNA, 201 bp, Bos taurus; identical to SEQ ID NO: 3634

SEQ ID NO: 45222 - DNA, 201 bp, Bos taurus; identical to SEQ ID NO: 3635

SEQ ID NO: 45223 - DNA, 201 bp, Bos taurus; identical to SEQ ID NO: 3640

SEQ ID NO: 45224 - DNA, 201 bp, Bos taurus
gtaccaatggtgtgacaggtactatgcccccaggagagagacggagaccgaggcttacagtatccacccagcggggagacagggctgttactgcacgtgtgtgttatgtgcgagtcagcccgccttctgagaaccggtggttctgtgtaactgtaactcttcctgcactagagaaactgaagaagtagagctggtggtggt

SEQ ID NO: 45225 - DNA, 201 bp, Bos taurus
ttggaggttcttcatcacggcccagtacctgaaagatgacacttcggtgttctcactctctcgcccttggcaacaaacccactcacacagcatcagtggtcgctgtcaggactctcgaatggcctcgtggcatttccccttggagatcctaaaggcagctcagagctgccgcacccacacttacactcctcactttattgc

SEQ ID NO: 45226 - DNA, 201 bp, Bos taurus; identical to SEQ ID NO: 3646

SEQ ID NO: 45227 - DNA, 201 bp, Bos taurus; identical to SEQ ID NO: 3647

SEQ ID NO: 45228 - DNA, 201 bp, Bos taurus; identical to SEQ ID NO: 3649

SEQ ID NO: 45229 - DNA, 201 bp, Bos taurus; identical to SEQ ID NO: 3650

SEQ ID NO: 45230 - DNA, 201 bp, Bos taurus
aaccacacgctctcctgtgctttttacacccctgccagcatgcacagctctgactcctggaccaaaaagctaggggtctcctcactgatggcccctgtgcgctgataaaacttgctggaaagataaatcgcttggttgggttttgttgagtaggtcgaggtggccccagctgaagcccattgcagcaaaagcagaaaccac

SEQ ID NO: 45231 - DNA, 201 bp, Bos taurus
tgaaaatgtccattatgtaaaagttttcattttctccatctgaatcctttggaacaactggtcatctatctatttgattagggaagtcagtgaacttgacatactagctttgggactccatgcatcctacacccaaccctacacacctctgagcgtgatggtcatggcttatagtattccagcccctttcaccacccttgg

SEQ ID NO: 45232 - DNA, 201 bp, Bos taurus
tcccacagcctcacctgcagactgacccgctgacctgagaacagggtctgcgttattccactactttctggatgaggggagccccagtcagcagccttcccggggcagacggcccagcccatgctccttaccacacagcagggatgcagcaaaagtggggtagagaccccagaaacctgtgcaccattctgctgaaaacac

SEQ ID NO: 45233 - DNA, 201 bp, Bos taurus; identical to SEQ ID NO: 3654

SEQ ID NO: 45234 - DNA, 201 bp, Bos taurus; identical to SEQ ID NO: 3655

SEQ ID NO: 45235 - DNA, 201 bp, Bos taurus; identical to SEQ ID NO: 3656

SEQ ID NO: 45236 - DNA, 201 bp, Bos taurus; identical to SEQ ID NO: 3657

SEQ ID NO: 45237 - DNA, 201 bp, Bos taurus; identical to SEQ ID NO: 3658

SEQ ID NO: 45238 - DNA, 201 bp, Bos taurus; identical to SEQ ID NO: 3659

SEQ ID NO: 45239 - DNA, 201 bp, Bos taurus; identical to SEQ ID NO: 3660

SEQ ID NO: 45240 - DNA, 201 bp, Bos taurus
cttgtccgtcatcagcatctttgagctgagtacctcatctgtatcgagcacagtgacgggtactggctgcagagcggtgaactgggaggcaagtggccacgttccctgattcccgcacaggactgagttgctctggttatggaaacaggagcagaagatccgtgtgaatttctggccggggacatgaaagccggtgaacat

SEQ ID NO: 45241 - DNA, 201 bp, Bos taurus; identical to SEQ ID NO: 3661

SEQ ID NO: 45242 - DNA, 201 bp, Bos taurus; identical to SEQ ID NO: 3663

SEQ ID NO: 45243 - DNA, 201 bp, Bos taurus; identical to SEQ ID NO: 3665

SEQ ID NO: 45244 - DNA, 201 bp, Bos taurus; identical to SEQ ID NO: 3666

SEQ ID NO: 45245 - DNA, 201 bp, Bos taurus; identical to SEQ ID NO: 3667

SEQ ID NO: 45246 - DNA, 201 bp, Bos taurus; identical to SEQ ID NO: 3668

SEQ ID NO: 45247 - DNA, 201 bp, Bos taurus; identical to SEQ ID NO: 3671

SEQ ID NO: 45248 - DNA, 201 bp, Bos taurus; identical to SEQ ID NO: 3672

SEQ ID NO: 45249 - DNA, 201 bp, Bos taurus; identical to SEQ ID NO: 3673

SEQ ID NO: 45250 - DNA, 201 bp, Bos taurus; identical to SEQ ID NO: 3674

SEQ ID NO: 45251 - DNA, 201 bp, Bos taurus; identical to SEQ ID NO: 3675

SEQ ID NO: 45252 - DNA, 201 bp, Bos taurus; identical to SEQ ID NO: 3676

SEQ ID NO: 45253 - DNA, 201 bp, Bos taurus; identical to SEQ ID NO: 3677

SEQ ID NO: 45254 - DNA, 201 bp, Bos taurus; identical to SEQ ID NO: 3678

SEQ ID NO: 45255 - DNA, 201 bp, Bos taurus; identical to SEQ ID NO: 3679

SEQ ID NO: 45256 - DNA, 201 bp, Bos taurus; identical to SEQ ID NO: 3680

SEQ ID NO: 45257 - DNA, 201 bp, Bos taurus
catggtctcactgcagggacgcagcagaggagagcctttcacatgcagcccgtttaattatcaggagcacgttgccgggccgggctggtgggcaattgccggtcgggcactacacgtgcttacgccgagatgccccactggagcggcagaaagtcatctcaagtattgcaagcgtctcctggatttctggggcctctgcca

SEQ ID NO: 45258 - DNA, 201 bp, Bos taurus; identical to SEQ ID NO: 3682

SEQ ID NO: 45259 - DNA, 201 bp, Bos taurus; identical to SEQ ID NO: 3683

SEQ ID NO: 45260 - DNA, 201 bp, Bos taurus; identical to SEQ ID NO: 3684

SEQ ID NO: 45261 - DNA, 201 bp, Bos taurus
ttgacccatgcctccactggagacttgtggatacttacaggcaagtctgactcagtcccttgtggggacactgctcctttctcctggatcctggcacatacgaggttttgtttgtgctcacctagtctgtttccccagacctgtgaaagttctgcagtcaatcccactggccccctaagtcaaattttctgggagttctca

SEQ ID NO: 45262 - DNA, 201 bp, Bos taurus
ttaatctgtgccagcgcccactccacattgaactggacccaccaagtatgagcctgagtatccccagcctgggacagaccgtagcatgttcaaattaaatatttttagtcttggtcttgtggtttgccattttgtgggatttttgcttcatgtactaaatccttggtaatagtacattgatgtcaagagatcagatattga

SEQ ID NO: 45263 - DNA, 201 bp, Bos taurus; identical to SEQ ID NO: 3685

SEQ ID NO: 45264 - DNA, 201 bp, Bos taurus; identical to SEQ ID NO: 3686

SEQ ID NO: 45265 - DNA, 201 bp, Bos taurus; identical to SEQ ID NO: 3687

SEQ ID NO: 45266 - DNA, 201 bp, Bos taurus; identical to SEQ ID NO: 3688

SEQ ID NO: 45267 - DNA, 201 bp, Bos taurus
atttaagagatatttcagcaacagcacctccaacatgcggttgtcattctaattaggttaggattgagaggaaaggaataggcccatgaggaaaaccacactgattgtaagcattattcagacttagaactgggggaggggaaaagtgaatgaccttcctgagcacattctccaaaagtaactctcatgcaagggcaggta

SEQ ID NO: 45268 - DNA, 201 bp, Bos taurus; identical to SEQ ID NO: 3689

SEQ ID NO: 45269 - DNA, 201 bp, Bos taurus; identical to SEQ ID NO: 3690

SEQ ID NO: 45270 - DNA, 201 bp, Bos taurus; identical to SEQ ID NO: 3691

SEQ ID NO: 45271 - DNA, 201 bp, Bos taurus; identical to SEQ ID NO: 3692

SEQ ID NO: 45272 - DNA, 201 bp, Bos taurus; identical to SEQ ID NO: 3693

SEQ ID NO: 45273 - DNA, 201 bp, Bos taurus; identical to SEQ ID NO: 3694

SEQ ID NO: 45274 - DNA, 201 bp, Bos taurus; identical to SEQ ID NO: 3695

SEQ ID NO: 45275 - DNA, 201 bp, Bos taurus; identical to SEQ ID NO: 3696

SEQ ID NO: 45276 - DNA, 201 bp, Bos taurus; identical to SEQ ID NO: 3697

SEQ ID NO: 45277 - DNA, 201 bp, Bos taurus; identical to SEQ ID NO: 3699

SEQ ID NO: 45278 - DNA, 201 bp, Bos taurus; identical to SEQ ID NO: 3700

SEQ ID NO: 45279 - DNA, 201 bp, Bos taurus
ccctgtaattataactctctttggatcattgtccaaataaattaattacgttactttctgcacatctttttttttttttttttttacttgtgagattgcaagactgtgagggtaagaattgttgccagcgaaaaatacattcatatactatattattcatataatcatacaacacacacacatatcctggggcagcttaca

SEQ ID NO: 45280 - DNA, 201 bp, Bos taurus; identical to SEQ ID NO: 3702

SEQ ID NO: 45281 - DNA, 201 bp, Bos taurus
tgagttcgatcactgatcagggaactagatcctatatgccacaactaagagtttgcatgctgcaactagagatactgcgtgctgtaactaagacacggcacggccaaataaacatcttttaaagttaattaggaaatggttagggatgtggtggagggtagaggttgagggctatatcaagatgaaatgaacagtttatgc

SEQ ID NO: 45282 - DNA, 201 bp, Bos taurus; identical to SEQ ID NO: 3703

SEQ ID NO: 45283 - DNA, 201 bp, Bos taurus; identical to SEQ ID NO: 3705

SEQ ID NO: 45284 - DNA, 201 bp, Bos taurus; identical to SEQ ID NO: 3708

SEQ ID NO: 45285 - DNA, 201 bp, Bos taurus; identical to SEQ ID NO: 3709

SEQ ID NO: 45286 - DNA, 201 bp, Bos taurus; identical to SEQ ID NO: 3710

SEQ ID NO: 45287 - DNA, 201 bp, Bos taurus; identical to SEQ ID NO: 3711

SEQ ID NO: 45288 - DNA, 201 bp, Bos taurus
atatttgacccatgatatgttaaataatacagacattgaactttgtttaaactgtgttattttttattgtaattcctgatgaattttgattttacatttactttgttcttctttaaaatgaagtttggcaggattactcaagtcaatgagcaattgctctcaagtatatactgacctgatttttagctttgtattcattct

SEQ ID NO: 45289 - DNA, 201 bp, Bos taurus; identical to SEQ ID NO: 3712

SEQ ID NO: 45290 - DNA, 201 bp, Bos taurus; identical to SEQ ID NO: 3713

SEQ ID NO: 45291 - DNA, 201 bp, Bos taurus
gttccttaggtagtgtataaaatggtcctaatatgtctttttgcatttatccatccttttttcaagtatccttgagacatcacagtgtaatgcaagttttatttaacttacatttatatgctatcaccccccaaaaaaaatcacaaaaaatcatattctattatctttaattatgatgacaatccaaaagaaaatgtttta

SEQ ID NO: 45292 - DNA, 201 bp, Bos taurus
aatttctagtgagactgaggcaacccctcctcgaagggtgtcctgatcctcagtgtgttcatttggaagccccatacaggggaaagtacaagagggagctatagttttcacacccaaatctgcacccttaggacataagtctggcatgtgtctcagacagataaagagcaacacatatgaaacatcaacccatttcccttg

SEQ ID NO: 45293 - DNA, 201 bp, Bos taurus; identical to SEQ ID NO: 3714

SEQ ID NO: 45294 - DNA, 201 bp, Bos taurus; identical to SEQ ID NO: 3715

SEQ ID NO: 45295 - DNA, 201 bp, Bos taurus; identical to SEQ ID NO: 3716

SEQ ID NO: 45296 - DNA, 201 bp, Bos taurus; identical to SEQ ID NO: 3717

SEQ ID NO: 45297 - DNA, 201 bp, Bos taurus; identical to SEQ ID NO: 3718

SEQ ID NO: 45298 - DNA, 201 bp, Bos taurus; identical to SEQ ID NO: 3720

SEQ ID NO: 45299 - DNA, 201 bp, Bos taurus; identical to SEQ ID NO: 3721

SEQ ID NO: 45300 - DNA, 201 bp, Bos taurus
ctgctccttttgttccatatctgcttgctcagtaatcctttctaaaaatatgacctatgccaaggtaactgatcctgagagtcttccaatcctagccattgctccaatgtatctgggccttccccgtacatactaacatatttgttggggttttagtatccccctctcctcaagatcatttcgtttagtagataccttgat

SEQ ID NO: 45301 - DNA, 201 bp, Bos taurus; identical to SEQ ID NO: 3722

SEQ ID NO: 45302 - DNA, 201 bp, Bos taurus; identical to SEQ ID NO: 3723

SEQ ID NO: 45303 - DNA, 201 bp, Bos taurus; identical to SEQ ID NO: 3724

SEQ ID NO: 45304 - DNA, 201 bp, Bos taurus; identical to SEQ ID NO: 3726

SEQ ID NO: 45305 - DNA, 201 bp, Bos taurus; identical to SEQ ID NO: 3728

SEQ ID NO: 45306 - DNA, 201 bp, Bos taurus; identical to SEQ ID NO: 3729

SEQ ID NO: 45307 - DNA, 201 bp, Bos taurus; identical to SEQ ID NO: 3730

SEQ ID NO: 45308 - DNA, 201 bp, Bos taurus; identical to SEQ ID NO: 3731

SEQ ID NO: 45309 - DNA, 201 bp, Bos taurus
cccagcctgtactgcggaagttccactctagacagctgagatctctcagctccagttttgctcaactggactccagccctcacccaggggccctcacccctgtctccagcactgggttccatcctgcccaagagaaggcatctctaacaagtgcttcagcccacttcctggtcaggccggctcagccgcgcttctgggatt

SEQ ID NO: 45310 - DNA, 201 bp, Bos taurus
aagcaggaattctgccttcaggctgtcttctgatttatgactccaacatcaactctgccctggtccctatcctgctagccttctctgaagacctcaaaacttgctcccacaactgcatgaaccaatttcttaaaagtttaatagacagataggtacacaaacactcagaggacacaaacaaaaccttgtgtgcaccaggat

SEQ ID NO: 45311 - DNA, 201 bp, Bos taurus; identical to SEQ ID NO: 3734

SEQ ID NO: 45312 - DNA, 201 bp, Bos taurus; identical to SEQ ID NO: 3735

SEQ ID NO: 45313 - DNA, 201 bp, Bos taurus; identical to SEQ ID NO: 3736

SEQ ID NO: 45314 - DNA, 201 bp, Bos taurus; identical to SEQ ID NO: 3737

SEQ ID NO: 45315 - DNA, 201 bp, Bos taurus; identical to SEQ ID NO: 3738

SEQ ID NO: 45316 - DNA, 201 bp, Bos taurus; identical to SEQ ID NO: 3739

SEQ ID NO: 45317 - DNA, 201 bp, Bos taurus; identical to SEQ ID NO: 3740

SEQ ID NO: 45318 - DNA, 201 bp, Bos taurus; identical to SEQ ID NO: 3741

SEQ ID NO: 45319 - DNA, 201 bp, Bos taurus; identical to SEQ ID NO: 3742

SEQ ID NO: 45320 - DNA, 201 bp, Bos taurus; identical to SEQ ID NO: 3743

SEQ ID NO: 45321 - DNA, 201 bp, Bos taurus; identical to SEQ ID NO: 3744

SEQ ID NO: 45322 - DNA, 201 bp, Bos taurus; identical to SEQ ID NO: 3745

SEQ ID NO: 45323 - DNA, 201 bp, Bos taurus; identical to SEQ ID NO: 3746

SEQ ID NO: 45324 - DNA, 201 bp, Bos taurus; identical to SEQ ID NO: 3747

SEQ ID NO: 45325 - DNA, 201 bp, Bos taurus; identical to SEQ ID NO: 3749

SEQ ID NO: 45326 - DNA, 201 bp, Bos taurus; identical to SEQ ID NO: 3750

SEQ ID NO: 45327 - DNA, 201 bp, Bos taurus
gtatatgcaaactacttaattttgcaaaaaactctcatgatcacttaactgcggaccccagggcctttgatgtttggcttatccttccttctgtgtggcccacattgccccatcaatgggatggcagctcagtaccagtttacccctaaggcaatatgagagagagattaggaagttcaagcttatcaagttcattaacat

SEQ ID NO: 45328 - DNA, 201 bp, Bos taurus
gcttaacaaaattaccaccttcaaagagaagaatagttcttgatagcattcatagtaatgcttccatttctctgtggaaacataagcgggaagcatgaagaagacaggggagagagtctcaggaaaagcaactggcttgctttcattcctgtgttcactctgccttatttctcatgtattctatcttaaaatagcaacaca

SEQ ID NO: 45329 - DNA, 201 bp, Bos taurus; identical to SEQ ID NO: 3752

SEQ ID NO: 45330 - DNA, 201 bp, Bos taurus; identical to SEQ ID NO: 3753

SEQ ID NO: 45331 - DNA, 201 bp, Bos taurus; identical to SEQ ID NO: 3754

SEQ ID NO: 45332 - DNA, 201 bp, Bos taurus; identical to SEQ ID NO: 3755

SEQ ID NO: 45333 - DNA, 201 bp, Bos taurus; identical to SEQ ID NO: 3756

SEQ ID NO: 45334 - DNA, 201 bp, Bos taurus
actgtcagctttcagaagttgttttgtggaatttgctcagcattcaaatgatctttcaataaatttgtgggggagaaagtggtctcccccttctattcctcggccatcttaggaccactcctctctttaaaaagacaaccagtatcttgttaataagttagcaaataacctcacatgacattttttcaataaatttcattg

SEQ ID NO: 45335 - DNA, 201 bp, Bos taurus
atggtcactcagtcaggtctgtgtcaaaggcctgcaccatgaatcagagcctccagttatttgatgtgctcacttccctttattatatgtgaaatcttacatacaaaaagaggggccacaactgtccaggaatggacagttaaatataaacatagaaaaatggttatcaatttgaacatacacctaattcttccaggaatt

SEQ ID NO: 45336 - DNA, 201 bp, Bos taurus; identical to SEQ ID NO: 3757

SEQ ID NO: 45337 - DNA, 201 bp, Bos taurus; identical to SEQ ID NO: 3758

SEQ ID NO: 45338 - DNA, 201 bp, Bos taurus; identical to SEQ ID NO: 3759

SEQ ID NO: 45339 - DNA, 201 bp, Bos taurus; identical to SEQ ID NO: 3760

SEQ ID NO: 45340 - DNA, 201 bp, Bos taurus; identical to SEQ ID NO: 3761

SEQ ID NO: 45341 - DNA, 201 bp, Bos taurus; identical to SEQ ID NO: 3763

SEQ ID NO: 45342 - DNA, 201 bp, Bos taurus
agtgtataacatctagtcgtctttcataagctagaataatatgtagagtaagtcttttccactatgaagctaagtgcaaaaggagccaagtgagtgaattttctcagttttgaagagaagttaatttttaagtgcttttacattatcagagtactcctgacttgtgttcaacaatcattaatactaatgatgtttatgtaa

SEQ ID NO: 45343 - DNA, 201 bp, Bos taurus; identical to SEQ ID NO: 3764

SEQ ID NO: 45344 - DNA, 201 bp, Bos taurus; identical to SEQ ID NO: 3765

SEQ ID NO: 45345 - DNA, 201 bp, Bos taurus; identical to SEQ ID NO: 3766

SEQ ID NO: 45346 - DNA, 201 bp, Bos taurus; identical to SEQ ID NO: 3769

SEQ ID NO: 45347 - DNA, 201 bp, Bos taurus
ccgaaatcctgaaatagatatggaaagaaatggtgtcgagggttcacactgagcgaaagcacgcagggggctttccagaaccttggaggtggagcttctcgggcctggagagtctcctgaggggtcgagaggagaccgccaggctcgcatgcgcgtgggtctcaggttggacacgggtgctgtgtccagaactgcccgggc

SEQ ID NO: 45348 - DNA, 201 bp, Bos taurus; identical to SEQ ID NO: 3771

SEQ ID NO: 45349 - DNA, 201 bp, Bos taurus; identical to SEQ ID NO: 3774

SEQ ID NO: 45350 - DNA, 201 bp, Bos taurus; identical to SEQ ID NO: 3775

SEQ ID NO: 45351 - DNA, 201 bp, Bos taurus; identical to SEQ ID NO: 3776

SEQ ID NO: 45352 - DNA, 201 bp, Bos taurus; identical to SEQ ID NO: 3777

SEQ ID NO: 45353 - DNA, 201 bp, Bos taurus; identical to SEQ ID NO: 3778

SEQ ID NO: 45354 - DNA, 201 bp, Bos taurus; identical to SEQ ID NO: 3779

SEQ ID NO: 45355 - DNA, 201 bp, Bos taurus; identical to SEQ ID NO: 3782

SEQ ID NO: 45356 - DNA, 201 bp, Bos taurus
aaaatgtaataaggaaatgaagtggaactctgttgtgttttaccagctaaggattattataactttttaaaaagtgagagagaattagaatatttactttcctttaaataataacaatattaattcatgactcctatagccttagttaggaattatgaggttggtcattaaactaatgttacaataggtactatgatttat

SEQ ID NO: 45357 - DNA, 201 bp, Bos taurus; identical to SEQ ID NO: 3783

SEQ ID NO: 45358 - DNA, 201 bp, Bos taurus; identical to SEQ ID NO: 3784

SEQ ID NO: 45359 - DNA, 201 bp, Bos taurus; identical to SEQ ID NO: 3785

SEQ ID NO: 45360 - DNA, 201 bp, Bos taurus; identical to SEQ ID NO: 3786

SEQ ID NO: 45361 - DNA, 201 bp, Bos taurus; identical to SEQ ID NO: 3787

SEQ ID NO: 45362 - DNA, 201 bp, Bos taurus
tcttaaacagtgtcagttatgtgttgaagatgtgaataagatacatccatgctctgttaagagctcagattctccagcctctttgcaagtgggtgtggccacaagatttcatcctgcccaatgggatgtaaccagaggagaggtatgtaacttgatagtcgtttcttttcccgtttcctgctggctggaatgtgggtgtga

SEQ ID NO: 45363 - DNA, 201 bp, Bos taurus; identical to SEQ ID NO: 3789

SEQ ID NO: 45364 - DNA, 201 bp, Bos taurus; identical to SEQ ID NO: 3790

SEQ ID NO: 45365 - DNA, 201 bp, Bos taurus; identical to SEQ ID NO: 3791

SEQ ID NO: 45366 - DNA, 201 bp, Bos taurus; identical to SEQ ID NO: 3796

SEQ ID NO: 45367 - DNA, 201 bp, Bos taurus; identical to SEQ ID NO: 3797

SEQ ID NO: 45368 - DNA, 201 bp, Bos taurus; identical to SEQ ID NO: 3798

SEQ ID NO: 45369 - DNA, 201 bp, Bos taurus; identical to SEQ ID NO: 3799

SEQ ID NO: 45370 - DNA, 201 bp, Bos taurus; identical to SEQ ID NO: 3801

SEQ ID NO: 45371 - DNA, 201 bp, Bos taurus; identical to SEQ ID NO: 3805

SEQ ID NO: 45372 - DNA, 201 bp, Bos taurus; identical to SEQ ID NO: 3806

SEQ ID NO: 45373 - DNA, 201 bp, Bos taurus; identical to SEQ ID NO: 3807

SEQ ID NO: 45374 - DNA, 201 bp, Bos taurus; identical to SEQ ID NO: 3809

SEQ ID NO: 45375 - DNA, 201 bp, Bos taurus; identical to SEQ ID NO: 3811

SEQ ID NO: 45376 - DNA, 201 bp, Bos taurus
aagaaagatttgcaagctctttggaacatgggtaaaaacagataatgacaggaaccatagagataatccggctaacatataggtggcctcagtcagccatatgacttgaaaatagatatctaaactgttttcattaagttcagttcagttcagtcgctcagtcatgtccaactctttgcgatcacatgaattgcagcacgc

SEQ ID NO: 45377 - DNA, 201 bp, Bos taurus; identical to SEQ ID NO: 3815

SEQ ID NO: 45378 - DNA, 201 bp, Bos taurus
attatggagactaatctcttccattaaatttcctactggttctgtttctctagtgatagtcagacagatatacctcctatatagccaattcccttaaatatgtattgaggccactgttgaatcagggaaaagatcaaacttttctttttaatcaactaggtgttgtggttttattttactcacactcacaggttatcaata

SEQ ID NO: 45379 - DNA, 201 bp, Bos taurus; identical to SEQ ID NO: 3817

SEQ ID NO: 45380 - DNA, 201 bp, Bos taurus; identical to SEQ ID NO: 3818

SEQ ID NO: 45381 - DNA, 201 bp, Bos taurus; identical to SEQ ID NO: 3821

SEQ ID NO: 45382 - DNA, 201 bp, Bos taurus; identical to SEQ ID NO: 3824

SEQ ID NO: 45383 - DNA, 201 bp, Bos taurus
gttaatattttacagagtcttattgggtaatcacacttgccctgactcattacttccacaagttaatgtcctactgtttaaaatagaactttctccctgtataagttctctatcttctgttttcatgatgaacatctggcatcaatagtatgatagtttaggaaaaaattttaatcataagggtttttttgaggatttagt

SEQ ID NO: 45384 - DNA, 201 bp, Bos taurus
aaggtcttatcatagctttccttatctattcagtctattaaataatgcaaatttgaggaaagaggatgttaaaagactcagggtcttcagggatattcctgttggtccagacatggactctggctaacctacaagctagttaatcatggattatttattcattttatgttgattgaaaattaatgcactgtattcagttga

SEQ ID NO: 45385 - DNA, 201 bp, Bos taurus
agagtagagagatcacccgggttttcttaatatctaagatttcatgggagcaaatcacagacttaaaataatctatcaccttggaatcatagaacacaagatattatttgttcaaaattttattttacataaggggagctatgaaccttagaaaaaaatttttttagtgatgtgtccaagattgcagagcgatgcttctct

SEQ ID NO: 45386 - DNA, 201 bp, Bos taurus; identical to SEQ ID NO: 3825

SEQ ID NO: 45387 - DNA, 201 bp, Bos taurus; identical to SEQ ID NO: 3827

SEQ ID NO: 45388 - DNA, 201 bp, Bos taurus; identical to SEQ ID NO: 3828

SEQ ID NO: 45389 - DNA, 201 bp, Bos taurus; identical to SEQ ID NO: 3829

SEQ ID NO: 45390 - DNA, 201 bp, Bos taurus; identical to SEQ ID NO: 3830

SEQ ID NO: 45391 - DNA, 201 bp, Bos taurus
aaaatggatttttccatctccagtcaatccaagtgttatgagctgaatggtttcctcccaaagatgttgaggtcctaacatccaatacctgtgaatgtaatcttatttggaaacatgagtctgcagatgatcatgttaaggtgaggtcatgaggtggggccctactccaacataactgtgccctcgttaaagaggagaaat

SEQ ID NO: 45392 - DNA, 201 bp, Bos taurus; identical to SEQ ID NO: 3832

SEQ ID NO: 45393 - DNA, 201 bp, Bos taurus; identical to SEQ ID NO: 3833

SEQ ID NO: 45394 - DNA, 201 bp, Bos taurus; identical to SEQ ID NO: 3834

SEQ ID NO: 45395 - DNA, 201 bp, Bos taurus; identical to SEQ ID NO: 3835

SEQ ID NO: 45396 - DNA, 201 bp, Bos taurus
cgtggagtgttaactctcctctggatttctgagttgaatactgcctcctcaggcaaccactaaagacacctaagcctttttggatctgggtgctaagggcgctcctaaagctatggagcccacagagcccgggaggctgaagcaaccgctgatcttagacagtgatcacagggacagccacaggactcaaacgtatcagaa

SEQ ID NO: 45397 - DNA, 201 bp, Bos taurus
gaaagtccatggtgaagagaacacaggacatcttagtgactctaatccagaccagcaagacagggcagttccacactttctgccctcacctccaggcctccagggagcagatggggagaaacccttgagggcttatctagtcagataaagcagtgaagccacagcctgtggcctctgacagatttctgtatgggtgataag

SEQ ID NO: 45398 - DNA, 201 bp, Bos taurus; identical to SEQ ID NO: 3836

SEQ ID NO: 45399 - DNA, 201 bp, Bos taurus; identical to SEQ ID NO: 3837

SEQ ID NO: 45400 - DNA, 201 bp, Bos taurus; identical to SEQ ID NO: 3838

SEQ ID NO: 45401 - DNA, 201 bp, Bos taurus; identical to SEQ ID NO: 3840

SEQ ID NO: 45402 - DNA, 201 bp, Bos taurus; identical to SEQ ID NO: 3841

SEQ ID NO: 45403 - DNA, 201 bp, Bos taurus; identical to SEQ ID NO: 3842

SEQ ID NO: 45404 - DNA, 201 bp, Bos taurus; identical to SEQ ID NO: 3843

SEQ ID NO: 45405 - DNA, 201 bp, Bos taurus; identical to SEQ ID NO: 3844

SEQ ID NO: 45406 - DNA, 201 bp, Bos taurus; identical to SEQ ID NO: 3845

SEQ ID NO: 45407 - DNA, 201 bp, Bos taurus
ttctactttctttctgtagattttattttggttaagaggaccagttatcggactgacagatcttgttcctcagcatcacctacgactatgtgctgggactcgtgctaagtgtgtcacagcacagctgcaccatgaccatctccctccagcctgctggctgtacaagtgtgtggaataagactaagaataatgcaacttgtt

SEQ ID NO: 45408 - DNA, 201 bp, Bos taurus; identical to SEQ ID NO: 3857

SEQ ID NO: 45409 - DNA, 201 bp, Bos taurus; identical to SEQ ID NO: 3858

SEQ ID NO: 45410 - DNA, 201 bp, Bos taurus; identical to SEQ ID NO: 3859

SEQ ID NO: 45411 - DNA, 201 bp, Bos taurus; identical to SEQ ID NO: 3860

SEQ ID NO: 45412 - DNA, 201 bp, Bos taurus; identical to SEQ ID NO: 3861

SEQ ID NO: 45413 - DNA, 201 bp, Bos taurus; identical to SEQ ID NO: 3864

SEQ ID NO: 45414 - DNA, 201 bp, Bos taurus; identical to SEQ ID NO: 3865

SEQ ID NO: 45415 - DNA, 201 bp, Bos taurus; identical to SEQ ID NO: 3868

SEQ ID NO: 45416 - DNA, 201 bp, Bos taurus; identical to SEQ ID NO: 3870

SEQ ID NO: 45417 - DNA, 201 bp, Bos taurus; identical to SEQ ID NO: 3872

SEQ ID NO: 45418 - DNA, 201 bp, Bos taurus; identical to SEQ ID NO: 3873

SEQ ID NO: 45419 - DNA, 201 bp, Bos taurus; identical to SEQ ID NO: 3875

SEQ ID NO: 45420 - DNA, 201 bp, Bos taurus; identical to SEQ ID NO: 3878

SEQ ID NO: 45421 - DNA, 201 bp, Bos taurus; identical to SEQ ID NO: 3879

SEQ ID NO: 45422 - DNA, 201 bp, Bos taurus; identical to SEQ ID NO: 3880

SEQ ID NO: 45423 - DNA, 201 bp, Bos taurus; identical to SEQ ID NO: 3881

SEQ ID NO: 45424 - DNA, 201 bp, Bos taurus; identical to SEQ ID NO: 3882

SEQ ID NO: 45425 - DNA, 201 bp, Bos taurus; identical to SEQ ID NO: 3883

SEQ ID NO: 45426 - DNA, 201 bp, Bos taurus; identical to SEQ ID NO: 3884

SEQ ID NO: 45427 - DNA, 201 bp, Bos taurus; identical to SEQ ID NO: 3885

SEQ ID NO: 45428 - DNA, 201 bp, Bos taurus; identical to SEQ ID NO: 3886

SEQ ID NO: 45429 - DNA, 201 bp, Bos taurus; identical to SEQ ID NO: 3888

SEQ ID NO: 45430 - DNA, 201 bp, Bos taurus; identical to SEQ ID NO: 3889

SEQ ID NO: 45431 - DNA, 201 bp, Bos taurus; identical to SEQ ID NO: 3890

SEQ ID NO: 45432 - DNA, 201 bp, Bos taurus; identical to SEQ ID NO: 3891

SEQ ID NO: 45433 - DNA, 201 bp, Bos taurus; identical to SEQ ID NO: 3893

SEQ ID NO: 45434 - DNA, 201 bp, Bos taurus; identical to SEQ ID NO: 3894

SEQ ID NO: 45435 - DNA, 201 bp, Bos taurus; identical to SEQ ID NO: 3895

SEQ ID NO: 45436 - DNA, 201 bp, Bos taurus; identical to SEQ ID NO: 3897

SEQ ID NO: 45437 - DNA, 201 bp, Bos taurus; identical to SEQ ID NO: 3898

SEQ ID NO: 45438 - DNA, 201 bp, Bos taurus; identical to SEQ ID NO: 3899

SEQ ID NO: 45439 - DNA, 201 bp, Bos taurus; identical to SEQ ID NO: 3900

SEQ ID NO: 45440 - DNA, 201 bp, Bos taurus; identical to SEQ ID NO: 3901

SEQ ID NO: 45441 - DNA, 201 bp, Bos taurus; identical to SEQ ID NO: 3902

SEQ ID NO: 45442 - DNA, 201 bp, Bos taurus; identical to SEQ ID NO: 3903

SEQ ID NO: 45443 - DNA, 201 bp, Bos taurus; identical to SEQ ID NO: 3904

SEQ ID NO: 45444 - DNA, 201 bp, Bos taurus; identical to SEQ ID NO: 3905

SEQ ID NO: 45445 - DNA, 201 bp, Bos taurus; identical to SEQ ID NO: 3906

SEQ ID NO: 45446 - DNA, 201 bp, Bos taurus; identical to SEQ ID NO: 3907

SEQ ID NO: 45447 - DNA, 201 bp, Bos taurus; identical to SEQ ID NO: 3908

SEQ ID NO: 45448 - DNA, 201 bp, Bos taurus; identical to SEQ ID NO: 3909

SEQ ID NO: 45449 - DNA, 201 bp, Bos taurus; identical to SEQ ID NO: 3912

SEQ ID NO: 45450 - DNA, 201 bp, Bos taurus; identical to SEQ ID NO: 3913

SEQ ID NO: 45451 - DNA, 201 bp, Bos taurus; identical to SEQ ID NO: 3914

SEQ ID NO: 45452 - DNA, 201 bp, Bos taurus; identical to SEQ ID NO: 3915

SEQ ID NO: 45453 - DNA, 201 bp, Bos taurus; identical to SEQ ID NO: 3917

SEQ ID NO: 45454 - DNA, 201 bp, Bos taurus; identical to SEQ ID NO: 3918

SEQ ID NO: 45455 - DNA, 201 bp, Bos taurus; identical to SEQ ID NO: 3920

SEQ ID NO: 45456 - DNA, 201 bp, Bos taurus; identical to SEQ ID NO: 3921

SEQ ID NO: 45457 - DNA, 201 bp, Bos taurus; identical to SEQ ID NO: 3922

SEQ ID NO: 45458 - DNA, 201 bp, Bos taurus; identical to SEQ ID NO: 3923

SEQ ID NO: 45459 - DNA, 201 bp, Bos taurus; identical to SEQ ID NO: 3924

SEQ ID NO: 45460 - DNA, 201 bp, Bos taurus; identical to SEQ ID NO: 3925

SEQ ID NO: 45461 - DNA, 201 bp, Bos taurus; identical to SEQ ID NO: 3926

SEQ ID NO: 45462 - DNA, 201 bp, Bos taurus; identical to SEQ ID NO: 3927

SEQ ID NO: 45463 - DNA, 201 bp, Bos taurus; identical to SEQ ID NO: 3928

SEQ ID NO: 45464 - DNA, 201 bp, Bos taurus; identical to SEQ ID NO: 3929

SEQ ID NO: 45465 - DNA, 201 bp, Bos taurus; identical to SEQ ID NO: 3930

SEQ ID NO: 45466 - DNA, 201 bp, Bos taurus; identical to SEQ ID NO: 3931

SEQ ID NO: 45467 - DNA, 201 bp, Bos taurus; identical to SEQ ID NO: 3932

SEQ ID NO: 45468 - DNA, 201 bp, Bos taurus; identical to SEQ ID NO: 3933

SEQ ID NO: 45469 - DNA, 201 bp, Bos taurus; identical to SEQ ID NO: 3937

SEQ ID NO: 45470 - DNA, 201 bp, Bos taurus; identical to SEQ ID NO: 3938

SEQ ID NO: 45471 - DNA, 201 bp, Bos taurus; identical to SEQ ID NO: 3941

SEQ ID NO: 45472 - DNA, 201 bp, Bos taurus; identical to SEQ ID NO: 3942

SEQ ID NO: 45473 - DNA, 201 bp, Bos taurus; identical to SEQ ID NO: 3943

SEQ ID NO: 45474 - DNA, 201 bp, Bos taurus; identical to SEQ ID NO: 3944

SEQ ID NO: 45475 - DNA, 201 bp, Bos taurus; identical to SEQ ID NO: 3946

SEQ ID NO: 45476 - DNA, 201 bp, Bos taurus; identical to SEQ ID NO: 3947

SEQ ID NO: 45477 - DNA, 201 bp, Bos taurus
tcgcatttaagttttattgtagactatttgtttacttaattaagaatttcttcctcaatcaaagattttgcgcatgaaggtatttcctgagatctgatacatggtgtgaatgaaactctgacttatgaaacccaaatgtacttatggaaatgaacacatattttcatttcctagtaaagttaaacaagattaggggtttac

SEQ ID NO: 45478 - DNA, 201 bp, Bos taurus
tactcatcagttcagttcagttcagtagctcagtcgtgtccgactctttgtgactccatgaactgcagcatgccaggcctccctgtcctactcagactcaggtgaaaatgacttttctgatgatgtctagtcaagacctcaagacatgataactataaaggaaatgaaaaatgcaaataaggggcctggaaattcagtgct

SEQ ID NO: 45479 - DNA, 201 bp, Bos taurus
gagcactttaagagaagagatgacctttcacattttcctagtaccctcctagtacttcatttagtgtggtcagtgttagcttttcaataaatacttgctacttgattccatttaggacctttgtgttaaattgaaaataattctctggaaaaacacagatatttacttaaataatgtgaattgcaatctactataattctt

SEQ ID NO: 45480 - DNA, 201 bp, Bos taurus; identical to SEQ ID NO: 3948

SEQ ID NO: 45481 - DNA, 201 bp, Bos taurus
tcagctcctgctgtgataggctcttccttcacctcttgcaatccaagcctccctctccttggtgcctctctcctccagctctgccaggcttgactcatttgccacttccctccattccatggctcttgcagatggcaggggggagtgggaccattggccatgagtagcaagtgatatgttatgatggaaaattcttctcta

SEQ ID NO: 45482 - DNA, 201 bp, Bos taurus; identical to SEQ ID NO: 3949

SEQ ID NO: 45483 - DNA, 201 bp, Bos taurus; identical to SEQ ID NO: 3950

SEQ ID NO: 45484 - DNA, 201 bp, Bos taurus; identical to SEQ ID NO: 3951

SEQ ID NO: 45485 - DNA, 201 bp, Bos taurus; identical to SEQ ID NO: 3952

SEQ ID NO: 45486 - DNA, 201 bp, Bos taurus
cctggaggaaaaggcacagtcatgcagaccacatggactgctttcactgtaaattcattcccacaaaactcaaatgggccatcaacactggtagacaatcccatatgcttcccttgtgaagctgctcttctttcttcataatttttccaataaaatatgcccactcgcagctgatggcctcccatcatacttcacaggata

SEQ ID NO: 45487 - DNA, 201 bp, Bos taurus; identical to SEQ ID NO: 3953

SEQ ID NO: 45488 - DNA, 201 bp, Bos taurus; identical to SEQ ID NO: 3954

SEQ ID NO: 45489 - DNA, 201 bp, Bos taurus; identical to SEQ ID NO: 3955

SEQ ID NO: 45490 - DNA, 201 bp, Bos taurus; identical to SEQ ID NO: 3956

SEQ ID NO: 45491 - DNA, 201 bp, Bos taurus; identical to SEQ ID NO: 3957

SEQ ID NO: 45492 - DNA, 201 bp, Bos taurus; identical to SEQ ID NO: 3958

SEQ ID NO: 45493 - DNA, 201 bp, Bos taurus; identical to SEQ ID NO: 3963

SEQ ID NO: 45494 - DNA, 201 bp, Bos taurus; identical to SEQ ID NO: 3964

SEQ ID NO: 45495 - DNA, 201 bp, Bos taurus; identical to SEQ ID NO: 3966

SEQ ID NO: 45496 - DNA, 201 bp, Bos taurus; identical to SEQ ID NO: 3969

SEQ ID NO: 45497 - DNA, 201 bp, Bos taurus; identical to SEQ ID NO: 3970

SEQ ID NO: 45498 - DNA, 201 bp, Bos taurus; identical to SEQ ID NO: 3971

SEQ ID NO: 45499 - DNA, 201 bp, Bos taurus; identical to SEQ ID NO: 3972

SEQ ID NO: 45500 - DNA, 201 bp, Bos taurus; identical to SEQ ID NO: 3973

SEQ ID NO: 45501 - DNA, 201 bp, Bos taurus; identical to SEQ ID NO: 3975

SEQ ID NO: 45502 - DNA, 201 bp, Bos taurus; identical to SEQ ID NO: 3976

SEQ ID NO: 45503 - DNA, 201 bp, Bos taurus; identical to SEQ ID NO: 3977

SEQ ID NO: 45504 - DNA, 201 bp, Bos taurus; identical to SEQ ID NO: 3978

SEQ ID NO: 45505 - DNA, 201 bp, Bos taurus; identical to SEQ ID NO: 3980

SEQ ID NO: 45506 - DNA, 201 bp, Bos taurus; identical to SEQ ID NO: 3982

SEQ ID NO: 45507 - DNA, 201 bp, Bos taurus; identical to SEQ ID NO: 3983

SEQ ID NO: 45508 - DNA, 201 bp, Bos taurus; identical to SEQ ID NO: 3984

SEQ ID NO: 45509 - DNA, 201 bp, Bos taurus; identical to SEQ ID NO: 3985

SEQ ID NO: 45510 - DNA, 201 bp, Bos taurus; identical to SEQ ID NO: 3986

SEQ ID NO: 45511 - DNA, 201 bp, Bos taurus; identical to SEQ ID NO: 3988

SEQ ID NO: 45512 - DNA, 201 bp, Bos taurus; identical to SEQ ID NO: 3989

SEQ ID NO: 45513 - DNA, 201 bp, Bos taurus; identical to SEQ ID NO: 3990

SEQ ID NO: 45514 - DNA, 201 bp, Bos taurus; identical to SEQ ID NO: 3991

SEQ ID NO: 45515 - DNA, 201 bp, Bos taurus; identical to SEQ ID NO: 3992

SEQ ID NO: 45516 - DNA, 201 bp, Bos taurus; identical to SEQ ID NO: 3993

SEQ ID NO: 45517 - DNA, 201 bp, Bos taurus; identical to SEQ ID NO: 3994

SEQ ID NO: 45518 - DNA, 201 bp, Bos taurus; identical to SEQ ID NO: 3995

SEQ ID NO: 45519 - DNA, 201 bp, Bos taurus; identical to SEQ ID NO: 3996

SEQ ID NO: 45520 - DNA, 201 bp, Bos taurus
agtggcaacctcagatagctagtatttggttgttttctgtgtatctgtgcagatcaggataccaaacaaaaatgactggcccttccatgtggtggccctccacttatagtgcacacccttcacacctgttctacctgtgactgtggtcaccagcctctgtctccaagcatccaggcctggtgctctctaagcacctgtctg

SEQ ID NO: 45521 - DNA, 201 bp, Bos taurus; identical to SEQ ID NO: 4000

SEQ ID NO: 45522 - DNA, 201 bp, Bos taurus
agccactgagcaagtgctgaaaaaactagaagtctaagcaccagcctttctagaacctgacacacttattctgtgctaggccaaaaagatacgtttttacgaaaaggaatctgttttaaaatttgaattataggcaaatgtatagctagtgttcaccatcatttcaaaataatacatcaaaaaggccactactcaattatt

SEQ ID NO: 45523 - DNA, 201 bp, Bos taurus; identical to SEQ ID NO: 4001

SEQ ID NO: 45524 - DNA, 201 bp, Bos taurus
gccaggagacccgcctaggcgtgactgctttgggcctcttgttttttattcagaagttgaatttgtaagatcaaaggcactttattcaaggaacagatctctaggcctcattccatacaaattgtatcgggatctagggctgggacccaggattctttttaatgcacgttcgttttgatgctcagccagatttggaaagca

SEQ ID NO: 45525 - DNA, 201 bp, Bos taurus
gtctacgtcagggatgttacacacttggtgtttatttaaaattcagcagcattgtcaggtgttactgccagattttctttaagttggaggttagaggccagtgctaagtatttgttaatgtattttgagactgataatctccagtttgactcccaaaggagtagctttttttccatccagggcctttgagtgatgttaggc

SEQ ID NO: 45526 - DNA, 201 bp, Bos taurus; identical to SEQ ID NO: 4002

SEQ ID NO: 45527 - DNA, 201 bp, Bos taurus; identical to SEQ ID NO: 4004

SEQ ID NO: 45528 - DNA, 201 bp, Bos taurus; identical to SEQ ID NO: 4005

SEQ ID NO: 45529 - DNA, 201 bp, Bos taurus; identical to SEQ ID NO: 4007

SEQ ID NO: 45530 - DNA, 201 bp, Bos taurus; identical to SEQ ID NO: 4010

SEQ ID NO: 45531 - DNA, 201 bp, Bos taurus; identical to SEQ ID NO: 4011

SEQ ID NO: 45532 - DNA, 201 bp, Bos taurus
cattggtgagagacatcctctccaggtttacggtgggtgggctccacgcctgatggctgggctttaccccttgtcctccttcaggacttcagacaggcaggaaagaacaccggggccacagccactgtcttcctgaacaacagcgtcagctccccacctctgccgttaaggctccctgtggagagactcaatggaagcagc

SEQ ID NO: 45533 - DNA, 201 bp, Bos taurus
cttccctgccaagactctatgctcccaaggctggggtacaggttcagtccccagtcagggaactaagatgccacatgatacaaggccaaaaagaaataaacacagattaaaaataaaagaaacaacctaaacctataactaattctgaagctttttagtctagtgaattttagaacctggccatttatgttttccagctaa

SEQ ID NO: 45534 - DNA, 201 bp, Bos taurus
gccctccttcagacctgaagaagctgtcccttcatggccaaagagcccgtggacccttacctaacccctccagaagttgtcagctcacatcagccagtagaaaagctagtgggccattttgtataacagacacaaaagaaccccaggggctttcagatcacaaagactctctaagtgaaatccctttcaagtgcaatggga

SEQ ID NO: 45535 - DNA, 201 bp, Bos taurus; identical to SEQ ID NO: 4012

SEQ ID NO: 45536 - DNA, 201 bp, Bos taurus; identical to SEQ ID NO: 4013

SEQ ID NO: 45537 - DNA, 201 bp, Bos taurus; identical to SEQ ID NO: 4014

SEQ ID NO: 45538 - DNA, 201 bp, Bos taurus; identical to SEQ ID NO: 4015

SEQ ID NO: 45539 - DNA, 201 bp, Bos taurus; identical to SEQ ID NO: 4016

SEQ ID NO: 45540 - DNA, 201 bp, Bos taurus; identical to SEQ ID NO: 4017

SEQ ID NO: 45541 - DNA, 201 bp, Bos taurus; identical to SEQ ID NO: 4018

SEQ ID NO: 45542 - DNA, 201 bp, Bos taurus; identical to SEQ ID NO: 4019

SEQ ID NO: 45543 - DNA, 201 bp, Bos taurus; identical to SEQ ID NO: 4020

SEQ ID NO: 45544 - DNA, 201 bp, Bos taurus; identical to SEQ ID NO: 4021

SEQ ID NO: 45545 - DNA, 201 bp, Bos taurus; identical to SEQ ID NO: 4022

SEQ ID NO: 45546 - DNA, 201 bp, Bos taurus
ttatatatatatatatatttttaattctttatttgttttggttggtgcacacggctttctctagctgtggtgaacaggggcttctcattgcaggagcatcccttgttgtggcgcacaggctctatggtgcatgggcttcaggagttagcagcacccaggctcagcagttgctcagaggctctagggcaggcggcttcgtaa

SEQ ID NO: 45547 - DNA, 201 bp, Bos taurus; identical to SEQ ID NO: 4023

SEQ ID NO: 45548 - DNA, 201 bp, Bos taurus
aggattcaattttctgacggaactgaaaaggaacattttctaacatgtttctgtttatcaacccacacccattctgttggccagatttctacttgagtagtgggcaggacaacttccgcttaaaacaactcgaatctccacactttgggggccagcagaaagcacctgaagaaactttggcaccctacacatagggcaggt

SEQ ID NO: 45549 - DNA, 201 bp, Bos taurus; identical to SEQ ID NO: 4024

SEQ ID NO: 45550 - DNA, 201 bp, Bos taurus
acaaggccctactgtatagcacatggaactacgttcactatcttgtaataacctgtaataaaagagaatctgaaaaaaaaaaaaaaaaagacctcacagaagagatggcctttgagacaaggtcttaaaagatatgagggagtttgtaatggggaatctgggggaagaatattctttgcagagggaataagcaggtatgga

SEQ ID NO: 45551 - DNA, 201 bp, Bos taurus
tagcacatgattgtgtgtttggaaaaaactattataagtaggaagggtcatatgggagggagagtgttaagagggcccatgagagttctaccttctggagtacatcttgatataatcccctctctttaaatgtgagcctgcactaggcccatgatgaagttttaagaaagagagattttccttggtgagcctgaatccatc

SEQ ID NO: 45552 - DNA, 201 bp, Bos taurus; identical to SEQ ID NO: 4025

SEQ ID NO: 45553 - DNA, 201 bp, Bos taurus; identical to SEQ ID NO: 4027

SEQ ID NO: 45554 - DNA, 201 bp, Bos taurus; identical to SEQ ID NO: 4028

SEQ ID NO: 45555 - DNA, 201 bp, Bos taurus; identical to SEQ ID NO: 4029

SEQ ID NO: 45556 - DNA, 201 bp, Bos taurus
tcagcatgatgtgtctctcctggagtttcctctgctggcctggaccccagcttttgctcttcctcctgtaagactaagatcgtgataggtggtgctgtgccccttccctgttagtcatttggcctgaggcatccagccagtcctgatgtctacagtgtctatggtaggactaaaggtgactcccaaaagggcttaggccaa

SEQ ID NO: 45557 - DNA, 201 bp, Bos taurus; identical to SEQ ID NO: 4032

SEQ ID NO: 45558 - DNA, 201 bp, Bos taurus
ccctgaaagtacaatagggaagaaccttttgtattctattacaagttaatcactaaaggaatgctgcctataaaatgaaattacacataaatggcccatctctgggaaccttgattcccgagtaaaagcattaagttaaaatacatttatttagctcacaggaagcattctgaccaggccctactgtgaatgactgcaggg

SEQ ID NO: 45559 - DNA, 201 bp, Bos taurus; identical to SEQ ID NO: 4034

SEQ ID NO: 45560 - DNA, 201 bp, Bos taurus; identical to SEQ ID NO: 4035

SEQ ID NO: 45561 - DNA, 201 bp, Bos taurus; identical to SEQ ID NO: 4036

SEQ ID NO: 45562 - DNA, 201 bp, Bos taurus; identical to SEQ ID NO: 4037

SEQ ID NO: 45563 - DNA, 201 bp, Bos taurus; identical to SEQ ID NO: 4038

SEQ ID NO: 45564 - DNA, 201 bp, Bos taurus; identical to SEQ ID NO: 4039

SEQ ID NO: 45565 - DNA, 201 bp, Bos taurus; identical to SEQ ID NO: 4040

SEQ ID NO: 45566 - DNA, 201 bp, Bos taurus; identical to SEQ ID NO: 4041

SEQ ID NO: 45567 - DNA, 201 bp, Bos taurus; identical to SEQ ID NO: 4042

SEQ ID NO: 45568 - DNA, 201 bp, Bos taurus; identical to SEQ ID NO: 4043

SEQ ID NO: 45569 - DNA, 201 bp, Bos taurus
gagcctccctcctggcctgggttccttgccaattccgggaaagaaggcagaagggattgtcctcgctctctgatattcacccttggctggtccccccttctacctcccaaaggccaggcaaagccctgctcagcaggccggtgaggacttggcaagaacaggaatccccggcctggcctaggctccgctttggtatttttg

SEQ ID NO: 45570 - DNA, 201 bp, Bos taurus; identical to SEQ ID NO: 4044

SEQ ID NO: 45571 - DNA, 201 bp, Bos taurus; identical to SEQ ID NO: 4045

SEQ ID NO: 45572 - DNA, 201 bp, Bos taurus; identical to SEQ ID NO: 4047

SEQ ID NO: 45573 - DNA, 201 bp, Bos taurus
aggagttaatcaaggaggatgtggggttgttttcctctccctaagaagaagttagaaatggaccacaacttggttaccctcctcttccccgcccccactccaactgggcacttctctacccccatcctgcctctctaggtcctggaataaatatctctttggggcagcacacagcccctattgtgtctagggagggtggga

SEQ ID NO: 45574 - DNA, 201 bp, Bos taurus; identical to SEQ ID NO: 4048

SEQ ID NO: 45575 - DNA, 201 bp, Bos taurus; identical to SEQ ID NO: 4049

SEQ ID NO: 45576 - DNA, 201 bp, Bos taurus; identical to SEQ ID NO: 4050

SEQ ID NO: 45577 - DNA, 201 bp, Bos taurus; identical to SEQ ID NO: 4054

SEQ ID NO: 45578 - DNA, 201 bp, Bos taurus; identical to SEQ ID NO: 4055

SEQ ID NO: 45579 - DNA, 201 bp, Bos taurus
tgtttggtatctgtgactcggtttcccctttttcacatggcccaggcattgggacggaggactgtgggatttcagcccaaagagagatcagaggattaagatgacttcctcaagagacaggccaagtcatgcagttcagtctacatctgatctcccttgggcagatttttaaatctctggggaaagcaatttcagattcta

SEQ ID NO: 45580 - DNA, 201 bp, Bos taurus; identical to SEQ ID NO: 4056

SEQ ID NO: 45581 - DNA, 201 bp, Bos taurus; identical to SEQ ID NO: 4057

SEQ ID NO: 45582 - DNA, 201 bp, Bos taurus; identical to SEQ ID NO: 4059

SEQ ID NO: 45583 - DNA, 201 bp, Bos taurus
tcacctttgtttccctggggaagagctgtgctttttttcccctccaccccactccatgtctagtggtgcctaggactaacagtttggtttccttaggaagcacatgacctatttaccccatcttttaaaaagaactttgcttctttaaagtggtctggtttgttctgagaatttccttcctattcattctagacttgtgaa

SEQ ID NO: 45584 - DNA, 201 bp, Bos taurus; identical to SEQ ID NO: 4061

SEQ ID NO: 45585 - DNA, 201 bp, Bos taurus; identical to SEQ ID NO: 4062

SEQ ID NO: 45586 - DNA, 201 bp, Bos taurus
catattcagttcgaccaagtttctgtcctgattgagtgaaatgaatctagtattaaatgtattttatgcagctatgattatacatggccccttggcttttacatacattatgtttaatcctcacaaacacccctgttgaaacagtatcattccaatcacaccaggaaactgagactttaggagcataagaaatctatacat

SEQ ID NO: 45587 - DNA, 201 bp, Bos taurus; identical to SEQ ID NO: 4064

SEQ ID NO: 45588 - DNA, 201 bp, Bos taurus; identical to SEQ ID NO: 4065

SEQ ID NO: 45589 - DNA, 201 bp, Bos taurus
tcctgaagattgtgttagtctgctagaggactggacacggcccatctgctcccatggtagggtctggactgatgggggtgggaagctgtgttccagcccagttagttgtttggcctgaggcatctctgcactggcacctacaggctgttgggtgaggccaggtcttagtgctaatgagccaagatgtcagctgccaacaca

SEQ ID NO: 45590 - DNA, 201 bp, Bos taurus; identical to SEQ ID NO: 4070

SEQ ID NO: 45591 - DNA, 201 bp, Bos taurus; identical to SEQ ID NO: 4071

SEQ ID NO: 45592 - DNA, 201 bp, Bos taurus; identical to SEQ ID NO: 4072

SEQ ID NO: 45593 - DNA, 201 bp, Bos taurus
agaaaaatggaaaaattcccctgtgaaggttaaaattaaatgaaaggcagataagaaaacattatctttgatggcatgtgactatttcataagggatttttctgccattatagccacttgcttttaaggataatattcattcattcattcagtcatttaatgattcattcatttatgtaactgagtcaccactacgattat

SEQ ID NO: 45594 - DNA, 201 bp, Bos taurus; identical to SEQ ID NO: 4073

SEQ ID NO: 45595 - DNA, 201 bp, Bos taurus
aactgaagctcagagaaagtgaacaactaactctggcatataactagtaaacagaagcctacggatacaaatcctgatctgtacaactccaaaatatatgttctttccactatatgatgaccagcttagaaacgatataatccaaatatagagagttgagagcctagggtagagttactttatttcattcaataaatattt

SEQ ID NO: 45596 - DNA, 201 bp, Bos taurus; identical to SEQ ID NO: 4074

SEQ ID NO: 45597 - DNA, 201 bp, Bos taurus
tggtcccttccaccatagccccttgagttgtgaagtggaaatttgatgcccttatataactgagcacttgtattattcaattaagcaaggtgcttgctgtgtgaatcaacaaaacaactccaaacgaagatcaggaaaatacatctcaattagtgacagcaggaccagtgcccgagggccccaatcctcgagaaaaatagg

SEQ ID NO: 45598 - DNA, 201 bp, Bos taurus; identical to SEQ ID NO: 4076

SEQ ID NO: 45599 - DNA, 201 bp, Bos taurus; identical to SEQ ID NO: 4077

SEQ ID NO: 45600 - DNA, 201 bp, Bos taurus; identical to SEQ ID NO: 4078

SEQ ID NO: 45601 - DNA, 201 bp, Bos taurus; identical to SEQ ID NO: 4079

SEQ ID NO: 45602 - DNA, 201 bp, Bos taurus; identical to SEQ ID NO: 4080

SEQ ID NO: 45603 - DNA, 201 bp, Bos taurus; identical to SEQ ID NO: 4081

SEQ ID NO: 45604 - DNA, 201 bp, Bos taurus; identical to SEQ ID NO: 4082

SEQ ID NO: 45605 - DNA, 201 bp, Bos taurus; identical to SEQ ID NO: 4083

SEQ ID NO: 45606 - DNA, 201 bp, Bos taurus; identical to SEQ ID NO: 4084

SEQ ID NO: 45607 - DNA, 201 bp, Bos taurus
taaggtaaggagccttcttggcacgggggcgtgcgttttgtgtttctgggtgtagatgtgaaactcagcagacctgacactcttctgtgaagggagggtgaagggaaaaggccaggtgggacatggcatggctattacaatgaccacacagcacactctgtcctcccctgattcagcacttcacatttctccagtgaaaaa

SEQ ID NO: 45608 - DNA, 201 bp, Bos taurus; identical to SEQ ID NO: 4086

SEQ ID NO: 45609 - DNA, 201 bp, Bos taurus; identical to SEQ ID NO: 4088

SEQ ID NO: 45610 - DNA, 201 bp, Bos taurus; identical to SEQ ID NO: 4089

SEQ ID NO: 45611 - DNA, 201 bp, Bos taurus
aattgcgatgtttcatagaatagcattggggcttggagtgggccacccaaaatatgcactatggcacgttgattattttgaattaaagttacttaataaacgaccagtgggacactctggccctcctttctgttgcctgaaagcaggaagtacgtcacatgaaaggtgcactccctacatctaaggaagtagaaagacacc

SEQ ID NO: 45612 - DNA, 201 bp, Bos taurus; identical to SEQ ID NO: 4091

SEQ ID NO: 45613 - DNA, 201 bp, Bos taurus; identical to SEQ ID NO: 4092

SEQ ID NO: 45614 - DNA, 201 bp, Bos taurus; identical to SEQ ID NO: 4093

SEQ ID NO: 45615 - DNA, 201 bp, Bos taurus; identical to SEQ ID NO: 4094

SEQ ID NO: 45616 - DNA, 201 bp, Bos taurus
agttattataattttagctcttatatttaaatctatatttatttagaggtaattttgtacatgatacgagataagggccatagttaagatcatacgtataccccatttttcgagctgttttttgaaggaactatattcctctcaccttggtgcctttgtcaaaaaccaagtggccatatatgtatgggtaactttctggcc

SEQ ID NO: 45617 - DNA, 201 bp, Bos taurus; identical to SEQ ID NO: 4095

SEQ ID NO: 45618 - DNA, 201 bp, Bos taurus; identical to SEQ ID NO: 4097

SEQ ID NO: 45619 - DNA, 201 bp, Bos taurus; identical to SEQ ID NO: 4098

SEQ ID NO: 45620 - DNA, 201 bp, Bos taurus; identical to SEQ ID NO: 4099

SEQ ID NO: 45621 - DNA, 201 bp, Bos taurus; identical to SEQ ID NO: 4100

SEQ ID NO: 45622 - DNA, 201 bp, Bos taurus; identical to SEQ ID NO: 4102

SEQ ID NO: 45623 - DNA, 201 bp, Bos taurus; identical to SEQ ID NO: 4104

SEQ ID NO: 45624 - DNA, 201 bp, Bos taurus; identical to SEQ ID NO: 4105

SEQ ID NO: 45625 - DNA, 201 bp, Bos taurus; identical to SEQ ID NO: 4109

SEQ ID NO: 45626 - DNA, 201 bp, Bos taurus; identical to SEQ ID NO: 4110

SEQ ID NO: 45627 - DNA, 201 bp, Bos taurus; identical to SEQ ID NO: 4111

SEQ ID NO: 45628 - DNA, 201 bp, Bos taurus; identical to SEQ ID NO: 4113

SEQ ID NO: 45629 - DNA, 201 bp, Bos taurus; identical to SEQ ID NO: 4114

SEQ ID NO: 45630 - DNA, 201 bp, Bos taurus; identical to SEQ ID NO: 4115

SEQ ID NO: 45631 - DNA, 201 bp, Bos taurus; identical to SEQ ID NO: 4116

SEQ ID NO: 45632 - DNA, 201 bp, Bos taurus; identical to SEQ ID NO: 4117

SEQ ID NO: 45633 - DNA, 201 bp, Bos taurus; identical to SEQ ID NO: 4119

SEQ ID NO: 45634 - DNA, 201 bp, Bos taurus; identical to SEQ ID NO: 4121

SEQ ID NO: 45635 - DNA, 201 bp, Bos taurus; identical to SEQ ID NO: 4125

SEQ ID NO: 45636 - DNA, 201 bp, Bos taurus; identical to SEQ ID NO: 4127

SEQ ID NO: 45637 - DNA, 201 bp, Bos taurus; identical to SEQ ID NO: 4128

SEQ ID NO: 45638 - DNA, 201 bp, Bos taurus; identical to SEQ ID NO: 4129

SEQ ID NO: 45639 - DNA, 201 bp, Bos taurus; identical to SEQ ID NO: 4130

SEQ ID NO: 45640 - DNA, 201 bp, Bos taurus; identical to SEQ ID NO: 4133

SEQ ID NO: 45641 - DNA, 201 bp, Bos taurus; identical to SEQ ID NO: 4134

SEQ ID NO: 45642 - DNA, 201 bp, Bos taurus
tgggctgcaaattacatcccaagcatatgcaaatattcatgtattaactagaaaaccagtctctaaactgttcttgcctgggggaagggagaaggcctcatttattaacccaggtgtctaagagtcatctttaaatacccctctctcaaatccaaatccaatctcttggccaacactcctcctaagtatctactccatttg

SEQ ID NO: 45643 - DNA, 201 bp, Bos taurus; identical to SEQ ID NO: 4135

SEQ ID NO: 45644 - DNA, 201 bp, Bos taurus; identical to SEQ ID NO: 4136

SEQ ID NO: 45645 - DNA, 201 bp, Bos taurus; identical to SEQ ID NO: 4137

SEQ ID NO: 45646 - DNA, 201 bp, Bos taurus
agacatggaaagtgagagttgtcctaagaaagtgcttgaggccagagagagtattaaaaaaaagaatttctactcagttggaaagaacaagaaaggagtgatgagaaatgggacagtaaacagaggccaaaccttgtgagccttatacatcatgtctacaaatttggatgtagtcctaaaagcaaagggaagtccttgaaa

SEQ ID NO: 45647 - DNA, 201 bp, Bos taurus; identical to SEQ ID NO: 4141

SEQ ID NO: 45648 - DNA, 201 bp, Bos taurus
ccctttctctgtggccagaggtcagccctgccaccggctggctgcctagccgtctcctcagctggagtccctgccagcttccaggccgcactttaaaccgagttctgccacttactagtgtccttaagcatctttcctaagctgtggtaaccatgatgaccatcttcccctgagtctgcatcttctctgggcccccacact

SEQ ID NO: 45649 - DNA, 201 bp, Bos taurus
tgacggcggcccacctctttccaaattcctcttccctcccttttaaaaactaccaaagcccaggtcttggctactcagctctccagggaggaggccattcagtctgcttctcctgcgaggacagtggaagcagagaaagtgaacactgaccctaactcccagaccgcagtcgggccccctagactacctaaaatcaaacac

SEQ ID NO: 45650 - DNA, 201 bp, Bos taurus; identical to SEQ ID NO: 4142

SEQ ID NO: 45651 - DNA, 201 bp, Bos taurus; identical to SEQ ID NO: 4143

SEQ ID NO: 45652 - DNA, 201 bp, Bos taurus; identical to SEQ ID NO: 4144

SEQ ID NO: 45653 - DNA, 201 bp, Bos taurus; identical to SEQ ID NO: 4145

SEQ ID NO: 45654 - DNA, 201 bp, Bos taurus; identical to SEQ ID NO: 4146

SEQ ID NO: 45655 - DNA, 201 bp, Bos taurus; identical to SEQ ID NO: 4147

SEQ ID NO: 45656 - DNA, 201 bp, Bos taurus
ccgtcatgtggatggaagagaattcacaaaggcaggccctccttcaagtacatggaagaggagagctggctggtgccctgtctcctcctctgcccaaaagtggcagggcctcaggaggcaggtcagcctattgaaatcatgaaacatgagaacagagtcaagtagaaagaagaggagggctcagacagaaaggccggctcc

SEQ ID NO: 45657 - DNA, 201 bp, Bos taurus
ccagattgtttcctctacaaagaaactctaccaatccatgaaaggcattgggaagaatgtccaaaacttcaagctggccaaagctgaccctcacttagcaaccagttctcagtgcttcatgaccaagtctcagtccaaattggcaaagtcaggaaagcttttggaagcatagctcttgcaatgtccaaaggagcccagatg

SEQ ID NO: 45658 - DNA, 201 bp, Bos taurus; identical to SEQ ID NO: 4148

SEQ ID NO: 45659 - DNA, 201 bp, Bos taurus; identical to SEQ ID NO: 4149

SEQ ID NO: 45660 - DNA, 201 bp, Bos taurus; identical to SEQ ID NO: 4154

SEQ ID NO: 45661 - DNA, 201 bp, Bos taurus; identical to SEQ ID NO: 4155

SEQ ID NO: 45662 - DNA, 201 bp, Bos taurus
gagaaatgaggaacagaggactataagaaaccaatagaaagagaggggaaacgggggtcggtcggaggtggaaagacagggagagacagagagagaagacggcgagtgggtggaaagccagaatgagggggagtgatgagaaatgcgtgacaggagaagagaaaagaggagaaaagagcagagaaggggccagagggaggg

SEQ ID NO: 45663 - DNA, 201 bp, Bos taurus; identical to SEQ ID NO: 4156

SEQ ID NO: 45664 - DNA, 201 bp, Bos taurus; identical to SEQ ID NO: 4157

SEQ ID NO: 45665 - DNA, 201 bp, Bos taurus
tgacattgttacctaatcccattaggagacccacccaacaacccctttttgtctgtcaatatctccttggtaggaagtggccgcagcagatggtacagatcggctactctgcttttaccctactttgaacagttctcattgacagatatccctgagctgggcccccaggctggcagagggccaggtcaccttgagggcagc

SEQ ID NO: 45666 - DNA, 201 bp, Bos taurus
atctaaaatgggggcagaagacgtgctttaactttacaaaatatatacaaatattgttaaaaatattttccaccaagtttcataaaataaattcaccataattgtggacctgcctgtacataaacttattctggaaacaaaccttgtgtctgggttgcactttgcggagaagcaagtatagtaaatagaagttgccaacac

SEQ ID NO: 45667 - DNA, 201 bp, Bos taurus; identical to SEQ ID NO: 4160

SEQ ID NO: 45668 - DNA, 201 bp, Bos taurus; identical to SEQ ID NO: 4161

SEQ ID NO: 45669 - DNA, 201 bp, Bos taurus; identical to SEQ ID NO: 4162

SEQ ID NO: 45670 - DNA, 201 bp, Bos taurus; identical to SEQ ID NO: 4163

SEQ ID NO: 45671 - DNA, 201 bp, Bos taurus; identical to SEQ ID NO: 4164

SEQ ID NO: 45672 - DNA, 201 bp, Bos taurus
tagcttttgcttgtctgtaaagcttttgatttctccctcaaatctaaacagcagccttattgaatagattattcttgattttaagtttttccatttcatctttttatgtgtattccgacacgcttttctgattggcagagtttctgctgaaaaatcacctgataggattatggaaattcccttgtatgtcatcagttcctt

SEQ ID NO: 45673 - DNA, 201 bp, Bos taurus; identical to SEQ ID NO: 4165

SEQ ID NO: 45674 - DNA, 201 bp, Bos taurus
acacacaactatttactacctactttcacattcatgtgctccttcacaatggcacttgctcagttgcacttaaatcatgagagagccaagtttttgatgaccttctgtcacctgaagctaaagtactaagtcctttcaatgatttgtcacagaagataatgccatagcatgtttcacaaagattccaattttaaaatccat

SEQ ID NO: 45675 - DNA, 201 bp, Bos taurus; identical to SEQ ID NO: 4166

SEQ ID NO: 45676 - DNA, 201 bp, Bos taurus
atctcttttctgtgtgtgggttggaaaactaatcagaaataaagtaatgcttttaataattcttgaagcatggaaaaacgtggcttaattttgtttaaaggaatagtgcatatgatagaaaataactcattgaaaatgattcatcagctctctgctgaagctccctgaactcattacaaagaatgtaagaaaccattactg

SEQ ID NO: 45677 - DNA, 201 bp, Bos taurus; identical to SEQ ID NO: 4167

SEQ ID NO: 45678 - DNA, 201 bp, Bos taurus
ttcatatctaccatatgaatgtgaagtcattcacattgtgaagtcaggtgaaggcccacttcctggttcagagttggccatcttcttgctgcgtcctcacatagtagaagggataagggagcttctctgcagtatttatagagtctaattcatgagggctccactctcatgacctaatcatccccaaaggccctacctcca

SEQ ID NO: 45679 - DNA, 201 bp, Bos taurus; identical to SEQ ID NO: 4169

SEQ ID NO: 45680 - DNA, 201 bp, Bos taurus
tgtctctgggcattggctgccactgtggtcctggtcagagaagcagataagcttatactgggacaaaatataaatgtaaaagttccccatgctgttactgtgctgatgaacagccaagggcacaagtaactgaccaataccaggatgactcactgtcagggactgctttgtgaaaacccacaggtccacctcgagactgtg

SEQ ID NO: 45681 - DNA, 201 bp, Bos taurus; identical to SEQ ID NO: 4170

SEQ ID NO: 45682 - DNA, 201 bp, Bos taurus; identical to SEQ ID NO: 4171

SEQ ID NO: 45683 - DNA, 201 bp, Bos taurus; identical to SEQ ID NO: 4172

SEQ ID NO: 45684 - DNA, 201 bp, Bos taurus
cagctgaaccatgctgttctgttgagtataagcagccccacgggaccatccactacaagcaaggtcactgtgcaacccacgaaatacgaagcaccctctttcttcaagctgcctggtatatattttttagaagtgctctgctaagcaggttttcacctaacacttaataatgaatcagatgagggaatttttaaatacatg

SEQ ID NO: 45685 - DNA, 201 bp, Bos taurus; identical to SEQ ID NO: 4175

SEQ ID NO: 45686 - DNA, 201 bp, Bos taurus; identical to SEQ ID NO: 4176

SEQ ID NO: 45687 - DNA, 201 bp, Bos taurus; identical to SEQ ID NO: 4177

SEQ ID NO: 45688 - DNA, 201 bp, Bos taurus; identical to SEQ ID NO: 4178

SEQ ID NO: 45689 - DNA, 201 bp, Bos taurus; identical to SEQ ID NO: 4180

SEQ ID NO: 45690 - DNA, 201 bp, Bos taurus; identical to SEQ ID NO: 4182

SEQ ID NO: 45691 - DNA, 201 bp, Bos taurus
tggaatattcaacaaagaagatgttatgactgactgaattgcttgtcagtcagaaatgcctagactgtgttatcttctctttcaacatatgatcctggccatttatctgaaggtagatacctaaattgattagttttaactgagaaaggaaatagtttatcttccattgactgaaattcatatgggtgataaaaaatggcc

SEQ ID NO: 45692 - DNA, 201 bp, Bos taurus
ccaagatgacttcttcacccaatgaacagcactgtggccaggatgccaaagtatgggctcaactggactgccaagcttaatgccaacatgatttccctggcatcgcatttaaggttaggccactcctccctcagtgcctcaggactccatcagcaagtgttcccagtgaacagagtgaaagctgcagcctcagaagcactt

SEQ ID NO: 45693 - DNA, 201 bp, Bos taurus; identical to SEQ ID NO: 4184

SEQ ID NO: 45694 - DNA, 201 bp, Bos taurus; identical to SEQ ID NO: 4185

SEQ ID NO: 45695 - DNA, 201 bp, Bos taurus; identical to SEQ ID NO: 4188

SEQ ID NO: 45696 - DNA, 201 bp, Bos taurus
tagtaactgacagaggattttcaaaagtaataaagtttatatgaccagatataaaatatgggagtaaaagaataaacacttaaaaaacaaaagcaaaagagaagagaaatggaccgagacagtgccagatcatgaaagccaaatttaaggaagctttgaaaaaaagtcataagcaagttttaggaaaaaagtgaaagtgaa

SEQ ID NO: 45697 - DNA, 201 bp, Bos taurus; identical to SEQ ID NO: 4189

SEQ ID NO: 45698 - DNA, 201 bp, Bos taurus; identical to SEQ ID NO: 4190

SEQ ID NO: 45699 - DNA, 201 bp, Bos taurus; identical to SEQ ID NO: 4191

SEQ ID NO: 45700 - DNA, 201 bp, Bos taurus; identical to SEQ ID NO: 4193

SEQ ID NO: 45701 - DNA, 201 bp, Bos taurus; identical to SEQ ID NO: 4194

SEQ ID NO: 45702 - DNA, 201 bp, Bos taurus
gtcgtggcccaggttcaattcctggtcagggaactaacatccaccaagccatgtggtacaagctgtaccagagaactgagatgttgtcaatcttctttcagaaactgagtcaacagggcctctaattgtaaagcctgagttacctttcagttcagttcagtcgctcagtcgtgtccgactctttgcgaccccatgaatcga

SEQ ID NO: 45703 - DNA, 201 bp, Bos taurus
tgcctcctattagactgggggaggaaaaaaaggcagactgcctggggtgaactcactcagctcttatctcttccaatcacatttctttcctcaatttcccacaacctttctttcattctctcaagaagcattcttacagatttcaaagctaacccgcattctccacctaatttcagtctatccctttcctttccccttctt

SEQ ID NO: 45704 - DNA, 201 bp, Bos taurus; identical to SEQ ID NO: 4195

SEQ ID NO: 45705 - DNA, 201 bp, Bos taurus; identical to SEQ ID NO: 4196

SEQ ID NO: 45706 - DNA, 201 bp, Bos taurus
aggtgttatagagatatttcaaactcatgctaatccctcccctggcatgtctttcactcataaatggacaatttctatttcactttatataggaagccatactaatctctccagcctgaagcactcttttctccttctgtttcccagtaccctgttacttgcttatcactttctgcttgatttacacttatttgtactcat

SEQ ID NO: 45707 - DNA, 201 bp, Bos taurus; identical to SEQ ID NO: 4198

SEQ ID NO: 45708 - DNA, 201 bp, Bos taurus; identical to SEQ ID NO: 4199

SEQ ID NO: 45709 - DNA, 201 bp, Bos taurus; identical to SEQ ID NO: 4200

SEQ ID NO: 45710 - DNA, 201 bp, Bos taurus
catttttgtgatggatatgtcatgtcttctagcatgaatatgatttactttacagtttctgtaaccagctactccaaatgcttattggatgaaaactttgaccatatgatatatcctggttaaacttgctgcataccttttgaatatagtttaactatattttagtatatatatatatattaatttaaaagaaaattctga

SEQ ID NO: 45711 - DNA, 201 bp, Bos taurus
gatgatgccatccaaccatctcatcctctttcattctcttctcctcctgcctttgatctttcccagcatcagggtcttttccaatgagtgctgggtcgaccgcatcttttttttttgtttgttggtggatatgcttcatggaaaaacacatcatcaaaatgaaagcattcagaagtaagcatctgtggtactaaagggatc

SEQ ID NO: 45712 - DNA, 201 bp, Bos taurus; identical to SEQ ID NO: 4201

SEQ ID NO: 45713 - DNA, 201 bp, Bos taurus; identical to SEQ ID NO: 4202

SEQ ID NO: 45714 - DNA, 201 bp, Bos taurus; identical to SEQ ID NO: 4203

SEQ ID NO: 45715 - DNA, 201 bp, Bos taurus; identical to SEQ ID NO: 4204

SEQ ID NO: 45716 - DNA, 201 bp, Bos taurus; identical to SEQ ID NO: 4205

SEQ ID NO: 45717 - DNA, 201 bp, Bos taurus; identical to SEQ ID NO: 4206

SEQ ID NO: 45718 - DNA, 201 bp, Bos taurus; identical to SEQ ID NO: 4207

SEQ ID NO: 45719 - DNA, 201 bp, Bos taurus; identical to SEQ ID NO: 4208

SEQ ID NO: 45720 - DNA, 201 bp, Bos taurus
ttaggcaagttacacaataaaaattccatgataaaggtgttacaatctgaggatatgaaaatctaactgattaaaagggtaggcaacggaaagaggccactccccgaaaagcagaataagtacagtctgcccttttagcttacctgtgtctttcagtcacagccaaagcaccatcctctatttcttcatatctgggccttt

SEQ ID NO: 45721 - DNA, 201 bp, Bos taurus; identical to SEQ ID NO: 4210

SEQ ID NO: 45722 - DNA, 201 bp, Bos taurus; identical to SEQ ID NO: 4211

SEQ ID NO: 45723 - DNA, 201 bp, Bos taurus
gatgcagttgtgatctgtcatgatattattaaattattcctctcatattaagtgaccacaatttcaacataggtttctcttgacagatgtacaattcatagagacgatgggaactatattcagggcgtgctgtgatttcatttgctgtgccactcatagtggaaaaaatatgccacacttttttaagcaaacaggcttctt

SEQ ID NO: 45724 - DNA, 201 bp, Bos taurus
gaatgacagtgcagatagaaagcgctgtagcaggtttaaagaaggaaaggtctttaagaggtaggtggcgtgaacaaggccttatagtccaggtaagattgtttctggagaaaggaataatattagaaggcatgggcaggaaaacatggcaacaatctgggaacgctttgttcctctagtttgcttgatgagtgcactctg

SEQ ID NO: 45725 - DNA, 201 bp, Bos taurus
ctagcattgcctagtgctgataagcagtgaggaataatctttgaggaaagcagggaataataaaaattcatcagccgtcaaggggccaccgtgtttttcagtgcagcagtgtgactagccttgtgtctggggatccgtttcctcacatgtaaaaatcaggaaatgcattgcccctgtttcttcacctggcctactcttgat

SEQ ID NO: 45726 - DNA, 201 bp, Bos taurus; identical to SEQ ID NO: 4213

SEQ ID NO: 45727 - DNA, 201 bp, Bos taurus; identical to SEQ ID NO: 4214

SEQ ID NO: 45728 - DNA, 201 bp, Bos taurus; identical to SEQ ID NO: 4215

SEQ ID NO: 45729 - DNA, 201 bp, Bos taurus; identical to SEQ ID NO: 4216

SEQ ID NO: 45730 - DNA, 201 bp, Bos taurus; identical to SEQ ID NO: 4217

SEQ ID NO: 45731 - DNA, 201 bp, Bos taurus; identical to SEQ ID NO: 4218

SEQ ID NO: 45732 - DNA, 201 bp, Bos taurus
aactcagataacatgctcagtgccttgctcttcccttctcctccacatcctactgtacacatttggcaataaacatcatgcataggtgcaagttgatcctgtatcaataaatcgtcaagtaaccagaatgcccagagactgggcctaacagacttttttatccctaagcattatatggatattccactcttcctacaagct

SEQ ID NO: 45733 - DNA, 201 bp, Bos taurus
ccaggcccatatgtcaccactactgagcccatgccctagaacctgtgctccgcaacaagagaagctaccagtaaagctcaccacaactagagagaaagcttacacacaagaaggcccaggacagccaaaaataaatattttttaaaaactgaaactttttatattaaaaaaaaaaaaaagctaacaatcaatgaaaagacc

SEQ ID NO: 45734 - DNA, 201 bp, Bos taurus; identical to SEQ ID NO: 4221

SEQ ID NO: 45735 - DNA, 201 bp, Bos taurus; identical to SEQ ID NO: 4222

SEQ ID NO: 45736 - DNA, 201 bp, Bos taurus; identical to SEQ ID NO: 4223

SEQ ID NO: 45737 - DNA, 201 bp, Bos taurus; identical to SEQ ID NO: 4224

SEQ ID NO: 45738 - DNA, 201 bp, Bos taurus; identical to SEQ ID NO: 4225

SEQ ID NO: 45739 - DNA, 201 bp, Bos taurus; identical to SEQ ID NO: 4226

SEQ ID NO: 45740 - DNA, 201 bp, Bos taurus; identical to SEQ ID NO: 4227

SEQ ID NO: 45741 - DNA, 201 bp, Bos taurus; identical to SEQ ID NO: 4228

SEQ ID NO: 45742 - DNA, 201 bp, Bos taurus; identical to SEQ ID NO: 4229

SEQ ID NO: 45743 - DNA, 201 bp, Bos taurus; identical to SEQ ID NO: 4230

SEQ ID NO: 45744 - DNA, 201 bp, Bos taurus
gtaaaattatctaacgaagggttcacccttcaacttgctgatgtagaactttagctttaacaaattaccataaatttggttaacctgatgctgagaactccgtaaggtccttgaaattgctccaaataccaattcctcttctgggattttgttggctatgtgacaaagtggtatttaaaaggctgttaatctatatggtgt

SEQ ID NO: 45745 - DNA, 201 bp, Bos taurus; identical to SEQ ID NO: 4231

SEQ ID NO: 45746 - DNA, 201 bp, Bos taurus
cagtacagattttattcaactaatccttctgctctgtctgccaaaactaccatcagtaatgaagcccaaggttacaactgctgttagaaaagccttataatattgggcctgaagtcaacccaaatctttaagccttttgcttcatttgtttataagcaaatattcaggcactttccatactggaattttattaaaatttat

SEQ ID NO: 45747 - DNA, 201 bp, Bos taurus; identical to SEQ ID NO: 4233

SEQ ID NO: 45748 - DNA, 201 bp, Bos taurus; identical to SEQ ID NO: 4235

SEQ ID NO: 45749 - DNA, 201 bp, Bos taurus
aatgcaatcaaaggggaaatttagcactggaaaagcacagtttagtgtctgctcagactacccagatgtgtaaatagccactgtttgatgtatacttttcaggcattaatcataaacatcatgacccagaaaagtacatattagttgctggaaaaacaaaacaaaacaaaaaaaaaccttctgcaaatgaaaaaagatatc

SEQ ID NO: 45750 - DNA, 201 bp, Bos taurus; identical to SEQ ID NO: 4236

SEQ ID NO: 45751 - DNA, 201 bp, Bos taurus; identical to SEQ ID NO: 4237

SEQ ID NO: 45752 - DNA, 201 bp, Bos taurus; identical to SEQ ID NO: 4240

SEQ ID NO: 45753 - DNA, 201 bp, Bos taurus; identical to SEQ ID NO: 4242

SEQ ID NO: 45754 - DNA, 201 bp, Bos taurus; identical to SEQ ID NO: 4243

SEQ ID NO: 45755 - DNA, 201 bp, Bos taurus; identical to SEQ ID NO: 4244

SEQ ID NO: 45756 - DNA, 201 bp, Bos taurus
ctttcccactttctaggaggaaggttctgaaaccatctttgccttttgggggcttggtgtgtggtttggccctgaaggcctactgagttatgtagggctgcctgtgtctacacctgtgattctcaaactgccctttaggaaagaatcaccctgtatgcttgtgaacattagactttcccacaccccaaggacagggctcag

SEQ ID NO: 45757 - DNA, 201 bp, Bos taurus; identical to SEQ ID NO: 4245

SEQ ID NO: 45758 - DNA, 201 bp, Bos taurus; identical to SEQ ID NO: 4246

SEQ ID NO: 45759 - DNA, 201 bp, Bos taurus; identical to SEQ ID NO: 4247

SEQ ID NO: 45760 - DNA, 201 bp, Bos taurus; identical to SEQ ID NO: 4248

SEQ ID NO: 45761 - DNA, 201 bp, Bos taurus; identical to SEQ ID NO: 4249

SEQ ID NO: 45762 - DNA, 201 bp, Bos taurus; identical to SEQ ID NO: 4250

SEQ ID NO: 45763 - DNA, 201 bp, Bos taurus; identical to SEQ ID NO: 4251

SEQ ID NO: 45764 - DNA, 201 bp, Bos taurus; identical to SEQ ID NO: 4253

SEQ ID NO: 45765 - DNA, 201 bp, Bos taurus; identical to SEQ ID NO: 4254

SEQ ID NO: 45766 - DNA, 201 bp, Bos taurus
gccttccagagcactgatgtcccttgactccagcatcctcactggctgaagctagcatcagtctgctttctaccatggtccttttagcacccagcaagccggcaggcctgtaaaggaggcttcccaggaagcttgtagaaactaggaacttaacctttcaattcaccctggctattccccttatgctgcagctgtgcttaa

SEQ ID NO: 45767 - DNA, 201 bp, Bos taurus; identical to SEQ ID NO: 4255

SEQ ID NO: 45768 - DNA, 201 bp, Bos taurus; identical to SEQ ID NO: 4256

SEQ ID NO: 45769 - DNA, 201 bp, Bos taurus; identical to SEQ ID NO: 4257

SEQ ID NO: 45770 - DNA, 201 bp, Bos taurus; identical to SEQ ID NO: 4260

SEQ ID NO: 45771 - DNA, 201 bp, Bos taurus
aatctggaaaacagacctagccagctatcgcgtcggtttcttcatctgtaaaatgataatgaaagagtgcctgtgtcatggggtttttgggaagattttatgaaacaacacatgggctttgtataaggcctgacaagcaagtactcaatatatatatactgacttattatttttattattaaattctttctacactgagtt

SEQ ID NO: 45772 - DNA, 201 bp, Bos taurus
tgccatttactgatcataatttttttcttcctttatggctcagtttgactgttcttattagtctgggttcgtttgcagtgcattcaggcatgttctacccagaatactcttagatccatgtaaaagagaaagtgttagctgcttattccaactctttgcaaccccacggactatagcccaccaggctccttggtccatgga

SEQ ID NO: 45773 - DNA, 201 bp, Bos taurus; identical to SEQ ID NO: 4261

SEQ ID NO: 45774 - DNA, 201 bp, Bos taurus; identical to SEQ ID NO: 4262

SEQ ID NO: 45775 - DNA, 201 bp, Bos taurus; identical to SEQ ID NO: 4264

SEQ ID NO: 45776 - DNA, 201 bp, Bos taurus; identical to SEQ ID NO: 4265

SEQ ID NO: 45777 - DNA, 201 bp, Bos taurus; identical to SEQ ID NO: 4266

SEQ ID NO: 45778 - DNA, 201 bp, Bos taurus; identical to SEQ ID NO: 4267

SEQ ID NO: 45779 - DNA, 201 bp, Bos taurus; identical to SEQ ID NO: 4268

SEQ ID NO: 45780 - DNA, 201 bp, Bos taurus; identical to SEQ ID NO: 4269

SEQ ID NO: 45781 - DNA, 201 bp, Bos taurus
ctccctctgatattcagttatgaatgaaaacaggaggcagttcacttgccccagtggcagcggtttggagactatgttcctggccttccttcctcacagcctcacgtttacgttgtaggtcgaccttgactgcagtcagaaggttgtcgtgtatgatcagagctcccaggatgtggcctctctggcttcagactgttttct

SEQ ID NO: 45782 - DNA, 201 bp, Bos taurus
cagaatcaggggtcagagatcataaaatgtgtccagggtcacacagctcatcctagcagtaaagtcagaattcaaacttatgctttttaagcctaatctccccctatcttttcttcagagcccattaattcaaatgattcacttcaatgaaatatataccatgttgggccacgtgttcaggaccttcttgatacccttgac

SEQ ID NO: 45783 - DNA, 201 bp, Bos taurus; identical to SEQ ID NO: 4271

SEQ ID NO: 45784 - DNA, 201 bp, Bos taurus; identical to SEQ ID NO: 4272

SEQ ID NO: 45785 - DNA, 201 bp, Bos taurus
tcactcccactcaccaacctccaacccatgactcagagcccacggtcttatggagagattcgttttctcagacgtctggatcctcggatcacttggagaaactactcaagattgatctggagagcccaccgtcatctgattataaagaagaaggccactctcagacgtcacagtcttcctcaggaccagcaatagctaatc

SEQ ID NO: 45786 - DNA, 201 bp, Bos taurus; identical to SEQ ID NO: 4273

SEQ ID NO: 45787 - DNA, 201 bp, Bos taurus; identical to SEQ ID NO: 4275

SEQ ID NO: 45788 - DNA, 201 bp, Bos taurus; identical to SEQ ID NO: 4276

SEQ ID NO: 45789 - DNA, 201 bp, Bos taurus
taatagtctctacttcttagaatttttttcagctacactgcataaacaagttttttcctttcttgatcagaattatgccaccttgttgcttcttccagtttgagagctctctgggcaaattaatattcaccatggcctgtaaaaacttgatttatgggcaataaagtagatgcctttatcagggacaaatatattcttatt

SEQ ID NO: 45790 - DNA, 201 bp, Bos taurus; identical to SEQ ID NO: 4278

SEQ ID NO: 45791 - DNA, 201 bp, Bos taurus; identical to SEQ ID NO: 4281

SEQ ID NO: 45792 - DNA, 201 bp, Bos taurus; identical to SEQ ID NO: 4282

SEQ ID NO: 45793 - DNA, 201 bp, Bos taurus
ccatacactgtgtgattccacacaccggaaaacatctctggtgatttccagaaataaaggaagtatatatggattttccagagactgggaaagggagaagggcagaggggatgttaaggcccctgcagtcaggcaaactgtctgttggtattgctgaaaaaatacctaaatctagaaactgtaaaaactgggaaatatgag

SEQ ID NO: 45794 - DNA, 201 bp, Bos taurus; identical to SEQ ID NO: 4283

SEQ ID NO: 45795 - DNA, 201 bp, Bos taurus
aaataacaacaaccatcaccaaactctcatttgtcacagtggactcaaaccttagacgaggaattcctttcacggggaaggtgaagtatttttcaattcatgtgtcaaaccatagtctcccccaatacacacaacatattctgctaaaaccacatttggctggtattatccattgattagtataatcaaaagcatgtgcgt

SEQ ID NO: 45796 - DNA, 201 bp, Bos taurus
tctggtttgttacaataagagctctgcatcagtggatctggggtgtggcccacagtctgcagctccaacaagcttccaggagtcactgatactggtctagcgtgttaggcagcctctaaggggccctgacaacccctgcatcctgatatttacactgctctgtcatcttctccccttgcttgtgggctggatttagtgatt

SEQ ID NO: 45797 - DNA, 201 bp, Bos taurus; identical to SEQ ID NO: 4284

SEQ ID NO: 45798 - DNA, 201 bp, Bos taurus
agggaggctctccctagcccaaggtctcagaggacatacgtttgttggctctgaaggcctccgcggagtccatctcttagtttggccattaccgctttattgcttcattctgctacacagagcactcccccacccctcatccccacctcatataaccctcctcctttcctctcctcccttttatgggatctgtgtgtgttt

SEQ ID NO: 45799 - DNA, 201 bp, Bos taurus
tgggaattgcctggcagtccagcagttaggcctctgagcttccactctcccactgcagggcacacggattcaacccctggttggagaactaagatcccacaaaccgagcagcgaggccaaaagaaagtaaaaaagccagaaaagtgaaaaatcttggctctcagccccagagaaccaaaacaaatgagtctttctaaaaaa

SEQ ID NO: 45800 - DNA, 201 bp, Bos taurus; identical to SEQ ID NO: 4285

SEQ ID NO: 45801 - DNA, 201 bp, Bos taurus; identical to SEQ ID NO: 4290

SEQ ID NO: 45802 - DNA, 201 bp, Bos taurus; identical to SEQ ID NO: 4292

SEQ ID NO: 45803 - DNA, 201 bp, Bos taurus; identical to SEQ ID NO: 4293

SEQ ID NO: 45804 - DNA, 201 bp, Bos taurus
agtgtactgagctggggacaggagaccaaatgaggtggctcaggagaggggtatggaccaaacactttttgtttgaatacaagagtgctcactaagacagcaggcaccgggcctccagcttcctcaaaggtgatgcggggacctcagggaccagggagacatgagcgctcccactccttaatcaagcctctgtctgtcctg

SEQ ID NO: 45805 - DNA, 201 bp, Bos taurus; identical to SEQ ID NO: 4294

SEQ ID NO: 45806 - DNA, 201 bp, Bos taurus; identical to SEQ ID NO: 4295

SEQ ID NO: 45807 - DNA, 201 bp, Bos taurus; identical to SEQ ID NO: 4296

SEQ ID NO: 45808 - DNA, 201 bp, Bos taurus; identical to SEQ ID NO: 4297

SEQ ID NO: 45809 - DNA, 201 bp, Bos taurus
tatctctatgcagccccctgagaggtcttggtgtgctccagcaatctccgcactgaataaatggccccggcgtagctgccagtctgacttttgggatcctggtgcttgctgccctatgggtgctgcttcctttagctggtgcctcctgaggtttcatctgaagtggtttctagtgtctgtggacagaagcagaggtcaaga

SEQ ID NO: 45810 - DNA, 201 bp, Bos taurus; identical to SEQ ID NO: 4300

SEQ ID NO: 45811 - DNA, 201 bp, Bos taurus
gaccctgcggccccagtctgagctgtagggcatctctgttcactatatgtttttcctctacccacctggagagcctacggacagaagaggagagagaaagatgggccccaagaatgctggtcacagtggaaacacggcatcatgtttccctcgggaaggacttaggttcaaataaggaggaggaataagggtgagccttgt

SEQ ID NO: 45812 - DNA, 201 bp, Bos taurus; identical to SEQ ID NO: 4303

SEQ ID NO: 45813 - DNA, 201 bp, Bos taurus; identical to SEQ ID NO: 4304

SEQ ID NO: 45814 - DNA, 201 bp, Bos taurus; identical to SEQ ID NO: 4305

SEQ ID NO: 45815 - DNA, 201 bp, Bos taurus
gttgatgaccacgcgctcgcagcattcgtggtcgtcgtgctcggccggccgcgggtagctgctgtcctgagggtggcctggggcagccgaagcctcgtccgcattctctccagacatcaccgtcatggtggaggtggtgggaggcagagatggtggccggaggcgggaggcgggggaccgggccggggcggggaggggcga

SEQ ID NO: 45816 - DNA, 201 bp, Bos taurus; identical to SEQ ID NO: 4306

SEQ ID NO: 45817 - DNA, 201 bp, Bos taurus; identical to SEQ ID NO: 4308

SEQ ID NO: 45818 - DNA, 201 bp, Bos taurus; identical to SEQ ID NO: 4309

SEQ ID NO: 45819 - DNA, 201 bp, Bos taurus; identical to SEQ ID NO: 4310

SEQ ID NO: 45820 - DNA, 201 bp, Bos taurus; identical to SEQ ID NO: 4311

SEQ ID NO: 45821 - DNA, 201 bp, Bos taurus; identical to SEQ ID NO: 4313

SEQ ID NO: 45822 - DNA, 201 bp, Bos taurus
tcacggagcagctccttctgatgtggggtgggtgtttggtattccgtgggtggttcactgacgttgtcgtctatgcttagagctatgaagtggccttgctctgtctcatctagccagggtctcctcattaacttctcctgaggttggtattctgcaagttgatcagttcagtccctcagtcatgtccaactctttgcgacc

SEQ ID NO: 45823 - DNA, 201 bp, Bos taurus; identical to SEQ ID NO: 4314

SEQ ID NO: 45824 - DNA, 201 bp, Bos taurus
agggctggaagctgccctcatggtggggagggtcccagggggccctgcaggagggctccaatgctccagttttaaggggtccaggttgggtgtttctagggtgccatcatggccacacctgcctttcttccacttcgcctataactttcctgattgtgcacaaggtgcccaggtccctgccagccagtgggggaaaccccc

SEQ ID NO: 45825 - DNA, 201 bp, Bos taurus; identical to SEQ ID NO: 4315

SEQ ID NO: 45826 - DNA, 201 bp, Bos taurus; identical to SEQ ID NO: 4316

SEQ ID NO: 45827 - DNA, 201 bp, Bos taurus
gatcagggcccttcctaatcttctttgtaagaagagattaggatgaagacttctcacagaggaaggaccatgaggacatggagagaggatccatctctaagccaaggagaggggcctcaggagaaaccaagcctgcctacaccttgaccttgaacttgcatcctccacaaccgtgagggataaatttctgtgtaagccacc

SEQ ID NO: 45828 - DNA, 201 bp, Bos taurus; identical to SEQ ID NO: 4319

SEQ ID NO: 45829 - DNA, 201 bp, Bos taurus
tggggcccaagtcagtgggggtaaccggagagagcccaggcagcagaggcttactccctggtggctgctggtcacaagtgggtgtggagcattagaaatgcggcctgtgtgtgcagctgaggaactgactgaactcttaatgtgcttaattttcagtaaaaatcaatttaaaagtcggttgcagatgaaccagttggttgg

SEQ ID NO: 45830 - DNA, 201 bp, Bos taurus; identical to SEQ ID NO: 4320

SEQ ID NO: 45831 - DNA, 201 bp, Bos taurus; identical to SEQ ID NO: 4322

SEQ ID NO: 45832 - DNA, 201 bp, Bos taurus; identical to SEQ ID NO: 4323

SEQ ID NO: 45833 - DNA, 201 bp, Bos taurus; identical to SEQ ID NO: 4325

SEQ ID NO: 45834 - DNA, 201 bp, Bos taurus
taccaggcccaggtggcagaacagtttgagggttttccatacagctcaccagtcctgtcaagtcctatgaagcagacacctgagcagaagccagtgcacgggggccccacctccagttctgtctttgaatttccatcgggacaggctttcctggtaggacacctccagaatgtaagattagattcgggactgagcccaggc

SEQ ID NO: 45835 - DNA, 201 bp, Bos taurus; identical to SEQ ID NO: 4326

SEQ ID NO: 45836 - DNA, 201 bp, Bos taurus
gaaaatagcttatcttggtagtttctctcgcctctaccgaggtttctagagatgtgttcctcctgacttgcttctcttgaactgttaatgtaccctttcagtcttttttcctccaaggttctgacctttgtgttgtttggttcccacaggtgaatgttctgcaggcttttgcagtgttttgcttatttcttccaggtattg

SEQ ID NO: 45837 - DNA, 201 bp, Bos taurus; identical to SEQ ID NO: 4330

SEQ ID NO: 45838 - DNA, 201 bp, Bos taurus
tttatgctgatgaaaacaggccaggcttgttgtcttgctggtagaagtagtagttgttgttgttgttttttgaccaaagtcatttcagcgactttgaagaaaggatctgaaaatgatcactcagcctggtatttattttgatatatatgctgacctctacctctcagagccgaacagcctaatccttgaccatcccagggt

SEQ ID NO: 45839 - DNA, 201 bp, Bos taurus; identical to SEQ ID NO: 4331

SEQ ID NO: 45840 - DNA, 201 bp, Bos taurus; identical to SEQ ID NO: 4332

SEQ ID NO: 45841 - DNA, 201 bp, Bos taurus; identical to SEQ ID NO: 4333

SEQ ID NO: 45842 - DNA, 201 bp, Bos taurus; identical to SEQ ID NO: 4334

SEQ ID NO: 45843 - DNA, 201 bp, Bos taurus; identical to SEQ ID NO: 4335

SEQ ID NO: 45844 - DNA, 201 bp, Bos taurus; identical to SEQ ID NO: 4338

SEQ ID NO: 45845 - DNA, 201 bp, Bos taurus; identical to SEQ ID NO: 4340

SEQ ID NO: 45846 - DNA, 201 bp, Bos taurus; identical to SEQ ID NO: 4341

SEQ ID NO: 45847 - DNA, 201 bp, Bos taurus; identical to SEQ ID NO: 4342

SEQ ID NO: 45848 - DNA, 201 bp, Bos taurus; identical to SEQ ID NO: 4343

SEQ ID NO: 45849 - DNA, 201 bp, Bos taurus; identical to SEQ ID NO: 4344

SEQ ID NO: 45850 - DNA, 201 bp, Bos taurus; identical to SEQ ID NO: 4345

SEQ ID NO: 45851 - DNA, 201 bp, Bos taurus; identical to SEQ ID NO: 4346

SEQ ID NO: 45852 - DNA, 201 bp, Bos taurus; identical to SEQ ID NO: 4347

SEQ ID NO: 45853 - DNA, 201 bp, Bos taurus; identical to SEQ ID NO: 4348

SEQ ID NO: 45854 - DNA, 201 bp, Bos taurus; identical to SEQ ID NO: 4350

SEQ ID NO: 45855 - DNA, 201 bp, Bos taurus; identical to SEQ ID NO: 4351

SEQ ID NO: 45856 - DNA, 201 bp, Bos taurus; identical to SEQ ID NO: 4352

SEQ ID NO: 45857 - DNA, 201 bp, Bos taurus
ttctgacagctctgctttcctctttatctcagaattcaaatactgttggaaaaagtttgtaaacagtcagaggaggcccttcaggccttggaagaaactatacagaaattatcagcggctggttgaagagcttgaggacattctcgggtgagggcttctttagcctcccctttaccccgacccacggcctccccctcacct

SEQ ID NO: 45858 - DNA, 201 bp, Bos taurus; identical to SEQ ID NO: 4355

SEQ ID NO: 45859 - DNA, 201 bp, Bos taurus; identical to SEQ ID NO: 4356

SEQ ID NO: 45860 - DNA, 201 bp, Bos taurus
tccgtagttgtaggtggctgcacagaaagaaagcctacctccaccctctgtaatgctgtgaaactgacagggacagagcagagcccaggaggcctgggatgggggcactctgacagcaaagtctcgccagtgtgcggcaccccacccctcgggaggaaatgactcagtttaacatgacatagccccacacagagaagcccc

SEQ ID NO: 45861 - DNA, 201 bp, Bos taurus; identical to SEQ ID NO: 4360

SEQ ID NO: 45862 - DNA, 201 bp, Bos taurus
agggcagcccacgatctcccattaaacagacaaaattactctgagcagaaaatagggagaacaaggtataaaaatctgtttaactaagttcacattttagtgaattcacaactgttttcttataaagatgttgtgcttggaactgacattcctttaggatttctcaaactgttaatatctgcctacattacatgaccgagt

SEQ ID NO: 45863 - DNA, 201 bp, Bos taurus
tctgaacccagcttctgatccactaattttggggcaatttagcaaaatttcacagaaagggagctagagtaaacttggaaaaggtctctgcacaagtgaacatgattttcaagtggatgacaccaagggaatgaagggtaatgatcttaattcccaataaaataaaagctcttccgcttttaatcataacgttctagctaa

SEQ ID NO: 45864 - DNA, 201 bp, Bos taurus; identical to SEQ ID NO: 4365

SEQ ID NO: 45865 - DNA, 201 bp, Bos taurus; identical to SEQ ID NO: 4366

SEQ ID NO: 45866 - DNA, 201 bp, Bos taurus
gggggagccccccctcccggcccacagacctggcagcaggggcagagctgaatgggaggctttgtgaggtgagggagagacaggcaccacgggagcagccgctggagttacagggcctcctgctctgaatctgggcctgggcctgagacccaagtccctggaccagcccagcaaggaggggcctcgagggccaggcagccc

SEQ ID NO: 45867 - DNA, 201 bp, Bos taurus
cattctacttggcagcttcctccttcatctgaagagcctctaggcaggtactgtttctatctgggcagcattctctggggtcctggcctgtcataggtacctcagttctgttcagtttagttgttcagtcgtgtccgattctttgcgacccatgaaccgcagcacaccaggcctccttgtccatcaccagttcccaaagtt

SEQ ID NO: 45868 - DNA, 201 bp, Bos taurus; identical to SEQ ID NO: 4367

SEQ ID NO: 45869 - DNA, 201 bp, Bos taurus; identical to SEQ ID NO: 4368

SEQ ID NO: 45870 - DNA, 201 bp, Bos taurus; identical to SEQ ID NO: 4369

SEQ ID NO: 45871 - DNA, 201 bp, Bos taurus
tcttaacccctaagtcatccaaacagagattcaaggtctcccggcttccctatttaggaagcaaaagtgaaaaggtttggagtcaggcccctgcgggcacacaggaggcgcccgggaagcctgtgtgtccagcgaggacctctttccttccaggaggcctgcaccaccaggcgccactctccccgaatggcccgaggccct

SEQ ID NO: 45872 - DNA, 201 bp, Bos taurus
tcgtatgtgccaggcctgcccctgtcccccagcctgcctcctttgcatcatttggtcccaacctatagtgagtgagtgatatctagactcagctggggaggtcaggtgggcccccacatagtcatggccctgggagtccctcagagatccttgacaggagagagaagctcaccatcagcccttatgctgtccatcggtgtg

SEQ ID NO: 45873 - DNA, 201 bp, Bos taurus; identical to SEQ ID NO: 4371

SEQ ID NO: 45874 - DNA, 201 bp, Bos taurus; identical to SEQ ID NO: 4372

SEQ ID NO: 45875 - DNA, 201 bp, Bos taurus
tcctttctggaaaaatcagtggacagaggacacccccctaagtcacaaccttcatggaagccagccaagaaaaccaaagagaccagagaaatgggcggccattacagcagctgagaggtgaacgagcccaagcccccatcagacagacaggaagactgagacctagggtggggccacaactgacttgggtccaaggctctg

SEQ ID NO: 45876 - DNA, 201 bp, Bos taurus
ggggggtggggcttgtgagcctgagtctctcaaagtggcaatctccctcgcagggatgctggggggtggggggtggcagtcagaggcacagaagggccagcggctactgcaactgtcagccttgagattaacccacttggtgcccagctggtgatgtcataggacatcagtcatggtgcatcacccagcctcccttgaggg

SEQ ID NO: 45877 - DNA, 201 bp, Bos taurus; identical to SEQ ID NO: 4373

SEQ ID NO: 45878 - DNA, 201 bp, Bos taurus; identical to SEQ ID NO: 4374

SEQ ID NO: 45879 - DNA, 201 bp, Bos taurus; identical to SEQ ID NO: 4375

SEQ ID NO: 45880 - DNA, 201 bp, Bos taurus; identical to SEQ ID NO: 4376

SEQ ID NO: 45881 - DNA, 201 bp, Bos taurus; identical to SEQ ID NO: 4378

SEQ ID NO: 45882 - DNA, 201 bp, Bos taurus; identical to SEQ ID NO: 4379

SEQ ID NO: 45883 - DNA, 201 bp, Bos taurus; identical to SEQ ID NO: 4380

SEQ ID NO: 45884 - DNA, 201 bp, Bos taurus; identical to SEQ ID NO: 4381

SEQ ID NO: 45885 - DNA, 201 bp, Bos taurus; identical to SEQ ID NO: 4382

SEQ ID NO: 45886 - DNA, 201 bp, Bos taurus; identical to SEQ ID NO: 4383

SEQ ID NO: 45887 - DNA, 201 bp, Bos taurus; identical to SEQ ID NO: 4385

SEQ ID NO: 45888 - DNA, 201 bp, Bos taurus; identical to SEQ ID NO: 4386

SEQ ID NO: 45889 - DNA, 201 bp, Bos taurus; identical to SEQ ID NO: 4387

SEQ ID NO: 45890 - DNA, 201 bp, Bos taurus; identical to SEQ ID NO: 4388

SEQ ID NO: 45891 - DNA, 201 bp, Bos taurus; identical to SEQ ID NO: 4389

SEQ ID NO: 45892 - DNA, 201 bp, Bos taurus; identical to SEQ ID NO: 4391

SEQ ID NO: 45893 - DNA, 201 bp, Bos taurus; identical to SEQ ID NO: 4392

SEQ ID NO: 45894 - DNA, 201 bp, Bos taurus
atctgatctggccgtcccagggggcctcctccctgagtgccctcgtgcccctgaacctgttcaccgagctgctgattgagtactacgagaaggtcttcagcggccgcggggagcgcggggcagaggccagcgagcagggcgctcccggtgccagaggctccgtccccaacgaaggcgccgctgcaggagacagacccgcct

SEQ ID NO: 45895 - DNA, 201 bp, Bos taurus
tgtgaggaaagcttcattccagggcagcctgcccgccacaaaaaagaggatgcaaattgatccccgccctcatcccggcctccagggtgtggcctgctgagggggtctggaagccttgtgacctcaggtgggttgggggtgggggatatatcggctctttgggacccaatttccccaacggtgaatgaaggcggggccgta

SEQ ID NO: 45896 - DNA, 201 bp, Bos taurus; identical to SEQ ID NO: 4393

SEQ ID NO: 45897 - DNA, 201 bp, Bos taurus
cttatggttgggctttaattagggagtcagtttaatcacaaaataatgcagtctgttacaatgacacttggcaccgaggccttgggtgggggaagggagaacagagagccccaaaaagacccgtaatcctccctggggggcgtaggggggatcttcctggaggaggggggcggatagttggtttgcagtgggccaggatgg

SEQ ID NO: 45898 - DNA, 201 bp, Bos taurus; identical to SEQ ID NO: 4395

SEQ ID NO: 45899 - DNA, 201 bp, Bos taurus; identical to SEQ ID NO: 4396

SEQ ID NO: 45900 - DNA, 201 bp, Bos taurus; identical to SEQ ID NO: 4400

SEQ ID NO: 45901 - DNA, 201 bp, Bos taurus
gtgcccatggcccccagcgtttaacagggagcagaaacgccagaggaactcagagctcctctgggtgtgctgctgcctccctccagcggcttcagcgtggcgctcaaggtgcctttcctctgggcccgagccaagttcacccagtactttggccaaaccgtggggaaccggccgcaggcagccctggcttcagagagccag

SEQ ID NO: 45902 - DNA, 201 bp, Bos taurus
ccggtgccctggcctctggcttccacctgcttgagccacattgcaccccagagtcggaggctctctgacacccagtcttgatccccccacagctttctgcggggcccccgtggcctccacaaagctgagctctgttccccgtttgcgggcaggccctccactcaggcctgggagtctccccggtccagaagctgcctggga

SEQ ID NO: 45903 - DNA, 201 bp, Bos taurus; identical to SEQ ID NO: 4404

SEQ ID NO: 45904 - DNA, 201 bp, Bos taurus; identical to SEQ ID NO: 4405

SEQ ID NO: 45905 - DNA, 201 bp, Bos taurus
ggagctgtgggcgtcatttcatcagggatctgagctctggccacaaggtggcgtcgtggtcctgctcgaggcagagggccggcgccagggcgtctgggctcttctctggaaggcagtgtgatcagagctgggtcacgtgccccccagctggggcgtggagaagtagggaccctgcgggctcggcctgcggcactttgcagt

SEQ ID NO: 45906 - DNA, 201 bp, Bos taurus; identical to SEQ ID NO: 4407

SEQ ID NO: 45907 - DNA, 201 bp, Bos taurus; identical to SEQ ID NO: 4408

SEQ ID NO: 45908 - DNA, 201 bp, Bos taurus
atcgtggtcagatcgggagaagcacgcgtgtccctgctcactttctccctggtctccacgtgcacctctttctgcagttgtgtccctgcccccctggcctcttgcagcccccgacctgatggtacaagtccagctcctggaagacacagattgttcttgggctcaattccacgttccccgggaagggtccggggggcccgc

SEQ ID NO: 45909 - DNA, 201 bp, Bos taurus; identical to SEQ ID NO: 4410

SEQ ID NO: 45910 - DNA, 201 bp, Bos taurus
cgccatgaaaatgggctgcttaaaatctcctgctgagaggaccctcattcactcatggacctggatggtgccccgtggaggccccaccatctgtgactccatatctttttgcatgatccctccatccgatggttgagcaccgcaggggtgctgatctgggcccacgcatgcgagaaggggactcatctgatgggcaacttc

SEQ ID NO: 45911 - DNA, 201 bp, Bos taurus; identical to SEQ ID NO: 4411

SEQ ID NO: 45912 - DNA, 201 bp, Bos taurus; identical to SEQ ID NO: 4412

SEQ ID NO: 45913 - DNA, 201 bp, Bos taurus
ctggtttgagattgcaaagccccaagggcctgggtgggaaagtcaagggttctcacaggaaaaagcccactgctgtcagaggtcactcagagctttaccttctctggcctcctgcgccacatgtcctgcagataatcttgcgagtgtccccaaggggctttctgccgcccctaagtgccctaaaatcttcctcgtctttct

SEQ ID NO: 45914 - DNA, 201 bp, Bos taurus; identical to SEQ ID NO: 4413

SEQ ID NO: 45915 - DNA, 201 bp, Bos taurus; identical to SEQ ID NO: 4414

SEQ ID NO: 45916 - DNA, 201 bp, Bos taurus
atccaagaaaccagctctctgggccaaggaagcagagacaggcctcctgaaccacccctgagccgggggaggagaagggagtccccgggagagagggtgaagcgacgcgcaaggccatgcgaggggcagagcacgaggccagggtcggggtgcagggcaggggtgcccgagtccctgtgctccatccgggcaggtggcctc

SEQ ID NO: 45917 - DNA, 201 bp, Bos taurus; identical to SEQ ID NO: 4415

SEQ ID NO: 45918 - DNA, 201 bp, Bos taurus; identical to SEQ ID NO: 4418

SEQ ID NO: 45919 - DNA, 201 bp, Bos taurus; identical to SEQ ID NO: 4420

SEQ ID NO: 45920 - DNA, 201 bp, Bos taurus
tcctgacccaccaaattcgataggcctccctgctgcccacctgcagggtgtggaaaggacgtgcggtccacctcctcgtgtgggggacagtcacacactccccccacggggcccggtcccagccgggttgtgacctgaggctgggcaggcgtggacaccgtccccaggaggggaaggactgctctccagcccctgcaggac

SEQ ID NO: 45921 - DNA, 201 bp, Bos taurus; identical to SEQ ID NO: 4425

SEQ ID NO: 45922 - DNA, 201 bp, Bos taurus; identical to SEQ ID NO: 4426

SEQ ID NO: 45923 - DNA, 201 bp, Bos taurus; identical to SEQ ID NO: 4427

SEQ ID NO: 45924 - DNA, 201 bp, Bos taurus; identical to SEQ ID NO: 4428

SEQ ID NO: 45925 - DNA, 201 bp, Bos taurus; identical to SEQ ID NO: 4429

SEQ ID NO: 45926 - DNA, 201 bp, Bos taurus
aacaggcagccactgctctctcctccagccccgtgggtctgcctcccggatgtcatgaagagagtcaccacaccgggggcctgtcgaagctagttccctttacccacacggtccctcggagatcccacctcctggtgtgtgcgtctgtgttctgttcgttcatgccgagtcctctcccacagggcaattccatggcccgga

SEQ ID NO: 45927 - DNA, 201 bp, Bos taurus; identical to SEQ ID NO: 4430

SEQ ID NO: 45928 - DNA, 201 bp, Bos taurus; identical to SEQ ID NO: 4431

SEQ ID NO: 45929 - DNA, 201 bp, Bos taurus; identical to SEQ ID NO: 4432

SEQ ID NO: 45930 - DNA, 201 bp, Bos taurus; identical to SEQ ID NO: 4434

SEQ ID NO: 45931 - DNA, 201 bp, Bos taurus; identical to SEQ ID NO: 4435

SEQ ID NO: 45932 - DNA, 201 bp, Bos taurus; identical to SEQ ID NO: 4437

SEQ ID NO: 45933 - DNA, 201 bp, Bos taurus
ggccaggctgctgacggacagtggacaacgtccaggcacgaggaggcctggatgtggatacacctggaagtaaccagaaccagggtttgaaagagctcgttgacgcctgggctgggggccgagaggccagcccctcctctggggagagccacagcgcagggcccgcgtggaacccactctgggtctccgtgacagacacac

SEQ ID NO: 45934 - DNA, 201 bp, Bos taurus; identical to SEQ ID NO: 4438

SEQ ID NO: 45935 - DNA, 201 bp, Bos taurus
acccctatactcacttccatccaggaaaataattggtcctccttacattgcacagaccttattctcctgaaaattagatccacaaggtatcattaaatgttgtgggaaacaaaaatagaagaattctatagcttgagaaaatgtgagttaagaatacttaaagaaatatattgtcgtcaaacttctcagaaattttagaca

SEQ ID NO: 45936 - DNA, 201 bp, Bos taurus; identical to SEQ ID NO: 4441

SEQ ID NO: 45937 - DNA, 201 bp, Bos taurus; identical to SEQ ID NO: 4442

SEQ ID NO: 45938 - DNA, 201 bp, Bos taurus; identical to SEQ ID NO: 4443

SEQ ID NO: 45939 - DNA, 201 bp, Bos taurus; identical to SEQ ID NO: 4444

SEQ ID NO: 45940 - DNA, 201 bp, Bos taurus; identical to SEQ ID NO: 4445

SEQ ID NO: 45941 - DNA, 201 bp, Bos taurus; identical to SEQ ID NO: 4446

SEQ ID NO: 45942 - DNA, 201 bp, Bos taurus
ttcctctagtctagggtcttggagtcagttctcccattccaaaggctcagggcttgatctatgctttttaagcaaggtacaattttcaagtttgaaaatatgtcttttatgattcagtggtctcttaaaaagttcctaaaatccagctggaggaagtcacataaaggacataatgactgactgaatggagagctggatggg

SEQ ID NO: 45943 - DNA, 201 bp, Bos taurus; identical to SEQ ID NO: 4448

SEQ ID NO: 45944 - DNA, 201 bp, Bos taurus; identical to SEQ ID NO: 4449

SEQ ID NO: 45945 - DNA, 201 bp, Bos taurus; identical to SEQ ID NO: 4450

SEQ ID NO: 45946 - DNA, 201 bp, Bos taurus
tgtgcccctttctgctgaattttagtatttgatactcaggggacctgtacggactgttgttgcagcagccagagccatccaagagctcatgaatataaacatcctatttcatttgtcactattttaacacagcaggcattttgaaaatgcccataggcttgtgtggtgggtgaaaggaaagatgaaagtgtcaagaagcta

SEQ ID NO: 45947 - DNA, 201 bp, Bos taurus
aaaaactgaaactaataactgattgattattataaacaatgtcagttaaaaaacattgtgtgagcttttattttccttagaagaaaagcctatgtattcacctcatatcaaaccccttttgaaaggagtacaatttctacttaggtcatgtaccatctttgggttcatttgatattgatataaatagaagcttgcaaccat

SEQ ID NO: 45948 - DNA, 201 bp, Bos taurus
tatcatccatagggtcacaaattgttgaacacaacagtgtgactgagcacacattccctgagacactggacactcaagtgaattctgaggctacatagtggggaaagcagtcagggcctcctttttaactacttttattcatgagagtctgaatagcttatgaataggattgtttttcttgtacttattcttggttattca

SEQ ID NO: 45949 - DNA, 201 bp, Bos taurus; identical to SEQ ID NO: 4455

SEQ ID NO: 45950 - DNA, 201 bp, Bos taurus; identical to SEQ ID NO: 4456

SEQ ID NO: 45951 - DNA, 201 bp, Bos taurus; identical to SEQ ID NO: 4457

SEQ ID NO: 45952 - DNA, 201 bp, Bos taurus; identical to SEQ ID NO: 4460

SEQ ID NO: 45953 - DNA, 201 bp, Bos taurus; identical to SEQ ID NO: 4462

SEQ ID NO: 45954 - DNA, 201 bp, Bos taurus; identical to SEQ ID NO: 4463

SEQ ID NO: 45955 - DNA, 201 bp, Bos taurus; identical to SEQ ID NO: 4467

SEQ ID NO: 45956 - DNA, 201 bp, Bos taurus; identical to SEQ ID NO: 4468

SEQ ID NO: 45957 - DNA, 201 bp, Bos taurus; identical to SEQ ID NO: 4469

SEQ ID NO: 45958 - DNA, 201 bp, Bos taurus; identical to SEQ ID NO: 4470

SEQ ID NO: 45959 - DNA, 201 bp, Bos taurus; identical to SEQ ID NO: 4471

SEQ ID NO: 45960 - DNA, 201 bp, Bos taurus; identical to SEQ ID NO: 4473

SEQ ID NO: 45961 - DNA, 201 bp, Bos taurus; identical to SEQ ID NO: 4474

SEQ ID NO: 45962 - DNA, 201 bp, Bos taurus; identical to SEQ ID NO: 4475

SEQ ID NO: 45963 - DNA, 201 bp, Bos taurus
gatgttagcatcataaagtgccctgacaaagaatccttcctactgaaagatatgacaaatcttcttgtccctgttggcttccagaccttttctctcctgtgacgctcatggatctctaaacagagtctcttactttaccaatctgcgtgtgctatgcttgttttcctttactgtctgtctttgacaagtcactcctcccac

SEQ ID NO: 45964 - DNA, 201 bp, Bos taurus
ttattcttttatttattttttctgaattaaatgaagaaagaaatgttcttctgccactgaaatccaatatttgagtttggtatttagtgcattagcttttcccttttcattcagtatgttttgtttttccctcttcattctggggtcaatttcttctgtaaatgaaaacattcccgtccatttcatcacccatctcctacc

SEQ ID NO: 45965 - DNA, 201 bp, Bos taurus; identical to SEQ ID NO: 4476

SEQ ID NO: 45966 - DNA, 201 bp, Bos taurus; identical to SEQ ID NO: 4477

SEQ ID NO: 45967 - DNA, 201 bp, Bos taurus; identical to SEQ ID NO: 4479

SEQ ID NO: 45968 - DNA, 201 bp, Bos taurus; identical to SEQ ID NO: 4480

SEQ ID NO: 45969 - DNA, 201 bp, Bos taurus; identical to SEQ ID NO: 4485

SEQ ID NO: 45970 - DNA, 201 bp, Bos taurus
gtctcagaacagaggaagaagcccccaaagagacatgatcagcactgtatccacccttgggcttctaattcctcccccttctcccagatgagctcacacaccccctggctttcattaccaatgatgctcccccaaattgcaagtgtttatttggaattcaaacctctttcctctgagctccagcatttcaaattgaactac

SEQ ID NO: 45971 - DNA, 201 bp, Bos taurus
aaccaccaaggaaaaggtattgttgctttgtttttctggtacaaattcagatttcccttttgaaggtatgtccttcatttctacatcttaatttgatacatacaagtagtacttaaaatgtatttgtgaacaaattccagacttcctttgtttaactgtggatgatttataagctttgaacatatatattcttagtttact

SEQ ID NO: 45972 - DNA, 201 bp, Bos taurus
taatgtgcctctttaaacaattaatttactagaggtgtttatgcaccaccaaaagtcatttctttactgttaagattttggaacatcctggaataccttataatattagatgagatagtcaatagttggacagaggagcctagagggttacagtccatggggttgcaaagagtcagatatgacttagtgacttaacagtaa

SEQ ID NO: 45973 - DNA, 201 bp, Bos taurus; identical to SEQ ID NO: 4487

SEQ ID NO: 45974 - DNA, 201 bp, Bos taurus
ctatcatcaagttttgagaaatagttgtcagtcattgttatagaccaggcaatacaaaagcagtggggagtcctacaaagaattatccagtttctttacattgagaaactcatggaattagggagtattgatgacttttgtttatgagcatttttctgtacagtgaaagtccaggttctcttcgttctctttaaatatggc

SEQ ID NO: 45975 - DNA, 201 bp, Bos taurus; identical to SEQ ID NO: 4488

SEQ ID NO: 45976 - DNA, 201 bp, Bos taurus; identical to SEQ ID NO: 4489

SEQ ID NO: 45977 - DNA, 201 bp, Bos taurus; identical to SEQ ID NO: 4490

SEQ ID NO: 45978 - DNA, 201 bp, Bos taurus; identical to SEQ ID NO: 4492

SEQ ID NO: 45979 - DNA, 201 bp, Bos taurus; identical to SEQ ID NO: 4493

SEQ ID NO: 45980 - DNA, 201 bp, Bos taurus; identical to SEQ ID NO: 4494

SEQ ID NO: 45981 - DNA, 201 bp, Bos taurus; identical to SEQ ID NO: 4495

SEQ ID NO: 45982 - DNA, 201 bp, Bos taurus; identical to SEQ ID NO: 4496

SEQ ID NO: 45983 - DNA, 201 bp, Bos taurus; identical to SEQ ID NO: 4497

SEQ ID NO: 45984 - DNA, 201 bp, Bos taurus; identical to SEQ ID NO: 4499

SEQ ID NO: 45985 - DNA, 201 bp, Bos taurus; identical to SEQ ID NO: 4505

SEQ ID NO: 45986 - DNA, 201 bp, Bos taurus; identical to SEQ ID NO: 4507

SEQ ID NO: 45987 - DNA, 201 bp, Bos taurus; identical to SEQ ID NO: 4509

SEQ ID NO: 45988 - DNA, 201 bp, Bos taurus; identical to SEQ ID NO: 4513

SEQ ID NO: 45989 - DNA, 201 bp, Bos taurus; identical to SEQ ID NO: 4516

SEQ ID NO: 45990 - DNA, 201 bp, Bos taurus; identical to SEQ ID NO: 4517

SEQ ID NO: 45991 - DNA, 201 bp, Bos taurus; identical to SEQ ID NO: 4519

SEQ ID NO: 45992 - DNA, 201 bp, Bos taurus; identical to SEQ ID NO: 4521

SEQ ID NO: 45993 - DNA, 201 bp, Bos taurus; identical to SEQ ID NO: 4523

SEQ ID NO: 45994 - DNA, 201 bp, Bos taurus; identical to SEQ ID NO: 4525

SEQ ID NO: 45995 - DNA, 201 bp, Bos taurus; identical to SEQ ID NO: 4527

SEQ ID NO: 45996 - DNA, 201 bp, Bos taurus; identical to SEQ ID NO: 4528

SEQ ID NO: 45997 - DNA, 201 bp, Bos taurus; identical to SEQ ID NO: 4529

SEQ ID NO: 45998 - DNA, 201 bp, Bos taurus; identical to SEQ ID NO: 4531

SEQ ID NO: 45999 - DNA, 201 bp, Bos taurus; identical to SEQ ID NO: 4533

SEQ ID NO: 46000 - DNA, 201 bp, Bos taurus; identical to SEQ ID NO: 4535

SEQ ID NO: 46001 - DNA, 201 bp, Bos taurus; identical to SEQ ID NO: 4537

SEQ ID NO: 46002 - DNA, 201 bp, Bos taurus; identical to SEQ ID NO: 4538

SEQ ID NO: 46003 - DNA, 201 bp, Bos taurus; identical to SEQ ID NO: 4539

SEQ ID NO: 46004 - DNA, 201 bp, Bos taurus; identical to SEQ ID NO: 4540

SEQ ID NO: 46005 - DNA, 201 bp, Bos taurus; identical to SEQ ID NO: 4541

SEQ ID NO: 46006 - DNA, 201 bp, Bos taurus; identical to SEQ ID NO: 4542

SEQ ID NO: 46007 - DNA, 201 bp, Bos taurus; identical to SEQ ID NO: 4543

SEQ ID NO: 46008 - DNA, 201 bp, Bos taurus; identical to SEQ ID NO: 4544

SEQ ID NO: 46009 - DNA, 201 bp, Bos taurus; identical to SEQ ID NO: 4545

SEQ ID NO: 46010 - DNA, 201 bp, Bos taurus; identical to SEQ ID NO: 4546

SEQ ID NO: 46011 - DNA, 201 bp, Bos taurus; identical to SEQ ID NO: 4547

SEQ ID NO: 46012 - DNA, 201 bp, Bos taurus; identical to SEQ ID NO: 4548

SEQ ID NO: 46013 - DNA, 201 bp, Bos taurus; identical to SEQ ID NO: 4549

SEQ ID NO: 46014 - DNA, 201 bp, Bos taurus; identical to SEQ ID NO: 4550

SEQ ID NO: 46015 - DNA, 201 bp, Bos taurus; identical to SEQ ID NO: 4551

SEQ ID NO: 46016 - DNA, 201 bp, Bos taurus; identical to SEQ ID NO: 4553

SEQ ID NO: 46017 - DNA, 201 bp, Bos taurus; identical to SEQ ID NO: 4554

SEQ ID NO: 46018 - DNA, 201 bp, Bos taurus; identical to SEQ ID NO: 4556

SEQ ID NO: 46019 - DNA, 201 bp, Bos taurus; identical to SEQ ID NO: 4557

SEQ ID NO: 46020 - DNA, 201 bp, Bos taurus; identical to SEQ ID NO: 4558

SEQ ID NO: 46021 - DNA, 201 bp, Bos taurus; identical to SEQ ID NO: 4559

SEQ ID NO: 46022 - DNA, 201 bp, Bos taurus; identical to SEQ ID NO: 4560

SEQ ID NO: 46023 - DNA, 201 bp, Bos taurus; identical to SEQ ID NO: 4561

SEQ ID NO: 46024 - DNA, 201 bp, Bos taurus; identical to SEQ ID NO: 4562

SEQ ID NO: 46025 - DNA, 201 bp, Bos taurus; identical to SEQ ID NO: 4563

SEQ ID NO: 46026 - DNA, 201 bp, Bos taurus; identical to SEQ ID NO: 4564

SEQ ID NO: 46027 - DNA, 201 bp, Bos taurus; identical to SEQ ID NO: 4565

SEQ ID NO: 46028 - DNA, 201 bp, Bos taurus; identical to SEQ ID NO: 4566

SEQ ID NO: 46029 - DNA, 201 bp, Bos taurus; identical to SEQ ID NO: 4567

SEQ ID NO: 46030 - DNA, 201 bp, Bos taurus; identical to SEQ ID NO: 4568

SEQ ID NO: 46031 - DNA, 201 bp, Bos taurus; identical to SEQ ID NO: 4569

SEQ ID NO: 46032 - DNA, 201 bp, Bos taurus; identical to SEQ ID NO: 4570

SEQ ID NO: 46033 - DNA, 201 bp, Bos taurus; identical to SEQ ID NO: 4571

SEQ ID NO: 46034 - DNA, 201 bp, Bos taurus; identical to SEQ ID NO: 4572

SEQ ID NO: 46035 - DNA, 201 bp, Bos taurus; identical to SEQ ID NO: 4573

SEQ ID NO: 46036 - DNA, 201 bp, Bos taurus; identical to SEQ ID NO: 4574

SEQ ID NO: 46037 - DNA, 201 bp, Bos taurus; identical to SEQ ID NO: 4575

SEQ ID NO: 46038 - DNA, 201 bp, Bos taurus; identical to SEQ ID NO: 4576

SEQ ID NO: 46039 - DNA, 201 bp, Bos taurus; identical to SEQ ID NO: 4577

SEQ ID NO: 46040 - DNA, 201 bp, Bos taurus; identical to SEQ ID NO: 4578

SEQ ID NO: 46041 - DNA, 201 bp, Bos taurus; identical to SEQ ID NO: 4579

SEQ ID NO: 46042 - DNA, 201 bp, Bos taurus; identical to SEQ ID NO: 4580

SEQ ID NO: 46043 - DNA, 201 bp, Bos taurus; identical to SEQ ID NO: 4581

SEQ ID NO: 46044 - DNA, 201 bp, Bos taurus; identical to SEQ ID NO: 4582

SEQ ID NO: 46045 - DNA, 201 bp, Bos taurus; identical to SEQ ID NO: 4583

SEQ ID NO: 46046 - DNA, 201 bp, Bos taurus; identical to SEQ ID NO: 4584

SEQ ID NO: 46047 - DNA, 201 bp, Bos taurus; identical to SEQ ID NO: 4585

SEQ ID NO: 46048 - DNA, 201 bp, Bos taurus; identical to SEQ ID NO: 4586

SEQ ID NO: 46049 - DNA, 201 bp, Bos taurus; identical to SEQ ID NO: 4587

SEQ ID NO: 46050 - DNA, 201 bp, Bos taurus; identical to SEQ ID NO: 4588

SEQ ID NO: 46051 - DNA, 201 bp, Bos taurus; identical to SEQ ID NO: 4589

SEQ ID NO: 46052 - DNA, 201 bp, Bos taurus; identical to SEQ ID NO: 4590

SEQ ID NO: 46053 - DNA, 201 bp, Bos taurus; identical to SEQ ID NO: 4591

SEQ ID NO: 46054 - DNA, 201 bp, Bos taurus; identical to SEQ ID NO: 4592

SEQ ID NO: 46055 - DNA, 201 bp, Bos taurus
atatgaatgtccttttttaaaaagaaatgtatcaagttatatattggaactgattttctaagatactagtatgtttatcacccaactgtatttcaatactatatcatttcacaatggatgaaatgctatttgaaaagtttcaatttcaaacgaggatgaggttaaacgctggggttctcagtgcacatagatttttctgac

SEQ ID NO: 46056 - DNA, 201 bp, Bos taurus; identical to SEQ ID NO: 4593

SEQ ID NO: 46057 - DNA, 201 bp, Bos taurus; identical to SEQ ID NO: 4594

SEQ ID NO: 46058 - DNA, 201 bp, Bos taurus; identical to SEQ ID NO: 4595

SEQ ID NO: 46059 - DNA, 201 bp, Bos taurus; identical to SEQ ID NO: 4596

SEQ ID NO: 46060 - DNA, 201 bp, Bos taurus; identical to SEQ ID NO: 4597

SEQ ID NO: 46061 - DNA, 201 bp, Bos taurus; identical to SEQ ID NO: 4598

SEQ ID NO: 46062 - DNA, 201 bp, Bos taurus; identical to SEQ ID NO: 4600

SEQ ID NO: 46063 - DNA, 201 bp, Bos taurus; identical to SEQ ID NO: 4601

SEQ ID NO: 46064 - DNA, 201 bp, Bos taurus; identical to SEQ ID NO: 4602

SEQ ID NO: 46065 - DNA, 201 bp, Bos taurus; identical to SEQ ID NO: 4603

SEQ ID NO: 46066 - DNA, 201 bp, Bos taurus; identical to SEQ ID NO: 4604

SEQ ID NO: 46067 - DNA, 201 bp, Bos taurus; identical to SEQ ID NO: 4605

SEQ ID NO: 46068 - DNA, 201 bp, Bos taurus; identical to SEQ ID NO: 4606

SEQ ID NO: 46069 - DNA, 201 bp, Bos taurus; identical to SEQ ID NO: 4607

SEQ ID NO: 46070 - DNA, 201 bp, Bos taurus; identical to SEQ ID NO: 4608

SEQ ID NO: 46071 - DNA, 201 bp, Bos taurus; identical to SEQ ID NO: 4609

SEQ ID NO: 46072 - DNA, 201 bp, Bos taurus; identical to SEQ ID NO: 4610

SEQ ID NO: 46073 - DNA, 201 bp, Bos taurus; identical to SEQ ID NO: 4611

SEQ ID NO: 46074 - DNA, 201 bp, Bos taurus; identical to SEQ ID NO: 4612

SEQ ID NO: 46075 - DNA, 201 bp, Bos taurus; identical to SEQ ID NO: 4613

SEQ ID NO: 46076 - DNA, 201 bp, Bos taurus; identical to SEQ ID NO: 4614

SEQ ID NO: 46077 - DNA, 201 bp, Bos taurus; identical to SEQ ID NO: 4615

SEQ ID NO: 46078 - DNA, 201 bp, Bos taurus; identical to SEQ ID NO: 4616

SEQ ID NO: 46079 - DNA, 201 bp, Bos taurus; identical to SEQ ID NO: 4617

SEQ ID NO: 46080 - DNA, 201 bp, Bos taurus; identical to SEQ ID NO: 4618

SEQ ID NO: 46081 - DNA, 201 bp, Bos taurus; identical to SEQ ID NO: 4619

SEQ ID NO: 46082 - DNA, 201 bp, Bos taurus; identical to SEQ ID NO: 4620

SEQ ID NO: 46083 - DNA, 201 bp, Bos taurus; identical to SEQ ID NO: 4622

SEQ ID NO: 46084 - DNA, 201 bp, Bos taurus; identical to SEQ ID NO: 4623

SEQ ID NO: 46085 - DNA, 201 bp, Bos taurus; identical to SEQ ID NO: 4624

SEQ ID NO: 46086 - DNA, 201 bp, Bos taurus; identical to SEQ ID NO: 4625

SEQ ID NO: 46087 - DNA, 201 bp, Bos taurus; identical to SEQ ID NO: 4626

SEQ ID NO: 46088 - DNA, 201 bp, Bos taurus; identical to SEQ ID NO: 4627

SEQ ID NO: 46089 - DNA, 201 bp, Bos taurus; identical to SEQ ID NO: 4628

SEQ ID NO: 46090 - DNA, 201 bp, Bos taurus; identical to SEQ ID NO: 4629

SEQ ID NO: 46091 - DNA, 201 bp, Bos taurus; identical to SEQ ID NO: 4630

SEQ ID NO: 46092 - DNA, 201 bp, Bos taurus; identical to SEQ ID NO: 4631

SEQ ID NO: 46093 - DNA, 201 bp, Bos taurus; identical to SEQ ID NO: 4632

SEQ ID NO: 46094 - DNA, 201 bp, Bos taurus; identical to SEQ ID NO: 4633

SEQ ID NO: 46095 - DNA, 201 bp, Bos taurus; identical to SEQ ID NO: 4634

SEQ ID NO: 46096 - DNA, 201 bp, Bos taurus; identical to SEQ ID NO: 4635

SEQ ID NO: 46097 - DNA, 201 bp, Bos taurus; identical to SEQ ID NO: 4636

SEQ ID NO: 46098 - DNA, 201 bp, Bos taurus; identical to SEQ ID NO: 4637

SEQ ID NO: 46099 - DNA, 201 bp, Bos taurus; identical to SEQ ID NO: 4638

SEQ ID NO: 46100 - DNA, 201 bp, Bos taurus; identical to SEQ ID NO: 4639

SEQ ID NO: 46101 - DNA, 201 bp, Bos taurus; identical to SEQ ID NO: 4640

SEQ ID NO: 46102 - DNA, 201 bp, Bos taurus; identical to SEQ ID NO: 4641

SEQ ID NO: 46103 - DNA, 201 bp, Bos taurus; identical to SEQ ID NO: 4642

SEQ ID NO: 46104 - DNA, 201 bp, Bos taurus; identical to SEQ ID NO: 4643

SEQ ID NO: 46105 - DNA, 201 bp, Bos taurus; identical to SEQ ID NO: 4644

SEQ ID NO: 46106 - DNA, 201 bp, Bos taurus; identical to SEQ ID NO: 4645

SEQ ID NO: 46107 - DNA, 201 bp, Bos taurus; identical to SEQ ID NO: 4646

SEQ ID NO: 46108 - DNA, 201 bp, Bos taurus; identical to SEQ ID NO: 4647

SEQ ID NO: 46109 - DNA, 201 bp, Bos taurus; identical to SEQ ID NO: 4648

SEQ ID NO: 46110 - DNA, 201 bp, Bos taurus; identical to SEQ ID NO: 4649

SEQ ID NO: 46111 - DNA, 201 bp, Bos taurus; identical to SEQ ID NO: 4650

SEQ ID NO: 46112 - DNA, 201 bp, Bos taurus; identical to SEQ ID NO: 4651

SEQ ID NO: 46113 - DNA, 201 bp, Bos taurus; identical to SEQ ID NO: 4652

SEQ ID NO: 46114 - DNA, 201 bp, Bos taurus; identical to SEQ ID NO: 4654

SEQ ID NO: 46115 - DNA, 201 bp, Bos taurus; identical to SEQ ID NO: 4655

SEQ ID NO: 46116 - DNA, 201 bp, Bos taurus; identical to SEQ ID NO: 4656

SEQ ID NO: 46117 - DNA, 201 bp, Bos taurus; identical to SEQ ID NO: 4657

SEQ ID NO: 46118 - DNA, 201 bp, Bos taurus; identical to SEQ ID NO: 4658

SEQ ID NO: 46119 - DNA, 201 bp, Bos taurus; identical to SEQ ID NO: 4660

SEQ ID NO: 46120 - DNA, 201 bp, Bos taurus; identical to SEQ ID NO: 4661

SEQ ID NO: 46121 - DNA, 201 bp, Bos taurus; identical to SEQ ID NO: 4662

SEQ ID NO: 46122 - DNA, 201 bp, Bos taurus; identical to SEQ ID NO: 4663

SEQ ID NO: 46123 - DNA, 201 bp, Bos taurus; identical to SEQ ID NO: 4664

SEQ ID NO: 46124 - DNA, 201 bp, Bos taurus; identical to SEQ ID NO: 4665

SEQ ID NO: 46125 - DNA, 201 bp, Bos taurus; identical to SEQ ID NO: 4666

SEQ ID NO: 46126 - DNA, 201 bp, Bos taurus; identical to SEQ ID NO: 4667

SEQ ID NO: 46127 - DNA, 201 bp, Bos taurus; identical to SEQ ID NO: 4668

SEQ ID NO: 46128 - DNA, 201 bp, Bos taurus; identical to SEQ ID NO: 4671

SEQ ID NO: 46129 - DNA, 201 bp, Bos taurus; identical to SEQ ID NO: 4672

SEQ ID NO: 46130 - DNA, 201 bp, Bos taurus; identical to SEQ ID NO: 4673

SEQ ID NO: 46131 - DNA, 201 bp, Bos taurus; identical to SEQ ID NO: 4674

SEQ ID NO: 46132 - DNA, 201 bp, Bos taurus; identical to SEQ ID NO: 4675

SEQ ID NO: 46133 - DNA, 201 bp, Bos taurus; identical to SEQ ID NO: 4676

SEQ ID NO: 46134 - DNA, 201 bp, Bos taurus; identical to SEQ ID NO: 4677

SEQ ID NO: 46135 - DNA, 201 bp, Bos taurus; identical to SEQ ID NO: 4678

SEQ ID NO: 46136 - DNA, 201 bp, Bos taurus; identical to SEQ ID NO: 4679

SEQ ID NO: 46137 - DNA, 201 bp, Bos taurus; identical to SEQ ID NO: 4680

SEQ ID NO: 46138 - DNA, 201 bp, Bos taurus; identical to SEQ ID NO: 4681

SEQ ID NO: 46139 - DNA, 201 bp, Bos taurus
ttggcctaagggcattttcaaacaattacggatcgtgaagattttctaatctgaattctacactttgcctatcaagaaactgaggctctgagaactttaccggctccttctaaggcctgttactggttttagtggaatccctgagcagctgatgactggagaataagagatgtccacttctgagcagttttcccatggtcc

SEQ ID NO: 46140 - DNA, 201 bp, Bos taurus; identical to SEQ ID NO: 4682

SEQ ID NO: 46141 - DNA, 201 bp, Bos taurus; identical to SEQ ID NO: 4685

SEQ ID NO: 46142 - DNA, 201 bp, Bos taurus; identical to SEQ ID NO: 4686

SEQ ID NO: 46143 - DNA, 201 bp, Bos taurus
tatccttaggtttttgtgcattttttatcttctcatggcactctccatgtgatccgagctatctccccagctagcaggcacttttctgccatagttctggatataaaactgcataggttttgaggggcctgccttgtttttcccataagccctgctatttctattgggcaattttgcagtgtaagaatttttggaaattcg

SEQ ID NO: 46144 - DNA, 201 bp, Bos taurus; identical to SEQ ID NO: 4687

SEQ ID NO: 46145 - DNA, 201 bp, Bos taurus; identical to SEQ ID NO: 4688

SEQ ID NO: 46146 - DNA, 201 bp, Bos taurus
atctaaatgagacttagaaaagaggaatgagttcagaacattaggtatttccaacaagttataagtgtatacacttttgaaattacagattcacagacaacggcagtttttaatgctgcatgcatttttttgtttatccacttgtataaaactaggtatttgtacattcatttcattctactgacaataaaagtattgaat

SEQ ID NO: 46147 - DNA, 201 bp, Bos taurus; identical to SEQ ID NO: 4689

SEQ ID NO: 46148 - DNA, 201 bp, Bos taurus
gtttaaaatgaacgtatttgctgaatcaaaacttttgatacatcctaaaaattttagtaagtttatcttcctacattagttgcaagtaagttcagccacacgagcaaaagactatacagataaatctttatactaaactaattttaaggaaaacatcaaatttagtgatttggctctttccaattctcctatgttattgtg

SEQ ID NO: 46149 - DNA, 201 bp, Bos taurus; identical to SEQ ID NO: 4690

SEQ ID NO: 46150 - DNA, 201 bp, Bos taurus; identical to SEQ ID NO: 4691

SEQ ID NO: 46151 - DNA, 201 bp, Bos taurus; identical to SEQ ID NO: 4693

SEQ ID NO: 46152 - DNA, 201 bp, Bos taurus; identical to SEQ ID NO: 4696

SEQ ID NO: 46153 - DNA, 201 bp, Bos taurus; identical to SEQ ID NO: 4697

SEQ ID NO: 46154 - DNA, 201 bp, Bos taurus; identical to SEQ ID NO: 4698

SEQ ID NO: 46155 - DNA, 201 bp, Bos taurus; identical to SEQ ID NO: 4699

SEQ ID NO: 46156 - DNA, 201 bp, Bos taurus; identical to SEQ ID NO: 4701

SEQ ID NO: 46157 - DNA, 201 bp, Bos taurus; identical to SEQ ID NO: 4702

SEQ ID NO: 46158 - DNA, 201 bp, Bos taurus; identical to SEQ ID NO: 4703

SEQ ID NO: 46159 - DNA, 201 bp, Bos taurus; identical to SEQ ID NO: 4704

SEQ ID NO: 46160 - DNA, 201 bp, Bos taurus; identical to SEQ ID NO: 4705

SEQ ID NO: 46161 - DNA, 201 bp, Bos taurus
aagaaaaagtttctagtgtaggtgatatataacttgtgtttcaaaatattgaatgcaacaacagtaggcagacaaacaggtaaggggataattgaccaaaagatcaacttatacaaaaacctgaaggtatttttaaaactttagtatatgcagaaagccagcattgaatctgtgcaatacaaaatttagatgcagaaatga

SEQ ID NO: 46162 - DNA, 201 bp, Bos taurus; identical to SEQ ID NO: 4707

SEQ ID NO: 46163 - DNA, 201 bp, Bos taurus
ttcccatggcagctggctgagatctctgtggcagcttgcctccccctggcatgtaagctctgtcaccaaaaggcacttttaagtctttctttgctacacaccctttttagcttcttgctagacaaaacaattcctagagagagaagaagaaaaaaaaagatagtgaaggggggcagggtgtggggaaccacaaaggaatta

SEQ ID NO: 46164 - DNA, 201 bp, Bos taurus; identical to SEQ ID NO: 4709

SEQ ID NO: 46165 - DNA, 201 bp, Bos taurus
gagtcaatgaaagtccaatgctaccttaatgtaaaattcttgttatgaaataaaacatcaggagaatgggcttagtgattttgcctaatggagtatacgcggaagaagtttgatgaaattacacatcataacatatggttttattttgtttaaacttctggttttaactttttctttgttcttattaaagattagcaatct

SEQ ID NO: 46166 - DNA, 201 bp, Bos taurus
aggtttttgtgtgagagaaattccccatagccaaatgatgaaacataaggaaattattctgatgaatatgaaacatgttaagcattatttacttttcatcgtaaaatagtataatgggttttcatttcactacgtgtagcttttggaacatacatttttccaacaaatagcaaacgggaaagcaaattggaattaagcaag

SEQ ID NO: 46167 - DNA, 201 bp, Bos taurus; identical to SEQ ID NO: 4713

SEQ ID NO: 46168 - DNA, 201 bp, Bos taurus; identical to SEQ ID NO: 4715

SEQ ID NO: 46169 - DNA, 201 bp, Bos taurus
atgaattgtatggccttcactatcttttgagaaaataaataaatattaaaattcatttaaaattgctaataagtgttcagattggtaccctttgaacttcatcacatgcggagaccaggccatgaggagtcaaagtttttattaatgttagttctttaaaaacctgaatctttatgacaatgcttagattttattttttct

SEQ ID NO: 46170 - DNA, 201 bp, Bos taurus
tttcaacttgcagattccttgaagaactgatgaaatctctggaaatttgtctgaataaaatgcccacaaataattttgcacataatttcagagacatagaaatctcctaaagatcagagatagactttttagttgtctcttaaccctaaatttagatattctataatatgcaaaactattaaagtttgcagttttaaaaat

SEQ ID NO: 46171 - DNA, 201 bp, Bos taurus; identical to SEQ ID NO: 4716

SEQ ID NO: 46172 - DNA, 201 bp, Bos taurus; identical to SEQ ID NO: 4717

SEQ ID NO: 46173 - DNA, 201 bp, Bos taurus; identical to SEQ ID NO: 4718

SEQ ID NO: 46174 - DNA, 201 bp, Bos taurus; identical to SEQ ID NO: 4719

SEQ ID NO: 46175 - DNA, 201 bp, Bos taurus; identical to SEQ ID NO: 4720

SEQ ID NO: 46176 - DNA, 201 bp, Bos taurus
tgcagtccattcagtacttccaatcctgttcccaaccacatgtgctgtcaatgatgatgtggtgcggggggtactcttcctccctccagctctctggaccacagttcccaagccacacagatgctcttttcctttctaaacctcatcccaaactttccactctgttcacatgatgatggtggctcaactctgcccacttgg

SEQ ID NO: 46177 - DNA, 201 bp, Bos taurus
aacaattcatgctctggatttgttgtcagtggtatgctcccaggtggatattatcttttaaaaattgagtacatgccatttgtctgtaaggtaaagggtggtatttttaacagtaactgaaaaactgttttggaaagaagctctaacacaggtgttttggaagtggacagggaaatgtttgcatcattgtgtgtgtgtgta

SEQ ID NO: 46178 - DNA, 201 bp, Bos taurus; identical to SEQ ID NO: 4721

SEQ ID NO: 46179 - DNA, 201 bp, Bos taurus; identical to SEQ ID NO: 4724

SEQ ID NO: 46180 - DNA, 201 bp, Bos taurus; identical to SEQ ID NO: 4725

SEQ ID NO: 46181 - DNA, 201 bp, Bos taurus; identical to SEQ ID NO: 4726

SEQ ID NO: 46182 - DNA, 201 bp, Bos taurus; identical to SEQ ID NO: 4727

SEQ ID NO: 46183 - DNA, 201 bp, Bos taurus
agtttcccagccagggatcaaacttcggccctggcagtgaaggctctgagtctcaaccactgaaccaccagggaattccctagatagaatgattattaactccagtttccagattaagaaatgcagcaacaaaattcaagctggaagctctttcttacaagcacaaattttgtatacccttttctaataatttcaaatatt

SEQ ID NO: 46184 - DNA, 201 bp, Bos taurus
agtaaaagcaggccagtctgcttacaagacttgtcaacacttctaatacatccaagtatgttctgagtctccaaactgaccgacagcagtgtttccaaaactccatggtcattgaggccttttcttacctgacctttgactctactgaaaacacttccttggcagctcagacagtaacaaatctgcctgcgatggaggaga

SEQ ID NO: 46185 - DNA, 201 bp, Bos taurus; identical to SEQ ID NO: 4728

SEQ ID NO: 46186 - DNA, 201 bp, Bos taurus
aatgaaaattgccccatatattcttgatctttaacatggttatagaaaaatgtcctgtacaaagaaaaaactttttactctaataatatttcattgggttggcattggtgattttatgaaaaatttgagctttaaactccctgataatcaatattttgcatcttaatgtcagaaaaatagacagaacaatgtgtcctgtcc

SEQ ID NO: 46187 - DNA, 201 bp, Bos taurus; identical to SEQ ID NO: 4729

SEQ ID NO: 46188 - DNA, 201 bp, Bos taurus; identical to SEQ ID NO: 4730

SEQ ID NO: 46189 - DNA, 201 bp, Bos taurus; identical to SEQ ID NO: 4731

SEQ ID NO: 46190 - DNA, 201 bp, Bos taurus; identical to SEQ ID NO: 4732

SEQ ID NO: 46191 - DNA, 201 bp, Bos taurus; identical to SEQ ID NO: 4733

SEQ ID NO: 46192 - DNA, 201 bp, Bos taurus
acccccttctgagacaatcactggagtctggtctactttctgccatctgcattctaaagtaaattcagtatccccctcaccctagcccctgctctcaggaggaggatatcatggggactcattcctcttgaaggtcttacctcactatacccgaagggtacttggtagaattggaagaaaggtaaataattaaatcagcct

SEQ ID NO: 46193 - DNA, 201 bp, Bos taurus; identical to SEQ ID NO: 4734

SEQ ID NO: 46194 - DNA, 201 bp, Bos taurus
tataatctttaaaacttggaaaccatttctagctttccagcatttagaacatcaaacaaacaaatgagagctgactggaacaggcctgtggatcaaatatctgccagggtttgcagactccattactggtgtaaaggagacaaatcaagttaataaaaacttgatcttgtatcttgatgacaaaatgtaagagaatttaag

SEQ ID NO: 46195 - DNA, 201 bp, Bos taurus
ttttatgtatgaaatttcttcccttatacttggtaatgttcttgctctgaaatctatagttattcataaagctactttggttttctttgattagtgttagtatggtatctcttttccattctgtcacttttaagcttctttgtctttatattttaaaagggtttcttttaggtactatatagctgagtctggtgtttttac

SEQ ID NO: 46196 - DNA, 201 bp, Bos taurus; identical to SEQ ID NO: 4735

SEQ ID NO: 46197 - DNA, 201 bp, Bos taurus
tctctttccagagagtcccaccaattacactgcagtgaaaatgagaatgaaatgggcttcagtaaaatttcagggaggctcatattcttccagattcctctttctaaccaatacatgcacaaatgtatttctaagaaaaaatactcatgttatgtctcatatatatattttttttaatcctgatgtgatgtgtaaggcctt

SEQ ID NO: 46198 - DNA, 201 bp, Bos taurus; identical to SEQ ID NO: 4736

SEQ ID NO: 46199 - DNA, 201 bp, Bos taurus; identical to SEQ ID NO: 4737

SEQ ID NO: 46200 - DNA, 201 bp, Bos taurus
atcttctagttgactgatggttattctatgtggcaagaaacactgcaaaagttaagtgcaggtgtaattgaaaaagaaaaaccccagtaaataaataaagtttcctggagtcttcaatttttatcaaccaacaagaaaattatctaagactggtgtcattatgtagtttgtaagaaagaaaatctgaaaatatggaggtgc

SEQ ID NO: 46201 - DNA, 201 bp, Bos taurus; identical to SEQ ID NO: 4738

SEQ ID NO: 46202 - DNA, 201 bp, Bos taurus; identical to SEQ ID NO: 4743

SEQ ID NO: 46203 - DNA, 201 bp, Bos taurus; identical to SEQ ID NO: 4744

SEQ ID NO: 46204 - DNA, 201 bp, Bos taurus; identical to SEQ ID NO: 4745

SEQ ID NO: 46205 - DNA, 201 bp, Bos taurus; identical to SEQ ID NO: 4746

SEQ ID NO: 46206 - DNA, 201 bp, Bos taurus
ggaaatccgatgagaaaacaggaatggaaagaagccatgagaaggtaaagaacggatttgcagaagctttctggaagtcccatttttcacttgtcattggcagctgacaacaggagagtcctatgggctgaatgtcagaatgggaaggggaactatccagagcttattgaacagtttcactatctgacaatctctccccag

SEQ ID NO: 46207 - DNA, 201 bp, Bos taurus
tggcccctatatatagctctccttacaacatcatgtctcacgggtattaaaaatagacccaaatcacttgaagacattctgaaaaatcaaaggcaaaagcgctttccaagaggaagttttaaatgttttctttcttctcgttgagatttttaaggagcaaaagccgtggtgtggccctcctcttcctaggaggccaagttc

SEQ ID NO: 46208 - DNA, 201 bp, Bos taurus; identical to SEQ ID NO: 4748

SEQ ID NO: 46209 - DNA, 201 bp, Bos taurus; identical to SEQ ID NO: 4750

SEQ ID NO: 46210 - DNA, 201 bp, Bos taurus; identical to SEQ ID NO: 4751

SEQ ID NO: 46211 - DNA, 201 bp, Bos taurus; identical to SEQ ID NO: 4753

SEQ ID NO: 46212 - DNA, 201 bp, Bos taurus
ggtctttctgaacctgagagaatattagcagtgatttcttctgagaaatgtactgcttaagaggagctgataaccaatgctcattgaatctcatgcattcatagttcattgcttgattgaacaagcatttgttgagcactttcaatatttatctactgaggtccttgaatgtggcaacggaaggactgaggttacaaagat

SEQ ID NO: 46213 - DNA, 201 bp, Bos taurus; identical to SEQ ID NO: 4755

SEQ ID NO: 46214 - DNA, 201 bp, Bos taurus
ccaagtgtgagttcttggcttcacacaggaaaaaactcaagagcaagccgtaagaaagtgaaaggtttattcaggaaggaaacacattccatagtcggagcgtgggccatctcagaaggcaagagaggcaccagggtttgcgcttgtcagtttttataggggtgggtaatttcatagggtaatgaatggcaggagtattcc

SEQ ID NO: 46215 - DNA, 201 bp, Bos taurus; identical to SEQ ID NO: 4757

SEQ ID NO: 46216 - DNA, 201 bp, Bos taurus; identical to SEQ ID NO: 4758

SEQ ID NO: 46217 - DNA, 201 bp, Bos taurus; identical to SEQ ID NO: 4761

SEQ ID NO: 46218 - DNA, 201 bp, Bos taurus; identical to SEQ ID NO: 4762

SEQ ID NO: 46219 - DNA, 201 bp, Bos taurus
ttctctagggaacccaatgtgctttgcaaacgtattaaataattaactctctcaaatctgagtgaagtggaaaggcagtgaaaatattccaggaagagccaagcaggttggtgagtgatgaccagatgtgttgctttgaaaaggcaaatccacatggcacctggcagagaccacaggacacgaggcttcttctgggggctg

SEQ ID NO: 46220 - DNA, 201 bp, Bos taurus
tttggctgtcccacaaatgagacagttggtggctgaagagggtgacacatgcaagacaagttggacagccaaagccaaggtcagcaggcaaggcctcaaatcaagccagtgccatgaaagtgatgggcaagggaagcaggagtgagtgggtcttgaacctgaagctggccatcaggcacatgaggctgggtctagacaccc

SEQ ID NO: 46221 - DNA, 201 bp, Bos taurus
gacctcaccaccccattccctgcctctcagcctgatgcctcacttgaagacagctcttgtaggttcaggagccctgcttgcaaagctctgtgtgaggcactaggggccccagatgtcaggcacccctgggtgttctttggagccagagatgctacctctcatctgcggtcatagttcaaggagctggggtacagggatctc

SEQ ID NO: 46222 - DNA, 201 bp, Bos taurus; identical to SEQ ID NO: 4763

SEQ ID NO: 46223 - DNA, 201 bp, Bos taurus; identical to SEQ ID NO: 4765

SEQ ID NO: 46224 - DNA, 201 bp, Bos taurus; identical to SEQ ID NO: 4766

SEQ ID NO: 46225 - DNA, 201 bp, Bos taurus; identical to SEQ ID NO: 4767

SEQ ID NO: 46226 - DNA, 201 bp, Bos taurus; identical to SEQ ID NO: 4768

SEQ ID NO: 46227 - DNA, 201 bp, Bos taurus; identical to SEQ ID NO: 4769

SEQ ID NO: 46228 - DNA, 201 bp, Bos taurus; identical to SEQ ID NO: 4770

SEQ ID NO: 46229 - DNA, 201 bp, Bos taurus; identical to SEQ ID NO: 4771

SEQ ID NO: 46230 - DNA, 201 bp, Bos taurus; identical to SEQ ID NO: 4772

SEQ ID NO: 46231 - DNA, 201 bp, Bos taurus; identical to SEQ ID NO: 4773

SEQ ID NO: 46232 - DNA, 201 bp, Bos taurus; identical to SEQ ID NO: 4774

SEQ ID NO: 46233 - DNA, 201 bp, Bos taurus; identical to SEQ ID NO: 4776

SEQ ID NO: 46234 - DNA, 201 bp, Bos taurus; identical to SEQ ID NO: 4777

SEQ ID NO: 46235 - DNA, 201 bp, Bos taurus; identical to SEQ ID NO: 4778

SEQ ID NO: 46236 - DNA, 201 bp, Bos taurus; identical to SEQ ID NO: 4779

SEQ ID NO: 46237 - DNA, 201 bp, Bos taurus; identical to SEQ ID NO: 4780

SEQ ID NO: 46238 - DNA, 201 bp, Bos taurus
ttgatttatgacattattattatttttgtcttctagtctgcatttctcactataatgaaagatttttttgttgttagtttacttataatcatagtagttaatggaatcactagacataataaatactcagaaaacattgttcaaaattccctgaattgcctcattgtattgcctcccaagactctcagacggaagttagca

SEQ ID NO: 46239 - DNA, 201 bp, Bos taurus; identical to SEQ ID NO: 4783

SEQ ID NO: 46240 - DNA, 201 bp, Bos taurus
catagtcaccactcagttccaaaaagacagacctccaactggtctcccatggtcattctagcacgttctaattccttccttgcactgtaataagagatgtcttcaaaattcaaatctcctcatgacatttgctgtgataaaatatctctatgtgttgcccaagctcttaggtttaaagatcaacatccttgcagacagtct

SEQ ID NO: 46241 - DNA, 201 bp, Bos taurus
gtaagagtatataatcatggactgggaaattttgtggtctgaagtcccatgtctttgccttttctctttcttttcatttagatgttgacctaaaaaggtatggatcatttttaaatgtgatttcagctcagctaacagcataaacttgggacttggaaaattatttttgttagttctgataataaaatatttaagaatgct

SEQ ID NO: 46242 - DNA, 201 bp, Bos taurus
tgaattaatctattcattttcatatccattttctaattaactgatataaacagttcaggtactgcctgatagtttattgctgcatggcaaaatgcctcaatggatgtgcaattctaaaaatggttctgcaattatagtagttttatttatccataggcacttaatgcatcaagcagcttctaattgctaacgaagaaagac

SEQ ID NO: 46243 - DNA, 201 bp, Bos taurus; identical to SEQ ID NO: 4784

SEQ ID NO: 46244 - DNA, 201 bp, Bos taurus; identical to SEQ ID NO: 4785

SEQ ID NO: 46245 - DNA, 201 bp, Bos taurus
aagcttcagcgcatcctctacagtgtgagctagttgtgtggttcaggcatcattggaacacctgacgcatgtaccttcttccatttttccatacctgtgcctcctttaatcaacatcatcagtagaatgggagctatcaatttaaatgcccaaactaaagaaaaacatcattttgaatgatataatttgcaacaaggctta

SEQ ID NO: 46246 - DNA, 201 bp, Bos taurus; identical to SEQ ID NO: 4786

SEQ ID NO: 46247 - DNA, 201 bp, Bos taurus; identical to SEQ ID NO: 4787

SEQ ID NO: 46248 - DNA, 201 bp, Bos taurus
tggtaaactatacactgtgagaaaactccacttttattatctcaaaacttctgtaaattgtgttattttaaagagtgaaagaggcagcgacaaattcggtgcacctcttggttgggaaaacaaagattcagtggactcaaacattggaaaaaaagagaaatttaagtctcttggtcacctgtgatgttattaggagatgct

SEQ ID NO: 46249 - DNA, 201 bp, Bos taurus; identical to SEQ ID NO: 4788

SEQ ID NO: 46250 - DNA, 201 bp, Bos taurus
ctaataataacaatatcaaaaaataatagcaaaaattgacttaacttttactaggaactagactttgcaataaaaatattatgcagaagagctcatttaaccctaatcataaaatttattttcaagcagtaaaaaccaagtttgcaatttagtattttaaactgaagatggctttgggaaccaataggtggagatcagctc

SEQ ID NO: 46251 - DNA, 201 bp, Bos taurus; identical to SEQ ID NO: 4790

SEQ ID NO: 46252 - DNA, 201 bp, Bos taurus; identical to SEQ ID NO: 4791

SEQ ID NO: 46253 - DNA, 201 bp, Bos taurus
acctgatatcatgtcatgcctccaagcatgacattcacttttactgtcctgtcaatggagtgctctactaacccctacactattccttggtaggcaaaactcaatcatttcccaatctagattaaatgatcttccctcagatatagacttctatagtacaagactttgtgcatttacagtttctcagtatttgtgttatct

SEQ ID NO: 46254 - DNA, 201 bp, Bos taurus; identical to SEQ ID NO: 4793

SEQ ID NO: 46255 - DNA, 201 bp, Bos taurus
ataggtgtggttttttggagctcataggaagcagtgcaggtaccataacaggaaattaagagctttctagaattcaaaatttctctctcaaaccccagctagtgtctcctgttaccagttctaaatgccaaagaaaggaattctgattgactcagtttgaatcgtctgcctggtgcattggtcaaagcctcgggtacagac

SEQ ID NO: 46256 - DNA, 201 bp, Bos taurus
ggaaatagcaacctattctagtattcttgcctaggaaatcccatggacagaggagcctggtgagctgcagtccataaggtcactaaaagtcagatatgacagagcaactgagcattgatacaaaagataatgtacatggaatttaatgattctataagttacacaaattttgtaatgcctttctggggtggttaagtgatc

SEQ ID NO: 46257 - DNA, 201 bp, Bos taurus
aaactgactcttcttacaggaagcatgctcgatttgttattttttaaaaaattatcttgctttaatataatgctgccacaatgtctttatcagggaaataaccatttccattttccattgtaaaattaaaatatgaaatgcaatatgacagttacctgataagggaaagttattatgcttctttgtggcatatccaagtaa

SEQ ID NO: 46258 - DNA, 201 bp, Bos taurus
agatgtacacaagaagcaggtcatgttaggtaggtcctggcgaatgcagtggagctgaagtaagataattgttattagtgaagttgatgaacaaagagaacggcagattatgaagataaccgtaggcaagttgatctcagaaaagcacctgacatcctcacacagttggatatctttttaacacatatgagaggccactga

SEQ ID NO: 46259 - DNA, 201 bp, Bos taurus
aagtgtcttttcagccatcagaaaaagatacaattatcttcagtattattttagtgctaactctttgacttcatacccaggtgtggaaactctaccttatgtggatattgtgcactgtaggattttccttggaatacatgagtattagataaataaggcaagacacaaggttcaaatgatgctgaataaagaaaagaatgg

SEQ ID NO: 46260 - DNA, 201 bp, Bos taurus
ttatatttgctcccttgtattgccttgaattccttttcaaagatcagttaactatacttacaagggtttattttagtattttctgttctgttgttttgttattgtttatttgctaagtcgtgttggcctcttttgcaaccccatggagtgtggagccaccaggctcttctgtccatgaaattctccagtcaagaatactgg

SEQ ID NO: 46261 - DNA, 201 bp, Bos taurus
gcaaggcatatagtcattttaaatctgctcagcttaatgttgtgtaatcattaaaagcaaacaaataagcacaaactaatactatacataggcttgcatacataaaagaacctccagatagtgtgctaattaagaaaaacttacctaagattctcccccaaagaagagactgaatgaaagcctaggagacgagtttattag

SEQ ID NO: 46262 - DNA, 201 bp, Bos taurus
gacaccttttcccaaagctatattattgtttctctagactgtccctcacttgtctctgtatcctctccctttcctaattggtaactgtttgaacctcctccttggaactgagggaaggtcataaatgaagcctatttcctatagtcaagaaattggggacatagaaatacagggtcctgcactctatcagtcaaattcaga

SEQ ID NO: 46263 - DNA, 201 bp, Bos taurus
agagagttttgagatacaagaatatagcctaatggatgaacgggtaagggcatttgaagcagacgttcaatctttgatacagccagcaggagcctcgagtggctaagtttttgttgtgcagtttttggaagaacaggaatgaactgtatattcataaaagtcagttgttttatgagcagtccaaacaaggtgaaacttgaa

SEQ ID NO: 46264 - DNA, 201 bp, Bos taurus; identical to SEQ ID NO: 4794

SEQ ID NO: 46265 - DNA, 201 bp, Bos taurus; identical to SEQ ID NO: 4795

SEQ ID NO: 46266 - DNA, 201 bp, Bos taurus
catgggggaagtctgctctccccatgccagatatggtgcacagcccaggcactacagtctctgagaggagttgtgttcaaggatacaaactagccagtcacactgtttccagtatttgggctccattctaagcaccttcattcctaggtctcttatcgaaggccttggccagagatattcttcaggtacttctgctgatgc

SEQ ID NO: 46267 - DNA, 201 bp, Bos taurus; identical to SEQ ID NO: 4797

SEQ ID NO: 46268 - DNA, 201 bp, Bos taurus; identical to SEQ ID NO: 4798

SEQ ID NO: 46269 - DNA, 201 bp, Bos taurus; identical to SEQ ID NO: 4799

SEQ ID NO: 46270 - DNA, 201 bp, Bos taurus; identical to SEQ ID NO: 4800

SEQ ID NO: 46271 - DNA, 201 bp, Bos taurus; identical to SEQ ID NO: 4801

SEQ ID NO: 46272 - DNA, 201 bp, Bos taurus; identical to SEQ ID NO: 4802

SEQ ID NO: 46273 - DNA, 201 bp, Bos taurus; identical to SEQ ID NO: 4803

SEQ ID NO: 46274 - DNA, 201 bp, Bos taurus; identical to SEQ ID NO: 4804

SEQ ID NO: 46275 - DNA, 201 bp, Bos taurus; identical to SEQ ID NO: 4805

SEQ ID NO: 46276 - DNA, 201 bp, Bos taurus
caggacctgggctcaaatcttgtttctagtgggtagcacaacttctatgttgagctgcctcctgttgcatagtaacctgaaacatccccaaccacctgtcgggggatattggtcttttattaggcattgttttggaggagttcattatgttttggcagatttcaaataccacagaaattattcaagacattaactttcttt

SEQ ID NO: 46277 - DNA, 201 bp, Bos taurus
ctaaactattttttagtgacttgaacctcaagtgattttagtaaatcaagactgcttccgtcaggctagtctgtcataagagcaaaataggcataaaccactgcatttttttaagggcttttgttttcctgagtgagatactgctaaatttcaaggttgcttttcagttaaatgtgacatatagaatataaccttgcatcc

SEQ ID NO: 46278 - DNA, 201 bp, Bos taurus
tccaggatcataaataagcatagggaaaagtgaacttaggattgagatagcatgagtaaatatcttgtccaatcatgtccacaaaataatattacattaaaaaatgtattgatggaaacacacagatacacacgaagcagaatgatggtcaagctcttctcaggggaataatgattagaataataatgttttggttcctgg

SEQ ID NO: 46279 - DNA, 201 bp, Bos taurus; identical to SEQ ID NO: 4806

SEQ ID NO: 46280 - DNA, 201 bp, Bos taurus; identical to SEQ ID NO: 4807

SEQ ID NO: 46281 - DNA, 201 bp, Bos taurus; identical to SEQ ID NO: 4809

SEQ ID NO: 46282 - DNA, 201 bp, Bos taurus; identical to SEQ ID NO: 4810

SEQ ID NO: 46283 - DNA, 201 bp, Bos taurus; identical to SEQ ID NO: 4813

SEQ ID NO: 46284 - DNA, 201 bp, Bos taurus; identical to SEQ ID NO: 4814

SEQ ID NO: 46285 - DNA, 201 bp, Bos taurus; identical to SEQ ID NO: 4815

SEQ ID NO: 46286 - DNA, 201 bp, Bos taurus; identical to SEQ ID NO: 4818

SEQ ID NO: 46287 - DNA, 201 bp, Bos taurus; identical to SEQ ID NO: 4819

SEQ ID NO: 46288 - DNA, 201 bp, Bos taurus; identical to SEQ ID NO: 4821

SEQ ID NO: 46289 - DNA, 201 bp, Bos taurus
ttccctgcaaacgcaactttgagaaatggcccagagagccaacgttttgcgttcttggaatacccaaagagaatgtgcagggacattcaggcctatggtaaattgcttctctcagcataggctgcaaagccattgaaaacctggctttcttgggcatgccactgtctcggattaccaaataaagcaggtaaggaggaagat

SEQ ID NO: 46290 - DNA, 201 bp, Bos taurus
tggatataatattccctgagttttggctgtttttataacctgataaatctgtttttataaccatgataattgaaggacagtttggttggaagtaaaatccatggcttacatatttctatccttaagcagtttttaatgatattgtatggttgtctttattttttctgttattgtcaaaaaatcagaggtcaagtgattttt

SEQ ID NO: 46291 - DNA, 201 bp, Bos taurus; identical to SEQ ID NO: 4824

SEQ ID NO: 46292 - DNA, 201 bp, Bos taurus
ctgtatctttgtggtatttgttactacatgacatctgtagacttctaccagaggatagaaatcttgtctatggttcactgctgaaggtcttaactttgaataccatcaggcacataaaaggtgctcaataaatgtgtgctgaaagactccctctcaactttgagatgatttaaggtaacaagtggaaagtacaaagtttta

SEQ ID NO: 46293 - DNA, 201 bp, Bos taurus
gagtctcccagagaacaggagcctgtctggaatgtactgtcttctgcctctggtgctgtactctccctaatgaaaggaggggcctggagaggaggcagcaggcttctctgggtttctcctcacaccctggactcctccagtatcaagtcctgtaatgccttggcctctgtacaatgtgccaatggaggggcaggcagcaat

SEQ ID NO: 46294 - DNA, 201 bp, Bos taurus; identical to SEQ ID NO: 4825

SEQ ID NO: 46295 - DNA, 201 bp, Bos taurus
cctgcctcttgggtccctggaaactagaatgggaaggaaagagacatggtaatcggatcttccagaaagcaggtggaaaatggccccaagctttggaaattatactcttacaagagaggaaataccatgtacacatatgtgtcctaggtaaacaggaaattctctctcaggtggcagagggtggggccagctttggtctct

SEQ ID NO: 46296 - DNA, 201 bp, Bos taurus
aggcagtaccatagggcttggtgcagttagcaaaaggacgcatcatcatccattcccttaggtttccctaagggagaactgccctgggctctgtgagggtgggggcatgacctggcctgagaggccagaatggcttctctgagggaagcctgtcccgccaagctgggaaggataagagggatctgatcaggcaaagtgggt

SEQ ID NO: 46297 - DNA, 201 bp, Bos taurus
ggaagactccatgatataaatgaaaaattttctgaagcccagctccaccatttgctagttgtgtaaccttatatgagttagttaagcttgctaaaccattctctatattcataagatggagctagtaatgcgtatctccaagttacgggaagaagacgaaataatgaatgtcaagcaccaaacgcaaactgggtgttcaag

SEQ ID NO: 46298 - DNA, 201 bp, Bos taurus; identical to SEQ ID NO: 4828

SEQ ID NO: 46299 - DNA, 201 bp, Bos taurus
tcaaaattggggcaggactagggtgaggcagtcacatgctccgagtgcaaattttaaggaggcactcacttttagggccctgcaagtatggaccctgtgcacacatgaccctgacagtgagtgcctcctttatattttgcatcctaggggcccaccttcctcaccctactcactgctactctacagctgggacaccgctgc

SEQ ID NO: 46300 - DNA, 201 bp, Bos taurus
gggaatcccacaatgtttttctaggtcttaaatcaaaagagcagtggctgtaatcattccaaggtaatgggggaggtatctgcgtgttccgtctggctacttataataccctatgggttgagactttcctggtggtacaatgaataagaatcggtctgccaaagcaggggacaggggtttgatctccagtctgggaagatt

SEQ ID NO: 46301 - DNA, 201 bp, Bos taurus; identical to SEQ ID NO: 4834

SEQ ID NO: 46302 - DNA, 201 bp, Bos taurus; identical to SEQ ID NO: 4835

SEQ ID NO: 46303 - DNA, 201 bp, Bos taurus
ggttatgctgtctttactttttatttttaacttcagatcagtattatagcagtcagtttaaattaagcaggaggttcaaaatttcaagggcaagacaatggaggaaatagagaagggacactgctatatcctaccagagtggtaggtggcttctagatcacacaattattctccttcagcagtgcagttaacaaagcatac

SEQ ID NO: 46304 - DNA, 201 bp, Bos taurus; identical to SEQ ID NO: 4836

SEQ ID NO: 46305 - DNA, 201 bp, Bos taurus; identical to SEQ ID NO: 4837

SEQ ID NO: 46306 - DNA, 201 bp, Bos taurus
gaaatgggggtgacaaactcttctgaggttgaagggccacatgctctaggactcagttagtcccacaatcttacctgtgcctccctgctccttgcccccaacacgggggcaacactggccccttttaagtccttcagcatgcccagcttcctccagccttaggaactgcataaatgctataccttcagcaccacatcacat

SEQ ID NO: 46307 - DNA, 201 bp, Bos taurus; identical to SEQ ID NO: 4839

SEQ ID NO: 46308 - DNA, 201 bp, Bos taurus
ggtggagtgcacaatcggttttggcccctgttttaggatgatccttcttggtctctgggctggatgatacggtggctatgtggccctcctcggggctagactggggcttgtttggtttctgcagcagcacatcaccgttcccgacagtgggggaggcctggcctggctgggccttctctcccacagccccaagctggttgc

SEQ ID NO: 46309 - DNA, 201 bp, Bos taurus; identical to SEQ ID NO: 4840

SEQ ID NO: 46310 - DNA, 201 bp, Bos taurus; identical to SEQ ID NO: 4841

SEQ ID NO: 46311 - DNA, 201 bp, Bos taurus; identical to SEQ ID NO: 4842

SEQ ID NO: 46312 - DNA, 201 bp, Bos taurus; identical to SEQ ID NO: 4844

SEQ ID NO: 46313 - DNA, 201 bp, Bos taurus; identical to SEQ ID NO: 4845

SEQ ID NO: 46314 - DNA, 201 bp, Bos taurus; identical to SEQ ID NO: 4846

SEQ ID NO: 46315 - DNA, 201 bp, Bos taurus; identical to SEQ ID NO: 4847

SEQ ID NO: 46316 - DNA, 201 bp, Bos taurus; identical to SEQ ID NO: 4848

SEQ ID NO: 46317 - DNA, 201 bp, Bos taurus; identical to SEQ ID NO: 4849

SEQ ID NO: 46318 - DNA, 201 bp, Bos taurus; identical to SEQ ID NO: 4850

SEQ ID NO: 46319 - DNA, 201 bp, Bos taurus; identical to SEQ ID NO: 4851

SEQ ID NO: 46320 - DNA, 201 bp, Bos taurus; identical to SEQ ID NO: 4852

SEQ ID NO: 46321 - DNA, 201 bp, Bos taurus; identical to SEQ ID NO: 4853

SEQ ID NO: 46322 - DNA, 201 bp, Bos taurus; identical to SEQ ID NO: 4854

SEQ ID NO: 46323 - DNA, 201 bp, Bos taurus; identical to SEQ ID NO: 4855

SEQ ID NO: 46324 - DNA, 201 bp, Bos taurus; identical to SEQ ID NO: 4857

SEQ ID NO: 46325 - DNA, 201 bp, Bos taurus; identical to SEQ ID NO: 4858

SEQ ID NO: 46326 - DNA, 201 bp, Bos taurus; identical to SEQ ID NO: 4859

SEQ ID NO: 46327 - DNA, 201 bp, Bos taurus; identical to SEQ ID NO: 4860

SEQ ID NO: 46328 - DNA, 201 bp, Bos taurus; identical to SEQ ID NO: 4861

SEQ ID NO: 46329 - DNA, 201 bp, Bos taurus; identical to SEQ ID NO: 4862

SEQ ID NO: 46330 - DNA, 201 bp, Bos taurus; identical to SEQ ID NO: 4863

SEQ ID NO: 46331 - DNA, 201 bp, Bos taurus; identical to SEQ ID NO: 4864

SEQ ID NO: 46332 - DNA, 201 bp, Bos taurus; identical to SEQ ID NO: 4865

SEQ ID NO: 46333 - DNA, 201 bp, Bos taurus; identical to SEQ ID NO: 4866

SEQ ID NO: 46334 - DNA, 201 bp, Bos taurus; identical to SEQ ID NO: 4867

SEQ ID NO: 46335 - DNA, 201 bp, Bos taurus; identical to SEQ ID NO: 4868

SEQ ID NO: 46336 - DNA, 201 bp, Bos taurus; identical to SEQ ID NO: 4869

SEQ ID NO: 46337 - DNA, 201 bp, Bos taurus
gtaggccagttcctaaccactgaaccaccacggaagtccataccttgttttttaaccaaatccacagaatgtcactataaaaataaatgacatagtctttgggaatgtgtttttaataagatatgcaggttaaaatccagaatcagtttacatctttgaatgtatatttgctgccatatcatccagttgttttgttttttt

SEQ ID NO: 46338 - DNA, 201 bp, Bos taurus
gcttgcatcattcattaggggatacgcatgtggacaggaagatgcaaaatgttaagataaatcaagggaggcaaatgagagagctagacagaacactttcttatataaactgaactaaattgaaatgtcgagagaaggcaaaagaaggggaggcagagagaaatttgggaccagggtgagtttagagggtatagttaactc

SEQ ID NO: 46339 - DNA, 201 bp, Bos taurus; identical to SEQ ID NO: 4871

SEQ ID NO: 46340 - DNA, 201 bp, Bos taurus; identical to SEQ ID NO: 4874

SEQ ID NO: 46341 - DNA, 201 bp, Bos taurus
ataaaaattaacccatgttgcagaatatatggccattccgagagatgctctccaatgccaaatacatgacccccacagcccaagagccaggctatactcactgtgggcccaccagcacctgggagggggcattatctgtttgattttctcttctaaagggatataagggtaaccctttagctcccttccgagcacagaggg

SEQ ID NO: 46342 - DNA, 201 bp, Bos taurus; identical to SEQ ID NO: 4879

SEQ ID NO: 46343 - DNA, 201 bp, Bos taurus; identical to SEQ ID NO: 4880

SEQ ID NO: 46344 - DNA, 201 bp, Bos taurus
aaaatatatataaattttcaattttcagatgactgtaactgacttttacacttattcatcatgcagacaatatcactggataagcccaagatatgaaggcatgcaagactctgcagaaacttaacatagtaccttggaagttattttataaaatcattcaaagcagttgttttcatgcattagccttttactcataaaaga

SEQ ID NO: 46345 - DNA, 201 bp, Bos taurus; identical to SEQ ID NO: 4882

SEQ ID NO: 46346 - DNA, 201 bp, Bos taurus
aactttttttaatgccagggttatacatacgtccttgaaaagatttttcaaggtaagcagacagatgaaagatctcacaattagatgtagggaggccctcggtttctggctgtcctcactgtgccaggtttgtctactgagacgctgagacccagggagggttatagaaatctgcccctggcccttggggaggagctcaac

SEQ ID NO: 46347 - DNA, 201 bp, Bos taurus; identical to SEQ ID NO: 4883

SEQ ID NO: 46348 - DNA, 201 bp, Bos taurus; identical to SEQ ID NO: 4885

SEQ ID NO: 46349 - DNA, 201 bp, Bos taurus
ctttcttccctttctttctttcatcagtatttattaacttttctacttctgaaataacttagaaagtcatttaaaataggttgatttgtgttcatccttacgtaaaatagaaaatttgctaattaatatgaaacataaggggaagattttagagcattttatttcaggcagttaagtttatattttttaaagacactatgg

SEQ ID NO: 46350 - DNA, 201 bp, Bos taurus
aggttctggcctaatgggatcacctgaggaacaacttcccaagactcaatcactttgatagcaagttataaaaaattctaaagggaaataactcctggaccctgatttctgaacactggccggctaacaaactccagctcactcaccatgaaagggaaggaagagtcccagcataaacactgccctggcaagagcttcagt

SEQ ID NO: 46351 - DNA, 201 bp, Bos taurus; identical to SEQ ID NO: 4889

SEQ ID NO: 46352 - DNA, 201 bp, Bos taurus; identical to SEQ ID NO: 4891

SEQ ID NO: 46353 - DNA, 201 bp, Bos taurus
aacaatggcacatgtgttcaatttggtgggaatccggtgagccataaatcagaaaaaagcctgggagggcttagtggggcctccttcctgggctgtgtttgtaccaccccagagctggagccacagccctgggtgagccttgccctggcacgcaggactcctggggcctggcacgctgcttgtctgctggcggttgtgcta

SEQ ID NO: 46354 - DNA, 201 bp, Bos taurus
gatgtgaaggcctaacataaaccaatggctgtgagacagccatcagcacagaggattcaaaggctgacgcttccttggaaatttccaaatgtgagacaaccgaggcccactttcagtaatgaaaggggagaactgttctctcaagccaattatagaacacatgataatggtaaaaatgttccttttcaccttgttaaactg

SEQ ID NO: 46355 - DNA, 201 bp, Bos taurus; identical to SEQ ID NO: 4892

SEQ ID NO: 46356 - DNA, 201 bp, Bos taurus; identical to SEQ ID NO: 4893

SEQ ID NO: 46357 - DNA, 201 bp, Bos taurus; identical to SEQ ID NO: 4894

SEQ ID NO: 46358 - DNA, 201 bp, Bos taurus; identical to SEQ ID NO: 4895

SEQ ID NO: 46359 - DNA, 201 bp, Bos taurus; identical to SEQ ID NO: 4897

SEQ ID NO: 46360 - DNA, 201 bp, Bos taurus; identical to SEQ ID NO: 4898

SEQ ID NO: 46361 - DNA, 201 bp, Bos taurus; identical to SEQ ID NO: 4899

SEQ ID NO: 46362 - DNA, 201 bp, Bos taurus; identical to SEQ ID NO: 4900

SEQ ID NO: 46363 - DNA, 201 bp, Bos taurus
atagagtatgccaactcacaactcagtgaagttagtaggtttttttttagattttagttgaagtggtgaagagatattgtattgatttatgcttgctacacctttacacattcaaagataatcatttatgcttcctctaaatcttctttttgcctgggcaatgacttctttaatagactttttatattttttattatgtaa

SEQ ID NO: 46364 - DNA, 201 bp, Bos taurus
ctgatagtattttgaaatacccaaagggaagtcattgtatacagcaatccctactgaagaattcctagtaaaactaatggcagtgatggaatttactcttcctctacttcgaatgttcactaactggaaaagtttaaaatgtggacgagtactataaaggtcaaacaatgttacttatgacaaaacaaaagattccttctg

SEQ ID NO: 46365 - DNA, 201 bp, Bos taurus; identical to SEQ ID NO: 4903

SEQ ID NO: 46366 - DNA, 201 bp, Bos taurus
aggccttgttactttgaaatgtgtaccttaagaggcgtgactcaatccaacagtgttggaggtgactcatcacacagaccgagctccaaaaaaaacacatcggccaccaatctccacacatcatcccacgatgcctgttcctttattttattttattttttattttaattcaggagctaatcccaaacagcttcctctctt

SEQ ID NO: 46367 - DNA, 201 bp, Bos taurus; identical to SEQ ID NO: 4905

SEQ ID NO: 46368 - DNA, 201 bp, Bos taurus; identical to SEQ ID NO: 4907

SEQ ID NO: 46369 - DNA, 201 bp, Bos taurus; identical to SEQ ID NO: 4908

SEQ ID NO: 46370 - DNA, 201 bp, Bos taurus; identical to SEQ ID NO: 4911

SEQ ID NO: 46371 - DNA, 201 bp, Bos taurus; identical to SEQ ID NO: 4912

SEQ ID NO: 46372 - DNA, 201 bp, Bos taurus
gactggctctttcccaagcaactttaactcaaaatgatcagggtacccacatggcatattttagggtggcatattctgcttgccttcagtcttatgttccagtctctccccttctctgacctccacttctgtcatcacacctcttcctatgaccctttaaaggtacttgtgtttgcattgggcccacctggaaaatccgtc

SEQ ID NO: 46373 - DNA, 201 bp, Bos taurus; identical to SEQ ID NO: 4918

SEQ ID NO: 46374 - DNA, 201 bp, Bos taurus; identical to SEQ ID NO: 4923

SEQ ID NO: 46375 - DNA, 201 bp, Bos taurus; identical to SEQ ID NO: 4924

SEQ ID NO: 46376 - DNA, 201 bp, Bos taurus
attcatgcaaaccatgaaatattcactctatttactttttaattaaattctgatcactatgataatttatttcaataatttttgaaatagcaatcccttagaaagatcagtggtgaacaatgtttaagacctacataactgccttcaatctcttgcattgtttctcagtttacttactctgaaaagtaatctgaggaatca

SEQ ID NO: 46377 - DNA, 201 bp, Bos taurus; identical to SEQ ID NO: 4925

SEQ ID NO: 46378 - DNA, 201 bp, Bos taurus; identical to SEQ ID NO: 4927

SEQ ID NO: 46379 - DNA, 201 bp, Bos taurus; identical to SEQ ID NO: 4932

SEQ ID NO: 46380 - DNA, 201 bp, Bos taurus; identical to SEQ ID NO: 4937

SEQ ID NO: 46381 - DNA, 201 bp, Bos taurus; identical to SEQ ID NO: 4940

SEQ ID NO: 46382 - DNA, 201 bp, Bos taurus; identical to SEQ ID NO: 4941

SEQ ID NO: 46383 - DNA, 201 bp, Bos taurus; identical to SEQ ID NO: 4942

SEQ ID NO: 46384 - DNA, 201 bp, Bos taurus; identical to SEQ ID NO: 4943

SEQ ID NO: 46385 - DNA, 201 bp, Bos taurus; identical to SEQ ID NO: 4944

SEQ ID NO: 46386 - DNA, 201 bp, Bos taurus; identical to SEQ ID NO: 4945

SEQ ID NO: 46387 - DNA, 201 bp, Bos taurus; identical to SEQ ID NO: 4946

SEQ ID NO: 46388 - DNA, 201 bp, Bos taurus; identical to SEQ ID NO: 4947

SEQ ID NO: 46389 - DNA, 201 bp, Bos taurus; identical to SEQ ID NO: 4948

SEQ ID NO: 46390 - DNA, 201 bp, Bos taurus; identical to SEQ ID NO: 4949

SEQ ID NO: 46391 - DNA, 201 bp, Bos taurus; identical to SEQ ID NO: 4950

SEQ ID NO: 46392 - DNA, 201 bp, Bos taurus; identical to SEQ ID NO: 4951

SEQ ID NO: 46393 - DNA, 201 bp, Bos taurus; identical to SEQ ID NO: 4952

SEQ ID NO: 46394 - DNA, 201 bp, Bos taurus; identical to SEQ ID NO: 4953

SEQ ID NO: 46395 - DNA, 201 bp, Bos taurus; identical to SEQ ID NO: 4954

SEQ ID NO: 46396 - DNA, 201 bp, Bos taurus; identical to SEQ ID NO: 4955

SEQ ID NO: 46397 - DNA, 201 bp, Bos taurus; identical to SEQ ID NO: 4956

SEQ ID NO: 46398 - DNA, 201 bp, Bos taurus; identical to SEQ ID NO: 4957

SEQ ID NO: 46399 - DNA, 201 bp, Bos taurus; identical to SEQ ID NO: 4959

SEQ ID NO: 46400 - DNA, 201 bp, Bos taurus; identical to SEQ ID NO: 4960

SEQ ID NO: 46401 - DNA, 201 bp, Bos taurus; identical to SEQ ID NO: 4961

SEQ ID NO: 46402 - DNA, 201 bp, Bos taurus; identical to SEQ ID NO: 4962

SEQ ID NO: 46403 - DNA, 201 bp, Bos taurus; identical to SEQ ID NO: 4963

SEQ ID NO: 46404 - DNA, 201 bp, Bos taurus; identical to SEQ ID NO: 4964

SEQ ID NO: 46405 - DNA, 201 bp, Bos taurus; identical to SEQ ID NO: 4965

SEQ ID NO: 46406 - DNA, 201 bp, Bos taurus; identical to SEQ ID NO: 4967

SEQ ID NO: 46407 - DNA, 201 bp, Bos taurus; identical to SEQ ID NO: 4968

SEQ ID NO: 46408 - DNA, 201 bp, Bos taurus; identical to SEQ ID NO: 4969

SEQ ID NO: 46409 - DNA, 201 bp, Bos taurus; identical to SEQ ID NO: 4970

SEQ ID NO: 46410 - DNA, 201 bp, Bos taurus; identical to SEQ ID NO: 4971

SEQ ID NO: 46411 - DNA, 201 bp, Bos taurus; identical to SEQ ID NO: 4972

SEQ ID NO: 46412 - DNA, 201 bp, Bos taurus; identical to SEQ ID NO: 4973

SEQ ID NO: 46413 - DNA, 201 bp, Bos taurus; identical to SEQ ID NO: 4975

SEQ ID NO: 46414 - DNA, 201 bp, Bos taurus; identical to SEQ ID NO: 4976

SEQ ID NO: 46415 - DNA, 201 bp, Bos taurus; identical to SEQ ID NO: 4977

SEQ ID NO: 46416 - DNA, 201 bp, Bos taurus; identical to SEQ ID NO: 4978

SEQ ID NO: 46417 - DNA, 201 bp, Bos taurus; identical to SEQ ID NO: 4979

SEQ ID NO: 46418 - DNA, 201 bp, Bos taurus; identical to SEQ ID NO: 4980

SEQ ID NO: 46419 - DNA, 201 bp, Bos taurus; identical to SEQ ID NO: 4981

SEQ ID NO: 46420 - DNA, 201 bp, Bos taurus; identical to SEQ ID NO: 4982

SEQ ID NO: 46421 - DNA, 201 bp, Bos taurus; identical to SEQ ID NO: 4983

SEQ ID NO: 46422 - DNA, 201 bp, Bos taurus; identical to SEQ ID NO: 4984

SEQ ID NO: 46423 - DNA, 201 bp, Bos taurus; identical to SEQ ID NO: 4985

SEQ ID NO: 46424 - DNA, 201 bp, Bos taurus; identical to SEQ ID NO: 4986

SEQ ID NO: 46425 - DNA, 201 bp, Bos taurus; identical to SEQ ID NO: 4987

SEQ ID NO: 46426 - DNA, 201 bp, Bos taurus; identical to SEQ ID NO: 4988

SEQ ID NO: 46427 - DNA, 201 bp, Bos taurus; identical to SEQ ID NO: 4989

SEQ ID NO: 46428 - DNA, 201 bp, Bos taurus; identical to SEQ ID NO: 4990

SEQ ID NO: 46429 - DNA, 201 bp, Bos taurus; identical to SEQ ID NO: 4991

SEQ ID NO: 46430 - DNA, 201 bp, Bos taurus; identical to SEQ ID NO: 4992

SEQ ID NO: 46431 - DNA, 201 bp, Bos taurus; identical to SEQ ID NO: 4993

SEQ ID NO: 46432 - DNA, 201 bp, Bos taurus; identical to SEQ ID NO: 4994

SEQ ID NO: 46433 - DNA, 201 bp, Bos taurus; identical to SEQ ID NO: 4995

SEQ ID NO: 46434 - DNA, 201 bp, Bos taurus; identical to SEQ ID NO: 4996

SEQ ID NO: 46435 - DNA, 201 bp, Bos taurus; identical to SEQ ID NO: 4997

SEQ ID NO: 46436 - DNA, 201 bp, Bos taurus; identical to SEQ ID NO: 4998

SEQ ID NO: 46437 - DNA, 201 bp, Bos taurus; identical to SEQ ID NO: 4999

SEQ ID NO: 46438 - DNA, 201 bp, Bos taurus; identical to SEQ ID NO: 5000

SEQ ID NO: 46439 - DNA, 201 bp, Bos taurus; identical to SEQ ID NO: 5001

SEQ ID NO: 46440 - DNA, 201 bp, Bos taurus; identical to SEQ ID NO: 5002

SEQ ID NO: 46441 - DNA, 201 bp, Bos taurus; identical to SEQ ID NO: 5003

SEQ ID NO: 46442 - DNA, 201 bp, Bos taurus; identical to SEQ ID NO: 5004

SEQ ID NO: 46443 - DNA, 201 bp, Bos taurus; identical to SEQ ID NO: 5005

SEQ ID NO: 46444 - DNA, 201 bp, Bos taurus; identical to SEQ ID NO: 5006

SEQ ID NO: 46445 - DNA, 201 bp, Bos taurus; identical to SEQ ID NO: 5007

SEQ ID NO: 46446 - DNA, 201 bp, Bos taurus; identical to SEQ ID NO: 5008

SEQ ID NO: 46447 - DNA, 201 bp, Bos taurus; identical to SEQ ID NO: 5009

SEQ ID NO: 46448 - DNA, 201 bp, Bos taurus; identical to SEQ ID NO: 5010

SEQ ID NO: 46449 - DNA, 201 bp, Bos taurus; identical to SEQ ID NO: 5011

SEQ ID NO: 46450 - DNA, 201 bp, Bos taurus; identical to SEQ ID NO: 5012

SEQ ID NO: 46451 - DNA, 201 bp, Bos taurus; identical to SEQ ID NO: 5013

SEQ ID NO: 46452 - DNA, 201 bp, Bos taurus; identical to SEQ ID NO: 5014

SEQ ID NO: 46453 - DNA, 201 bp, Bos taurus; identical to SEQ ID NO: 5015

SEQ ID NO: 46454 - DNA, 201 bp, Bos taurus; identical to SEQ ID NO: 5016

SEQ ID NO: 46455 - DNA, 201 bp, Bos taurus; identical to SEQ ID NO: 5017

SEQ ID NO: 46456 - DNA, 201 bp, Bos taurus; identical to SEQ ID NO: 5018

SEQ ID NO: 46457 - DNA, 201 bp, Bos taurus; identical to SEQ ID NO: 5019

SEQ ID NO: 46458 - DNA, 201 bp, Bos taurus; identical to SEQ ID NO: 5020

SEQ ID NO: 46459 - DNA, 201 bp, Bos taurus; identical to SEQ ID NO: 5021

SEQ ID NO: 46460 - DNA, 201 bp, Bos taurus; identical to SEQ ID NO: 5022

SEQ ID NO: 46461 - DNA, 201 bp, Bos taurus; identical to SEQ ID NO: 5023

SEQ ID NO: 46462 - DNA, 201 bp, Bos taurus; identical to SEQ ID NO: 5024

SEQ ID NO: 46463 - DNA, 201 bp, Bos taurus; identical to SEQ ID NO: 5025

SEQ ID NO: 46464 - DNA, 201 bp, Bos taurus; identical to SEQ ID NO: 5026

SEQ ID NO: 46465 - DNA, 201 bp, Bos taurus; identical to SEQ ID NO: 5027

SEQ ID NO: 46466 - DNA, 201 bp, Bos taurus; identical to SEQ ID NO: 5028

SEQ ID NO: 46467 - DNA, 201 bp, Bos taurus; identical to SEQ ID NO: 5029

SEQ ID NO: 46468 - DNA, 201 bp, Bos taurus; identical to SEQ ID NO: 5030

SEQ ID NO: 46469 - DNA, 201 bp, Bos taurus; identical to SEQ ID NO: 5031

SEQ ID NO: 46470 - DNA, 201 bp, Bos taurus; identical to SEQ ID NO: 5032

SEQ ID NO: 46471 - DNA, 201 bp, Bos taurus; identical to SEQ ID NO: 5033

SEQ ID NO: 46472 - DNA, 201 bp, Bos taurus; identical to SEQ ID NO: 5034

SEQ ID NO: 46473 - DNA, 201 bp, Bos taurus; identical to SEQ ID NO: 5035

SEQ ID NO: 46474 - DNA, 201 bp, Bos taurus; identical to SEQ ID NO: 5036

SEQ ID NO: 46475 - DNA, 201 bp, Bos taurus; identical to SEQ ID NO: 5037

SEQ ID NO: 46476 - DNA, 201 bp, Bos taurus; identical to SEQ ID NO: 5038

SEQ ID NO: 46477 - DNA, 201 bp, Bos taurus; identical to SEQ ID NO: 5039

SEQ ID NO: 46478 - DNA, 201 bp, Bos taurus; identical to SEQ ID NO: 5040

SEQ ID NO: 46479 - DNA, 201 bp, Bos taurus; identical to SEQ ID NO: 5041

SEQ ID NO: 46480 - DNA, 201 bp, Bos taurus; identical to SEQ ID NO: 5042

SEQ ID NO: 46481 - DNA, 201 bp, Bos taurus; identical to SEQ ID NO: 5043

SEQ ID NO: 46482 - DNA, 201 bp, Bos taurus; identical to SEQ ID NO: 5044

SEQ ID NO: 46483 - DNA, 201 bp, Bos taurus; identical to SEQ ID NO: 5046

SEQ ID NO: 46484 - DNA, 201 bp, Bos taurus; identical to SEQ ID NO: 5047

SEQ ID NO: 46485 - DNA, 201 bp, Bos taurus; identical to SEQ ID NO: 5048

SEQ ID NO: 46486 - DNA, 201 bp, Bos taurus; identical to SEQ ID NO: 5049

SEQ ID NO: 46487 - DNA, 201 bp, Bos taurus; identical to SEQ ID NO: 5050

SEQ ID NO: 46488 - DNA, 201 bp, Bos taurus; identical to SEQ ID NO: 5051

SEQ ID NO: 46489 - DNA, 201 bp, Bos taurus; identical to SEQ ID NO: 5052

SEQ ID NO: 46490 - DNA, 201 bp, Bos taurus; identical to SEQ ID NO: 5054

SEQ ID NO: 46491 - DNA, 201 bp, Bos taurus; identical to SEQ ID NO: 5055

SEQ ID NO: 46492 - DNA, 201 bp, Bos taurus; identical to SEQ ID NO: 5056

SEQ ID NO: 46493 - DNA, 201 bp, Bos taurus; identical to SEQ ID NO: 5057

SEQ ID NO: 46494 - DNA, 201 bp, Bos taurus; identical to SEQ ID NO: 5058

SEQ ID NO: 46495 - DNA, 201 bp, Bos taurus; identical to SEQ ID NO: 5059

SEQ ID NO: 46496 - DNA, 201 bp, Bos taurus; identical to SEQ ID NO: 5062

SEQ ID NO: 46497 - DNA, 201 bp, Bos taurus; identical to SEQ ID NO: 5063

SEQ ID NO: 46498 - DNA, 201 bp, Bos taurus; identical to SEQ ID NO: 5064

SEQ ID NO: 46499 - DNA, 201 bp, Bos taurus; identical to SEQ ID NO: 5065

SEQ ID NO: 46500 - DNA, 201 bp, Bos taurus; identical to SEQ ID NO: 5066

SEQ ID NO: 46501 - DNA, 201 bp, Bos taurus; identical to SEQ ID NO: 5067

SEQ ID NO: 46502 - DNA, 201 bp, Bos taurus; identical to SEQ ID NO: 5068

SEQ ID NO: 46503 - DNA, 201 bp, Bos taurus; identical to SEQ ID NO: 5069

SEQ ID NO: 46504 - DNA, 201 bp, Bos taurus; identical to SEQ ID NO: 5070

SEQ ID NO: 46505 - DNA, 201 bp, Bos taurus; identical to SEQ ID NO: 5071

SEQ ID NO: 46506 - DNA, 201 bp, Bos taurus; identical to SEQ ID NO: 5072

SEQ ID NO: 46507 - DNA, 201 bp, Bos taurus; identical to SEQ ID NO: 5073

SEQ ID NO: 46508 - DNA, 201 bp, Bos taurus; identical to SEQ ID NO: 5074

SEQ ID NO: 46509 - DNA, 201 bp, Bos taurus; identical to SEQ ID NO: 5075

SEQ ID NO: 46510 - DNA, 201 bp, Bos taurus; identical to SEQ ID NO: 5076

SEQ ID NO: 46511 - DNA, 201 bp, Bos taurus; identical to SEQ ID NO: 5077

SEQ ID NO: 46512 - DNA, 201 bp, Bos taurus; identical to SEQ ID NO: 5078

SEQ ID NO: 46513 - DNA, 201 bp, Bos taurus; identical to SEQ ID NO: 5079

SEQ ID NO: 46514 - DNA, 201 bp, Bos taurus; identical to SEQ ID NO: 5080

SEQ ID NO: 46515 - DNA, 201 bp, Bos taurus; identical to SEQ ID NO: 5081

SEQ ID NO: 46516 - DNA, 201 bp, Bos taurus; identical to SEQ ID NO: 5082

SEQ ID NO: 46517 - DNA, 201 bp, Bos taurus; identical to SEQ ID NO: 5083

SEQ ID NO: 46518 - DNA, 201 bp, Bos taurus; identical to SEQ ID NO: 5084

SEQ ID NO: 46519 - DNA, 201 bp, Bos taurus; identical to SEQ ID NO: 5085

SEQ ID NO: 46520 - DNA, 201 bp, Bos taurus; identical to SEQ ID NO: 5086

SEQ ID NO: 46521 - DNA, 201 bp, Bos taurus; identical to SEQ ID NO: 5087

SEQ ID NO: 46522 - DNA, 201 bp, Bos taurus; identical to SEQ ID NO: 5088

SEQ ID NO: 46523 - DNA, 201 bp, Bos taurus; identical to SEQ ID NO: 5089

SEQ ID NO: 46524 - DNA, 201 bp, Bos taurus; identical to SEQ ID NO: 5090

SEQ ID NO: 46525 - DNA, 201 bp, Bos taurus; identical to SEQ ID NO: 5091

SEQ ID NO: 46526 - DNA, 201 bp, Bos taurus; identical to SEQ ID NO: 5092

SEQ ID NO: 46527 - DNA, 201 bp, Bos taurus; identical to SEQ ID NO: 5093

SEQ ID NO: 46528 - DNA, 201 bp, Bos taurus; identical to SEQ ID NO: 5094

SEQ ID NO: 46529 - DNA, 201 bp, Bos taurus; identical to SEQ ID NO: 5095

SEQ ID NO: 46530 - DNA, 201 bp, Bos taurus; identical to SEQ ID NO: 5096

SEQ ID NO: 46531 - DNA, 201 bp, Bos taurus; identical to SEQ ID NO: 5097

SEQ ID NO: 46532 - DNA, 201 bp, Bos taurus; identical to SEQ ID NO: 5098

SEQ ID NO: 46533 - DNA, 201 bp, Bos taurus; identical to SEQ ID NO: 5099

SEQ ID NO: 46534 - DNA, 201 bp, Bos taurus; identical to SEQ ID NO: 5100

SEQ ID NO: 46535 - DNA, 201 bp, Bos taurus; identical to SEQ ID NO: 5101

SEQ ID NO: 46536 - DNA, 201 bp, Bos taurus; identical to SEQ ID NO: 5102

SEQ ID NO: 46537 - DNA, 201 bp, Bos taurus; identical to SEQ ID NO: 5103

SEQ ID NO: 46538 - DNA, 201 bp, Bos taurus; identical to SEQ ID NO: 5104

SEQ ID NO: 46539 - DNA, 201 bp, Bos taurus; identical to SEQ ID NO: 5105

SEQ ID NO: 46540 - DNA, 201 bp, Bos taurus; identical to SEQ ID NO: 5107

SEQ ID NO: 46541 - DNA, 201 bp, Bos taurus; identical to SEQ ID NO: 5108

SEQ ID NO: 46542 - DNA, 201 bp, Bos taurus; identical to SEQ ID NO: 5109

SEQ ID NO: 46543 - DNA, 201 bp, Bos taurus; identical to SEQ ID NO: 5110

SEQ ID NO: 46544 - DNA, 201 bp, Bos taurus; identical to SEQ ID NO: 5111

SEQ ID NO: 46545 - DNA, 201 bp, Bos taurus; identical to SEQ ID NO: 5112

SEQ ID NO: 46546 - DNA, 201 bp, Bos taurus; identical to SEQ ID NO: 5113

SEQ ID NO: 46547 - DNA, 201 bp, Bos taurus; identical to SEQ ID NO: 5114

SEQ ID NO: 46548 - DNA, 201 bp, Bos taurus; identical to SEQ ID NO: 5115

SEQ ID NO: 46549 - DNA, 201 bp, Bos taurus; identical to SEQ ID NO: 5116

SEQ ID NO: 46550 - DNA, 201 bp, Bos taurus; identical to SEQ ID NO: 5117

SEQ ID NO: 46551 - DNA, 201 bp, Bos taurus; identical to SEQ ID NO: 5119

SEQ ID NO: 46552 - DNA, 201 bp, Bos taurus; identical to SEQ ID NO: 5120

SEQ ID NO: 46553 - DNA, 201 bp, Bos taurus; identical to SEQ ID NO: 5122

SEQ ID NO: 46554 - DNA, 201 bp, Bos taurus; identical to SEQ ID NO: 5123

SEQ ID NO: 46555 - DNA, 201 bp, Bos taurus; identical to SEQ ID NO: 5124

SEQ ID NO: 46556 - DNA, 201 bp, Bos taurus; identical to SEQ ID NO: 5125

SEQ ID NO: 46557 - DNA, 201 bp, Bos taurus; identical to SEQ ID NO: 5126

SEQ ID NO: 46558 - DNA, 201 bp, Bos taurus; identical to SEQ ID NO: 5127

SEQ ID NO: 46559 - DNA, 201 bp, Bos taurus; identical to SEQ ID NO: 5128

SEQ ID NO: 46560 - DNA, 201 bp, Bos taurus; identical to SEQ ID NO: 5129

SEQ ID NO: 46561 - DNA, 201 bp, Bos taurus; identical to SEQ ID NO: 5130

SEQ ID NO: 46562 - DNA, 201 bp, Bos taurus; identical to SEQ ID NO: 5131

SEQ ID NO: 46563 - DNA, 201 bp, Bos taurus; identical to SEQ ID NO: 5132

SEQ ID NO: 46564 - DNA, 201 bp, Bos taurus; identical to SEQ ID NO: 5133

SEQ ID NO: 46565 - DNA, 201 bp, Bos taurus; identical to SEQ ID NO: 5134

SEQ ID NO: 46566 - DNA, 201 bp, Bos taurus; identical to SEQ ID NO: 5135

SEQ ID NO: 46567 - DNA, 201 bp, Bos taurus; identical to SEQ ID NO: 5136

SEQ ID NO: 46568 - DNA, 201 bp, Bos taurus; identical to SEQ ID NO: 5137

SEQ ID NO: 46569 - DNA, 201 bp, Bos taurus; identical to SEQ ID NO: 5138

SEQ ID NO: 46570 - DNA, 201 bp, Bos taurus; identical to SEQ ID NO: 5139

SEQ ID NO: 46571 - DNA, 201 bp, Bos taurus; identical to SEQ ID NO: 5140

SEQ ID NO: 46572 - DNA, 201 bp, Bos taurus; identical to SEQ ID NO: 5141

SEQ ID NO: 46573 - DNA, 201 bp, Bos taurus; identical to SEQ ID NO: 5142

SEQ ID NO: 46574 - DNA, 201 bp, Bos taurus; identical to SEQ ID NO: 5143

SEQ ID NO: 46575 - DNA, 201 bp, Bos taurus; identical to SEQ ID NO: 5144

SEQ ID NO: 46576 - DNA, 201 bp, Bos taurus; identical to SEQ ID NO: 5145

SEQ ID NO: 46577 - DNA, 201 bp, Bos taurus; identical to SEQ ID NO: 5146

SEQ ID NO: 46578 - DNA, 201 bp, Bos taurus; identical to SEQ ID NO: 5147

SEQ ID NO: 46579 - DNA, 201 bp, Bos taurus; identical to SEQ ID NO: 5149

SEQ ID NO: 46580 - DNA, 201 bp, Bos taurus; identical to SEQ ID NO: 5150

SEQ ID NO: 46581 - DNA, 201 bp, Bos taurus; identical to SEQ ID NO: 5151

SEQ ID NO: 46582 - DNA, 201 bp, Bos taurus; identical to SEQ ID NO: 5152

SEQ ID NO: 46583 - DNA, 201 bp, Bos taurus; identical to SEQ ID NO: 5153

SEQ ID NO: 46584 - DNA, 201 bp, Bos taurus; identical to SEQ ID NO: 5154

SEQ ID NO: 46585 - DNA, 201 bp, Bos taurus; identical to SEQ ID NO: 5155

SEQ ID NO: 46586 - DNA, 201 bp, Bos taurus; identical to SEQ ID NO: 5156

SEQ ID NO: 46587 - DNA, 201 bp, Bos taurus; identical to SEQ ID NO: 5158

SEQ ID NO: 46588 - DNA, 201 bp, Bos taurus; identical to SEQ ID NO: 5159

SEQ ID NO: 46589 - DNA, 201 bp, Bos taurus; identical to SEQ ID NO: 5160

SEQ ID NO: 46590 - DNA, 201 bp, Bos taurus; identical to SEQ ID NO: 5161

SEQ ID NO: 46591 - DNA, 201 bp, Bos taurus; identical to SEQ ID NO: 5162

SEQ ID NO: 46592 - DNA, 201 bp, Bos taurus; identical to SEQ ID NO: 5163

SEQ ID NO: 46593 - DNA, 201 bp, Bos taurus; identical to SEQ ID NO: 5164

SEQ ID NO: 46594 - DNA, 201 bp, Bos taurus; identical to SEQ ID NO: 5165

SEQ ID NO: 46595 - DNA, 201 bp, Bos taurus; identical to SEQ ID NO: 5166

SEQ ID NO: 46596 - DNA, 201 bp, Bos taurus; identical to SEQ ID NO: 5167

SEQ ID NO: 46597 - DNA, 201 bp, Bos taurus; identical to SEQ ID NO: 5168

SEQ ID NO: 46598 - DNA, 201 bp, Bos taurus; identical to SEQ ID NO: 5169

SEQ ID NO: 46599 - DNA, 201 bp, Bos taurus; identical to SEQ ID NO: 5170

SEQ ID NO: 46600 - DNA, 201 bp, Bos taurus; identical to SEQ ID NO: 5171

SEQ ID NO: 46601 - DNA, 201 bp, Bos taurus; identical to SEQ ID NO: 5172

SEQ ID NO: 46602 - DNA, 201 bp, Bos taurus; identical to SEQ ID NO: 5173

SEQ ID NO: 46603 - DNA, 201 bp, Bos taurus; identical to SEQ ID NO: 5174

SEQ ID NO: 46604 - DNA, 201 bp, Bos taurus; identical to SEQ ID NO: 5175

SEQ ID NO: 46605 - DNA, 201 bp, Bos taurus; identical to SEQ ID NO: 5176

SEQ ID NO: 46606 - DNA, 201 bp, Bos taurus; identical to SEQ ID NO: 5177

SEQ ID NO: 46607 - DNA, 201 bp, Bos taurus; identical to SEQ ID NO: 5178

SEQ ID NO: 46608 - DNA, 201 bp, Bos taurus; identical to SEQ ID NO: 5179

SEQ ID NO: 46609 - DNA, 201 bp, Bos taurus; identical to SEQ ID NO: 5180

SEQ ID NO: 46610 - DNA, 201 bp, Bos taurus; identical to SEQ ID NO: 5181

SEQ ID NO: 46611 - DNA, 201 bp, Bos taurus; identical to SEQ ID NO: 5183

SEQ ID NO: 46612 - DNA, 201 bp, Bos taurus; identical to SEQ ID NO: 5187

SEQ ID NO: 46613 - DNA, 201 bp, Bos taurus; identical to SEQ ID NO: 5192

SEQ ID NO: 46614 - DNA, 201 bp, Bos taurus; identical to SEQ ID NO: 5194

SEQ ID NO: 46615 - DNA, 201 bp, Bos taurus; identical to SEQ ID NO: 5195

SEQ ID NO: 46616 - DNA, 201 bp, Bos taurus; identical to SEQ ID NO: 5196

SEQ ID NO: 46617 - DNA, 201 bp, Bos taurus; identical to SEQ ID NO: 5197

SEQ ID NO: 46618 - DNA, 201 bp, Bos taurus; identical to SEQ ID NO: 5198

SEQ ID NO: 46619 - DNA, 201 bp, Bos taurus; identical to SEQ ID NO: 5199

SEQ ID NO: 46620 - DNA, 201 bp, Bos taurus; identical to SEQ ID NO: 5200

SEQ ID NO: 46621 - DNA, 201 bp, Bos taurus; identical to SEQ ID NO: 5202

SEQ ID NO: 46622 - DNA, 201 bp, Bos taurus; identical to SEQ ID NO: 5203

SEQ ID NO: 46623 - DNA, 201 bp, Bos taurus; identical to SEQ ID NO: 5204

SEQ ID NO: 46624 - DNA, 201 bp, Bos taurus; identical to SEQ ID NO: 5206

SEQ ID NO: 46625 - DNA, 201 bp, Bos taurus; identical to SEQ ID NO: 5208

SEQ ID NO: 46626 - DNA, 201 bp, Bos taurus; identical to SEQ ID NO: 5212

SEQ ID NO: 46627 - DNA, 201 bp, Bos taurus; identical to SEQ ID NO: 5213

SEQ ID NO: 46628 - DNA, 201 bp, Bos taurus; identical to SEQ ID NO: 5214

SEQ ID NO: 46629 - DNA, 201 bp, Bos taurus; identical to SEQ ID NO: 5215

SEQ ID NO: 46630 - DNA, 201 bp, Bos taurus; identical to SEQ ID NO: 5219

SEQ ID NO: 46631 - DNA, 201 bp, Bos taurus; identical to SEQ ID NO: 5220

SEQ ID NO: 46632 - DNA, 201 bp, Bos taurus; identical to SEQ ID NO: 5221

SEQ ID NO: 46633 - DNA, 201 bp, Bos taurus; identical to SEQ ID NO: 5222

SEQ ID NO: 46634 - DNA, 201 bp, Bos taurus; identical to SEQ ID NO: 5223

SEQ ID NO: 46635 - DNA, 201 bp, Bos taurus; identical to SEQ ID NO: 5227

SEQ ID NO: 46636 - DNA, 201 bp, Bos taurus; identical to SEQ ID NO: 5230

SEQ ID NO: 46637 - DNA, 201 bp, Bos taurus; identical to SEQ ID NO: 5234

SEQ ID NO: 46638 - DNA, 201 bp, Bos taurus; identical to SEQ ID NO: 5235

SEQ ID NO: 46639 - DNA, 201 bp, Bos taurus; identical to SEQ ID NO: 5237

SEQ ID NO: 46640 - DNA, 201 bp, Bos taurus; identical to SEQ ID NO: 5238

SEQ ID NO: 46641 - DNA, 201 bp, Bos taurus; identical to SEQ ID NO: 5239

SEQ ID NO: 46642 - DNA, 201 bp, Bos taurus; identical to SEQ ID NO: 5241

SEQ ID NO: 46643 - DNA, 201 bp, Bos taurus; identical to SEQ ID NO: 5242

SEQ ID NO: 46644 - DNA, 201 bp, Bos taurus; identical to SEQ ID NO: 5243

SEQ ID NO: 46645 - DNA, 201 bp, Bos taurus; identical to SEQ ID NO: 5244

SEQ ID NO: 46646 - DNA, 201 bp, Bos taurus; identical to SEQ ID NO: 5245

SEQ ID NO: 46647 - DNA, 201 bp, Bos taurus; identical to SEQ ID NO: 5246

SEQ ID NO: 46648 - DNA, 201 bp, Bos taurus
tggaaatgggcctcatctcctgtttttctactgcactcagactcatgtcggctgtcagcggggatcttcccctccatgtgacaccagggtgatggggagcggctgtttacaactgtctagtgctgttctgggtgggtgcaaatgcagaactgagccccacagctcccggaaaatgaaccctgtgtatgccaacctcattta

SEQ ID NO: 46649 - DNA, 201 bp, Bos taurus; identical to SEQ ID NO: 5248

SEQ ID NO: 46650 - DNA, 201 bp, Bos taurus; identical to SEQ ID NO: 5249

SEQ ID NO: 46651 - DNA, 201 bp, Bos taurus; identical to SEQ ID NO: 5250

SEQ ID NO: 46652 - DNA, 201 bp, Bos taurus; identical to SEQ ID NO: 5251

SEQ ID NO: 46653 - DNA, 201 bp, Bos taurus; identical to SEQ ID NO: 5252

SEQ ID NO: 46654 - DNA, 201 bp, Bos taurus; identical to SEQ ID NO: 5253

SEQ ID NO: 46655 - DNA, 201 bp, Bos taurus; identical to SEQ ID NO: 5254

SEQ ID NO: 46656 - DNA, 201 bp, Bos taurus; identical to SEQ ID NO: 5257

SEQ ID NO: 46657 - DNA, 201 bp, Bos taurus; identical to SEQ ID NO: 5258

SEQ ID NO: 46658 - DNA, 201 bp, Bos taurus; identical to SEQ ID NO: 5259

SEQ ID NO: 46659 - DNA, 201 bp, Bos taurus; identical to SEQ ID NO: 5260

SEQ ID NO: 46660 - DNA, 201 bp, Bos taurus; identical to SEQ ID NO: 5261

SEQ ID NO: 46661 - DNA, 201 bp, Bos taurus; identical to SEQ ID NO: 5262

SEQ ID NO: 46662 - DNA, 201 bp, Bos taurus; identical to SEQ ID NO: 5263

SEQ ID NO: 46663 - DNA, 201 bp, Bos taurus; identical to SEQ ID NO: 5264

SEQ ID NO: 46664 - DNA, 201 bp, Bos taurus; identical to SEQ ID NO: 5265

SEQ ID NO: 46665 - DNA, 201 bp, Bos taurus; identical to SEQ ID NO: 5266

SEQ ID NO: 46666 - DNA, 201 bp, Bos taurus; identical to SEQ ID NO: 5267

SEQ ID NO: 46667 - DNA, 201 bp, Bos taurus; identical to SEQ ID NO: 5268

SEQ ID NO: 46668 - DNA, 201 bp, Bos taurus; identical to SEQ ID NO: 5269

SEQ ID NO: 46669 - DNA, 201 bp, Bos taurus; identical to SEQ ID NO: 5270

SEQ ID NO: 46670 - DNA, 201 bp, Bos taurus; identical to SEQ ID NO: 5271

SEQ ID NO: 46671 - DNA, 201 bp, Bos taurus; identical to SEQ ID NO: 5272

SEQ ID NO: 46672 - DNA, 201 bp, Bos taurus; identical to SEQ ID NO: 5273

SEQ ID NO: 46673 - DNA, 201 bp, Bos taurus; identical to SEQ ID NO: 5274

SEQ ID NO: 46674 - DNA, 201 bp, Bos taurus; identical to SEQ ID NO: 5275

SEQ ID NO: 46675 - DNA, 201 bp, Bos taurus; identical to SEQ ID NO: 5276

SEQ ID NO: 46676 - DNA, 201 bp, Bos taurus; identical to SEQ ID NO: 5277

SEQ ID NO: 46677 - DNA, 201 bp, Bos taurus; identical to SEQ ID NO: 5278

SEQ ID NO: 46678 - DNA, 201 bp, Bos taurus; identical to SEQ ID NO: 5279

SEQ ID NO: 46679 - DNA, 201 bp, Bos taurus; identical to SEQ ID NO: 5280

SEQ ID NO: 46680 - DNA, 201 bp, Bos taurus; identical to SEQ ID NO: 5281

SEQ ID NO: 46681 - DNA, 201 bp, Bos taurus; identical to SEQ ID NO: 5282

SEQ ID NO: 46682 - DNA, 201 bp, Bos taurus; identical to SEQ ID NO: 5283

SEQ ID NO: 46683 - DNA, 201 bp, Bos taurus; identical to SEQ ID NO: 5284

SEQ ID NO: 46684 - DNA, 201 bp, Bos taurus; identical to SEQ ID NO: 5285

SEQ ID NO: 46685 - DNA, 201 bp, Bos taurus; identical to SEQ ID NO: 5286

SEQ ID NO: 46686 - DNA, 201 bp, Bos taurus; identical to SEQ ID NO: 5287

SEQ ID NO: 46687 - DNA, 201 bp, Bos taurus; identical to SEQ ID NO: 5289

SEQ ID NO: 46688 - DNA, 201 bp, Bos taurus; identical to SEQ ID NO: 5290

SEQ ID NO: 46689 - DNA, 201 bp, Bos taurus
caataactatatcacaatccccagatcctactcagactttaccaactgttccacttttggccttttctgattattttgctaagttttaaattatagaaagcattctgttgttcatctcttggacaacattggatggacaatggattgcactcgattttagcaattatgaacaatgctgttaagaatattcttgtcctgaac

SEQ ID NO: 46690 - DNA, 201 bp, Bos taurus
caaccacttgattctgtattcatggaaatgatgacatctttttcattcaatctcttaatgtcaagctttctgtctattaccatggccaaagttaaacccataatgcaaccctggactaggatcgctgatctctaccctcagattcaatactgaatccattttgatgacatttaatttatgatttgggccagaatagtcaca

SEQ ID NO: 46691 - DNA, 201 bp, Bos taurus; identical to SEQ ID NO: 5292

SEQ ID NO: 46692 - DNA, 201 bp, Bos taurus; identical to SEQ ID NO: 5293

SEQ ID NO: 46693 - DNA, 201 bp, Bos taurus
cccacgccaccgtggggccaaagctgcggagatgtggtataaaacggtactggggctcccccagctggtgccactgagcacagaggtatgcttgggaggattctggtgggtgtgaggaatgcctgtgcctctactcaaagacactgtgttccacctggtgccacaagattcccaccttgacacatgcccccagtcaacatg

SEQ ID NO: 46694 - DNA, 201 bp, Bos taurus; identical to SEQ ID NO: 5294

SEQ ID NO: 46695 - DNA, 201 bp, Bos taurus
ggccaggcaacatttcacagtaccagaggctgaggaggaaaagtcttggcacggcagtacatggtgggcagttcctatgggcattagttgaggggtccattggccttgctcattcccagacaggatgaatgagtcagatgtgatgagggccaagccaagtagcccaccggagacttcacaatggccagtggcaggtaggtc

SEQ ID NO: 46696 - DNA, 201 bp, Bos taurus; identical to SEQ ID NO: 5295

SEQ ID NO: 46697 - DNA, 201 bp, Bos taurus; identical to SEQ ID NO: 5296

SEQ ID NO: 46698 - DNA, 201 bp, Bos taurus; identical to SEQ ID NO: 5297

SEQ ID NO: 46699 - DNA, 201 bp, Bos taurus
tctccactaaggccatactgggcaagaccacaaacaaatgcaaaggctaaagctttttgacagtccctcaacaacacagaaagctgtaccagcactgaaagccagtggtgtacaggcctagatggcaaagcaacaggagcaggaccccacaaatttatacatctcaaacttcccattgtcgatggatgagcaaacactgga

SEQ ID NO: 46700 - DNA, 201 bp, Bos taurus
aggagcctggtggactagagctccatggggtcgtaaagagtcagacatgactgagcacagcacagcttttttgtagcccagtttctggggccactggcttttgactggagtaatgttgacctaaaacaaatagactgccagctatttctccagcaaagatgggtttatttgggatcaacagagaattgaaattcagggtct

SEQ ID NO: 46701 - DNA, 201 bp, Bos taurus; identical to SEQ ID NO: 5298

SEQ ID NO: 46702 - DNA, 201 bp, Bos taurus; identical to SEQ ID NO: 5299

SEQ ID NO: 46703 - DNA, 201 bp, Bos taurus; identical to SEQ ID NO: 5300

SEQ ID NO: 46704 - DNA, 201 bp, Bos taurus
aatgccttgtctgaggtctccctgcgggccaggtagggcccagaggccagctggagcctgggtctcttccacacctcatacaccatccagcttcaactcactgcacacccactattggccatctaaagtcactttgcaaactgattcaacagccactctttgtgcactcattctgccctgtccagaatttatcattacact

SEQ ID NO: 46705 - DNA, 201 bp, Bos taurus; identical to SEQ ID NO: 5301

SEQ ID NO: 46706 - DNA, 201 bp, Bos taurus; identical to SEQ ID NO: 5302

SEQ ID NO: 46707 - DNA, 201 bp, Bos taurus
tgatcggtagtttcagccttctggttgggtctgtcccaaagactgccctttgggcaagtgtgtgacttctttcggaatccgggccccttctgtgatcggcgggacctgaggagtagttcactgtggctgcgcagggagcagatctcctagagctgggggttatttttcaggttgcttggagtatcctttcttggccccaca

SEQ ID NO: 46708 - DNA, 201 bp, Bos taurus
gaagcacccccagcctcctactcagacagccctctggcccagaagccgctcattaaagctgctcattaaagccactcagcagagaataacgtgggatatgggagatggggcaatcgtgctgagggccagggggagcttgtgtgtcccatgagctggggttccccctcacgaggaccccaggggcaaagacacgaccctggg

SEQ ID NO: 46709 - DNA, 201 bp, Bos taurus; identical to SEQ ID NO: 5303

SEQ ID NO: 46710 - DNA, 201 bp, Bos taurus
gaagaacgtgggagtgagatgggccggcgcgcacaaaggctaggagcgtgaggacaggtggggcctgcacacggcgcagccgctgtcctcagggacatgcagagagaaggggctgagcttgtgcagcgactgccacggagctgagtgacaacagggtccagatgccagccgcactgggcagcggccaagctccacaccctc

SEQ ID NO: 46711 - DNA, 201 bp, Bos taurus; identical to SEQ ID NO: 5304

SEQ ID NO: 46712 - DNA, 201 bp, Bos taurus; identical to SEQ ID NO: 5305

SEQ ID NO: 46713 - DNA, 201 bp, Bos taurus; identical to SEQ ID NO: 5306

SEQ ID NO: 46714 - DNA, 201 bp, Bos taurus; identical to SEQ ID NO: 5307

SEQ ID NO: 46715 - DNA, 201 bp, Bos taurus
tggaggaggagaagggggccccctctgaggaggtggcagagatgccaacagaggcttgaacaaagcgcagacaaaggtgaccatgggtgggtgttcggtgtggcaggaggggcagaggccctgggcctggtgagctggatgtgttggaggaccgaggcagttgtaactggagtgggtgcaagcggggagacggggctaggc

SEQ ID NO: 46716 - DNA, 201 bp, Bos taurus; identical to SEQ ID NO: 5308

SEQ ID NO: 46717 - DNA, 201 bp, Bos taurus
tgctggggaagggtgctagcagtcatggccccacaggagcggttagtgttgcctggcttgaagggagacctgcgtccttcctggcaggtgcaccctgaccctggtctctcctcaggccaaggccttcaccctctgcctctggccctgcacgtgggggtgagaatggggtgaaggctgatactcgacacgacggaacaatgg

SEQ ID NO: 46718 - DNA, 201 bp, Bos taurus; identical to SEQ ID NO: 5309

SEQ ID NO: 46719 - DNA, 201 bp, Bos taurus
acagctttgttgcgggacgtgaggcaggaggtgctgtgcttggcacacctttctccgtctcatggctggagggcgggaggaacagagagtcacagcacacgcaggcctagagtggccggtgacataattagagatgaggtgaggcccaggccagatctcctgggggtgctgttagagctcgttccagcgtgttccctgacc

SEQ ID NO: 46720 - DNA, 201 bp, Bos taurus; identical to SEQ ID NO: 5310

SEQ ID NO: 46721 - DNA, 201 bp, Bos taurus; identical to SEQ ID NO: 5311

SEQ ID NO: 46722 - DNA, 201 bp, Bos taurus; identical to SEQ ID NO: 5312

SEQ ID NO: 46723 - DNA, 201 bp, Bos taurus; identical to SEQ ID NO: 5314

SEQ ID NO: 46724 - DNA, 201 bp, Bos taurus; identical to SEQ ID NO: 5315

SEQ ID NO: 46725 - DNA, 201 bp, Bos taurus; identical to SEQ ID NO: 5316

SEQ ID NO: 46726 - DNA, 201 bp, Bos taurus
acacccaactcatcaccccacccccgaggccccacatcagtttcccaccaactcacctcctcgaactccattcccgcctcccctcactgtccatctaaccgaccagcttgatcctacctcagggcctgtgcatgttctgttccctctgcctggcatgctacttccctagctctcccatggccagctccttttcctctttcc

SEQ ID NO: 46727 - DNA, 201 bp, Bos taurus; identical to SEQ ID NO: 5317

SEQ ID NO: 46728 - DNA, 201 bp, Bos taurus; identical to SEQ ID NO: 5318

SEQ ID NO: 46729 - DNA, 201 bp, Bos taurus
gcgggcggaggggcgggacgttgccagggccgcgggcggaggggcgggacattgccagggttgcaggcggcaggggcggggcgttggcggtacctggatgcagggccttggaacttggctctcttccagcaaaatgtaaatacgacagcttctccctctacccattccctaggcattaagcccttcgggagggagtgtggc

SEQ ID NO: 46730 - DNA, 201 bp, Bos taurus; identical to SEQ ID NO: 5319

SEQ ID NO: 46731 - DNA, 201 bp, Bos taurus; identical to SEQ ID NO: 5321

SEQ ID NO: 46732 - DNA, 201 bp, Bos taurus
cacacagaaattgccagggggctgctactcagcaactcatgtctcggatgctcttctctgtcttgatctcagaagagggccagcagcaactggccttcacatgggaaggatcccaccattctttttctgcactgctaagggatccgtgaactcagtcgtaatctgctcagaagcgacgtggcctcgaggcagatccccagg

SEQ ID NO: 46733 - DNA, 201 bp, Bos taurus; identical to SEQ ID NO: 5322

SEQ ID NO: 46734 - DNA, 201 bp, Bos taurus
gcagcagtgtggataagcccacctcacaggaggtagcttcccagctccagggctatgttcagcgtctccaggaacgccgtgctctggtgaagattccctctgagcctggctccacctgggtgcccatatctaccgtgccccatgcagaagccatggtgcaggccattctggggacccagcctggcccagccctaccccggt

SEQ ID NO: 46735 - DNA, 201 bp, Bos taurus; identical to SEQ ID NO: 5323

SEQ ID NO: 46736 - DNA, 201 bp, Bos taurus
gcccacatccccccaaacagatgatgcacaaggttggcctctctgtgtgcagaaatgcggccaccagatgccgctgcgtctgggtgtttctgattcaagcggttgccgggttccttattcaggtcaaccctgacctgggttcagggtgtcgggtttctggcgccattttaaacaacgccgctgcctacaggctccagctgg

SEQ ID NO: 46737 - DNA, 201 bp, Bos taurus
tctgacatacaagatgcgcacgagagggcctgagttgcctaagctgactggtttcctcgcaaagatgtggcaaggacacagagaagtgggaccaggaagcacggagggcagaaggggccagcggagtcacaggctcagaggggctgcgtgggagggacagaaaagcgagctccttgaggatgggcgtggatggggtgggag

SEQ ID NO: 46738 - DNA, 201 bp, Bos taurus
catcagctcactgaggcgctcagctgacttctctggcttttacgcatgccttccgcacagagtccaaacacagcctaaaacctggaagccagtcacactgtagcttaaggtcttgttccaagtgcctgtgaaacctgcaccccaggaagccccagactgtgtctggaatgaaaggaagcaggtctggggctgaggaactgg

SEQ ID NO: 46739 - DNA, 201 bp, Bos taurus
tcctgactgcagtgggttagctcacatgatcagaggccaccaggaggtagagaagagaagttagtctagctccagcctctgagactgcaggaagagattccacatggcaggcccggcacacacagccctcagccttccccaagagacggacagacacatatcatctcttgctgccttgtgaggaagacatggtctctgctc

SEQ ID NO: 46740 - DNA, 201 bp, Bos taurus
ttccaagatgtggttgaatgagggaggtggaatattggcccctgggcatccctcagccatccctctccgggaacctggagcctcctgtgtgcatgcctccagagaacttggcctggagtgggtctgtaagcagtctctaaaccccaaaccacaaaggcaattgtaaattccagtgcagaaaggcacaataaaggccttaaa

SEQ ID NO: 46741 - DNA, 201 bp, Bos taurus; identical to SEQ ID NO: 5324

SEQ ID NO: 46742 - DNA, 201 bp, Bos taurus; identical to SEQ ID NO: 5326

SEQ ID NO: 46743 - DNA, 201 bp, Bos taurus; identical to SEQ ID NO: 5327

SEQ ID NO: 46744 - DNA, 201 bp, Bos taurus; identical to SEQ ID NO: 5328

SEQ ID NO: 46745 - DNA, 201 bp, Bos taurus; identical to SEQ ID NO: 5329

SEQ ID NO: 46746 - DNA, 201 bp, Bos taurus; identical to SEQ ID NO: 5330

SEQ ID NO: 46747 - DNA, 201 bp, Bos taurus; identical to SEQ ID NO: 5331

SEQ ID NO: 46748 - DNA, 201 bp, Bos taurus
cagcagccaggtgagttaggtgtgtcctggtgctgtgctccacagtggaagggagaaagctcaggttggagacacatcatctgggcctgctactcaccatgtttccaagaatcaaaggctacagcagacagttcccagacatatccagacctgctgccaacagctcaactgtagccaggtatggatttccagactctgaag

SEQ ID NO: 46749 - DNA, 201 bp, Bos taurus; identical to SEQ ID NO: 5332

SEQ ID NO: 46750 - DNA, 201 bp, Bos taurus
caggaaaatattgaaaaacattgactgtggcttcggattcagccaagtgtgactttgctgggctaagtcgcctcccctctctgtgcctcggccttcctttcctgtaaaatgggaaagcccttgggaactcccaagggcactatgagcagtacggagacgctgctagtgggctttgtgctccagcggctaagactccacagc

SEQ ID NO: 46751 - DNA, 201 bp, Bos taurus; identical to SEQ ID NO: 5333

SEQ ID NO: 46752 - DNA, 201 bp, Bos taurus; identical to SEQ ID NO: 5334

SEQ ID NO: 46753 - DNA, 201 bp, Bos taurus; identical to SEQ ID NO: 5335

SEQ ID NO: 46754 - DNA, 201 bp, Bos taurus
tgtctgagactatgtgatctacgtgatccagactttgcaaggagcaagctgagttacagaggcagaacgagcaggaggttatgtaaaatttcaacttttcttcttcaatatattgatgttgcaatatgattagcactgcatgttaactcacacctctggtgtgtgtgtgtgtgaacaattatgatgtagtgtcttatcagc

SEQ ID NO: 46755 - DNA, 201 bp, Bos taurus; identical to SEQ ID NO: 5336

SEQ ID NO: 46756 - DNA, 201 bp, Bos taurus; identical to SEQ ID NO: 5337

SEQ ID NO: 46757 - DNA, 201 bp, Bos taurus; identical to SEQ ID NO: 5338

SEQ ID NO: 46758 - DNA, 201 bp, Bos taurus; identical to SEQ ID NO: 5339

SEQ ID NO: 46759 - DNA, 201 bp, Bos taurus
actatggttatggctatggctatggccaggataacaccaccaactatgggtatggtatggccacttcaaactcttgggaaatgcctaactctgacacaaatgcaaaccctagtgccatgggtagtgccagtgctgattccgttttgtccagaattaaccaacgcttagatatggtgccgcatttggagacggacatgatac

SEQ ID NO: 46760 - DNA, 201 bp, Bos taurus; identical to SEQ ID NO: 5340

SEQ ID NO: 46761 - DNA, 201 bp, Bos taurus; identical to SEQ ID NO: 5341

SEQ ID NO: 46762 - DNA, 201 bp, Bos taurus; identical to SEQ ID NO: 5342

SEQ ID NO: 46763 - DNA, 201 bp, Bos taurus
tatagcatttaaaaaaacatacatttcttgatacaaaaaggccagttagagttccttctgagctatgatactactaaatgatttctcaactttggccctattgacatttgagactgtgtcattctctgctgtgggggctgtcacatgcattatacgatgttgagtaacatatctggcctaattatcagtagaaatagcaat

SEQ ID NO: 46764 - DNA, 201 bp, Bos taurus; identical to SEQ ID NO: 5343

SEQ ID NO: 46765 - DNA, 201 bp, Bos taurus; identical to SEQ ID NO: 5344

SEQ ID NO: 46766 - DNA, 201 bp, Bos taurus; identical to SEQ ID NO: 5345

SEQ ID NO: 46767 - DNA, 201 bp, Bos taurus; identical to SEQ ID NO: 5346

SEQ ID NO: 46768 - DNA, 201 bp, Bos taurus; identical to SEQ ID NO: 5348

SEQ ID NO: 46769 - DNA, 201 bp, Bos taurus; identical to SEQ ID NO: 5349

SEQ ID NO: 46770 - DNA, 201 bp, Bos taurus; identical to SEQ ID NO: 5350

SEQ ID NO: 46771 - DNA, 201 bp, Bos taurus; identical to SEQ ID NO: 5351

SEQ ID NO: 46772 - DNA, 201 bp, Bos taurus; identical to SEQ ID NO: 5353

SEQ ID NO: 46773 - DNA, 201 bp, Bos taurus
agggggcagctgggctctgtttcacacggtcatgcagggacccagggtccatgcttcctgtggctctgccaccctcaagtcctccactgggccaattacactttgatgctggacagaagaagagaatgagcgtggaggatcttgcaggaagttttaggaacctggccctggagtggcttatgtcgtttcctctcccatccc

SEQ ID NO: 46774 - DNA, 201 bp, Bos taurus; identical to SEQ ID NO: 5355

SEQ ID NO: 46775 - DNA, 201 bp, Bos taurus; identical to SEQ ID NO: 5359

SEQ ID NO: 46776 - DNA, 201 bp, Bos taurus; identical to SEQ ID NO: 5360

SEQ ID NO: 46777 - DNA, 201 bp, Bos taurus
atgtgggtgagttatatactttgttcatcttgaaataggctgggacctgggatgtaagactttgatgcagggcttgcacttggacaaatgtctcctccagtaataaagtatgaagaaaatataatgggctaaaaataactgagtgtttttgtgcctgtgctcagttgctcagttgtgtctatttgtgaccccatggattgt

SEQ ID NO: 46778 - DNA, 201 bp, Bos taurus; identical to SEQ ID NO: 5363

SEQ ID NO: 46779 - DNA, 201 bp, Bos taurus; identical to SEQ ID NO: 5364

SEQ ID NO: 46780 - DNA, 201 bp, Bos taurus; identical to SEQ ID NO: 5365

SEQ ID NO: 46781 - DNA, 201 bp, Bos taurus; identical to SEQ ID NO: 5366

SEQ ID NO: 46782 - DNA, 201 bp, Bos taurus
attctcaaaaaacatcagaggtatatagggcaccctcaggcctgtggaggcgaaggagtgctggctggatgaggacagccagcagggggagccctcttgtatggaggatggtcggggctggccagggctgggaggcacagcaggactggatccaaagcccagtggtcaaggtcaatgtccagcactcagggccagactccc

SEQ ID NO: 46783 - DNA, 201 bp, Bos taurus; identical to SEQ ID NO: 5368

SEQ ID NO: 46784 - DNA, 201 bp, Bos taurus; identical to SEQ ID NO: 5369

SEQ ID NO: 46785 - DNA, 201 bp, Bos taurus; identical to SEQ ID NO: 5370

SEQ ID NO: 46786 - DNA, 201 bp, Bos taurus; identical to SEQ ID NO: 5371

SEQ ID NO: 46787 - DNA, 201 bp, Bos taurus; identical to SEQ ID NO: 5372

SEQ ID NO: 46788 - DNA, 201 bp, Bos taurus
aagccctgcccccaaagccaagattccatttttcctcccatatttacatctttatttcttagtataagcaaagtccactccaagcacggctctgggcctgtactccaatcctgaccacttgggggctgtgggaccttgagcacattccttctgggttttgtgcctcagtttccccatctgtaaaatgggccccatggcaac

SEQ ID NO: 46789 - DNA, 201 bp, Bos taurus; identical to SEQ ID NO: 5373

SEQ ID NO: 46790 - DNA, 201 bp, Bos taurus; identical to SEQ ID NO: 5374

SEQ ID NO: 46791 - DNA, 201 bp, Bos taurus; identical to SEQ ID NO: 5377

SEQ ID NO: 46792 - DNA, 201 bp, Bos taurus
ccaagagccctttcaactaggtctccaggtctgcctcctgcctagtcccccagaacccctggcctcagtcccatgggcccattggaattgcttttcctagtcccccagtccccaggaactctgagctgacccctcctcaagctcccttcagttccccaccctctgatcctagctgtagacctgggggctccgaggggccgg

SEQ ID NO: 46793 - DNA, 201 bp, Bos taurus; identical to SEQ ID NO: 5380

SEQ ID NO: 46794 - DNA, 201 bp, Bos taurus; identical to SEQ ID NO: 5381

SEQ ID NO: 46795 - DNA, 201 bp, Bos taurus; identical to SEQ ID NO: 5382

SEQ ID NO: 46796 - DNA, 201 bp, Bos taurus; identical to SEQ ID NO: 5383

SEQ ID NO: 46797 - DNA, 201 bp, Bos taurus; identical to SEQ ID NO: 5384

SEQ ID NO: 46798 - DNA, 201 bp, Bos taurus
tgcctgggctggaggcagctggcaatgccctggtgttcagaaagacagaaactgcctgacccttgctgcacggccagagcgcttctcaggccaagagatgccgagcggaggagccgattctgtgattcctgagtgaagctgttttcagattgattttgcacactcttgtacacgaggatgatgaacagacagatgtggtcc

SEQ ID NO: 46799 - DNA, 201 bp, Bos taurus
caggatgactttcttccccctcacttgcttcctcctaccttggcatcctcctggcccatccccctgagattctctcagtcaccatgtctagtgccctgctatgaccttggtcctcagctcccccagccttcccaccacctctgctgtggtctccatccttagagagccagttctggcacattccaagctcccactttccct

SEQ ID NO: 46800 - DNA, 201 bp, Bos taurus
gctacaggccatggggtcgcagagagctggacacaactgaagcaacttggtgtgcgtgcatgtgagggacatcactcttgatcctagagtgttgatttgcgggctggcctcagtttcccctctgctcctgggacacagacgtctcagctgtcctcctctgccaccctcagagccggtggggggcgatcctactcaagcagt

SEQ ID NO: 46801 - DNA, 201 bp, Bos taurus
cttcatcatcagaataagagagtgccagtttcctcagagcctcaccaacaggaggtgttatcaaaccttttgatctttgccaatctgatcggttaaacatcgcattgtggtgtagttttaatgttcacttcccttatgaagttgagaatcttctcttgtgactaagaaccatttgtttctcttcctctgtgagctcaaagt

SEQ ID NO: 46802 - DNA, 201 bp, Bos taurus
gtatgtgagacagcccagccaagatcagcaaagctgacatgcaactgcccagaaacacatggagaccagcccagtggaaaccgaaagaactgaccagcagagcccaatctaaactgccaacacatggaatgcagagagctaaataaatggttgttgttttagtcactaactctcagggtgattttgttactcagcaatagc

SEQ ID NO: 46803 - DNA, 201 bp, Bos taurus; identical to SEQ ID NO: 5386

SEQ ID NO: 46804 - DNA, 201 bp, Bos taurus; identical to SEQ ID NO: 5387

SEQ ID NO: 46805 - DNA, 201 bp, Bos taurus; identical to SEQ ID NO: 5388

SEQ ID NO: 46806 - DNA, 201 bp, Bos taurus; identical to SEQ ID NO: 5389

SEQ ID NO: 46807 - DNA, 201 bp, Bos taurus; identical to SEQ ID NO: 5390

SEQ ID NO: 46808 - DNA, 201 bp, Bos taurus
ctttcacttagccacgtgcatttaagcccctccgcgtctcatcatggccgggtagctcatttctttttagcactgaatcacattccattgtttgaatgtttcacacttttgtttctttttacctgctgaaggatgtctgagttgcttccaagctttggcaattatgaacaaagcttccataagcattcacgtgcaggtttt

SEQ ID NO: 46809 - DNA, 201 bp, Bos taurus
tcctcaccaacatcagcgcttgattttactacccccattcctacctcctccgcaacgggctcatctgtacctcaccccacatcaggccaagtcctacacatttactgcagggactatgtgctcacagagagcccgcccaactaaaggaagggacttgcaacgtgtggtcactggcccctgtgttctctctgttcaagggac

SEQ ID NO: 46810 - DNA, 201 bp, Bos taurus; identical to SEQ ID NO: 5391

SEQ ID NO: 46811 - DNA, 201 bp, Bos taurus; identical to SEQ ID NO: 5392

SEQ ID NO: 46812 - DNA, 201 bp, Bos taurus
tggaacagtttcctgctggtgatgcggggccaacacctgggtgtgctgacacccaggaccacagcctcgctgggtcttaggcgatggaacttcacctctgggggcccgacccaccaaccttgaaaagattgttctaggcagcccggtgccttcttgcgagtcggtggcggggatggctgagaactcaactctgggaactcg

SEQ ID NO: 46813 - DNA, 201 bp, Bos taurus; identical to SEQ ID NO: 5397

SEQ ID NO: 46814 - DNA, 201 bp, Bos taurus; identical to SEQ ID NO: 5398

SEQ ID NO: 46815 - DNA, 201 bp, Bos taurus; identical to SEQ ID NO: 5399

SEQ ID NO: 46816 - DNA, 201 bp, Bos taurus; identical to SEQ ID NO: 5400

SEQ ID NO: 46817 - DNA, 201 bp, Bos taurus
gggaaggtgtctatggctttgggctctggctcccaggagtatgaagggaggatgccctgccctgcccactcctgacccgccctcagcagccaaatttgccaccaaagggcctttgcacatgccattgtcttttctgggatccagccctccccttacccaatcctcctccctcaggctagctttgactaagccatcctgcat

SEQ ID NO: 46818 - DNA, 201 bp, Bos taurus; identical to SEQ ID NO: 5401

SEQ ID NO: 46819 - DNA, 201 bp, Bos taurus
tcacccttaatcctgtacacattaagcagtcctttaattcccccttcccagcccctggcaaccactaatccactttctgtctctgtggatttgcctgttcgggatatttcatatcaatggaataatcgactatgccatcttctgtatctggcttctctcactgagcatcatttttccaggatcatctgcatggtggtgcat

SEQ ID NO: 46820 - DNA, 201 bp, Bos taurus; identical to SEQ ID NO: 5402

SEQ ID NO: 46821 - DNA, 201 bp, Bos taurus; identical to SEQ ID NO: 5403

SEQ ID NO: 46822 - DNA, 201 bp, Bos taurus; identical to SEQ ID NO: 5405

SEQ ID NO: 46823 - DNA, 201 bp, Bos taurus; identical to SEQ ID NO: 5406

SEQ ID NO: 46824 - DNA, 201 bp, Bos taurus; identical to SEQ ID NO: 5407

SEQ ID NO: 46825 - DNA, 201 bp, Bos taurus; identical to SEQ ID NO: 5408

SEQ ID NO: 46826 - DNA, 201 bp, Bos taurus; identical to SEQ ID NO: 5409

SEQ ID NO: 46827 - DNA, 201 bp, Bos taurus
gcggtggatctcattacctacccccacccctgctccgcatggatgctgcctccattgcgtgggcagagaatgactcatatctggcctctgacacactcttccccatttgaacaccacccagaaggaagtggggagacaatcccattctacttcccttgacagggctccatgaaggtgagcacttggccaggtgcttctctg

SEQ ID NO: 46828 - DNA, 201 bp, Bos taurus; identical to SEQ ID NO: 5410

SEQ ID NO: 46829 - DNA, 201 bp, Bos taurus
cagcctgattcttccactcctgtctgaacaccaatctctcccaggtctaatccagggtcacctccagcactgcttacactggagccacatcactcaagggaacattcctagacaccatggggtggccctggccccatctacctgaggccagcagtaacaccccctcccctcacccctcgggtgctaacagctggtccactg

SEQ ID NO: 46830 - DNA, 201 bp, Bos taurus
tcctacggccaccatgtgcgtcgtctgtcggtccgtctgtccgtcggtggctctggctcccgacctggggcagcgccgggccgtgtgggcaaggggctaacgctgtgctgccttttttcccacgcgtgtccgcaggtaactaggatttctacctcaaccgcgagactatgcaagggtgggctgggccggcggcgcggggcc

SEQ ID NO: 46831 - DNA, 201 bp, Bos taurus
tttggttcatttctgtaactcgcccaccttcccttctttggctacatctaggttttgcatcgtgttagacactctggccagttccgctggtcacaacagtggtgaactcttggtctgatctttagtttctctttgaaagagtagctggtcggcctgcatttcggaccccagggcatggcaaagcaaatatgtgaaaggagt

SEQ ID NO: 46832 - DNA, 201 bp, Bos taurus
ttgaggccagaagaggccagggtccattggtgtctcccagctgcctggctctgcctcttctcactcccagcagaaacaccttacacaacccacatagctatgtcttatgtccaggccagccttttggctcttccttccacatgttatttctgaggccactaagaagggatggttcttggggttacggacagtaagggatgg

SEQ ID NO: 46833 - DNA, 201 bp, Bos taurus
agatagtttctaaggtcatatgtcgaaaagtggcaaatgtgtagattcacgttgaggtctttctactctgggacctttgttcttttgctgtaactatactaccttctccaatttaatgtccgcattaagtaattaacaaacataaatttcttaggattagctaaaatgttcgattttacatttatctcattggctctagaa

SEQ ID NO: 46834 - DNA, 201 bp, Bos taurus
agttataatactttacaagagaacaaaaccatcctgaataaatacattacaggactccaatgggagattcaatattaaaaacattttccctcaagtaatctgtaaattaaatgcaatccaaacaaaactcccaacaagattaaataattttttaaataaaacccacaagatgactctaaaattcatatatgagagataatg

SEQ ID NO: 46835 - DNA, 201 bp, Bos taurus
ggggcaaagtaaacctgaatggaagtgatgagtgctcatctgcagcaactcagctgtgagttgcctgcatgctggcccaaggcagaaacaggcccctgacgtccacacaggggtattctcctgcccagggcagttctttctccttcagctcattaacactcttttgctggcagaaacctcttccccttcgtctcaaggcct

SEQ ID NO: 46836 - DNA, 201 bp, Bos taurus; identical to SEQ ID NO: 5411

SEQ ID NO: 46837 - DNA, 201 bp, Bos taurus; identical to SEQ ID NO: 5412

SEQ ID NO: 46838 - DNA, 201 bp, Bos taurus; identical to SEQ ID NO: 5413

SEQ ID NO: 46839 - DNA, 201 bp, Bos taurus; identical to SEQ ID NO: 5414

SEQ ID NO: 46840 - DNA, 201 bp, Bos taurus; identical to SEQ ID NO: 5415

SEQ ID NO: 46841 - DNA, 201 bp, Bos taurus; identical to SEQ ID NO: 5416

SEQ ID NO: 46842 - DNA, 201 bp, Bos taurus; identical to SEQ ID NO: 5417

SEQ ID NO: 46843 - DNA, 201 bp, Bos taurus; identical to SEQ ID NO: 5418

SEQ ID NO: 46844 - DNA, 201 bp, Bos taurus; identical to SEQ ID NO: 5419

SEQ ID NO: 46845 - DNA, 201 bp, Bos taurus; identical to SEQ ID NO: 5420

SEQ ID NO: 46846 - DNA, 201 bp, Bos taurus; identical to SEQ ID NO: 5421

SEQ ID NO: 46847 - DNA, 201 bp, Bos taurus; identical to SEQ ID NO: 5422

SEQ ID NO: 46848 - DNA, 201 bp, Bos taurus; identical to SEQ ID NO: 5423

SEQ ID NO: 46849 - DNA, 201 bp, Bos taurus
ccatctttattcacgtcactgaatgttttgtgcccttcgatggcttaaatgaatactacttactctgcattttctgctgaagtggcccctcagccttctacactctatttacattgagggtcaggttgggacaagacgggtagtcttctcgtttaacattgtcatttcttgccagatcacggcccatgcctcatgttaaaa

SEQ ID NO: 46850 - DNA, 201 bp, Bos taurus; identical to SEQ ID NO: 5424

SEQ ID NO: 46851 - DNA, 201 bp, Bos taurus; identical to SEQ ID NO: 5425

SEQ ID NO: 46852 - DNA, 201 bp, Bos taurus; identical to SEQ ID NO: 5426

SEQ ID NO: 46853 - DNA, 201 bp, Bos taurus; identical to SEQ ID NO: 5430

SEQ ID NO: 46854 - DNA, 201 bp, Bos taurus; identical to SEQ ID NO: 5431

SEQ ID NO: 46855 - DNA, 201 bp, Bos taurus; identical to SEQ ID NO: 5433

SEQ ID NO: 46856 - DNA, 201 bp, Bos taurus; identical to SEQ ID NO: 5434

SEQ ID NO: 46857 - DNA, 201 bp, Bos taurus; identical to SEQ ID NO: 5435

SEQ ID NO: 46858 - DNA, 201 bp, Bos taurus; identical to SEQ ID NO: 5436

SEQ ID NO: 46859 - DNA, 201 bp, Bos taurus; identical to SEQ ID NO: 5437

SEQ ID NO: 46860 - DNA, 201 bp, Bos taurus; identical to SEQ ID NO: 5438

SEQ ID NO: 46861 - DNA, 201 bp, Bos taurus; identical to SEQ ID NO: 5439

SEQ ID NO: 46862 - DNA, 201 bp, Bos taurus; identical to SEQ ID NO: 5440

SEQ ID NO: 46863 - DNA, 201 bp, Bos taurus; identical to SEQ ID NO: 5441

SEQ ID NO: 46864 - DNA, 201 bp, Bos taurus; identical to SEQ ID NO: 5442

SEQ ID NO: 46865 - DNA, 201 bp, Bos taurus; identical to SEQ ID NO: 5443

SEQ ID NO: 46866 - DNA, 201 bp, Bos taurus; identical to SEQ ID NO: 5444

SEQ ID NO: 46867 - DNA, 201 bp, Bos taurus; identical to SEQ ID NO: 5445

SEQ ID NO: 46868 - DNA, 201 bp, Bos taurus; identical to SEQ ID NO: 5446

SEQ ID NO: 46869 - DNA, 201 bp, Bos taurus; identical to SEQ ID NO: 5447

SEQ ID NO: 46870 - DNA, 201 bp, Bos taurus; identical to SEQ ID NO: 5448

SEQ ID NO: 46871 - DNA, 201 bp, Bos taurus; identical to SEQ ID NO: 5449

SEQ ID NO: 46872 - DNA, 201 bp, Bos taurus; identical to SEQ ID NO: 5450

SEQ ID NO: 46873 - DNA, 201 bp, Bos taurus; identical to SEQ ID NO: 5451

SEQ ID NO: 46874 - DNA, 201 bp, Bos taurus; identical to SEQ ID NO: 5452

SEQ ID NO: 46875 - DNA, 201 bp, Bos taurus; identical to SEQ ID NO: 5454

SEQ ID NO: 46876 - DNA, 201 bp, Bos taurus; identical to SEQ ID NO: 5455

SEQ ID NO: 46877 - DNA, 201 bp, Bos taurus
ggtacaggcagtggccttggatatcaaagaccaatcttattaagatattttttttctatacatgtacatttgcatatcaagattaggcacctcagggactcagcacacaattcaggccatgatgaacttgaagcaatgtaagataacacacgagttttctagcccaaaagaatgtaaactttcagccctctgtgaagggga

SEQ ID NO: 46878 - DNA, 201 bp, Bos taurus; identical to SEQ ID NO: 5456

SEQ ID NO: 46879 - DNA, 201 bp, Bos taurus
gcccgtggacatggggtgccattcccaaaggccaggaagacaatcattcaattcccaccctgtcactgggctgaacacagcctcatgaaacttctcaatttagccaagattcaggccaatactgccaacttttaaacaggacataagctgagaaagatattaaatgaagcctctatagccatttttctcaacttttaattt

SEQ ID NO: 46880 - DNA, 201 bp, Bos taurus; identical to SEQ ID NO: 5457

SEQ ID NO: 46881 - DNA, 201 bp, Bos taurus; identical to SEQ ID NO: 5458

SEQ ID NO: 46882 - DNA, 201 bp, Bos taurus
aaaatttgtaagtggggaatgaggtggtgatggactttttaggaaggctcagttatccagtagtttgcaggatggaagtctacaaaaagcatttgaagacaagataaacatttagctgtagtatcaagaagccctgcctctcacgttggttatagggaacctttcaaaatctattctctgtcttccaaggatttctgaaat

SEQ ID NO: 46883 - DNA, 201 bp, Bos taurus; identical to SEQ ID NO: 5461

SEQ ID NO: 46884 - DNA, 201 bp, Bos taurus; identical to SEQ ID NO: 5464

SEQ ID NO: 46885 - DNA, 201 bp, Bos taurus
tacgggcctgagggtagcactttctagtccccattcagggacagtgatttctgattccaggatttatgggaggggtccaatctcagctgcccactgtgcacgagggcctggaactggacttgtcccaactgcattaacaccgagcctaccggcctggtggctcagagagtggagaatctgcctgcaatgcaagagacctag

SEQ ID NO: 46886 - DNA, 201 bp, Bos taurus
ttaacagcgtgttcctgctgcaaggccagtgaggcccagctataaatgatcctgttggagacagtttggaggaggtccatgttggcatgaggaatgtttgcaggcaggcagcagggcccaaagcaacagctcagctttaaggtcaagcttccatcctttctggatggaagaattgggcagtacttgatcctgaagggactg

SEQ ID NO: 46887 - DNA, 201 bp, Bos taurus; identical to SEQ ID NO: 5467

SEQ ID NO: 46888 - DNA, 201 bp, Bos taurus; identical to SEQ ID NO: 5470

SEQ ID NO: 46889 - DNA, 201 bp, Bos taurus; identical to SEQ ID NO: 5471

SEQ ID NO: 46890 - DNA, 201 bp, Bos taurus
tactgtctgctccttcctgcttctgagactgcactgcttgtttgcagttttaagtcatcatattcttatgtgtcagtcaggactcactccctttaccccaaatttgtagtcagtatctcttcaagagtcactactgcagcccaggctcttctctcctctgggactgccctgcccttcttctggagaaatgcctgttttcca

SEQ ID NO: 46891 - DNA, 201 bp, Bos taurus; identical to SEQ ID NO: 5473

SEQ ID NO: 46892 - DNA, 201 bp, Bos taurus; identical to SEQ ID NO: 5475

SEQ ID NO: 46893 - DNA, 201 bp, Bos taurus; identical to SEQ ID NO: 5476

SEQ ID NO: 46894 - DNA, 201 bp, Bos taurus; identical to SEQ ID NO: 5477

SEQ ID NO: 46895 - DNA, 201 bp, Bos taurus; identical to SEQ ID NO: 5481

SEQ ID NO: 46896 - DNA, 201 bp, Bos taurus; identical to SEQ ID NO: 5482

SEQ ID NO: 46897 - DNA, 201 bp, Bos taurus
cctaaacagaggcaagggcagagtcatggaggaactcaggagaaactttgtggagagagcattacttaatattgaaggaatggtagggataaagtaagcatagaagtgagagtaggtgtgaaaaagacgtgagggagatctggaatagttttaaactgaaaatgagcatggtaatgctggagttcaaggtaaggatggaag

SEQ ID NO: 46898 - DNA, 201 bp, Bos taurus; identical to SEQ ID NO: 5485

SEQ ID NO: 46899 - DNA, 201 bp, Bos taurus; identical to SEQ ID NO: 5486

SEQ ID NO: 46900 - DNA, 201 bp, Bos taurus
gggttttctttcacagcgacgccccctgggttgttggccagaatcagcctggcaggaagctgggtactttgaagagtcatgctgtgtgttcctgagatcagatgaagagggaggctccatggaggcctcctgcacatttcagtaaatggctaaagtgatatggtgtttctctttccaaataattaatttgcaaaaattggc

SEQ ID NO: 46901 - DNA, 201 bp, Bos taurus
gtattaagagagggaaaatgacattatttagggagacagcaaggtaaaataaaatataaagtttatctttgaagtactaaaacaataactgtaggtagagagatgctgaaaaaccattggggatctgtcaaaatagtataaattcctcctgacaaaagaaatcttaagaatcgctaaaatgattggaagtaacttttgggg

SEQ ID NO: 46902 - DNA, 201 bp, Bos taurus; identical to SEQ ID NO: 5489

SEQ ID NO: 46903 - DNA, 201 bp, Bos taurus
ccaatgaaataatctgtcatggtggcccactttatccatctcacctcccaggggaaagaggcaaatttgatgataaaactcttgcctttccctcctcccccctaaaaaatgtcctggcccccaaataatcctttcttttgctaatagcttccttgcccctcaatagaaccaccccccaccttttttacaattaaaaaaaaa

SEQ ID NO: 46904 - DNA, 201 bp, Bos taurus
agatagtaaagtgttattagttcatatcaataattttattaaatgctgaattggtacaaagaaagactacaatgtatgtggaagatattaaattaacactaaaacacaaatgtgaatcctattcagtttaatatatggaatgtttcagtacttttgaaggtccttttgtgtccattaaaagcccatctgcctttccctggc

SEQ ID NO: 46905 - DNA, 201 bp, Bos taurus; identical to SEQ ID NO: 5490

SEQ ID NO: 46906 - DNA, 201 bp, Bos taurus; identical to SEQ ID NO: 5491

SEQ ID NO: 46907 - DNA, 201 bp, Bos taurus; identical to SEQ ID NO: 5492

SEQ ID NO: 46908 - DNA, 201 bp, Bos taurus; identical to SEQ ID NO: 5493

SEQ ID NO: 46909 - DNA, 201 bp, Bos taurus
gggttgggtacccataaaacaagacccttcaggtgaggaagctgggctgaatagagggagaaataattgaagttgccaggcatttcaagtgatacaggccgtatataaactaaaatatttccactgcccaaagtcggcaagtgtgttcctgattaacacatgcgtgggtctttcagctgatagtgacccagtcttttagca

SEQ ID NO: 46910 - DNA, 201 bp, Bos taurus
ccacccagggattgagcccgagtctcatgtgtctcctgcattgcaggtggattcttcactactgagctaccggggaaggcccctgattcaagtcaaggcttcagcaaatgttgtgctactggaggagcgcatattccagtttttgtttgtggggccatgagtgcctttcacaggaagtatactgggttctgtttcagggat

SEQ ID NO: 46911 - DNA, 201 bp, Bos taurus; identical to SEQ ID NO: 5495

SEQ ID NO: 46912 - DNA, 201 bp, Bos taurus; identical to SEQ ID NO: 5496

SEQ ID NO: 46913 - DNA, 201 bp, Bos taurus; identical to SEQ ID NO: 5499

SEQ ID NO: 46914 - DNA, 201 bp, Bos taurus; identical to SEQ ID NO: 5500

SEQ ID NO: 46915 - DNA, 201 bp, Bos taurus
attaacattccagacaatcagtctcgaccatctctcatagttgaatgctaagctttcccattaaagtgtatctagcccccagattttgttttgcaagatcctgaactgagccatgaaaaactttccaggaacatcaatattttcttcttcctgtacagctttcagcactatgggggactaactgtaaataatcaaagagga

SEQ ID NO: 46916 - DNA, 201 bp, Bos taurus
aattttttaatgttggaaaatactttaatactattataaaaccttatgattatcccttgctaagatgaatgtgacagattctacctcctaaagatattgaagggcaggaaactgcaatatatgttaaaatggtcatgaaaggtctcagggactctgagaaaacttctgaaaaaaaaaatgaatatagatgagcagcaaaga

SEQ ID NO: 46917 - DNA, 201 bp, Bos taurus
atctataaaagtacctgtcattctctccttcattccatccaaagttggcctttcatctactccctgatgcaatgacatgagaaatcatggaagtcaacttgatctagctgtcatcacagctttcaatgacttacaagttactcataatgagaaaagacttagagacaactgaactgaataaagagctatgaagcttataca

SEQ ID NO: 46918 - DNA, 201 bp, Bos taurus; identical to SEQ ID NO: 5502

SEQ ID NO: 46919 - DNA, 201 bp, Bos taurus
cggaagttgctctggggcatgatggtcgatgagtgaggaagctgaacccaaactggaaacagtctcagagatacagtgaggtcccacctcaacaatctggtgcatctaagtcacactctattctgctccccattttatccccctacccagaccctctgcagcttccagctcttctttcacctgcgccgcagcccacccttc

SEQ ID NO: 46920 - DNA, 201 bp, Bos taurus
ctttgttcttttattgttttgacgtgtgtttttatgcctttcaagggacttccacatctatgaggccatctcatactgatgacattcctgcgagatagacggacaggtattattgtaactcggtcactctcctgccgttggtcatggttcttgatggaagccaccatgtcccacagcagggaaagcaaccccatcattttc

SEQ ID NO: 46921 - DNA, 201 bp, Bos taurus
ctggtggggagaggaccaaaggaaacggcctttcacatctgcaacatgaagagaggatgcaaaggaaatgacctttggactagaaaggaacattcacaccgtaagctggccacgatgtcaggggttctaagcagaggagtgtgtgaaagggtcacttgcgtgagaagaagagctgggatcctttgcctaactttggaagtg

SEQ ID NO: 46922 - DNA, 201 bp, Bos taurus
ctgctccttgactgctgagaacagggccccgctgacagtgcgctacctgaaggagacgccgctcaggagttgcaggacctgggatttctgccagtgtcctcggaacacagagggcctttttcttggtccaaccccgataagcattttgcagtttgtttctggtcatggcctgccagccagcatttgttgcacaattttgtt

SEQ ID NO: 46923 - DNA, 201 bp, Bos taurus; identical to SEQ ID NO: 5504

SEQ ID NO: 46924 - DNA, 201 bp, Bos taurus; identical to SEQ ID NO: 5505

SEQ ID NO: 46925 - DNA, 201 bp, Bos taurus
ttccaacactagggcaaggggtgggcgctggcagattccagctcttaggaccccaagtacagacagccccatgcagaggaggaaagcgttcttggtccccttgggccttgattgccatagtctggccctcggatgatttatacaggccacacaaatattttttattccaattatcctaatttaaggacattttagaaaact

SEQ ID NO: 46926 - DNA, 201 bp, Bos taurus; identical to SEQ ID NO: 5506

SEQ ID NO: 46927 - DNA, 201 bp, Bos taurus
caggaagtgcctcatactggctcttagagcaagcacaggttatgaagtgcaaaatacaagcatttgcaaatctgggtagtatccttcctcactgatctcactgggccaggtaaaaagagccatcctcactgtagcagattgtgtgtgtgtgtgtgtgtgcgcgcgcgcgcgcgaagtcgtgtctctctttgtgactccatg

SEQ ID NO: 46928 - DNA, 201 bp, Bos taurus; identical to SEQ ID NO: 5507

SEQ ID NO: 46929 - DNA, 201 bp, Bos taurus; identical to SEQ ID NO: 5508

SEQ ID NO: 46930 - DNA, 201 bp, Bos taurus; identical to SEQ ID NO: 5509

SEQ ID NO: 46931 - DNA, 201 bp, Bos taurus; identical to SEQ ID NO: 5510

SEQ ID NO: 46932 - DNA, 201 bp, Bos taurus; identical to SEQ ID NO: 5511

SEQ ID NO: 46933 - DNA, 201 bp, Bos taurus; identical to SEQ ID NO: 5512

SEQ ID NO: 46934 - DNA, 201 bp, Bos taurus; identical to SEQ ID NO: 5513

SEQ ID NO: 46935 - DNA, 201 bp, Bos taurus; identical to SEQ ID NO: 5514

SEQ ID NO: 46936 - DNA, 201 bp, Bos taurus; identical to SEQ ID NO: 5515

SEQ ID NO: 46937 - DNA, 201 bp, Bos taurus; identical to SEQ ID NO: 5516

SEQ ID NO: 46938 - DNA, 201 bp, Bos taurus; identical to SEQ ID NO: 5517

SEQ ID NO: 46939 - DNA, 201 bp, Bos taurus; identical to SEQ ID NO: 5518

SEQ ID NO: 46940 - DNA, 201 bp, Bos taurus
tggaggtgatgaagctgattggccgacacaagaacattatcaacctgctgggtgtctgcacccaggaaggtgggagcggggcggggtgagggacagggacagtgggggcatggagccacagccttgtcagcttccctgtcgcccctctcctctgcagggcccttgtacgtgatcgtggagtgtgctgccaagggcaacctg

SEQ ID NO: 46941 - DNA, 201 bp, Bos taurus; identical to SEQ ID NO: 5519

SEQ ID NO: 46942 - DNA, 201 bp, Bos taurus
cacattcagggtgccccatgcctaaaacacccctactttataactttctatgtcttgagaaccctatattctgtgcacctagcacctgggcacccgggccgcagatatggatggctctgcttacctgttccctgctttccaacgcttgccctctttttgttgtgcccagtgtcttgggcccccatgctgactgccctgggt

SEQ ID NO: 46943 - DNA, 201 bp, Bos taurus
aagtgctataaacatgcctgggagggtggcctgggcccaagctgcctgccctgcagggctcggggggcccaacacccctctcccaggtgggactgccagctgccagcagcagggtacaaggagcacctgctcccacaccagggtcctttgagtccattccaacagtgactccaagcagccctggaggctctgtgagggctc

SEQ ID NO: 46944 - DNA, 201 bp, Bos taurus; identical to SEQ ID NO: 5520

SEQ ID NO: 46945 - DNA, 201 bp, Bos taurus; identical to SEQ ID NO: 5521

SEQ ID NO: 46946 - DNA, 201 bp, Bos taurus; identical to SEQ ID NO: 5522

SEQ ID NO: 46947 - DNA, 201 bp, Bos taurus; identical to SEQ ID NO: 5523

SEQ ID NO: 46948 - DNA, 201 bp, Bos taurus
ctgcttaggacttggcgcagctttaaagaaagtggagtggcagaggttggaggcagttgttcaaggaggtgaagacagtacagtgaggattacaccttcaatggggacgctggcccaggccagttggagtctggagtaccctggaacacctgtcttgacttgccattgaaaatgggattctatcccagcgaagttgtgaaa

SEQ ID NO: 46949 - DNA, 201 bp, Bos taurus
tactctgcctgaattgtaacagaagccctgtgtaaggcaggtgttatcattcccatcttacagaggaggaagctaggtccagtgaggggaaggcattgccccaggccaggcagccagaagtgggaactggagcccagatggcagggacttaaattctgtgtggacacagaaacctataccacactaagccctggcagtggt

SEQ ID NO: 46950 - DNA, 201 bp, Bos taurus
cctgaggcctgagcaactcttggctgcgtgcacctagcttctctcctgctctgccagctctgtcccaggcacagactcccattgcagctattcagttgctctgtttagggcccttaccctccttgcactggttgctagtgcccctcagagctcccctcacctgcatcagccaactcaaatcttaaggaccatcaccctcca

SEQ ID NO: 46951 - DNA, 201 bp, Bos taurus; identical to SEQ ID NO: 5524

SEQ ID NO: 46952 - DNA, 201 bp, Bos taurus; identical to SEQ ID NO: 5525

SEQ ID NO: 46953 - DNA, 201 bp, Bos taurus
ctattgggcaggggagcccagatgatgcagtaacaaagaggtcagcctcctaagggcaaagagctgagtcagagtggtggagggaagatctaggggatgggaatccactgcattccctaacatgcatatagattaccaaggtcagtctagctactattgcctctgaaatggctaacctgtcagcgataggcactaatcctc

SEQ ID NO: 46954 - DNA, 201 bp, Bos taurus
aagttaagaccaaagaaaattcacaaaactgctcttctgaaattcatcagtcttaggatatacccatctgtaactaagctctcttccttttttcagaactgtacacaatacgagacaggcaaaaaaggattcctttcttaatgtaagtgaattttagatttctctggcacagagaattctctcaagaaagctgaatcagag

SEQ ID NO: 46955 - DNA, 201 bp, Bos taurus; identical to SEQ ID NO: 5527

SEQ ID NO: 46956 - DNA, 201 bp, Bos taurus; identical to SEQ ID NO: 5528

SEQ ID NO: 46957 - DNA, 201 bp, Bos taurus
cataagtttgagcatgctccagagatggtgaaggataggcaagcctggcgtgctgcagtccatggggtcacaaagagtcagacaagagtgagtgactgaataacaacaaaaacattcaaacaatggccatgccactcctatactgcagtgctgtatttacagaaagaaagaaagaaagaaaaaagctttgtgttctgatga

SEQ ID NO: 46958 - DNA, 201 bp, Bos taurus
gccagccagggctgtagcagaggccagaaggacaagggaaaataggaagaagtcatatggtgaatagctgaacagacccaaaaggatgaagtctgatagcgaggtgtggttccagatgtccatggccttgaccctgagggaaaaataaatgagtaaacatcaaaacgaaataacttacctggcatctccatcatatacgta

SEQ ID NO: 46959 - DNA, 201 bp, Bos taurus
atcttgggaactccccccaacccccaaccccattcttgacatgttgccttgtgctcacagcaccatcacctccactgggcctccactgggtttggaattattggattcaagttctctggagaattattctcctactttctgccaggatgagggatgggtggggcccatgtgtgcggagttgggagggaactgtgctccttt

SEQ ID NO: 46960 - DNA, 201 bp, Bos taurus
agctggatatgtcccaacccagagcaaaggaaccagtagttggaacagctctggtgacagactacttcttttctgaacttctatgtcccaggcccaggctgcgtaaaatgaagaacaatggtggggaggtgttggggcagtttaaggctggtgcctcgttacatgtcacagaggccaactttgccaacagtactcaggcag

SEQ ID NO: 46961 - DNA, 201 bp, Bos taurus; identical to SEQ ID NO: 5529

SEQ ID NO: 46962 - DNA, 201 bp, Bos taurus; identical to SEQ ID NO: 5530

SEQ ID NO: 46963 - DNA, 201 bp, Bos taurus; identical to SEQ ID NO: 5531

SEQ ID NO: 46964 - DNA, 201 bp, Bos taurus; identical to SEQ ID NO: 5532

SEQ ID NO: 46965 - DNA, 201 bp, Bos taurus; identical to SEQ ID NO: 5533

SEQ ID NO: 46966 - DNA, 201 bp, Bos taurus; identical to SEQ ID NO: 5534

SEQ ID NO: 46967 - DNA, 201 bp, Bos taurus; identical to SEQ ID NO: 5535

SEQ ID NO: 46968 - DNA, 201 bp, Bos taurus; identical to SEQ ID NO: 5536

SEQ ID NO: 46969 - DNA, 201 bp, Bos taurus; identical to SEQ ID NO: 5537

SEQ ID NO: 46970 - DNA, 201 bp, Bos taurus; identical to SEQ ID NO: 5538

SEQ ID NO: 46971 - DNA, 201 bp, Bos taurus; identical to SEQ ID NO: 5539

SEQ ID NO: 46972 - DNA, 201 bp, Bos taurus; identical to SEQ ID NO: 5540

SEQ ID NO: 46973 - DNA, 201 bp, Bos taurus; identical to SEQ ID NO: 5541

SEQ ID NO: 46974 - DNA, 201 bp, Bos taurus; identical to SEQ ID NO: 5542

SEQ ID NO: 46975 - DNA, 201 bp, Bos taurus; identical to SEQ ID NO: 5543

SEQ ID NO: 46976 - DNA, 201 bp, Bos taurus
gaaggctttgattggtttaggcctaggggacttctcattgcccatccctccttggtcatttcctagtgcatcaccaggccaggatccctggtccaaagctttaaaacaagctggacactcttcctcttctgagcactgtactggaggcaaacttccctctgagtccctcctgcccttcctagtggcacaaggacacacccc

SEQ ID NO: 46977 - DNA, 201 bp, Bos taurus; identical to SEQ ID NO: 5544

SEQ ID NO: 46978 - DNA, 201 bp, Bos taurus; identical to SEQ ID NO: 5545

SEQ ID NO: 46979 - DNA, 201 bp, Bos taurus
aagcacagcatctctttcattggctgtggaatccaaatgtttttctgcctgagtctaggtggtgctgagtgtctccttctgaccttcatgtcgtatgaccgatttgtggctatttgtaatcccctgcaatacacagtcatcatgaattctaaggtctgtttgctcatagcagtagcatcatggactgggggtgctctaaat

SEQ ID NO: 46980 - DNA, 201 bp, Bos taurus; identical to SEQ ID NO: 5546

SEQ ID NO: 46981 - DNA, 201 bp, Bos taurus; identical to SEQ ID NO: 5547

SEQ ID NO: 46982 - DNA, 201 bp, Bos taurus
gtgggcgggacctatagtcccaagagagtatcacaagctcaggtcttgtgggatcgggaatggggaagagtagggtacaagtttggaaagggggcttctggggcccctatggggtgagaaatacgagtatgagagtcagaggaacttattggcgcaaagtggggaaagattgaccgtagatctggggcgtggcgtggttcg

SEQ ID NO: 46983 - DNA, 201 bp, Bos taurus
aattcggcccgctcacaggtggtggacttcaccagccctttcttctccaccagcctgggcatcatggtgcgcgcacgcgacacggcgtcgcccattggcgccttcatgtggccgctgcactggtccatgtggctgggcgtcttcgctgcgctgcacctgaccgcactcttcctcaccctctacgagtggcgcagccccttc

SEQ ID NO: 46984 - DNA, 201 bp, Bos taurus
cctcagctttctgtgtgtccccagggaagttactacccagctctgccttggtttccttcaaagttggatgcccagaggcccatccaactctgatatttttggatcctgcagtcatcacttttcctgctgtgtatcagtttgatgtatcagtgtgatgcttttggagcattcaggtccgcgtcaggcctgagccccagcctg

SEQ ID NO: 46985 - DNA, 201 bp, Bos taurus
agactctcccagagggctgcccgcccgacagcccctgacttgccccattgatcccgaaacagagactgaggcccagaggtgatctatgggccctaatggacgatgcagtccttggggaaggggatggacgagtggtggaggagacccctctcctgtgtagagggggaaactgaggctccacaggtcaataaaggtggatcc

SEQ ID NO: 46986 - DNA, 201 bp, Bos taurus
acctgtgcctgtgctcagtgtagtcagcacccagcagcaggggtgggcctggagtgagcactgctttgccgtcacaggctgcgtggcctcatctgaggcctctgtctcaccgtttcagtttcccatttctttaacatgggaaccagctgaatggctggagtaggtgagcacttcctctgtgcctgacactgaaggccaaga

SEQ ID NO: 46987 - DNA, 201 bp, Bos taurus
ctggccatggagaacaggagagaccgggcaggcgaggctgatttaaaaagccccagaggtaggtggttactctaacatgggtgggattacaggtgatgctcggcctcttcctccccccaggtatttttagtggtcttgtatcttctgacacctgctgccttgtctctggtctgcttttctctctggagtctttgtttcctt

SEQ ID NO: 46988 - DNA, 201 bp, Bos taurus; identical to SEQ ID NO: 5549

SEQ ID NO: 46989 - DNA, 201 bp, Bos taurus; identical to SEQ ID NO: 5550

SEQ ID NO: 46990 - DNA, 201 bp, Bos taurus; identical to SEQ ID NO: 5551

SEQ ID NO: 46991 - DNA, 201 bp, Bos taurus; identical to SEQ ID NO: 5552

SEQ ID NO: 46992 - DNA, 201 bp, Bos taurus; identical to SEQ ID NO: 5553

SEQ ID NO: 46993 - DNA, 201 bp, Bos taurus
gcttcgtggatgcagggacttgggtgcaagctgagtgcgagggccacaggcagaagagagtgcggttttaaagggatagcctaaggaaccccacttgaatccttggaggagggcatggtttctgcattgagcctggaggccactgttctgcacgcacatttccaggcaagcttggtcagccctgaatctggggtactggac

SEQ ID NO: 46994 - DNA, 201 bp, Bos taurus
tgtggggtttctgtgtagaagaaggtcagtttctgtagagaagttctctagagctgactgtgcattctctggatttccagcaccctagactgttgccaaaattggctcccatgtgcctgggaggaggtgcgggctgagcctgggctggccagtgtacacagatcctggaaagctcagggatcctggaaagttccctgaatg

SEQ ID NO: 46995 - DNA, 201 bp, Bos taurus; identical to SEQ ID NO: 5554

SEQ ID NO: 46996 - DNA, 201 bp, Bos taurus
gctggccaaatcttggacctcctgaaaataatgatagcagcaggtaatatcccattgaataaacagaaatccacaaatccacagtgagttttaaaaactgagcaaataaatggggtaaagtagaaaagtcttccttacagtagaatttcaattaataagaatagaagaaataaaggaggtagaaaattttaatttggcaat

SEQ ID NO: 46997 - DNA, 201 bp, Bos taurus; identical to SEQ ID NO: 5555

SEQ ID NO: 46998 - DNA, 201 bp, Bos taurus; identical to SEQ ID NO: 5556

SEQ ID NO: 46999 - DNA, 201 bp, Bos taurus; identical to SEQ ID NO: 5557

SEQ ID NO: 47000 - DNA, 201 bp, Bos taurus; identical to SEQ ID NO: 5558

SEQ ID NO: 47001 - DNA, 201 bp, Bos taurus
ttaaaaggaaagctgtgaatgatagcggagagctccagaccctccaaggccttcatgcaaatgtctcgctgctctctcagcaccggaaatctgggccaaactgtaatcattgctcaatttttttttttttaaatgttgtcacccagctgctttgagaggctgtgctctggtccaggtggtgtgactgtgtgtgcagagggg

SEQ ID NO: 47002 - DNA, 201 bp, Bos taurus
tgcccatccaaaaccacaagagagagctgaccaggcctggccaccagatgccaagagggctaagatgcacagcacagcaccttggagttggggtccagagtccagagttggggccctaccacttacctactgggtgaccatggcccatcccttccctctctgagcctaagcttcctcacctgtacaatgtggtggtgggaa

SEQ ID NO: 47003 - DNA, 201 bp, Bos taurus; identical to SEQ ID NO: 5559

SEQ ID NO: 47004 - DNA, 201 bp, Bos taurus
ctagagatttgcctactgaaaccagtgccccatgtggccaattggtctctcaaaagcagtaccatccactaatgcgtataacacatctggggatctgcacctcctcaatctctagctcctaacaagtggctgtctgatttgggaaccatctgcatatccctaaggaagcaaggtgtcaaggacttgccatggaatcagcac

SEQ ID NO: 47005 - DNA, 201 bp, Bos taurus
atcgtcctggggtgttgagaaagaaggcagcttaggcagggggctgggggcgggggtgggagtgtggagaagaacagagcaccctggcccctttaggggcgaaggtcttattgaaaatatgaggaggagttcctggaccccttgaggtgctggagaatagaagaccgatgccacaactctccccaggcccatgatctgttc

SEQ ID NO: 47006 - DNA, 201 bp, Bos taurus; identical to SEQ ID NO: 5560

SEQ ID NO: 47007 - DNA, 201 bp, Bos taurus; identical to SEQ ID NO: 5561

SEQ ID NO: 47008 - DNA, 201 bp, Bos taurus; identical to SEQ ID NO: 5562

SEQ ID NO: 47009 - DNA, 201 bp, Bos taurus; identical to SEQ ID NO: 5563

SEQ ID NO: 47010 - DNA, 201 bp, Bos taurus; identical to SEQ ID NO: 5564

SEQ ID NO: 47011 - DNA, 201 bp, Bos taurus; identical to SEQ ID NO: 5565

SEQ ID NO: 47012 - DNA, 201 bp, Bos taurus
agttacgcagtttactcttaggagaaattcttgcttttctcaacagtattgtagccagatatccaaactagtagaacattttaacctctttgacctcttggatacctgcttttttttttaaattgaagtatagttgatttacaatatagtgttagtttcaagtgtacagcaaagtgattcagttatacacacacatgtgta

SEQ ID NO: 47013 - DNA, 201 bp, Bos taurus; identical to SEQ ID NO: 5566

SEQ ID NO: 47014 - DNA, 201 bp, Bos taurus
aatgatattttaaaaatttcacctgatgaaaatgttttcttggacgttatgaatggctccaaagaactttaaaagcccaaccagtgatgctggccaggcatttagagattagtagttgttacgtcttggtttggtatgcctagtggtgtctaatcatgttgtgtgcttgggaaccatgaaagaattttcttttcaagtctt

SEQ ID NO: 47015 - DNA, 201 bp, Bos taurus; identical to SEQ ID NO: 5567

SEQ ID NO: 47016 - DNA, 201 bp, Bos taurus; identical to SEQ ID NO: 5569

SEQ ID NO: 47017 - DNA, 201 bp, Bos taurus; identical to SEQ ID NO: 5570

SEQ ID NO: 47018 - DNA, 201 bp, Bos taurus
aattgctttttttttaatttaatgaagtttagttttctccaagctttcattctacctggtggcagaaagagtgattttgccatttcaggtgtaaaattccagaattccaagtaaaattcaggcagttcagtacttcctcctcctcctccctctcctggggtgactttgaattcttggggcttggggtttgagggagaggct

SEQ ID NO: 47019 - DNA, 201 bp, Bos taurus; identical to SEQ ID NO: 5571

SEQ ID NO: 47020 - DNA, 201 bp, Bos taurus
aactggctgccccgaatcacaggaccaagcctggcgtccacacaggacgggggtaagcaaaggcaggagtccctagaggcgtgtgtcctgggggccctgattgttcgttctccacaacctcactctttcttggtaagtcaccccaatacgtggtagagcaggcagcagccaggcctgtgtccacctgactttttccaccag

SEQ ID NO: 47021 - DNA, 201 bp, Bos taurus; identical to SEQ ID NO: 5572

SEQ ID NO: 47022 - DNA, 201 bp, Bos taurus; identical to SEQ ID NO: 5573

SEQ ID NO: 47023 - DNA, 201 bp, Bos taurus
ggtaaaactacctctgtttggagggaatagagggtatggatggactgaaataatttcatcttccttgagtttatcccatggcccaccatgcaagtcatgccaccagattcctgacttaagtgccccctcagtgaccaaagcaagtccaggctgctgacctttgttgtcacctctggccaaaacatgtttattctttacata

SEQ ID NO: 47024 - DNA, 201 bp, Bos taurus; identical to SEQ ID NO: 5574

SEQ ID NO: 47025 - DNA, 201 bp, Bos taurus
ccgagtagagactcttgtatacaaggcacggtggcagatacttctctgcaaggtggttgcttttccagaggaaatgggcagatggagagaaggatggccaacctggaacagggcaagtgtaggtaggaagggacgaatgaatagccatgaccagagagaatgctctcctgggcctctgctctcccaagcctttggccacag

SEQ ID NO: 47026 - DNA, 201 bp, Bos taurus
ggccactcccaagcaccgcttcactgctggactgcctgccagagcataggagctccccacacatgttcttaggaactgagggaactgaaagcatgtccccaaaagagcggccacaggggcaagcattgctccgacttcaagaactaagagatgggataggactcattctgcacggtcccagggtcaaattggaactaacca

SEQ ID NO: 47027 - DNA, 201 bp, Bos taurus
acacgaggggccactgagatcccatctgtgagccaagtgttccccacattcctctcattatctcagaatcctagtgtccagctcgaggagggatgaggcagtgagtggggccctcgtctgcatctggcctagtccttctgtttccagtgccctggactccagctggccttccttctgtatcattccactcttgttggacac

SEQ ID NO: 47028 - DNA, 201 bp, Bos taurus; identical to SEQ ID NO: 5575

SEQ ID NO: 47029 - DNA, 201 bp, Bos taurus
ggatggaagatggttaacagaatagatcaggaacaggagatgtcatggtgccaggtggtgggggcggggggagcagggaggagcgcagtaaggcctcataccgcttgttcaccgcaagtgtttgaaagtctctttcaaggaaaagaccaccatcaactaaagggaaagggaagaggaacagagaggagagagataagtaag

SEQ ID NO: 47030 - DNA, 201 bp, Bos taurus; identical to SEQ ID NO: 5577

SEQ ID NO: 47031 - DNA, 201 bp, Bos taurus; identical to SEQ ID NO: 5579

SEQ ID NO: 47032 - DNA, 201 bp, Bos taurus; identical to SEQ ID NO: 5580

SEQ ID NO: 47033 - DNA, 201 bp, Bos taurus; identical to SEQ ID NO: 5581

SEQ ID NO: 47034 - DNA, 201 bp, Bos taurus
tgataacaacatgaatgttcgttcccaataatggcctgcctggggatctcctggtcccagggatgacctatggtaggctgatggtagaaacacagtgcctgtcctcaggctggcctaggctcagggaagagatgtggctcctttgctcagatctgagagaggagaaggaagctggggaaaatacaaaccacagtattactt

SEQ ID NO: 47035 - DNA, 201 bp, Bos taurus; identical to SEQ ID NO: 5582

SEQ ID NO: 47036 - DNA, 201 bp, Bos taurus
cacatgtgttcttttggtgactggcttgtagcatctgtcaggccagtgtatgctctccggttcttctgtctcatctcaacaaaaatttgaagcaacagacgttagagacctcggcctgtcacagctctcggacggaccgtgttatagctctcaggtctcaaacagaccgtgttatagcccttagacagatcagtgttacag

SEQ ID NO: 47037 - DNA, 201 bp, Bos taurus
ggctaagactttgccctccccatgcagggggcctgggttcaatcactgatcagggaactagatcccacatgcccaagcgaagatggaagatccctcgtgtcacaactaagatctagtgcagacaaataaatattaaaaacaaaaagaggtgaccagcagttctgtcaggacatatatgagctttcaggatggagagttgga

SEQ ID NO: 47038 - DNA, 201 bp, Bos taurus
ttcgaagaaaataaattgtacgaaatatccgtggaagcgattgacaaggggaatattccaatggcgggtcattgtaccattttggtggaaatagtagatacaaatgacaatgctccagaagttaccatcacttctttggctctgccggtgagagaggacgctcaggtgggcactgtcatcgccttggtcagcgtatccgac

SEQ ID NO: 47039 - DNA, 201 bp, Bos taurus; identical to SEQ ID NO: 5583

SEQ ID NO: 47040 - DNA, 201 bp, Bos taurus; identical to SEQ ID NO: 5584

SEQ ID NO: 47041 - DNA, 201 bp, Bos taurus; identical to SEQ ID NO: 5585

SEQ ID NO: 47042 - DNA, 201 bp, Bos taurus; identical to SEQ ID NO: 5586

SEQ ID NO: 47043 - DNA, 201 bp, Bos taurus; identical to SEQ ID NO: 5587

SEQ ID NO: 47044 - DNA, 201 bp, Bos taurus; identical to SEQ ID NO: 5588

SEQ ID NO: 47045 - DNA, 201 bp, Bos taurus
gcaagaggtgagctgctggcaagcaagtaaagcttcatctgcctctccccatggctgacatgactgcctgaaccatcttatttcaactgctgaccactgaagggccattgccaaccattggtcaggacaataacttgctttttgcacttgccacaggatctccctccaaggggaacacattaaatgttcccctttaatgtg

SEQ ID NO: 47046 - DNA, 201 bp, Bos taurus
agagctccatttttgggtggataagggaaacatagtgtggtgtagtggagggaagacacaagctgatctggttttgaatttctgctctgccacttattgacagcatctacttccctcatagctcagttggtaaaggatctgcccacaatgcaggagacccaggttcgattcctggatcaggaagatcccctggagaaggaa

SEQ ID NO: 47047 - DNA, 201 bp, Bos taurus; identical to SEQ ID NO: 5589

SEQ ID NO: 47048 - DNA, 201 bp, Bos taurus
gggatgaggtgagcttgatgccatgggtaagggccagatcaaggagtggcttttcgacctcattttagatgcagtgggagccattggaaagttgaaaactagggcccctcatgagctgaggcatgttttataaagatcactggctgctatttgaagcacctctgaaggtagttgccaggttgaaatgaagtctcttccgca

SEQ ID NO: 47049 - DNA, 201 bp, Bos taurus
ccagatacagtcgtctcagtcatagtgtgcctggccagctggaatccgtgcagccaccgtgcttgacttctcagtcccaaggtgaaccctaatgtagagcaacaacacctggccccaaatataatttcctcttgcagctcattgcagccatgaggaagtcgccaggggagggctggggagggcggcgcagcagcaccataa

SEQ ID NO: 47050 - DNA, 201 bp, Bos taurus
agttctggattttaatatgtgcttagatgcatgtgactaccaccacagtcagggaacccccccccccccaacacctctgtgccatctctttataagcatacgcttccctttgtcccagctcctggcaaccactggtctgatctctacccctcgaatttttctttctgagaatgtcattaaatggacacttacagtgtgtca

SEQ ID NO: 47051 - DNA, 201 bp, Bos taurus; identical to SEQ ID NO: 5590

SEQ ID NO: 47052 - DNA, 201 bp, Bos taurus; identical to SEQ ID NO: 5591

SEQ ID NO: 47053 - DNA, 201 bp, Bos taurus; identical to SEQ ID NO: 5592

SEQ ID NO: 47054 - DNA, 201 bp, Bos taurus; identical to SEQ ID NO: 5593

SEQ ID NO: 47055 - DNA, 201 bp, Bos taurus
aggctgaggtaaagcagggacattcataattagaaaacagcgagatgcctggggcaagtttatttaaacaaagcaagccaaaggggccactgaggcaagttgaaagtgaaagtgaaagggggaaagtggctcagtcgtgtctgactctttgcaactccatggactatacagtccacggaattctctaggccagaatactgg

SEQ ID NO: 47056 - DNA, 201 bp, Bos taurus
gcctgctggaggtggctcatgcactggcgtttcacaggagaattaaccccaggtaaaactgtgtgtggcaggaagtttgctttggtggtgccctacctctatgccaggggcttttaggaagacaggcagtgcttcccagaagttttccctgaaagagactgtcaccagctttgatgaagactcatgggaggccaagccctc

SEQ ID NO: 47057 - DNA, 201 bp, Bos taurus; identical to SEQ ID NO: 5594

SEQ ID NO: 47058 - DNA, 201 bp, Bos taurus; identical to SEQ ID NO: 5595

SEQ ID NO: 47059 - DNA, 201 bp, Bos taurus
ttccagagagacatttataaatatgacatttataaatccataggccaagatgagagcaatgtttcattacagctcttagtttcctacattattttgtcacttatttgttaattcaacccagcatttagtcattttgtgcaaaatagatttaggatctaaatccttatttacaaatagatttaggatctatactttttttca

SEQ ID NO: 47060 - DNA, 201 bp, Bos taurus
ctagaaaaaggactattctttcaatagaaactttgcttttattcctcttctcgaggattttgaagatagtgaagaacatttcctaaacagttgcatctttctttgatttgaaattttaatgcagtttgttactctccaggaataatttaagacaaataatttagattttagttttaaaataattacaccggatcccccctc

SEQ ID NO: 47061 - DNA, 201 bp, Bos taurus
tgtgtggtaaggaagtatgtggaatctaagtttcacatgagtttcatcagggaaaaatatttggcatacactagggaaaagggatcaagttcctcttattctttataatcactgattattctacctcaggactcaggataggaaagggatttaaggcagaagagcaacttgattagttttgcttggcatttcattgccaca

SEQ ID NO: 47062 - DNA, 201 bp, Bos taurus; identical to SEQ ID NO: 5596

SEQ ID NO: 47063 - DNA, 201 bp, Bos taurus; identical to SEQ ID NO: 5597

SEQ ID NO: 47064 - DNA, 201 bp, Bos taurus; identical to SEQ ID NO: 5598

SEQ ID NO: 47065 - DNA, 201 bp, Bos taurus; identical to SEQ ID NO: 5599

SEQ ID NO: 47066 - DNA, 201 bp, Bos taurus; identical to SEQ ID NO: 5600

SEQ ID NO: 47067 - DNA, 201 bp, Bos taurus; identical to SEQ ID NO: 5601

SEQ ID NO: 47068 - DNA, 201 bp, Bos taurus
tttgtgtgaagttcatagtatcctctcatagaactagtttattatcttttctacctccataatctatagccatttatgcaaattagaagaataggatgttagtttttccaaaaaaccttaattcattgtataatcagaattagtcttttggttcataagatcttattagaaaaggtagatacacaaatcttttattattga

SEQ ID NO: 47069 - DNA, 201 bp, Bos taurus
atgaaactttgacaatgttatatataaatgttacctcaataaataattaaataaaatgatgcaggctactttgggagaaaaaattttgagtcagacatgtgtttgatccaagctccgcaactcactaggtctatgagtactggaaaaccactatatcactctgagcctctattccctgagccaccaaatgggagcagtaat

SEQ ID NO: 47070 - DNA, 201 bp, Bos taurus
aggtcctgttgtgtccagttggaataaaataatccatgtctatgaaagttgttcacttgttcagtgacagggaacttcaaacttccatcatgtaaatgaaggaactaggccctgatcttgctactcgattcatttcaacctcacatattgaatcctcactatatcttcttacctacctcttagacacaatcaacttctcac

SEQ ID NO: 47071 - DNA, 201 bp, Bos taurus; identical to SEQ ID NO: 5602

SEQ ID NO: 47072 - DNA, 201 bp, Bos taurus; identical to SEQ ID NO: 5603

SEQ ID NO: 47073 - DNA, 201 bp, Bos taurus; identical to SEQ ID NO: 5604

SEQ ID NO: 47074 - DNA, 201 bp, Bos taurus; identical to SEQ ID NO: 5605

SEQ ID NO: 47075 - DNA, 201 bp, Bos taurus; identical to SEQ ID NO: 5606

SEQ ID NO: 47076 - DNA, 201 bp, Bos taurus
atacatcttaaaatattctttcctctggtatctacttcattcccattgtccctttcccccacatagttaggaaaacttttattctagcctggctgcttgtgtgaatgtctcttgcccttcccaaactatcctcatacttctttgctgtctgcctcttcccttttcccaggttcattagcaatagcaaagaaccaaatggaa

SEQ ID NO: 47077 - DNA, 201 bp, Bos taurus; identical to SEQ ID NO: 5607

SEQ ID NO: 47078 - DNA, 201 bp, Bos taurus; identical to SEQ ID NO: 5608

SEQ ID NO: 47079 - DNA, 201 bp, Bos taurus; identical to SEQ ID NO: 5609

SEQ ID NO: 47080 - DNA, 201 bp, Bos taurus; identical to SEQ ID NO: 5610

SEQ ID NO: 47081 - DNA, 201 bp, Bos taurus; identical to SEQ ID NO: 5611

SEQ ID NO: 47082 - DNA, 201 bp, Bos taurus; identical to SEQ ID NO: 5612

SEQ ID NO: 47083 - DNA, 201 bp, Bos taurus; identical to SEQ ID NO: 5613

SEQ ID NO: 47084 - DNA, 201 bp, Bos taurus; identical to SEQ ID NO: 5614

SEQ ID NO: 47085 - DNA, 201 bp, Bos taurus; identical to SEQ ID NO: 5615

SEQ ID NO: 47086 - DNA, 201 bp, Bos taurus; identical to SEQ ID NO: 5616

SEQ ID NO: 47087 - DNA, 201 bp, Bos taurus
gagccttttcctcagaaaagacacatgactaggtgttttctccccttaacacaagaagggcagccttgattttctttactcagttgatctattcgattccctctcccctttttgttcatcactctttcccctcttttaatgcaccaaaggattgcaaacccgtgggtgatttaaaattaaacactatttttttaatctctt

SEQ ID NO: 47088 - DNA, 201 bp, Bos taurus; identical to SEQ ID NO: 5617

SEQ ID NO: 47089 - DNA, 201 bp, Bos taurus; identical to SEQ ID NO: 5618

SEQ ID NO: 47090 - DNA, 201 bp, Bos taurus
gggtgaaactcaggaaaggtggtggtgtaattcaatcagaaggtttgagaatcaaggggcccattgggtaagagaggtatgcatctgaaggcccaaggactgggggcattgatgtctgagggtagatgaagttggatgtctcagttcaagcagaaaagcaaactggcccctcctctgccttttcattcttccccaggaaga

SEQ ID NO: 47091 - DNA, 201 bp, Bos taurus
gttatggatattattgttgtaagatcagtgttgtctctcaagtgcctgccatgtgcctgctgcagcatgaacaataaatattaactctaaccactctcatgactcatgggaagtacatcagtttgaaacattattacggactagcctcaaacacctcttcctgtggccaagcaggcattactaatcaatctttccccttgg

SEQ ID NO: 47092 - DNA, 201 bp, Bos taurus; identical to SEQ ID NO: 5619

SEQ ID NO: 47093 - DNA, 201 bp, Bos taurus; identical to SEQ ID NO: 5620

SEQ ID NO: 47094 - DNA, 201 bp, Bos taurus; identical to SEQ ID NO: 5621

SEQ ID NO: 47095 - DNA, 201 bp, Bos taurus
gagcttagacaactctagtggaagcagtctagctggaataggatagatgaggcctggaagaagcaacgattctaactcagataatcctcaaaccttgagaagcagattgccaataagaaatggccttcctctactctgagcctcccaaactacattctcttgcacaacagctgactccttcctgacaccttctaatcatga

SEQ ID NO: 47096 - DNA, 201 bp, Bos taurus; identical to SEQ ID NO: 5622

SEQ ID NO: 47097 - DNA, 201 bp, Bos taurus
aatgatgaaattgaatatatttgaatttcagtttacatgaagacattatgtgttaaataaggaaatggacaaccaaagcagagaagaagatgcccaagatcctatttcaatcatcagccactctccaggactttagtgttctggaactaatgcctccaatgggtaaagaccgggtgaaatgatcaaataaactgagaaatg

SEQ ID NO: 47098 - DNA, 201 bp, Bos taurus
tagaacaaatattctcataatattctgggttttcttgtcctggacaagtgaggtaagagttgctcttgtccagacatttgtattgatcacagcctgaggtgtcttttaaagcatgctatatggcacccagtaagttgaatcaaaaaaaggacaacaagcagactagaagacttcagcgtcctttgaaatactggcaaatgg

SEQ ID NO: 47099 - DNA, 201 bp, Bos taurus
ctttacagaaaaaatagtggaaatattggttttagtcattggggttgttgttaactctgcctcagctacacattcctgtggcttttattgcaatcctattttgctatggattctacaatcaattagtctttcagtcaaggctttaaattcttagatgaccagactaagccttcagtagtacacaagccagaatatacattg

SEQ ID NO: 47100 - DNA, 201 bp, Bos taurus; identical to SEQ ID NO: 5624

SEQ ID NO: 47101 - DNA, 201 bp, Bos taurus; identical to SEQ ID NO: 5625

SEQ ID NO: 47102 - DNA, 201 bp, Bos taurus; identical to SEQ ID NO: 5626

SEQ ID NO: 47103 - DNA, 201 bp, Bos taurus
cagttgatattattaaaaaggattaaaaaaaaaccttttaagctctgagatatttcatggtagaaatatccattatagtcagatacaagaacaggcaatagacagactgagtgtgggaatctaagcttgtgagtatattgggggaaaacagaggggaagatttagatgtttactcaggaaaatgtcaagcaaggacaggat

SEQ ID NO: 47104 - DNA, 201 bp, Bos taurus; identical to SEQ ID NO: 5627

SEQ ID NO: 47105 - DNA, 201 bp, Bos taurus; identical to SEQ ID NO: 5628

SEQ ID NO: 47106 - DNA, 201 bp, Bos taurus; identical to SEQ ID NO: 5629

SEQ ID NO: 47107 - DNA, 201 bp, Bos taurus
tccccagcaagagcctcctgctcgcagacccttccttggactcacctgcctttatttcccccttgtttcctcaagtgtgtggctgtggcctagcccagtcgggcttcttcttcaagaaccaggagtacatctgcacgcaggactaccagcagctctacggcacccgctgcgacagctgccgggacttcatcacaggcgagg

SEQ ID NO: 47108 - DNA, 201 bp, Bos taurus; identical to SEQ ID NO: 5630

SEQ ID NO: 47109 - DNA, 201 bp, Bos taurus; identical to SEQ ID NO: 5631

SEQ ID NO: 47110 - DNA, 201 bp, Bos taurus; identical to SEQ ID NO: 5632

SEQ ID NO: 47111 - DNA, 201 bp, Bos taurus
tgagtctgcaggcaggccagcgggtgactgtgctggaggcccaggacaagaaggggaacccagaatggagcctcgtggaagtaaacggacagaggggctatgtgccttccagcttcctggccagggccccaagtccagctccgtggggctggagtttgccttcttagagtgccctcctttaagtctatgttccaggagggt

SEQ ID NO: 47112 - DNA, 201 bp, Bos taurus
attctttccctctctgggcttctgtttttcaggtgacttccagacaaataaacaggtaatatggccctctggaggtgacagtggaagtgtggcatgggcagcaagctggtggattgggaagaaccagaatggggactgggacccaacctcctgggccatcttggatgactccttgacacctccagttgtctacccaatgcc

SEQ ID NO: 47113 - DNA, 201 bp, Bos taurus; identical to SEQ ID NO: 5634

SEQ ID NO: 47114 - DNA, 201 bp, Bos taurus
tccttcagtgtgaggcttgtgttctgtgatgaggacctcacagctcccaccatctgaggtctgtcttcgaggggcgggtgggtccggtccccttgtcctccagcctgaggaagagacaggcaggtttgagaccctgggggagcagaggaaatcccagggacttgacctgtcacgtgttgtaagtctgtcttgtcactgcta

SEQ ID NO: 47115 - DNA, 201 bp, Bos taurus; identical to SEQ ID NO: 5635

SEQ ID NO: 47116 - DNA, 201 bp, Bos taurus
tccaactgcccacatctgaatacattctactaccatggaaactacaaaggaaggaaaaatatatttattccaggattcatttactaggatttttaagcgccctctcttctgtagagccccagagcggtgatgagtgctaggggctgctgtgcttcccggcatgtgctcccatcctctgagggtcctgagaaggataatgga

SEQ ID NO: 47117 - DNA, 201 bp, Bos taurus
caatccttgtaactttcaaatagagaaaatgaagtcctgagagtcaaaggaacatgccccagggtttctcactcctggtaaagtagtattctgtgttctggttccacaaatgcagttccttgcacactatgtcagttcattcatatttacagttgagtaggaaaccagttgctgtcctaaaaagagaagaaagagaaaaaa

SEQ ID NO: 47118 - DNA, 201 bp, Bos taurus
aaagtatcgttgacctagggaaggtttcagctttctttcagccttccaccttattaagtcagacccacccaaggtaatctttctgattataaagccagcaattctggggccttaattacatctgcaaaatccctcacccttgtcatgtgacctaacctaatcacagggtaactccagggaacagattgtgggagccatctt

SEQ ID NO: 47119 - DNA, 201 bp, Bos taurus; identical to SEQ ID NO: 5636

SEQ ID NO: 47120 - DNA, 201 bp, Bos taurus; identical to SEQ ID NO: 5638

SEQ ID NO: 47121 - DNA, 201 bp, Bos taurus; identical to SEQ ID NO: 5639

SEQ ID NO: 47122 - DNA, 201 bp, Bos taurus; identical to SEQ ID NO: 5640

SEQ ID NO: 47123 - DNA, 201 bp, Bos taurus; identical to SEQ ID NO: 5642

SEQ ID NO: 47124 - DNA, 201 bp, Bos taurus; identical to SEQ ID NO: 5643

SEQ ID NO: 47125 - DNA, 201 bp, Bos taurus; identical to SEQ ID NO: 5644

SEQ ID NO: 47126 - DNA, 201 bp, Bos taurus; identical to SEQ ID NO: 5645

SEQ ID NO: 47127 - DNA, 201 bp, Bos taurus; identical to SEQ ID NO: 5646

SEQ ID NO: 47128 - DNA, 201 bp, Bos taurus; identical to SEQ ID NO: 5649

SEQ ID NO: 47129 - DNA, 201 bp, Bos taurus; identical to SEQ ID NO: 5652

SEQ ID NO: 47130 - DNA, 201 bp, Bos taurus; identical to SEQ ID NO: 5655

SEQ ID NO: 47131 - DNA, 201 bp, Bos taurus; identical to SEQ ID NO: 5658

SEQ ID NO: 47132 - DNA, 201 bp, Bos taurus; identical to SEQ ID NO: 5659

SEQ ID NO: 47133 - DNA, 201 bp, Bos taurus; identical to SEQ ID NO: 5660

SEQ ID NO: 47134 - DNA, 201 bp, Bos taurus; identical to SEQ ID NO: 5662

SEQ ID NO: 47135 - DNA, 201 bp, Bos taurus; identical to SEQ ID NO: 5663

SEQ ID NO: 47136 - DNA, 201 bp, Bos taurus; identical to SEQ ID NO: 5664

SEQ ID NO: 47137 - DNA, 201 bp, Bos taurus; identical to SEQ ID NO: 5667

SEQ ID NO: 47138 - DNA, 201 bp, Bos taurus; identical to SEQ ID NO: 5668

SEQ ID NO: 47139 - DNA, 201 bp, Bos taurus; identical to SEQ ID NO: 5671

SEQ ID NO: 47140 - DNA, 201 bp, Bos taurus; identical to SEQ ID NO: 5672

SEQ ID NO: 47141 - DNA, 201 bp, Bos taurus; identical to SEQ ID NO: 5673

SEQ ID NO: 47142 - DNA, 201 bp, Bos taurus; identical to SEQ ID NO: 5675

SEQ ID NO: 47143 - DNA, 201 bp, Bos taurus; identical to SEQ ID NO: 5676

SEQ ID NO: 47144 - DNA, 201 bp, Bos taurus; identical to SEQ ID NO: 5677

SEQ ID NO: 47145 - DNA, 201 bp, Bos taurus; identical to SEQ ID NO: 5678

SEQ ID NO: 47146 - DNA, 201 bp, Bos taurus; identical to SEQ ID NO: 5679

SEQ ID NO: 47147 - DNA, 201 bp, Bos taurus; identical to SEQ ID NO: 5680

SEQ ID NO: 47148 - DNA, 201 bp, Bos taurus; identical to SEQ ID NO: 5681

SEQ ID NO: 47149 - DNA, 201 bp, Bos taurus; identical to SEQ ID NO: 5682

SEQ ID NO: 47150 - DNA, 201 bp, Bos taurus; identical to SEQ ID NO: 5683

SEQ ID NO: 47151 - DNA, 201 bp, Bos taurus; identical to SEQ ID NO: 5685

SEQ ID NO: 47152 - DNA, 201 bp, Bos taurus; identical to SEQ ID NO: 5686

SEQ ID NO: 47153 - DNA, 201 bp, Bos taurus; identical to SEQ ID NO: 5687

SEQ ID NO: 47154 - DNA, 201 bp, Bos taurus; identical to SEQ ID NO: 5688

SEQ ID NO: 47155 - DNA, 201 bp, Bos taurus; identical to SEQ ID NO: 5690

SEQ ID NO: 47156 - DNA, 201 bp, Bos taurus; identical to SEQ ID NO: 5691

SEQ ID NO: 47157 - DNA, 201 bp, Bos taurus; identical to SEQ ID NO: 5692

SEQ ID NO: 47158 - DNA, 201 bp, Bos taurus; identical to SEQ ID NO: 5693

SEQ ID NO: 47159 - DNA, 201 bp, Bos taurus; identical to SEQ ID NO: 5694

SEQ ID NO: 47160 - DNA, 201 bp, Bos taurus; identical to SEQ ID NO: 5695

SEQ ID NO: 47161 - DNA, 201 bp, Bos taurus; identical to SEQ ID NO: 5696

SEQ ID NO: 47162 - DNA, 201 bp, Bos taurus; identical to SEQ ID NO: 5700

SEQ ID NO: 47163 - DNA, 201 bp, Bos taurus; identical to SEQ ID NO: 5702

SEQ ID NO: 47164 - DNA, 201 bp, Bos taurus; identical to SEQ ID NO: 5703

SEQ ID NO: 47165 - DNA, 201 bp, Bos taurus; identical to SEQ ID NO: 5704

SEQ ID NO: 47166 - DNA, 201 bp, Bos taurus; identical to SEQ ID NO: 5705

SEQ ID NO: 47167 - DNA, 201 bp, Bos taurus; identical to SEQ ID NO: 5706

SEQ ID NO: 47168 - DNA, 201 bp, Bos taurus; identical to SEQ ID NO: 5709

SEQ ID NO: 47169 - DNA, 201 bp, Bos taurus; identical to SEQ ID NO: 5710

SEQ ID NO: 47170 - DNA, 201 bp, Bos taurus; identical to SEQ ID NO: 5711

SEQ ID NO: 47171 - DNA, 201 bp, Bos taurus; identical to SEQ ID NO: 5712

SEQ ID NO: 47172 - DNA, 201 bp, Bos taurus; identical to SEQ ID NO: 5713

SEQ ID NO: 47173 - DNA, 201 bp, Bos taurus; identical to SEQ ID NO: 5715

SEQ ID NO: 47174 - DNA, 201 bp, Bos taurus; identical to SEQ ID NO: 5716

SEQ ID NO: 47175 - DNA, 201 bp, Bos taurus; identical to SEQ ID NO: 5719

SEQ ID NO: 47176 - DNA, 201 bp, Bos taurus; identical to SEQ ID NO: 5721

SEQ ID NO: 47177 - DNA, 201 bp, Bos taurus; identical to SEQ ID NO: 5722

SEQ ID NO: 47178 - DNA, 201 bp, Bos taurus; identical to SEQ ID NO: 5725

SEQ ID NO: 47179 - DNA, 201 bp, Bos taurus; identical to SEQ ID NO: 5726

SEQ ID NO: 47180 - DNA, 201 bp, Bos taurus; identical to SEQ ID NO: 5727

SEQ ID NO: 47181 - DNA, 201 bp, Bos taurus; identical to SEQ ID NO: 5728

SEQ ID NO: 47182 - DNA, 201 bp, Bos taurus; identical to SEQ ID NO: 5729

SEQ ID NO: 47183 - DNA, 201 bp, Bos taurus; identical to SEQ ID NO: 5730

SEQ ID NO: 47184 - DNA, 201 bp, Bos taurus; identical to SEQ ID NO: 5731

SEQ ID NO: 47185 - DNA, 201 bp, Bos taurus; identical to SEQ ID NO: 5732

SEQ ID NO: 47186 - DNA, 201 bp, Bos taurus; identical to SEQ ID NO: 5735

SEQ ID NO: 47187 - DNA, 201 bp, Bos taurus; identical to SEQ ID NO: 5736

SEQ ID NO: 47188 - DNA, 201 bp, Bos taurus; identical to SEQ ID NO: 5739

SEQ ID NO: 47189 - DNA, 201 bp, Bos taurus; identical to SEQ ID NO: 5740

SEQ ID NO: 47190 - DNA, 201 bp, Bos taurus; identical to SEQ ID NO: 5741

SEQ ID NO: 47191 - DNA, 201 bp, Bos taurus; identical to SEQ ID NO: 5742

SEQ ID NO: 47192 - DNA, 201 bp, Bos taurus; identical to SEQ ID NO: 5743

SEQ ID NO: 47193 - DNA, 201 bp, Bos taurus
cagagaaaataataaatatggaggatatgcaattcatacatgaagagtccaaatgcaaaagcatatatattcaagatacaataaaattctctttgaaatatagaaaagataatgagatgtagactaaaagattatcccacataatgacacagtgttctagtgatatgatgagacattactgaacatcaaaaataaagaatg

SEQ ID NO: 47194 - DNA, 201 bp, Bos taurus
ggggcctgtgacgagccttgatcacttggagcttttgtgtaataaagttttattaaagtataaaagaaatagagaaagattctgacatagacatcagaagcggccagaaagaataacccccttgctagtctttagccggatgttatatagcagactagcagcctgctaattaaagaaaggaaatgtctcaaaactcaagcg

SEQ ID NO: 47195 - DNA, 201 bp, Bos taurus
atgaattctttagaacatagtcaactctttctaattttcatcaatcttcaaaaaatcctgtgttcctttaataaatatctgatctttttctattttctgctctgcattgaggcacttgcaaaagcaccaagaacacatgttatgtctctacaaagggtgcttcactacatttcatttaacctgtgtaataatacagtaaag

SEQ ID NO: 47196 - DNA, 201 bp, Bos taurus; identical to SEQ ID NO: 5745

SEQ ID NO: 47197 - DNA, 201 bp, Bos taurus; identical to SEQ ID NO: 5746

SEQ ID NO: 47198 - DNA, 201 bp, Bos taurus; identical to SEQ ID NO: 5748

SEQ ID NO: 47199 - DNA, 201 bp, Bos taurus; identical to SEQ ID NO: 5750

SEQ ID NO: 47200 - DNA, 201 bp, Bos taurus; identical to SEQ ID NO: 5751

SEQ ID NO: 47201 - DNA, 201 bp, Bos taurus; identical to SEQ ID NO: 5752

SEQ ID NO: 47202 - DNA, 201 bp, Bos taurus; identical to SEQ ID NO: 5753

SEQ ID NO: 47203 - DNA, 201 bp, Bos taurus
aggagagagctccagagtgggcctcccaggctgacttcccaacaatcctgtggagctggtcttctcagcgtgtttctcctgctacactaaggataccaggaacacgtaaaactgctggcccatgttagctatgacccggaactaggtaactgtttccacatttgttgaattcagagtcacgccttgccagccactcttcac

SEQ ID NO: 47204 - DNA, 201 bp, Bos taurus
aggtttcttataaagtagagttaaggaaatttttgtagctgaaatgagggggaatgtaacagaaataaagaaagacgatggtgaagtgcagctctttgacgtgatttgaggctgtgcatgtcactgaatattttggccaagtaatctatgtttttgaaagttaactctgtactggtggatctccaacttcaacatgcacca

SEQ ID NO: 47205 - DNA, 201 bp, Bos taurus
ccttcagagaggacaggttcactaaccaaaacaaataaaacatttttcctatatcaagaaaaattagactagataaagagaaatcaaaataagccagactgttattacaaatattttcttaagtaaacaatatatataaaactatatatatatatatatataaatgaggaaatatttccattttgatccctttttccaaat

SEQ ID NO: 47206 - DNA, 201 bp, Bos taurus; identical to SEQ ID NO: 5754

SEQ ID NO: 47207 - DNA, 201 bp, Bos taurus; identical to SEQ ID NO: 5755

SEQ ID NO: 47208 - DNA, 201 bp, Bos taurus
tcaaacacactctttctgaggtagcaaaagtaattgtttaacaattctgctgtattgagtcctcatttatttatatccttaaaaaggcaagtatatttctgtattttgaaaatcctggaaacaacacattttgggttggttttttgttttttttttttcctcagtaagtttttccctttaaaataattttagacttaggaa

SEQ ID NO: 47209 - DNA, 201 bp, Bos taurus; identical to SEQ ID NO: 5756

SEQ ID NO: 47210 - DNA, 201 bp, Bos taurus
gcaagagtcaaacatgacttagcagtctaaacaaccaccaccacaagcctctccttcctggctcacagggccattctcactatgtttttccatagtagaagggtcagtggcgtcctctgggtctctgttgttgtttaggctgctaagtcatgtctgactcttttgtgaccccatggactgtagccttcaaagttcctcatt

SEQ ID NO: 47211 - DNA, 201 bp, Bos taurus; identical to SEQ ID NO: 5757

SEQ ID NO: 47212 - DNA, 201 bp, Bos taurus; identical to SEQ ID NO: 5758

SEQ ID NO: 47213 - DNA, 201 bp, Bos taurus
catattcctccctgaagctgcaatgaagcagagatctcagccacaggctctgcccatctgtagaactgagtccatagctgcatctggctaaggagttcagctgatacaagctttgttggccatgaaacctgttctatgaccccaacgttggcagaggaaaaaaataaataaattgatgtcccacccaactgtttttttttt

SEQ ID NO: 47214 - DNA, 201 bp, Bos taurus; identical to SEQ ID NO: 5759

SEQ ID NO: 47215 - DNA, 201 bp, Bos taurus
cagcaaaccacatttggttcagcttcttcctctgctctatcctgcttcccttgtatccttatagatttctcctgaaaatgtttctcaatgaatcacccacgtatgaatcctcatcttataaccaatggaaatgtactgtatgactcaggaaactcaaaccagggctttgtaacaacctgtgctgtgcttagtcactcagtc

SEQ ID NO: 47216 - DNA, 201 bp, Bos taurus
actccaaaatcatgagaaaatatttttcagctgtttaagtcacccagtctgttacactattgaagaatccatggcaaattaatacagtgaccttccaagatagatgtctaaagaaaggggacaatttataaggattctaaatagaaatatttctccagattaatttaagtattaggggaatttatatggcttatcaaagtt

SEQ ID NO: 47217 - DNA, 201 bp, Bos taurus; identical to SEQ ID NO: 5760

SEQ ID NO: 47218 - DNA, 201 bp, Bos taurus
attttaatcttacaggcattgctattgtgatttcacactcaaagataccacgtttctttaatttggatgctccactaatttctatatgtaacaacaaccatatttagcaaaacatattttcctaaatccttgcttactacactgttgcaatcgttagtttatctattctgatagttacaaaccccttaggttcacacactt

SEQ ID NO: 47219 - DNA, 201 bp, Bos taurus; identical to SEQ ID NO: 5761

SEQ ID NO: 47220 - DNA, 201 bp, Bos taurus; identical to SEQ ID NO: 5762

SEQ ID NO: 47221 - DNA, 201 bp, Bos taurus
tattctcatcttgtctttcaaatggccaaagttgagagtttataccaattccatgaattgagatgtgagaaagtagtactatagtagctccttggtagctgtcacagactgttattgcctctccaattgccattttgccctccatttttgctcacagatccctactcttttttagtgcagaaatacgtccagcagaatgga

SEQ ID NO: 47222 - DNA, 201 bp, Bos taurus; identical to SEQ ID NO: 5763

SEQ ID NO: 47223 - DNA, 201 bp, Bos taurus; identical to SEQ ID NO: 5764

SEQ ID NO: 47224 - DNA, 201 bp, Bos taurus; identical to SEQ ID NO: 5765

SEQ ID NO: 47225 - DNA, 201 bp, Bos taurus; identical to SEQ ID NO: 5766

SEQ ID NO: 47226 - DNA, 201 bp, Bos taurus; identical to SEQ ID NO: 5767

SEQ ID NO: 47227 - DNA, 201 bp, Bos taurus
cagactcttcaaagcagcaggggtaaggatgttcatttacttaagcagtaggttctaccattagcgtttgtgattggtgttaattagaactgtgtgtgcacatctctctgccacagagcccacattttcaaaatcctagttacaatcaagctattaatgaattaagtacccatatttgtttgtgttcttttttaatctaat

SEQ ID NO: 47228 - DNA, 201 bp, Bos taurus; identical to SEQ ID NO: 5768

SEQ ID NO: 47229 - DNA, 201 bp, Bos taurus
cctttcttctcaaagaagctaagtgatggaaggagagggagcagtggttctcttcctggaactgctgtgcaaaccctctgatttctttataagaaacattatttatggtgatgaaatcagaacctgtaaaatttctatagggccttctgaaaattgtcagtatgattttattttaaatcatatttagtaaaattctgtctt

SEQ ID NO: 47230 - DNA, 201 bp, Bos taurus
accataggaaagaactggtttatgttagatgctcaccaagtatttggtgtattatctcagtttctgatgctatcattaaataagataaacttggccaaggtaaatgtaatttcctctacttggattatcagttcagttcagttgctcagccatgtccgactctttgcgaccccatgtgtcgcagcacgccaggcctccctg

SEQ ID NO: 47231 - DNA, 201 bp, Bos taurus; identical to SEQ ID NO: 5770

SEQ ID NO: 47232 - DNA, 201 bp, Bos taurus; identical to SEQ ID NO: 5771

SEQ ID NO: 47233 - DNA, 201 bp, Bos taurus; identical to SEQ ID NO: 5772

SEQ ID NO: 47234 - DNA, 201 bp, Bos taurus
gaggggtggttaaattatttctacttttaatgtgagagttccaaataattggtccggttgacttatttttcatagtttgaaggtgctccgtgctattccagcctttgaaagaagcaaatttcaaaagtaactcagacaacataaaggagggcctatcttgcccattttctgctttcttctcaatctaaaatggaatctaat

SEQ ID NO: 47235 - DNA, 201 bp, Bos taurus; identical to SEQ ID NO: 5773

SEQ ID NO: 47236 - DNA, 201 bp, Bos taurus; identical to SEQ ID NO: 5774

SEQ ID NO: 47237 - DNA, 201 bp, Bos taurus; identical to SEQ ID NO: 5775

SEQ ID NO: 47238 - DNA, 201 bp, Bos taurus; identical to SEQ ID NO: 5776

SEQ ID NO: 47239 - DNA, 201 bp, Bos taurus; identical to SEQ ID NO: 5777

SEQ ID NO: 47240 - DNA, 201 bp, Bos taurus; identical to SEQ ID NO: 5778

SEQ ID NO: 47241 - DNA, 201 bp, Bos taurus
actttctttaccagtggtagtgttagcctcttctactcaacccttcctgtacatgaaatatattgagatatccaatcatagggttatccccactatctgatagcaccaaatgcagggagcctgtttctttgacccctccctaaaattattcaacatagccctttctaatacccttctactgaagcaccccatggcaccttc

SEQ ID NO: 47242 - DNA, 201 bp, Bos taurus; identical to SEQ ID NO: 5779

SEQ ID NO: 47243 - DNA, 201 bp, Bos taurus
ttgctgctttacaggagggccgggtgagtggagagttgagtatttgtttatcttctcctgttcgtccttctccatccctcaactcccccacccgccccccacgatgatgccctaggccttctcttaaggagaaatggagaatttgacctgtctggaaaactggaaaactcaccctccatcttttggaaacaaaccactcaa

SEQ ID NO: 47244 - DNA, 201 bp, Bos taurus
tggagtgggttgccattgccttctccgaaagagtagccttagctcactgcaattagagaagacctgtgcaacaataaaggcccagagcagccaaagataacaaataaaaattaaaatacagactcctggacccctctctcaccatatctggatggcccagagacctacttttatccacattcccacgtcagtcttatgcac

SEQ ID NO: 47245 - DNA, 201 bp, Bos taurus
gaccctgcccctagcgaggtagtgacaactacagggcaaagagaaggccccgctccacaaccagggcagggtctgctcaccacaacacagtcacacctcctgtcaaggggattaacagctggcccacactaagaggtggcagccatccataccaaaacagccctcacacccaaaagattaaacctacgcaggctacacagg

SEQ ID NO: 47246 - DNA, 201 bp, Bos taurus
gggtcatcagcggtgcccaccctcggcgcctgcgcagactgaggctcactgtcaccatgacagcgaccgccgggggccctggtaagcggggttccccaggctcggagtctgagaccgtgctccacactgttggcttgcagtgagtggacattttctccggcccggtgccgtagttgggggccctttgagactcctctggtg

SEQ ID NO: 47247 - DNA, 201 bp, Bos taurus
atgtgaaacatctgaaaagagctcacatgagacagtgatcacaaaaaaaacccttcttttagcgtttttcatatacaaatgggtttaataaagcaaagagccttatagaaatgagctggaacataatctaaaatataaaaactactctgtaactgtcattcaagaagaggtaatagtatcaatcatgtaaaaacacctctg

SEQ ID NO: 47248 - DNA, 201 bp, Bos taurus
gatccaagatgagtggaggccaggatctggcttcccactctggaacctgaagcgaagcaggtgatccctctttggaccccttagacctgtgtgtggacatctggccaaggctcagccaatcagaggctctttggtgagactttgggtcttcagggagtgatgataaggctagagacagccataggtcattcatagtggctg

SEQ ID NO: 47249 - DNA, 201 bp, Bos taurus; identical to SEQ ID NO: 5780

SEQ ID NO: 47250 - DNA, 201 bp, Bos taurus; identical to SEQ ID NO: 5781

SEQ ID NO: 47251 - DNA, 201 bp, Bos taurus; identical to SEQ ID NO: 5782

SEQ ID NO: 47252 - DNA, 201 bp, Bos taurus; identical to SEQ ID NO: 5783

SEQ ID NO: 47253 - DNA, 201 bp, Bos taurus
cagcacacttccaaacttttcaaaaacatattaaaagcattcataattctgtaattactcccttagagtcaagttttcctttaattagcaattacacacatacagactaaataacaggtcgaagataccacattggaactacttccaaacaagaatcggaggatgtttgagttacagagcctcaggagttgcatgcggaca

SEQ ID NO: 47254 - DNA, 201 bp, Bos taurus; identical to SEQ ID NO: 5784

SEQ ID NO: 47255 - DNA, 201 bp, Bos taurus
aggttctcttaaacatgtgttactgtatttcccaattgggattttaatggttgctgttttaaatttaaaatattggagtgaaattacgtatctgcaacattgtctttccttttagaaacagaatagatgctcactttaaagattgattctgctggatatattttgcaactagttacctaaatgaactgtcttactacatct

SEQ ID NO: 47256 - DNA, 201 bp, Bos taurus
tgtctgtcttctgcaaggaggggttcagttacaatctattttgctccttcactaagcttgtcctccagtctggcctttcatagtaataaaggtggtatttaaccctatacttgtctaacatcttgtttttgtggtttagtcactaagtggtgtctgactcttgtgaccccgtggacttggggacatagccagccaagctcc

SEQ ID NO: 47257 - DNA, 201 bp, Bos taurus
tggtaaacattagcaaagagaagccttgcaaggagtttattttttctgagacagatcagtttaagaaacaacagtgaaggcttctttaccttgggcccacgttgacttcaacctgtaggaacctgagagaaattcaggtttactcacattttatctggtcaaaaggcagtcttttcttagaactcatcttgagtgcaatca

SEQ ID NO: 47258 - DNA, 201 bp, Bos taurus; identical to SEQ ID NO: 5785

SEQ ID NO: 47259 - DNA, 201 bp, Bos taurus; identical to SEQ ID NO: 5786

SEQ ID NO: 47260 - DNA, 201 bp, Bos taurus; identical to SEQ ID NO: 5787

SEQ ID NO: 47261 - DNA, 201 bp, Bos taurus; identical to SEQ ID NO: 5788

SEQ ID NO: 47262 - DNA, 201 bp, Bos taurus; identical to SEQ ID NO: 5789

SEQ ID NO: 47263 - DNA, 201 bp, Bos taurus; identical to SEQ ID NO: 5790

SEQ ID NO: 47264 - DNA, 201 bp, Bos taurus
aaggaaagttgtactatttacaaaaataaagtcagagaagcagatttagaagggataaacagctttgtttcgaaaatgttttgaattgctgggaggccatacaagtgggtcttaagagggtgtgatgctcttgtaatgtgtcagcttggttgatacattgcaagcttggccatcctacattttttagaattcttagtttct

SEQ ID NO: 47265 - DNA, 201 bp, Bos taurus; identical to SEQ ID NO: 5791

SEQ ID NO: 47266 - DNA, 201 bp, Bos taurus; identical to SEQ ID NO: 5792

SEQ ID NO: 47267 - DNA, 201 bp, Bos taurus; identical to SEQ ID NO: 5793

SEQ ID NO: 47268 - DNA, 201 bp, Bos taurus; identical to SEQ ID NO: 5794

SEQ ID NO: 47269 - DNA, 201 bp, Bos taurus
taacaactccaattggaaaatttgagcagcatacatcttttccacctggtgctgtcaccaaagcaaaaacagatgaagtggtaacgctaacaccaaccacagggtcaaaggtaactttcagtccatggcctaaacaaaaatatgaaacagaaggtaccagtccaaggggatttgtatctccttttagcattggtgttaccc

SEQ ID NO: 47270 - DNA, 201 bp, Bos taurus; identical to SEQ ID NO: 5795

SEQ ID NO: 47271 - DNA, 201 bp, Bos taurus; identical to SEQ ID NO: 5796

SEQ ID NO: 47272 - DNA, 201 bp, Bos taurus; identical to SEQ ID NO: 5797

SEQ ID NO: 47273 - DNA, 201 bp, Bos taurus; identical to SEQ ID NO: 5798

SEQ ID NO: 47274 - DNA, 201 bp, Bos taurus; identical to SEQ ID NO: 5799

SEQ ID NO: 47275 - DNA, 201 bp, Bos taurus
ctcaaactggggatcaaattatatgcattttaagtacaaatcaataacttaaataattctttgacggattaattcattctttcattcagcagtacttatcatgagaatgtaaagtgatacagccacagtggaaaacaatacagaggttccttaagaaactaaacacagggttataatatgatcctgtgatcctattcctgg

SEQ ID NO: 47276 - DNA, 201 bp, Bos taurus
tttaaacagtttttcaagttagagtatcagagatgttgctaagtgccagagatagtcactagaatctctttgatagataattgtgcctagaaaaagataattaaactgttttctaactaaagtaggagtgcatgtgtgatagagagagaggaatgttgtacaatgatcttttttggtcttgaattactcaaaacacatttc

SEQ ID NO: 47277 - DNA, 201 bp, Bos taurus; identical to SEQ ID NO: 5800

SEQ ID NO: 47278 - DNA, 201 bp, Bos taurus; identical to SEQ ID NO: 5801

SEQ ID NO: 47279 - DNA, 201 bp, Bos taurus; identical to SEQ ID NO: 5802

SEQ ID NO: 47280 - DNA, 201 bp, Bos taurus; identical to SEQ ID NO: 5804

SEQ ID NO: 47281 - DNA, 201 bp, Bos taurus; identical to SEQ ID NO: 5805

SEQ ID NO: 47282 - DNA, 201 bp, Bos taurus; identical to SEQ ID NO: 5807

SEQ ID NO: 47283 - DNA, 201 bp, Bos taurus
tgccatcaaatttggaaaactcagcaatggccacaggactgggaaaggtcagttttcattccatatcaaagaaggcaataccaaagaacaggaaaactgctatacaattgaacttatttcacatgctagcaagttttaatgttcaaaaaccttcaaatatgtgaaccaagaatttccaaatgtacaagttaggtgtagaaa

SEQ ID NO: 47284 - DNA, 201 bp, Bos taurus; identical to SEQ ID NO: 5809

SEQ ID NO: 47285 - DNA, 201 bp, Bos taurus; identical to SEQ ID NO: 5810

SEQ ID NO: 47286 - DNA, 201 bp, Bos taurus
gcattagaagacagagaaaagtggagagtttgggtcatcccccaaaagagcatccactgaatgctgtgtatagatttttttttaaattgaaaatatcaccatgaggaatattgctgcagtatcgtgaaactttatgcaagataaccactgaatgttctactcctattggttgacctgaggaattattgcacatacacatat

SEQ ID NO: 47287 - DNA, 201 bp, Bos taurus; identical to SEQ ID NO: 5812

SEQ ID NO: 47288 - DNA, 201 bp, Bos taurus; identical to SEQ ID NO: 5813

SEQ ID NO: 47289 - DNA, 201 bp, Bos taurus
cctacatctctccctgggaacaatacgaagacaagggccaacttctggatgtttgacctgtgcttgacttaacgctctgatgttgcctcttgatattcttgatagttttttaacaagaggccccacatttttatttcgtcctgggtcccacaaattttgtaagtggtcctagtaaggagattggctatggatggaggaaca

SEQ ID NO: 47290 - DNA, 201 bp, Bos taurus; identical to SEQ ID NO: 5814

SEQ ID NO: 47291 - DNA, 201 bp, Bos taurus; identical to SEQ ID NO: 5815

SEQ ID NO: 47292 - DNA, 201 bp, Bos taurus; identical to SEQ ID NO: 5816

SEQ ID NO: 47293 - DNA, 201 bp, Bos taurus; identical to SEQ ID NO: 5817

SEQ ID NO: 47294 - DNA, 201 bp, Bos taurus; identical to SEQ ID NO: 5818

SEQ ID NO: 47295 - DNA, 201 bp, Bos taurus; identical to SEQ ID NO: 5819

SEQ ID NO: 47296 - DNA, 201 bp, Bos taurus; identical to SEQ ID NO: 5820

SEQ ID NO: 47297 - DNA, 201 bp, Bos taurus; identical to SEQ ID NO: 5821

SEQ ID NO: 47298 - DNA, 201 bp, Bos taurus; identical to SEQ ID NO: 5826

SEQ ID NO: 47299 - DNA, 201 bp, Bos taurus; identical to SEQ ID NO: 5827

SEQ ID NO: 47300 - DNA, 201 bp, Bos taurus; identical to SEQ ID NO: 5828

SEQ ID NO: 47301 - DNA, 201 bp, Bos taurus; identical to SEQ ID NO: 5830

SEQ ID NO: 47302 - DNA, 201 bp, Bos taurus
aaagctaactcagagtaataatcaacagctagggaagacacaaacattttttaactatgaaggcagtggattataaatccaaatattagagttagagcttaagaagtcatttaaattttctcaagtttcaatcatctctgttttaaaatataactaattatgttgattctcttcaaagagctagtactaaaaatagaaaag

SEQ ID NO: 47303 - DNA, 201 bp, Bos taurus; identical to SEQ ID NO: 5831

SEQ ID NO: 47304 - DNA, 201 bp, Bos taurus
aatagattattcgtgttcttgaagaactgtaatgttctagtgagctacaacttagaaaaaaattacattataagtcttggtttataatttaagtatgttcgattcaagattagtttttccacacaagtagttataacgagacattaagatcccaaaccagctactgaaaccctttaactcttcatccgactattatggatt

SEQ ID NO: 47305 - DNA, 201 bp, Bos taurus; identical to SEQ ID NO: 5832

SEQ ID NO: 47306 - DNA, 201 bp, Bos taurus; identical to SEQ ID NO: 5833

SEQ ID NO: 47307 - DNA, 201 bp, Bos taurus; identical to SEQ ID NO: 5834

SEQ ID NO: 47308 - DNA, 201 bp, Bos taurus; identical to SEQ ID NO: 5835

SEQ ID NO: 47309 - DNA, 201 bp, Bos taurus; identical to SEQ ID NO: 5836

SEQ ID NO: 47310 - DNA, 201 bp, Bos taurus; identical to SEQ ID NO: 5837

SEQ ID NO: 47311 - DNA, 201 bp, Bos taurus
tcatgtaactgaataaacagaatgacgctgagtcgatgctgccatgtctaccagcacactgtgcaaaagagacgaatgcaaacttggtaggcagacgagtatgggatagagttgagttatctaggtttacttggataaccaggaccaaattcctggctttgtgtttttgcataatacttgcatttatttttaagatctatg

SEQ ID NO: 47312 - DNA, 201 bp, Bos taurus
acaggaactatagtctactgtgacctggagaggttgtagaaacttcatgaaagaattggaacttgggcagcatatttaagaatggacaggattaagctttcaggtaagggtagcgaggaagaaaggcataggaagtgattttgagcatgagagcgagttgtgatgttcaagatagatgactctcccaatatgataaaggac

SEQ ID NO: 47313 - DNA, 201 bp, Bos taurus
ccttgaactgtcactagaggggcccctttcatgtacttccccaggtcctcagctccatgaaccattcctgttggtgtgcactctgctccctgcgctgtcccgggcctcttcctcggcacatcctcgaacttgtcacatctctcctaaaataggaagcccacacggagcaccgggttcctgggaagaggagccagggacagc

SEQ ID NO: 47314 - DNA, 201 bp, Bos taurus; identical to SEQ ID NO: 5844

SEQ ID NO: 47315 - DNA, 201 bp, Bos taurus
taaagggacaaacacatttttattatttctgaatgtatatgatctaagatgtatattatgtattatttctgcttccttcacatctgtttattcacaattaggtaacatttaggaactgaagtttacaagtgctacttgatttccaaaacaggcaggacccattgatcagacttttaaagccattcttttccaaaacaaaaa

SEQ ID NO: 47316 - DNA, 201 bp, Bos taurus; identical to SEQ ID NO: 5845

SEQ ID NO: 47317 - DNA, 201 bp, Bos taurus
gcatgtcagtttgagagttatcactctgaagcctgggttggctttgattactgcatcattactaagctgcagttttcccataactataaatcgcaattatttgccatttaatatttttcaaaatcaacctttttaatgactccacagtcgtctatcacacggctaatccataagtgagttgtctaattgcatactgtgaga

SEQ ID NO: 47318 - DNA, 201 bp, Bos taurus; identical to SEQ ID NO: 5847

SEQ ID NO: 47319 - DNA, 201 bp, Bos taurus
atccagagttgccacaatatatgatctaaagtatctacttttcaacaagatattataagatatgcaaggagggaaaaagtggccaatagaaactgggtatctctagatattgaatttaaacacagtctttaaagcagaattataaataaattcaatgaaccaaaggtgaccacacttaaaaaacaaaacgaaagtaaggca

SEQ ID NO: 47320 - DNA, 201 bp, Bos taurus
gatgaaacagaataaggaaatgtatcaaaagtacacacatgcttatgctaacagcatttggtgtgagaatatttgctgatatgaaaggcctcagattagacagataatgaatgtagaaggtttgccttttgaagaattaggcaatgcttaaaaaaaaaattgtaaggggcctagccacatataaaaactgattttgatgat

SEQ ID NO: 47321 - DNA, 201 bp, Bos taurus
tgtgtgcctagacctgggtttaatagaccaatgattccaatttcccattgtgaaactcccattttgaccgcaagacagataaaaaaaaaaaagtttttaacgtaaatacaggcctaatagtaacatgtcacaatgcatcctttatgggagtcagtgtgatccaatgtttaatatggctgacccgtgttgatgtatggcaca

SEQ ID NO: 47322 - DNA, 201 bp, Bos taurus; identical to SEQ ID NO: 5849

SEQ ID NO: 47323 - DNA, 201 bp, Bos taurus; identical to SEQ ID NO: 5850

SEQ ID NO: 47324 - DNA, 201 bp, Bos taurus; identical to SEQ ID NO: 5851

SEQ ID NO: 47325 - DNA, 201 bp, Bos taurus; identical to SEQ ID NO: 5852

SEQ ID NO: 47326 - DNA, 201 bp, Bos taurus; identical to SEQ ID NO: 5854

SEQ ID NO: 47327 - DNA, 201 bp, Bos taurus; identical to SEQ ID NO: 5855

SEQ ID NO: 47328 - DNA, 201 bp, Bos taurus; identical to SEQ ID NO: 5856

SEQ ID NO: 47329 - DNA, 201 bp, Bos taurus; identical to SEQ ID NO: 5857

SEQ ID NO: 47330 - DNA, 201 bp, Bos taurus; identical to SEQ ID NO: 5858

SEQ ID NO: 47331 - DNA, 201 bp, Bos taurus
tgagcatctggatttgctcttccctaatcagatatctttccagctcctccaagtaggtcggcctcactcagcctgtcttgcttagctgccgtggccatcacaactgagataccagagactaaaccgcaactccacaggtggtcccagggctcctggagtgatgctgggctctctagcaactgcacatcttttccagctatg

SEQ ID NO: 47332 - DNA, 201 bp, Bos taurus
atgcagccccaagggggcttgggagtggctgagagcaccgatgaactctaagaagcttgaacccatgttaggatctcaggcagtagcagaagtcgtgggcataacatccaatttctaaagggtaggaaagacaatttaaatagctgatgccagcagagaatagagaatgcctattgaccagacacatgcacaccctgtcaa

SEQ ID NO: 47333 - DNA, 201 bp, Bos taurus
gaggtgctcccctttctgctctgggccatgggaggatacaagtgtgacttgactatctgcatcccagaagagggctctcaccagaacctgagcatgttggtaccctggtcttggacttctggcctgtagtagtcctgtgggaaatgaatgtctggtgtttcagttcactcagttgtgtccaactctttgtgaccccatgga

SEQ ID NO: 47334 - DNA, 201 bp, Bos taurus; identical to SEQ ID NO: 5860

SEQ ID NO: 47335 - DNA, 201 bp, Bos taurus
cggtgcagccatggctccttggacatggggtagttcctcccggccaccgcccctgacctcgggtgtggggtagcttctctcgccacgcttctgcatggtccgtcgcagccaggctgggccaaaaagaaaaaaagattaatataaagtagtcttatgggttaaacattcttttcagaattttgaccctagaatataatacct

SEQ ID NO: 47336 - DNA, 201 bp, Bos taurus; identical to SEQ ID NO: 5861

SEQ ID NO: 47337 - DNA, 201 bp, Bos taurus; identical to SEQ ID NO: 5864

SEQ ID NO: 47338 - DNA, 201 bp, Bos taurus; identical to SEQ ID NO: 5865

SEQ ID NO: 47339 - DNA, 201 bp, Bos taurus; identical to SEQ ID NO: 5866

SEQ ID NO: 47340 - DNA, 201 bp, Bos taurus; identical to SEQ ID NO: 5872

SEQ ID NO: 47341 - DNA, 201 bp, Bos taurus; identical to SEQ ID NO: 5873

SEQ ID NO: 47342 - DNA, 201 bp, Bos taurus; identical to SEQ ID NO: 5875

SEQ ID NO: 47343 - DNA, 201 bp, Bos taurus
tctacctttagttttttgaggaacctccatatcgttttccacagtggttgcaccaatttacattctcaccaacagcataatatcccttttcttcacaccctctccataatttgttatttacagacttaaattgtggccattctgaccattgggatgttgtacttcactgtagtattaattcatgcttttctaataaatagc

SEQ ID NO: 47344 - DNA, 201 bp, Bos taurus; identical to SEQ ID NO: 5876

SEQ ID NO: 47345 - DNA, 201 bp, Bos taurus; identical to SEQ ID NO: 5877

SEQ ID NO: 47346 - DNA, 201 bp, Bos taurus
gccaccagggaaaccctgtaatcaactatactcttgtaaaaaaaatagtattaatagtaattaaaaggaaaagatgcagggccatctgaggtgtgggagccgtggggaaagataactggaaataagaagagggtgaagtaattattgttctgtgcaggtgcaactaagttacaggttagcatgttctgggggtggggtttt

SEQ ID NO: 47347 - DNA, 201 bp, Bos taurus; identical to SEQ ID NO: 5882

SEQ ID NO: 47348 - DNA, 201 bp, Bos taurus; identical to SEQ ID NO: 5883

SEQ ID NO: 47349 - DNA, 201 bp, Bos taurus; identical to SEQ ID NO: 5884

SEQ ID NO: 47350 - DNA, 201 bp, Bos taurus
agtctaaagggtttctttgcagagataaatgtctccagagagactgatgagtcaaggagtctgttaataggataagtaaatgtaacctttcacctagttattgctattacctaagtcataactacgtagttttagcaaattgtttgaactcgttccagttacttaataaaacagagcatattggtcccattcttttctagt

SEQ ID NO: 47351 - DNA, 201 bp, Bos taurus; identical to SEQ ID NO: 5887

SEQ ID NO: 47352 - DNA, 201 bp, Bos taurus; identical to SEQ ID NO: 5888

SEQ ID NO: 47353 - DNA, 201 bp, Bos taurus; identical to SEQ ID NO: 5889

SEQ ID NO: 47354 - DNA, 201 bp, Bos taurus; identical to SEQ ID NO: 5890

SEQ ID NO: 47355 - DNA, 201 bp, Bos taurus; identical to SEQ ID NO: 5891

SEQ ID NO: 47356 - DNA, 201 bp, Bos taurus; identical to SEQ ID NO: 5892

SEQ ID NO: 47357 - DNA, 201 bp, Bos taurus; identical to SEQ ID NO: 5893

SEQ ID NO: 47358 - DNA, 201 bp, Bos taurus; identical to SEQ ID NO: 5894

SEQ ID NO: 47359 - DNA, 201 bp, Bos taurus; identical to SEQ ID NO: 5895

SEQ ID NO: 47360 - DNA, 201 bp, Bos taurus; identical to SEQ ID NO: 5896

SEQ ID NO: 47361 - DNA, 201 bp, Bos taurus
acagggcagagacacaggaggatctcacatcaacaattaattgccagtgctttccaaaacagctcatccagaattaggttgggaggcctacttgaatacagtatgccagaaagagcaatcagttcagttcagtctctcagtcgtgtccaactctttgtgcccccaagaaccacagcacaccaggcctctctgtccatcacc

SEQ ID NO: 47362 - DNA, 201 bp, Bos taurus; identical to SEQ ID NO: 5899

SEQ ID NO: 47363 - DNA, 201 bp, Bos taurus
ccatgacattttccaggcaaggatactggagtgggttgccatttccttatccagcaaataggatagatttatttaaattactacttaaagagaatatttcgattaaagaaagcaaatgtaccataaatacatataaaatattcatatttataataaaacataattttttgcagtaaatgtatatataatactcaaaattgt

SEQ ID NO: 47364 - DNA, 201 bp, Bos taurus
ttttttttttttccagaaaacataatttggagccatgtaccctacctttcataaatctttgacttcataggtttcctctcttgatctaagacctccatttctatggtagtactttcattagtataaccaactagtttgaagttgtaatggggttttgtcaagttacttgacatcctcagacagtactttcttctgtgtgta

SEQ ID NO: 47365 - DNA, 201 bp, Bos taurus; identical to SEQ ID NO: 5900

SEQ ID NO: 47366 - DNA, 201 bp, Bos taurus; identical to SEQ ID NO: 5903

SEQ ID NO: 47367 - DNA, 201 bp, Bos taurus
tgttaaagttgtggggcataaaaatagagcttgaatagggactgattcactagattattttaacccaaaggctttcctccaatttacaaaggaatcagcacggtgctgaagcccactgtttaaataaaatatactgactgccaaaggaagaaaagactcttaagtcacagacacactttcaaagcctcaaaagactctgtc

SEQ ID NO: 47368 - DNA, 201 bp, Bos taurus
tagctcagttttgtctttgtaaattacttttgtaagtcttcttagaaaagtttctaatttctagttcatttttgcaataacctgcatttccatcaatagcctttcttcattttttctgtattttaatttcctccttttgaacttagtgtctgtttagacagatgaggtctgtttcattgttccttcaggggaattttcttg

SEQ ID NO: 47369 - DNA, 201 bp, Bos taurus
gtgtgcactggcttatttaggcaatgttcaatccttactatatagtctcatttcctactgagattttccgtttcctgtagattcttacttctcttccaatgggagaagaccctttaatatttcttgtagggcaagcttagtattgctgaattttttcaatttttacttgtttgagaaattatttctattatacatgacaat

SEQ ID NO: 47370 - DNA, 201 bp, Bos taurus
attccttattttatagacacaaaagctatacttttcaactgtatctggtattggcacacagtattcatagcatatattctgaaataaaatcaatctcatatataaaattatacagttttgaggtaatataacatattggctagaaacagctcatcaacttcatatcattttgtttcctttcaataatgtatttctttcata

SEQ ID NO: 47371 - DNA, 201 bp, Bos taurus; identical to SEQ ID NO: 5904

SEQ ID NO: 47372 - DNA, 201 bp, Bos taurus; identical to SEQ ID NO: 5905

SEQ ID NO: 47373 - DNA, 201 bp, Bos taurus
tcaatgtgttgttctcctgatgacgaatgacttagtcatcagcaaaagtaacagtggcacatatattgtggttatttaggtcacacgacatgcaaaaaaacgccacttcattaggacagaaattatgttgtgggttttaagtgctcagaaataagagtgagacgaattgatttctctgaagcaaaccctgggaggagaaac

SEQ ID NO: 47374 - DNA, 201 bp, Bos taurus; identical to SEQ ID NO: 5906

SEQ ID NO: 47375 - DNA, 201 bp, Bos taurus; identical to SEQ ID NO: 5907

SEQ ID NO: 47376 - DNA, 201 bp, Bos taurus; identical to SEQ ID NO: 5908

SEQ ID NO: 47377 - DNA, 201 bp, Bos taurus; identical to SEQ ID NO: 5909

SEQ ID NO: 47378 - DNA, 201 bp, Bos taurus; identical to SEQ ID NO: 5910

SEQ ID NO: 47379 - DNA, 201 bp, Bos taurus; identical to SEQ ID NO: 5911

SEQ ID NO: 47380 - DNA, 201 bp, Bos taurus
atgtataattcttagaatcaaaccggaataacagtcggtagctgtcatttcatgcttcgctttgactttctctgttgggaagatcagagtacactctttcaatgtgtagccccgcgcccagcagagcagggtcaagaacaataagcagtatgcactcttgttggcaacacgcctgtcagtattagcaagaggaatttagcc

SEQ ID NO: 47381 - DNA, 201 bp, Bos taurus; identical to SEQ ID NO: 5912

SEQ ID NO: 47382 - DNA, 201 bp, Bos taurus; identical to SEQ ID NO: 5913

SEQ ID NO: 47383 - DNA, 201 bp, Bos taurus; identical to SEQ ID NO: 5914

SEQ ID NO: 47384 - DNA, 201 bp, Bos taurus
tgcattatgggggatgtaaaatgaatcagatggtggattctgccctcaaagaacttaaagggctatgaactatcaattctcattatgagggttcagagaaagtgaaatgacttctggctgagattaatttgagaaagtgtgtggaactgggtgtggagaaaagcaaacagctccttccctgtagcagaagcacacagagca

SEQ ID NO: 47385 - DNA, 201 bp, Bos taurus; identical to SEQ ID NO: 5915

SEQ ID NO: 47386 - DNA, 201 bp, Bos taurus; identical to SEQ ID NO: 5916

SEQ ID NO: 47387 - DNA, 201 bp, Bos taurus; identical to SEQ ID NO: 5917

SEQ ID NO: 47388 - DNA, 201 bp, Bos taurus
gatgatgtggggaataacgaggaaatcatccaggatagagagaaaaagacaagtgtatgatgagaagtccttggggaataatgcccacattacacactcacattttgagtatgctttcccactgccttgcagcctccattgtttctgctgagaagttagttattaatcttcttggagttctcttgtacatggtgattcatt

SEQ ID NO: 47389 - DNA, 201 bp, Bos taurus; identical to SEQ ID NO: 5918

SEQ ID NO: 47390 - DNA, 201 bp, Bos taurus; identical to SEQ ID NO: 5919

SEQ ID NO: 47391 - DNA, 201 bp, Bos taurus; identical to SEQ ID NO: 5920

SEQ ID NO: 47392 - DNA, 201 bp, Bos taurus; identical to SEQ ID NO: 5921

SEQ ID NO: 47393 - DNA, 201 bp, Bos taurus; identical to SEQ ID NO: 5922

SEQ ID NO: 47394 - DNA, 201 bp, Bos taurus; identical to SEQ ID NO: 5923

SEQ ID NO: 47395 - DNA, 201 bp, Bos taurus
agcccagtgggatgcagtgcctagggttgcaaagagctggacatgaatgaatgacttcactttcactggagacacagctccatcacaggccacaaactcagcagtcttgagtgaggaaacagaggataatttaacaagatgtacattcagttcaggtcagttgctcagtcatgtctgactcttttgacctcatggactgca

SEQ ID NO: 47396 - DNA, 201 bp, Bos taurus
tgaatggaaatcagaattattgggccatatatcctcaaaggcagaaggagtgccattattaaaagactcttctccatactgtggactttaggcaagctcaggttatgattaaagtcatatgcattatgtgcgttaagtggaggaggccaccagggtaaaatcggcaagcatgcagcaggccaagttcactcagtgctcaca

SEQ ID NO: 47397 - DNA, 201 bp, Bos taurus; identical to SEQ ID NO: 5925

SEQ ID NO: 47398 - DNA, 201 bp, Bos taurus; identical to SEQ ID NO: 5927

SEQ ID NO: 47399 - DNA, 201 bp, Bos taurus; identical to SEQ ID NO: 5929

SEQ ID NO: 47400 - DNA, 201 bp, Bos taurus; identical to SEQ ID NO: 5930

SEQ ID NO: 47401 - DNA, 201 bp, Bos taurus; identical to SEQ ID NO: 5932

SEQ ID NO: 47402 - DNA, 201 bp, Bos taurus; identical to SEQ ID NO: 5934

SEQ ID NO: 47403 - DNA, 201 bp, Bos taurus; identical to SEQ ID NO: 5935

SEQ ID NO: 47404 - DNA, 201 bp, Bos taurus; identical to SEQ ID NO: 5936

SEQ ID NO: 47405 - DNA, 201 bp, Bos taurus; identical to SEQ ID NO: 5937

SEQ ID NO: 47406 - DNA, 201 bp, Bos taurus; identical to SEQ ID NO: 5938

SEQ ID NO: 47407 - DNA, 201 bp, Bos taurus; identical to SEQ ID NO: 5939

SEQ ID NO: 47408 - DNA, 201 bp, Bos taurus; identical to SEQ ID NO: 5940

SEQ ID NO: 47409 - DNA, 201 bp, Bos taurus; identical to SEQ ID NO: 5941

SEQ ID NO: 47410 - DNA, 201 bp, Bos taurus; identical to SEQ ID NO: 5943

SEQ ID NO: 47411 - DNA, 201 bp, Bos taurus; identical to SEQ ID NO: 5944

SEQ ID NO: 47412 - DNA, 201 bp, Bos taurus; identical to SEQ ID NO: 5945

SEQ ID NO: 47413 - DNA, 201 bp, Bos taurus; identical to SEQ ID NO: 5948

SEQ ID NO: 47414 - DNA, 201 bp, Bos taurus; identical to SEQ ID NO: 5949

SEQ ID NO: 47415 - DNA, 201 bp, Bos taurus; identical to SEQ ID NO: 5950

SEQ ID NO: 47416 - DNA, 201 bp, Bos taurus; identical to SEQ ID NO: 5951

SEQ ID NO: 47417 - DNA, 201 bp, Bos taurus; identical to SEQ ID NO: 5952

SEQ ID NO: 47418 - DNA, 201 bp, Bos taurus; identical to SEQ ID NO: 5954

SEQ ID NO: 47419 - DNA, 201 bp, Bos taurus; identical to SEQ ID NO: 5956

SEQ ID NO: 47420 - DNA, 201 bp, Bos taurus; identical to SEQ ID NO: 5959

SEQ ID NO: 47421 - DNA, 201 bp, Bos taurus; identical to SEQ ID NO: 5960

SEQ ID NO: 47422 - DNA, 201 bp, Bos taurus; identical to SEQ ID NO: 5961

SEQ ID NO: 47423 - DNA, 201 bp, Bos taurus; identical to SEQ ID NO: 5963

SEQ ID NO: 47424 - DNA, 201 bp, Bos taurus; identical to SEQ ID NO: 5964

SEQ ID NO: 47425 - DNA, 201 bp, Bos taurus; identical to SEQ ID NO: 5965

SEQ ID NO: 47426 - DNA, 201 bp, Bos taurus; identical to SEQ ID NO: 5966

SEQ ID NO: 47427 - DNA, 201 bp, Bos taurus; identical to SEQ ID NO: 5968

SEQ ID NO: 47428 - DNA, 201 bp, Bos taurus
catagagactgaaagttgaggggacgattcatgcagggcaatgtcaaatgcactcgcctgacacgggctagagaggagtcctcagcatgcccagctatgacgaggccaattagaagacttcagatcaagcaatgcttaagccacagtcagtcctcaggagtgaggacctggattgtgactgtggagagagcaaagaggaag

SEQ ID NO: 47429 - DNA, 201 bp, Bos taurus; identical to SEQ ID NO: 5969

SEQ ID NO: 47430 - DNA, 201 bp, Bos taurus
tttcttctctctccatggccacatgcccagagaggagggtgtaatataagaagcagagaaaaagatttgagatgggaagaaatcgcgtgaagggagcatccggccaagatgcgggtccagacagcaagggaaatgggtgccagtgttcacggtgggggcacctgctgcaatctctcctgtggtcgggctgcaggttctctg

SEQ ID NO: 47431 - DNA, 201 bp, Bos taurus
gcattcataataaaatttgagatgagaaatttgatcatttgagatggccatgggaatggattcaattatagctaaaaatctactaaatatctactacatatctatgtttttaaaaatgtgttataactgaatgtttctttgggtaaagcaactagattgtcctgtccacaggctgtgagcacagtgagaccagggcaaagt

SEQ ID NO: 47432 - DNA, 201 bp, Bos taurus; identical to SEQ ID NO: 5970

SEQ ID NO: 47433 - DNA, 201 bp, Bos taurus; identical to SEQ ID NO: 5974

SEQ ID NO: 47434 - DNA, 201 bp, Bos taurus; identical to SEQ ID NO: 5976

SEQ ID NO: 47435 - DNA, 201 bp, Bos taurus
gaacccttcattcccgtctccagggtaggaagcatctttgacaaccacacgaggacacgacattgtcatctggtttttcaaacattaaggccttgtcctcactctcaggtcattttgcaatatgatagtcctctttgtcttcagacaggtcttcctttgagaccccacactctccagggccctgcaggactgcgctcggcc

SEQ ID NO: 47436 - DNA, 201 bp, Bos taurus; identical to SEQ ID NO: 5977

SEQ ID NO: 47437 - DNA, 201 bp, Bos taurus; identical to SEQ ID NO: 5978

SEQ ID NO: 47438 - DNA, 201 bp, Bos taurus
tctaggtgggaaccccaaagcactctgcccaggggctctaatagaaggccctaggtccagcctctctctctgtcacaccagccttgacccctctacccccgccccaagcccctgtgcttctgtggcctcctcctcccggaccggtgatcaagaagcttctctatttcggtctccttgcgctcacctcagacaccccagggg

SEQ ID NO: 47439 - DNA, 201 bp, Bos taurus
agcctgaagatgactctgtcagtcccaaaacaggactgtctgctccagcgtggggtcattcctggatgtgactatatttggatgtccctctgcacaacagttcagctggtagagaatccacctgcaatgcaggagatcctggtttgatttctgggttgggaagatctactggagaagggataggctacccactccagtatt

SEQ ID NO: 47440 - DNA, 201 bp, Bos taurus
tggttagtatgtcattagactgggtatttttttatgcactctaaataaacatggggacaagagaaacaaccacagatttggcctgaagggctcctggatgcactgttggctagatttgggagcacagtaccattcaccatcacaaaagccccgcttggaccagagagacaggaggccacagcggggtttccaccgtcagtt

SEQ ID NO: 47441 - DNA, 201 bp, Bos taurus; identical to SEQ ID NO: 5979

SEQ ID NO: 47442 - DNA, 201 bp, Bos taurus; identical to SEQ ID NO: 5980

SEQ ID NO: 47443 - DNA, 201 bp, Bos taurus; identical to SEQ ID NO: 5981

SEQ ID NO: 47444 - DNA, 201 bp, Bos taurus
ccattaacttacaggagtctcccacatttttttctacttacagtcccagagtgggattacctgtttgatcacttactttgtcctttgctctgtccctgtcgaaaccagccttcttgcatgaccattcactatcttatcttgcaaaacatatactgggagtgctgaaacattatggaaattatgtagttgttaatgaaactc

SEQ ID NO: 47445 - DNA, 201 bp, Bos taurus
tctcttcatgtggtgttgatttctcagtgtgtaactcggccctcaaggaatagaaaatattttataaactgtatcattaagtcagtctaagctcccaaaaaaggattatctaaaagggtctctgggggtaaatgttttattattttacgtaattggaatttaaggtggctcaaatggtaaagaatttgcctgcaatgcagg

SEQ ID NO: 47446 - DNA, 201 bp, Bos taurus; identical to SEQ ID NO: 5982

SEQ ID NO: 47447 - DNA, 201 bp, Bos taurus
tggcactgtaatgacatctgtaactgcctgtgaaaaggtaacacaactcacaggttaaatttgagcacaaacaaattcaaatgagtaatgttttgcacagggaacaacaaacagttttctgcaaatgtgtgctatttctagagaggtggaagagacaggcgttgaatatttcttttgccatctatattaggttatggtcca

SEQ ID NO: 47448 - DNA, 201 bp, Bos taurus; identical to SEQ ID NO: 5983

SEQ ID NO: 47449 - DNA, 201 bp, Bos taurus; identical to SEQ ID NO: 5984

SEQ ID NO: 47450 - DNA, 201 bp, Bos taurus; identical to SEQ ID NO: 5985

SEQ ID NO: 47451 - DNA, 201 bp, Bos taurus
aagggctatagaggaaatatataaaggaatggaaaaggagaatgccaatgggagaaacccaaacaagacttccatacactagttcagaaccagagaccctagtttgatttgatgctctttaagtgagttgcagaggttttggagaagccttcatgaatgccagatgaaatcacctgtgccttacaacacttcctagtccag

SEQ ID NO: 47452 - DNA, 201 bp, Bos taurus; identical to SEQ ID NO: 5986

SEQ ID NO: 47453 - DNA, 201 bp, Bos taurus
cagaaatcagagatattttaagagcttaaaaagccaggctgacccacctttagacactgggtataattgaagacaatttcagcttccattaagagttctgttatatgcaggccctgtcaaaatctaggataagccttatgtcactgcagaaaaagcagcaattcatctgtatttgtttcaacttaacactggctggtggag

SEQ ID NO: 47454 - DNA, 201 bp, Bos taurus; identical to SEQ ID NO: 5987

SEQ ID NO: 47455 - DNA, 201 bp, Bos taurus; identical to SEQ ID NO: 5988

SEQ ID NO: 47456 - DNA, 201 bp, Bos taurus
tctcagaccatagagagagccccaaagaatgcaagtgtctagggctgtcctcaatagaccttcacaccagcacatcacaggaatagtcacactcatttgctcttgtcccagacttagaagagataagattcattaaaacaaagactactccgtgttctaatgactactaaagcaaaatgagtctctccaaaacttattttg

SEQ ID NO: 47457 - DNA, 201 bp, Bos taurus; identical to SEQ ID NO: 5989

SEQ ID NO: 47458 - DNA, 201 bp, Bos taurus
gtgggtacaggccttcaaagccctacttgatctagaaatcttttagacccactgtaatagaagggataaggtaccattggcctgctatggggagagccacggtcttcccctcagcccttcctgtgacgacagccctcccctcacaggtctgagggccagtgtggagatctgaccagctgcctattctggttgggcaagcct

SEQ ID NO: 47459 - DNA, 201 bp, Bos taurus; identical to SEQ ID NO: 5990

SEQ ID NO: 47460 - DNA, 201 bp, Bos taurus; identical to SEQ ID NO: 5991

SEQ ID NO: 47461 - DNA, 201 bp, Bos taurus
ttgctgcgtcttcacctgggggaagggtgaatgagtgctctgctgcctttttcataagggcactagtcccattcatacacactgcacacttatgacctcaccacctccaaaggcctcacctccaaacaccatcatactgggggttgggtttcgacatttgaattttggaggatgccaaaattcaatccacagcagtgaggc

SEQ ID NO: 47462 - DNA, 201 bp, Bos taurus
tgggccacagtccatggggtcacaaagagtcagatatgactttgcaaataaacaacaataagattctttaaaaacacctgacaggttaggaaagagatcaaaggaaaagagcattaaggcccctccatgtggcttctctacgggacctttgcccctcctggcctggggactgagtgctcacagggaagctcagagctctga

SEQ ID NO: 47463 - DNA, 201 bp, Bos taurus
cagtatctcattgtgcttaactcaactgggtaacttccctagaaacagttgcagaaagtaaaggggagtatttctgtcagttgccagcatccttctcttagattgtaaccttcttttcactgaaaataaatagtaagatctctcttttttttttttttaagtttgtttccctttgtcctctgtcttcaacaataaaagtta

SEQ ID NO: 47464 - DNA, 201 bp, Bos taurus
ctgctaagccatcagggaagccgataggttcaagcatccgaaagagctgggaggcttacatatccctgtgatatataaaaagggggaacatccagagaaacgaaactgaatttctgtacagcaatctatgcattcacagtgacataaaattccacagtgactcaggatcagttcagttcagtcactcagtcatgtccgact

SEQ ID NO: 47465 - DNA, 201 bp, Bos taurus; identical to SEQ ID NO: 5992

SEQ ID NO: 47466 - DNA, 201 bp, Bos taurus; identical to SEQ ID NO: 5993

SEQ ID NO: 47467 - DNA, 201 bp, Bos taurus; identical to SEQ ID NO: 5994

SEQ ID NO: 47468 - DNA, 201 bp, Bos taurus; identical to SEQ ID NO: 5995

SEQ ID NO: 47469 - DNA, 201 bp, Bos taurus; identical to SEQ ID NO: 5996

SEQ ID NO: 47470 - DNA, 201 bp, Bos taurus; identical to SEQ ID NO: 5997

SEQ ID NO: 47471 - DNA, 201 bp, Bos taurus; identical to SEQ ID NO: 5998

SEQ ID NO: 47472 - DNA, 201 bp, Bos taurus; identical to SEQ ID NO: 5999

SEQ ID NO: 47473 - DNA, 201 bp, Bos taurus; identical to SEQ ID NO: 6000

SEQ ID NO: 47474 - DNA, 201 bp, Bos taurus; identical to SEQ ID NO: 6001

SEQ ID NO: 47475 - DNA, 201 bp, Bos taurus; identical to SEQ ID NO: 6002

SEQ ID NO: 47476 - DNA, 201 bp, Bos taurus; identical to SEQ ID NO: 6003

SEQ ID NO: 47477 - DNA, 201 bp, Bos taurus; identical to SEQ ID NO: 6004

SEQ ID NO: 47478 - DNA, 201 bp, Bos taurus; identical to SEQ ID NO: 6005

SEQ ID NO: 47479 - DNA, 201 bp, Bos taurus; identical to SEQ ID NO: 6006

SEQ ID NO: 47480 - DNA, 201 bp, Bos taurus; identical to SEQ ID NO: 6008

SEQ ID NO: 47481 - DNA, 201 bp, Bos taurus; identical to SEQ ID NO: 6009

SEQ ID NO: 47482 - DNA, 201 bp, Bos taurus; identical to SEQ ID NO: 6010

SEQ ID NO: 47483 - DNA, 201 bp, Bos taurus; identical to SEQ ID NO: 6012

SEQ ID NO: 47484 - DNA, 201 bp, Bos taurus; identical to SEQ ID NO: 6013

SEQ ID NO: 47485 - DNA, 201 bp, Bos taurus; identical to SEQ ID NO: 6014

SEQ ID NO: 47486 - DNA, 201 bp, Bos taurus
gtgaagtcaagtgggccttaggaagcatcactccgaacaaagctagtggaggtgatggaattctagctgagctacgtcaaatcctaaaagataatgctgttaaagtgccgcggtccatggggcctgtcttagggacttctgaacaacagtaaccacgcgaacagtagacggcaatagagttcaacagtaatgagagaggct

SEQ ID NO: 47487 - DNA, 201 bp, Bos taurus; identical to SEQ ID NO: 6015

SEQ ID NO: 47488 - DNA, 201 bp, Bos taurus
ccctgaatcagcctgtgacatttcctgaactttctgggtcaaaagatgagcttcttggaggtcaacagctgaaacaaatctcccagccccactccggcccgaggaccccagacccatatggaggacggagaacctgaccaaggggggtcatctgctaggtgaccagctgtctgtatccaccatgtcaaatggccaaaggct

SEQ ID NO: 47489 - DNA, 201 bp, Bos taurus
acccgagcactatgggaggaggttggccctgcccagcgaaggccacgttcagagtgcctcaccacctcagcagggatccactggcccaaagtaaagtcacatgcactctggtatgagctctgaatcatgtgaccaacatataagcacaagcctgcccagggcaacggtgctgaggatccctgggcctgggtaggaggacac

SEQ ID NO: 47490 - DNA, 201 bp, Bos taurus; identical to SEQ ID NO: 6016

SEQ ID NO: 47491 - DNA, 201 bp, Bos taurus
taggctggcaaatgtggccaagctgagcagctagccatgtgcctagaaagaggaggatagattctgacaggattaggcaagacaagaatccttgcccccaatggccaattaaacaataatcagctctcatctagttatttactctgcattgcaggcagattctttaccatatgagccaccaaggaagcccatttactctgc

SEQ ID NO: 47492 - DNA, 201 bp, Bos taurus; identical to SEQ ID NO: 6017

SEQ ID NO: 47493 - DNA, 201 bp, Bos taurus; identical to SEQ ID NO: 6018

SEQ ID NO: 47494 - DNA, 201 bp, Bos taurus; identical to SEQ ID NO: 6019

SEQ ID NO: 47495 - DNA, 201 bp, Bos taurus; identical to SEQ ID NO: 6020

SEQ ID NO: 47496 - DNA, 201 bp, Bos taurus; identical to SEQ ID NO: 6023

SEQ ID NO: 47497 - DNA, 201 bp, Bos taurus; identical to SEQ ID NO: 6024

SEQ ID NO: 47498 - DNA, 201 bp, Bos taurus
caccagagaaaccctgcgtcaaggccccacaccccccctccacccagattgccttcctgctcctggggaagctcactcacttttccgtttgtgttcttacgaggccgtgggatcctctcctgaaaggcatcttcaaagaagtcaggatgaaagaaacccaccccttccagccatctgggattaggcaggctgaagcgtgca

SEQ ID NO: 47499 - DNA, 201 bp, Bos taurus; identical to SEQ ID NO: 6026

SEQ ID NO: 47500 - DNA, 201 bp, Bos taurus; identical to SEQ ID NO: 6028

SEQ ID NO: 47501 - DNA, 201 bp, Bos taurus; identical to SEQ ID NO: 6029

SEQ ID NO: 47502 - DNA, 201 bp, Bos taurus; identical to SEQ ID NO: 6030

SEQ ID NO: 47503 - DNA, 201 bp, Bos taurus; identical to SEQ ID NO: 6031

SEQ ID NO: 47504 - DNA, 201 bp, Bos taurus; identical to SEQ ID NO: 6032

SEQ ID NO: 47505 - DNA, 201 bp, Bos taurus
aaacaccttctttatcaggctctcacactccaggccaccatccatcggcaccaaaacctccaacacaacatagcagaaagtagggacctatgctctgccccagggcctgctgaaatatttatttagccactcctaaaccttgttagatagcatcactgacacaatggacgtgaatctgagcaaactctgagagatagtgaa

SEQ ID NO: 47506 - DNA, 201 bp, Bos taurus; identical to SEQ ID NO: 6034

SEQ ID NO: 47507 - DNA, 201 bp, Bos taurus; identical to SEQ ID NO: 6035

SEQ ID NO: 47508 - DNA, 201 bp, Bos taurus; identical to SEQ ID NO: 6036

SEQ ID NO: 47509 - DNA, 201 bp, Bos taurus; identical to SEQ ID NO: 6037

SEQ ID NO: 47510 - DNA, 201 bp, Bos taurus; identical to SEQ ID NO: 6038

SEQ ID NO: 47511 - DNA, 201 bp, Bos taurus
acagactctgtttcccttcgtatatttcacactccagccaaagcaaatatctgctgttttctaccttgtgcctttgcttctattgttccctctgccctcagtgttatactcctgctcagtcatcacatgtctggatccaagctaaggctgagggttgacacagtagttttaatagtaagatctgctactactgctgctgct

SEQ ID NO: 47512 - DNA, 201 bp, Bos taurus
tgttcaggcctcctctgtacctcctcccatcttctctagctcctagcaggtaactctgatttttactaaagcctacctttacaactctaacttctcttatttcactcagggcctccagagatgtaaagtatcttcagttgttttccagtgctgaattaacagagttttaaaaatgcttgcagctcattagggttcattagg

SEQ ID NO: 47513 - DNA, 201 bp, Bos taurus; identical to SEQ ID NO: 6040

SEQ ID NO: 47514 - DNA, 201 bp, Bos taurus; identical to SEQ ID NO: 6041

SEQ ID NO: 47515 - DNA, 201 bp, Bos taurus; identical to SEQ ID NO: 6042

SEQ ID NO: 47516 - DNA, 201 bp, Bos taurus; identical to SEQ ID NO: 6043

SEQ ID NO: 47517 - DNA, 201 bp, Bos taurus; identical to SEQ ID NO: 6045

SEQ ID NO: 47518 - DNA, 201 bp, Bos taurus
agagtggtgcaggatgtaggccagtgactgaagaggctaatgaattgattcttccagaactggacagtaggcagtattctttattttacaattccctcccttccagtcttaattttggccgaggttttggaggcattttgtgactgatttgttccatggtgctaagaaagctcattaccaggtggaacatggatttcttgg

SEQ ID NO: 47519 - DNA, 201 bp, Bos taurus
acaaaaataagccttcagtaaatgtattggctcatcaaaccatttatgttggattttttcctggaatataataagaagttatgaagatgatttattgctcgtgtaattcaaattgttgtcattcaaactttaggttatgaatattgtttcattaattttagtgctaatgttgtctgaatagctgccatgttatgtttttga

SEQ ID NO: 47520 - DNA, 201 bp, Bos taurus
ttcttttcagttagtaaacatttaacagtaagtgcattttatgaaacatgcacaagaatcttgaatgaacttgatgaaatttcttccacatcaaccatttccacagagcttctgaatattctgggaatttataggcattcaacccatgcctgaatttattgtgtgttcaatgcgatttgtgtgaattcattaggggttttg

SEQ ID NO: 47521 - DNA, 201 bp, Bos taurus; identical to SEQ ID NO: 6047

SEQ ID NO: 47522 - DNA, 201 bp, Bos taurus
cacagccacctccatttattatttgttgtctaagcctgctttcatgatacaaatggcaggattgcatagttgtgacaaagactatagtcctacaaagccagatgttgatatctaaccctttataacaaatagttcgctgattcataatctaagatagcactatctattagagtatagtgtgagtctttaagtgggtttatg

SEQ ID NO: 47523 - DNA, 201 bp, Bos taurus; identical to SEQ ID NO: 6049

SEQ ID NO: 47524 - DNA, 201 bp, Bos taurus
ttctcgtgattcaacaacaacctttcactctgaggtatgttttgtgactccagattccacaacaccatcatttgaccgctaacaaattataaaaaagacctcttaataggcctaaaaggaacacacaatagaacaacctagaaaggcagaatgtttacatctcaaagacacaaagaaatgtaagtttcccccaggaggtct

SEQ ID NO: 47525 - DNA, 201 bp, Bos taurus; identical to SEQ ID NO: 6050

SEQ ID NO: 47526 - DNA, 201 bp, Bos taurus; identical to SEQ ID NO: 6051

SEQ ID NO: 47527 - DNA, 201 bp, Bos taurus
gactctttctggagagaggtcattatctgatgtctttggtcatttgctacgttagaagtttagatcaatttcatctgattctttctgtttaccctttctttagggttatttttggggttctctcagaaccctcacagcctgtccttgtaacattgtagtatctaagattgctatactgtctgatatttatgttttttgtga

SEQ ID NO: 47528 - DNA, 201 bp, Bos taurus; identical to SEQ ID NO: 6052

SEQ ID NO: 47529 - DNA, 201 bp, Bos taurus; identical to SEQ ID NO: 6054

SEQ ID NO: 47530 - DNA, 201 bp, Bos taurus; identical to SEQ ID NO: 6055

SEQ ID NO: 47531 - DNA, 201 bp, Bos taurus; identical to SEQ ID NO: 6057

SEQ ID NO: 47532 - DNA, 201 bp, Bos taurus; identical to SEQ ID NO: 6058

SEQ ID NO: 47533 - DNA, 201 bp, Bos taurus; identical to SEQ ID NO: 6059

SEQ ID NO: 47534 - DNA, 201 bp, Bos taurus; identical to SEQ ID NO: 6060

SEQ ID NO: 47535 - DNA, 201 bp, Bos taurus; identical to SEQ ID NO: 6061

SEQ ID NO: 47536 - DNA, 201 bp, Bos taurus; identical to SEQ ID NO: 6062

SEQ ID NO: 47537 - DNA, 201 bp, Bos taurus; identical to SEQ ID NO: 6063

SEQ ID NO: 47538 - DNA, 201 bp, Bos taurus; identical to SEQ ID NO: 6064

SEQ ID NO: 47539 - DNA, 201 bp, Bos taurus; identical to SEQ ID NO: 6065

SEQ ID NO: 47540 - DNA, 201 bp, Bos taurus; identical to SEQ ID NO: 6066

SEQ ID NO: 47541 - DNA, 201 bp, Bos taurus; identical to SEQ ID NO: 6068

SEQ ID NO: 47542 - DNA, 201 bp, Bos taurus; identical to SEQ ID NO: 6069

SEQ ID NO: 47543 - DNA, 201 bp, Bos taurus
tcagatcagtcatttgtcagtaaggcatttgcagagtttaacagtgctgaatggtagctaaacccaagaaattgcattctgatgggtagttgatattatttgatatcaatattgtaccatacacagtaggagcatggatatgggggtcttagccacttgttcaattttacaacattcttgaaaaacagctggggaagaaaa

SEQ ID NO: 47544 - DNA, 201 bp, Bos taurus; identical to SEQ ID NO: 6070

SEQ ID NO: 47545 - DNA, 201 bp, Bos taurus; identical to SEQ ID NO: 6071

SEQ ID NO: 47546 - DNA, 201 bp, Bos taurus; identical to SEQ ID NO: 6072

SEQ ID NO: 47547 - DNA, 201 bp, Bos taurus; identical to SEQ ID NO: 6073

SEQ ID NO: 47548 - DNA, 201 bp, Bos taurus; identical to SEQ ID NO: 6074

SEQ ID NO: 47549 - DNA, 201 bp, Bos taurus; identical to SEQ ID NO: 6075

SEQ ID NO: 47550 - DNA, 201 bp, Bos taurus
aaaaaagagaaagagagaaatgttgtacttagtagggatattatagaatttcccttataatcattaccaagataagttttcctactattacccttaatattttccctaaaaatcacactaaatagtgtaagtctaaaaacagtagtaagaggcataagaatcaataagaaatatctttcgtttcttagatgaaagataact

SEQ ID NO: 47551 - DNA, 201 bp, Bos taurus
ctaccacaacagccactgttttataaaccacatgtagatttgagcaatctcctaggtggactaaaaaaatttacatgcctaggtctctcctgttcggccctgctgcctatgagaggcaactcatccacatttcagggtggcatcaagcagtataccatttcatcggagtccagaagtggcaggacaaagggccaagactct

SEQ ID NO: 47552 - DNA, 201 bp, Bos taurus; identical to SEQ ID NO: 6077

SEQ ID NO: 47553 - DNA, 201 bp, Bos taurus; identical to SEQ ID NO: 6078

SEQ ID NO: 47554 - DNA, 201 bp, Bos taurus; identical to SEQ ID NO: 6079

SEQ ID NO: 47555 - DNA, 201 bp, Bos taurus; identical to SEQ ID NO: 6080

SEQ ID NO: 47556 - DNA, 201 bp, Bos taurus; identical to SEQ ID NO: 6081

SEQ ID NO: 47557 - DNA, 201 bp, Bos taurus
gtttctgcattatctatctgctactactggaagtaagctctgtgaggacagtagcattgtattactttcatactccctagagcagtgcctgacacacacaatcagttctcaatgcctcactattgactaactgtcagatattgttctaagacgtttatacacactacttcatttcactccccacaggacatatgtaatttc

SEQ ID NO: 47558 - DNA, 201 bp, Bos taurus; identical to SEQ ID NO: 6083

SEQ ID NO: 47559 - DNA, 201 bp, Bos taurus; identical to SEQ ID NO: 6084

SEQ ID NO: 47560 - DNA, 201 bp, Bos taurus
actttcactttctacttgattgtctggtacctggccctaggctgattcagagtgggaagaatattggcttggtctgaggatttgataaaggagatgaggtgtggcctctggtttgtatatcaaaggtacctcccaagggagttgtttgctctctaggattaactattcctgggaatggaggtctcctggatctaggccata

SEQ ID NO: 47561 - DNA, 201 bp, Bos taurus
aaaagaactatgaaactaaatggcctttgctttaggctgggtaagaggaagagacagtgtctgtggaaatggaggaagaggcttgcaataaagcaccagggtggatgatggaacatggccacgatacgggggatttcaacacaactctgaagcagatctcctttgctcaatggcccagtactttcccagtctcaccttata

SEQ ID NO: 47562 - DNA, 201 bp, Bos taurus; identical to SEQ ID NO: 6086

SEQ ID NO: 47563 - DNA, 201 bp, Bos taurus; identical to SEQ ID NO: 6087

SEQ ID NO: 47564 - DNA, 201 bp, Bos taurus; identical to SEQ ID NO: 6088

SEQ ID NO: 47565 - DNA, 201 bp, Bos taurus; identical to SEQ ID NO: 6091

SEQ ID NO: 47566 - DNA, 201 bp, Bos taurus; identical to SEQ ID NO: 6092

SEQ ID NO: 47567 - DNA, 201 bp, Bos taurus; identical to SEQ ID NO: 6093

SEQ ID NO: 47568 - DNA, 201 bp, Bos taurus
acagcatagaattggaaacacttcaattattttctgtgtattaccagtctttcctaatccatcctaaaagttgtcgcaatttcaacttctgaaagcctagctctagtaacttttaagctcaaaagctgtcatcctttacatcctttgcttctcttctctaactaaataattgtaaaacttctcatttgtcatccaatgggc

SEQ ID NO: 47569 - DNA, 201 bp, Bos taurus; identical to SEQ ID NO: 6094

SEQ ID NO: 47570 - DNA, 201 bp, Bos taurus
acctaatagtcttctggagagcacttcagaatagaaaacacccaggggccagcttatcctcggctctgagctactgagcaatctcaagaatacagaaactgctctggaagatgtttaaagtcaaaacaccttaaaacttaaattaggtgaacttcaacaattgcctttgttttctttagttgtagcatgggcaaacagaaa

SEQ ID NO: 47571 - DNA, 201 bp, Bos taurus; identical to SEQ ID NO: 6095

SEQ ID NO: 47572 - DNA, 201 bp, Bos taurus; identical to SEQ ID NO: 6096

SEQ ID NO: 47573 - DNA, 201 bp, Bos taurus; identical to SEQ ID NO: 6097

SEQ ID NO: 47574 - DNA, 201 bp, Bos taurus; identical to SEQ ID NO: 6098

SEQ ID NO: 47575 - DNA, 201 bp, Bos taurus
actgaggtgccctcaggaagttgattatgaagataaattgacccaatgttaataagaatttaagcctagaaaattgacattgaatttaagtaaatctgttcagtgtttctgcctccatgttcttctaggcatagattttcagccttcataaagaactttgcaaatctactactacacctttagtgagatttttaagttaca

SEQ ID NO: 47576 - DNA, 201 bp, Bos taurus
tgaggaccagtagtatcctaccgttgtgcaggatgctgggtgggaataagaaatgcagacttgctcctgctctggggaatcagttcctccccatctaagggactctcagttagaaagtcctgatggaggatgtgtgtggggaagaggtgtttaaaactaaaaagcaagaccttgatcttgaaaagtacagactacaggaaa

SEQ ID NO: 47577 - DNA, 201 bp, Bos taurus; identical to SEQ ID NO: 6099

SEQ ID NO: 47578 - DNA, 201 bp, Bos taurus; identical to SEQ ID NO: 6100

SEQ ID NO: 47579 - DNA, 201 bp, Bos taurus; identical to SEQ ID NO: 6101

SEQ ID NO: 47580 - DNA, 201 bp, Bos taurus
ctcatttttagttgtaaaacatgtagcttgaaaagatactgaaggaagaacatgaacacagatggtgaagagactgccatttgtaacacagaagcaaagcggggaggggggagtcactttcaagttttaaatctttaaaaatactttgtgttctaccactcacacacaagataagtaacagtccattcgtatgcaaagggc

SEQ ID NO: 47581 - DNA, 201 bp, Bos taurus; identical to SEQ ID NO: 6102

SEQ ID NO: 47582 - DNA, 201 bp, Bos taurus; identical to SEQ ID NO: 6103

SEQ ID NO: 47583 - DNA, 201 bp, Bos taurus; identical to SEQ ID NO: 6104

SEQ ID NO: 47584 - DNA, 201 bp, Bos taurus; identical to SEQ ID NO: 6105

SEQ ID NO: 47585 - DNA, 201 bp, Bos taurus; identical to SEQ ID NO: 6106

SEQ ID NO: 47586 - DNA, 201 bp, Bos taurus; identical to SEQ ID NO: 6107

SEQ ID NO: 47587 - DNA, 201 bp, Bos taurus; identical to SEQ ID NO: 6108

SEQ ID NO: 47588 - DNA, 201 bp, Bos taurus; identical to SEQ ID NO: 6110

SEQ ID NO: 47589 - DNA, 201 bp, Bos taurus; identical to SEQ ID NO: 6111

SEQ ID NO: 47590 - DNA, 201 bp, Bos taurus; identical to SEQ ID NO: 6113

SEQ ID NO: 47591 - DNA, 201 bp, Bos taurus
ttatgcctctgtattccacaactgaatacatgaataaacatagcattccctatggcttccaaaatttggctccttcaaattcaaccatttttatataacttgcaaattatttcccagtaaatttatcagtgatagaaatgtttaatttttctgaagttgctagaaatactctaatactttctgagcagcctgaagctgccc

SEQ ID NO: 47592 - DNA, 201 bp, Bos taurus; identical to SEQ ID NO: 6115

SEQ ID NO: 47593 - DNA, 201 bp, Bos taurus; identical to SEQ ID NO: 6116

SEQ ID NO: 47594 - DNA, 201 bp, Bos taurus; identical to SEQ ID NO: 6117

SEQ ID NO: 47595 - DNA, 201 bp, Bos taurus
tgtccaagacccacaactagaaagtaaaagggccagattcatcctttaactcttcagctgtgctgccttagtgaagacctttctataggtatctgtgcccatgtttctcaccagccagatggcctgctttttttccccataggttgtggccaatgccaaaggggctatgactggggcaaaagatgctgtgacgactactgt

SEQ ID NO: 47596 - DNA, 201 bp, Bos taurus; identical to SEQ ID NO: 6119

SEQ ID NO: 47597 - DNA, 201 bp, Bos taurus; identical to SEQ ID NO: 6121

SEQ ID NO: 47598 - DNA, 201 bp, Bos taurus
gggctggcctcatggggaagggcagggctctggctaaaaaccaaactgctcaggtttgaatcctgggtgaccttgggcttctctgggcctctgtctacccataagtcagtggagataatcatagggttcatgtgaggattgaaatgtggtagtgatctttagatgggggccctgatgagggtgtacacccaggatttcggc

SEQ ID NO: 47599 - DNA, 201 bp, Bos taurus; identical to SEQ ID NO: 6122

SEQ ID NO: 47600 - DNA, 201 bp, Bos taurus; identical to SEQ ID NO: 6123

SEQ ID NO: 47601 - DNA, 201 bp, Bos taurus; identical to SEQ ID NO: 6124

SEQ ID NO: 47602 - DNA, 201 bp, Bos taurus; identical to SEQ ID NO: 6126

SEQ ID NO: 47603 - DNA, 201 bp, Bos taurus; identical to SEQ ID NO: 6127

SEQ ID NO: 47604 - DNA, 201 bp, Bos taurus; identical to SEQ ID NO: 6128

SEQ ID NO: 47605 - DNA, 201 bp, Bos taurus; identical to SEQ ID NO: 6130

SEQ ID NO: 47606 - DNA, 201 bp, Bos taurus; identical to SEQ ID NO: 6131

SEQ ID NO: 47607 - DNA, 201 bp, Bos taurus; identical to SEQ ID NO: 6133

SEQ ID NO: 47608 - DNA, 201 bp, Bos taurus; identical to SEQ ID NO: 6137

SEQ ID NO: 47609 - DNA, 201 bp, Bos taurus; identical to SEQ ID NO: 6138

SEQ ID NO: 47610 - DNA, 201 bp, Bos taurus; identical to SEQ ID NO: 6139

SEQ ID NO: 47611 - DNA, 201 bp, Bos taurus; identical to SEQ ID NO: 6140

SEQ ID NO: 47612 - DNA, 201 bp, Bos taurus; identical to SEQ ID NO: 6141

SEQ ID NO: 47613 - DNA, 201 bp, Bos taurus
caatgggttttaccactcccccactagaccccgtcttacagaaccctctccctagccagctggtgttctctgggctaaagactgtccaacccgttcctccattttatagaagtttactcactccaggggaaatggtgagtcctccgacctccctcccaaccagtcccatcattccaaccagtggtaccatagagcagcacc

SEQ ID NO: 47614 - DNA, 201 bp, Bos taurus; identical to SEQ ID NO: 6142

SEQ ID NO: 47615 - DNA, 201 bp, Bos taurus; identical to SEQ ID NO: 6146

SEQ ID NO: 47616 - DNA, 201 bp, Bos taurus
gagaaattgaggaaaattttaaaagattatacttgcagtcatgtagcaaattgccagatagtggtcaaaagtgaatgcagtatgacaaattagaaggaactgtagcagactactcaagagctgatggcagcttagattagggtcctggcagagaaaagggtgtgtgggagtataagcactgaaggatgttgaaggggtgca

SEQ ID NO: 47617 - DNA, 201 bp, Bos taurus
aggtctgtcttcaccacctaccacctgattaaacctctctgactctctaacactcagtgggaataaagtgcctcctagttacattgctgtaaagataacatgggagtaccagtgatggacagggaagcctggcgtgctgcagtccatggggtcgcaaagagtgggacacaactgagcaactgaactatacttgttaaacaa

SEQ ID NO: 47618 - DNA, 201 bp, Bos taurus
aagagtacatactctatgattcctttcctataaagtacaaaaaggaggcaaaataaattaatgtcctgctattaaaaatcaggatagcagtcatctatgtagaagactttgataattttccattccatgacccaggtgctggttataagtcatacacatagctaggcacatttctttacatatattatactctgtggttcc

SEQ ID NO: 47619 - DNA, 201 bp, Bos taurus; identical to SEQ ID NO: 6149

SEQ ID NO: 47620 - DNA, 201 bp, Bos taurus; identical to SEQ ID NO: 6150

SEQ ID NO: 47621 - DNA, 201 bp, Bos taurus
aagagagaaagactgatttctgtttaggaattggctcatgcaattgtggagtctgacacattccaaaatctacgaggcaggccagcagcctgaagattacagaaggagttgatgttacagtcttgagtccaaaggcagtttggaggcagaattccttcctcttcaagagacttcagtctttttttttttttttttttttta

SEQ ID NO: 47622 - DNA, 201 bp, Bos taurus; identical to SEQ ID NO: 6154

SEQ ID NO: 47623 - DNA, 201 bp, Bos taurus; identical to SEQ ID NO: 6155

SEQ ID NO: 47624 - DNA, 201 bp, Bos taurus; identical to SEQ ID NO: 6156

SEQ ID NO: 47625 - DNA, 201 bp, Bos taurus; identical to SEQ ID NO: 6157

SEQ ID NO: 47626 - DNA, 201 bp, Bos taurus; identical to SEQ ID NO: 6159

SEQ ID NO: 47627 - DNA, 201 bp, Bos taurus; identical to SEQ ID NO: 6160

SEQ ID NO: 47628 - DNA, 201 bp, Bos taurus; identical to SEQ ID NO: 6162

SEQ ID NO: 47629 - DNA, 201 bp, Bos taurus; identical to SEQ ID NO: 6163

SEQ ID NO: 47630 - DNA, 201 bp, Bos taurus; identical to SEQ ID NO: 6165

SEQ ID NO: 47631 - DNA, 201 bp, Bos taurus; identical to SEQ ID NO: 6166

SEQ ID NO: 47632 - DNA, 201 bp, Bos taurus; identical to SEQ ID NO: 6167

SEQ ID NO: 47633 - DNA, 201 bp, Bos taurus; identical to SEQ ID NO: 6168

SEQ ID NO: 47634 - DNA, 201 bp, Bos taurus; identical to SEQ ID NO: 6170

SEQ ID NO: 47635 - DNA, 201 bp, Bos taurus; identical to SEQ ID NO: 6171

SEQ ID NO: 47636 - DNA, 201 bp, Bos taurus; identical to SEQ ID NO: 6174

SEQ ID NO: 47637 - DNA, 201 bp, Bos taurus; identical to SEQ ID NO: 6176

SEQ ID NO: 47638 - DNA, 201 bp, Bos taurus; identical to SEQ ID NO: 6177

SEQ ID NO: 47639 - DNA, 201 bp, Bos taurus; identical to SEQ ID NO: 6178

SEQ ID NO: 47640 - DNA, 201 bp, Bos taurus; identical to SEQ ID NO: 6180

SEQ ID NO: 47641 - DNA, 201 bp, Bos taurus; identical to SEQ ID NO: 6185

SEQ ID NO: 47642 - DNA, 201 bp, Bos taurus; identical to SEQ ID NO: 6186

SEQ ID NO: 47643 - DNA, 201 bp, Bos taurus; identical to SEQ ID NO: 6187

SEQ ID NO: 47644 - DNA, 201 bp, Bos taurus; identical to SEQ ID NO: 6188

SEQ ID NO: 47645 - DNA, 201 bp, Bos taurus; identical to SEQ ID NO: 6189

SEQ ID NO: 47646 - DNA, 201 bp, Bos taurus; identical to SEQ ID NO: 6190

SEQ ID NO: 47647 - DNA, 201 bp, Bos taurus; identical to SEQ ID NO: 6191

SEQ ID NO: 47648 - DNA, 201 bp, Bos taurus; identical to SEQ ID NO: 6195

SEQ ID NO: 47649 - DNA, 201 bp, Bos taurus; identical to SEQ ID NO: 6200

SEQ ID NO: 47650 - DNA, 201 bp, Bos taurus; identical to SEQ ID NO: 6202

SEQ ID NO: 47651 - DNA, 201 bp, Bos taurus; identical to SEQ ID NO: 6206

SEQ ID NO: 47652 - DNA, 201 bp, Bos taurus; identical to SEQ ID NO: 6207

SEQ ID NO: 47653 - DNA, 201 bp, Bos taurus; identical to SEQ ID NO: 6209

SEQ ID NO: 47654 - DNA, 201 bp, Bos taurus; identical to SEQ ID NO: 6211

SEQ ID NO: 47655 - DNA, 201 bp, Bos taurus; identical to SEQ ID NO: 6212

SEQ ID NO: 47656 - DNA, 201 bp, Bos taurus; identical to SEQ ID NO: 6214

SEQ ID NO: 47657 - DNA, 201 bp, Bos taurus; identical to SEQ ID NO: 6215

SEQ ID NO: 47658 - DNA, 201 bp, Bos taurus; identical to SEQ ID NO: 6216

SEQ ID NO: 47659 - DNA, 201 bp, Bos taurus; identical to SEQ ID NO: 6217

SEQ ID NO: 47660 - DNA, 201 bp, Bos taurus; identical to SEQ ID NO: 6218

SEQ ID NO: 47661 - DNA, 201 bp, Bos taurus; identical to SEQ ID NO: 6222

SEQ ID NO: 47662 - DNA, 201 bp, Bos taurus; identical to SEQ ID NO: 6223

SEQ ID NO: 47663 - DNA, 201 bp, Bos taurus; identical to SEQ ID NO: 6224

SEQ ID NO: 47664 - DNA, 201 bp, Bos taurus; identical to SEQ ID NO: 6225

SEQ ID NO: 47665 - DNA, 201 bp, Bos taurus; identical to SEQ ID NO: 6226

SEQ ID NO: 47666 - DNA, 201 bp, Bos taurus; identical to SEQ ID NO: 6231

SEQ ID NO: 47667 - DNA, 201 bp, Bos taurus; identical to SEQ ID NO: 6233

SEQ ID NO: 47668 - DNA, 201 bp, Bos taurus; identical to SEQ ID NO: 6239

SEQ ID NO: 47669 - DNA, 201 bp, Bos taurus; identical to SEQ ID NO: 6241

SEQ ID NO: 47670 - DNA, 201 bp, Bos taurus; identical to SEQ ID NO: 6243

SEQ ID NO: 47671 - DNA, 201 bp, Bos taurus; identical to SEQ ID NO: 6246

SEQ ID NO: 47672 - DNA, 201 bp, Bos taurus; identical to SEQ ID NO: 6247

SEQ ID NO: 47673 - DNA, 201 bp, Bos taurus; identical to SEQ ID NO: 6250

SEQ ID NO: 47674 - DNA, 201 bp, Bos taurus; identical to SEQ ID NO: 6251

SEQ ID NO: 47675 - DNA, 201 bp, Bos taurus; identical to SEQ ID NO: 6252

SEQ ID NO: 47676 - DNA, 201 bp, Bos taurus; identical to SEQ ID NO: 6253

SEQ ID NO: 47677 - DNA, 201 bp, Bos taurus; identical to SEQ ID NO: 6254

SEQ ID NO: 47678 - DNA, 201 bp, Bos taurus; identical to SEQ ID NO: 6256

SEQ ID NO: 47679 - DNA, 201 bp, Bos taurus; identical to SEQ ID NO: 6262

SEQ ID NO: 47680 - DNA, 201 bp, Bos taurus; identical to SEQ ID NO: 6263

SEQ ID NO: 47681 - DNA, 201 bp, Bos taurus; identical to SEQ ID NO: 6264

SEQ ID NO: 47682 - DNA, 201 bp, Bos taurus; identical to SEQ ID NO: 6267

SEQ ID NO: 47683 - DNA, 201 bp, Bos taurus; identical to SEQ ID NO: 6268

SEQ ID NO: 47684 - DNA, 201 bp, Bos taurus; identical to SEQ ID NO: 6270

SEQ ID NO: 47685 - DNA, 201 bp, Bos taurus; identical to SEQ ID NO: 6271

SEQ ID NO: 47686 - DNA, 201 bp, Bos taurus; identical to SEQ ID NO: 6272

SEQ ID NO: 47687 - DNA, 201 bp, Bos taurus; identical to SEQ ID NO: 6273

SEQ ID NO: 47688 - DNA, 201 bp, Bos taurus; identical to SEQ ID NO: 6274

SEQ ID NO: 47689 - DNA, 201 bp, Bos taurus; identical to SEQ ID NO: 6275

SEQ ID NO: 47690 - DNA, 201 bp, Bos taurus; identical to SEQ ID NO: 6277

SEQ ID NO: 47691 - DNA, 201 bp, Bos taurus; identical to SEQ ID NO: 6278

SEQ ID NO: 47692 - DNA, 201 bp, Bos taurus; identical to SEQ ID NO: 6279

SEQ ID NO: 47693 - DNA, 201 bp, Bos taurus; identical to SEQ ID NO: 6281

SEQ ID NO: 47694 - DNA, 201 bp, Bos taurus; identical to SEQ ID NO: 6282

SEQ ID NO: 47695 - DNA, 201 bp, Bos taurus; identical to SEQ ID NO: 6283

SEQ ID NO: 47696 - DNA, 201 bp, Bos taurus; identical to SEQ ID NO: 6287

SEQ ID NO: 47697 - DNA, 201 bp, Bos taurus; identical to SEQ ID NO: 6288

SEQ ID NO: 47698 - DNA, 201 bp, Bos taurus; identical to SEQ ID NO: 6289

SEQ ID NO: 47699 - DNA, 201 bp, Bos taurus; identical to SEQ ID NO: 6290

SEQ ID NO: 47700 - DNA, 201 bp, Bos taurus; identical to SEQ ID NO: 6291

SEQ ID NO: 47701 - DNA, 201 bp, Bos taurus; identical to SEQ ID NO: 6292

SEQ ID NO: 47702 - DNA, 201 bp, Bos taurus; identical to SEQ ID NO: 6293

SEQ ID NO: 47703 - DNA, 201 bp, Bos taurus; identical to SEQ ID NO: 6299

SEQ ID NO: 47704 - DNA, 201 bp, Bos taurus; identical to SEQ ID NO: 6300

SEQ ID NO: 47705 - DNA, 201 bp, Bos taurus; identical to SEQ ID NO: 6303

SEQ ID NO: 47706 - DNA, 201 bp, Bos taurus; identical to SEQ ID NO: 6304

SEQ ID NO: 47707 - DNA, 201 bp, Bos taurus; identical to SEQ ID NO: 6309

SEQ ID NO: 47708 - DNA, 201 bp, Bos taurus; identical to SEQ ID NO: 6310

SEQ ID NO: 47709 - DNA, 201 bp, Bos taurus; identical to SEQ ID NO: 6311

SEQ ID NO: 47710 - DNA, 201 bp, Bos taurus; identical to SEQ ID NO: 6313

SEQ ID NO: 47711 - DNA, 201 bp, Bos taurus; identical to SEQ ID NO: 6315

SEQ ID NO: 47712 - DNA, 201 bp, Bos taurus; identical to SEQ ID NO: 6316

SEQ ID NO: 47713 - DNA, 201 bp, Bos taurus; identical to SEQ ID NO: 6317

SEQ ID NO: 47714 - DNA, 201 bp, Bos taurus; identical to SEQ ID NO: 6318

SEQ ID NO: 47715 - DNA, 201 bp, Bos taurus; identical to SEQ ID NO: 6320

SEQ ID NO: 47716 - DNA, 201 bp, Bos taurus; identical to SEQ ID NO: 6321

SEQ ID NO: 47717 - DNA, 201 bp, Bos taurus; identical to SEQ ID NO: 6324

SEQ ID NO: 47718 - DNA, 201 bp, Bos taurus; identical to SEQ ID NO: 6325

SEQ ID NO: 47719 - DNA, 201 bp, Bos taurus; identical to SEQ ID NO: 6326

SEQ ID NO: 47720 - DNA, 201 bp, Bos taurus; identical to SEQ ID NO: 6327

SEQ ID NO: 47721 - DNA, 201 bp, Bos taurus; identical to SEQ ID NO: 6328

SEQ ID NO: 47722 - DNA, 201 bp, Bos taurus; identical to SEQ ID NO: 6329

SEQ ID NO: 47723 - DNA, 201 bp, Bos taurus; identical to SEQ ID NO: 6330

SEQ ID NO: 47724 - DNA, 201 bp, Bos taurus; identical to SEQ ID NO: 6331

SEQ ID NO: 47725 - DNA, 201 bp, Bos taurus; identical to SEQ ID NO: 6332

SEQ ID NO: 47726 - DNA, 201 bp, Bos taurus; identical to SEQ ID NO: 6333

SEQ ID NO: 47727 - DNA, 201 bp, Bos taurus; identical to SEQ ID NO: 6334

SEQ ID NO: 47728 - DNA, 201 bp, Bos taurus; identical to SEQ ID NO: 6336

SEQ ID NO: 47729 - DNA, 201 bp, Bos taurus; identical to SEQ ID NO: 6337

SEQ ID NO: 47730 - DNA, 201 bp, Bos taurus; identical to SEQ ID NO: 6338

SEQ ID NO: 47731 - DNA, 201 bp, Bos taurus; identical to SEQ ID NO: 6339

SEQ ID NO: 47732 - DNA, 201 bp, Bos taurus; identical to SEQ ID NO: 6340

SEQ ID NO: 47733 - DNA, 201 bp, Bos taurus; identical to SEQ ID NO: 6341

SEQ ID NO: 47734 - DNA, 201 bp, Bos taurus; identical to SEQ ID NO: 6342

SEQ ID NO: 47735 - DNA, 201 bp, Bos taurus; identical to SEQ ID NO: 6343

SEQ ID NO: 47736 - DNA, 201 bp, Bos taurus; identical to SEQ ID NO: 6344

SEQ ID NO: 47737 - DNA, 201 bp, Bos taurus; identical to SEQ ID NO: 6345

SEQ ID NO: 47738 - DNA, 201 bp, Bos taurus; identical to SEQ ID NO: 6346

SEQ ID NO: 47739 - DNA, 201 bp, Bos taurus; identical to SEQ ID NO: 6347

SEQ ID NO: 47740 - DNA, 201 bp, Bos taurus; identical to SEQ ID NO: 6348

SEQ ID NO: 47741 - DNA, 201 bp, Bos taurus; identical to SEQ ID NO: 6349

SEQ ID NO: 47742 - DNA, 201 bp, Bos taurus; identical to SEQ ID NO: 6350

SEQ ID NO: 47743 - DNA, 201 bp, Bos taurus; identical to SEQ ID NO: 6351

SEQ ID NO: 47744 - DNA, 201 bp, Bos taurus; identical to SEQ ID NO: 6352

SEQ ID NO: 47745 - DNA, 201 bp, Bos taurus; identical to SEQ ID NO: 6353

SEQ ID NO: 47746 - DNA, 201 bp, Bos taurus; identical to SEQ ID NO: 6354

SEQ ID NO: 47747 - DNA, 201 bp, Bos taurus; identical to SEQ ID NO: 6355

SEQ ID NO: 47748 - DNA, 201 bp, Bos taurus; identical to SEQ ID NO: 6356

SEQ ID NO: 47749 - DNA, 201 bp, Bos taurus; identical to SEQ ID NO: 6357

SEQ ID NO: 47750 - DNA, 201 bp, Bos taurus; identical to SEQ ID NO: 6358

SEQ ID NO: 47751 - DNA, 201 bp, Bos taurus; identical to SEQ ID NO: 6359

SEQ ID NO: 47752 - DNA, 201 bp, Bos taurus
atgggagaacatcaaaatcacagggccatgcagaggcatgaagaaggatttttaataacacacagtcttggtcccatctgctatagtctcatcaggtagatctgaaatggggcccaggcctgtgttttcagcaagctctccaagtgaagatgatgcccactgaaatttaagaaccatggctgtatgatacgttactactag

SEQ ID NO: 47753 - DNA, 201 bp, Bos taurus; identical to SEQ ID NO: 6361

SEQ ID NO: 47754 - DNA, 201 bp, Bos taurus
tttgtgcaagtgtggaatttctgctgacagttgcaaatgtctttcttgaggcctacactacaggcactgctgtagaaaccaatgttcaaacatggtctgctaaagaagaaggttagttattggctaaaatattccatatctgttactgaagtgctataataacacttagcttgattatccttctagatgatgaggataaca

SEQ ID NO: 47755 - DNA, 201 bp, Bos taurus
caaatattatttggatgttagaggagcagtgggttgtcatatataaaaaaatgtcagtagccttcaaaatactctgtttaaatagaatatgtaggaaatacattaattcttgtggcatctagaaagcagaattctgcatttcttttgtaagccagacttggttcttcaaaatatcacatcaaattattgtaaattttcatt

SEQ ID NO: 47756 - DNA, 201 bp, Bos taurus
gcacgagtcccctgtggcctcctttgcctggaaaagcaataaagctgttcttttctgtttcattcaaaactgtctctgagattcgattcaattcgactctggtgcacagaggccaagtttgtggcatcacaatctctttacctttacactctgtgcctaccattagataattaaatatggagggatgggttacttcaaggg

SEQ ID NO: 47757 - DNA, 201 bp, Bos taurus; identical to SEQ ID NO: 6365

SEQ ID NO: 47758 - DNA, 201 bp, Bos taurus; identical to SEQ ID NO: 6366

SEQ ID NO: 47759 - DNA, 201 bp, Bos taurus; identical to SEQ ID NO: 6367

SEQ ID NO: 47760 - DNA, 201 bp, Bos taurus; identical to SEQ ID NO: 6368

SEQ ID NO: 47761 - DNA, 201 bp, Bos taurus; identical to SEQ ID NO: 6369

SEQ ID NO: 47762 - DNA, 201 bp, Bos taurus; identical to SEQ ID NO: 6370

SEQ ID NO: 47763 - DNA, 201 bp, Bos taurus; identical to SEQ ID NO: 6371

SEQ ID NO: 47764 - DNA, 201 bp, Bos taurus; identical to SEQ ID NO: 6374

SEQ ID NO: 47765 - DNA, 201 bp, Bos taurus
ttttgacacctcgttaaacagaattttgttcagactaaacgttcttggcaaggcactggttcacccaagtgctttgttaattttaaagagcagtataagcagaagcccttattacaggaaatagtgcagtgcacgtgtagtggagagagaggttggcactgtcggttcggcttcagaatcctcacttttggtaactcactt

SEQ ID NO: 47766 - DNA, 201 bp, Bos taurus; identical to SEQ ID NO: 6376

SEQ ID NO: 47767 - DNA, 201 bp, Bos taurus
gtaattctgggtagctaccactgttacaaatagaggactcatatcatgtttaaatcctttgagccacatgtcacaatggacagaatgattggaaacatacgaggatggagatttacccaagaccccaagagttctagtgagaccatgtctagggtaatacaaagacatacatgctgcaaattaaccatctcaaaacagagt

SEQ ID NO: 47768 - DNA, 201 bp, Bos taurus
cattaactgttgttgggagagtatgtcatctgagggatactttaggattatggtgtgatttggatctgtagctccattatccctgcgttaataggccatgtgctgctctatgcatagacgattgaggctaaagggagttgtcacctttcaaaaattattagtaagaggtcaattcaggccatcctattaattgtaatagac

SEQ ID NO: 47769 - DNA, 201 bp, Bos taurus
tctaactttaatatatataccatatcatatatatatgcccatattcttgggagtgaggaatctaaaactatcttttatttttcttaaatttttccttactaaaaaaataacattggcaagattggctgctaatattttgatgtcacaaatatggtgctcatgcatccctggttaaatttgccaggtagagacaggtggagt

SEQ ID NO: 47770 - DNA, 201 bp, Bos taurus
tactttgtggccatgtctgtgaacctgcaactttctcttgatgggtgtaataaatccatgtaatgttctgcctttaagataaagtccagactccttaacccagaaccaaggtctgtggggccctggggtctacatatctctcacctcacatctcactcttctccttagctgtcccctgcaatcctcttgcaacctaggtga

SEQ ID NO: 47771 - DNA, 201 bp, Bos taurus
ttcccttggtccactggtcctgcctggctgaccagcgctcactttggacagcaaccatgctaagcatcacttgactcacctggcaggagaacacaggccatgaccacgtgctctcaccctgttgatagtcactcaagaagtcagatggttcagactctgctgtacaagccctttagtggcttctgctagaagaagcagagg

SEQ ID NO: 47772 - DNA, 201 bp, Bos taurus
attctccctgtgtggcctgcctcctttccttgccctccccattattccttgtcagacccttgttgtcatgccaggacagctatgctagcctcgaagctcaacaccttgtctacagccttggccttctctgctcctttatctgggcttacaggagctctgggtatacttctgtatctatctgtattgtgtcattctttaagg

SEQ ID NO: 47773 - DNA, 201 bp, Bos taurus
cactgagagagcttgaattttcacattagcgtatatgttcataccagctgtgtttgcttgaagcacttgttgtgttcctgttgggatatagttcggttaccaaatctctcaaggtcactcggcatagaacctacttttcccacctgctatcctgtctcctgttgaaggagagaatgtgtgggtgaggacccataagagagc

SEQ ID NO: 47774 - DNA, 201 bp, Bos taurus
ttttttacattcatatatagtaacacttaccgtagcccactctggaaaaatcataaaattacctacagggatgctcagtatcctcacttctctatttcttgagttatttctgctgcaacacttacttcaatccaacttatatattttgttttatggtgctttgaagtactccacatatcttctgggttaaagattctctgc

SEQ ID NO: 47775 - DNA, 201 bp, Bos taurus
gtcccagataggaactagcagcagagctgagctctcacttacctctccccagggaaggaaattctcagctgggatcttagctctttggcccacagggaagaagagttcccacagggctgccttcagtccagagaaaaagcacaagcaagtgtttttaccgaagtcgctctggctgatctcacagcaggcctagacaggctg

SEQ ID NO: 47776 - DNA, 201 bp, Bos taurus
agggcctttaaagaggtacgcaaggttaatgaagtcataaactcagggctctaatccagtatgacttgtatccttgtaagaagaggaagagacactaggcgtatgcatgccacgaaggaaggccaagtgaggacacagtgggaaggcagccctctgcaagccaagggaagacggcttaaggaaacctagcccatttggttt

SEQ ID NO: 47777 - DNA, 201 bp, Bos taurus; identical to SEQ ID NO: 6378

SEQ ID NO: 47778 - DNA, 201 bp, Bos taurus
gcaatatgtatctcttttcttctgtatattggccattttgtgtgtgtggggtttctcatcatggagatattacagatatttgtaagggaaatgagaggacaaaagttattttagttataggcaattcaaattactcctgcaaagaattttagcatcacatacaaaagctaaaataccagcagtctcacttcaaatcctgta

SEQ ID NO: 47779 - DNA, 201 bp, Bos taurus; identical to SEQ ID NO: 6379

SEQ ID NO: 47780 - DNA, 201 bp, Bos taurus; identical to SEQ ID NO: 6380

SEQ ID NO: 47781 - DNA, 201 bp, Bos taurus; identical to SEQ ID NO: 6381

SEQ ID NO: 47782 - DNA, 201 bp, Bos taurus; identical to SEQ ID NO: 6382

SEQ ID NO: 47783 - DNA, 201 bp, Bos taurus; identical to SEQ ID NO: 6383

SEQ ID NO: 47784 - DNA, 201 bp, Bos taurus
actcaaagattgctagtgcttttaaagcaggcatttcagtagaaggatggtggttgcagttacagaatagggaattagttcgaggagaggagatgatggcaggttggaggctgagggtattgaatactctcaacatgtatattaagagataagaagcaaaaaggatgaacagttcagtaaggatatttgaagggtctttgt

SEQ ID NO: 47785 - DNA, 201 bp, Bos taurus
gacataagcaaaaaggaacacaattcagtttcagagaaaatgtcactttccacatctggaaagaacagaggtaatggtggcctaagaacaaagaaagaatgatctggcaaaacgttcttaaataaaatgaagttcttgttcccaaaatataggaagaggaaaaccacttcagagtgggaagtaggggagaaacatgctatc

SEQ ID NO: 47786 - DNA, 201 bp, Bos taurus; identical to SEQ ID NO: 6385

SEQ ID NO: 47787 - DNA, 201 bp, Bos taurus; identical to SEQ ID NO: 6386

SEQ ID NO: 47788 - DNA, 201 bp, Bos taurus
gagagtgtcaggatgggagtaagtatctacaagacatttatctctggaggaaaacaatctctcaaagcgcataccttggcctccaacatggataggtttataggtaaacatggtttaactataacctttagccaccagagctccaggcagattttcatttcccattctttagcggtgagcattgattcctgctctgtggcc

SEQ ID NO: 47789 - DNA, 201 bp, Bos taurus; identical to SEQ ID NO: 6388

SEQ ID NO: 47790 - DNA, 201 bp, Bos taurus; identical to SEQ ID NO: 6389

SEQ ID NO: 47791 - DNA, 201 bp, Bos taurus; identical to SEQ ID NO: 6391

SEQ ID NO: 47792 - DNA, 201 bp, Bos taurus; identical to SEQ ID NO: 6392

SEQ ID NO: 47793 - DNA, 201 bp, Bos taurus
gaattaaatgaggtaatgtgtctgccagctcctggcatgcagaaggcaccccctcccctcttgattcttcctctgagatttgaaggaacaaaaaagaggagctaagagatattttgaggtggaggtgagggttgataaagcagccaggaaagtcatccccttgaccatcaccctccagcgaagtagaagagattatttgcc

SEQ ID NO: 47794 - DNA, 201 bp, Bos taurus
tccttggatatctgtctgctgtttgcttttagcattttctttctctatctggaatatttgttccctcttcaatatttggttacagcctaattagcctttataaataatcttgagattttcttctccggtaggacttgagtccacttggttgaactacctgtcccttccctccttcctttccatagcttttgtgtgtaggtg

SEQ ID NO: 47795 - DNA, 201 bp, Bos taurus; identical to SEQ ID NO: 6393

SEQ ID NO: 47796 - DNA, 201 bp, Bos taurus
ctaggatgtctggctctaggtgagtgataacaccatcatgattatcttgcagggtaacaagtaatatcccaaatcggtagcagccttctttactgggcccaaggccaaagtggtctttctgatacttgtcccactttgagtctcaacttctacaccagtatgtgtggaataatacagagaaaaccacaaatgacagaggaa

SEQ ID NO: 47797 - DNA, 201 bp, Bos taurus; identical to SEQ ID NO: 6394

SEQ ID NO: 47798 - DNA, 201 bp, Bos taurus; identical to SEQ ID NO: 6395

SEQ ID NO: 47799 - DNA, 201 bp, Bos taurus; identical to SEQ ID NO: 6397

SEQ ID NO: 47800 - DNA, 201 bp, Bos taurus; identical to SEQ ID NO: 6400

SEQ ID NO: 47801 - DNA, 201 bp, Bos taurus; identical to SEQ ID NO: 6401

SEQ ID NO: 47802 - DNA, 201 bp, Bos taurus; identical to SEQ ID NO: 6402

SEQ ID NO: 47803 - DNA, 201 bp, Bos taurus; identical to SEQ ID NO: 6403

SEQ ID NO: 47804 - DNA, 201 bp, Bos taurus; identical to SEQ ID NO: 6404

SEQ ID NO: 47805 - DNA, 201 bp, Bos taurus; identical to SEQ ID NO: 6405

SEQ ID NO: 47806 - DNA, 201 bp, Bos taurus
gtatttgatgattttgttagcagagcacaagaaataaaaaattaatcttaaacatcgaaacaaacataaggaagacaaagactgcctctggcaatggatctctcataaaaactttctttaaaggcaaaacagcactgctcaagaatgcaaagtccttccaatgtttcccatatagtacctatctatatctttcttgctggc

SEQ ID NO: 47807 - DNA, 201 bp, Bos taurus; identical to SEQ ID NO: 6409

SEQ ID NO: 47808 - DNA, 201 bp, Bos taurus; identical to SEQ ID NO: 6410

SEQ ID NO: 47809 - DNA, 201 bp, Bos taurus; identical to SEQ ID NO: 6411

SEQ ID NO: 47810 - DNA, 201 bp, Bos taurus; identical to SEQ ID NO: 6413

SEQ ID NO: 47811 - DNA, 201 bp, Bos taurus; identical to SEQ ID NO: 6414

SEQ ID NO: 47812 - DNA, 201 bp, Bos taurus
tggacttgagtttgagtgaactccgggagttggtgatggacagggaggcctggcgtgctgcgattcatggggtcgcaaagagtcagacgtgactgagcgaatgaactgaagcttcaagacatggccaaaaatttgattaagtttagtaggagggtgtgatttttggcatatgtattacctgtaacatttgttgtcatttta

SEQ ID NO: 47813 - DNA, 201 bp, Bos taurus; identical to SEQ ID NO: 6415

SEQ ID NO: 47814 - DNA, 201 bp, Bos taurus; identical to SEQ ID NO: 6416

SEQ ID NO: 47815 - DNA, 201 bp, Bos taurus
ttaagttccacagcagaccagtcattcattttctttatttttttctggactttctagttcattccattagcctttatatctctgtacttcattgtaaatacttttaaataaacattttaaaatgctccagttgtaatagtaatcctcttgctatagaatttacttcattttatcttaagttttccatgcaatatattgggt

SEQ ID NO: 47816 - DNA, 201 bp, Bos taurus
agccctactcaatgcttccaggagttttgtgaaaaaatacactggagagctaatccctctatattgaaatttacatacacacacacccacctgtctccccgcagactggcacctctcttgtatggactagatctgatttatctctttttcctcagtgacccaactgagaatgtgcttagatgcttattaagtgaattgtca

SEQ ID NO: 47817 - DNA, 201 bp, Bos taurus
cacctgctaaaaggggaagatcttgatctgcctaaacctgtcagggagatggtcagccaagatggtggcccaccagcaggatgctgtctgaaagacgggcgtgcccaagtcagtcagttccaggacagagtctgatagtactgcacttcaacttcaaaataatttacaacaaacttcgtgctttatcctgttcagaacttt

SEQ ID NO: 47818 - DNA, 201 bp, Bos taurus
tgcgggtgtcatcatgaatacgtttagattctgatggttttgacacctcaaggcttaatttccagcagtgattagatcacagcatatgactggcctctgagcagcctctgtcctcatggggaagcaggcaccgtgtgggtcacttccgtcactcgcaccgaggggtggtgtggatggggaaaggccttgagtggtaagtat

SEQ ID NO: 47819 - DNA, 201 bp, Bos taurus
cattgctgcccacctctgcatcctgtgagccagccctgggggagccggtggttgggctagtggggctctggctgccttcaatgacaatgccacaggtccttgggctccaggcctggtccctgctctccaggtcaagggacattaaagagtccgagtcctcggtggggagcacgccaggagaggacctgatgagccctaaga

SEQ ID NO: 47820 - DNA, 201 bp, Bos taurus
gggttcttcccatcttcctcttcgacttcattaacagactcgcacaacctccaggctgaaggcaaccgcagagatccaccttcctggccccgtttcacaagaggggaaaccaaggcacagatgttctccggagcagctaagcctccaagtgccagcagagcgcggggccgcgggcggcctgagggcagccctcccggtgca

SEQ ID NO: 47821 - DNA, 201 bp, Bos taurus; identical to SEQ ID NO: 6417

SEQ ID NO: 47822 - DNA, 201 bp, Bos taurus; identical to SEQ ID NO: 6418

SEQ ID NO: 47823 - DNA, 201 bp, Bos taurus; identical to SEQ ID NO: 6420

SEQ ID NO: 47824 - DNA, 201 bp, Bos taurus
ggctgtggccagtggagtgagggtagcactgacttggtggcttggctttggtgggtcatctcaaaaacttaggagacacctgactcacacaatagccagaggggattctcaagcatcatctttggccctgtctctaacccacacaatgactgtgtaacactgggggcagggggtcaagtgatgatgaatgaggatcagcct

SEQ ID NO: 47825 - DNA, 201 bp, Bos taurus
tgttaaagggcatgggtcccttcagttccttagggtctgattccttctccttcaggctgtcctgtccggagtctttggcctctccctctaggctggctccctctcttcaaacagccctccctgacccacgttgggctcccctcccctctacccaccaggcccccttttctaggggtgttttcaccaaggatactatgggtc

SEQ ID NO: 47826 - DNA, 201 bp, Bos taurus; identical to SEQ ID NO: 6422

SEQ ID NO: 47827 - DNA, 201 bp, Bos taurus; identical to SEQ ID NO: 6424

SEQ ID NO: 47828 - DNA, 201 bp, Bos taurus
acagcctgtggatgatgtgtgtgggtaaagtatggggctgcctgcacactctgccaggagggctggctgcctcacgctgtgccaggccctgaggtcaggaggatggatatctgggcacagctctggtccatttgcacgtccccaaggcagaggaaccagagatcaaattgctaacatccgctggatcatggaaaaagcaag

SEQ ID NO: 47829 - DNA, 201 bp, Bos taurus
ctctgttcaatccccgcaccaagtttttcttggtggtggacaggggtttccctagaaaccccccaacacccaagatgggctgtgaggagaaaggagagggtaggtgcaaggcccaggaaacgggtaggtgggagctgggcctggatcaaaaggccaaccagtatttgagagacgctgtcgcccacaaagacgggagctgta

SEQ ID NO: 47830 - DNA, 201 bp, Bos taurus
aacagtgctgtgacattagagaccctggaggtggcagagggcagggtctcagaagtctccaccatggacttttgcttggccctgcagggggctgtctggcgtgaacatagatgtcctgagatcagacaaatgacagcttcttcttagagggctagatctacggtcatggatggtagcggagacctatgtttacaccctcaa

SEQ ID NO: 47831 - DNA, 201 bp, Bos taurus
ctgaatgtgcgaaaccaccatatggcacagacattattttgatctgcatttttcgatgaagcaactgaggctcaaagaggctaagccacttgcacgtcatcacagatcaagtgactggcaaagcagggagactaatatcaccagcttccattccacagactgttatgcttcttctgtgtgatgaacaacttccaaaattca

SEQ ID NO: 47832 - DNA, 201 bp, Bos taurus; identical to SEQ ID NO: 6429

SEQ ID NO: 47833 - DNA, 201 bp, Bos taurus; identical to SEQ ID NO: 6430

SEQ ID NO: 47834 - DNA, 201 bp, Bos taurus; identical to SEQ ID NO: 6431

SEQ ID NO: 47835 - DNA, 201 bp, Bos taurus; identical to SEQ ID NO: 6432

SEQ ID NO: 47836 - DNA, 201 bp, Bos taurus; identical to SEQ ID NO: 6434

SEQ ID NO: 47837 - DNA, 201 bp, Bos taurus
gaggtccgatgaggctgtgcaaggaaaaggtctcggcccagtgcctggcacaagggaagtggctgttgtcgcacttgttcggggctctggctatgagagggaagttggggccctcactcctgtgagatggagagccctcctaggagctcatttctggtcccatgggaaaggcagcggtggtgtgggcctcctccctcctgg

SEQ ID NO: 47838 - DNA, 201 bp, Bos taurus
gccctgcagaagagaaagcacaacccagagagtgaaggacactcgtctacaggcgcacagccagcagtggccgagctgtggccaggacagttgttccgctacagactgacgcaaggctttagacccacccgcctcacccgctgggtcttctcagctctggcctccttttccaaagagggttcgtatttgatacttatcaaa

SEQ ID NO: 47839 - DNA, 201 bp, Bos taurus; identical to SEQ ID NO: 6435

SEQ ID NO: 47840 - DNA, 201 bp, Bos taurus
gtcagaagtcttcatcccctttttccgttttagtggctgatctgtcttctctcttagcaaggaagaaacctctgaatccttccaggggactttttgtcacggatactattcttggagtaataatgctgtgtttggttttgaatgtgttgactttgcactaacaggtaagccaagcagaatatgcccgggcaggcagtttgg

SEQ ID NO: 47841 - DNA, 201 bp, Bos taurus; identical to SEQ ID NO: 6437

SEQ ID NO: 47842 - DNA, 201 bp, Bos taurus; identical to SEQ ID NO: 6438

SEQ ID NO: 47843 - DNA, 201 bp, Bos taurus; identical to SEQ ID NO: 6439

SEQ ID NO: 47844 - DNA, 201 bp, Bos taurus
tttaacatcttagtggatccctcattgattagcgagttgaataaaatatttgacttgtgtttatttcatacttgagagagtcataattttatctttttgagaatcattccttaccaagattaaagtccaacactttctgctaagaaattctattactatttgatgacagtactaccttacctgtctatagtaatttatagt

SEQ ID NO: 47845 - DNA, 201 bp, Bos taurus; identical to SEQ ID NO: 6440

SEQ ID NO: 47846 - DNA, 201 bp, Bos taurus; identical to SEQ ID NO: 6441

SEQ ID NO: 47847 - DNA, 201 bp, Bos taurus; identical to SEQ ID NO: 6442

SEQ ID NO: 47848 - DNA, 201 bp, Bos taurus; identical to SEQ ID NO: 6443

SEQ ID NO: 47849 - DNA, 201 bp, Bos taurus; identical to SEQ ID NO: 6444

SEQ ID NO: 47850 - DNA, 201 bp, Bos taurus; identical to SEQ ID NO: 6445

SEQ ID NO: 47851 - DNA, 201 bp, Bos taurus; identical to SEQ ID NO: 6446

SEQ ID NO: 47852 - DNA, 201 bp, Bos taurus; identical to SEQ ID NO: 6448

SEQ ID NO: 47853 - DNA, 201 bp, Bos taurus
gatgggactttgtttagtattttaaatctttatttcaaaattattctcaaattcatcctctatttctctttctaggatattaactgctattagctgcttctaatggtggtcttatttcagaaatgcagtttttattttgttaattataaccatttagctttctatttatgtgtttaacagagcgatgccctgtagtgaagg

SEQ ID NO: 47854 - DNA, 201 bp, Bos taurus; identical to SEQ ID NO: 6449

SEQ ID NO: 47855 - DNA, 201 bp, Bos taurus
ttaggcatacagtggcattgagattccagtgagattacttagagtcatgccaccaatactttttcataatttggatcattttatctgggccatgattagttccagaatgtaaagctttgagtaatgacatttttaaggactcaagaaaaaccaggctgctctccaggccctcagtgagaccgcatttaatattcaatttgc

SEQ ID NO: 47856 - DNA, 201 bp, Bos taurus; identical to SEQ ID NO: 6450

SEQ ID NO: 47857 - DNA, 201 bp, Bos taurus
aagacaacactctgtctggccttggctctcacttggagatgaccagaggatggaaacagaagtggacagtacggtgagagcagaagctctggctctggcacttgccagtggaggggcctcaggcaagtcacttaatatctctgaaccagctttctctgttgtaaaataaagaaaatagagtccactatgatgaactagttt

SEQ ID NO: 47858 - DNA, 201 bp, Bos taurus
gtcagtgctggatctgaatacttcctggcctcatacttcttgtgcggagtgaagaatgctgtagaaaccagcatgttttcatatttacagtacttctgtcatttcctaaataagtactggcctgggagcaccatcagtgccctctgttttggtggcatgtccaggcatgcagtgttccatctccagcagcacctggagaca

SEQ ID NO: 47859 - DNA, 201 bp, Bos taurus; identical to SEQ ID NO: 6451

SEQ ID NO: 47860 - DNA, 201 bp, Bos taurus; identical to SEQ ID NO: 6452

SEQ ID NO: 47861 - DNA, 201 bp, Bos taurus; identical to SEQ ID NO: 6453

SEQ ID NO: 47862 - DNA, 201 bp, Bos taurus
gctagaagcaggattttggttccctggccagaaactgaagtcaggtcacagctgtaagagtgctgaatcctagccactagaccaccagcgaaagtgatcctgttctgttggccttgtagaaatgaatttccacaaaaagccagaaactagtgaaacaagtaaagtgtttattaggagggaaaaagtataagtggatagact

SEQ ID NO: 47863 - DNA, 201 bp, Bos taurus; identical to SEQ ID NO: 6454

SEQ ID NO: 47864 - DNA, 201 bp, Bos taurus; identical to SEQ ID NO: 6456

SEQ ID NO: 47865 - DNA, 201 bp, Bos taurus; identical to SEQ ID NO: 6457

SEQ ID NO: 47866 - DNA, 201 bp, Bos taurus
gtacagaggtggatagttcattccccagagagggtctgtggtgtgatggggatacagatgagatacagtcccctggcagtgctgggtgtggcaggaggactgatgggccaacggaatcacttctcccactcttgtgccttagtgcccccttctgtaaaatggtacatggaaaatggatatatagctccttcttgatttata

SEQ ID NO: 47867 - DNA, 201 bp, Bos taurus
accctgggtttgatatgtctagggaactcatatcccaccggtgttaatcctgcctgtgaaatctcattgtaattataaacacgtgggcaggcccagtgagtgctttgactagtagagcccttggaggagggctgatttggctgaaccagggtcctgattccactgcctggccctgggcactctgagtctccagaccgcctc

SEQ ID NO: 47868 - DNA, 201 bp, Bos taurus; identical to SEQ ID NO: 6458

SEQ ID NO: 47869 - DNA, 201 bp, Bos taurus
cgcagactagcaggatgatgaggtgtcattttatcaaggctctggaatggggtcattagatgtcattccctttctctaagccaatttgtctgtatcagctgttgtaggccatcagaatctctcagactcatggagagacatctgaaccctgcaaatgcttggcatatggcaagcatagcatgtgcttatgagctgtgtctc

SEQ ID NO: 47870 - DNA, 201 bp, Bos taurus; identical to SEQ ID NO: 6459

SEQ ID NO: 47871 - DNA, 201 bp, Bos taurus
ctagtgctttggaaggtgtgcaattcatgccccatgactgggcttggaaagagtaatatcgattcctgggacagttgccaaagtgatcttttctaaggaccgtcatgaaacagggccaggtaaggaccttggtctggtccatcctagacccatgacttagagtgcaaagtgacttccttagtatgttatctatcatccact

SEQ ID NO: 47872 - DNA, 201 bp, Bos taurus; identical to SEQ ID NO: 6460

SEQ ID NO: 47873 - DNA, 201 bp, Bos taurus; identical to SEQ ID NO: 6461

SEQ ID NO: 47874 - DNA, 201 bp, Bos taurus
gcccagagcaagcctgaaacctcaggcctaagtgacaccccttcctggtcacatgtgtggcactcctgtcccacctgccacgtcagcaggatgggaaccagctggccggtgttatcccattgtgcaaatgaggacaatgagatgggagagagacagtgatctacccaaatcactggatggttagcagcagatctcaggcta

SEQ ID NO: 47875 - DNA, 201 bp, Bos taurus
cctggtatccaactaggttaaattgctttctatatttaaattgcctgctagctggttagatgtgggagccacagctgtgaaatggatagttccagccagtcaatagaaaggaataaatcctaatggattaatctgttataattagacaattctgtatgactttgacatggagcccaactcctccgagaaagaggagagggg

SEQ ID NO: 47876 - DNA, 201 bp, Bos taurus
tgatttcctttaggattgactggtctgatctccctgctgtccaagggactctcaagcatgtagattataccaatatatgaaaattcaaacatgaaataacgttaagggataaaaagcaggaaacgatatacttatgcaccgtaggtagaacaggggaaaatggtcagtgaactgacacaatccagaaataaatttcaaaag

SEQ ID NO: 47877 - DNA, 201 bp, Bos taurus
aagaggtggccaaagtggttcctcctccctgggcatctgtgcatgagtttccagcaggggaaggaggaggcaggggcccccagacctgtctacctgcccagatttcttccctgcacattttccagaaggtaaaagcccacctctcctgctagcacagttccacacctccttccaatggcagcagagagagctggccgctta

SEQ ID NO: 47878 - DNA, 201 bp, Bos taurus; identical to SEQ ID NO: 6462

SEQ ID NO: 47879 - DNA, 201 bp, Bos taurus; identical to SEQ ID NO: 6463

SEQ ID NO: 47880 - DNA, 201 bp, Bos taurus; identical to SEQ ID NO: 6464

SEQ ID NO: 47881 - DNA, 201 bp, Bos taurus; identical to SEQ ID NO: 6465

SEQ ID NO: 47882 - DNA, 201 bp, Bos taurus; identical to SEQ ID NO: 6466

SEQ ID NO: 47883 - DNA, 201 bp, Bos taurus; identical to SEQ ID NO: 6467

SEQ ID NO: 47884 - DNA, 201 bp, Bos taurus; identical to SEQ ID NO: 6468

SEQ ID NO: 47885 - DNA, 201 bp, Bos taurus; identical to SEQ ID NO: 6469

SEQ ID NO: 47886 - DNA, 201 bp, Bos taurus; identical to SEQ ID NO: 6470

SEQ ID NO: 47887 - DNA, 201 bp, Bos taurus; identical to SEQ ID NO: 6471

SEQ ID NO: 47888 - DNA, 201 bp, Bos taurus
ctctagttcttgtgtccctaacagtgatcatcacacttcagagctggaaggacctagaggtcagccagactggggcctctcagactgatggcacacaatcccttggggacctgttaacatgcagattcttacgcaatcttacgtcaatctcccaagggccctggatttgacactgactgcagatgctgccagccctcgtgg

SEQ ID NO: 47889 - DNA, 201 bp, Bos taurus; identical to SEQ ID NO: 6472

SEQ ID NO: 47890 - DNA, 201 bp, Bos taurus; identical to SEQ ID NO: 6473

SEQ ID NO: 47891 - DNA, 201 bp, Bos taurus; identical to SEQ ID NO: 6474

SEQ ID NO: 47892 - DNA, 201 bp, Bos taurus
gcatcagtttaaactaaaaccaaggtcaccttgctgaggcaggcagcacaattgagtcttatttgagcaaagtctattccttctcttgtctcatgtgaaatagtaacacctaccattaatgtaagtagtattctaccatgccatctacaaatgcccttaagtcctggctagttggcaacagattttattagatttttctta

SEQ ID NO: 47893 - DNA, 201 bp, Bos taurus; identical to SEQ ID NO: 6475

SEQ ID NO: 47894 - DNA, 201 bp, Bos taurus
aaaatgcagacagtgcagtgtggggcaagacacggaggcatggacctgaatccaaggcagcaaatccacaaggttcagctgtgagccataatgagtaagattgatgggtgatgccaatgagtttgtgaaatagaaattaaaagaaacccaaaaaacaaaaaactcaggctgaagcatcattctgacatatgtagcctaaag

SEQ ID NO: 47895 - DNA, 201 bp, Bos taurus; identical to SEQ ID NO: 6476

SEQ ID NO: 47896 - DNA, 201 bp, Bos taurus
aattagaataagtgtaatagaaggagaggatctagaaaaggtaggacccagggcatccaattccaattgcttaaccagttttcccatgaattactgaggcattgacgtatctcaaggcactgtttgtcagatttcttgctgcttcctttataacgtcttatttattggtgtagaaacaggaggcttcctccaaaaataggc

SEQ ID NO: 47897 - DNA, 201 bp, Bos taurus; identical to SEQ ID NO: 6477

SEQ ID NO: 47898 - DNA, 201 bp, Bos taurus; identical to SEQ ID NO: 6478

SEQ ID NO: 47899 - DNA, 201 bp, Bos taurus; identical to SEQ ID NO: 6479

SEQ ID NO: 47900 - DNA, 201 bp, Bos taurus; identical to SEQ ID NO: 6480

SEQ ID NO: 47901 - DNA, 201 bp, Bos taurus; identical to SEQ ID NO: 6481

SEQ ID NO: 47902 - DNA, 201 bp, Bos taurus
ggagatgagcagaagtgtggaaagaagccaggagttccattgctgccagttgtcattattacaatccaggcacctgaaatgaccatgactcctggatgctgccatcttggttttgattttgaatgacctatgctctggacctaaggaaggcattcccaagtgaacatcctgggaggattctccccaggagatcaggtggcc

SEQ ID NO: 47903 - DNA, 201 bp, Bos taurus
ctgcctctaagggttctttttctgctgcagtgatgctgcagaaaagcgctttaaaacattccctgcttacaaatgcactcagttgaatctggaaatcccagcaagggactctaatctccagcaaatattctattcttgacaactaattccaccgaagaattttttttcttagatctaatgggatttaacatcttttgtgat

SEQ ID NO: 47904 - DNA, 201 bp, Bos taurus
aacctcagggccccctgcattcttcaagagcctcctcagatgaccccgaaggagcctgactcttgctctttctgtctgaatatcatgttacctctagtgttcaggacacttccgggcctccatcttgaacttgtctttgcacctgaatctttggtttaagtataattccttgtaagggagcacagttctgaagtgtctgtg

SEQ ID NO: 47905 - DNA, 201 bp, Bos taurus
cataatgaccccacagtctcagaagcttcaccaggtcttatccctagtattagtattctcaaagataatctctgccaggacccctttgtttgagaagatcggctcatcaacttgaccgtacaagttcaggttgtgaatattaatgttcaagaatgtaaaattcaaaaacaaacaaaaatttaagaaaaaataggtaaaaaa

SEQ ID NO: 47906 - DNA, 201 bp, Bos taurus
cctatggaggtcttggagacactttcagatggcccatgagattaaaacttcctggtaataatagtaagatgttattggcctgtcttcactctgttctgtcgtgagtacacagtatagtttcccagaggctatgtcgaatgtgatactgcatcagattgaatgcagaggcagagagtctaaaggccttttgtgaagccagat

SEQ ID NO: 47907 - DNA, 201 bp, Bos taurus; identical to SEQ ID NO: 6482

SEQ ID NO: 47908 - DNA, 201 bp, Bos taurus; identical to SEQ ID NO: 6483

SEQ ID NO: 47909 - DNA, 201 bp, Bos taurus; identical to SEQ ID NO: 6484

SEQ ID NO: 47910 - DNA, 201 bp, Bos taurus
ctcaattcaggatttcatactcctgatcccatcattttatacagtaatacttgacttccattttacctaatttgccgtattctgtctgggagacctatgttctttcctatgagtgtctaatgttctgtatctgagctgccccatatggtcgccactagtcacatgtggctgtgcttgtgtactagttgttcaatcatatcc

SEQ ID NO: 47911 - DNA, 201 bp, Bos taurus; identical to SEQ ID NO: 6486

SEQ ID NO: 47912 - DNA, 201 bp, Bos taurus; identical to SEQ ID NO: 6487

SEQ ID NO: 47913 - DNA, 201 bp, Bos taurus; identical to SEQ ID NO: 6488

SEQ ID NO: 47914 - DNA, 201 bp, Bos taurus; identical to SEQ ID NO: 6489

SEQ ID NO: 47915 - DNA, 201 bp, Bos taurus; identical to SEQ ID NO: 6490

SEQ ID NO: 47916 - DNA, 201 bp, Bos taurus; identical to SEQ ID NO: 6491

SEQ ID NO: 47917 - DNA, 201 bp, Bos taurus
tcaagtcacagcagaatacctgcaatggagtggggccaccaggcctaaccagggactaccagagaggggcaataaggggtgttattgccaaggtcagggaggacagaatgctaggaatttagggaggcaggtgaaatttaaaagaccatagaggccagagtagggggtaaagctaagaagtcaggcccatcagtgggagat

SEQ ID NO: 47918 - DNA, 201 bp, Bos taurus
taaggcaggagtctggaggcaaggcagagggagaagaaatcaggatgaagatgtaaaaggcagcagaacaagaatgagcaggctgaggtcagcagagaccagagccccggagcccctcctcattcctgataccaatacccccctccctggacagaatcgcctcccttccctcctaacacaaaggggctctcttctcctcct

SEQ ID NO: 47919 - DNA, 201 bp, Bos taurus
tttgctacctgaccccttccagaaaaagtctgctgacctctggcctggtcttctgaccttttctgatgtcatctcctctgtatcttccccacctcagccccactggcctctttacggttccccaaatgtgccaagcacacagagcttcataaatgctccccctggggactctgtacatctggtccctttgcctggaagatc

SEQ ID NO: 47920 - DNA, 201 bp, Bos taurus; identical to SEQ ID NO: 6492

SEQ ID NO: 47921 - DNA, 201 bp, Bos taurus
aggtgcccgtggcgttgacgatggcccactcgccgctctcccagtagtccttcaggtccaccgtctgctccatctgcaccaggtcgatcttggccttgtcgtacgaccaggagccaaacttcatcttgcagttctgctggtcgaaggggaagaaggtgacgtcgatgctgcaggagctcttgtagatggcaggcggtgccc

SEQ ID NO: 47922 - DNA, 201 bp, Bos taurus; identical to SEQ ID NO: 6493

SEQ ID NO: 47923 - DNA, 201 bp, Bos taurus; identical to SEQ ID NO: 6494

SEQ ID NO: 47924 - DNA, 201 bp, Bos taurus; identical to SEQ ID NO: 6495

SEQ ID NO: 47925 - DNA, 201 bp, Bos taurus; identical to SEQ ID NO: 6496

SEQ ID NO: 47926 - DNA, 201 bp, Bos taurus
agatagtccaggccccagactcaggagagggaagtgacagtgctctcagttaacaacctccaaagagcgctgaggagaggaagccctgccactgaaatggcgtgatttcagggggccctgtccacaggaatgggggccctgtccataggaatggcacctcctagaactgcataacgtgtcagccctgtctgctccccagca

SEQ ID NO: 47927 - DNA, 201 bp, Bos taurus; identical to SEQ ID NO: 6497

SEQ ID NO: 47928 - DNA, 201 bp, Bos taurus
ctgtgtgtcatttattaataatgtaattaaaataacatatttagaattctgtccaaagttaaacatggagtcaagcatagagaaaattgtgttgtaactgctgtgacagcagagaagaatttacagtttaaactctcttaacttgtcatgtgggttattcatacattatgaacaagctcgatactgataatgtacagggtg

SEQ ID NO: 47929 - DNA, 201 bp, Bos taurus; identical to SEQ ID NO: 6498

SEQ ID NO: 47930 - DNA, 201 bp, Bos taurus
aggaggaaaaagtcagacaggcccctgcaaataggaacagggctggctcaacaacaggaagctggcaggtctctgcagcccttccgtttgtttccaggctcctgggatgggtcacaggccagtcctttgagcagcccctactcctaaccccctgaagacgactaacctgaatacgggttattagtgaggctcccatctcga

SEQ ID NO: 47931 - DNA, 201 bp, Bos taurus; identical to SEQ ID NO: 6499

SEQ ID NO: 47932 - DNA, 201 bp, Bos taurus; identical to SEQ ID NO: 6500

SEQ ID NO: 47933 - DNA, 201 bp, Bos taurus; identical to SEQ ID NO: 6501

SEQ ID NO: 47934 - DNA, 201 bp, Bos taurus; identical to SEQ ID NO: 6502

SEQ ID NO: 47935 - DNA, 201 bp, Bos taurus
ccacaagtcaaggcccatttggctgggatgtggccagccaagggcactctgccctctggccctgccttagcacacagtgagtgctcagtgggcctggtgcgtcccctcctccagctgagctgcctgccctcaatgccctcttaaaattcttaacatttgacttcattttttttttttttttcaattggccacaccacatgg

SEQ ID NO: 47936 - DNA, 201 bp, Bos taurus; identical to SEQ ID NO: 6503

SEQ ID NO: 47937 - DNA, 201 bp, Bos taurus
ggagtactctaagtcacagagaccttcaggtacctaaggttgccattgggctcctaatctgtgcgggggtgggggtggggaatgcagacctgggtggccccagaacccattctcttaacctctgtgcaatgctggcagtcctggaaaagcgtgtcccagagagccgtggccctctgggcccccttggagggctgtccactc

SEQ ID NO: 47938 - DNA, 201 bp, Bos taurus
cccgagacccgcctggtccgtacacccagcgctccagctcctccacccgggcctgtagccgctgaacatcggtcacagccgccatgactcccgctgccccgcctcagccaggaatagccagagggcaggacatccgtccaaatagagaaggcgggccaatccgagtggacgggagcccttgcatacaggaagtgacgcaac

SEQ ID NO: 47939 - DNA, 201 bp, Bos taurus; identical to SEQ ID NO: 6504

SEQ ID NO: 47940 - DNA, 201 bp, Bos taurus; identical to SEQ ID NO: 6506

SEQ ID NO: 47941 - DNA, 201 bp, Bos taurus; identical to SEQ ID NO: 6507

SEQ ID NO: 47942 - DNA, 201 bp, Bos taurus
tgggacctacagattggggtttacaaatttttaaaagtccatcttgtttcctaattattaaagtaatatatgcccactatagaagaataactaaatgaaaaaggaaaggaaaggccaactgcaatgagacagtaaaatgatgtagctcctttggaaaagactctagcagtttctcaaaaatatcaaatatagagttctcat

SEQ ID NO: 47943 - DNA, 201 bp, Bos taurus
gtgcctgcagccagcatgctgtggtggccatgattctggggcgtatttgaaagtgaataggattttgcagatggatctgacaattttgtatttcatgacaccactggccagtgggagaagattaaccagagaagatgggcatttaaaatcagacccatctactcaagatggggccagtgctgggaaaaagtgttttaggga

SEQ ID NO: 47944 - DNA, 201 bp, Bos taurus
actacattccagttataattgttaaatatgctttaactttagtccttggttgtactagtcctatttcaaattctcagccacatatggccaagtgtctaccgtactagatggcacacatacagaacatcaccatcgtcacagaaagttctattagacggcactggccaagagcaaagcttctttaaactttaatctacattt

SEQ ID NO: 47945 - DNA, 201 bp, Bos taurus
taattttcttttaaatctatgaatgcctgtgcccaaaggatcttaaggtgaattagcattgtaacaccaaatgttaaaaaagtaacagaagtcaaatttatatcaacagagtatcccagtgaattccaaactggaacaaaagcctagagataaaatattttgcacaacctcccaaattatatctaaggaaattaatgtaaa

SEQ ID NO: 47946 - DNA, 201 bp, Bos taurus
aatactcagctctgccctcatatcacgaagcaactatagacaatacataaaagaataagcctgattgtgtcctggtaaaactacttaaaaaaaaaacccagtttggcccaggaggtctaaatgtctatttgaggcattttctttttaatatcttttgtttattaatagtctagaaaaaaataacaagagcgtacttcattc

SEQ ID NO: 47947 - DNA, 201 bp, Bos taurus
attttctgtgattgaaaaatatgaaaatgtacaaactgtatttgttgggcaaatcagtatttagttcttaattccaaactgaagtttatattatataataatatttagagcaaacaaatcttggaagaaaacacacattcacagtatacaaaaggattccttcctccccttctttatcctgagagaagagctagtgaactt

SEQ ID NO: 47948 - DNA, 201 bp, Bos taurus; identical to SEQ ID NO: 6508

SEQ ID NO: 47949 - DNA, 201 bp, Bos taurus; identical to SEQ ID NO: 6509

SEQ ID NO: 47950 - DNA, 201 bp, Bos taurus; identical to SEQ ID NO: 6510

SEQ ID NO: 47951 - DNA, 201 bp, Bos taurus
tgctttggcttttcagcgttgttcagaagaacaatatctcccagttggggattttcaacagaagcaaaggtgtttccgggtgttaattggtgcctgaaaaatgacccttaaaatacctgtttatctgcttctttttaaattggagtcctacgtgctataataggtggcccataattacttcttagcccattgttttttttc

SEQ ID NO: 47952 - DNA, 201 bp, Bos taurus; identical to SEQ ID NO: 6511

SEQ ID NO: 47953 - DNA, 201 bp, Bos taurus; identical to SEQ ID NO: 6512

SEQ ID NO: 47954 - DNA, 201 bp, Bos taurus; identical to SEQ ID NO: 6513

SEQ ID NO: 47955 - DNA, 201 bp, Bos taurus; identical to SEQ ID NO: 6514

SEQ ID NO: 47956 - DNA, 201 bp, Bos taurus; identical to SEQ ID NO: 6515

SEQ ID NO: 47957 - DNA, 201 bp, Bos taurus
ttgtgcttgattgcattctgctccttgcattcagactgtgtgccggcaattgaaaagtagagtttgtagctaccaaatgagtgcagataatgtatctcattactaggattggaatcaggtgtgatctcctagggcctctaatttgttcagtattttctatgggtacagagacaatgaacaggaattgcttagaaggcatga

SEQ ID NO: 47958 - DNA, 201 bp, Bos taurus
agctgtatggggagctgatgttatctttgaggcttttccaaatccacagggctctttcaatgacaagaaacaggtccctctactttccaagataaatgaggtacatacagtaacaaagaaagggcaacccagatgaagttcaccccaggaggcccctccaaccgagtgctgcaaggagatatcattaggctatgaagtcct

SEQ ID NO: 47959 - DNA, 201 bp, Bos taurus
tggtttcagttgctctgccctatgagagcagcgttccaccgagtgcctgggaggatgagaataaaggtcaactatttgacacgaagacctagaaagactttcctgggtttcatagtgggttcctgaattgaaagggaactgagatgctatttaagaaactgaaggagaataatggtctaggatcttgacaggactagacag

SEQ ID NO: 47960 - DNA, 201 bp, Bos taurus; identical to SEQ ID NO: 6516

SEQ ID NO: 47961 - DNA, 201 bp, Bos taurus
ggataccttcactgtataaagaattctagttggcagtttcattctttcaacattttaaagatgtcattctactgtctcctggcttctactgtctctaccgggaagctagtgatgacctaattgttgctttattgctcctctgaaggtgataatttcctctcatttgggctgcttttgaaacttgaagtcacatatattagt

SEQ ID NO: 47962 - DNA, 201 bp, Bos taurus; identical to SEQ ID NO: 6517

SEQ ID NO: 47963 - DNA, 201 bp, Bos taurus; identical to SEQ ID NO: 6518

SEQ ID NO: 47964 - DNA, 201 bp, Bos taurus; identical to SEQ ID NO: 6519

SEQ ID NO: 47965 - DNA, 201 bp, Bos taurus; identical to SEQ ID NO: 6520

SEQ ID NO: 47966 - DNA, 201 bp, Bos taurus; identical to SEQ ID NO: 6521

SEQ ID NO: 47967 - DNA, 201 bp, Bos taurus
acagtacataaagcaagaaagattgttttttttttcccctgccaggtgtgagatgcttctgcaacaagagcatcatggaggctcctttccaaagaagaaagggtgataaaaaatgagaaaaaattcaagtgacaaaaaaaattgaatagaacaggctttttaaaagtgtgttggttttggttccactaggtggcagtaaat

SEQ ID NO: 47968 - DNA, 201 bp, Bos taurus; identical to SEQ ID NO: 6522

SEQ ID NO: 47969 - DNA, 201 bp, Bos taurus; identical to SEQ ID NO: 6523

SEQ ID NO: 47970 - DNA, 201 bp, Bos taurus; identical to SEQ ID NO: 6524

SEQ ID NO: 47971 - DNA, 201 bp, Bos taurus; identical to SEQ ID NO: 6525

SEQ ID NO: 47972 - DNA, 201 bp, Bos taurus
cccatggggtcgcaaagagtcggacacaactgagtgactaacactttcactttcaatatacgtttcaatggtcttctctcatatcatcccactttctccttcccccactagacagtggttctttattctgcattttagaatcattgaggactttttttttttaatgctaatatctgggctctctcctggatcaatgaaata

SEQ ID NO: 47973 - DNA, 201 bp, Bos taurus; identical to SEQ ID NO: 6526

SEQ ID NO: 47974 - DNA, 201 bp, Bos taurus
ctttctgccataagggtggtgtcatctgcatatctgaagttattgatatacttgagttaaaaatttgttctgactgtatagggcacaccatggcccaccttgaagtgtactcctgaagcagcactttttaaagtagttccctttgaaaactatttggaataatgtcttggccttcaggactcctaagtgttcattgattgt

SEQ ID NO: 47975 - DNA, 201 bp, Bos taurus
acttctcctctttccctcagtgttctgaaataacatttgaagttctgtttggtctctttggagaactgccaatgacttcaaggcatgtagtgaagttatatatcaagacacaattacatgcagtacttttgaaaagtgattctcacttaggagtaatatacgatatgaatttaataatctgccatactactcctttttttt

SEQ ID NO: 47976 - DNA, 201 bp, Bos taurus; identical to SEQ ID NO: 6528

SEQ ID NO: 47977 - DNA, 201 bp, Bos taurus; identical to SEQ ID NO: 6529

SEQ ID NO: 47978 - DNA, 201 bp, Bos taurus; identical to SEQ ID NO: 6530

SEQ ID NO: 47979 - DNA, 201 bp, Bos taurus; identical to SEQ ID NO: 6531

SEQ ID NO: 47980 - DNA, 201 bp, Bos taurus
tttttcttgatgaactttttttctttaaagaccttaagaagcaatcatttggtaacaggtaggagatgagaaatccagccactagaaaaatgagtcataaaactcttattcaaagactcaaaagtattcttcacatgtatttcctgcagggtttcattccttcctggggcaggagtcagtctggcagataacttatctggg

SEQ ID NO: 47981 - DNA, 201 bp, Bos taurus; identical to SEQ ID NO: 6535

SEQ ID NO: 47982 - DNA, 201 bp, Bos taurus; identical to SEQ ID NO: 6536

SEQ ID NO: 47983 - DNA, 201 bp, Bos taurus
aggaatgcgctagtgactataatgttatgaaagctacttgaagtccttgacacttgagtgtgcccggccacaagagtgcacagaggttgggagagcatccagtggagagctcgacaactcacgcttcacttcagcacttcatgtgggatgcagtatgggactggagtagttaggctgggggagggcctttgagcctctcta

SEQ ID NO: 47984 - DNA, 201 bp, Bos taurus
acaaacttgtggctgttaagaagtggccccatcatttcatcgtgtggagtcattggttaacttgcccaggcaaggcttgctctcgcagctctgtgaggagctctctggccagttttctcgacctatgggcttccacgcaaagatgatcccatctgtacaaagtatagtccaggaagccaataatctcgttcattatcgcat

SEQ ID NO: 47985 - DNA, 201 bp, Bos taurus; identical to SEQ ID NO: 6538

SEQ ID NO: 47986 - DNA, 201 bp, Bos taurus; identical to SEQ ID NO: 6539

SEQ ID NO: 47987 - DNA, 201 bp, Bos taurus
agcccagctgctttctgaataatccctggaacaactgtctctgtgggcgctggaggtcccaaggccttctcatttcttccgacttctcttactcgactcttctctagtctgacagtagcaggacaccgtgtcctcctagtgaaggggatctaacttcaactactttccactcaaggaatcaatcaaaatgtttccttctct

SEQ ID NO: 47988 - DNA, 201 bp, Bos taurus
atttagggcctgtgtatataaccttctcatctcaaaataatttaactgcatatgcaaatattcttttttccaataaatccagatgttccagagattgacatggatgtatttttttaggggccagttttcaacctaccacacgcattaaatgtaataaaaaagctcacatatagtcacattgaaatgaaagtgcagaaaaac

SEQ ID NO: 47989 - DNA, 201 bp, Bos taurus; identical to SEQ ID NO: 6541

SEQ ID NO: 47990 - DNA, 201 bp, Bos taurus
ggtctccatcacctctcccctccgcctgcagctctgagcacttagcatgcctgagctcaggccccgggcatcacaccacacactggaggcagggcagttgccacccacctaccttgccattcattcccaaggttgtaactgtgtgtgccttacataagatgacagcagcactgaaaatccacttagggatcaactgattct

SEQ ID NO: 47991 - DNA, 201 bp, Bos taurus
agagggggagggtatgacttttctttcagcttgggatgctaccagctcgggatggccccttcaaagaattccaaagcacggaaaactgttcttcagttaccaccacagctgtggtcttcagtttcctagctcggtggtcagactccacctggctttctctttgccttctacccattgcttgcaaacagtcttacacagctc

SEQ ID NO: 47992 - DNA, 201 bp, Bos taurus; identical to SEQ ID NO: 6544

SEQ ID NO: 47993 - DNA, 201 bp, Bos taurus; identical to SEQ ID NO: 6546

SEQ ID NO: 47994 - DNA, 201 bp, Bos taurus; identical to SEQ ID NO: 6549

SEQ ID NO: 47995 - DNA, 201 bp, Bos taurus; identical to SEQ ID NO: 6550

SEQ ID NO: 47996 - DNA, 201 bp, Bos taurus; identical to SEQ ID NO: 6551

SEQ ID NO: 47997 - DNA, 201 bp, Bos taurus; identical to SEQ ID NO: 6552

SEQ ID NO: 47998 - DNA, 201 bp, Bos taurus; identical to SEQ ID NO: 6553

SEQ ID NO: 47999 - DNA, 201 bp, Bos taurus; identical to SEQ ID NO: 6554

SEQ ID NO: 48000 - DNA, 201 bp, Bos taurus; identical to SEQ ID NO: 6555

SEQ ID NO: 48001 - DNA, 201 bp, Bos taurus; identical to SEQ ID NO: 6556

SEQ ID NO: 48002 - DNA, 201 bp, Bos taurus
gtgaagactttgaggtttcaaacccactgtgtcctcccaggcccctcaccaaggggacttcagtgggcatttgtaggcctgcagacattgaattatgaagatgttaatgagatcctggacaggggagtgaaggacactcaggtccggtgggaagctgagacaccacttctcaaggtgttggcgaactgggccaggaaagat

SEQ ID NO: 48003 - DNA, 201 bp, Bos taurus; identical to SEQ ID NO: 6557

SEQ ID NO: 48004 - DNA, 201 bp, Bos taurus
tgctcaacatgcattgtaatgggcagtggcattttcactgggcctgggctgcgaattctcttgaacctttcccttgagtcttcagtttgacacacaccctggaggcatccacacgtcaggcctgttccctttctatggcatcacccctcaccctcccaccttggtgagattccaggaggcaggacaggctttgggcctctt

SEQ ID NO: 48005 - DNA, 201 bp, Bos taurus
agttccttccttttttctgtctctgttgtgtggatgaaccacatttacgtcatggattcttgggttactttccccttgggctattgtgaaatagccaagtaaatagcactgatgaatagtgctcctgtgaacacggttgtgcaaaaatcttttgggagtccctgttttcagtcctttgggatacggacccaggagtgggat

SEQ ID NO: 48006 - DNA, 201 bp, Bos taurus
aaagtgggtctcactgtgctaaaagcaaggtgtgagagggccacgtttcttctggaggctccagggagagtgtttcctgcctttttagcttctgtaggggctgtattctgtggctcatggcccttccttcatcatcaaagctgtcaatggccagtagagtcctgcactccctcatgtatgaaacctgctcctctgccttcc

SEQ ID NO: 48007 - DNA, 201 bp, Bos taurus
agcaagagtatctggagtgtagtaagcaggacaagcatagtaaaggcaggcatggagacagagaggagacttctctaggcaggcaagaggctttctccaggtgggtaaggggcctggatcatagtgtggccaggaggtagagaggaggggtagtgctagaccccatgaagattagacgctgcagggggcttcctgaaaagc

SEQ ID NO: 48008 - DNA, 201 bp, Bos taurus; identical to SEQ ID NO: 6560

SEQ ID NO: 48009 - DNA, 201 bp, Bos taurus
tcctatgtgagctggaggcttcatcctggctgcactgcagacctgggagagggatgaaggatggaaatgggagggaaacatccctgagtgcctgctaggtgttggccctggggtcagagtgccactgaccctactcttgaagctcctcaaactacaacaggggctcaagccacaggagggccccgcaggcctctatgcctc

SEQ ID NO: 48010 - DNA, 201 bp, Bos taurus
gccctgccctactcacccccgtgacccactccccacagggtcttagtccaagttcgaccatcccttcatggctcagacccactccccacagggtgggccccgtctctcagggagaaacaaccctacaatagtcctcaagtacccgcctgctctgacctctgagatgctgcctggcctcaactcccccaggtctaccccaag

SEQ ID NO: 48011 - DNA, 201 bp, Bos taurus; identical to SEQ ID NO: 6562

SEQ ID NO: 48012 - DNA, 201 bp, Bos taurus; identical to SEQ ID NO: 6563

SEQ ID NO: 48013 - DNA, 201 bp, Bos taurus
tatcccccgggctcctggaagggcacctgaaatgcagcaggtgttcattgctgagtgagtgcaatgccagcctcctccactggcctctgcccccttctcctctctctgcattctcatgtgggaggataaagcacagcgcttattcttaacacaaacaaaggcctaaagttaaaggaaaaaaaatggacatcatagttcgag

SEQ ID NO: 48014 - DNA, 201 bp, Bos taurus
tgacattggccttgatgtttttagtaagcctctcttctggtcagagaggtgggatgtctgtccaaaattctcagagcagcagatccagtgctcaggtctcctgacctggccacagcaagcacatcagctgcatattagaattttcttcagctctctatggggtgacttgcatgatgtgaccttcatgatgcctgatgtgct

SEQ ID NO: 48015 - DNA, 201 bp, Bos taurus; identical to SEQ ID NO: 6565

SEQ ID NO: 48016 - DNA, 201 bp, Bos taurus; identical to SEQ ID NO: 6566

SEQ ID NO: 48017 - DNA, 201 bp, Bos taurus; identical to SEQ ID NO: 6567

SEQ ID NO: 48018 - DNA, 201 bp, Bos taurus; identical to SEQ ID NO: 6568

SEQ ID NO: 48019 - DNA, 201 bp, Bos taurus; identical to SEQ ID NO: 6569

SEQ ID NO: 48020 - DNA, 201 bp, Bos taurus; identical to SEQ ID NO: 6570

SEQ ID NO: 48021 - DNA, 201 bp, Bos taurus
gaggcatccttggagttctttgttgtgagacagagcccaggtctgctgtggcacacctgtcccctgcaagctgtcagttggggcctctcatttgagttggtttctaaagccacactgcccagtgttggtgctatttcagtccttctcaattaagttacgagctgtaagctctttcagggtggggcccttatatatgttcat

SEQ ID NO: 48022 - DNA, 201 bp, Bos taurus
gcctccttgctagtcagtcaccttagcacactgtatgcagcgaggaagggaactcatttataaatggggacaaagcacactgtccccacaaaatccacatcgggaggagggcatgacagggccagtaggtctcagaagtccatgtttgacctcattccctgacagtagattaagccccttagtaatctcctcaccaggttc

SEQ ID NO: 48023 - DNA, 201 bp, Bos taurus; identical to SEQ ID NO: 6571

SEQ ID NO: 48024 - DNA, 201 bp, Bos taurus; identical to SEQ ID NO: 6572

SEQ ID NO: 48025 - DNA, 201 bp, Bos taurus; identical to SEQ ID NO: 6573

SEQ ID NO: 48026 - DNA, 201 bp, Bos taurus; identical to SEQ ID NO: 6575

SEQ ID NO: 48027 - DNA, 201 bp, Bos taurus; identical to SEQ ID NO: 6576

SEQ ID NO: 48028 - DNA, 201 bp, Bos taurus
tagccaggcactgtacaagcactgggaaatgatgccctgacccttcaggatataccctggatgcagagccctctgatcaggatcctggcctctccatcagggagtgccctcaccataatgtcccactgccaagcagagacctaatgggaagagacaattatcaaaattcagctgaaggcctgaatataacaataaagatat

SEQ ID NO: 48029 - DNA, 201 bp, Bos taurus; identical to SEQ ID NO: 6578

SEQ ID NO: 48030 - DNA, 201 bp, Bos taurus; identical to SEQ ID NO: 6579

SEQ ID NO: 48031 - DNA, 201 bp, Bos taurus; identical to SEQ ID NO: 6581

SEQ ID NO: 48032 - DNA, 201 bp, Bos taurus; identical to SEQ ID NO: 6582

SEQ ID NO: 48033 - DNA, 201 bp, Bos taurus; identical to SEQ ID NO: 6583

SEQ ID NO: 48034 - DNA, 201 bp, Bos taurus; identical to SEQ ID NO: 6584

SEQ ID NO: 48035 - DNA, 201 bp, Bos taurus
tagaagaggagaggaaggatttcctcattgaaacaacggagggagcatggccctgcgcacaccttgatttagaaggtctggccttcagaactggagagaagaagtatttgttgctttctgccacccactgtgtgatagtctgttacaactgcctgaggccaaccctggtgcacaggttcttctgctgttttacatgaattg

SEQ ID NO: 48036 - DNA, 201 bp, Bos taurus
cccaggcttcaagcagcaaagaggggctgggcgctcagggctgggagctggcccgcccacatccctctacccaggtggctccaggaggcccctgctggcaccgatccccaagtaaacctaaacaagcctggggttgagggaggtcatgcccaaatcctaacagaaacttggcagtcacaagtcggagctctgggccctggg

SEQ ID NO: 48037 - DNA, 201 bp, Bos taurus
aacaagttaaacaatgtgttgctaacttagctaaaaggctggctgtgaatccaaaccgtccatcatcggtaggtgactgatgccctgtgtccttaggccctccttgtgtttccatctgctcttagaagacagatgatggacaagtcaggaaagaattgcaaaggactgacttctggctggggaacccctttctcatctttg

SEQ ID NO: 48038 - DNA, 201 bp, Bos taurus
ttctctgttgagctgctgagtttctggcccttgtgctcgagagtccagcccggctgctgcctcctggcatccctaagcaaactattcaggtctaaggtcgctgcaggcctcggcccagtgtggagaaattctggctggcatgggctggggtgggggtgcttcttcttaccacttgtccccttgtcatgtgggatttcatac

SEQ ID NO: 48039 - DNA, 201 bp, Bos taurus; identical to SEQ ID NO: 6587

SEQ ID NO: 48040 - DNA, 201 bp, Bos taurus; identical to SEQ ID NO: 6588

SEQ ID NO: 48041 - DNA, 201 bp, Bos taurus
gggcagccaggccagtgaccacagccccccagcccccacatgctgctgccgcagacctgccaagcctggcgccatctgtcaaggtgcaagtgggccgcacggtcctatcatcaccgacatcacactccacctcctgctttccagacgcccacaagaggaggctttctttccgtggcaaagagcaataaactctgagcgtgt

SEQ ID NO: 48042 - DNA, 201 bp, Bos taurus; identical to SEQ ID NO: 6590

SEQ ID NO: 48043 - DNA, 201 bp, Bos taurus
agctggcctgccttgagctcaggctgtctcacaccaggggcaggacctgatagaactctctacctggaactccagagaccaagggctgtggatggggcactgtggcctctgctatagcagggatacatcaacccttatattaacctcttcatttcttttatttttttatgtatttctttttattttttctgtgtatatgct

SEQ ID NO: 48044 - DNA, 201 bp, Bos taurus
gtccacggcgttcagagactcaagcccaatgcacttgggggtttggcacgtaaaacaatagcagaaatgaaatctggtttagaagcaactgtgattgtttcaagaatgcacagtcccttcaaatgctgcaagacatacacaacaggaaaatcaccttctgttggcactacatttgcttcaccagtgcatttatatcctaca

SEQ ID NO: 48045 - DNA, 201 bp, Bos taurus; identical to SEQ ID NO: 6594

SEQ ID NO: 48046 - DNA, 201 bp, Bos taurus; identical to SEQ ID NO: 6595

SEQ ID NO: 48047 - DNA, 201 bp, Bos taurus
gatagcccgaaattctaaccactaggtcactagggaactccctactcttttcattttttaaaaaatatccctctgtccaggaagtggtgtccaatttctcgagttgggtcagaggtcaatcccaggtttgcattggtgctgagccataagtcattccagtgtttttgaactgaactcaagtactatgattctctcctacca

SEQ ID NO: 48048 - DNA, 201 bp, Bos taurus; identical to SEQ ID NO: 6596

SEQ ID NO: 48049 - DNA, 201 bp, Bos taurus
acatgaacctaagatgtgaagcagaagctttgctagataaggctgtgtgatttgaaagaatcaggttcaataacaaagggtcgtgtggccttatggagctagagaaaccaaaatcgttttgatgaaaatcaccaggaagattcagttgggtgaataggtaagacctggacaggctgattgaggttttgatgactggcagca

SEQ ID NO: 48050 - DNA, 201 bp, Bos taurus; identical to SEQ ID NO: 6598

SEQ ID NO: 48051 - DNA, 201 bp, Bos taurus; identical to SEQ ID NO: 6599

SEQ ID NO: 48052 - DNA, 201 bp, Bos taurus; identical to SEQ ID NO: 6602

SEQ ID NO: 48053 - DNA, 201 bp, Bos taurus; identical to SEQ ID NO: 6603

SEQ ID NO: 48054 - DNA, 201 bp, Bos taurus
cagagagttctctctgtcctccctttttaactttcttcttttccttctttttttttatttcctcctctgccttaaccttattccagaatcaacaaacaaggtttacatttgtctggcaggaacaaattatgcccaactgttttcttggcctcagttccctattctgttcccagttttatttctaaaacataaatttgacca

SEQ ID NO: 48055 - DNA, 201 bp, Bos taurus
ctgaagggaagtgtgaaagatattttccaaaaactgagagagaataaactatatagaatctttcttatgtttattgtttctctctaagcagtccatgttacctccccaaagcgattttcctttcattgcagatatgcttggctgaccaactggacacaagctgtaaaaatcagagggggagaaattgctttagtagattca

SEQ ID NO: 48056 - DNA, 201 bp, Bos taurus
ggatctcagatgtctccattgctagatagcaatgctggaagcagtatttaaagtggtagggagacaatgatagtagtatgactgaagaccccacgtgcagggatactgccctttatgtacagctgcgacaaaaagacaccatgtactatgcacagctcatgagatgtagtacacaagttccatccagaataagagagatat

SEQ ID NO: 48057 - DNA, 201 bp, Bos taurus; identical to SEQ ID NO: 6606

SEQ ID NO: 48058 - DNA, 201 bp, Bos taurus; identical to SEQ ID NO: 6607

SEQ ID NO: 48059 - DNA, 201 bp, Bos taurus; identical to SEQ ID NO: 6608

SEQ ID NO: 48060 - DNA, 201 bp, Bos taurus; identical to SEQ ID NO: 6609

SEQ ID NO: 48061 - DNA, 201 bp, Bos taurus; identical to SEQ ID NO: 6610

SEQ ID NO: 48062 - DNA, 201 bp, Bos taurus; identical to SEQ ID NO: 6611

SEQ ID NO: 48063 - DNA, 201 bp, Bos taurus
cttagcatatcagatggacattgagttggatctaagcatcatgcaaaatagctagatgtgttgctaaccattctctcatcaacgtaagatagattaatagattgctaaatgcaacaggatttaatgtgagtaggcatagcaatgacctggcttaattatgatattgttggatacagtgaagacatcctaatataccatcag

SEQ ID NO: 48064 - DNA, 201 bp, Bos taurus; identical to SEQ ID NO: 6612

SEQ ID NO: 48065 - DNA, 201 bp, Bos taurus; identical to SEQ ID NO: 6614

SEQ ID NO: 48066 - DNA, 201 bp, Bos taurus; identical to SEQ ID NO: 6616

SEQ ID NO: 48067 - DNA, 201 bp, Bos taurus; identical to SEQ ID NO: 6617

SEQ ID NO: 48068 - DNA, 201 bp, Bos taurus; identical to SEQ ID NO: 6618

SEQ ID NO: 48069 - DNA, 201 bp, Bos taurus; identical to SEQ ID NO: 6619

SEQ ID NO: 48070 - DNA, 201 bp, Bos taurus; identical to SEQ ID NO: 6620

SEQ ID NO: 48071 - DNA, 201 bp, Bos taurus; identical to SEQ ID NO: 6621

SEQ ID NO: 48072 - DNA, 201 bp, Bos taurus; identical to SEQ ID NO: 6622

SEQ ID NO: 48073 - DNA, 201 bp, Bos taurus; identical to SEQ ID NO: 6623

SEQ ID NO: 48074 - DNA, 201 bp, Bos taurus; identical to SEQ ID NO: 6624

SEQ ID NO: 48075 - DNA, 201 bp, Bos taurus; identical to SEQ ID NO: 6627

SEQ ID NO: 48076 - DNA, 201 bp, Bos taurus; identical to SEQ ID NO: 6630

SEQ ID NO: 48077 - DNA, 201 bp, Bos taurus; identical to SEQ ID NO: 6632

SEQ ID NO: 48078 - DNA, 201 bp, Bos taurus; identical to SEQ ID NO: 6633

SEQ ID NO: 48079 - DNA, 201 bp, Bos taurus; identical to SEQ ID NO: 6634

SEQ ID NO: 48080 - DNA, 201 bp, Bos taurus; identical to SEQ ID NO: 6635

SEQ ID NO: 48081 - DNA, 201 bp, Bos taurus
ttgttttttgcacatgtctaatgattcagattcttactctgacattcttggtaaaagagataggcctcgatttgaagtaagttgtgaattaatgctttctagtcagaggtagataaaagacttctggtaaccctgactgattttaacattgaaggcagccccaccctccaattcattgtgcaatggggaagtggtttgctg

SEQ ID NO: 48082 - DNA, 201 bp, Bos taurus; identical to SEQ ID NO: 6636

SEQ ID NO: 48083 - DNA, 201 bp, Bos taurus
ccatcgtttggctgtgaaacagttgatattattttttgtcagagatgaggaagaaacagtctaaaaaggtaaatggatcaaggttatataggtggtaaatggtagagtgagggtttgaatccagatctttttggatcctctttctattactctatgatgcctctcgttaaagaactgtattggaaaggttcgccattaacc

SEQ ID NO: 48084 - DNA, 201 bp, Bos taurus
acagaggggaggcaggtttctttgggaaggggagcctgcccacctcccaaagtcaacagtatggaggaacacatcatgggagttggaggagtggccacaatagagataaaaaaaaaaaaaaagtctgtaggatggctggcttgtttaactttttaaacttccctcctttcccccattaaatctacctgcagagtgggtgtc

SEQ ID NO: 48085 - DNA, 201 bp, Bos taurus; identical to SEQ ID NO: 6638

SEQ ID NO: 48086 - DNA, 201 bp, Bos taurus; identical to SEQ ID NO: 6642

SEQ ID NO: 48087 - DNA, 201 bp, Bos taurus; identical to SEQ ID NO: 6643

SEQ ID NO: 48088 - DNA, 201 bp, Bos taurus
ttgtttcaataaagaataattaagtgaatgaataagaaaatgagcaaatgaatagatgcagaacagaacaaatggatgtttctcttcccctggtttggcctctctagcttttggaaatgcccatggtcacataccagcacacagagccagagcctggcagaccgatgtttgactctcggccttggtactggcccagcctgc

SEQ ID NO: 48089 - DNA, 201 bp, Bos taurus
tgtgaccttttaaatagtcatggagttgaaccatgatgcattaaagggtattgtttttactgtcccactgtaaacagctctaaaattgaacatatagacattggacaccaaagagttcagaactctaattttaagaggagggcaacatgtaaggtgagctccacattcatcctaggtttctgcctgggagtattttttaaa

SEQ ID NO: 48090 - DNA, 201 bp, Bos taurus
tacggtcctgcccaccagagggccatgactcagctcaacccataagagggcaagcaaaggccatgccctccaggaagcctgcactaacttctagtccagcctcactcaccaggaagcagacaacaaaggcaagaaaactacgatcccacagctgtggaaccagcccacttagagcaagcagaccccaccctgggaccactt

SEQ ID NO: 48091 - DNA, 201 bp, Bos taurus; identical to SEQ ID NO: 6644

SEQ ID NO: 48092 - DNA, 201 bp, Bos taurus; identical to SEQ ID NO: 6645

SEQ ID NO: 48093 - DNA, 201 bp, Bos taurus; identical to SEQ ID NO: 6646

SEQ ID NO: 48094 - DNA, 201 bp, Bos taurus; identical to SEQ ID NO: 6647

SEQ ID NO: 48095 - DNA, 201 bp, Bos taurus; identical to SEQ ID NO: 6648

SEQ ID NO: 48096 - DNA, 201 bp, Bos taurus; identical to SEQ ID NO: 6649

SEQ ID NO: 48097 - DNA, 201 bp, Bos taurus; identical to SEQ ID NO: 6650

SEQ ID NO: 48098 - DNA, 201 bp, Bos taurus
gcaggactaaccaggagcccttccacatcgacagccatgccagtagctaagcgtggagcccaggtcgcccctcatggacaagtggcccatggagcttctggtgctcaaggagcacagcgcagagcccagggtgccacatgtctgtgatgagagaaggggaagcaggaaggttgagcttctggtggtggcctgcccatatat

SEQ ID NO: 48099 - DNA, 201 bp, Bos taurus
cggagctggtcccatcatgggcctggatggcctcctcggtgcaggtctcccttgggctcccagcccaggcagaggccatcccagcatcaggcatcatcacggtctgccttcctgactcttcgctgcatacaggctctcaccctcctccaaccccaggcccaggctagcacctggccggcagtgtttcctggctgttggact

SEQ ID NO: 48100 - DNA, 201 bp, Bos taurus; identical to SEQ ID NO: 6652

SEQ ID NO: 48101 - DNA, 201 bp, Bos taurus
aattaccacccagaggaaaaagtgcagaagaccaccaaagacgttctgcaatgttcaacagcaccattattaataagggccccaaaccagaagcaatcaaatgtctaccaatagaataatggctacatagatggcaatgttttcatagaatagaatactggccagcaatgaatacgtgaacaaaataatgacactcgccag

SEQ ID NO: 48102 - DNA, 201 bp, Bos taurus; identical to SEQ ID NO: 6655

SEQ ID NO: 48103 - DNA, 201 bp, Bos taurus; identical to SEQ ID NO: 6656

SEQ ID NO: 48104 - DNA, 201 bp, Bos taurus; identical to SEQ ID NO: 6657

SEQ ID NO: 48105 - DNA, 201 bp, Bos taurus
gccttccttgactcacggctgattttcttcctcataatggacaacttaaagattcatatgattgctaatgaaaataagaccacaaacttgcttcagggatgagactgtcttcatctttgtatggttagcacatagtaggtgctcattagacgacactgaatggatgaatagtaatactgatttatggaattcaattagcac

SEQ ID NO: 48106 - DNA, 201 bp, Bos taurus; identical to SEQ ID NO: 6660

SEQ ID NO: 48107 - DNA, 201 bp, Bos taurus; identical to SEQ ID NO: 6661

SEQ ID NO: 48108 - DNA, 201 bp, Bos taurus; identical to SEQ ID NO: 6662

SEQ ID NO: 48109 - DNA, 201 bp, Bos taurus; identical to SEQ ID NO: 6663

SEQ ID NO: 48110 - DNA, 201 bp, Bos taurus; identical to SEQ ID NO: 6664

SEQ ID NO: 48111 - DNA, 201 bp, Bos taurus; identical to SEQ ID NO: 6665

SEQ ID NO: 48112 - DNA, 201 bp, Bos taurus; identical to SEQ ID NO: 6666

SEQ ID NO: 48113 - DNA, 201 bp, Bos taurus
agcctttctacacacaagcattcttagaaagtctttgaatgtctattcttacttatactggtggcaaaatgtccccaaataaaatcatcatgaggttctgcctgcttcctgctttagatgtactggaaatcttcccaggaaactcagggactttgtaaattctcctttgcctttcccattgccattaagtagttgaaagct

SEQ ID NO: 48114 - DNA, 201 bp, Bos taurus; identical to SEQ ID NO: 6669

SEQ ID NO: 48115 - DNA, 201 bp, Bos taurus; identical to SEQ ID NO: 6670

SEQ ID NO: 48116 - DNA, 201 bp, Bos taurus
cagaggagaggccaagtgtgaggatgcaggggaaggaaataaatgtggaacacgctggaaaggaacttcctcgggcacaggaagccagagaccctggagaagaaatgaaggaaaggcaggcggccacaatctcggccaagaatgggagtgaacgtggtccaggagccaagtgttcttatgcgacagccatccttgtcccgg

SEQ ID NO: 48117 - DNA, 201 bp, Bos taurus; identical to SEQ ID NO: 6672

SEQ ID NO: 48118 - DNA, 201 bp, Bos taurus; identical to SEQ ID NO: 6673

SEQ ID NO: 48119 - DNA, 201 bp, Bos taurus; identical to SEQ ID NO: 6674

SEQ ID NO: 48120 - DNA, 201 bp, Bos taurus; identical to SEQ ID NO: 6675

SEQ ID NO: 48121 - DNA, 201 bp, Bos taurus; identical to SEQ ID NO: 6676

SEQ ID NO: 48122 - DNA, 201 bp, Bos taurus; identical to SEQ ID NO: 6677

SEQ ID NO: 48123 - DNA, 201 bp, Bos taurus; identical to SEQ ID NO: 6678

SEQ ID NO: 48124 - DNA, 201 bp, Bos taurus; identical to SEQ ID NO: 6679

SEQ ID NO: 48125 - DNA, 201 bp, Bos taurus; identical to SEQ ID NO: 6680

SEQ ID NO: 48126 - DNA, 201 bp, Bos taurus; identical to SEQ ID NO: 6681

SEQ ID NO: 48127 - DNA, 201 bp, Bos taurus; identical to SEQ ID NO: 6685

SEQ ID NO: 48128 - DNA, 201 bp, Bos taurus
gttttgtccctgggagaaggggcaatgacagtgtgtttctgtgccagagatacttgttcttccaacctggaaggaaatccatccaacttgtctgtgtaggactccaaacagaagacttcagaaataaattttggcctgacacttttgtttgtccatttttctattttcctgtaaaaaaccacagttttgacaatcttcctc

SEQ ID NO: 48129 - DNA, 201 bp, Bos taurus; identical to SEQ ID NO: 6686

SEQ ID NO: 48130 - DNA, 201 bp, Bos taurus; identical to SEQ ID NO: 6687

SEQ ID NO: 48131 - DNA, 201 bp, Bos taurus; identical to SEQ ID NO: 6688

SEQ ID NO: 48132 - DNA, 201 bp, Bos taurus; identical to SEQ ID NO: 6689

SEQ ID NO: 48133 - DNA, 201 bp, Bos taurus; identical to SEQ ID NO: 6690

SEQ ID NO: 48134 - DNA, 201 bp, Bos taurus; identical to SEQ ID NO: 6691

SEQ ID NO: 48135 - DNA, 201 bp, Bos taurus
gccccgtacaggactataaggagtatgcccagcggcggcctcctgccatgcgctatgaggatgcccctttctacttgtccatcaagccagttgtgaacttggcggctctgcattggtacaactgccaggccctcggcaagaacaagctggccaagatggtaaagaccatgtgcgagaaggggaacatcccgggcaggaaga

SEQ ID NO: 48136 - DNA, 201 bp, Bos taurus; identical to SEQ ID NO: 6692

SEQ ID NO: 48137 - DNA, 201 bp, Bos taurus; identical to SEQ ID NO: 6693

SEQ ID NO: 48138 - DNA, 201 bp, Bos taurus; identical to SEQ ID NO: 6694

SEQ ID NO: 48139 - DNA, 201 bp, Bos taurus
aagcatgtgggatcttcttggacccagggattgaacccgatcccatgaattggcaggtggaatcttatccacttgaccgccagggtagttccatggcccactttctgatgatatctgatagccattgccagagcatatcattcaggttatagcactgggtatataaggccaatggggctcatagaggagacatttggcaga

SEQ ID NO: 48140 - DNA, 201 bp, Bos taurus
ttattcttttttccagagtcaaacatagcctgttttgcaccttccacttgcatgtgctttaaaaaaaagaaaatccaaccgagtaaattagaatatctaactgactttattaagagattcatgaatgggacagcatttcatttagcagacagaaacgccatctgaggagctgtgcagaatggagtatttttaaaggtataa

SEQ ID NO: 48141 - DNA, 201 bp, Bos taurus
ataaaatgcaataattaaaattatgccccatgaggttccctcccctctttttagctccttgttatggtccccactaggagcctgtgatttactagtaactacaacattctggacaaccattagatgataaacactgtatcaaattcataaattatcatatggccatctcagaatgaagttcacaaatataaattcctaaaa

SEQ ID NO: 48142 - DNA, 201 bp, Bos taurus; identical to SEQ ID NO: 6695

SEQ ID NO: 48143 - DNA, 201 bp, Bos taurus; identical to SEQ ID NO: 6697

SEQ ID NO: 48144 - DNA, 201 bp, Bos taurus
agtagcctgccctagtgcccgcccgtagaggcttctcgagtcctctctgcttcttcctttgctggccactgtcccctgctgtgtcctctcttctccatcttagggcttctgtttcttcgtggcctctgcctcctcatgtctacggctcctgtgagcgtacgccttcggtagccccagactttctctttcttcgtgtatctc

SEQ ID NO: 48145 - DNA, 201 bp, Bos taurus; identical to SEQ ID NO: 6698

SEQ ID NO: 48146 - DNA, 201 bp, Bos taurus; identical to SEQ ID NO: 6699

SEQ ID NO: 48147 - DNA, 201 bp, Bos taurus
cagttggtcatcttttttcttcttagaagagtgggagtgatgacttctgtgctctttacatatggaagctaaaaccgaaagcccccacctggtggcttttttcagtcttgttctctggtgtcataacggtgctggaggacttggtgccctttggtttcctgggtgatggggacacagtgaggggcctgggcatgtcataac

SEQ ID NO: 48148 - DNA, 201 bp, Bos taurus; identical to SEQ ID NO: 6701

SEQ ID NO: 48149 - DNA, 201 bp, Bos taurus; identical to SEQ ID NO: 6702

SEQ ID NO: 48150 - DNA, 201 bp, Bos taurus; identical to SEQ ID NO: 6703

SEQ ID NO: 48151 - DNA, 201 bp, Bos taurus; identical to SEQ ID NO: 6704

SEQ ID NO: 48152 - DNA, 201 bp, Bos taurus; identical to SEQ ID NO: 6705

SEQ ID NO: 48153 - DNA, 201 bp, Bos taurus; identical to SEQ ID NO: 6706

SEQ ID NO: 48154 - DNA, 201 bp, Bos taurus; identical to SEQ ID NO: 6707

SEQ ID NO: 48155 - DNA, 201 bp, Bos taurus; identical to SEQ ID NO: 6708

SEQ ID NO: 48156 - DNA, 201 bp, Bos taurus; identical to SEQ ID NO: 6709

SEQ ID NO: 48157 - DNA, 201 bp, Bos taurus; identical to SEQ ID NO: 6710

SEQ ID NO: 48158 - DNA, 201 bp, Bos taurus; identical to SEQ ID NO: 6711

SEQ ID NO: 48159 - DNA, 201 bp, Bos taurus
gccaatagaatggagcaagaagcgatgggcatgtcttccaggtctacaatcctttttttgagtgatcctttctctcttgtctcatattttggccaacagacagaattctgaggacccagaggagggtgacccacaagaccaaaggaagcaagagttctggattatggcctgaagcatatcacctctttctcagccaaacca

SEQ ID NO: 48160 - DNA, 201 bp, Bos taurus; identical to SEQ ID NO: 6712

SEQ ID NO: 48161 - DNA, 201 bp, Bos taurus
gagaatcccaagccagagctccccagctgagctctgtgagaaactgtgagagataataaacactcaccattttaaggccctaggctttggggcaatttgctgcatggcaatagagaacaggtacaagaggaaagggagtgtgcgctaagactggggaagtgggccagagtcaatcacacagggaattctaggtcccattaa

SEQ ID NO: 48162 - DNA, 201 bp, Bos taurus; identical to SEQ ID NO: 6715

SEQ ID NO: 48163 - DNA, 201 bp, Bos taurus; identical to SEQ ID NO: 6716

SEQ ID NO: 48164 - DNA, 201 bp, Bos taurus; identical to SEQ ID NO: 6717

SEQ ID NO: 48165 - DNA, 201 bp, Bos taurus; identical to SEQ ID NO: 6718

SEQ ID NO: 48166 - DNA, 201 bp, Bos taurus; identical to SEQ ID NO: 6719

SEQ ID NO: 48167 - DNA, 201 bp, Bos taurus; identical to SEQ ID NO: 6720

SEQ ID NO: 48168 - DNA, 201 bp, Bos taurus; identical to SEQ ID NO: 6721

SEQ ID NO: 48169 - DNA, 201 bp, Bos taurus; identical to SEQ ID NO: 6722

SEQ ID NO: 48170 - DNA, 201 bp, Bos taurus; identical to SEQ ID NO: 6723

SEQ ID NO: 48171 - DNA, 201 bp, Bos taurus; identical to SEQ ID NO: 6724

SEQ ID NO: 48172 - DNA, 201 bp, Bos taurus; identical to SEQ ID NO: 6726

SEQ ID NO: 48173 - DNA, 201 bp, Bos taurus; identical to SEQ ID NO: 6727

SEQ ID NO: 48174 - DNA, 201 bp, Bos taurus; identical to SEQ ID NO: 6728

SEQ ID NO: 48175 - DNA, 201 bp, Bos taurus; identical to SEQ ID NO: 6729

SEQ ID NO: 48176 - DNA, 201 bp, Bos taurus; identical to SEQ ID NO: 6730

SEQ ID NO: 48177 - DNA, 201 bp, Bos taurus; identical to SEQ ID NO: 6731

SEQ ID NO: 48178 - DNA, 201 bp, Bos taurus; identical to SEQ ID NO: 6732

SEQ ID NO: 48179 - DNA, 201 bp, Bos taurus; identical to SEQ ID NO: 6733

SEQ ID NO: 48180 - DNA, 201 bp, Bos taurus; identical to SEQ ID NO: 6734

SEQ ID NO: 48181 - DNA, 201 bp, Bos taurus; identical to SEQ ID NO: 6735

SEQ ID NO: 48182 - DNA, 201 bp, Bos taurus; identical to SEQ ID NO: 6736

SEQ ID NO: 48183 - DNA, 201 bp, Bos taurus; identical to SEQ ID NO: 6737

SEQ ID NO: 48184 - DNA, 201 bp, Bos taurus; identical to SEQ ID NO: 6740

SEQ ID NO: 48185 - DNA, 201 bp, Bos taurus; identical to SEQ ID NO: 6742

SEQ ID NO: 48186 - DNA, 201 bp, Bos taurus; identical to SEQ ID NO: 6743

SEQ ID NO: 48187 - DNA, 201 bp, Bos taurus; identical to SEQ ID NO: 6744

SEQ ID NO: 48188 - DNA, 201 bp, Bos taurus; identical to SEQ ID NO: 6745

SEQ ID NO: 48189 - DNA, 201 bp, Bos taurus; identical to SEQ ID NO: 6746

SEQ ID NO: 48190 - DNA, 201 bp, Bos taurus; identical to SEQ ID NO: 6747

SEQ ID NO: 48191 - DNA, 201 bp, Bos taurus; identical to SEQ ID NO: 6749

SEQ ID NO: 48192 - DNA, 201 bp, Bos taurus; identical to SEQ ID NO: 6752

SEQ ID NO: 48193 - DNA, 201 bp, Bos taurus; identical to SEQ ID NO: 6753

SEQ ID NO: 48194 - DNA, 201 bp, Bos taurus; identical to SEQ ID NO: 6755

SEQ ID NO: 48195 - DNA, 201 bp, Bos taurus; identical to SEQ ID NO: 6756

SEQ ID NO: 48196 - DNA, 201 bp, Bos taurus; identical to SEQ ID NO: 6757

SEQ ID NO: 48197 - DNA, 201 bp, Bos taurus; identical to SEQ ID NO: 6758

SEQ ID NO: 48198 - DNA, 201 bp, Bos taurus; identical to SEQ ID NO: 6759

SEQ ID NO: 48199 - DNA, 201 bp, Bos taurus; identical to SEQ ID NO: 6760

SEQ ID NO: 48200 - DNA, 201 bp, Bos taurus; identical to SEQ ID NO: 6761

SEQ ID NO: 48201 - DNA, 201 bp, Bos taurus; identical to SEQ ID NO: 6762

SEQ ID NO: 48202 - DNA, 201 bp, Bos taurus; identical to SEQ ID NO: 6763

SEQ ID NO: 48203 - DNA, 201 bp, Bos taurus; identical to SEQ ID NO: 6764

SEQ ID NO: 48204 - DNA, 201 bp, Bos taurus; identical to SEQ ID NO: 6767

SEQ ID NO: 48205 - DNA, 201 bp, Bos taurus; identical to SEQ ID NO: 6768

SEQ ID NO: 48206 - DNA, 201 bp, Bos taurus; identical to SEQ ID NO: 6774

SEQ ID NO: 48207 - DNA, 201 bp, Bos taurus; identical to SEQ ID NO: 6775

SEQ ID NO: 48208 - DNA, 201 bp, Bos taurus; identical to SEQ ID NO: 6776

SEQ ID NO: 48209 - DNA, 201 bp, Bos taurus; identical to SEQ ID NO: 6777

SEQ ID NO: 48210 - DNA, 201 bp, Bos taurus; identical to SEQ ID NO: 6778

SEQ ID NO: 48211 - DNA, 201 bp, Bos taurus; identical to SEQ ID NO: 6782

SEQ ID NO: 48212 - DNA, 201 bp, Bos taurus; identical to SEQ ID NO: 6783

SEQ ID NO: 48213 - DNA, 201 bp, Bos taurus; identical to SEQ ID NO: 6784

SEQ ID NO: 48214 - DNA, 201 bp, Bos taurus; identical to SEQ ID NO: 6786

SEQ ID NO: 48215 - DNA, 201 bp, Bos taurus; identical to SEQ ID NO: 6787

SEQ ID NO: 48216 - DNA, 201 bp, Bos taurus; identical to SEQ ID NO: 6788

SEQ ID NO: 48217 - DNA, 201 bp, Bos taurus; identical to SEQ ID NO: 6789

SEQ ID NO: 48218 - DNA, 201 bp, Bos taurus; identical to SEQ ID NO: 6790

SEQ ID NO: 48219 - DNA, 201 bp, Bos taurus; identical to SEQ ID NO: 6791

SEQ ID NO: 48220 - DNA, 201 bp, Bos taurus; identical to SEQ ID NO: 6792

SEQ ID NO: 48221 - DNA, 201 bp, Bos taurus; identical to SEQ ID NO: 6794

SEQ ID NO: 48222 - DNA, 201 bp, Bos taurus; identical to SEQ ID NO: 6795

SEQ ID NO: 48223 - DNA, 201 bp, Bos taurus; identical to SEQ ID NO: 6796

SEQ ID NO: 48224 - DNA, 201 bp, Bos taurus; identical to SEQ ID NO: 6797

SEQ ID NO: 48225 - DNA, 201 bp, Bos taurus; identical to SEQ ID NO: 6799

SEQ ID NO: 48226 - DNA, 201 bp, Bos taurus; identical to SEQ ID NO: 6800

SEQ ID NO: 48227 - DNA, 201 bp, Bos taurus; identical to SEQ ID NO: 6801

SEQ ID NO: 48228 - DNA, 201 bp, Bos taurus; identical to SEQ ID NO: 6802

SEQ ID NO: 48229 - DNA, 201 bp, Bos taurus; identical to SEQ ID NO: 6803

SEQ ID NO: 48230 - DNA, 201 bp, Bos taurus; identical to SEQ ID NO: 6804

SEQ ID NO: 48231 - DNA, 201 bp, Bos taurus; identical to SEQ ID NO: 6805

SEQ ID NO: 48232 - DNA, 201 bp, Bos taurus
gaaacattactggaaggaaaacaattaaagcccacagtgtgaatggcctaatgtgctatggcaccccaagacagatggcctgctggactcaacagactcactttaggatgtcagatggcagggggaaacaggaaagaaggctaagaaagaagaagtccaagaggcggtcaaatggttaaaggcccaagtaatcaagacaga

SEQ ID NO: 48233 - DNA, 201 bp, Bos taurus; identical to SEQ ID NO: 6807

SEQ ID NO: 48234 - DNA, 201 bp, Bos taurus; identical to SEQ ID NO: 6808

SEQ ID NO: 48235 - DNA, 201 bp, Bos taurus; identical to SEQ ID NO: 6809

SEQ ID NO: 48236 - DNA, 201 bp, Bos taurus; identical to SEQ ID NO: 6811

SEQ ID NO: 48237 - DNA, 201 bp, Bos taurus; identical to SEQ ID NO: 6812

SEQ ID NO: 48238 - DNA, 201 bp, Bos taurus
ttttatttgtaaattcaacatattcatacaaatgtttgaaagtatagcccttactatttcaatatcctattttttgagtgactaagcacatacacactccccacacattatttcccctcctgtgtccgtgctctacaattcctatagcagaaacatctatgcaagtaaacctctaaggaactagcttgctttctggtatga

SEQ ID NO: 48239 - DNA, 201 bp, Bos taurus; identical to SEQ ID NO: 6813

SEQ ID NO: 48240 - DNA, 201 bp, Bos taurus; identical to SEQ ID NO: 6814

SEQ ID NO: 48241 - DNA, 201 bp, Bos taurus; identical to SEQ ID NO: 6815

SEQ ID NO: 48242 - DNA, 201 bp, Bos taurus; identical to SEQ ID NO: 6816

SEQ ID NO: 48243 - DNA, 201 bp, Bos taurus; identical to SEQ ID NO: 6817

SEQ ID NO: 48244 - DNA, 201 bp, Bos taurus; identical to SEQ ID NO: 6818

SEQ ID NO: 48245 - DNA, 201 bp, Bos taurus; identical to SEQ ID NO: 6819

SEQ ID NO: 48246 - DNA, 201 bp, Bos taurus; identical to SEQ ID NO: 6822

SEQ ID NO: 48247 - DNA, 201 bp, Bos taurus; identical to SEQ ID NO: 6827

SEQ ID NO: 48248 - DNA, 201 bp, Bos taurus; identical to SEQ ID NO: 6828

SEQ ID NO: 48249 - DNA, 201 bp, Bos taurus; identical to SEQ ID NO: 6829

SEQ ID NO: 48250 - DNA, 201 bp, Bos taurus; identical to SEQ ID NO: 6830

SEQ ID NO: 48251 - DNA, 201 bp, Bos taurus; identical to SEQ ID NO: 6831

SEQ ID NO: 48252 - DNA, 201 bp, Bos taurus; identical to SEQ ID NO: 6832

SEQ ID NO: 48253 - DNA, 201 bp, Bos taurus; identical to SEQ ID NO: 6833

SEQ ID NO: 48254 - DNA, 201 bp, Bos taurus; identical to SEQ ID NO: 6834

SEQ ID NO: 48255 - DNA, 201 bp, Bos taurus; identical to SEQ ID NO: 6835

SEQ ID NO: 48256 - DNA, 201 bp, Bos taurus; identical to SEQ ID NO: 6836

SEQ ID NO: 48257 - DNA, 201 bp, Bos taurus; identical to SEQ ID NO: 6837

SEQ ID NO: 48258 - DNA, 201 bp, Bos taurus; identical to SEQ ID NO: 6838

SEQ ID NO: 48259 - DNA, 201 bp, Bos taurus; identical to SEQ ID NO: 6839

SEQ ID NO: 48260 - DNA, 201 bp, Bos taurus; identical to SEQ ID NO: 6840

SEQ ID NO: 48261 - DNA, 201 bp, Bos taurus; identical to SEQ ID NO: 6841

SEQ ID NO: 48262 - DNA, 201 bp, Bos taurus; identical to SEQ ID NO: 6843

SEQ ID NO: 48263 - DNA, 201 bp, Bos taurus; identical to SEQ ID NO: 6844

SEQ ID NO: 48264 - DNA, 201 bp, Bos taurus; identical to SEQ ID NO: 6847

SEQ ID NO: 48265 - DNA, 201 bp, Bos taurus; identical to SEQ ID NO: 6848

SEQ ID NO: 48266 - DNA, 201 bp, Bos taurus; identical to SEQ ID NO: 6849

SEQ ID NO: 48267 - DNA, 201 bp, Bos taurus; identical to SEQ ID NO: 6850

SEQ ID NO: 48268 - DNA, 201 bp, Bos taurus; identical to SEQ ID NO: 6851

SEQ ID NO: 48269 - DNA, 201 bp, Bos taurus
tccatagggttgcaaagagtcagacatgactgagcgtctgagcacctctcttttttttttccttcccatttctaaatagcagacttataaatagtatatcattttttagatactatcaattggcatcctacacagaagcacattttttaaatctcttaaaccacatgttttaaaaatgtgttttaaatctcttaaaccaca

SEQ ID NO: 48270 - DNA, 201 bp, Bos taurus; identical to SEQ ID NO: 6852

SEQ ID NO: 48271 - DNA, 201 bp, Bos taurus; identical to SEQ ID NO: 6853

SEQ ID NO: 48272 - DNA, 201 bp, Bos taurus; identical to SEQ ID NO: 6854

SEQ ID NO: 48273 - DNA, 201 bp, Bos taurus; identical to SEQ ID NO: 6855

SEQ ID NO: 48274 - DNA, 201 bp, Bos taurus
ggggcgggccgggacgacgcgacccgcgaacacctcagggcaggcagttgcggacgccgcgggagcggacgccatggctgcgttaggactcgcttcgttgctgggccgcgtcccggctacagcgtggagagcggcaagtaaggcgccccggcctggggccgaggtcgcgggcagggtcgcgaaggcccaagcaccgagaga

SEQ ID NO: 48275 - DNA, 201 bp, Bos taurus; identical to SEQ ID NO: 6856

SEQ ID NO: 48276 - DNA, 201 bp, Bos taurus; identical to SEQ ID NO: 6857

SEQ ID NO: 48277 - DNA, 201 bp, Bos taurus; identical to SEQ ID NO: 6860

SEQ ID NO: 48278 - DNA, 201 bp, Bos taurus; identical to SEQ ID NO: 6861

SEQ ID NO: 48279 - DNA, 201 bp, Bos taurus; identical to SEQ ID NO: 6862

SEQ ID NO: 48280 - DNA, 201 bp, Bos taurus; identical to SEQ ID NO: 6863

SEQ ID NO: 48281 - DNA, 201 bp, Bos taurus; identical to SEQ ID NO: 6864

SEQ ID NO: 48282 - DNA, 201 bp, Bos taurus; identical to SEQ ID NO: 6866

SEQ ID NO: 48283 - DNA, 201 bp, Bos taurus; identical to SEQ ID NO: 6871

SEQ ID NO: 48284 - DNA, 201 bp, Bos taurus; identical to SEQ ID NO: 6872

SEQ ID NO: 48285 - DNA, 201 bp, Bos taurus; identical to SEQ ID NO: 6873

SEQ ID NO: 48286 - DNA, 201 bp, Bos taurus; identical to SEQ ID NO: 6874

SEQ ID NO: 48287 - DNA, 201 bp, Bos taurus; identical to SEQ ID NO: 6875

SEQ ID NO: 48288 - DNA, 201 bp, Bos taurus; identical to SEQ ID NO: 6877

SEQ ID NO: 48289 - DNA, 201 bp, Bos taurus; identical to SEQ ID NO: 6878

SEQ ID NO: 48290 - DNA, 201 bp, Bos taurus; identical to SEQ ID NO: 6879

SEQ ID NO: 48291 - DNA, 201 bp, Bos taurus; identical to SEQ ID NO: 6880

SEQ ID NO: 48292 - DNA, 201 bp, Bos taurus; identical to SEQ ID NO: 6881

SEQ ID NO: 48293 - DNA, 201 bp, Bos taurus; identical to SEQ ID NO: 6883

SEQ ID NO: 48294 - DNA, 201 bp, Bos taurus; identical to SEQ ID NO: 6885

SEQ ID NO: 48295 - DNA, 201 bp, Bos taurus; identical to SEQ ID NO: 6886

SEQ ID NO: 48296 - DNA, 201 bp, Bos taurus; identical to SEQ ID NO: 6887

SEQ ID NO: 48297 - DNA, 201 bp, Bos taurus; identical to SEQ ID NO: 6888

SEQ ID NO: 48298 - DNA, 201 bp, Bos taurus; identical to SEQ ID NO: 6890

SEQ ID NO: 48299 - DNA, 201 bp, Bos taurus; identical to SEQ ID NO: 6891

SEQ ID NO: 48300 - DNA, 201 bp, Bos taurus; identical to SEQ ID NO: 6893

SEQ ID NO: 48301 - DNA, 201 bp, Bos taurus; identical to SEQ ID NO: 6894

SEQ ID NO: 48302 - DNA, 201 bp, Bos taurus; identical to SEQ ID NO: 6895

SEQ ID NO: 48303 - DNA, 201 bp, Bos taurus; identical to SEQ ID NO: 6896

SEQ ID NO: 48304 - DNA, 201 bp, Bos taurus; identical to SEQ ID NO: 6897

SEQ ID NO: 48305 - DNA, 201 bp, Bos taurus; identical to SEQ ID NO: 6898

SEQ ID NO: 48306 - DNA, 201 bp, Bos taurus; identical to SEQ ID NO: 6899

SEQ ID NO: 48307 - DNA, 201 bp, Bos taurus; identical to SEQ ID NO: 6900

SEQ ID NO: 48308 - DNA, 201 bp, Bos taurus; identical to SEQ ID NO: 6901

SEQ ID NO: 48309 - DNA, 201 bp, Bos taurus; identical to SEQ ID NO: 6902

SEQ ID NO: 48310 - DNA, 201 bp, Bos taurus; identical to SEQ ID NO: 6904

SEQ ID NO: 48311 - DNA, 201 bp, Bos taurus
aattagacatggtccctggactaatataaatcattaacatgatcttgaaacacttgcaagacaacatatggaaaaatgcaatatgcaatattctcatgacgtagtgtacactgagtagaagtaaaatttattataactagaaaaaaaagcatataaaataagctcatcccagtgcaccagccccaagcatcctgtatcctg

SEQ ID NO: 48312 - DNA, 201 bp, Bos taurus; identical to SEQ ID NO: 6905

SEQ ID NO: 48313 - DNA, 201 bp, Bos taurus
aagagttttctaaagtttctactagcatcgttgtttctagatagaaatgttaaatagaaaaagctgcttttagaaaattctagttggtaactgatttcttcgaagtggtgtttatttgaatcagtagctatttcatatgggtaggttttctctctgcaatgagggtttaagctcctgtgtcacacactcttttggaatctt

SEQ ID NO: 48314 - DNA, 201 bp, Bos taurus
tgctgcctcccaggcctaagtcctaaaaatttccaccaaataaaacataattaaatctttaaaacaaaacaaaacaaaacaaacactttaatttcagttgatctctcactgaaggccttgctgtcttctttccctaaccttcactttcatgggacaagtgctcactcggccttcaccctctgtttcttatcccacctagac

SEQ ID NO: 48315 - DNA, 201 bp, Bos taurus
actgttagctgcttcagttttcaaaaacaaaatttgagtagttcatataatctggagagagaaataaatcagattcccttacttaaatattatgttgtaacagcctggtgctgagaacagtcctttgttcaacagaactgactgaaacctttctatcacttggcagagatcacaccaggactcaccgtctcagcaattgta

SEQ ID NO: 48316 - DNA, 201 bp, Bos taurus; identical to SEQ ID NO: 6907

SEQ ID NO: 48317 - DNA, 201 bp, Bos taurus; identical to SEQ ID NO: 6912

SEQ ID NO: 48318 - DNA, 201 bp, Bos taurus; identical to SEQ ID NO: 6913

SEQ ID NO: 48319 - DNA, 201 bp, Bos taurus; identical to SEQ ID NO: 6914

SEQ ID NO: 48320 - DNA, 201 bp, Bos taurus; identical to SEQ ID NO: 6916

SEQ ID NO: 48321 - DNA, 201 bp, Bos taurus; identical to SEQ ID NO: 6918

SEQ ID NO: 48322 - DNA, 201 bp, Bos taurus; identical to SEQ ID NO: 6919

SEQ ID NO: 48323 - DNA, 201 bp, Bos taurus; identical to SEQ ID NO: 6920

SEQ ID NO: 48324 - DNA, 201 bp, Bos taurus; identical to SEQ ID NO: 6921

SEQ ID NO: 48325 - DNA, 201 bp, Bos taurus; identical to SEQ ID NO: 6922

SEQ ID NO: 48326 - DNA, 201 bp, Bos taurus
gccagaggagccgtgagtccagacccaaaaggtctagataacttctttacaccagacactgatgtgggtgccactgtcatcccatgtctcctcccagagtcccgcagagggagcaaagcaaaggccttctgcttctaagggtctttagcatctttaaagcaccttcccttctggagcagcttctgcctgcaaagtgatggt

SEQ ID NO: 48327 - DNA, 201 bp, Bos taurus
cactgtactaacatgtccttgttttctcaatttacagcaagacggaccttttccccctaaactcagtattggtgtttcaatgggacaggaaatggtgatgtttttgtagtctgtaatcccaccggcttccgaggctctgcgtcagcaccgcgggccatactgtcagtggaagatattatattgctggaccctggtgctcaa

SEQ ID NO: 48328 - DNA, 201 bp, Bos taurus
aagaataaatcctttcaacaagaaaaaaaacgttgctgaacaggaaaaaaggaagaaaggtgaacaccaaagccatagtctaaatattgaaaataaggcccgactttaagcaattaaggtgagaaaaaaatttcatgtgtcctcgatgttaagatcactattataactgatttaggagtcatgaccttgaaaggaaggata

SEQ ID NO: 48329 - DNA, 201 bp, Bos taurus; identical to SEQ ID NO: 6925

SEQ ID NO: 48330 - DNA, 201 bp, Bos taurus; identical to SEQ ID NO: 6927

SEQ ID NO: 48331 - DNA, 201 bp, Bos taurus; identical to SEQ ID NO: 6928

SEQ ID NO: 48332 - DNA, 201 bp, Bos taurus; identical to SEQ ID NO: 6929

SEQ ID NO: 48333 - DNA, 201 bp, Bos taurus; identical to SEQ ID NO: 6930

SEQ ID NO: 48334 - DNA, 201 bp, Bos taurus; identical to SEQ ID NO: 6931

SEQ ID NO: 48335 - DNA, 201 bp, Bos taurus; identical to SEQ ID NO: 6934

SEQ ID NO: 48336 - DNA, 201 bp, Bos taurus; identical to SEQ ID NO: 6935

SEQ ID NO: 48337 - DNA, 201 bp, Bos taurus; identical to SEQ ID NO: 6940

SEQ ID NO: 48338 - DNA, 201 bp, Bos taurus; identical to SEQ ID NO: 6942

SEQ ID NO: 48339 - DNA, 201 bp, Bos taurus; identical to SEQ ID NO: 6943

SEQ ID NO: 48340 - DNA, 201 bp, Bos taurus; identical to SEQ ID NO: 6944

SEQ ID NO: 48341 - DNA, 201 bp, Bos taurus; identical to SEQ ID NO: 6945

SEQ ID NO: 48342 - DNA, 201 bp, Bos taurus; identical to SEQ ID NO: 6946

SEQ ID NO: 48343 - DNA, 201 bp, Bos taurus; identical to SEQ ID NO: 6947

SEQ ID NO: 48344 - DNA, 201 bp, Bos taurus; identical to SEQ ID NO: 6948

SEQ ID NO: 48345 - DNA, 201 bp, Bos taurus; identical to SEQ ID NO: 6949

SEQ ID NO: 48346 - DNA, 201 bp, Bos taurus; identical to SEQ ID NO: 6952

SEQ ID NO: 48347 - DNA, 201 bp, Bos taurus; identical to SEQ ID NO: 6953

SEQ ID NO: 48348 - DNA, 201 bp, Bos taurus; identical to SEQ ID NO: 6954

SEQ ID NO: 48349 - DNA, 201 bp, Bos taurus; identical to SEQ ID NO: 6955

SEQ ID NO: 48350 - DNA, 201 bp, Bos taurus; identical to SEQ ID NO: 6956

SEQ ID NO: 48351 - DNA, 201 bp, Bos taurus; identical to SEQ ID NO: 6957

SEQ ID NO: 48352 - DNA, 201 bp, Bos taurus; identical to SEQ ID NO: 6958

SEQ ID NO: 48353 - DNA, 201 bp, Bos taurus; identical to SEQ ID NO: 6959

SEQ ID NO: 48354 - DNA, 201 bp, Bos taurus; identical to SEQ ID NO: 6960

SEQ ID NO: 48355 - DNA, 201 bp, Bos taurus; identical to SEQ ID NO: 6961

SEQ ID NO: 48356 - DNA, 201 bp, Bos taurus; identical to SEQ ID NO: 6962

SEQ ID NO: 48357 - DNA, 201 bp, Bos taurus; identical to SEQ ID NO: 6964

SEQ ID NO: 48358 - DNA, 201 bp, Bos taurus; identical to SEQ ID NO: 6965

SEQ ID NO: 48359 - DNA, 201 bp, Bos taurus; identical to SEQ ID NO: 6966

SEQ ID NO: 48360 - DNA, 201 bp, Bos taurus; identical to SEQ ID NO: 6967

SEQ ID NO: 48361 - DNA, 201 bp, Bos taurus; identical to SEQ ID NO: 6968

SEQ ID NO: 48362 - DNA, 201 bp, Bos taurus; identical to SEQ ID NO: 6969

SEQ ID NO: 48363 - DNA, 201 bp, Bos taurus; identical to SEQ ID NO: 6971

SEQ ID NO: 48364 - DNA, 201 bp, Bos taurus; identical to SEQ ID NO: 6972

SEQ ID NO: 48365 - DNA, 201 bp, Bos taurus; identical to SEQ ID NO: 6973

SEQ ID NO: 48366 - DNA, 201 bp, Bos taurus; identical to SEQ ID NO: 6975

SEQ ID NO: 48367 - DNA, 201 bp, Bos taurus; identical to SEQ ID NO: 6979

SEQ ID NO: 48368 - DNA, 201 bp, Bos taurus; identical to SEQ ID NO: 6980

SEQ ID NO: 48369 - DNA, 201 bp, Bos taurus; identical to SEQ ID NO: 6981

SEQ ID NO: 48370 - DNA, 201 bp, Bos taurus; identical to SEQ ID NO: 6983

SEQ ID NO: 48371 - DNA, 201 bp, Bos taurus; identical to SEQ ID NO: 6984

SEQ ID NO: 48372 - DNA, 201 bp, Bos taurus; identical to SEQ ID NO: 6988

SEQ ID NO: 48373 - DNA, 201 bp, Bos taurus; identical to SEQ ID NO: 6990

SEQ ID NO: 48374 - DNA, 201 bp, Bos taurus; identical to SEQ ID NO: 6992

SEQ ID NO: 48375 - DNA, 201 bp, Bos taurus; identical to SEQ ID NO: 6993

SEQ ID NO: 48376 - DNA, 201 bp, Bos taurus; identical to SEQ ID NO: 6994

SEQ ID NO: 48377 - DNA, 201 bp, Bos taurus; identical to SEQ ID NO: 6995

SEQ ID NO: 48378 - DNA, 201 bp, Bos taurus; identical to SEQ ID NO: 6996

SEQ ID NO: 48379 - DNA, 201 bp, Bos taurus; identical to SEQ ID NO: 6997

SEQ ID NO: 48380 - DNA, 201 bp, Bos taurus; identical to SEQ ID NO: 6998

SEQ ID NO: 48381 - DNA, 201 bp, Bos taurus; identical to SEQ ID NO: 7000

SEQ ID NO: 48382 - DNA, 201 bp, Bos taurus; identical to SEQ ID NO: 7001

SEQ ID NO: 48383 - DNA, 201 bp, Bos taurus; identical to SEQ ID NO: 7003

SEQ ID NO: 48384 - DNA, 201 bp, Bos taurus; identical to SEQ ID NO: 7005

SEQ ID NO: 48385 - DNA, 201 bp, Bos taurus; identical to SEQ ID NO: 7006

SEQ ID NO: 48386 - DNA, 201 bp, Bos taurus; identical to SEQ ID NO: 7008

SEQ ID NO: 48387 - DNA, 201 bp, Bos taurus; identical to SEQ ID NO: 7009

SEQ ID NO: 48388 - DNA, 201 bp, Bos taurus; identical to SEQ ID NO: 7011

SEQ ID NO: 48389 - DNA, 201 bp, Bos taurus; identical to SEQ ID NO: 7012

SEQ ID NO: 48390 - DNA, 201 bp, Bos taurus; identical to SEQ ID NO: 7013

SEQ ID NO: 48391 - DNA, 201 bp, Bos taurus; identical to SEQ ID NO: 7015

SEQ ID NO: 48392 - DNA, 201 bp, Bos taurus; identical to SEQ ID NO: 7016

SEQ ID NO: 48393 - DNA, 201 bp, Bos taurus; identical to SEQ ID NO: 7017

SEQ ID NO: 48394 - DNA, 201 bp, Bos taurus; identical to SEQ ID NO: 7018

SEQ ID NO: 48395 - DNA, 201 bp, Bos taurus; identical to SEQ ID NO: 7019

SEQ ID NO: 48396 - DNA, 201 bp, Bos taurus; identical to SEQ ID NO: 7022

SEQ ID NO: 48397 - DNA, 201 bp, Bos taurus; identical to SEQ ID NO: 7023

SEQ ID NO: 48398 - DNA, 201 bp, Bos taurus; identical to SEQ ID NO: 7024

SEQ ID NO: 48399 - DNA, 201 bp, Bos taurus; identical to SEQ ID NO: 7026

SEQ ID NO: 48400 - DNA, 201 bp, Bos taurus; identical to SEQ ID NO: 7027

SEQ ID NO: 48401 - DNA, 201 bp, Bos taurus; identical to SEQ ID NO: 7028

SEQ ID NO: 48402 - DNA, 201 bp, Bos taurus; identical to SEQ ID NO: 7029

SEQ ID NO: 48403 - DNA, 201 bp, Bos taurus; identical to SEQ ID NO: 7030

SEQ ID NO: 48404 - DNA, 201 bp, Bos taurus; identical to SEQ ID NO: 7031

SEQ ID NO: 48405 - DNA, 201 bp, Bos taurus; identical to SEQ ID NO: 7034

SEQ ID NO: 48406 - DNA, 201 bp, Bos taurus; identical to SEQ ID NO: 7035

SEQ ID NO: 48407 - DNA, 201 bp, Bos taurus; identical to SEQ ID NO: 7036

SEQ ID NO: 48408 - DNA, 201 bp, Bos taurus; identical to SEQ ID NO: 7038

SEQ ID NO: 48409 - DNA, 201 bp, Bos taurus; identical to SEQ ID NO: 7039

SEQ ID NO: 48410 - DNA, 201 bp, Bos taurus
cctttcctcattgataaaccttcaatttcccaatagattaattcagctacaattcaacagtttcttgtctgtaaggttgacgtaacatgatagaatattaataaatggtgagacatcattttctagttaatatcctttgtcagcaaagtggggaaggtaagaagatggtaaacatttttttttttcacttggcaaatcaga

SEQ ID NO: 48411 - DNA, 201 bp, Bos taurus; identical to SEQ ID NO: 7040

SEQ ID NO: 48412 - DNA, 201 bp, Bos taurus; identical to SEQ ID NO: 7041

SEQ ID NO: 48413 - DNA, 201 bp, Bos taurus; identical to SEQ ID NO: 7042

SEQ ID NO: 48414 - DNA, 201 bp, Bos taurus; identical to SEQ ID NO: 7043

SEQ ID NO: 48415 - DNA, 201 bp, Bos taurus; identical to SEQ ID NO: 7044

SEQ ID NO: 48416 - DNA, 201 bp, Bos taurus; identical to SEQ ID NO: 7045

SEQ ID NO: 48417 - DNA, 201 bp, Bos taurus; identical to SEQ ID NO: 7046

SEQ ID NO: 48418 - DNA, 201 bp, Bos taurus; identical to SEQ ID NO: 7047

SEQ ID NO: 48419 - DNA, 201 bp, Bos taurus; identical to SEQ ID NO: 7048

SEQ ID NO: 48420 - DNA, 201 bp, Bos taurus; identical to SEQ ID NO: 7049

SEQ ID NO: 48421 - DNA, 201 bp, Bos taurus; identical to SEQ ID NO: 7050

SEQ ID NO: 48422 - DNA, 201 bp, Bos taurus; identical to SEQ ID NO: 7051

SEQ ID NO: 48423 - DNA, 201 bp, Bos taurus; identical to SEQ ID NO: 7052

SEQ ID NO: 48424 - DNA, 201 bp, Bos taurus; identical to SEQ ID NO: 7053

SEQ ID NO: 48425 - DNA, 201 bp, Bos taurus; identical to SEQ ID NO: 7054

SEQ ID NO: 48426 - DNA, 201 bp, Bos taurus; identical to SEQ ID NO: 7055

SEQ ID NO: 48427 - DNA, 201 bp, Bos taurus; identical to SEQ ID NO: 7057

SEQ ID NO: 48428 - DNA, 201 bp, Bos taurus
gaaggtggttctcacattttagggagtatcagaatcaatggaagccttgttagaacacagatttttggcttttacacctgagtgtcagagttaatgggagtggggcctaagaatttacatttctaagttgtcagatgatgctggggaaagtgcagggaaaaacactttgacaaccactaatctattaaccaacctcttcat

SEQ ID NO: 48429 - DNA, 201 bp, Bos taurus; identical to SEQ ID NO: 7058

SEQ ID NO: 48430 - DNA, 201 bp, Bos taurus; identical to SEQ ID NO: 7059

SEQ ID NO: 48431 - DNA, 201 bp, Bos taurus; identical to SEQ ID NO: 7060

SEQ ID NO: 48432 - DNA, 201 bp, Bos taurus; identical to SEQ ID NO: 7062

SEQ ID NO: 48433 - DNA, 201 bp, Bos taurus
atgaattactggtgggaaaatattttggcatgctatacaggaaaaacttggtaaaaattagtgaatagataagcctaaactatgaacaataatcccactcctagatatataccctaaataaatcctcaatcataaggacagctttacatggattttattgcaataaacccttgtaaagaatataaatatttattaatatgg

SEQ ID NO: 48434 - DNA, 201 bp, Bos taurus
gcattattgattttcctgttgaggctatcagagtgcatagacagtcactggatcaacccaagaggaaaatgttttaatgcccatcccttttaagctgtacgtaagctccccctcccacatgttcatgaatgactcagctttcgtctttttatgtatgatctggattacccacctgctgtttttgtcctgtttgcagaaaaa

SEQ ID NO: 48435 - DNA, 201 bp, Bos taurus; identical to SEQ ID NO: 7063

SEQ ID NO: 48436 - DNA, 201 bp, Bos taurus; identical to SEQ ID NO: 7064

SEQ ID NO: 48437 - DNA, 201 bp, Bos taurus; identical to SEQ ID NO: 7065

SEQ ID NO: 48438 - DNA, 201 bp, Bos taurus
gggatgggtccttttctagaaaatcagagctacaaagctgagtggaaccccagactcgtcctgtctcttttttattttacagagggaataagcgaaggcccgggaacttgagatgagctcaaggctgtgactgagaggagcagccctgggatggaaacatcaggtctccagcgcccaggccagggcctcttctctccactg

SEQ ID NO: 48439 - DNA, 201 bp, Bos taurus; identical to SEQ ID NO: 7066

SEQ ID NO: 48440 - DNA, 201 bp, Bos taurus; identical to SEQ ID NO: 7068

SEQ ID NO: 48441 - DNA, 201 bp, Bos taurus; identical to SEQ ID NO: 7070

SEQ ID NO: 48442 - DNA, 201 bp, Bos taurus; identical to SEQ ID NO: 7072

SEQ ID NO: 48443 - DNA, 201 bp, Bos taurus; identical to SEQ ID NO: 7073

SEQ ID NO: 48444 - DNA, 201 bp, Bos taurus; identical to SEQ ID NO: 7074

SEQ ID NO: 48445 - DNA, 201 bp, Bos taurus; identical to SEQ ID NO: 7075

SEQ ID NO: 48446 - DNA, 201 bp, Bos taurus; identical to SEQ ID NO: 7076

SEQ ID NO: 48447 - DNA, 201 bp, Bos taurus; identical to SEQ ID NO: 7077

SEQ ID NO: 48448 - DNA, 201 bp, Bos taurus; identical to SEQ ID NO: 7078

SEQ ID NO: 48449 - DNA, 201 bp, Bos taurus; identical to SEQ ID NO: 7079

SEQ ID NO: 48450 - DNA, 201 bp, Bos taurus; identical to SEQ ID NO: 7080

SEQ ID NO: 48451 - DNA, 201 bp, Bos taurus
cggagtgggttgccatttccttctccaggggatcttccccatccagggatcgaatcctcgtcaactgaacaaatgaatgcaaatactgggctttcatttttccattccccaacaatgaaaaaggtcactgatgtaactgatgaaggaaaatggcattgctttctttaataaataaaactgagatctaaggttgacaatgaa

SEQ ID NO: 48452 - DNA, 201 bp, Bos taurus; identical to SEQ ID NO: 7081

SEQ ID NO: 48453 - DNA, 201 bp, Bos taurus
tctccaccaacacagaacttatcccaaaggcaaactttaaaatctttcttacctacttgacctcaatggagtccatcaagttgcttaggactttgaaccccaaagctgaatgatttttatgacgtttattaataggaaaatccacaacatgggctactgagaatagttttacagcagggtggagttcccctgaacatagcc

SEQ ID NO: 48454 - DNA, 201 bp, Bos taurus
ccccgaatacaggagccactgcaggcctgatgtgcttcgatactgagggctttgtgggtctctttccacagtctgcctctacatcaacaagcaagccaatgcagggccgtacctggagaggaggaaggtgcagcagctccctgagcacttcgggcctgagcggccgtcagcagtcctgcagcaggctgtgcaagcatgcat

SEQ ID NO: 48455 - DNA, 201 bp, Bos taurus; identical to SEQ ID NO: 7082

SEQ ID NO: 48456 - DNA, 201 bp, Bos taurus; identical to SEQ ID NO: 7083

SEQ ID NO: 48457 - DNA, 201 bp, Bos taurus; identical to SEQ ID NO: 7084

SEQ ID NO: 48458 - DNA, 201 bp, Bos taurus; identical to SEQ ID NO: 7085

SEQ ID NO: 48459 - DNA, 201 bp, Bos taurus; identical to SEQ ID NO: 7086

SEQ ID NO: 48460 - DNA, 201 bp, Bos taurus
gctttcacagggcccatctggaacaggtcaaggcaagttgcaactaataattggatcttggaaagaaaaaaggattttgtttctcctctcttaaaagatgacgtggccacttgataacaaagtgacctttagcaagttgctcaactgtgtaagtcctgttttgttgttttttcaagaggaaatcaggtaaagcttggacaa

SEQ ID NO: 48461 - DNA, 201 bp, Bos taurus
agttgatttactgtgttgtgttagtttcagctccttcagctcctataggtctccttcttcagccctttccccctgggccaggtgcaagttgagttctgaggcgaatagcagcagtttctcctgagggttcctcctgtcctcaaagctgaaaggctggagagggtgagcaacctataggctccaggccatctctgttgattc

SEQ ID NO: 48462 - DNA, 201 bp, Bos taurus; identical to SEQ ID NO: 7088

SEQ ID NO: 48463 - DNA, 201 bp, Bos taurus; identical to SEQ ID NO: 7089

SEQ ID NO: 48464 - DNA, 201 bp, Bos taurus; identical to SEQ ID NO: 7090

SEQ ID NO: 48465 - DNA, 201 bp, Bos taurus; identical to SEQ ID NO: 7091

SEQ ID NO: 48466 - DNA, 201 bp, Bos taurus; identical to SEQ ID NO: 7092

SEQ ID NO: 48467 - DNA, 201 bp, Bos taurus; identical to SEQ ID NO: 7093

SEQ ID NO: 48468 - DNA, 201 bp, Bos taurus; identical to SEQ ID NO: 7094

SEQ ID NO: 48469 - DNA, 201 bp, Bos taurus
attgtggttagtttctccctggttagtttcttctgacaaagttaatcaactatatgtgtacatatatagagagagctccctctgagagctcccttccaccacgctccctattcttttgtttttaagtgaataataaggctctgtctctactttagaaacttcatgtgtgtgtgtgtgtgtatgtgtgtgtgtgtgtgtatg

SEQ ID NO: 48470 - DNA, 201 bp, Bos taurus; identical to SEQ ID NO: 7095

SEQ ID NO: 48471 - DNA, 201 bp, Bos taurus; identical to SEQ ID NO: 7096

SEQ ID NO: 48472 - DNA, 201 bp, Bos taurus
catggatggatgtcagtgtcatgccggccagagagttcacattgggagtacctaagtttactctccggtttatctatttatgtcagatttgttcagccttcatcagctggccactggctttcctcctggccacctgaataaccctcagagctttgctttacctgtttctgagatgcccatctccctgacagcatcattgct

SEQ ID NO: 48473 - DNA, 201 bp, Bos taurus; identical to SEQ ID NO: 7097

SEQ ID NO: 48474 - DNA, 201 bp, Bos taurus; identical to SEQ ID NO: 7098

SEQ ID NO: 48475 - DNA, 201 bp, Bos taurus; identical to SEQ ID NO: 7099

SEQ ID NO: 48476 - DNA, 201 bp, Bos taurus
agcagtgtcatagaacacaacttatatatatatatatatatatatatatatatttaaaatcttattgctatatcttagatcggaacaacaagaaaccacagtttggaaaactatgatttacaataggtcaaacaattgagatactgagctataaattttacaaaagatgtgagaaattggaggctgaaaataaggaatcaa

SEQ ID NO: 48477 - DNA, 201 bp, Bos taurus; identical to SEQ ID NO: 7101

SEQ ID NO: 48478 - DNA, 201 bp, Bos taurus; identical to SEQ ID NO: 7102

SEQ ID NO: 48479 - DNA, 201 bp, Bos taurus; identical to SEQ ID NO: 7103

SEQ ID NO: 48480 - DNA, 201 bp, Bos taurus; identical to SEQ ID NO: 7105

SEQ ID NO: 48481 - DNA, 201 bp, Bos taurus; identical to SEQ ID NO: 7106

SEQ ID NO: 48482 - DNA, 201 bp, Bos taurus; identical to SEQ ID NO: 7107

SEQ ID NO: 48483 - DNA, 201 bp, Bos taurus; identical to SEQ ID NO: 7109

SEQ ID NO: 48484 - DNA, 201 bp, Bos taurus; identical to SEQ ID NO: 7110

SEQ ID NO: 48485 - DNA, 201 bp, Bos taurus; identical to SEQ ID NO: 7111

SEQ ID NO: 48486 - DNA, 201 bp, Bos taurus
ctgctgctgggcctgctccaaatagttttgtctcttcacagaaagtgttcagtcctgcttatggcatggcagaagagttgctgacattgtcctcaaaagtgcaacttactagcttggcctgggggcaagattggatcaccgagctcctgggggtcatgttaaaagcatttgcaaaaggagattccacttagacatttttaa

SEQ ID NO: 48487 - DNA, 201 bp, Bos taurus; identical to SEQ ID NO: 7112

SEQ ID NO: 48488 - DNA, 201 bp, Bos taurus; identical to SEQ ID NO: 7113

SEQ ID NO: 48489 - DNA, 201 bp, Bos taurus; identical to SEQ ID NO: 7114

SEQ ID NO: 48490 - DNA, 201 bp, Bos taurus; identical to SEQ ID NO: 7115

SEQ ID NO: 48491 - DNA, 201 bp, Bos taurus
attatgaaaactagattcagatagtgtctttgagttctatacaatacataaagtcacaggtattttctagatggcaaagaaagataacaaaaactacaaaggatgttgataggctgaatccaggtgatggtattatacccacctatattttaaaagaaaatatcaggaaattgggagttatgcaggtatctataattatac

SEQ ID NO: 48492 - DNA, 201 bp, Bos taurus; identical to SEQ ID NO: 7117

SEQ ID NO: 48493 - DNA, 201 bp, Bos taurus
aagcctttctcaaagagctatgttttattttcatgatatcccatctaggaacaatatctcatctactaatatctgggttcttaaaaatatgttttttcctgtgaaaatccaatccttttttaaaatttttagatggagtcagttatcctattaagactaaaattaaaaaaaatttctactgaggttaccttgtagccagag

SEQ ID NO: 48494 - DNA, 201 bp, Bos taurus; identical to SEQ ID NO: 7119

SEQ ID NO: 48495 - DNA, 201 bp, Bos taurus; identical to SEQ ID NO: 7121

SEQ ID NO: 48496 - DNA, 201 bp, Bos taurus; identical to SEQ ID NO: 7122

SEQ ID NO: 48497 - DNA, 201 bp, Bos taurus; identical to SEQ ID NO: 7123

SEQ ID NO: 48498 - DNA, 201 bp, Bos taurus; identical to SEQ ID NO: 7124

SEQ ID NO: 48499 - DNA, 201 bp, Bos taurus; identical to SEQ ID NO: 7125

SEQ ID NO: 48500 - DNA, 201 bp, Bos taurus; identical to SEQ ID NO: 7126

SEQ ID NO: 48501 - DNA, 201 bp, Bos taurus; identical to SEQ ID NO: 7127

SEQ ID NO: 48502 - DNA, 201 bp, Bos taurus; identical to SEQ ID NO: 7128

SEQ ID NO: 48503 - DNA, 201 bp, Bos taurus
atgtcaatgtaccagtctttcaaatactttttctaagaacctgtgtatcctcaccttcttctaatttgatgtgcatttctgtataaacacttctaaatagtttacaggccaatccctcagatatctataatggatttgacattctttgaacatgtgtattctcatactattaattagtttgtatatttttgagatgatgat

SEQ ID NO: 48504 - DNA, 201 bp, Bos taurus; identical to SEQ ID NO: 7130

SEQ ID NO: 48505 - DNA, 201 bp, Bos taurus
gtagcttgcaggatgttagttctctgaacctgagtccttggcaatgagagcatggagtcttaaccactggcccaccaaggaattcccaaaatttctttggcggtctactcactctgacctcatttccagctgcctcagaagtgtcctttattctgttcaagatgtttaccttagttataatatccttcccactaaccccag

SEQ ID NO: 48506 - DNA, 201 bp, Bos taurus
atcatcattacgctatcctattctacataccgtggcctttaatagtggatgtcattcaactttccacacaaggtctagggtatgggcctgtgatcacatagagctgtgggctgaacctataggaagaaaggcagtaactgctgctgtgtcattgcttccggccacatttaaactcagttaaaatttgtttcttcacttcga

SEQ ID NO: 48507 - DNA, 201 bp, Bos taurus; identical to SEQ ID NO: 7132

SEQ ID NO: 48508 - DNA, 201 bp, Bos taurus; identical to SEQ ID NO: 7133

SEQ ID NO: 48509 - DNA, 201 bp, Bos taurus
cagcgcaaagaacaaatgaatttttattcagtacacaaatatacagattttaggtagctctattactcagtatcatcaaacgaggtcatttaatggaaaactagaaatgtgcaagtaaaaaaggtagaaaataagttatggttgatgataaccaaaaatgaggcgagatgtaagaggaatgttttagtaaaaggctttgtg

SEQ ID NO: 48510 - DNA, 201 bp, Bos taurus; identical to SEQ ID NO: 7136

SEQ ID NO: 48511 - DNA, 201 bp, Bos taurus; identical to SEQ ID NO: 7137

SEQ ID NO: 48512 - DNA, 201 bp, Bos taurus
gcttctaccattgttaaggtaagccagtctcttgtggtcaaatctggaatgtgttctcatttcccttgtgctttggcacctgtgtgacatcgcattctcttttttcttctcatcccttcctcagcgataactgcttcttcctacatacacattttcccttcttctccccactggtaagatctggcccttcacctgctctgt

SEQ ID NO: 48513 - DNA, 201 bp, Bos taurus; identical to SEQ ID NO: 7138

SEQ ID NO: 48514 - DNA, 201 bp, Bos taurus; identical to SEQ ID NO: 7139

SEQ ID NO: 48515 - DNA, 201 bp, Bos taurus; identical to SEQ ID NO: 7140

SEQ ID NO: 48516 - DNA, 201 bp, Bos taurus
atcgttatgagattccgagtggcagagcctctggcctgtcaacatttcttgaatactgtagggagggggagcaagttaatgttcttcctctcagcagcccggccacccccacactctccctcatagcaactcagggaatgcggattccagtgcctgtgacagtgtggccatcctagcccccccatctcttgctccaccggc

SEQ ID NO: 48517 - DNA, 201 bp, Bos taurus; identical to SEQ ID NO: 7141

SEQ ID NO: 48518 - DNA, 201 bp, Bos taurus; identical to SEQ ID NO: 7142

SEQ ID NO: 48519 - DNA, 201 bp, Bos taurus; identical to SEQ ID NO: 7144

SEQ ID NO: 48520 - DNA, 201 bp, Bos taurus; identical to SEQ ID NO: 7145

SEQ ID NO: 48521 - DNA, 201 bp, Bos taurus
gactgaagtgacttagcagtagcagcagcatgggacaatataaagtgtgccaatctatgcataacaggatctcagaagagaaaaggggactgaaaacaacggaagaaattatggctgaaaatctcccaaatctaaggaaacagatatccaggtaaaggaagcacagaagctcccctccaaaaaagatgaacccaaacaaac

SEQ ID NO: 48522 - DNA, 201 bp, Bos taurus
taagtgtattggtaattttttcaatttggacaagtacaatcttcagttctgaaaaactttcttggtaaaaaaatattttttatgttcttgaagtgaagtcgcacagtcatgtccgactctttgcaaccccatggactgcagcctaccaggctcctccgtccatgggattctccaggcaagagtactggagtggggtgccat

SEQ ID NO: 48523 - DNA, 201 bp, Bos taurus
ttttcataatttcaaaattatttaaaagttatttaaaaatgttctttactgagcatgaaagaaaatatacatatatatatatatccaattaaatattaaacttcagcatcttaagtcaagattaattatattaattgccactaattaatataatttaatgtagacttattaaatattaattggtgttgttagtttgcttcc

SEQ ID NO: 48524 - DNA, 201 bp, Bos taurus; identical to SEQ ID NO: 7147

SEQ ID NO: 48525 - DNA, 201 bp, Bos taurus
gctttactttggaaatcttaacactcaaatatcctataacttcttagactcccacctttctcactttctcacttccactatatgtgctattgaatttgcttgagctgtaaaccttctgatttctacttattccttcctttcttagacattatctcatcaaaactctcagctccttggtactatgatcctggagaaatccaa

SEQ ID NO: 48526 - DNA, 201 bp, Bos taurus; identical to SEQ ID NO: 7148

SEQ ID NO: 48527 - DNA, 201 bp, Bos taurus; identical to SEQ ID NO: 7149

SEQ ID NO: 48528 - DNA, 201 bp, Bos taurus
tttattttccccctaacctgtctttagggtctgattcctatattttgttcataatctctagcgtcacttgccactaaaagacatcagacattttggatttgttaagttataaaagctcttagcatttcagaaattcacctcatagcattgctcataaaaaggtagattttattaagaaacaaatgaaaatgaagaatgggg

SEQ ID NO: 48529 - DNA, 201 bp, Bos taurus
gggatgggattggagagcattgacctctaaacataatcagtatttgtgatttcaattcagttataacactacatggatcactataaaaatttgtataaagctgggaaatctattcccaggagtttcatatatagttactataacaactaccttgagcctaaaggattaaagtaattcaaagtatattaatccctcctgagc

SEQ ID NO: 48530 - DNA, 201 bp, Bos taurus
tttcaggaattttatggacttaagaagctcaaagcaccttgcgtgtatcaactgaagctgtgcctatatgacatcaggaaaaaataaattagcaaataatcggattaatataaaagtgaaaaatactatgttaaaatagaaaccagtcccatatttccccttgactttataatattctgcactactgagggagacttgctc

SEQ ID NO: 48531 - DNA, 201 bp, Bos taurus; identical to SEQ ID NO: 7152

SEQ ID NO: 48532 - DNA, 201 bp, Bos taurus; identical to SEQ ID NO: 7153

SEQ ID NO: 48533 - DNA, 201 bp, Bos taurus; identical to SEQ ID NO: 7154

SEQ ID NO: 48534 - DNA, 201 bp, Bos taurus; identical to SEQ ID NO: 7156

SEQ ID NO: 48535 - DNA, 201 bp, Bos taurus; identical to SEQ ID NO: 7157

SEQ ID NO: 48536 - DNA, 201 bp, Bos taurus; identical to SEQ ID NO: 7159

SEQ ID NO: 48537 - DNA, 201 bp, Bos taurus
aatactaagatcacattttttctgtaatgcacttctaaactctaaatcctcttagttctcatagacccttatctctgtgcaagataatttacattgagaatgttggccgtaatccatagtagtaaagggagtctctgccatggtttatgcagtacctttgaccttgaagaaatctcaaggatattcctaaaactggaattt

SEQ ID NO: 48538 - DNA, 201 bp, Bos taurus; identical to SEQ ID NO: 7163

SEQ ID NO: 48539 - DNA, 201 bp, Bos taurus
tgatggacagggaggcctggcatgctgcaattcatggggttgcaaagaatcagacatgtctgagtgactgaactgaactgatacaaagaacagtatggagtttccttaagcctgggaacctgcggcctaacaggcatgtggccaatatagtgcagagactctgagaggttaaggtgagcccagaggtggagcaagagagaa

SEQ ID NO: 48540 - DNA, 201 bp, Bos taurus
tatattgtaattttctacctagatggccatctctttttgaagacttttctaatcttcttccactctcctctcttcctccttcttcacaagtgcatagacacactggccaggcaggcattcaacgtacatcagctttgctgtatgcacctcatgggattataggttactacaaagtaatggcttttccttatgttcttcaca

SEQ ID NO: 48541 - DNA, 201 bp, Bos taurus
ctctgaatcaggcaggggaacagttgacctttcatggagggcaacaagccctggtctctttattcttgacaaaattacgcagcaggccatgttcatgttcctgttccgtgttcagaaatccctggagaaagttctgcttcgacaccctgataagagcagctaacagctcagtcttcactgaggggacagggagccggaccc

SEQ ID NO: 48542 - DNA, 201 bp, Bos taurus
aatacctataaaaagagatgggaccaagtatttatcaaacaaattcagttttatgtgaaaatactttataaaggagtttttattgaattttataaaatactcaacagtgacataaacctgaactcaaatactgaaagataccacagatttacaataccttaattcagaatttgtaattaattatacctaagctagataaaa

SEQ ID NO: 48543 - DNA, 201 bp, Bos taurus
ggtttatactttgtttatctgataaggcctgactttccattgagagaacaaaaactaacagtatattctgtgtcttttttgtagcctccattatcaacttacttctatgaatggatggcacattgactttttcactaataaaacattacatgtggaaaggcagttcttcaataataacatatgttgtcttgttgtgttgga

SEQ ID NO: 48544 - DNA, 201 bp, Bos taurus; identical to SEQ ID NO: 7166

SEQ ID NO: 48545 - DNA, 201 bp, Bos taurus
aacatcacattgtcagagaacacaaggaggcttgagaaacagtggatagaatccttgcttatacttttcaaatactgtagttcatttaaaagatctatggaatacaggaacgtaagttcaaagctgtgtttgacgctctgtatcaggaacctgaaagtttcacagcagagctatagaacacctgcatagccagcagcctgg

SEQ ID NO: 48546 - DNA, 201 bp, Bos taurus
gtttttctaatttgatacaataatctaaactagtaacactgtgtgtacttggatgatcaacctgagtctgtctccatctgtttgtctgtctcttttgttttcctcttaattttaaactacataatattttgaaattgttatatattcatagcttcaaagtaaagtattacagattagattagttgaccagagaaccacttt

SEQ ID NO: 48547 - DNA, 201 bp, Bos taurus; identical to SEQ ID NO: 7167

SEQ ID NO: 48548 - DNA, 201 bp, Bos taurus
gctcacgattgagtaccaccttaagcaagctagtgagagagcattgtactccaagttttagcagtgtattgttttgaacttaatttgcatattttgttcagtagtgtgactaaacttcatgtgtattatcagtttgttttcttttatggggaattgctcatagtaacatttgctagttttccctaagaagttgttggcaat

SEQ ID NO: 48549 - DNA, 201 bp, Bos taurus
gaaagtttttggcaatataaaataaggaaaataaggcttaagagagaacagctactgatgggaggtataggtaatgtttcctagtaggaaaatatattattataagaagaaacacttaccataaaacatttcagtggggagcagttggaattatgtccccttccattgtgttgacataatgtgaaaacagccagtcaaatc

SEQ ID NO: 48550 - DNA, 201 bp, Bos taurus; identical to SEQ ID NO: 7171

SEQ ID NO: 48551 - DNA, 201 bp, Bos taurus; identical to SEQ ID NO: 7172

SEQ ID NO: 48552 - DNA, 201 bp, Bos taurus
gagagggaactggccataaattgtcagcaaccaacactctctggagcttgaagaataaggaccacagtcttgaaggctggtcagatcggcacatcacaacatcttttctagttagtctgagattcggactattttcaatgaggtccctttctttttctgagagtgtcttcctggtctggttttgactcaatctcaactttg

SEQ ID NO: 48553 - DNA, 201 bp, Bos taurus; identical to SEQ ID NO: 7174

SEQ ID NO: 48554 - DNA, 201 bp, Bos taurus
ctgctaactggctcacagctcacagctgatccttcactgggagttgccctttgcagtcagacaagttccatgtgcagggtcatgagccctcccttggggtgcttgttgacctgtgactgttatatgctgaaagacaaaggtgcatcccttttgcctaaatttttaagatcactcaagttccagagtttcttcaagaatatt

SEQ ID NO: 48555 - DNA, 201 bp, Bos taurus; identical to SEQ ID NO: 7175

SEQ ID NO: 48556 - DNA, 201 bp, Bos taurus
attactttaaacactttctccctgaaatacttagaatagtgaagatgttacaagctattgtaacaaataaatttcaaaatttcatgggcccaacatagtcatcgttcatctaccagtccagtgtgggtgtttctggatagcaagtggcttttcagccttcagatgactactgccctggccaacagcttggctgcaactttg

SEQ ID NO: 48557 - DNA, 201 bp, Bos taurus; identical to SEQ ID NO: 7176

SEQ ID NO: 48558 - DNA, 201 bp, Bos taurus; identical to SEQ ID NO: 7177

SEQ ID NO: 48559 - DNA, 201 bp, Bos taurus; identical to SEQ ID NO: 7178

SEQ ID NO: 48560 - DNA, 201 bp, Bos taurus
ccaagaaatccttgattcagaacaaaataaatgatattctgataactagcaactgcactatgaagatggaccatgaaaacatccaaaacagggggcacttgtgaggttgtaattctttgtctttgatttagttgggatttaatgtattttcacttattttgtcaaagatacatttgtgttgaagtcaaggaaaaacagtgc

SEQ ID NO: 48561 - DNA, 201 bp, Bos taurus; identical to SEQ ID NO: 7179

SEQ ID NO: 48562 - DNA, 201 bp, Bos taurus; identical to SEQ ID NO: 7180

SEQ ID NO: 48563 - DNA, 201 bp, Bos taurus
agggctggaactgacacttgctcagaaaataggcccagagagctcctaacaggagctaagtaagacactaagggcacaagaaaaggaagcaggagcttaggcaagggcccaggcagagcctcagacactgcacacagaccgtctgctcggtgactgtctttgctttacgcagatatcacaatcatcttcacccaaagccat

SEQ ID NO: 48564 - DNA, 201 bp, Bos taurus
aaccccgagtggggcctcagatttgccatttgaattctccctggcagctgcttcgctttgaatttagagagtggtgctttcaactttgtgaatgaaatgtggggccagcagagtcagaagcccgggcctccttcctgctggcacccagtcttcatggtttcctgtgttagttgccttcgtgagcagcagaaactagaagga

SEQ ID NO: 48565 - DNA, 201 bp, Bos taurus; identical to SEQ ID NO: 7181

SEQ ID NO: 48566 - DNA, 201 bp, Bos taurus; identical to SEQ ID NO: 7182

SEQ ID NO: 48567 - DNA, 201 bp, Bos taurus; identical to SEQ ID NO: 7183

SEQ ID NO: 48568 - DNA, 201 bp, Bos taurus
ctgtgtttttccagacttctttcctttcgtcaaccaattccaaattgacaagcagtactctggactgctgacatcccacaaattggtggaattcagaaataataactttgttatcattttataggacagtgatctcctagttgcttatttttctcccttcaaattacattcatcagctcttacaagaacagatacctctgt

SEQ ID NO: 48569 - DNA, 201 bp, Bos taurus; identical to SEQ ID NO: 7184

SEQ ID NO: 48570 - DNA, 201 bp, Bos taurus; identical to SEQ ID NO: 7185

SEQ ID NO: 48571 - DNA, 201 bp, Bos taurus; identical to SEQ ID NO: 7186

SEQ ID NO: 48572 - DNA, 201 bp, Bos taurus; identical to SEQ ID NO: 7187

SEQ ID NO: 48573 - DNA, 201 bp, Bos taurus; identical to SEQ ID NO: 7188

SEQ ID NO: 48574 - DNA, 201 bp, Bos taurus; identical to SEQ ID NO: 7189

SEQ ID NO: 48575 - DNA, 201 bp, Bos taurus; identical to SEQ ID NO: 7190

SEQ ID NO: 48576 - DNA, 201 bp, Bos taurus; identical to SEQ ID NO: 7192

SEQ ID NO: 48577 - DNA, 201 bp, Bos taurus; identical to SEQ ID NO: 7194

SEQ ID NO: 48578 - DNA, 201 bp, Bos taurus; identical to SEQ ID NO: 7195

SEQ ID NO: 48579 - DNA, 201 bp, Bos taurus
ctttttaagaaagtgcattctgtttttacttaattgtttgaaaatggatctaaattgtatgtccattaacatgctaatatcaaaagtatttttcctgaccattgtacaatgacacgagttcctcaaatatcatccaatttacctcttgtgagtaatgtctttaactttcataactagagcaggaatatgtattatttagat

SEQ ID NO: 48580 - DNA, 201 bp, Bos taurus; identical to SEQ ID NO: 7196

SEQ ID NO: 48581 - DNA, 201 bp, Bos taurus; identical to SEQ ID NO: 7197

SEQ ID NO: 48582 - DNA, 201 bp, Bos taurus; identical to SEQ ID NO: 7198

SEQ ID NO: 48583 - DNA, 201 bp, Bos taurus
agagaaagacaaatgctagaagaagtaggcctgcccgccctgttggagcagaagggaagtctgcaatgtataaattgggtaattgctggctgaccttgcccatgaacacatgcagcacctcctggggactcacagatcccatggggcatttggcagtcacccaagaagccgtgtgagcagatggagtgagatgggcaagtt

SEQ ID NO: 48584 - DNA, 201 bp, Bos taurus
aatttaaggttacaagggtaattcataaaacccaggggcatgaaggcagccaagcttcagaagggtctatagcaaagacccagaaaaccattgggggcctctcgatttctccttatttctctaagtactcctgtcccttctctctctctctctctcaggtcatctttatctgggtgatttgcctctgcttgagctttcact

SEQ ID NO: 48585 - DNA, 201 bp, Bos taurus; identical to SEQ ID NO: 7200

SEQ ID NO: 48586 - DNA, 201 bp, Bos taurus; identical to SEQ ID NO: 7201

SEQ ID NO: 48587 - DNA, 201 bp, Bos taurus; identical to SEQ ID NO: 7202

SEQ ID NO: 48588 - DNA, 201 bp, Bos taurus; identical to SEQ ID NO: 7203

SEQ ID NO: 48589 - DNA, 201 bp, Bos taurus; identical to SEQ ID NO: 7204

SEQ ID NO: 48590 - DNA, 201 bp, Bos taurus; identical to SEQ ID NO: 7207

SEQ ID NO: 48591 - DNA, 201 bp, Bos taurus
tctacatggggttagactcaactaccaccagcatcctgcttcaagcctgcgattctcatctttccacattctgcccatggaccctctcctaggaggccaggggtcacttggctctctttctaggtcagctgagaaacaaagacattcaagaggcaaccctcaaccaatgagggacagaagtagtggataaatgccctggcc

SEQ ID NO: 48592 - DNA, 201 bp, Bos taurus; identical to SEQ ID NO: 7208

SEQ ID NO: 48593 - DNA, 201 bp, Bos taurus; identical to SEQ ID NO: 7209

SEQ ID NO: 48594 - DNA, 201 bp, Bos taurus; identical to SEQ ID NO: 7210

SEQ ID NO: 48595 - DNA, 201 bp, Bos taurus; identical to SEQ ID NO: 7212

SEQ ID NO: 48596 - DNA, 201 bp, Bos taurus
tggatggaggcttagttttggtttcagtcttgtgggataggatgaatttcgggatcttccctgacatttccttgtcattttattcctggttggccttatatgtggattgagtatgacagtcatgagtgtgtcacagagttgtgcctacattccttagcatctcattttaggcctatgtcaaggggctgcctggtgcctaat

SEQ ID NO: 48597 - DNA, 201 bp, Bos taurus
gcttgaggaggatgcagaggtggagaggggagggttagagcttgaagtctcaggcaggccctcccaccctccgcctgaccctacaactcccactcttcttccctccaatacgaagagctccctgggggaagccagctgggggctgttctcctcttttttccctgtaggaactttctaaagtttggggcacctactgtgcag

SEQ ID NO: 48598 - DNA, 201 bp, Bos taurus; identical to SEQ ID NO: 7213

SEQ ID NO: 48599 - DNA, 201 bp, Bos taurus; identical to SEQ ID NO: 7215

SEQ ID NO: 48600 - DNA, 201 bp, Bos taurus; identical to SEQ ID NO: 7216

SEQ ID NO: 48601 - DNA, 201 bp, Bos taurus; identical to SEQ ID NO: 7217

SEQ ID NO: 48602 - DNA, 201 bp, Bos taurus; identical to SEQ ID NO: 7218

SEQ ID NO: 48603 - DNA, 201 bp, Bos taurus; identical to SEQ ID NO: 7221

SEQ ID NO: 48604 - DNA, 201 bp, Bos taurus; identical to SEQ ID NO: 7222

SEQ ID NO: 48605 - DNA, 201 bp, Bos taurus; identical to SEQ ID NO: 7223

SEQ ID NO: 48606 - DNA, 201 bp, Bos taurus; identical to SEQ ID NO: 7224

SEQ ID NO: 48607 - DNA, 201 bp, Bos taurus; identical to SEQ ID NO: 7225

SEQ ID NO: 48608 - DNA, 201 bp, Bos taurus
aaaaatttgaatcattctatatctacttaaaacataaaatatgtaacaaaatattccaaaaaaatccccaaactgtgggcccagatgatttcactagtatgctcaataaaacactaagggaagaaattgtataaattctatgcaaacacattcaggaaggaccataatccaactaattatataaggccagcattactctga

SEQ ID NO: 48609 - DNA, 201 bp, Bos taurus; identical to SEQ ID NO: 7229

SEQ ID NO: 48610 - DNA, 201 bp, Bos taurus
gtcctgggccctatggttggggggggggggcatgtcctgggatggttgtgggctcaggaaataataggcagctggtctgctgataggtgggctgtgtccccgtccagctggctgcttggcctggcacattcccaaactgctgctgactggctggtgggcagggccagaacctggtgctaataagctagaaggaggattcca

SEQ ID NO: 48611 - DNA, 201 bp, Bos taurus
aatctcttttaacagtgatttccctttaatatctattcacattgtttctctcttttgagtgtcaaagatgagcgcttgcataatgcatggggactttgaccggcacaacatcaattatttcttacactgatttggtagctaaacaataaaagtgaaatgtaccctttagatgaaaatttgccctgaattttttgtggacag

SEQ ID NO: 48612 - DNA, 201 bp, Bos taurus; identical to SEQ ID NO: 7230

SEQ ID NO: 48613 - DNA, 201 bp, Bos taurus; identical to SEQ ID NO: 7231

SEQ ID NO: 48614 - DNA, 201 bp, Bos taurus; identical to SEQ ID NO: 7234

SEQ ID NO: 48615 - DNA, 201 bp, Bos taurus; identical to SEQ ID NO: 7236

SEQ ID NO: 48616 - DNA, 201 bp, Bos taurus; identical to SEQ ID NO: 7237

SEQ ID NO: 48617 - DNA, 201 bp, Bos taurus; identical to SEQ ID NO: 7238

SEQ ID NO: 48618 - DNA, 201 bp, Bos taurus
gggacatgtccgcattcatgatacccaccaggagcatattctaggcctgcatcttgctctctgcaaagggctaggccccctcatcatctttgagcctgtgattctgtcctagctccctattccagaatctatgggctctttccctgcttggcttcgtaccctagtcttggaggagaactttctccagggccacttctgagc

SEQ ID NO: 48619 - DNA, 201 bp, Bos taurus; identical to SEQ ID NO: 7239

SEQ ID NO: 48620 - DNA, 201 bp, Bos taurus
cttttagttaatcctttttttctttccttttaaagaagaattttatttttttcttgaaacactgtatgcttctaatgtgtttagatgtggatttatttctgtcgtttctacattttacatggtgtgctttcaatatcagaactcatatctttttatctagtagttaccacatcaatagccctttagtcagtaatcctgatt

SEQ ID NO: 48621 - DNA, 201 bp, Bos taurus; identical to SEQ ID NO: 7240

SEQ ID NO: 48622 - DNA, 201 bp, Bos taurus; identical to SEQ ID NO: 7242

SEQ ID NO: 48623 - DNA, 201 bp, Bos taurus; identical to SEQ ID NO: 7243

SEQ ID NO: 48624 - DNA, 201 bp, Bos taurus; identical to SEQ ID NO: 7244

SEQ ID NO: 48625 - DNA, 201 bp, Bos taurus; identical to SEQ ID NO: 7245

SEQ ID NO: 48626 - DNA, 201 bp, Bos taurus
catgtcactcctgggccctccatgatatccacataatagtttggtgtatattcgtgtaaatttttatatgaccattctcaatctcacccttaatcatctatctatccatcagtctgtccatccatgtatcatttatctcttaaaagactgtgatctcactatcttgtaatgagacttgtttttttcttggagcttttaaat

SEQ ID NO: 48627 - DNA, 201 bp, Bos taurus
acacatcttcactcctgacttttgtcactccaaggggcatgaccgtgtttgacctagagtgttatcaaggtcaccctcgttcctttcttcacatttcccagcgtgggtccttcaggtagcctacgtatctcttccctgtgttcatctattgctttgtttttcaagtcttttttagaggaggaaggtcttctcttaaaatgt

SEQ ID NO: 48628 - DNA, 201 bp, Bos taurus
aaggctacccactccagtattctggcctggagaattccgtggactgtatagtccatggggtcgcaaagagttgtacatgactgagcaactttcacttttattttcttacatattgtggcccataggcattagtttctgcaaaacagtcaataacatgttaaaacttagttcagaaatcacatcctttgttaccatcctctc

SEQ ID NO: 48629 - DNA, 201 bp, Bos taurus; identical to SEQ ID NO: 7246

SEQ ID NO: 48630 - DNA, 201 bp, Bos taurus; identical to SEQ ID NO: 7247

SEQ ID NO: 48631 - DNA, 201 bp, Bos taurus; identical to SEQ ID NO: 7249

SEQ ID NO: 48632 - DNA, 201 bp, Bos taurus; identical to SEQ ID NO: 7250

SEQ ID NO: 48633 - DNA, 201 bp, Bos taurus; identical to SEQ ID NO: 7251

SEQ ID NO: 48634 - DNA, 201 bp, Bos taurus; identical to SEQ ID NO: 7252

SEQ ID NO: 48635 - DNA, 201 bp, Bos taurus; identical to SEQ ID NO: 7253

SEQ ID NO: 48636 - DNA, 201 bp, Bos taurus; identical to SEQ ID NO: 7254

SEQ ID NO: 48637 - DNA, 201 bp, Bos taurus; identical to SEQ ID NO: 7255

SEQ ID NO: 48638 - DNA, 201 bp, Bos taurus; identical to SEQ ID NO: 7256

SEQ ID NO: 48639 - DNA, 201 bp, Bos taurus
gtgagttgagggagaacggcctttggtcaaatctgcatccatgagactgacatgtgaacccagaggagcttctagagaccacaagagacacagaaacagtgaaatggcccccaggatgtctgtcggcaggaagcaggcaccttcacaaggcaggatccagatcctggacagggctgactccaaattccagagagaacagat

SEQ ID NO: 48640 - DNA, 201 bp, Bos taurus; identical to SEQ ID NO: 7257

SEQ ID NO: 48641 - DNA, 201 bp, Bos taurus
tcaaatagatcaaaaactttctgtttaggcgtggattccctaaaaaggggcagatctagggaaaagattatttgcaagctgctccactgatgagcggggtgggggagggggtcatgcatggagaaagggagggaaattcccagctctggaggagaaagaagggaatacccacaaaaattagaggtactttggcatgaattt

SEQ ID NO: 48642 - DNA, 201 bp, Bos taurus; identical to SEQ ID NO: 7258

SEQ ID NO: 48643 - DNA, 201 bp, Bos taurus
gctgggcctcagtttccaattctgtaatatggaaatcattacccctcatgtgattgcttggagaaataaagagcttccaatgaatgaataaagtacctggtacagtttatggccagtgcagaggaccaaacagatgacagataaaacataatgaaagacttaagatatcataatcttgttgtaatgaaactgtgcaatgag

SEQ ID NO: 48644 - DNA, 201 bp, Bos taurus
gttatgcttcctttgaggcaacaagtacagggcagtgaggtaaaaaaaaaaaaaaaaagaataactaacagctttcaagaaaacaatctaaaataagcacgtgtgtagtgattataaaaatatacagatttcctttccttctactggtaatgtcaaagcccacacaatttgtgatgtgtctgcatgtgatgctcatctagc

SEQ ID NO: 48645 - DNA, 201 bp, Bos taurus
gatgctcataaatttagatgcagtgagataaacatgaaaggaatgattaatggaataattttcagtgccttccttgattacatgatttaccaaggagaagcaactcataaaaacactgtgtaaaagagaaataggccatgcaaacaactcacccaaatatttctataaccttgaagaatgaatgtaaaattaggtagatat

SEQ ID NO: 48646 - DNA, 201 bp, Bos taurus
ttgctgctttttcagtttttagggaaacattcttaatgaattttatagaactctgataaaagggttttttaaatactctcaagttttaaactgcttcattctatacaagaagtctgagggtagctgtagcgtttcatatgctttctgagagaaatagactgttttcttggctactggaaatgtttcttatgaaatgaaacc

SEQ ID NO: 48647 - DNA, 201 bp, Bos taurus; identical to SEQ ID NO: 7259

SEQ ID NO: 48648 - DNA, 201 bp, Bos taurus
gaccagctgagccacaaggaaagccccagaaagtgagtgattaaggactaaatggaaagaaaaaacacaaaagatgctgaaacaatgcaattgagtggtacaagagtaagaaggggtggtacacaatgaaaggaccctgatgacataagcactgagccctcagctggtactaatagttagctggaagtcacctacaattga

SEQ ID NO: 48649 - DNA, 201 bp, Bos taurus
gactcgggaatcgagaagggtatggctgagtggttctggctcagagtctctgatggagttgcagtcaaggcagtcaactgaggccaccatcatttgaagctgggactgacaccacttctaaaatggcttacttatacagcagttgactggaggcctcaggtcctcacccttgaaactctcctcaaaccatgaaactggctt

SEQ ID NO: 48650 - DNA, 201 bp, Bos taurus; identical to SEQ ID NO: 7260

SEQ ID NO: 48651 - DNA, 201 bp, Bos taurus; identical to SEQ ID NO: 7261

SEQ ID NO: 48652 - DNA, 201 bp, Bos taurus; identical to SEQ ID NO: 7262

SEQ ID NO: 48653 - DNA, 201 bp, Bos taurus
agaaattagtaggaagggagaaagaagctaataatgagaccgaaggtaaaaaaaaaacctatggaagatgtgtccgaaatatgaactcttggggaaaatgcaatttatcaatttgttgcatttttaaaaatgttctggatttggaagtcaacagaggagatccaggcactgagttatatgatcaaatgccttagatctcct

SEQ ID NO: 48654 - DNA, 201 bp, Bos taurus; identical to SEQ ID NO: 7263

SEQ ID NO: 48655 - DNA, 201 bp, Bos taurus
aggcatgtgggatcttaacttctgaccagggatcgaacccacacccatacattgaaaagcaaagtcttaaccactggactgccaggggagtcccaattgtatgatgtaatgtcgattataatctggctggtcatctttggttgaggaatggtgcagacataaacaaatacaagtgaacttcggtggatgactaaagcatgg

SEQ ID NO: 48656 - DNA, 201 bp, Bos taurus
gaggctcagagaaataaattttccaatatcacacaggtagcaagtatctgagctaagtttatccaaggtctaccttgttctaatgttgctgaagctgaagctccaatactttggccacatgatatgaagagctgactcattggaaaagaccctgattctgggaaagattgaaggcaggaggagaaggggacagcaaaggat

SEQ ID NO: 48657 - DNA, 201 bp, Bos taurus; identical to SEQ ID NO: 7264

SEQ ID NO: 48658 - DNA, 201 bp, Bos taurus
gaacattacagaatgaaatcttaattgtctggctccctacataaccttatcaaaatgtacacagtaagtcgctggcttaactttttgctccttagagtcaagttatctaacatcatcttataatatttaaatcgtatttcacatctaatgagagaatgcagacacatatactaacatttagaatcaacgtatccttttctc

SEQ ID NO: 48659 - DNA, 201 bp, Bos taurus
tgtgaaacatcaagtacatctaatggaccaattaaagtgataaaccatcacagcctgttcactgttatatccaaataagccattctaagaacaagtacagctaattgcaaatgaaaattccccctaaattctggatgtcagaaagactggggcagctatcagctcagctcatgaaaaggccatgagaaatccccaaaagta

SEQ ID NO: 48660 - DNA, 201 bp, Bos taurus; identical to SEQ ID NO: 7265

SEQ ID NO: 48661 - DNA, 201 bp, Bos taurus; identical to SEQ ID NO: 7266

SEQ ID NO: 48662 - DNA, 201 bp, Bos taurus; identical to SEQ ID NO: 7267

SEQ ID NO: 48663 - DNA, 201 bp, Bos taurus
tcctttgaatgtagtgactcattattttagagtctggatgtttaatgtgttatttgatcctaaatacagatgaagcacataatttcaagcattggcctaggaacaccagtgaacctgactacagacttcataagggctcctgatttgtgatctatgacggaggactttgtgactcagagagcattatcagccgtttcactg

SEQ ID NO: 48664 - DNA, 201 bp, Bos taurus
tcagtgttcttgcctgggaaatcccatggacagaggagcctgctgggctagtccacagggccccaaaggaatcaaacactacttagggactaaaccacaaccctacatttaggaaaaaattgtaacaacttaccttctgtgttgttatcatcagaaaaggtaatacaaagttcatcagacttttcagttgtaacagcccat

SEQ ID NO: 48665 - DNA, 201 bp, Bos taurus
ggcctccatgccaaagcactcactaattctgtgtgatgagtgaggctggcagcagccgtgtgttccccagggacctataccaaggtgcaaacatattgaggtgggatgattgctggagcaggcctgcttttccagcccctcggttcatgaggggaatccaaggcagcctgccccgtgagcattgctaattatgttggcttc

SEQ ID NO: 48666 - DNA, 201 bp, Bos taurus
aaggaaatgttttaatcctgaatctgatcatttcatgcgactcctttctttaccctataattccaccagactttttagcatctgtggtaaatcgttcttttcctctcagatccattctctccttcttcctggatacacatgtcacacctgaaccccagttggagtccatatttcctagcttgcttgtgaccttgtgatcaa

SEQ ID NO: 48667 - DNA, 201 bp, Bos taurus
ttccatggagagagggacataggctgacagcagccaggcccaaggggggctgcattgggcgcagaaggggagccaggcctctgcctgcacggacaagatctacttcatccccaaaaggtttttggctccagtatggaggcaatgcttggagtgtgtcctggcctgaggtcctctttcacagtctgggacgcgcgcgtcctc

SEQ ID NO: 48668 - DNA, 201 bp, Bos taurus; identical to SEQ ID NO: 7268

SEQ ID NO: 48669 - DNA, 201 bp, Bos taurus; identical to SEQ ID NO: 7269

SEQ ID NO: 48670 - DNA, 201 bp, Bos taurus
tattcagggacgggtccatgtgaactgggaaagcgtgtacaaaattaaatcattttctctgtgggcacgtgttcaacttctggccacctccgatgcttccaaagttagcgattcatttccttgattctgccagcttgtcgctgtcagcatagggcccctctgtacatggtagagtatcctcaaccacagatttactgctac

SEQ ID NO: 48671 - DNA, 201 bp, Bos taurus; identical to SEQ ID NO: 7270

SEQ ID NO: 48672 - DNA, 201 bp, Bos taurus
caggaatgttagaaatctcatcttttcccaaatttctcaattttcacaactctgaacttaacaaaatctattattttggcctttagtttattatttctgggttatattcaaggccctctgatactgttgccagccgccctttccaacctgtattatctctcttactcagcatggatcttccactccgtttagccatctgta

SEQ ID NO: 48673 - DNA, 201 bp, Bos taurus
gccttgttcttttcttcatttcactcatgataaatgtcagttggtccaaccagacctgcaagcgtccacagtctggccgtgggaaccattcttctgtagcgtaactcaaccaagaatttgcacagtttcctgtgcagtgatgggaaccccacgatgggtaccaggatgttactagctttccacggcccattctggagacct

SEQ ID NO: 48674 - DNA, 201 bp, Bos taurus; identical to SEQ ID NO: 7271

SEQ ID NO: 48675 - DNA, 201 bp, Bos taurus; identical to SEQ ID NO: 7272

SEQ ID NO: 48676 - DNA, 201 bp, Bos taurus
tcatgggcaactcttgtgatttctggtcagatagaacagatgtcacaggaaagctcccagagaggttctgggaaggagtaaggtggaaaagagggcttcctgtgtgattcagacagtaaagaaactgcctgcaatgcaggagacctgggttcgatacctgggatgggaagatcctctggagaagggaagggctacccactc

SEQ ID NO: 48677 - DNA, 201 bp, Bos taurus
actcaaattcacttcagctgatgggttgccttagaaatccatttcaactaaatacactaaaataagaattagttgaactcttagggaggaaaagatgtgaggttctttcctgtttttaccttgtcaatttgatcaaatttgtaccaaccatataaacaaataactcaaactcagaattcaatattaaagacttgggtggct

SEQ ID NO: 48678 - DNA, 201 bp, Bos taurus; identical to SEQ ID NO: 7273

SEQ ID NO: 48679 - DNA, 201 bp, Bos taurus; identical to SEQ ID NO: 7274

SEQ ID NO: 48680 - DNA, 201 bp, Bos taurus
ctatgctttatattctttcttatatgcttatgacacataattcctatcctcttatctgagtttttgttaaatatttagacttatttgtctcaccaacttcttcagttcaacccccacatttaaacaaggcatggtggtagagtacaagaacatgggctttggattgcctggtttcagatcttggtaagcagccgtaaactt

SEQ ID NO: 48681 - DNA, 201 bp, Bos taurus
atgtgagaaccttaagtgcctcccagtgcccactgttactttgaacactgtgcatacttaagaggagaacattttgccaaggcctatctgtagtgctacacattataacagcctgccccctttccggataagagcattctctacaatgttgtgagttcaagaacgactgcgtgtttgcacgcatacttgaattatgggagg

SEQ ID NO: 48682 - DNA, 201 bp, Bos taurus; identical to SEQ ID NO: 7275

SEQ ID NO: 48683 - DNA, 201 bp, Bos taurus; identical to SEQ ID NO: 7276

SEQ ID NO: 48684 - DNA, 201 bp, Bos taurus
aactgaaggtcgcacattttggccaacagtctgtatctgaagcagttcactgatggagagagagatttatttttcagtttcaagtttatgacatgaagtatttgtttcatagacagtatttacctggttcttttttttttcctgtctttaattcttggatcccagataccaagaacaaagtgaataacacagttaaatcag

SEQ ID NO: 48685 - DNA, 201 bp, Bos taurus; identical to SEQ ID NO: 7277

SEQ ID NO: 48686 - DNA, 201 bp, Bos taurus; identical to SEQ ID NO: 7278

SEQ ID NO: 48687 - DNA, 201 bp, Bos taurus
ttttaattgaggaaaaaatatatatcatacacatacacactactcccttccctacactcctcccttcatctcccctccatcaaaaaaaacccaaaaaacataaaaccccccaaaaaacccaacccataaaaaaaccccaaacaaatgaaaaacccaagcctctgctgtttagaagtctataagaactgctggttaaaggtc

SEQ ID NO: 48688 - DNA, 201 bp, Bos taurus; identical to SEQ ID NO: 7279

SEQ ID NO: 48689 - DNA, 201 bp, Bos taurus; identical to SEQ ID NO: 7280

SEQ ID NO: 48690 - DNA, 201 bp, Bos taurus; identical to SEQ ID NO: 7281

SEQ ID NO: 48691 - DNA, 201 bp, Bos taurus
acttcatgtgagcaactgctagaagttatttgcaatccccattcctaaaatgcatcattaggaggaaagtaaagaatctagagatacccaacgtaatacacattactctaatatttttaaatgcaactagagtggtgtggagtacactgaatttttaaaattataatagatataatttgcacataaataattatttaattg

SEQ ID NO: 48692 - DNA, 201 bp, Bos taurus; identical to SEQ ID NO: 7282

SEQ ID NO: 48693 - DNA, 201 bp, Bos taurus
aagaactcccttggtttgtagttggccacatttcccttgaatcatcatatggaaaacagagagagagctctagtatctttcttctaacaagatcactaatcccatcatggggcccaacttcatgacttcatctaaacttaattacctcccttccaaaggccatactctaaataccatcagattgagggttagagcttcaac

SEQ ID NO: 48694 - DNA, 201 bp, Bos taurus
taacataacatattatgtgttaaagacacaaaatatacacataaacatatttcatattcctactaaaattgaggcaagagaccttcttttctacatttgtgttagtttccagttccatatcctggattttatatatatatatatatattttttttttctttcatgaattcatcatccctgcttggtttcatgaggaaatcc

SEQ ID NO: 48695 - DNA, 201 bp, Bos taurus; identical to SEQ ID NO: 7283

SEQ ID NO: 48696 - DNA, 201 bp, Bos taurus; identical to SEQ ID NO: 7284

SEQ ID NO: 48697 - DNA, 201 bp, Bos taurus; identical to SEQ ID NO: 7285

SEQ ID NO: 48698 - DNA, 201 bp, Bos taurus; identical to SEQ ID NO: 7286

SEQ ID NO: 48699 - DNA, 201 bp, Bos taurus; identical to SEQ ID NO: 7287

SEQ ID NO: 48700 - DNA, 201 bp, Bos taurus; identical to SEQ ID NO: 7288

SEQ ID NO: 48701 - DNA, 201 bp, Bos taurus; identical to SEQ ID NO: 7289

SEQ ID NO: 48702 - DNA, 201 bp, Bos taurus; identical to SEQ ID NO: 7290

SEQ ID NO: 48703 - DNA, 201 bp, Bos taurus; identical to SEQ ID NO: 7291

SEQ ID NO: 48704 - DNA, 201 bp, Bos taurus; identical to SEQ ID NO: 7292

SEQ ID NO: 48705 - DNA, 201 bp, Bos taurus; identical to SEQ ID NO: 7293

SEQ ID NO: 48706 - DNA, 201 bp, Bos taurus; identical to SEQ ID NO: 7294

SEQ ID NO: 48707 - DNA, 201 bp, Bos taurus
tttttaaaaaacttattgagcaatttaaacctctgttaaatcagtttttgctccctccattttgaagctcaactatggtagttcacatttaagatcattatgccttcttagtgaattgatccatttatcatgatttatttttggtaatattgcttatcttgaaaccttcttttgatattaatatagctattccatctttct

SEQ ID NO: 48708 - DNA, 201 bp, Bos taurus; identical to SEQ ID NO: 7295

SEQ ID NO: 48709 - DNA, 201 bp, Bos taurus
tcactgctgagtttttatcttcatgggagttgggttggcctcaaagtgtccgaatgtggcttggcattatagattttctctgaaaaatgcattccaaaatctttctgatagatgtggcctgtgttcagttctacaggtaaaaacctagctgggaaagaaaattaatattttctgcagcattttcaagcagtgctctttact

SEQ ID NO: 48710 - DNA, 201 bp, Bos taurus; identical to SEQ ID NO: 7296

SEQ ID NO: 48711 - DNA, 201 bp, Bos taurus
acagcagatttcataacctccgctgggagtggtgggcattccccaccgctggagggcttggtcccttttatccagaaaaatgacaggcgagggggcctgagacaagggcatggacgtggggagaactgggctggagctctgccaggcccctgctaacctgaacagagtgcctttgtgtcctccaccgtgtgggaatagaag

SEQ ID NO: 48712 - DNA, 201 bp, Bos taurus; identical to SEQ ID NO: 7297

SEQ ID NO: 48713 - DNA, 201 bp, Bos taurus; identical to SEQ ID NO: 7298

SEQ ID NO: 48714 - DNA, 201 bp, Bos taurus; identical to SEQ ID NO: 7299

SEQ ID NO: 48715 - DNA, 201 bp, Bos taurus; identical to SEQ ID NO: 7300

SEQ ID NO: 48716 - DNA, 201 bp, Bos taurus
cactccttgaagccagtgcctgacagttaaggagagagaaggtacttgtcggtctgtgctcctgtggctgcactttctggaagatgttcctgctcgtccttattcgctccctcccatgtagaagcagcgggaaattcctaaagcataggagaagtgttaaatccaaaatgtggtacatcctggaaacactgttcctctggt

SEQ ID NO: 48717 - DNA, 201 bp, Bos taurus
aaggtgcagaataaacagaggcctcctttgcagtgatttcttagccagtccagtggataacctgtcccagtgaactagagtccttaaggactgagctacctgtgttaaacctaaaggtggccttaactgcaaaggatctgaggttaagagtcacaaagcggaacttttttttccccctctttagattttgacattaggtat

SEQ ID NO: 48718 - DNA, 201 bp, Bos taurus
aaacttcaatttactaaaggtactctcactccctgatgatataatggctttgtttttattgaatgctatatgtgccaggttctgctataaaaactttattccagttaactcacttaattctcaaaggttatgcagtttaaatgctactattatcccagttttactgatgaggacactaaggccagaacattcaaatgactt

SEQ ID NO: 48719 - DNA, 201 bp, Bos taurus; identical to SEQ ID NO: 7301

SEQ ID NO: 48720 - DNA, 201 bp, Bos taurus; identical to SEQ ID NO: 7302

SEQ ID NO: 48721 - DNA, 201 bp, Bos taurus; identical to SEQ ID NO: 7303

SEQ ID NO: 48722 - DNA, 201 bp, Bos taurus; identical to SEQ ID NO: 7304

SEQ ID NO: 48723 - DNA, 201 bp, Bos taurus
ggtgtatttaggtaatggggttatttaaaaccttaatagttctttattcctgttaattgtgagaagaagaggtgctcaagaaccataggccctgaagtttgaattctttagtaataattaaagagatttaaaaaatctgcttcccataaatgaatatgattctggcctgcttctgatgtctttccaggaaaaattcagttg

SEQ ID NO: 48724 - DNA, 201 bp, Bos taurus; identical to SEQ ID NO: 7305

SEQ ID NO: 48725 - DNA, 201 bp, Bos taurus; identical to SEQ ID NO: 7306

SEQ ID NO: 48726 - DNA, 201 bp, Bos taurus; identical to SEQ ID NO: 7307

SEQ ID NO: 48727 - DNA, 201 bp, Bos taurus; identical to SEQ ID NO: 7308

SEQ ID NO: 48728 - DNA, 201 bp, Bos taurus; identical to SEQ ID NO: 7309

SEQ ID NO: 48729 - DNA, 201 bp, Bos taurus; identical to SEQ ID NO: 7310

SEQ ID NO: 48730 - DNA, 201 bp, Bos taurus; identical to SEQ ID NO: 7311

SEQ ID NO: 48731 - DNA, 201 bp, Bos taurus; identical to SEQ ID NO: 7312

SEQ ID NO: 48732 - DNA, 201 bp, Bos taurus; identical to SEQ ID NO: 7313

SEQ ID NO: 48733 - DNA, 201 bp, Bos taurus; identical to SEQ ID NO: 7314

SEQ ID NO: 48734 - DNA, 201 bp, Bos taurus
ttggcattttatgttccaaatagctacatcccttgtatgagtcatgcagatagatagatcttttaaattgcttttaagcaattttgataatttgcctttcgctgtcaaaataatgactgacgttaataattctgagtgattcagttaaaggaaaagagaacagaaaagtgtgtgccaaataattttgtgctatgatttttg

SEQ ID NO: 48735 - DNA, 201 bp, Bos taurus
taatatcttagatgctattggtatttagtcacttactctttcaaatcccctttcagcttcaagctcttaaataatgcgctttttatatatgcactggattctaccactctagcagaagtttaatccatttcaaagctaccccatgggaatgagtgctgagaatcatgttgcttgattctgaaagtaaaagtatgaaataga

SEQ ID NO: 48736 - DNA, 201 bp, Bos taurus; identical to SEQ ID NO: 7315

SEQ ID NO: 48737 - DNA, 201 bp, Bos taurus; identical to SEQ ID NO: 7317

SEQ ID NO: 48738 - DNA, 201 bp, Bos taurus; identical to SEQ ID NO: 7318

SEQ ID NO: 48739 - DNA, 201 bp, Bos taurus
gaaacttactaaccatttaaaacggttctaaaagctttgaaattgagagtttcagtcatgtaatacagacttcactagatattccactttgattatggccgtattgaaattgcatttatgaaagtgaaagttacttagtcgtggctgactctttgtaaccccatgaactatacagtccatagaattctctaggccagaata

SEQ ID NO: 48740 - DNA, 201 bp, Bos taurus
aaagggaaacaacagatggtaaagtatttctgtttcatttggactcaagaacctatgttgaaaccatcagtattttggcctaagtttgggtcagatgaagcttggatcttccaattgcctatagaatttgttaatgacaagagtctggttgcccaggaagaaatagattatgttctttgttggagaaaggggccaatggtt

SEQ ID NO: 48741 - DNA, 201 bp, Bos taurus; identical to SEQ ID NO: 7319

SEQ ID NO: 48742 - DNA, 201 bp, Bos taurus; identical to SEQ ID NO: 7320

SEQ ID NO: 48743 - DNA, 201 bp, Bos taurus; identical to SEQ ID NO: 7321

SEQ ID NO: 48744 - DNA, 201 bp, Bos taurus; identical to SEQ ID NO: 7322

SEQ ID NO: 48745 - DNA, 201 bp, Bos taurus; identical to SEQ ID NO: 7323

SEQ ID NO: 48746 - DNA, 201 bp, Bos taurus; identical to SEQ ID NO: 7324

SEQ ID NO: 48747 - DNA, 201 bp, Bos taurus
ggtgctggaaaatctatttcttggcctgcctcaggctcttggctttttgccccacattcctgcaaaccttgctctcttttatccttcaagtttcaacacacatgtcctgatgttaggaggccttccctggccactttatgtaaaattgcaacactctcccccttagggttttctctcctcttctttgctttacttttctcc

SEQ ID NO: 48748 - DNA, 201 bp, Bos taurus; identical to SEQ ID NO: 7325

SEQ ID NO: 48749 - DNA, 201 bp, Bos taurus; identical to SEQ ID NO: 7326

SEQ ID NO: 48750 - DNA, 201 bp, Bos taurus; identical to SEQ ID NO: 7328

SEQ ID NO: 48751 - DNA, 201 bp, Bos taurus; identical to SEQ ID NO: 7329

SEQ ID NO: 48752 - DNA, 201 bp, Bos taurus
aatggcaacctactccaatgtctttgcctggaaaattacatggacagagaagcctggcggggtacagtccattcatgtctcaaagagtcagacaccccccgacacacacacataccatcttatggaaaagcccaaaccaacttttcagccagcacagtgttaaaacagaccaaattctctaccctcatgtagctcacatta

SEQ ID NO: 48753 - DNA, 201 bp, Bos taurus; identical to SEQ ID NO: 7330

SEQ ID NO: 48754 - DNA, 201 bp, Bos taurus; identical to SEQ ID NO: 7331

SEQ ID NO: 48755 - DNA, 201 bp, Bos taurus; identical to SEQ ID NO: 7332

SEQ ID NO: 48756 - DNA, 201 bp, Bos taurus; identical to SEQ ID NO: 7333

SEQ ID NO: 48757 - DNA, 201 bp, Bos taurus; identical to SEQ ID NO: 7334

SEQ ID NO: 48758 - DNA, 201 bp, Bos taurus; identical to SEQ ID NO: 7335

SEQ ID NO: 48759 - DNA, 201 bp, Bos taurus
aggctgccctgcctgcaaacttggcttaaacctgagttacagaggactggcccccttaagcttctgtccaaggccagcatttatcttaaaggccaaagagcgacctcccagcccaggcagaaaagagtttctaaggcgggaaactcggcagggtatgaggaagggcctgcagtcatctctcctgtgtttctgacttccctc

SEQ ID NO: 48760 - DNA, 201 bp, Bos taurus
agacttctcaactaagagaaaatactaagtttggaaagtttcgttctcgttcaataaagaagctttaaaaacaaagtgatcactggttaaaacatagtatctttgagtttccactaagatcaatcttgtggccgctatttgtattcaatcaacagagttgacattgacagatttgagaagtgagttttgactgtcctctgt

SEQ ID NO: 48761 - DNA, 201 bp, Bos taurus; identical to SEQ ID NO: 7341

SEQ ID NO: 48762 - DNA, 201 bp, Bos taurus; identical to SEQ ID NO: 7342

SEQ ID NO: 48763 - DNA, 201 bp, Bos taurus; identical to SEQ ID NO: 7344

SEQ ID NO: 48764 - DNA, 201 bp, Bos taurus
actccagtattcttgcctgggaaatcccatagacagaggaacctggaataaatgcttgtctcagtcccacagaacctcatggaaacttggctttcggccgcggcataacccagatgcactcaagggtctcctccttttgaaacaccaggcaataggagtttcggcaccacaagttccagttctgcagctagtggggcctct

SEQ ID NO: 48765 - DNA, 201 bp, Bos taurus; identical to SEQ ID NO: 7345

SEQ ID NO: 48766 - DNA, 201 bp, Bos taurus; identical to SEQ ID NO: 7346

SEQ ID NO: 48767 - DNA, 201 bp, Bos taurus; identical to SEQ ID NO: 7347

SEQ ID NO: 48768 - DNA, 201 bp, Bos taurus; identical to SEQ ID NO: 7348

SEQ ID NO: 48769 - DNA, 201 bp, Bos taurus; identical to SEQ ID NO: 7349

SEQ ID NO: 48770 - DNA, 201 bp, Bos taurus; identical to SEQ ID NO: 7351

SEQ ID NO: 48771 - DNA, 201 bp, Bos taurus; identical to SEQ ID NO: 7352

SEQ ID NO: 48772 - DNA, 201 bp, Bos taurus; identical to SEQ ID NO: 7353

SEQ ID NO: 48773 - DNA, 201 bp, Bos taurus; identical to SEQ ID NO: 7354

SEQ ID NO: 48774 - DNA, 201 bp, Bos taurus; identical to SEQ ID NO: 7355

SEQ ID NO: 48775 - DNA, 201 bp, Bos taurus; identical to SEQ ID NO: 7356

SEQ ID NO: 48776 - DNA, 201 bp, Bos taurus
cagatccactcccacaacatacatcttaagataacagggttagaactaacaatagaaagatcttaccagatccactgccacagtatacaagttttaatataacaagattagtcagaatgttcttgttaaggggaaacatatcctcgagcaagatacattgttatactaagacaaagcaatatagaaaaaaaaaaaaaaatg

SEQ ID NO: 48777 - DNA, 201 bp, Bos taurus; identical to SEQ ID NO: 7358

SEQ ID NO: 48778 - DNA, 201 bp, Bos taurus; identical to SEQ ID NO: 7361

SEQ ID NO: 48779 - DNA, 201 bp, Bos taurus; identical to SEQ ID NO: 7362

SEQ ID NO: 48780 - DNA, 201 bp, Bos taurus; identical to SEQ ID NO: 7363

SEQ ID NO: 48781 - DNA, 201 bp, Bos taurus
cttcagaacctgtttctactctatataatcctttcctctttctccaaagcaaatgtttgctccaattttgttaatatcctatgaagattgccccctaggatttaatgcatgtgactatactattctagtggttagatataacacttacagggtattaggtttcaaagaaattaggaataaaaataacataatcatcagaga

SEQ ID NO: 48782 - DNA, 201 bp, Bos taurus
gtgccccaaagacgtttttgttgcttgctgacagttagtagtgtctgtttaaaacacatggttttattgggccttaaaaatatctttcagtttcgttctcgtcaggacaagagaagagctgaggaaggtggattgcggctcactattttgttggaagatttcaacttcattccacctctctccagatgagtgctctttgca

SEQ ID NO: 48783 - DNA, 201 bp, Bos taurus; identical to SEQ ID NO: 7364

SEQ ID NO: 48784 - DNA, 201 bp, Bos taurus; identical to SEQ ID NO: 7366

SEQ ID NO: 48785 - DNA, 201 bp, Bos taurus
aaattgaagtgtttacagtgaggccctcatgtacgtgtgaaaaccccactgtgcctgcttaaatgctccctcgaacacattttaaaatgaggtctttttttccctctgtttcagtgtttcagccagtcattcgccccttattctgtctcagctctttgtgtagaaggtgccaaagactaaagaggcccagggaagatttac

SEQ ID NO: 48786 - DNA, 201 bp, Bos taurus; identical to SEQ ID NO: 7367

SEQ ID NO: 48787 - DNA, 201 bp, Bos taurus
atctttctgagcaatttgcttagctttatctttcaaccaacataattcatgctcatgagaattcaattcatcttctaactgattgaagactctcaacctgcaaattaaaatgttattttactattagtttactacaagtgttgaactactatttcctttctttaaataagggcttccctggtgactcagacagcaaagaat

SEQ ID NO: 48788 - DNA, 201 bp, Bos taurus
ttccttcggtaaaaatcttcaaactattgattataaaactgatcatttatacagctgagtttctactgctggtctagggcaagaattaaaatccatttgttgggttcacttgagtcaagtgtattcacagatattattttattcataccaataggtcttctattgcttactcatcctaagaaagcaatgacaagcattaac

SEQ ID NO: 48789 - DNA, 201 bp, Bos taurus
tcttctaaaatgtattattgttttatttttatacatggaatatttatccctctttttctccattagtttttaagccaaagcacatgccctcaataaatctctgctttgatatcatgctctcagaaatacctgctctgcctttcataaaccttataattatgtactcagtgtctctattttccactgatctttgctcccctt

SEQ ID NO: 48790 - DNA, 201 bp, Bos taurus; identical to SEQ ID NO: 7368

SEQ ID NO: 48791 - DNA, 201 bp, Bos taurus; identical to SEQ ID NO: 7369

SEQ ID NO: 48792 - DNA, 201 bp, Bos taurus; identical to SEQ ID NO: 7370

SEQ ID NO: 48793 - DNA, 201 bp, Bos taurus
acaaaatgaaatgtgatataaatacaaagagataataatagttgagcataggtcttatataaactacacaaataactgaattgactaatctctctgaatataatgttgctgttttacaggttttaaaaatctttgattttaatttttgtaatctttgattttaattttcatcacaggaaaattgttcttagaccacttctt

SEQ ID NO: 48794 - DNA, 201 bp, Bos taurus
cacagaatgtaaagattgttccaggtattaaaatcaatgaagtttgtttaaaaaaaaagaacacttctgccaaattggcagaaaaaaagtgaatgtaaaacaatcaaactaccaaactctttatcgatttaactatgagttttaaaaaaccagatattaagaaaattcagagttcaaaaaatcgtgaccatgttttattga

SEQ ID NO: 48795 - DNA, 201 bp, Bos taurus
atctttttttccaggatcctttagacttttgtggagtgaactgggcagggcatattttccgtaagacaaatgtattggctcaattgtggctcaggttaaggtatcattatcttccttcaggccactatgttagacatttccaaaaggaatatgtattccatgtgtgactaattcatttctaattaagattattaaatcact

SEQ ID NO: 48796 - DNA, 201 bp, Bos taurus; identical to SEQ ID NO: 7373

SEQ ID NO: 48797 - DNA, 201 bp, Bos taurus
ggataggtactttgaattacatcttcaaagatgcagtggtgttaaataggacaggggagcagggtgggcagtgtcatgccagtggagagaattccagatagcaggagacttggaacagttaatgctgccctcctatgaaatgagcaaaagatttgcttttttttccttcaggataacatttgtgatgaccaaagggaaagg

SEQ ID NO: 48798 - DNA, 201 bp, Bos taurus; identical to SEQ ID NO: 7375

SEQ ID NO: 48799 - DNA, 201 bp, Bos taurus; identical to SEQ ID NO: 7376

SEQ ID NO: 48800 - DNA, 201 bp, Bos taurus; identical to SEQ ID NO: 7379

SEQ ID NO: 48801 - DNA, 201 bp, Bos taurus; identical to SEQ ID NO: 7380

SEQ ID NO: 48802 - DNA, 201 bp, Bos taurus; identical to SEQ ID NO: 7381

SEQ ID NO: 48803 - DNA, 201 bp, Bos taurus; identical to SEQ ID NO: 7382

SEQ ID NO: 48804 - DNA, 201 bp, Bos taurus; identical to SEQ ID NO: 7383

SEQ ID NO: 48805 - DNA, 201 bp, Bos taurus; identical to SEQ ID NO: 7385

SEQ ID NO: 48806 - DNA, 201 bp, Bos taurus; identical to SEQ ID NO: 7386

SEQ ID NO: 48807 - DNA, 201 bp, Bos taurus
tgagtttttaacaatggtaaaatagtctagtctgtttttatgggctcaatgaactaatagctggaaacaatgagactgtgcctggccatgtcatgtagacgtcagcatgtagatgttagttaagcaagtaagagaaatttctcccactctgtccttggccacccagtttctctcccaaagtaatcactgtcccttgtgtct

SEQ ID NO: 48808 - DNA, 201 bp, Bos taurus; identical to SEQ ID NO: 7387

SEQ ID NO: 48809 - DNA, 201 bp, Bos taurus; identical to SEQ ID NO: 7388

SEQ ID NO: 48810 - DNA, 201 bp, Bos taurus; identical to SEQ ID NO: 7389

SEQ ID NO: 48811 - DNA, 201 bp, Bos taurus; identical to SEQ ID NO: 7390

SEQ ID NO: 48812 - DNA, 201 bp, Bos taurus; identical to SEQ ID NO: 7391

SEQ ID NO: 48813 - DNA, 201 bp, Bos taurus
gtattatccgcccggctcccagctccccagccggcctgcctctcccctctcctggcacatttacagctcccgatgtcagcaagtgctgggcactcatgtgttcagtgtcaacaacacaccaggaaatcagggctccgggcagcccagcgatgctggctttcggctgcctctggaagcgaagcgagctctcctccacgctgc

SEQ ID NO: 48814 - DNA, 201 bp, Bos taurus
agtgctaatggttctttcagttaaaagactgctgcccttgctcattaacatacacaagtcgggtatttttaaatccttcgttacttcaccatacccagggttgctgctgcaatggccaggaatacccaaatcccacggaatcttgggcaaaagatgtcagctcaagcccagctgtgggtctcagctacctacaaggattcg

SEQ ID NO: 48815 - DNA, 201 bp, Bos taurus; identical to SEQ ID NO: 7392

SEQ ID NO: 48816 - DNA, 201 bp, Bos taurus; identical to SEQ ID NO: 7393

SEQ ID NO: 48817 - DNA, 201 bp, Bos taurus; identical to SEQ ID NO: 7394

SEQ ID NO: 48818 - DNA, 201 bp, Bos taurus; identical to SEQ ID NO: 7395

SEQ ID NO: 48819 - DNA, 201 bp, Bos taurus
gagcaggggcctctctcgagttgtggtgctcgggcttctcattgtagtggcttctcttgttgcagagcatgggctcgaggacttcagcagtttcggtatgtgggctccaggcacaggcccaatagttgtggttcaagggcttagtggctgcagagcatgtaggatcttcccagaacacggatcaaacctgtatctcctgca

SEQ ID NO: 48820 - DNA, 201 bp, Bos taurus
tccacatgtggccattagcctggttaaaattttgctggtttttccttaactcctgtttatggtggattcctgttctccctgccatttggtaggaatgaaatctactcttggccttttttttctttggggatgggcttgacacatttatacttctttgcatcctcagctccctgatatattttaaaaactgtgcttttgtag

SEQ ID NO: 48821 - DNA, 201 bp, Bos taurus; identical to SEQ ID NO: 7397

SEQ ID NO: 48822 - DNA, 201 bp, Bos taurus; identical to SEQ ID NO: 7399

SEQ ID NO: 48823 - DNA, 201 bp, Bos taurus; identical to SEQ ID NO: 7400

SEQ ID NO: 48824 - DNA, 201 bp, Bos taurus; identical to SEQ ID NO: 7401

SEQ ID NO: 48825 - DNA, 201 bp, Bos taurus
gactgctcctctagtgttctaggatggcccagacaagagtccacagtctgctctgaaagcacagggtccgtgggggaagtaccctcttcctccagtaaccggatttgggggggccccccattcctttccagcctttgtcataggtgtctggaaggccctggagccctgatgaaccaggtggtacacagactggcagcattg

SEQ ID NO: 48826 - DNA, 201 bp, Bos taurus; identical to SEQ ID NO: 7403

SEQ ID NO: 48827 - DNA, 201 bp, Bos taurus; identical to SEQ ID NO: 7404

SEQ ID NO: 48828 - DNA, 201 bp, Bos taurus
cattgaaaggacatcttattactaaggaattcatgtaaatttgataacaaaatggcattatagaaagtacactaattagatctgcattttctgcttttcactgccatgttttatcaattcaataccatcttggttggggaaagaaacagatcaaaggtgctgtgtgtctagtgtcactgatggaaaaagtaagtaggagga

SEQ ID NO: 48829 - DNA, 201 bp, Bos taurus; identical to SEQ ID NO: 7405

SEQ ID NO: 48830 - DNA, 201 bp, Bos taurus; identical to SEQ ID NO: 7406

SEQ ID NO: 48831 - DNA, 201 bp, Bos taurus
aaatgatggatttttatccaacaatataattgcctatggctctccaaacagaggtttcacaatgtttggctccggcatcatagcaatagagaaaataaaacttatcatacggatttcatgtattcattcattcaactatttattaagtctatctataaggcggtgtcgtgggttctggggacccatgctaaatgttaaagc

SEQ ID NO: 48832 - DNA, 201 bp, Bos taurus; identical to SEQ ID NO: 7408

SEQ ID NO: 48833 - DNA, 201 bp, Bos taurus; identical to SEQ ID NO: 7410

SEQ ID NO: 48834 - DNA, 201 bp, Bos taurus; identical to SEQ ID NO: 7411

SEQ ID NO: 48835 - DNA, 201 bp, Bos taurus
agacagctgagggaccagacgctgtctgagcatctctggagttttcatgagtacagcccagtacaagggaggggagggtggtatgaaggccacttcactcgcagatgaaacagccggaggatacacggaggtggctgagagctgtctgccccagggcaggagactggggccccagtgccccgcctccactcagctttcctc

SEQ ID NO: 48836 - DNA, 201 bp, Bos taurus; identical to SEQ ID NO: 7414

SEQ ID NO: 48837 - DNA, 201 bp, Bos taurus
tcgactgactgtgagtatgtaaagaacacgctgggctcagaaggcaagacctatggtcgaactgcgggacactgggcctccgtaaaaacctgggggatcgaggctaaccagctcaccagcacataccccaaagggtccaggaaaggagtcctaagggagacccactcagtgtcagaaccatcctcctggactctcaccgta

SEQ ID NO: 48838 - DNA, 201 bp, Bos taurus; identical to SEQ ID NO: 7416

SEQ ID NO: 48839 - DNA, 201 bp, Bos taurus
ctgatagaaaatatcttacggtttgaggcctacagtctctgtggcaactactcaactaccgctgtggctcaaaatcagctgcagaaacctgaaacaaacgtgtggggccgcatccttccaaaccttgtttatgggcactgaaaatggaattttctacataggcacacctcgttttgtcatgctttgctttactgcacttcg

SEQ ID NO: 48840 - DNA, 201 bp, Bos taurus
tttatttattactttgctatgatctgaatgtttgtcttttcctcaaattcatatgttgaagcataatcctcgctgtgatggtatgtggagcggcggcctttagaatgtgatatggtcacgagagcaggaccctgaggaatagggttagtgcctgtattaaaagacaccacagagctctttgccttggccaccacaggaaga

SEQ ID NO: 48841 - DNA, 201 bp, Bos taurus; identical to SEQ ID NO: 7417

SEQ ID NO: 48842 - DNA, 201 bp, Bos taurus
gacagtgatcctactgcacacttaaaatatttttaaatgccttaggaaccatggagcaagcagtgttaaaaataataatgtaccaactaaagatatttagtgctctgctaagacaggaggcgatgcagcagaatgagaaaatctgcagattgtgtccacaccatgcgtgttcaagctggagccccacctcacacggggtct

SEQ ID NO: 48843 - DNA, 201 bp, Bos taurus
aggagcctggtgagctctagtccaaaaggtcgcaaagggtcagacacaactcagcaactgtgcacatgcgctaagagagcacggctgaaccattctggccagaacgctcttcacagctactcacctacagcagcagcttcccacccaaggggcaaatgtgtcacccagggtctccaggttggaggccagagggcagaaggt

SEQ ID NO: 48844 - DNA, 201 bp, Bos taurus; identical to SEQ ID NO: 7418

SEQ ID NO: 48845 - DNA, 201 bp, Bos taurus
tgaggaaggagagagaaaattcacaaaggaaaatcctagagagatgctcagagacagcacaacagaggtctgcagcggccccttcctgtccagctacactcgtgaggggaaactgtccaagggactgaagcaccacttggaggaactagagaacacagtgaccagggcccacacggggccaggagtagctcctcctcccac

SEQ ID NO: 48846 - DNA, 201 bp, Bos taurus; identical to SEQ ID NO: 7419

SEQ ID NO: 48847 - DNA, 201 bp, Bos taurus
tattatggagagacagtttgccagcaaactgctgtatttaacccaatttgagttgctggaagaacccagaaggttgccttgtggaggatggatggtgattgagaatgctgtggagggcgagaggtggaacttgaaagcagaatatacatcacgaaagcacaaataaatttaatgagagaccagggtgtgaaatatcaacaa

SEQ ID NO: 48848 - DNA, 201 bp, Bos taurus
taactgactctttttgtttattttatagtggtatttattatatcctctggattttccagatatttttattttgtacacgtaagaactcccaacttttcagcgtgataatattatagcagtttaagtggcacccaaataatttctaacaatcactccaaggctataataatttaaatatctatttaacttcaaagcaaatca

SEQ ID NO: 48849 - DNA, 201 bp, Bos taurus; identical to SEQ ID NO: 7420

SEQ ID NO: 48850 - DNA, 201 bp, Bos taurus
tccagggggactcctgagactcgatcccacctttgcgtatgtcgagcctccttcctcatgacctttgccacgggcggagcgcctcacgccggcccccgacgagtggggactgacccagtcctcaaccacgtgtggaaagaactccgctctcttgtgcctcccaccggccttcccatagcaccagctgaatcatcccatgtc

SEQ ID NO: 48851 - DNA, 201 bp, Bos taurus; identical to SEQ ID NO: 7421

SEQ ID NO: 48852 - DNA, 201 bp, Bos taurus; identical to SEQ ID NO: 7422

SEQ ID NO: 48853 - DNA, 201 bp, Bos taurus; identical to SEQ ID NO: 7423

SEQ ID NO: 48854 - DNA, 201 bp, Bos taurus; identical to SEQ ID NO: 7424

SEQ ID NO: 48855 - DNA, 201 bp, Bos taurus
ggggcccagaagctgtgcacttagttcgtaggctatgtgcctttactaaggtaaatactgactcccctgggctaggactgaaccgtagagtatttatgctgtatcatatttcaacactggccactgtagtctcccccagcagaactaaccatgagttagtacttttatttctaaatgacattatgatggtcttcctatatt

SEQ ID NO: 48856 - DNA, 201 bp, Bos taurus; identical to SEQ ID NO: 7425

SEQ ID NO: 48857 - DNA, 201 bp, Bos taurus; identical to SEQ ID NO: 7426

SEQ ID NO: 48858 - DNA, 201 bp, Bos taurus; identical to SEQ ID NO: 7427

SEQ ID NO: 48859 - DNA, 201 bp, Bos taurus; identical to SEQ ID NO: 7428

SEQ ID NO: 48860 - DNA, 201 bp, Bos taurus; identical to SEQ ID NO: 7430

SEQ ID NO: 48861 - DNA, 201 bp, Bos taurus
atggcaaatgcacacagatgtgaactcaccacccactcctgcactaagggagacatttctactgaagcacagaagtctgactcacctaccaaatccctctaaagacaggtctccagacagcctcgcccacaggataggcgttgatgttccagacggaactaggagtccccccgggacgtggttctcctccaggacttctcc

SEQ ID NO: 48862 - DNA, 201 bp, Bos taurus
tgataattctttgttatgagcggtgggttagagaaatggtcagttctgatggacacattcaactattaaagggagaatattttcattaatgtattagcttacacctgtccagttttaagctaaggtcagcatagtgagatattcctgccgtgacagaacatcatggtttataaagactgtgcacacaccgccatacttgat

SEQ ID NO: 48863 - DNA, 201 bp, Bos taurus; identical to SEQ ID NO: 7434

SEQ ID NO: 48864 - DNA, 201 bp, Bos taurus; identical to SEQ ID NO: 7436

SEQ ID NO: 48865 - DNA, 201 bp, Bos taurus; identical to SEQ ID NO: 7437

SEQ ID NO: 48866 - DNA, 201 bp, Bos taurus; identical to SEQ ID NO: 7438

SEQ ID NO: 48867 - DNA, 201 bp, Bos taurus; identical to SEQ ID NO: 7439

SEQ ID NO: 48868 - DNA, 201 bp, Bos taurus; identical to SEQ ID NO: 7441

SEQ ID NO: 48869 - DNA, 201 bp, Bos taurus; identical to SEQ ID NO: 7442

SEQ ID NO: 48870 - DNA, 201 bp, Bos taurus
agaagggaacgtgcatacgcctagagaagggcaagaccagccaacacagtccggacaggcctcccagcacccagggcccagacaggcctcctcttgtctatgtctaaagactgtactgatggaagacatttttcatgctgctgtgaggggatgactgtgagtcagacaacaaggaagactaccacgtacttggggccagag

SEQ ID NO: 48871 - DNA, 201 bp, Bos taurus
gaggggaggccgttttccctgctgccctgtcacttcctgtttgccctgggtgcctcctcagtgctgcctaagctgtgctgagtgggcgtctgtaagctccttgggagctggcctgctaactggtgtgccccgcggtccctggagcggcgttgagtctgcagactgtgctcagtacgaggccagggcggcaggagcaggctc

SEQ ID NO: 48872 - DNA, 201 bp, Bos taurus
atgagtttgagcaagctcctggagttggcgatggacagggaggcctggcgtgctgcagtccgtggggtcgcaaagagatgagcacgactgagtgactgaactgaactgaaccaaggtctatggcctgaaccacaggggttgaagggatttggttgcctggtgctgaaatgagcttgtggatgagcaactttatggaaggca

SEQ ID NO: 48873 - DNA, 201 bp, Bos taurus
gaaaaaaccagattggccttaagaaaagagtttccaagtcaacaccctcctgcggcatccagatctcaacagaagggcctggtggttccaggccaagcacacctgccctgagacccccacgggaatggcacgtgggtcctcgtgcagagcagcactttgccgagaaggaggtgggccgggggttggggggagcaggatgtg

SEQ ID NO: 48874 - DNA, 201 bp, Bos taurus
caaaaaagtcctgagaaaaacccttgtgaagtggctttgaataaaaccactacttacagtctggtacctgatggcttaggttcaaatcttggccctgacacgtcccagcttggggacctgtgaagacaggaatttccttctcccctccctgcctgggactgtctacagggccgggacagtaactgaatgtgggatgcaggc

SEQ ID NO: 48875 - DNA, 201 bp, Bos taurus
gctggggcctttggtgaccagcccccgccctgatggagggacagaagcacccagcaccgaacagcagggagcaagccacctcaccatcaggaggggagccgaggccgccagcaacaaccctccccagtttctgcttttgctcagaaggtcgagagagaaacacaccgtggccaaccctagaagcaagcagcagcccgggtg

SEQ ID NO: 48876 - DNA, 201 bp, Bos taurus; identical to SEQ ID NO: 7443

SEQ ID NO: 48877 - DNA, 201 bp, Bos taurus; identical to SEQ ID NO: 7444

SEQ ID NO: 48878 - DNA, 201 bp, Bos taurus
gggtggggcaggctccttggagaccaggctcctccttgtaggagcaccttccttttcacttctgtggcttggttttgcagcttggccagagttatgaaaagattctactaatccccagctgtattcatgcttttattctgcagaaacatgggcagggaagcaggcgcctgtgctcagaatgtgtatggaggccgtgcaggg

SEQ ID NO: 48879 - DNA, 201 bp, Bos taurus
gaacctcattcactgcaacatctttttcttttatttctcctcaaagtatgtttcaggcttctttccttaggaaaacaaatctttctttgacccaatcatcagtttaaataatctctcagttttcctttgccacggcaaactcctcaaaggggacctctctctgagcagtcttgctcagaagatacagtgccttacctttct

SEQ ID NO: 48880 - DNA, 201 bp, Bos taurus; identical to SEQ ID NO: 7446

SEQ ID NO: 48881 - DNA, 201 bp, Bos taurus; identical to SEQ ID NO: 7447

SEQ ID NO: 48882 - DNA, 201 bp, Bos taurus
agcctctcgaggcccttccccgggtctggcctcgtcctcctccatgtgcgcacaccctcctgttcaccacccaaatcaagctggatcttcgcctccacccgtaccctcgggaggcctttcctgcacccgaggcttcaaacatgctgtccctctgtccatctccccctgcagcccccacggttcccccctaactgaggccgc

SEQ ID NO: 48883 - DNA, 201 bp, Bos taurus; identical to SEQ ID NO: 7448

SEQ ID NO: 48884 - DNA, 201 bp, Bos taurus; identical to SEQ ID NO: 7449

SEQ ID NO: 48885 - DNA, 201 bp, Bos taurus; identical to SEQ ID NO: 7451

SEQ ID NO: 48886 - DNA, 201 bp, Bos taurus
tccttgccctctgcctgacatgagggggtggtcctcccaggccgtactcacacctgtccagccgcacccagcagcccacactgagccaggtgcgccctcacgggagcgtcggcaccgggcccctggcgtccccggactagacagccacaatggacgggaaacactctcagtctaaagcgcaaacacagaccctgccagcga

SEQ ID NO: 48887 - DNA, 201 bp, Bos taurus; identical to SEQ ID NO: 7452

SEQ ID NO: 48888 - DNA, 201 bp, Bos taurus; identical to SEQ ID NO: 7453

SEQ ID NO: 48889 - DNA, 201 bp, Bos taurus; identical to SEQ ID NO: 7454

SEQ ID NO: 48890 - DNA, 201 bp, Bos taurus; identical to SEQ ID NO: 7455

SEQ ID NO: 48891 - DNA, 201 bp, Bos taurus; identical to SEQ ID NO: 7456

SEQ ID NO: 48892 - DNA, 201 bp, Bos taurus; identical to SEQ ID NO: 7457

SEQ ID NO: 48893 - DNA, 201 bp, Bos taurus; identical to SEQ ID NO: 7458

SEQ ID NO: 48894 - DNA, 201 bp, Bos taurus; identical to SEQ ID NO: 7460

SEQ ID NO: 48895 - DNA, 201 bp, Bos taurus; identical to SEQ ID NO: 7461

SEQ ID NO: 48896 - DNA, 201 bp, Bos taurus; identical to SEQ ID NO: 7462

SEQ ID NO: 48897 - DNA, 201 bp, Bos taurus; identical to SEQ ID NO: 7463

SEQ ID NO: 48898 - DNA, 201 bp, Bos taurus; identical to SEQ ID NO: 7464

SEQ ID NO: 48899 - DNA, 201 bp, Bos taurus; identical to SEQ ID NO: 7465

SEQ ID NO: 48900 - DNA, 201 bp, Bos taurus; identical to SEQ ID NO: 7466

SEQ ID NO: 48901 - DNA, 201 bp, Bos taurus
atatttcctgagcgtagccttgtgttcagccaaaacaagtgacatcttgggaaacatttcttgggaaggagacgtgcattctagttgcctgtggccaataggtttcctctcaccatcaactcctgttggttggttgtccatgtagcacagctttgagacggattctggaggccactttcactgtcttaggaagctgatctt

SEQ ID NO: 48902 - DNA, 201 bp, Bos taurus
gtcaccgagtattcttctgccgggcctgttcacctaagactatactctgttgtgtcactttttacccattgtgtgggctcataaagtacgttgtagttggcgctgcttttggccccaacatagggatgctggcaatcagccccggtgcctttcacatttcgtttttcacaagaccaccagcacagatccacaggagtaaga

SEQ ID NO: 48903 - DNA, 201 bp, Bos taurus; identical to SEQ ID NO: 7467

SEQ ID NO: 48904 - DNA, 201 bp, Bos taurus
cattgagcatggttcagctttagttggtccaacttcaactgcattggctcaccttttttcatctttgtgaggatacacaactctccaccttatctttcctgttagcttggccaatagagagtggattacatactttttgaccaacccactatttccccagatggctttggtagcctctgctggctttttccaaaatgtccg

SEQ ID NO: 48905 - DNA, 201 bp, Bos taurus
atatttctccttcactgtctgactgacttcactcagtgtgacactttctaggtccatccatgttgctgcaaattgctcatcatggatcctgtgatctatcggttccattcctaggtatatcctataggcaaagtcacaggtgaaggtgttcttggccagtaccaggagtagggggaagtaagggaagatgcctagtgctca

SEQ ID NO: 48906 - DNA, 201 bp, Bos taurus
tttgtcatgtcctgagcccgccggcacacacaggcccggctggctttagcaaagtgcatgaatgcagcagggctcctgggaagcggccagcgtctggtcttactgcctgagcatcacccagagaccaaggagaaatgggaattctcagcccgaacccagacctcctgagtcagaatctctgtgatcagggccaaggtatct

SEQ ID NO: 48907 - DNA, 201 bp, Bos taurus; identical to SEQ ID NO: 7468

SEQ ID NO: 48908 - DNA, 201 bp, Bos taurus; identical to SEQ ID NO: 7470

SEQ ID NO: 48909 - DNA, 201 bp, Bos taurus; identical to SEQ ID NO: 7471

SEQ ID NO: 48910 - DNA, 201 bp, Bos taurus; identical to SEQ ID NO: 7472

SEQ ID NO: 48911 - DNA, 201 bp, Bos taurus; identical to SEQ ID NO: 7473

SEQ ID NO: 48912 - DNA, 201 bp, Bos taurus; identical to SEQ ID NO: 7478

SEQ ID NO: 48913 - DNA, 201 bp, Bos taurus; identical to SEQ ID NO: 7479

SEQ ID NO: 48914 - DNA, 201 bp, Bos taurus; identical to SEQ ID NO: 7481

SEQ ID NO: 48915 - DNA, 201 bp, Bos taurus; identical to SEQ ID NO: 7482

SEQ ID NO: 48916 - DNA, 201 bp, Bos taurus; identical to SEQ ID NO: 7483

SEQ ID NO: 48917 - DNA, 201 bp, Bos taurus; identical to SEQ ID NO: 7484

SEQ ID NO: 48918 - DNA, 201 bp, Bos taurus; identical to SEQ ID NO: 7485

SEQ ID NO: 48919 - DNA, 201 bp, Bos taurus; identical to SEQ ID NO: 7486

SEQ ID NO: 48920 - DNA, 201 bp, Bos taurus; identical to SEQ ID NO: 7487

SEQ ID NO: 48921 - DNA, 201 bp, Bos taurus; identical to SEQ ID NO: 7488

SEQ ID NO: 48922 - DNA, 201 bp, Bos taurus; identical to SEQ ID NO: 7490

SEQ ID NO: 48923 - DNA, 201 bp, Bos taurus; identical to SEQ ID NO: 7493

SEQ ID NO: 48924 - DNA, 201 bp, Bos taurus; identical to SEQ ID NO: 7494

SEQ ID NO: 48925 - DNA, 201 bp, Bos taurus; identical to SEQ ID NO: 7495

SEQ ID NO: 48926 - DNA, 201 bp, Bos taurus
tgtgacacctttgaagccaaatctgaaatagtatcaaatctctataactttaaggtacttactaaatatgcaccctggtttcctcatctcttatgaaaatgaaatagggtaatgagtgttaaatactgtaagatcaaaacacttttacagttattgcatttaaaaagatttaacaagctgttaccattaattttattactt

SEQ ID NO: 48927 - DNA, 201 bp, Bos taurus; identical to SEQ ID NO: 7496

SEQ ID NO: 48928 - DNA, 201 bp, Bos taurus; identical to SEQ ID NO: 7497

SEQ ID NO: 48929 - DNA, 201 bp, Bos taurus; identical to SEQ ID NO: 7498

SEQ ID NO: 48930 - DNA, 201 bp, Bos taurus
ttactgcaactggagaaggcccacacacagccacaaatagaatgatccttaagataaagaaaagtcatttagaaaacataaaatattttttaaaccattatggccatcccattgtctgtctcataccctttgcttttgctttctagtctcagaatatagactgtgttgattcattcatcagtccttctaagacaatctcta

SEQ ID NO: 48931 - DNA, 201 bp, Bos taurus; identical to SEQ ID NO: 7501

SEQ ID NO: 48932 - DNA, 201 bp, Bos taurus; identical to SEQ ID NO: 7503

SEQ ID NO: 48933 - DNA, 201 bp, Bos taurus; identical to SEQ ID NO: 7504

SEQ ID NO: 48934 - DNA, 201 bp, Bos taurus; identical to SEQ ID NO: 7506

SEQ ID NO: 48935 - DNA, 201 bp, Bos taurus; identical to SEQ ID NO: 7507

SEQ ID NO: 48936 - DNA, 201 bp, Bos taurus; identical to SEQ ID NO: 7508

SEQ ID NO: 48937 - DNA, 201 bp, Bos taurus; identical to SEQ ID NO: 7509

SEQ ID NO: 48938 - DNA, 201 bp, Bos taurus; identical to SEQ ID NO: 7510

SEQ ID NO: 48939 - DNA, 201 bp, Bos taurus; identical to SEQ ID NO: 7512

SEQ ID NO: 48940 - DNA, 201 bp, Bos taurus
atatttcttagtcctcagttgacagcatcggccatgtattgcttcagaataggtgagacttaagggtaataacttctgataattgtaccagaactacctaggcagaaatacacgaggccgggtattgtgatggtgggttatgaaaggtacccttgcgcctgatgattgtgggactggtgggcagtgggcaaggtgtggctc

SEQ ID NO: 48941 - DNA, 201 bp, Bos taurus; identical to SEQ ID NO: 7513

SEQ ID NO: 48942 - DNA, 201 bp, Bos taurus
ctattcttgggccttgatagaaagtcaccacagcagccctgttgggccatgacttgggtctgagaacagaagatcaggagtaaagcagaaagagggcagggtgctgtgtggtgacacgggcccggctgtgccacgtctctgggcaaggagatagttgcctggccacgggccccagagggctggggatggagcaggtggtac

SEQ ID NO: 48943 - DNA, 201 bp, Bos taurus; identical to SEQ ID NO: 7518

SEQ ID NO: 48944 - DNA, 201 bp, Bos taurus; identical to SEQ ID NO: 7519

SEQ ID NO: 48945 - DNA, 201 bp, Bos taurus; identical to SEQ ID NO: 7521

SEQ ID NO: 48946 - DNA, 201 bp, Bos taurus; identical to SEQ ID NO: 7522

SEQ ID NO: 48947 - DNA, 201 bp, Bos taurus; identical to SEQ ID NO: 7523

SEQ ID NO: 48948 - DNA, 201 bp, Bos taurus; identical to SEQ ID NO: 7524

SEQ ID NO: 48949 - DNA, 201 bp, Bos taurus; identical to SEQ ID NO: 7525

SEQ ID NO: 48950 - DNA, 201 bp, Bos taurus; identical to SEQ ID NO: 7526

SEQ ID NO: 48951 - DNA, 201 bp, Bos taurus; identical to SEQ ID NO: 7527

SEQ ID NO: 48952 - DNA, 201 bp, Bos taurus; identical to SEQ ID NO: 7528

SEQ ID NO: 48953 - DNA, 201 bp, Bos taurus; identical to SEQ ID NO: 7529

SEQ ID NO: 48954 - DNA, 201 bp, Bos taurus; identical to SEQ ID NO: 7530

SEQ ID NO: 48955 - DNA, 201 bp, Bos taurus
tggctgtgtaagctactcagtctatggtgttttgttacagtaacctgaaccaactctgagcctcagtttcctggtgggccacatagggataccctccctgcctagagcagaggaataatctcagagatagtgtgatgaaggtgggtcatcttaaaaattgtttaaaggtcaaacttgggccagaagtcactgatgaaccac

SEQ ID NO: 48956 - DNA, 201 bp, Bos taurus; identical to SEQ ID NO: 7531

SEQ ID NO: 48957 - DNA, 201 bp, Bos taurus; identical to SEQ ID NO: 7532

SEQ ID NO: 48958 - DNA, 201 bp, Bos taurus
catccgtctttgtcatcacaatccgggtgtctgccctgtgtgctgggtaccttgcagagccagcagaccagccccaggcatgccctctgggtacttagactgaagaggggactgtagagactacccgaactagacagtggagataaaagaggggcagatcaggtaaaggtaagcatttcatgtgtctaactgaaaccttgt

SEQ ID NO: 48959 - DNA, 201 bp, Bos taurus; identical to SEQ ID NO: 7534

SEQ ID NO: 48960 - DNA, 201 bp, Bos taurus
tattacagacctctgggaacagccccatcccaccccttccaagaggagaatgaagcatggatgcagaaaaaactggccctggtgaactgaggcatggtccatgggaaaacctctgggctagggatcaagagagctggatcttcgcccaagccttcccggacctggcctcttctgtagaagggcgggttggatcagatgaac

SEQ ID NO: 48961 - DNA, 201 bp, Bos taurus
tccgaggggcctgtgggcgctggggcgtccggcccccaggctcgcggtggcgaaacgaggaggtcccgagccgtgggccccgcagtgcgagtcggggcgctggagcaaacgttgctgctgcttctcgttgtactttgctctgctccccaccacttttctgacctaccagcaccgaggcctcagacatttacccagtggaga

SEQ ID NO: 48962 - DNA, 201 bp, Bos taurus; identical to SEQ ID NO: 7538

SEQ ID NO: 48963 - DNA, 201 bp, Bos taurus
aaaagataataataatgacaataataataggtttatacccatcttatagtcaagcaaactgcagctcgggcaaatgactcggccacgaccacatcagtaactgggagatctggaattggagcccagatcgtcctgtcatagaagcccaggctgcttgctgccttcctgccagagcctccagagtaggagttgtggggaggc

SEQ ID NO: 48964 - DNA, 201 bp, Bos taurus; identical to SEQ ID NO: 7539

SEQ ID NO: 48965 - DNA, 201 bp, Bos taurus
tcaaatatctgctgtaccccaccccccagctcctagggcctggcccctatcagaggagcccatttggtgtctgtggctgctctgaggcctcctctacacttggggtccagaaacctctcagttctttgttttcctaaatgaagctcaacctgaatctacatgcctcctaaacctgtttataaaggccaattttgtgtattt

SEQ ID NO: 48966 - DNA, 201 bp, Bos taurus
attaagtcttgcacagcttttgtcaaatttatccctaagtatttcttatttttgataacacgccatttttaaagaattatatcagcaaaaatactgccagctcaggctgaaagggacagagacagtaaaaaaatgaaaagaagtttttgcactcctagaattctgctggtagggagcaggctgataaaacggctcagcaca

SEQ ID NO: 48967 - DNA, 201 bp, Bos taurus; identical to SEQ ID NO: 7540

SEQ ID NO: 48968 - DNA, 201 bp, Bos taurus; identical to SEQ ID NO: 7541

SEQ ID NO: 48969 - DNA, 201 bp, Bos taurus; identical to SEQ ID NO: 7542

SEQ ID NO: 48970 - DNA, 201 bp, Bos taurus; identical to SEQ ID NO: 7544

SEQ ID NO: 48971 - DNA, 201 bp, Bos taurus
gcacacacacacacacccactcctttcccttcacagtggcccactacaatttccctgtgccctctcctccaccacactgctctggtcctggggctgccctgtcagcataggccctagaatgactggcggagcctctgaaaacaccttgccctctcgatgggccatttcctggccaattaccctgtgtaggaacacttagat

SEQ ID NO: 48972 - DNA, 201 bp, Bos taurus
ccaggaacccagagtgtgcggcttccagccagtcccgcccccacaaggcggaagcttcagtcttgctgtccccacacggagccaggtggacacttctgagcaccttcgcgaaggctctgtggccccctcgcctcccacacgacctcacctctgtatgctgatgcggccagcaggccccacccgcccagccaccttcatttg

SEQ ID NO: 48973 - DNA, 201 bp, Bos taurus
agtacattaattttctccttaggtttgtctaatcctaccattaattccatacattgagtttttgtttgtcaattatggtatttttcatcatatctagaatttctcctttgtccttttcatggtttctagttctttgatgaagttttgagggaatacaaagagttactcagtgcattgtcaagcaggtagactcttgcccta

SEQ ID NO: 48974 - DNA, 201 bp, Bos taurus; identical to SEQ ID NO: 7545

SEQ ID NO: 48975 - DNA, 201 bp, Bos taurus
gacttttcacagccaaggctttcttctccttcactgcagaatccagtgcaagctgggtggctttgttctgtgtcatgagtccttcatcctggagctagacgttctctgtctcctccgagggagaaaatagggctgctggaagacatggatatttttaaggctcaaggctgggatagctagcctcgcttccacttacattcc

SEQ ID NO: 48976 - DNA, 201 bp, Bos taurus
agtccctggcccactccctgagagcgtgatcctgcaggcctgccggggggcccaggaacctgaatttccacagacaccccaggtgacactttgaggatccgtgctctggagttcaagcttgcaggcctccaccccagcctcattttcaaaagttttcctcctccactccccatctccattggccctgaaccacccatctga

SEQ ID NO: 48977 - DNA, 201 bp, Bos taurus; identical to SEQ ID NO: 7547

SEQ ID NO: 48978 - DNA, 201 bp, Bos taurus; identical to SEQ ID NO: 7548

SEQ ID NO: 48979 - DNA, 201 bp, Bos taurus
ttatcaggagggtttagtcagcattaaatttatccttatcctcatgattttaggaaaccaggtgaaaaaaagacaaggcttggccaacaagctcaagggctgatatacttaggtagctatggcccactcatccatccagccatttattttatacctcatcttcttccccaaattctttgaggcagatataacaaaactaaa

SEQ ID NO: 48980 - DNA, 201 bp, Bos taurus
acttgatttagtcattcattacagggaatggaactcagagaggggaggagttgtggggaccccaggggtctcgggggcctcactatgggcccctgatgtaggagcagaagaaactcaggatctgggtgagaagacctgagctctgtcagcttccctgagcctttaagcctcactttccccatatgtgagcagaggttcaat

SEQ ID NO: 48981 - DNA, 201 bp, Bos taurus; identical to SEQ ID NO: 7549

SEQ ID NO: 48982 - DNA, 201 bp, Bos taurus
gcaccaccaagggggtgggagaccacctaagccgccccttcacctgacccagacccactgattcaccccacctttatgccacttaaggaaggaggccgccctcctcagagagtggagagcaagcaagggcgcctgttgcctgtttttgacccatctgcagcatgagtcccaggaaagccgagcctgaatttcttgtctggc

SEQ ID NO: 48983 - DNA, 201 bp, Bos taurus; identical to SEQ ID NO: 7550

SEQ ID NO: 48984 - DNA, 201 bp, Bos taurus
ctctctctggaggttgagatctagagagccagactacaaggcctaaaccagtgcttctcaaacttgaatgtgcacacctgaaccttgttagaaaggaatctgtgggtctagggcagggcctgcatttctaaccatctcctgggtgatggtgatgctgttggtctgggggctgcactttcaacagtggatccaaggcagcgc

SEQ ID NO: 48985 - DNA, 201 bp, Bos taurus
atggctctgtcctggagctgctgctcctttcactggacgtgacctacctaggtgactccctgatcatccagtcactgtggtcaccacccttccttgctcatggcccccaaacctctctctctttagtcctgggtcccaccctgggtgtcatactcacgcctccactctccagtctagtgcgtttctccccacatggtccac

SEQ ID NO: 48986 - DNA, 201 bp, Bos taurus; identical to SEQ ID NO: 7552

SEQ ID NO: 48987 - DNA, 201 bp, Bos taurus; identical to SEQ ID NO: 7554

SEQ ID NO: 48988 - DNA, 201 bp, Bos taurus
ttatagatgagagaaagagttcagagaggttaagtaaccagcagaaggccacacagccaacagatgtggaagccaggattaaacccatgcctctctgacttcttgctcctcctgtcctcaggccaggaactttgggtctcataagacttctgggaaagggcatttgaactgcagtgacaagtcatcaactcaatggacatg

SEQ ID NO: 48989 - DNA, 201 bp, Bos taurus; identical to SEQ ID NO: 7556

SEQ ID NO: 48990 - DNA, 201 bp, Bos taurus; identical to SEQ ID NO: 7558

SEQ ID NO: 48991 - DNA, 201 bp, Bos taurus
ttctttgcccatgcagaaatatgaacatttgagcactgtttgccaatatagagcgaccagcacctgaggcacagcatttctggggcctcagccatttagcttgggtgcccccgtggtctctgtttggttggaactccagtgtctccgagctctctacgctaataggtacactttcacctcatggcccctcagtggttataa

SEQ ID NO: 48992 - DNA, 201 bp, Bos taurus; identical to SEQ ID NO: 7559

SEQ ID NO: 48993 - DNA, 201 bp, Bos taurus; identical to SEQ ID NO: 7560

SEQ ID NO: 48994 - DNA, 201 bp, Bos taurus
atgggcttcgggaactgacctgtggtctccactgtgcctcagtggatggagggccatggagcatggagcagtttagtgttaccgaccacgagtgagcaatgcattgaatgatgataccataccattactttgcctgggaaacagtgggtgcccagtgactgttttctgaattttgatatgagtaacagctgtgaacttgag

SEQ ID NO: 48995 - DNA, 201 bp, Bos taurus; identical to SEQ ID NO: 7561

SEQ ID NO: 48996 - DNA, 201 bp, Bos taurus
aatttcttgacaagggaagaaaagcaaaggcctcattaaggtttagatgttctaagccagcttccgaggtgcttgggacacaagtgtgacaatggcagatggaagtcactctggccacataaaggactcagtcctcctctttcccaagggcactagagtggaaacaaagcaaagaccccaaaaggctcctcaagcaccttt

SEQ ID NO: 48997 - DNA, 201 bp, Bos taurus; identical to SEQ ID NO: 7562

SEQ ID NO: 48998 - DNA, 201 bp, Bos taurus
taaaaaaacaaaacagaagctgctccttctcttggtcatcctcatcacccttttagagcaagtaagaacagagtgcagggccagacctactccttaggaaacccaaaataatgttcagttcagttcagttcagtcgcttagtcatgtctgactctttgcaaacccatggactgcagctcaacaggcctccctgtccatcac

SEQ ID NO: 48999 - DNA, 201 bp, Bos taurus; identical to SEQ ID NO: 7564

SEQ ID NO: 49000 - DNA, 201 bp, Bos taurus; identical to SEQ ID NO: 7565

SEQ ID NO: 49001 - DNA, 201 bp, Bos taurus; identical to SEQ ID NO: 7566

SEQ ID NO: 49002 - DNA, 201 bp, Bos taurus; identical to SEQ ID NO: 7567

SEQ ID NO: 49003 - DNA, 201 bp, Bos taurus; identical to SEQ ID NO: 7569

SEQ ID NO: 49004 - DNA, 201 bp, Bos taurus
tggccaacccagtgtttactcatcgtcctcttttcctccccagcgcttttatcccacccagtcctgtctgttctaatgtgttagccagtaactaccacctgtgtgtctaggacagggccctgccgtgttctgattagtcggaatgttctcatgtgaggtgcctgttgcagaccctgagctgacgggtcacatgcaagagat

SEQ ID NO: 49005 - DNA, 201 bp, Bos taurus; identical to SEQ ID NO: 7571

SEQ ID NO: 49006 - DNA, 201 bp, Bos taurus
tttctagaaaggtttgtaacagatgggtttatcttaatggacaatgtcaccatcaaactccattagtctaaaagacccatttccacactagggccagtcagcaaaaccaggacacttgtgcagcctggttagatcattcccttctctggacaatatcaggaacacagaacacaaatgtttttggccacagtaattggaaaa

SEQ ID NO: 49007 - DNA, 201 bp, Bos taurus
tattttccatgggtgcaacctgtacgattttcagtattctcagcagccgtgtaaggataaactgctttctcctaagtttgggtggcctggttctacctcacgattactaagtggtttacaatcacaacctccagctcccggttcaccagcgaagagatgtgatttcctggtacgaaaacgcgaggtggcccgcaaacgcag

SEQ ID NO: 49008 - DNA, 201 bp, Bos taurus
cttaagttttatgagttctggatcccctcactttcagggaccccttttagggtctggagagtctctgacaacgtgttcagtgcttatatatatatttttgtaaagtctgcaaaattgagactttcttccctattctttttcttacaaaagacccccatattatatatttttcaaaccctgcaaagttcagatcagccctag

SEQ ID NO: 49009 - DNA, 201 bp, Bos taurus; identical to SEQ ID NO: 7572

SEQ ID NO: 49010 - DNA, 201 bp, Bos taurus; identical to SEQ ID NO: 7573

SEQ ID NO: 49011 - DNA, 201 bp, Bos taurus
ttagtttcccaggccttgaggaggggagagggtggccctgctccagggtccctggctggctgtgccacctgcttgcttgaacgtggtgaggagaatgctgcagaacaaaggccctctattgtattgcctgggattttcctcacctaagtaatgttgagtgccccccccctgctgccaaagatcagggagactcttggtgac

SEQ ID NO: 49012 - DNA, 201 bp, Bos taurus; identical to SEQ ID NO: 7574

SEQ ID NO: 49013 - DNA, 201 bp, Bos taurus; identical to SEQ ID NO: 7575

SEQ ID NO: 49014 - DNA, 201 bp, Bos taurus; identical to SEQ ID NO: 7577

SEQ ID NO: 49015 - DNA, 201 bp, Bos taurus
gagccctgggtgtgctctgcctttttacagttctccccaccccctctgcatcttaaccagaggttaagacactccctccacccaggaactccaggtcttcggagggctacctcctggtccttgtgcagtttctgtatcccaggacctctccccttataggcttctaattccagcagcaaaacccctggcattgctcaggtg

SEQ ID NO: 49016 - DNA, 201 bp, Bos taurus; identical to SEQ ID NO: 7580

SEQ ID NO: 49017 - DNA, 201 bp, Bos taurus
aagatgttccaattgcaacctttcactcactctaagagccggttaaagctgattgaggtaaagggtcagtggagatcctacagaggcccagcagaggccagaattttgcagcgaagttaagagtcggtaggaaaacaggacttctctggtagtccagtggctaagactctgagctcccaatgtagggggcctgaagttcta

SEQ ID NO: 49018 - DNA, 201 bp, Bos taurus; identical to SEQ ID NO: 7582

SEQ ID NO: 49019 - DNA, 201 bp, Bos taurus; identical to SEQ ID NO: 7583

SEQ ID NO: 49020 - DNA, 201 bp, Bos taurus; identical to SEQ ID NO: 7584

SEQ ID NO: 49021 - DNA, 201 bp, Bos taurus; identical to SEQ ID NO: 7586

SEQ ID NO: 49022 - DNA, 201 bp, Bos taurus; identical to SEQ ID NO: 7587

SEQ ID NO: 49023 - DNA, 201 bp, Bos taurus; identical to SEQ ID NO: 7588

SEQ ID NO: 49024 - DNA, 201 bp, Bos taurus; identical to SEQ ID NO: 7589

SEQ ID NO: 49025 - DNA, 201 bp, Bos taurus; identical to SEQ ID NO: 7590

SEQ ID NO: 49026 - DNA, 201 bp, Bos taurus; identical to SEQ ID NO: 7591

SEQ ID NO: 49027 - DNA, 201 bp, Bos taurus; identical to SEQ ID NO: 7592

SEQ ID NO: 49028 - DNA, 201 bp, Bos taurus; identical to SEQ ID NO: 7593

SEQ ID NO: 49029 - DNA, 201 bp, Bos taurus; identical to SEQ ID NO: 7594

SEQ ID NO: 49030 - DNA, 201 bp, Bos taurus; identical to SEQ ID NO: 7595

SEQ ID NO: 49031 - DNA, 201 bp, Bos taurus; identical to SEQ ID NO: 7596

SEQ ID NO: 49032 - DNA, 201 bp, Bos taurus; identical to SEQ ID NO: 7597

SEQ ID NO: 49033 - DNA, 201 bp, Bos taurus; identical to SEQ ID NO: 7598

SEQ ID NO: 49034 - DNA, 201 bp, Bos taurus; identical to SEQ ID NO: 7599

SEQ ID NO: 49035 - DNA, 201 bp, Bos taurus; identical to SEQ ID NO: 7600

SEQ ID NO: 49036 - DNA, 201 bp, Bos taurus; identical to SEQ ID NO: 7601

SEQ ID NO: 49037 - DNA, 201 bp, Bos taurus; identical to SEQ ID NO: 7602

SEQ ID NO: 49038 - DNA, 201 bp, Bos taurus; identical to SEQ ID NO: 7603

SEQ ID NO: 49039 - DNA, 201 bp, Bos taurus; identical to SEQ ID NO: 7604

SEQ ID NO: 49040 - DNA, 201 bp, Bos taurus; identical to SEQ ID NO: 7605

SEQ ID NO: 49041 - DNA, 201 bp, Bos taurus; identical to SEQ ID NO: 7606

SEQ ID NO: 49042 - DNA, 201 bp, Bos taurus; identical to SEQ ID NO: 7607

SEQ ID NO: 49043 - DNA, 201 bp, Bos taurus; identical to SEQ ID NO: 7608

SEQ ID NO: 49044 - DNA, 201 bp, Bos taurus; identical to SEQ ID NO: 7609

SEQ ID NO: 49045 - DNA, 201 bp, Bos taurus; identical to SEQ ID NO: 7610

SEQ ID NO: 49046 - DNA, 201 bp, Bos taurus; identical to SEQ ID NO: 7611

SEQ ID NO: 49047 - DNA, 201 bp, Bos taurus; identical to SEQ ID NO: 7612

SEQ ID NO: 49048 - DNA, 201 bp, Bos taurus; identical to SEQ ID NO: 7614

SEQ ID NO: 49049 - DNA, 201 bp, Bos taurus; identical to SEQ ID NO: 7615

SEQ ID NO: 49050 - DNA, 201 bp, Bos taurus; identical to SEQ ID NO: 7616

SEQ ID NO: 49051 - DNA, 201 bp, Bos taurus; identical to SEQ ID NO: 7617

SEQ ID NO: 49052 - DNA, 201 bp, Bos taurus; identical to SEQ ID NO: 7618

SEQ ID NO: 49053 - DNA, 201 bp, Bos taurus; identical to SEQ ID NO: 7619

SEQ ID NO: 49054 - DNA, 201 bp, Bos taurus; identical to SEQ ID NO: 7620

SEQ ID NO: 49055 - DNA, 201 bp, Bos taurus; identical to SEQ ID NO: 7621

SEQ ID NO: 49056 - DNA, 201 bp, Bos taurus; identical to SEQ ID NO: 7622

SEQ ID NO: 49057 - DNA, 201 bp, Bos taurus; identical to SEQ ID NO: 7623

SEQ ID NO: 49058 - DNA, 201 bp, Bos taurus; identical to SEQ ID NO: 7624

SEQ ID NO: 49059 - DNA, 201 bp, Bos taurus; identical to SEQ ID NO: 7625

SEQ ID NO: 49060 - DNA, 201 bp, Bos taurus; identical to SEQ ID NO: 7626

SEQ ID NO: 49061 - DNA, 201 bp, Bos taurus; identical to SEQ ID NO: 7627

SEQ ID NO: 49062 - DNA, 201 bp, Bos taurus; identical to SEQ ID NO: 7628

SEQ ID NO: 49063 - DNA, 201 bp, Bos taurus; identical to SEQ ID NO: 7629

SEQ ID NO: 49064 - DNA, 201 bp, Bos taurus; identical to SEQ ID NO: 7631

SEQ ID NO: 49065 - DNA, 201 bp, Bos taurus; identical to SEQ ID NO: 7632

SEQ ID NO: 49066 - DNA, 201 bp, Bos taurus; identical to SEQ ID NO: 7633

SEQ ID NO: 49067 - DNA, 201 bp, Bos taurus
atgtgaaagagagagggctcaagatgacttgcagttttcttggtttgaacaactgagtggtggttggcgacaattctcagataggaaagaagaattaggataagttagggctgtgcatcagagtctagttttacccctgttaacttgaaagttaactaaaaagcctctagatgaaggtgaaagaggagagtgaaaaaactg

SEQ ID NO: 49068 - DNA, 201 bp, Bos taurus; identical to SEQ ID NO: 7635

SEQ ID NO: 49069 - DNA, 201 bp, Bos taurus; identical to SEQ ID NO: 7636

SEQ ID NO: 49070 - DNA, 201 bp, Bos taurus; identical to SEQ ID NO: 7637

SEQ ID NO: 49071 - DNA, 201 bp, Bos taurus; identical to SEQ ID NO: 7638

SEQ ID NO: 49072 - DNA, 201 bp, Bos taurus; identical to SEQ ID NO: 7639

SEQ ID NO: 49073 - DNA, 201 bp, Bos taurus; identical to SEQ ID NO: 7640

SEQ ID NO: 49074 - DNA, 201 bp, Bos taurus; identical to SEQ ID NO: 7641

SEQ ID NO: 49075 - DNA, 201 bp, Bos taurus; identical to SEQ ID NO: 7642

SEQ ID NO: 49076 - DNA, 201 bp, Bos taurus; identical to SEQ ID NO: 7643

SEQ ID NO: 49077 - DNA, 201 bp, Bos taurus; identical to SEQ ID NO: 7644

SEQ ID NO: 49078 - DNA, 201 bp, Bos taurus; identical to SEQ ID NO: 7645

SEQ ID NO: 49079 - DNA, 201 bp, Bos taurus; identical to SEQ ID NO: 7646

SEQ ID NO: 49080 - DNA, 201 bp, Bos taurus
cagaaactttgcagaccacaagagaatagcatgacatagtcaaagtgctgaaagaaaaactctgtaacctaggacactcctcagacaagcaaaatctaacgtcgtcactttctcaaaactaaacttgctcttaaagaaatgttgaagggtctcctctaagtggcaaagaaggcagaagctataagaaagggaaaatcctac

SEQ ID NO: 49081 - DNA, 201 bp, Bos taurus; identical to SEQ ID NO: 7647

SEQ ID NO: 49082 - DNA, 201 bp, Bos taurus; identical to SEQ ID NO: 7648

SEQ ID NO: 49083 - DNA, 201 bp, Bos taurus; identical to SEQ ID NO: 7649

SEQ ID NO: 49084 - DNA, 201 bp, Bos taurus; identical to SEQ ID NO: 7651

SEQ ID NO: 49085 - DNA, 201 bp, Bos taurus; identical to SEQ ID NO: 7652

SEQ ID NO: 49086 - DNA, 201 bp, Bos taurus; identical to SEQ ID NO: 7653

SEQ ID NO: 49087 - DNA, 201 bp, Bos taurus; identical to SEQ ID NO: 7654

SEQ ID NO: 49088 - DNA, 201 bp, Bos taurus; identical to SEQ ID NO: 7655

SEQ ID NO: 49089 - DNA, 201 bp, Bos taurus; identical to SEQ ID NO: 7656

SEQ ID NO: 49090 - DNA, 201 bp, Bos taurus; identical to SEQ ID NO: 7657

SEQ ID NO: 49091 - DNA, 201 bp, Bos taurus; identical to SEQ ID NO: 7658

SEQ ID NO: 49092 - DNA, 201 bp, Bos taurus; identical to SEQ ID NO: 7659

SEQ ID NO: 49093 - DNA, 201 bp, Bos taurus; identical to SEQ ID NO: 7660

SEQ ID NO: 49094 - DNA, 201 bp, Bos taurus; identical to SEQ ID NO: 7661

SEQ ID NO: 49095 - DNA, 201 bp, Bos taurus; identical to SEQ ID NO: 7662

SEQ ID NO: 49096 - DNA, 201 bp, Bos taurus; identical to SEQ ID NO: 7663

SEQ ID NO: 49097 - DNA, 201 bp, Bos taurus; identical to SEQ ID NO: 7665

SEQ ID NO: 49098 - DNA, 201 bp, Bos taurus; identical to SEQ ID NO: 7666

SEQ ID NO: 49099 - DNA, 201 bp, Bos taurus; identical to SEQ ID NO: 7667

SEQ ID NO: 49100 - DNA, 201 bp, Bos taurus; identical to SEQ ID NO: 7668

SEQ ID NO: 49101 - DNA, 201 bp, Bos taurus; identical to SEQ ID NO: 7669

SEQ ID NO: 49102 - DNA, 201 bp, Bos taurus; identical to SEQ ID NO: 7670

SEQ ID NO: 49103 - DNA, 201 bp, Bos taurus; identical to SEQ ID NO: 7671

SEQ ID NO: 49104 - DNA, 201 bp, Bos taurus; identical to SEQ ID NO: 7672

SEQ ID NO: 49105 - DNA, 201 bp, Bos taurus; identical to SEQ ID NO: 7673

SEQ ID NO: 49106 - DNA, 201 bp, Bos taurus; identical to SEQ ID NO: 7674

SEQ ID NO: 49107 - DNA, 201 bp, Bos taurus; identical to SEQ ID NO: 7675

SEQ ID NO: 49108 - DNA, 201 bp, Bos taurus; identical to SEQ ID NO: 7677

SEQ ID NO: 49109 - DNA, 201 bp, Bos taurus; identical to SEQ ID NO: 7678

SEQ ID NO: 49110 - DNA, 201 bp, Bos taurus; identical to SEQ ID NO: 7679

SEQ ID NO: 49111 - DNA, 201 bp, Bos taurus; identical to SEQ ID NO: 7680

SEQ ID NO: 49112 - DNA, 201 bp, Bos taurus; identical to SEQ ID NO: 7681

SEQ ID NO: 49113 - DNA, 201 bp, Bos taurus; identical to SEQ ID NO: 7682

SEQ ID NO: 49114 - DNA, 201 bp, Bos taurus; identical to SEQ ID NO: 7683

SEQ ID NO: 49115 - DNA, 201 bp, Bos taurus; identical to SEQ ID NO: 7684

SEQ ID NO: 49116 - DNA, 201 bp, Bos taurus
ggaataaataacttagaaccaagaattgaagtacttttacttttggggttccctttcccttttattgtagggccaaggcagggtcacatagcatttattcaagttattcaaatattgtagtcttttctatttgagtatctccactccacctgccatgtgcggtgaaaaaaacccatgaatattgggatcaggtggatacag

SEQ ID NO: 49117 - DNA, 201 bp, Bos taurus
aagtgaaatattagggaattggaattagagcatctgtatgaaattaagaatacatataccatagtattttttcccttagcttactgaatatgaagttaaaccttataaaaagcacctaagaaacaaaagaaacttgaaaagggtctagtatttctaataataggctgcttctattacaagttagttatctacgttaaatct

SEQ ID NO: 49118 - DNA, 201 bp, Bos taurus; identical to SEQ ID NO: 7685

SEQ ID NO: 49119 - DNA, 201 bp, Bos taurus
acagcagagtattcacacatactctgagttcctgatcctctggttcaaccatggtgttgcctccacccttattctagaggcttgttgcgcctcttttctttgattgtgctataagacagaaatagacccacaccacacattcctcctcattcagcctcttccttcaatggtccaattctgataacaaaactctgccccttg

SEQ ID NO: 49120 - DNA, 201 bp, Bos taurus
ggaggagactgccaacattcttgacctagttcagtcaattggcaagtggatcagagagaagtcttaatatattgtgaataagctcttcttatttcaaaaaggatccctgggaagacatcataaaagcctttcgatttaccttctcatggaggtctgctatagttaagagtctgtctacagcattttaaaaaggaagcaaat

SEQ ID NO: 49121 - DNA, 201 bp, Bos taurus
ctaatctcccccaaccccagagggtcttaccttcaaggccagatctagttaagagtgctacctaccaaccagcaccttattctcctggcctgtcaaaactgaacttcagagtctgaggtcctttgggaacaatctaaaatctgtgattcctaattccaactccagtctaactaccagtgttccttcttcaaagaactcgag

SEQ ID NO: 49122 - DNA, 201 bp, Bos taurus; identical to SEQ ID NO: 7688

SEQ ID NO: 49123 - DNA, 201 bp, Bos taurus
aattggtaccatcccagaaaagcctcatggaaatagtacacagtggattgattgcttccttggttcattctcttccctcttggccccagagtgctttcgattggtgtggcttccacaccagccctcattcgtcttagctctccctgtagctgcacagaccgtaaaaatcactattcgtttgtgaaaatggccaacctatgc

SEQ ID NO: 49124 - DNA, 201 bp, Bos taurus; identical to SEQ ID NO: 7690

SEQ ID NO: 49125 - DNA, 201 bp, Bos taurus; identical to SEQ ID NO: 7691

SEQ ID NO: 49126 - DNA, 201 bp, Bos taurus; identical to SEQ ID NO: 7692

SEQ ID NO: 49127 - DNA, 201 bp, Bos taurus; identical to SEQ ID NO: 7693

SEQ ID NO: 49128 - DNA, 201 bp, Bos taurus; identical to SEQ ID NO: 7694

SEQ ID NO: 49129 - DNA, 201 bp, Bos taurus; identical to SEQ ID NO: 7695

SEQ ID NO: 49130 - DNA, 201 bp, Bos taurus; identical to SEQ ID NO: 7697

SEQ ID NO: 49131 - DNA, 201 bp, Bos taurus; identical to SEQ ID NO: 7698

SEQ ID NO: 49132 - DNA, 201 bp, Bos taurus; identical to SEQ ID NO: 7699

SEQ ID NO: 49133 - DNA, 201 bp, Bos taurus; identical to SEQ ID NO: 7701

SEQ ID NO: 49134 - DNA, 201 bp, Bos taurus; identical to SEQ ID NO: 7702

SEQ ID NO: 49135 - DNA, 201 bp, Bos taurus; identical to SEQ ID NO: 7703

SEQ ID NO: 49136 - DNA, 201 bp, Bos taurus; identical to SEQ ID NO: 7704

SEQ ID NO: 49137 - DNA, 201 bp, Bos taurus; identical to SEQ ID NO: 7706

SEQ ID NO: 49138 - DNA, 201 bp, Bos taurus; identical to SEQ ID NO: 7707

SEQ ID NO: 49139 - DNA, 201 bp, Bos taurus; identical to SEQ ID NO: 7709

SEQ ID NO: 49140 - DNA, 201 bp, Bos taurus
aaagaaactctcaagagagctgctatattatctggtaaaccaacacctgccttgggatgtggttatggaaactggaaggaaaggccttgacagacagccagtcatgggtcagctgggttgttaaagggcacacctgcagtgggggctggagctgccaaccatgcaggagcctgggaaggtgggaaggcccatgtgtggggg

SEQ ID NO: 49141 - DNA, 201 bp, Bos taurus; identical to SEQ ID NO: 7712

SEQ ID NO: 49142 - DNA, 201 bp, Bos taurus; identical to SEQ ID NO: 7713

SEQ ID NO: 49143 - DNA, 201 bp, Bos taurus; identical to SEQ ID NO: 7714

SEQ ID NO: 49144 - DNA, 201 bp, Bos taurus; identical to SEQ ID NO: 7715

SEQ ID NO: 49145 - DNA, 201 bp, Bos taurus
cttgaatctaaataaaagcattggcttgttggggccacacattggtaccatactcagggtgaagcctggcccccagtaagaactcttagcaagtgggctccgacttatgtagggtgctaagtcacttcagtcatgtccgagtctttgcgaccctgtggactatagcctgccaggctcctctgtccatggaattctctcagg

SEQ ID NO: 49146 - DNA, 201 bp, Bos taurus; identical to SEQ ID NO: 7716

SEQ ID NO: 49147 - DNA, 201 bp, Bos taurus; identical to SEQ ID NO: 7717

SEQ ID NO: 49148 - DNA, 201 bp, Bos taurus; identical to SEQ ID NO: 7718

SEQ ID NO: 49149 - DNA, 201 bp, Bos taurus
agacagagccaatatttcagggaaaaaagtggaaattggtgtgggcttatgcctcaaccagaccctgtgccaatagcttggaaaaagctctcctgtgtttcgagacaaatgtacatcaataataatcacaatgtgtgatggactttatgatctaagcactttcagagccttttgaagattcaggacttatgtattgctggg

SEQ ID NO: 49150 - DNA, 201 bp, Bos taurus; identical to SEQ ID NO: 7719

SEQ ID NO: 49151 - DNA, 201 bp, Bos taurus; identical to SEQ ID NO: 7720

SEQ ID NO: 49152 - DNA, 201 bp, Bos taurus; identical to SEQ ID NO: 7721

SEQ ID NO: 49153 - DNA, 201 bp, Bos taurus; identical to SEQ ID NO: 7722

SEQ ID NO: 49154 - DNA, 201 bp, Bos taurus; identical to SEQ ID NO: 7723

SEQ ID NO: 49155 - DNA, 201 bp, Bos taurus; identical to SEQ ID NO: 7724

SEQ ID NO: 49156 - DNA, 201 bp, Bos taurus; identical to SEQ ID NO: 7725

SEQ ID NO: 49157 - DNA, 201 bp, Bos taurus; identical to SEQ ID NO: 7726

SEQ ID NO: 49158 - DNA, 201 bp, Bos taurus; identical to SEQ ID NO: 7727

SEQ ID NO: 49159 - DNA, 201 bp, Bos taurus; identical to SEQ ID NO: 7728

SEQ ID NO: 49160 - DNA, 201 bp, Bos taurus
aggacagaacatgttttatttgttagcttgctttatcatatttagacatatgttttgtaagcctccatttgtgctcttgtcttggggcctaccacaccccgctccccttctagaaaagccttcacagcccacacagctcagtggtccagctgagcccacatgctgaatggccttgcatctgtcttacttttcagactgccc

SEQ ID NO: 49161 - DNA, 201 bp, Bos taurus; identical to SEQ ID NO: 7729

SEQ ID NO: 49162 - DNA, 201 bp, Bos taurus; identical to SEQ ID NO: 7730

SEQ ID NO: 49163 - DNA, 201 bp, Bos taurus; identical to SEQ ID NO: 7732

SEQ ID NO: 49164 - DNA, 201 bp, Bos taurus; identical to SEQ ID NO: 7733

SEQ ID NO: 49165 - DNA, 201 bp, Bos taurus; identical to SEQ ID NO: 7734

SEQ ID NO: 49166 - DNA, 201 bp, Bos taurus; identical to SEQ ID NO: 7736

SEQ ID NO: 49167 - DNA, 201 bp, Bos taurus; identical to SEQ ID NO: 7737

SEQ ID NO: 49168 - DNA, 201 bp, Bos taurus; identical to SEQ ID NO: 7738

SEQ ID NO: 49169 - DNA, 201 bp, Bos taurus; identical to SEQ ID NO: 7739

SEQ ID NO: 49170 - DNA, 201 bp, Bos taurus; identical to SEQ ID NO: 7740

SEQ ID NO: 49171 - DNA, 201 bp, Bos taurus; identical to SEQ ID NO: 7741

SEQ ID NO: 49172 - DNA, 201 bp, Bos taurus; identical to SEQ ID NO: 7742

SEQ ID NO: 49173 - DNA, 201 bp, Bos taurus; identical to SEQ ID NO: 7743

SEQ ID NO: 49174 - DNA, 201 bp, Bos taurus; identical to SEQ ID NO: 7744

SEQ ID NO: 49175 - DNA, 201 bp, Bos taurus; identical to SEQ ID NO: 7745

SEQ ID NO: 49176 - DNA, 201 bp, Bos taurus; identical to SEQ ID NO: 7746

SEQ ID NO: 49177 - DNA, 201 bp, Bos taurus; identical to SEQ ID NO: 7747

SEQ ID NO: 49178 - DNA, 201 bp, Bos taurus; identical to SEQ ID NO: 7748

SEQ ID NO: 49179 - DNA, 201 bp, Bos taurus; identical to SEQ ID NO: 7749

SEQ ID NO: 49180 - DNA, 201 bp, Bos taurus; identical to SEQ ID NO: 7750

SEQ ID NO: 49181 - DNA, 201 bp, Bos taurus; identical to SEQ ID NO: 7751

SEQ ID NO: 49182 - DNA, 201 bp, Bos taurus; identical to SEQ ID NO: 7752

SEQ ID NO: 49183 - DNA, 201 bp, Bos taurus; identical to SEQ ID NO: 7753

SEQ ID NO: 49184 - DNA, 201 bp, Bos taurus; identical to SEQ ID NO: 7754

SEQ ID NO: 49185 - DNA, 201 bp, Bos taurus; identical to SEQ ID NO: 7756

SEQ ID NO: 49186 - DNA, 201 bp, Bos taurus; identical to SEQ ID NO: 7758

SEQ ID NO: 49187 - DNA, 201 bp, Bos taurus; identical to SEQ ID NO: 7759

SEQ ID NO: 49188 - DNA, 201 bp, Bos taurus
atattcaagaactcaagcaaagttggggtgtcaaagtgatggtgaatgtggtggcctcaaggtccttcttgttcccaaacatcattttcactgcctggcatagcagttcccttctcatagcattggccccagttccaacatgatagatgagtcagacaaaatctggtattataatttccagaaatgtgcattaaagatatt

SEQ ID NO: 49189 - DNA, 201 bp, Bos taurus; identical to SEQ ID NO: 7761

SEQ ID NO: 49190 - DNA, 201 bp, Bos taurus; identical to SEQ ID NO: 7762

SEQ ID NO: 49191 - DNA, 201 bp, Bos taurus
ggatgctctgaaccgggaaggggcctgaaaaatgccctcccttggctgcccttcctcatgaggcatattggtgtcacaggagggggacaactgcctgactgctgccaaagagagaagagatggcctttaaaatctaggctactgcaacctcctgggtagtcaatctggtgcctttcaagccatcagagagcatcttaaaga

SEQ ID NO: 49192 - DNA, 201 bp, Bos taurus; identical to SEQ ID NO: 7767

SEQ ID NO: 49193 - DNA, 201 bp, Bos taurus; identical to SEQ ID NO: 7769

SEQ ID NO: 49194 - DNA, 201 bp, Bos taurus; identical to SEQ ID NO: 7770

SEQ ID NO: 49195 - DNA, 201 bp, Bos taurus; identical to SEQ ID NO: 7771

SEQ ID NO: 49196 - DNA, 201 bp, Bos taurus
agcctccagggtccatgatagaggatgtacctgatgctatggaatgaggctaaaggacagtttgcatttccagtatgagacataggccagaaaactcttaccaggcatttctgggcttagttttgaaagatgcataagggcaaagcaagttgaagccaagaaagcagcatatgcaaaggccactgggaatcaaggatatgg

SEQ ID NO: 49197 - DNA, 201 bp, Bos taurus; identical to SEQ ID NO: 7773

SEQ ID NO: 49198 - DNA, 201 bp, Bos taurus; identical to SEQ ID NO: 7774

SEQ ID NO: 49199 - DNA, 201 bp, Bos taurus; identical to SEQ ID NO: 7775

SEQ ID NO: 49200 - DNA, 201 bp, Bos taurus
gagaatgaaataaaattcatcagacaggttttctgaatgggaagagtttccagatgttaaacaaagagatttgtaagacgtgattttgaggccgttttaccattcctatacatcactagccagcacatggttttcagtagcacactgatttgtttctaaaaacaaatctagattttcctattcctggattgagaatcagga

SEQ ID NO: 49201 - DNA, 201 bp, Bos taurus; identical to SEQ ID NO: 7778

SEQ ID NO: 49202 - DNA, 201 bp, Bos taurus
ctccctgctgaaaacccatggctcaccttcctaatgctattactcggagtcctgagcacgaccttgtgactggccaccttggcaggtttgggcagtggcagggggtgggggaggcgggggcagcattaccaggcctccaccccaggccagtccctggtgggcaggccctttcccattctttaactctctttttgtgacaaa

SEQ ID NO: 49203 - DNA, 201 bp, Bos taurus; identical to SEQ ID NO: 7779

SEQ ID NO: 49204 - DNA, 201 bp, Bos taurus; identical to SEQ ID NO: 7780

SEQ ID NO: 49205 - DNA, 201 bp, Bos taurus; identical to SEQ ID NO: 7781

SEQ ID NO: 49206 - DNA, 201 bp, Bos taurus; identical to SEQ ID NO: 7782

SEQ ID NO: 49207 - DNA, 201 bp, Bos taurus; identical to SEQ ID NO: 7783

SEQ ID NO: 49208 - DNA, 201 bp, Bos taurus; identical to SEQ ID NO: 7784

SEQ ID NO: 49209 - DNA, 201 bp, Bos taurus; identical to SEQ ID NO: 7785

SEQ ID NO: 49210 - DNA, 201 bp, Bos taurus; identical to SEQ ID NO: 7786

SEQ ID NO: 49211 - DNA, 201 bp, Bos taurus; identical to SEQ ID NO: 7787

SEQ ID NO: 49212 - DNA, 201 bp, Bos taurus; identical to SEQ ID NO: 7789

SEQ ID NO: 49213 - DNA, 201 bp, Bos taurus; identical to SEQ ID NO: 7791

SEQ ID NO: 49214 - DNA, 201 bp, Bos taurus; identical to SEQ ID NO: 7794

SEQ ID NO: 49215 - DNA, 201 bp, Bos taurus; identical to SEQ ID NO: 7795

SEQ ID NO: 49216 - DNA, 201 bp, Bos taurus; identical to SEQ ID NO: 7796

SEQ ID NO: 49217 - DNA, 201 bp, Bos taurus; identical to SEQ ID NO: 7797

SEQ ID NO: 49218 - DNA, 201 bp, Bos taurus; identical to SEQ ID NO: 7798

SEQ ID NO: 49219 - DNA, 201 bp, Bos taurus; identical to SEQ ID NO: 7801

SEQ ID NO: 49220 - DNA, 201 bp, Bos taurus; identical to SEQ ID NO: 7802

SEQ ID NO: 49221 - DNA, 201 bp, Bos taurus; identical to SEQ ID NO: 7805

SEQ ID NO: 49222 - DNA, 201 bp, Bos taurus; identical to SEQ ID NO: 7806

SEQ ID NO: 49223 - DNA, 201 bp, Bos taurus
caaattcactagcaaggaggaaatgaattgaagaaggcccagactgttaatgtctgaaggacagcacagaagtggaacacatggaacaggtgttcacaagatcagcaacaccagaatggcccttgctgtgtgaatgtacccattgtagatttgctgattatattcagattctgcttccaatttggttatgtgcatagttct

SEQ ID NO: 49224 - DNA, 201 bp, Bos taurus; identical to SEQ ID NO: 7807

SEQ ID NO: 49225 - DNA, 201 bp, Bos taurus; identical to SEQ ID NO: 7808

SEQ ID NO: 49226 - DNA, 201 bp, Bos taurus; identical to SEQ ID NO: 7809

SEQ ID NO: 49227 - DNA, 201 bp, Bos taurus; identical to SEQ ID NO: 7810

SEQ ID NO: 49228 - DNA, 201 bp, Bos taurus
agccttgacttatataaacagataaattttaaatggtattagaagaaccctaattcaagttcatcacaggagtggtgattcacagccccttactcagttttcagacccacagttacttgattaaggaagaaacttgtccctttgtgatgcaggcacaaatgtatggtataactcttctcccaagcttgcatgatctgcggt

SEQ ID NO: 49229 - DNA, 201 bp, Bos taurus; identical to SEQ ID NO: 7813

SEQ ID NO: 49230 - DNA, 201 bp, Bos taurus; identical to SEQ ID NO: 7815

SEQ ID NO: 49231 - DNA, 201 bp, Bos taurus
attcacccaaagatctggatttccttctgccagtcctggactacccgttgaatcaacaaagtgatacatatttaagctaaaactttacttgatggccaatatattggtcaaatttctcagggtcttttacctccctgctttgcttaccacaaaggttaaatctcctaagggccctggaggtagagatctagagcatattta

SEQ ID NO: 49232 - DNA, 201 bp, Bos taurus
gctttgtcttgtccggttttaactcacccctaagctagcagacaagccttgcacggaacatgcaggcggctgcagaatcacgggaataataattaaatcataatctgtgtgccagacgctgtacaagaatcttttcgacattttcgcaagttttttaggctcagagatgctctagtcatataggcagtaagtggtggagat

SEQ ID NO: 49233 - DNA, 201 bp, Bos taurus
tacagaaatccactgcttcttgccttcgatccactcctccactccagagagacgcttgtttttgtactgagacagttgctgataggccacaaactcgttcgtgaagaatttcatccccaccatctcagccaccattggacagtctgcccactcgacacccatcatgaaaaccatgggccttaagacataggagcagatgac

SEQ ID NO: 49234 - DNA, 201 bp, Bos taurus
atagaagaattccttattcttagggaatggctgctaaagtatttagagctgaagcatcatgacaactgaaacttgcatcaaatcgttaagggggggaaaaagctgaagggatagaacaaatgtggcaaaatgttaaaaagtggtgaatctaggtgaagggtatacagatttcccctgtactttcttacttgtacttacttg

SEQ ID NO: 49235 - DNA, 201 bp, Bos taurus; identical to SEQ ID NO: 7817

SEQ ID NO: 49236 - DNA, 201 bp, Bos taurus; identical to SEQ ID NO: 7818

SEQ ID NO: 49237 - DNA, 201 bp, Bos taurus
aagagggggaaggatcttggtggggaaggggacaggcttgagtgggatggtttcgtcagagggaaattcttcatccagcagctctgggtaatgggcctcaggtaacggaagctggtttagtctcttacctgttttgttgagggagacagaagacagatttaggagagagagtggaggatgctgcccccttattctggcccc

SEQ ID NO: 49238 - DNA, 201 bp, Bos taurus; identical to SEQ ID NO: 7819

SEQ ID NO: 49239 - DNA, 201 bp, Bos taurus; identical to SEQ ID NO: 7820

SEQ ID NO: 49240 - DNA, 201 bp, Bos taurus
atgactaaacacaacacaatagattcatctgttacataatacccccattaattgagttctgctcatacgccacgcttctgaagtgacttacagcgttatacattcacgtgggtcttacactatcccattttatgcatgcagagggtgttgttcagagacattaaacaatctgttcagcatcacacaactggcaataggcag

SEQ ID NO: 49241 - DNA, 201 bp, Bos taurus; identical to SEQ ID NO: 7821

SEQ ID NO: 49242 - DNA, 201 bp, Bos taurus; identical to SEQ ID NO: 7822

SEQ ID NO: 49243 - DNA, 201 bp, Bos taurus; identical to SEQ ID NO: 7823

SEQ ID NO: 49244 - DNA, 201 bp, Bos taurus; identical to SEQ ID NO: 7824

SEQ ID NO: 49245 - DNA, 201 bp, Bos taurus
tgatgattgggttcctgttcacccagagaatgtggctggcaaagataagcacaccagaacatgcacttcatgggaaagcatgaatccatccacctccaacaaataagaggctgtctttcctttcagtactcactctcaggggtttgatgttgatagattctgaagtatcctattctagagcataaaccaggtgctctcaag

SEQ ID NO: 49246 - DNA, 201 bp, Bos taurus; identical to SEQ ID NO: 7827

SEQ ID NO: 49247 - DNA, 201 bp, Bos taurus; identical to SEQ ID NO: 7828

SEQ ID NO: 49248 - DNA, 201 bp, Bos taurus; identical to SEQ ID NO: 7829

SEQ ID NO: 49249 - DNA, 201 bp, Bos taurus
ctgggcctacaaagctcaaagtgctgctactcacttcccagtttcccttgcaccttggatatggcatgtgatcaagactcacccatcacgtgcactctccggtggccactgcagcaagatcaaatttcaggagttccagggtcagtactgctagtgatagactcgtgtccagtggtgccagggctgttgggggtcacaaac

SEQ ID NO: 49250 - DNA, 201 bp, Bos taurus; identical to SEQ ID NO: 7830

SEQ ID NO: 49251 - DNA, 201 bp, Bos taurus
acacacacacacacacgggagggctgggagagggtttgatggcattaagccatcatattgggagtttgggattagaagctatggactgatgtgtatggaatggataaacaacaaggtcctactgcatagtgcaggaagctatgttcagtatcttctgatagcccatatggaatctaagaatatgaaagagaatgtgtatat

SEQ ID NO: 49252 - DNA, 201 bp, Bos taurus; identical to SEQ ID NO: 7832

SEQ ID NO: 49253 - DNA, 201 bp, Bos taurus
atagctacactcagatttgtgttttggatggatttaaataatttcctcaaataaaagtacatttgctttcaaatgcattttattctttctttctcctcctcctctccctcttgctttttggtgctggagctcacaggctttgaagtgcttggtgttacacccattggaactgtgtgttctgagctaggttttcctcttccc

SEQ ID NO: 49254 - DNA, 201 bp, Bos taurus; identical to SEQ ID NO: 7834

SEQ ID NO: 49255 - DNA, 201 bp, Bos taurus
catctggcctgtgtttaaatgatcacattaggaaagcagcctgtgggatttcagcttaattacctataacatacactattcatgcaaagaggaatgggggaaagtgagggaaactaatattaaaaatgaatgcaatgtaatgtattgctccccatcccccaaccttttggtacaaagacaagtaaagcaaagaggtgcaaa

SEQ ID NO: 49256 - DNA, 201 bp, Bos taurus
ccaagcaccttccaggcgccttcaaagcccgcctccccccacgtccttcagtctgtacctggcctgcttgtgcctcctgctacagggttgtggggcctctctctgtcttcagaacttgtgatgggtgacaaggaggggtttctggagcgcttgattgataaactgattaccttgaggaaatctggccctttttgcgcaagg

SEQ ID NO: 49257 - DNA, 201 bp, Bos taurus; identical to SEQ ID NO: 7835

SEQ ID NO: 49258 - DNA, 201 bp, Bos taurus; identical to SEQ ID NO: 7836

SEQ ID NO: 49259 - DNA, 201 bp, Bos taurus; identical to SEQ ID NO: 7839

SEQ ID NO: 49260 - DNA, 201 bp, Bos taurus; identical to SEQ ID NO: 7840

SEQ ID NO: 49261 - DNA, 201 bp, Bos taurus; identical to SEQ ID NO: 7841

SEQ ID NO: 49262 - DNA, 201 bp, Bos taurus; identical to SEQ ID NO: 7842

SEQ ID NO: 49263 - DNA, 201 bp, Bos taurus; identical to SEQ ID NO: 7843

SEQ ID NO: 49264 - DNA, 201 bp, Bos taurus; identical to SEQ ID NO: 7844

SEQ ID NO: 49265 - DNA, 201 bp, Bos taurus
aaattgtcctgactaatgtagaagactccggccacttcctttatttcttttactatgagttttatttccttcttttcctcacttacaatagccttcccccatggcctacccccacacaactattccaaggcacttacgaatctaaagcagttgattttggatcactagagtctaaaatttgtttctatctagcgtagaaca

SEQ ID NO: 49266 - DNA, 201 bp, Bos taurus
attggttgaagaaaacattattaaataaaagacacttatttaaacaccaaattaatcatttaaaggcaaattagaggtcatatctcctcctaactaaatactgttaaccagtaatgagatatccattttagataaaagcacatttgcaggttctggctgctggcttaactgtgctttggttttccaagtttactcagagtc

SEQ ID NO: 49267 - DNA, 201 bp, Bos taurus; identical to SEQ ID NO: 7845

SEQ ID NO: 49268 - DNA, 201 bp, Bos taurus; identical to SEQ ID NO: 7846

SEQ ID NO: 49269 - DNA, 201 bp, Bos taurus; identical to SEQ ID NO: 7847

SEQ ID NO: 49270 - DNA, 201 bp, Bos taurus
tggcaatttggttacactgaagggaagctgcaaagtgcttcttttatgcaaaaaagtagaagttttcaacttaataagaaaaaaaaatcatatactgagattgctgagatcagtagtaaaagcaaattttctgtccatgaaattgcaaagatgaaaaaagaaatttgtgctagttttgctgtcatacttcaaacaagtgtg

SEQ ID NO: 49271 - DNA, 201 bp, Bos taurus
acctttgctttgtgagtcctcctggcttcttgctggttcaggagcctttcagaagtaattacttgtggcaggtcaatgggttcaagcttctaaaagtccagcattgagagcagtcagcattcctcatgccaggagatgatgaaacataaaagcccgaacttaagctatcttaacactctgcacgtgttcccgagagcacac

SEQ ID NO: 49272 - DNA, 201 bp, Bos taurus; identical to SEQ ID NO: 7850

SEQ ID NO: 49273 - DNA, 201 bp, Bos taurus
tgttgatctactgaagtaggttttgcatgcttttaacagatgcttcaagaaaatgatccagaacttccacagcaaaccttactgattgcttcacaatcagcaaattacacagcctgaaacatgaagggagcagagatgggtgtgtagggatctaagagacccagaaggaattagccacagtttaatttcctgcagaagcca

SEQ ID NO: 49274 - DNA, 201 bp, Bos taurus; identical to SEQ ID NO: 7851

SEQ ID NO: 49275 - DNA, 201 bp, Bos taurus; identical to SEQ ID NO: 7852

SEQ ID NO: 49276 - DNA, 201 bp, Bos taurus; identical to SEQ ID NO: 7853

SEQ ID NO: 49277 - DNA, 201 bp, Bos taurus; identical to SEQ ID NO: 7854

SEQ ID NO: 49278 - DNA, 201 bp, Bos taurus
agtctctcgtttcggcctgacaatattattaatataagggaagcaggcaatgcaagcccttgggaaggcttgctttctaacatttgcttgtcaccgtggtgtaaatgctcacaccatggccagttccaaactaccaatgacttaacaatctgaatttctagatatttaacttgggagtcactttgggagtcaggacataga

SEQ ID NO: 49279 - DNA, 201 bp, Bos taurus; identical to SEQ ID NO: 7855

SEQ ID NO: 49280 - DNA, 201 bp, Bos taurus; identical to SEQ ID NO: 7856

SEQ ID NO: 49281 - DNA, 201 bp, Bos taurus; identical to SEQ ID NO: 7857

SEQ ID NO: 49282 - DNA, 201 bp, Bos taurus; identical to SEQ ID NO: 7858

SEQ ID NO: 49283 - DNA, 201 bp, Bos taurus; identical to SEQ ID NO: 7859

SEQ ID NO: 49284 - DNA, 201 bp, Bos taurus; identical to SEQ ID NO: 7860

SEQ ID NO: 49285 - DNA, 201 bp, Bos taurus
aaaatcaaatatagtgatataataaattcaataaaatgcacatacttaaaacaagatgaaaacaaaagtagaagaaacagcttcaaaaagcttggggtttatctgactttaatttatagctctttaggttgtggtagatatagaaggccagtaagtatcttaaatttcttacacaattctaaaatgttagaaagggtgtct

SEQ ID NO: 49286 - DNA, 201 bp, Bos taurus; identical to SEQ ID NO: 7862

SEQ ID NO: 49287 - DNA, 201 bp, Bos taurus
tttacaggtataaaagagttgatgctagggtgaagtattttatagcaacaggcaaagtggggggttgctggacctctggccctagagacctagcacatttaacttgagtaagtggaagcttcttttcactgcctttttgcctcctttttagccctgggcctgccgtcttcaccacactctctctattgagcttctccaagt

SEQ ID NO: 49288 - DNA, 201 bp, Bos taurus
tcacacaagagctgagtcaaggtttgttgaatcgatatttggaaaagaagtgatgactggatgctagtcaactggcttgggccactggaaggcctgcccctgcctgtagtttctgtcagctgcagcctctcagggttgttactggcctgcaccaggcaatggtgtttgcatttgccgtatctgagctcaggataacaagac

SEQ ID NO: 49289 - DNA, 201 bp, Bos taurus; identical to SEQ ID NO: 7863

SEQ ID NO: 49290 - DNA, 201 bp, Bos taurus; identical to SEQ ID NO: 7864

SEQ ID NO: 49291 - DNA, 201 bp, Bos taurus; identical to SEQ ID NO: 7865

SEQ ID NO: 49292 - DNA, 201 bp, Bos taurus; identical to SEQ ID NO: 7866

SEQ ID NO: 49293 - DNA, 201 bp, Bos taurus
ccttacacagggccataatctatctcctgctcagtttctgttgtgacatggaggagcctgagcaacccttctagtatgcaatgctttgattcacaatcttcttgaataatacacagcatattcagcgttgtgagtcactatgttcacacttcatatttctattatcaaaactggagacatatattaggcccaaagttgacc

SEQ ID NO: 49294 - DNA, 201 bp, Bos taurus; identical to SEQ ID NO: 7867

SEQ ID NO: 49295 - DNA, 201 bp, Bos taurus
cttactaactcgttgagccagggaatgaacccagaaagtctgcctacaaatccaggttcctaactactctgtggtccacacgggcaatctgctgagtgcatgaaccacaaccttttctttccttgccttaatctcagtttggcactggagcaaatcccccacttggagcttctgaccccagaaacttctcctgcaacaaga

SEQ ID NO: 49296 - DNA, 201 bp, Bos taurus
tattgaaagtcaatcagtaatgattataccatgataatatttacatttcacagggaagcaaaatacttgcagactcgccgtgtctctgtctagagatctgtggtttatttgcattcagataaattatttgttttcattcatccccagaatagttaaccagactaaataagttgcattcatgcattttaatgtcaatgtaca

SEQ ID NO: 49297 - DNA, 201 bp, Bos taurus; identical to SEQ ID NO: 7870

SEQ ID NO: 49298 - DNA, 201 bp, Bos taurus
acttggaacatgtatctccctgccagtgatcctgggatgagttgagtgtaaataaatataagtatctattcatcagagactgtttatctttttctggcccatcattcaaagcagccacagttttctgaaagagctactcagaccatactccaaagcagagaattatttggttcagagtggggaatgctgaggccacagtct

SEQ ID NO: 49299 - DNA, 201 bp, Bos taurus; identical to SEQ ID NO: 7871

SEQ ID NO: 49300 - DNA, 201 bp, Bos taurus
acatctagcaggaaagaggttaattgaaagggtttgggttgttatttacatgccatgtaaatacctaactggtcctggcctttgcatttggccatatctcaacagggattataggatgaacctggcacttgtgggactcccaggagaagtcttgggatttgggaatatatgcttttgaagtttgccatccacttcaatctg

SEQ ID NO: 49301 - DNA, 201 bp, Bos taurus; identical to SEQ ID NO: 7872

SEQ ID NO: 49302 - DNA, 201 bp, Bos taurus; identical to SEQ ID NO: 7873

SEQ ID NO: 49303 - DNA, 201 bp, Bos taurus; identical to SEQ ID NO: 7877

SEQ ID NO: 49304 - DNA, 201 bp, Bos taurus
gcagttcatcgggtcgcaaagagtcagacacgactgagcaactgaactgaactgattcataagaaatattggtttctaattattttcttatgatgtgtttgcctggctttgatgttaggttagtactgcatgcatgtatgctaagttgcttcagtcatgtctgactctttgcaactctatggactgtagcctgccagcttc

SEQ ID NO: 49305 - DNA, 201 bp, Bos taurus
cgatattatttgaaatgttttctagtgattgagtgatgctcagtctgatgtcttcaggaactgctgtacacatgaaatgttggcctcaatatttaatgtctccatcctgccatgttttgagtttgtataatttctcttgcctctcatctttcctccttcaatgtcagtggccacttatagagatgtctttgtactcaccac

SEQ ID NO: 49306 - DNA, 201 bp, Bos taurus; identical to SEQ ID NO: 7878

SEQ ID NO: 49307 - DNA, 201 bp, Bos taurus; identical to SEQ ID NO: 7880

SEQ ID NO: 49308 - DNA, 201 bp, Bos taurus
ccacttagtctagttttccaaagaatcctgctgaattggtttagtgaaagtcctccacctttggtatctgatcaccttgtatcagatcaaattcctcatcctgcattcttgatattttagggccagtcttcagcaggaatctcccttatccctaatgtgttctatccactgacctctatcttgctccttgaatgtaaatcc

SEQ ID NO: 49309 - DNA, 201 bp, Bos taurus
agcatttatcccttctatttttagttcacttctttaattgagatgaacatgatataatctcactgagtcaaaggatggcatctagtcctgtgcttcccgctgaagaccaacaggtttccttgggcattgatgatctccatttttcattgcaaggtaattaagattggttggggtaaccccatggcaactatgcaaacctca

SEQ ID NO: 49310 - DNA, 201 bp, Bos taurus; identical to SEQ ID NO: 7881

SEQ ID NO: 49311 - DNA, 201 bp, Bos taurus; identical to SEQ ID NO: 7882

SEQ ID NO: 49312 - DNA, 201 bp, Bos taurus; identical to SEQ ID NO: 7883

SEQ ID NO: 49313 - DNA, 201 bp, Bos taurus
gccttgcttcagcagcacagactaaaactccgaaaataaggttcttggccatcaacaggactgatgccaaagaaagcttcagctcaacacataatctcacctatgggtacccttgatttcaaaatcccagtagctaaactccttaaaaatccacctccttttgtttcccagagcctccgtccccctttattaatcagagcc

SEQ ID NO: 49314 - DNA, 201 bp, Bos taurus; identical to SEQ ID NO: 7884

SEQ ID NO: 49315 - DNA, 201 bp, Bos taurus
aatggatgtggcactgagaaaccagaccagccctgcccacagcacataatcaccgggtttcttattcggatggcccaagccagtgccaggcctcttgtacgtgtaggagccaggacataaaatcccagcctttcttccaaaacaaacctagggagcctttattctgcgttgctttcctttgatgaggttttccggggcccg

SEQ ID NO: 49316 - DNA, 201 bp, Bos taurus
agcccagaacctgagaggtgatgcaattgatcgtgggaacaatctcaggtagcctcggcctgcagcagcttgaagtaggatttgttttcctggccaaagattgaagtcaggcagcggcagggaacactgaatcctggtcactagaccaccagggacagtggctagtggcaaggccctagcccgtcagcggtgtagaagtga

SEQ ID NO: 49317 - DNA, 201 bp, Bos taurus
ctcactaggccagccggaaagccacgtgggtaagagggacgctcttcaaatcaccccctgcccactcaactctctgggaatctgggagacaatcactgctccaggccaaggctctgcccttcgctaagtggaacacggagaaacctggtattatttcctggtgaacaaaacaaaagcactaccacaccccagaaacttgcc

SEQ ID NO: 49318 - DNA, 201 bp, Bos taurus; identical to SEQ ID NO: 7888

SEQ ID NO: 49319 - DNA, 201 bp, Bos taurus; identical to SEQ ID NO: 7889

SEQ ID NO: 49320 - DNA, 201 bp, Bos taurus; identical to SEQ ID NO: 7890

SEQ ID NO: 49321 - DNA, 201 bp, Bos taurus; identical to SEQ ID NO: 7891

SEQ ID NO: 49322 - DNA, 201 bp, Bos taurus
tcaatatggtttgaaattttcttctaaaaaatactctggaaagtggccctaaagtgttctctgtggtactccagatctcttattcaacccaacacatttttaaaaatttagttgagggccaatgcatattctgtttcccctggagtataccacatgtgaaagttaggacttttccaggagaaagaagcttatagagtccca

SEQ ID NO: 49323 - DNA, 201 bp, Bos taurus; identical to SEQ ID NO: 7892

SEQ ID NO: 49324 - DNA, 201 bp, Bos taurus; identical to SEQ ID NO: 7893

SEQ ID NO: 49325 - DNA, 201 bp, Bos taurus
ttttgattctgactcaaatgattcttttaagatgactcgagctggatagaatcccttgtttctattactgtaacactaattttattctgtgatatatttgccttgacctgcatttgcacctggcatgtaagatgaacagttatggtgtctttcctactaagctcattgaaggtaggaaccttgtcttagagactggggtat

SEQ ID NO: 49326 - DNA, 201 bp, Bos taurus
taccatggttccccatgtccatgccttagccctctattgaatttaaattctttctcgtttgttcggctctttcacattactgttctgctgcctctttcatgatccctctttcctgcttagccttctgttctcaacctaaattttacttcctcagagaggccttcctgcagtttggtgccctgtggtctgtcccatatcact

SEQ ID NO: 49327 - DNA, 201 bp, Bos taurus; identical to SEQ ID NO: 7894

SEQ ID NO: 49328 - DNA, 201 bp, Bos taurus
gaactgtccagccaaaaggttcaaaccttctgacctttgaccaacctttcacctggtcttatctattgttccttgagtcactgttgagctgaccaagataactaggggctgagaatactttaaagaaagttgccttgctggagaacattttcctcctcaaaatctttaacagctcagtgcatatgaccttgacattacctg

SEQ ID NO: 49329 - DNA, 201 bp, Bos taurus; identical to SEQ ID NO: 7895

SEQ ID NO: 49330 - DNA, 201 bp, Bos taurus; identical to SEQ ID NO: 7896

SEQ ID NO: 49331 - DNA, 201 bp, Bos taurus; identical to SEQ ID NO: 7898

SEQ ID NO: 49332 - DNA, 201 bp, Bos taurus; identical to SEQ ID NO: 7900

SEQ ID NO: 49333 - DNA, 201 bp, Bos taurus; identical to SEQ ID NO: 7901

SEQ ID NO: 49334 - DNA, 201 bp, Bos taurus; identical to SEQ ID NO: 7902

SEQ ID NO: 49335 - DNA, 201 bp, Bos taurus; identical to SEQ ID NO: 7903

SEQ ID NO: 49336 - DNA, 201 bp, Bos taurus; identical to SEQ ID NO: 7904

SEQ ID NO: 49337 - DNA, 201 bp, Bos taurus
gttcctcgcgtatatactgtcattgaatgctaaaccacttaactattacatgtagtatttgtatagaaatatttatatatatgtatgtataattttatttcttaatacaaggttttccaagaggagagccagggcctggctgctactgctgctgctaagtcgcttcagtcgtgtccgactctgtgcgaccccatagacagc

SEQ ID NO: 49338 - DNA, 201 bp, Bos taurus
gtcttgcctgttttttgatttgtgttacatgacgattagaatcaggagtgccggcggtgggggtcttcactgagcctggcccagtgctgtgtgttgtggatgctcagcagctgttagttgaaagagtgactgggatgcactgcctttgtcatcacctttctgctcttctttggtctgagtgtggaattgtacggaagaata

SEQ ID NO: 49339 - DNA, 201 bp, Bos taurus
ctgcagcctttctgccctgtgcctcatctggcctttgtcctgtttctttgaaaaatatgtatatcttggctgcttctctagctctgatggtgccttgggttctgcttgtggtgtgctggccttccggtgccctgcgacgtccttcctgtgagtgttggaggatggaagaggaccattttggtctattgtggtaacctcctc

SEQ ID NO: 49340 - DNA, 201 bp, Bos taurus; identical to SEQ ID NO: 7905

SEQ ID NO: 49341 - DNA, 201 bp, Bos taurus
ctactctggttctgtcactcagatcttctcaagatgttacagacgatgtcacccaagaaaaagaaaatcttctgttgcacctttcctccatgggttctttatttaccattttttctagtgaaaagaacccaggtgatctttgtactgaaaattcacgtatgcgggagaatatcaaacctcttgcagctgcatttggggctg

SEQ ID NO: 49342 - DNA, 201 bp, Bos taurus
tgaacacatgttcctgagccagccttgcctgcagcaagccaaagcatcagctgtgtatattcctgatggtgaagtggccagacaaggatcccctgtgtacccacccgggcaagggtgggtctgagacaacagccaagagtgatgagtccagatttctgagctgagcattaaggagtctatttggcccttgccaaatcccct

SEQ ID NO: 49343 - DNA, 201 bp, Bos taurus; identical to SEQ ID NO: 7906

SEQ ID NO: 49344 - DNA, 201 bp, Bos taurus
agtttgagcaagctttgagagatggtgaaggacagtgaagcctggcgtgttgcagtccatggggtcacagagagttggacgtggccgagtgactgaactggtgctagaggaaatcttgccctaaaaattgaggggctctttttgcatacgtgtgtgtgtgtgctaagtcacttcagtcatgtccaactctttgcaacccta

SEQ ID NO: 49345 - DNA, 201 bp, Bos taurus
tttcatacctgtgaatatgatgctggatgataataaaagtggccagttttgagtaagaatgcaaggcaagaaaaggtcttggttcttgcttgcccattgagaacccaaagccataattagagctgtcaagtatggcacagctgatgtctttgaccctgttggaaactggtggtagtggtagatatgatgtgaaatctatga

SEQ ID NO: 49346 - DNA, 201 bp, Bos taurus
tttattgttccatcatgagcttgagttgatttaatattctattctggcttcctgcccttaacttgctgtatttatacagccctctccaaagcttggtgtttattctgaagcagatcctagctgctaaactcttctatgtccttttcattccaggcggttaccagggctacatgtgagaagaatgagggtggcactgaagct

SEQ ID NO: 49347 - DNA, 201 bp, Bos taurus; identical to SEQ ID NO: 7908

SEQ ID NO: 49348 - DNA, 201 bp, Bos taurus; identical to SEQ ID NO: 7909

SEQ ID NO: 49349 - DNA, 201 bp, Bos taurus
caacctcagggtgctgttggcgctccagctgcgatgtctgcaagaggaggggaaggaaaaactgcagaggggctttctggaatctcctctctgacttgtacttggaattccttggccaccactgtcttcaaggaggctccagtgtggtgtttaagtgggcacattgccaggccaaataaaaccagctttctatgactaaag

SEQ ID NO: 49350 - DNA, 201 bp, Bos taurus; identical to SEQ ID NO: 7911

SEQ ID NO: 49351 - DNA, 201 bp, Bos taurus
tggcgggcggtcacatcgaaggccccctccagctcttctttcggaagtggcaatgggaagtctatcgctatttatttctgcctttaaactgtgcatgcggatggccaaattcacaggatgacgtaacctggtggcactgacattccctagacatgttggttagacacctgctgtttccattcgcacctcctccttaggtgg

SEQ ID NO: 49352 - DNA, 201 bp, Bos taurus; identical to SEQ ID NO: 7912

SEQ ID NO: 49353 - DNA, 201 bp, Bos taurus; identical to SEQ ID NO: 7913

SEQ ID NO: 49354 - DNA, 201 bp, Bos taurus
atggagaacagtgtgaggagcaggaaagcagttcgggggttgcctcaccacgaggactcgtgtagtttttttcagtctggcctcacctgtggtgagcagggtggtctcctagcacctcagctgtaagtgttctgctttacagccaatagccttctgggcactcatgatttaagagtgttgctgggtatccttcggggccct

SEQ ID NO: 49355 - DNA, 201 bp, Bos taurus; identical to SEQ ID NO: 7914

SEQ ID NO: 49356 - DNA, 201 bp, Bos taurus; identical to SEQ ID NO: 7915

SEQ ID NO: 49357 - DNA, 201 bp, Bos taurus
aatgaaaatattcaatcttcatacaggctgaagaccaacttccagtaatcaggataggccagaaaaatctaaattcttgattttggtgaaaagtgattccggatcattagtagccatgggcacttggatgcagcagatacaaatactttctagaagaagttaactttattctagtcctcaaattatttccaccaatgactt

SEQ ID NO: 49358 - DNA, 201 bp, Bos taurus; identical to SEQ ID NO: 7918

SEQ ID NO: 49359 - DNA, 201 bp, Bos taurus; identical to SEQ ID NO: 7919

SEQ ID NO: 49360 - DNA, 201 bp, Bos taurus; identical to SEQ ID NO: 7920

SEQ ID NO: 49361 - DNA, 201 bp, Bos taurus; identical to SEQ ID NO: 7922

SEQ ID NO: 49362 - DNA, 201 bp, Bos taurus
aagaggtgtatttggccctgacgtgccaatgacggggaaatggtaggatgcccgtggaggcacgtggcaaggtggccaagaaccggtggcccagagtcaacggctaactaatggaggggttcaaatctcccctctattgctgaccaggcgtgtgaccctaggcaagggtctctcctttctgatcctcccctggcccagctg

SEQ ID NO: 49363 - DNA, 201 bp, Bos taurus
ccagataccaaataactacagctttgcaggccatatagtctgtgtcatctactcaagtctgccttgctgtacaaaagcagccagacaatatgtaaacaaatggacatggatttgtaacaatacaactttataaaagggttttggaaggacaattcattatattgaaatattagatctgtttggaattgctcctgaattctt

SEQ ID NO: 49364 - DNA, 201 bp, Bos taurus
actttctcccacccactgtagatattcctcaaataattctccattggtgttctctttgcattatcactcttggagaaataatcaacacaaactattaccccgattaggagcattttctaattgtactcttaactcttcctctcttacttaaatttctatatttgggtgcactgatactgcctcaattgcattaatttaaag

SEQ ID NO: 49365 - DNA, 201 bp, Bos taurus
gaatgccctagcaatttcctaggcctctttttttttaaggtttaaagagatctataaagaactgctacattttagaccccttcaaatggtacaaaatgaatagcttttaatcaaatcatttcaggtaattaaatattcatttactcccctacagcagttcagtctcctttttttaccctcttctttaccccaccgtatcca

SEQ ID NO: 49366 - DNA, 201 bp, Bos taurus; identical to SEQ ID NO: 7923

SEQ ID NO: 49367 - DNA, 201 bp, Bos taurus; identical to SEQ ID NO: 7925

SEQ ID NO: 49368 - DNA, 201 bp, Bos taurus
ccaaacataaacgattattggtttatagggtcgttaatcgagtaatcctaactatcctgtatcacattttttacagtgtgattttttgttttgattgtgctgggcctttgttgccgtgcacgggcccttggttgcagcagaggcttctctagttttggtgcccgggcttagttgccccgtggttcttagttccccgaccag

SEQ ID NO: 49369 - DNA, 201 bp, Bos taurus
cacctgtgtagtgataagttgccagcgggtggttatggggacgcaggggcttcttcagtagcagcttattcagcgtttcctgaaagggaagtgaggaaaaggtcagggccctgacaggttctcagtggccaaaatccaggactctgagtagggtgattacttaactcttaactgcgaaggggcaagaggtctggcaggagg

SEQ ID NO: 49370 - DNA, 201 bp, Bos taurus; identical to SEQ ID NO: 7927

SEQ ID NO: 49371 - DNA, 201 bp, Bos taurus; identical to SEQ ID NO: 7928

SEQ ID NO: 49372 - DNA, 201 bp, Bos taurus; identical to SEQ ID NO: 7930

SEQ ID NO: 49373 - DNA, 201 bp, Bos taurus
agtgggatgactcacttacctggctggcctgagagtcgcctggggaggaaaggggagagcgtgagctcagggaggacacgtacggctgcctgctcccgccccccacggccagggctggttcactctgtgacctccctactttgtccacagcaggcccggtggcagagacagctctgactagtttacctgcccctgccaccc

SEQ ID NO: 49374 - DNA, 201 bp, Bos taurus
ctttcttggaagtttgcggtcaccgttgttattgtggccatcacttgtttctctaattggaactcaatgctaaggaccgcaagaatcctgagttcaaatcgctttagggccaatggttcaactttgcagagaagggggaaaaaaaaaaatccctagtcatagaaagacctgtctatacagaggagagaggataggatttgg

SEQ ID NO: 49375 - DNA, 201 bp, Bos taurus
atcagctctctctcctgggacttagagaggccttctccctccatcagttatccattaggtgaggcactgacttcagggtgggcggcttaagcccgcaccctcctccgaggcctccaggccccccacacgctgtcttgtctgggagataaatctagcttccagattagactctgggcccagcacccccacacccgaggctcc

SEQ ID NO: 49376 - DNA, 201 bp, Bos taurus
ccaaaataaaaataaaatgatgttgcttggctgctggtcagcaatttaatgtgaaagcaaaacaccctcccctttcatggacactgtattatatatgcagacgtgaggtttacacaagtgatttcattaccttttacagcttttctgccttgttcatttctttattttcacaccttttagtgcttcctgcttcctttatcc

SEQ ID NO: 49377 - DNA, 201 bp, Bos taurus; identical to SEQ ID NO: 7937

SEQ ID NO: 49378 - DNA, 201 bp, Bos taurus
cttgtccattagcactttatagtttatgtgtgtatttgtggggcctttaaaaactcacatttatgtgaaggctgttaagagatgttttttgcagttagagttatttcttttagtatgggaaatgactacaagaaagtcatttctgtgtttatcgatgatctccctgaaatcctgttgccaatgagaagtcaacattttgct

SEQ ID NO: 49379 - DNA, 201 bp, Bos taurus
aatccctgacttccaagcacatacatattcagtgtatccaaatcccacctatctttccagccttaaccatgaagtctcctttaaccactactgtccacaccgattccctcttctctaaagccccacaacactgagactgccacacaattaacactcgtaacactgtcatatccacgttgttttgctttttatccttccccc

SEQ ID NO: 49380 - DNA, 201 bp, Bos taurus; identical to SEQ ID NO: 7939

SEQ ID NO: 49381 - DNA, 201 bp, Bos taurus
actgtatggttcatggggttgcaaagacaggactgagtgactttcacttttctattcccatgcctaagattgagtcgctgctccctctgctggccacgcaggggcatgacagtcattgactaagtagataaacagcatgtcagtatggtgattcagtggctaagactgtgctctcaatgcagggggcccaggtttgatacc

SEQ ID NO: 49382 - DNA, 201 bp, Bos taurus
tggattgagtaggggaggagaggggaacatgagccaggctggccccaggatataccctagattcatcccactaacaacacaggccagtgtctggtatgacgggcaggacctgaacaaaatcagttactccaggggactctgtagcagattctgtgcttctccagggggaaactgacagaaaatagacaaaggccagcctgg

SEQ ID NO: 49383 - DNA, 201 bp, Bos taurus
agggaaaaaggaaggagggaggggaggaaggagttctgatagtcttaaagtttgtctacttcaggtaaaaattccttatggccccctcagatgttggcctcttgtttatccccagggaggtaggaagaacaaggctgtaggaacccaggctgactggcttgatctggtggcctctagaagtttaaagtaccattagtatgg

SEQ ID NO: 49384 - DNA, 201 bp, Bos taurus; identical to SEQ ID NO: 7941

SEQ ID NO: 49385 - DNA, 201 bp, Bos taurus; identical to SEQ ID NO: 7942

SEQ ID NO: 49386 - DNA, 201 bp, Bos taurus; identical to SEQ ID NO: 7943

SEQ ID NO: 49387 - DNA, 201 bp, Bos taurus; identical to SEQ ID NO: 7944

SEQ ID NO: 49388 - DNA, 201 bp, Bos taurus; identical to SEQ ID NO: 7945

SEQ ID NO: 49389 - DNA, 201 bp, Bos taurus; identical to SEQ ID NO: 7946

SEQ ID NO: 49390 - DNA, 201 bp, Bos taurus; identical to SEQ ID NO: 7948

SEQ ID NO: 49391 - DNA, 201 bp, Bos taurus
ggttggtgtgcttagaggggtcagcgtactgcagcctgtggcccaaatccagcccgccacctgcctgtgtaaagtttactggaacatggccacgtaccttcatttacatactgcctatggctaccttggggctacaggagcagaactcagttgtgacagagaccacgtggcctgcaaagcctgaattatttactctctagc

SEQ ID NO: 49392 - DNA, 201 bp, Bos taurus; identical to SEQ ID NO: 7950

SEQ ID NO: 49393 - DNA, 201 bp, Bos taurus; identical to SEQ ID NO: 7951

SEQ ID NO: 49394 - DNA, 201 bp, Bos taurus; identical to SEQ ID NO: 7952

SEQ ID NO: 49395 - DNA, 201 bp, Bos taurus; identical to SEQ ID NO: 7953

SEQ ID NO: 49396 - DNA, 201 bp, Bos taurus; identical to SEQ ID NO: 7954

SEQ ID NO: 49397 - DNA, 201 bp, Bos taurus; identical to SEQ ID NO: 7955

SEQ ID NO: 49398 - DNA, 201 bp, Bos taurus; identical to SEQ ID NO: 7956

SEQ ID NO: 49399 - DNA, 201 bp, Bos taurus; identical to SEQ ID NO: 7957

SEQ ID NO: 49400 - DNA, 201 bp, Bos taurus; identical to SEQ ID NO: 7958

SEQ ID NO: 49401 - DNA, 201 bp, Bos taurus; identical to SEQ ID NO: 7959

SEQ ID NO: 49402 - DNA, 201 bp, Bos taurus; identical to SEQ ID NO: 7960

SEQ ID NO: 49403 - DNA, 201 bp, Bos taurus; identical to SEQ ID NO: 7961

SEQ ID NO: 49404 - DNA, 201 bp, Bos taurus; identical to SEQ ID NO: 7962

SEQ ID NO: 49405 - DNA, 201 bp, Bos taurus; identical to SEQ ID NO: 7963

SEQ ID NO: 49406 - DNA, 201 bp, Bos taurus; identical to SEQ ID NO: 7965

SEQ ID NO: 49407 - DNA, 201 bp, Bos taurus; identical to SEQ ID NO: 7966

SEQ ID NO: 49408 - DNA, 201 bp, Bos taurus; identical to SEQ ID NO: 7967

SEQ ID NO: 49409 - DNA, 201 bp, Bos taurus; identical to SEQ ID NO: 7968

SEQ ID NO: 49410 - DNA, 201 bp, Bos taurus; identical to SEQ ID NO: 7969

SEQ ID NO: 49411 - DNA, 201 bp, Bos taurus; identical to SEQ ID NO: 7970

SEQ ID NO: 49412 - DNA, 201 bp, Bos taurus; identical to SEQ ID NO: 7971

SEQ ID NO: 49413 - DNA, 201 bp, Bos taurus; identical to SEQ ID NO: 7972

SEQ ID NO: 49414 - DNA, 201 bp, Bos taurus; identical to SEQ ID NO: 7973

SEQ ID NO: 49415 - DNA, 201 bp, Bos taurus; identical to SEQ ID NO: 7974

SEQ ID NO: 49416 - DNA, 201 bp, Bos taurus; identical to SEQ ID NO: 7975

SEQ ID NO: 49417 - DNA, 201 bp, Bos taurus; identical to SEQ ID NO: 7976

SEQ ID NO: 49418 - DNA, 201 bp, Bos taurus; identical to SEQ ID NO: 7977

SEQ ID NO: 49419 - DNA, 201 bp, Bos taurus; identical to SEQ ID NO: 7978

SEQ ID NO: 49420 - DNA, 201 bp, Bos taurus; identical to SEQ ID NO: 7979

SEQ ID NO: 49421 - DNA, 201 bp, Bos taurus; identical to SEQ ID NO: 7980

SEQ ID NO: 49422 - DNA, 201 bp, Bos taurus; identical to SEQ ID NO: 7981

SEQ ID NO: 49423 - DNA, 201 bp, Bos taurus; identical to SEQ ID NO: 7982

SEQ ID NO: 49424 - DNA, 201 bp, Bos taurus; identical to SEQ ID NO: 7983

SEQ ID NO: 49425 - DNA, 201 bp, Bos taurus; identical to SEQ ID NO: 7984

SEQ ID NO: 49426 - DNA, 201 bp, Bos taurus; identical to SEQ ID NO: 7985

SEQ ID NO: 49427 - DNA, 201 bp, Bos taurus; identical to SEQ ID NO: 7986

SEQ ID NO: 49428 - DNA, 201 bp, Bos taurus; identical to SEQ ID NO: 7987

SEQ ID NO: 49429 - DNA, 201 bp, Bos taurus; identical to SEQ ID NO: 7988

SEQ ID NO: 49430 - DNA, 201 bp, Bos taurus; identical to SEQ ID NO: 7989

SEQ ID NO: 49431 - DNA, 201 bp, Bos taurus; identical to SEQ ID NO: 7990

SEQ ID NO: 49432 - DNA, 201 bp, Bos taurus; identical to SEQ ID NO: 7991

SEQ ID NO: 49433 - DNA, 201 bp, Bos taurus; identical to SEQ ID NO: 7992

SEQ ID NO: 49434 - DNA, 201 bp, Bos taurus; identical to SEQ ID NO: 7993

SEQ ID NO: 49435 - DNA, 201 bp, Bos taurus; identical to SEQ ID NO: 7994

SEQ ID NO: 49436 - DNA, 201 bp, Bos taurus; identical to SEQ ID NO: 7995

SEQ ID NO: 49437 - DNA, 201 bp, Bos taurus; identical to SEQ ID NO: 7996

SEQ ID NO: 49438 - DNA, 201 bp, Bos taurus; identical to SEQ ID NO: 7997

SEQ ID NO: 49439 - DNA, 201 bp, Bos taurus; identical to SEQ ID NO: 7998

SEQ ID NO: 49440 - DNA, 201 bp, Bos taurus; identical to SEQ ID NO: 7999

SEQ ID NO: 49441 - DNA, 201 bp, Bos taurus; identical to SEQ ID NO: 8000

SEQ ID NO: 49442 - DNA, 201 bp, Bos taurus; identical to SEQ ID NO: 8001

SEQ ID NO: 49443 - DNA, 201 bp, Bos taurus; identical to SEQ ID NO: 8002

SEQ ID NO: 49444 - DNA, 201 bp, Bos taurus; identical to SEQ ID NO: 8003

SEQ ID NO: 49445 - DNA, 201 bp, Bos taurus; identical to SEQ ID NO: 8004

SEQ ID NO: 49446 - DNA, 201 bp, Bos taurus; identical to SEQ ID NO: 8005

SEQ ID NO: 49447 - DNA, 201 bp, Bos taurus; identical to SEQ ID NO: 8006

SEQ ID NO: 49448 - DNA, 201 bp, Bos taurus; identical to SEQ ID NO: 8007

SEQ ID NO: 49449 - DNA, 201 bp, Bos taurus; identical to SEQ ID NO: 8008

SEQ ID NO: 49450 - DNA, 201 bp, Bos taurus; identical to SEQ ID NO: 8009

SEQ ID NO: 49451 - DNA, 201 bp, Bos taurus; identical to SEQ ID NO: 8010

SEQ ID NO: 49452 - DNA, 201 bp, Bos taurus; identical to SEQ ID NO: 8011

SEQ ID NO: 49453 - DNA, 201 bp, Bos taurus; identical to SEQ ID NO: 8012

SEQ ID NO: 49454 - DNA, 201 bp, Bos taurus; identical to SEQ ID NO: 8013

SEQ ID NO: 49455 - DNA, 201 bp, Bos taurus; identical to SEQ ID NO: 8014

SEQ ID NO: 49456 - DNA, 201 bp, Bos taurus; identical to SEQ ID NO: 8015

SEQ ID NO: 49457 - DNA, 201 bp, Bos taurus; identical to SEQ ID NO: 8016

SEQ ID NO: 49458 - DNA, 201 bp, Bos taurus; identical to SEQ ID NO: 8017

SEQ ID NO: 49459 - DNA, 201 bp, Bos taurus; identical to SEQ ID NO: 8018

SEQ ID NO: 49460 - DNA, 201 bp, Bos taurus; identical to SEQ ID NO: 8019

SEQ ID NO: 49461 - DNA, 201 bp, Bos taurus; identical to SEQ ID NO: 8020

SEQ ID NO: 49462 - DNA, 201 bp, Bos taurus; identical to SEQ ID NO: 8021

SEQ ID NO: 49463 - DNA, 201 bp, Bos taurus; identical to SEQ ID NO: 8022

SEQ ID NO: 49464 - DNA, 201 bp, Bos taurus; identical to SEQ ID NO: 8023

SEQ ID NO: 49465 - DNA, 201 bp, Bos taurus; identical to SEQ ID NO: 8024

SEQ ID NO: 49466 - DNA, 201 bp, Bos taurus; identical to SEQ ID NO: 8025

SEQ ID NO: 49467 - DNA, 201 bp, Bos taurus; identical to SEQ ID NO: 8026

SEQ ID NO: 49468 - DNA, 201 bp, Bos taurus; identical to SEQ ID NO: 8027

SEQ ID NO: 49469 - DNA, 201 bp, Bos taurus; identical to SEQ ID NO: 8028

SEQ ID NO: 49470 - DNA, 201 bp, Bos taurus; identical to SEQ ID NO: 8029

SEQ ID NO: 49471 - DNA, 201 bp, Bos taurus; identical to SEQ ID NO: 8030

SEQ ID NO: 49472 - DNA, 201 bp, Bos taurus; identical to SEQ ID NO: 8031

SEQ ID NO: 49473 - DNA, 201 bp, Bos taurus; identical to SEQ ID NO: 8032

SEQ ID NO: 49474 - DNA, 201 bp, Bos taurus; identical to SEQ ID NO: 8033

SEQ ID NO: 49475 - DNA, 201 bp, Bos taurus; identical to SEQ ID NO: 8034

SEQ ID NO: 49476 - DNA, 201 bp, Bos taurus; identical to SEQ ID NO: 8035

SEQ ID NO: 49477 - DNA, 201 bp, Bos taurus; identical to SEQ ID NO: 8036

SEQ ID NO: 49478 - DNA, 201 bp, Bos taurus
aggaaatggcagcaacccactccagtattgcctgggaaatcccatggacagaggatactggtgggctacagtccatggggtcacaaaagagtcagatacggcatagcaactaaacagcaacaccctgtgcttagtgattctagagaaagagatactactccctggtatgagtagcaggtattaagactatcatttttattg

SEQ ID NO: 49479 - DNA, 201 bp, Bos taurus
gtagagcatagagcatcttatcacatgggatacaaaagagttgcatgggaagagtaggtgtttcttcatccttgggtcccaatgtctgtgggcatcccctcccccacaaaactgaagatagcaaattgattttcacagacaaaaacacacgagaaactggtgaaaaaggaaaccagatggagagggagaaggagggggtgg

SEQ ID NO: 49480 - DNA, 201 bp, Bos taurus; identical to SEQ ID NO: 8038

SEQ ID NO: 49481 - DNA, 201 bp, Bos taurus; identical to SEQ ID NO: 8039

SEQ ID NO: 49482 - DNA, 201 bp, Bos taurus
gataaaatgataattatataaagaactaaatgatgagaatgaacaactgataggaaaattggtgggcagagttttctaggtggagtgaatagcatttgtctggggggaaggaatgcttgacatattttggacaatgtgggctcagactactgaagcagtgagagagtcagctgacagatgattcaggtgaggtgcttggat

SEQ ID NO: 49483 - DNA, 201 bp, Bos taurus; identical to SEQ ID NO: 8041

SEQ ID NO: 49484 - DNA, 201 bp, Bos taurus; identical to SEQ ID NO: 8042

SEQ ID NO: 49485 - DNA, 201 bp, Bos taurus; identical to SEQ ID NO: 8043

SEQ ID NO: 49486 - DNA, 201 bp, Bos taurus; identical to SEQ ID NO: 8044

SEQ ID NO: 49487 - DNA, 201 bp, Bos taurus; identical to SEQ ID NO: 8045

SEQ ID NO: 49488 - DNA, 201 bp, Bos taurus; identical to SEQ ID NO: 8046

SEQ ID NO: 49489 - DNA, 201 bp, Bos taurus; identical to SEQ ID NO: 8047

SEQ ID NO: 49490 - DNA, 201 bp, Bos taurus; identical to SEQ ID NO: 8048

SEQ ID NO: 49491 - DNA, 201 bp, Bos taurus; identical to SEQ ID NO: 8049

SEQ ID NO: 49492 - DNA, 201 bp, Bos taurus; identical to SEQ ID NO: 8050

SEQ ID NO: 49493 - DNA, 201 bp, Bos taurus; identical to SEQ ID NO: 8052

SEQ ID NO: 49494 - DNA, 201 bp, Bos taurus; identical to SEQ ID NO: 8053

SEQ ID NO: 49495 - DNA, 201 bp, Bos taurus; identical to SEQ ID NO: 8054

SEQ ID NO: 49496 - DNA, 201 bp, Bos taurus; identical to SEQ ID NO: 8055

SEQ ID NO: 49497 - DNA, 201 bp, Bos taurus; identical to SEQ ID NO: 8056

SEQ ID NO: 49498 - DNA, 201 bp, Bos taurus; identical to SEQ ID NO: 8059

SEQ ID NO: 49499 - DNA, 201 bp, Bos taurus; identical to SEQ ID NO: 8067

SEQ ID NO: 49500 - DNA, 201 bp, Bos taurus; identical to SEQ ID NO: 8069

SEQ ID NO: 49501 - DNA, 201 bp, Bos taurus; identical to SEQ ID NO: 8070

SEQ ID NO: 49502 - DNA, 201 bp, Bos taurus; identical to SEQ ID NO: 8071

SEQ ID NO: 49503 - DNA, 201 bp, Bos taurus; identical to SEQ ID NO: 8072

SEQ ID NO: 49504 - DNA, 201 bp, Bos taurus; identical to SEQ ID NO: 8073

SEQ ID NO: 49505 - DNA, 201 bp, Bos taurus; identical to SEQ ID NO: 8074

SEQ ID NO: 49506 - DNA, 201 bp, Bos taurus; identical to SEQ ID NO: 8075

SEQ ID NO: 49507 - DNA, 201 bp, Bos taurus; identical to SEQ ID NO: 8076

SEQ ID NO: 49508 - DNA, 201 bp, Bos taurus; identical to SEQ ID NO: 8077

SEQ ID NO: 49509 - DNA, 201 bp, Bos taurus; identical to SEQ ID NO: 8078

SEQ ID NO: 49510 - DNA, 201 bp, Bos taurus; identical to SEQ ID NO: 8079

SEQ ID NO: 49511 - DNA, 201 bp, Bos taurus; identical to SEQ ID NO: 8080

SEQ ID NO: 49512 - DNA, 201 bp, Bos taurus; identical to SEQ ID NO: 8081

SEQ ID NO: 49513 - DNA, 201 bp, Bos taurus; identical to SEQ ID NO: 8082

SEQ ID NO: 49514 - DNA, 201 bp, Bos taurus; identical to SEQ ID NO: 8083

SEQ ID NO: 49515 - DNA, 201 bp, Bos taurus; identical to SEQ ID NO: 8084

SEQ ID NO: 49516 - DNA, 201 bp, Bos taurus; identical to SEQ ID NO: 8085

SEQ ID NO: 49517 - DNA, 201 bp, Bos taurus; identical to SEQ ID NO: 8086

SEQ ID NO: 49518 - DNA, 201 bp, Bos taurus; identical to SEQ ID NO: 8087

SEQ ID NO: 49519 - DNA, 201 bp, Bos taurus; identical to SEQ ID NO: 8088

SEQ ID NO: 49520 - DNA, 201 bp, Bos taurus; identical to SEQ ID NO: 8089

SEQ ID NO: 49521 - DNA, 201 bp, Bos taurus; identical to SEQ ID NO: 8090

SEQ ID NO: 49522 - DNA, 201 bp, Bos taurus; identical to SEQ ID NO: 8091

SEQ ID NO: 49523 - DNA, 201 bp, Bos taurus; identical to SEQ ID NO: 8092

SEQ ID NO: 49524 - DNA, 201 bp, Bos taurus; identical to SEQ ID NO: 8093

SEQ ID NO: 49525 - DNA, 201 bp, Bos taurus; identical to SEQ ID NO: 8094

SEQ ID NO: 49526 - DNA, 201 bp, Bos taurus; identical to SEQ ID NO: 8095

SEQ ID NO: 49527 - DNA, 201 bp, Bos taurus; identical to SEQ ID NO: 8096

SEQ ID NO: 49528 - DNA, 201 bp, Bos taurus; identical to SEQ ID NO: 8097

SEQ ID NO: 49529 - DNA, 201 bp, Bos taurus; identical to SEQ ID NO: 8098

SEQ ID NO: 49530 - DNA, 201 bp, Bos taurus; identical to SEQ ID NO: 8099

SEQ ID NO: 49531 - DNA, 201 bp, Bos taurus; identical to SEQ ID NO: 8100

SEQ ID NO: 49532 - DNA, 201 bp, Bos taurus; identical to SEQ ID NO: 8101

SEQ ID NO: 49533 - DNA, 201 bp, Bos taurus; identical to SEQ ID NO: 8102

SEQ ID NO: 49534 - DNA, 201 bp, Bos taurus; identical to SEQ ID NO: 8103

SEQ ID NO: 49535 - DNA, 201 bp, Bos taurus; identical to SEQ ID NO: 8104

SEQ ID NO: 49536 - DNA, 201 bp, Bos taurus; identical to SEQ ID NO: 8105

SEQ ID NO: 49537 - DNA, 201 bp, Bos taurus; identical to SEQ ID NO: 8106

SEQ ID NO: 49538 - DNA, 201 bp, Bos taurus; identical to SEQ ID NO: 8107

SEQ ID NO: 49539 - DNA, 201 bp, Bos taurus; identical to SEQ ID NO: 8108

SEQ ID NO: 49540 - DNA, 201 bp, Bos taurus; identical to SEQ ID NO: 8109

SEQ ID NO: 49541 - DNA, 201 bp, Bos taurus; identical to SEQ ID NO: 8110

SEQ ID NO: 49542 - DNA, 201 bp, Bos taurus; identical to SEQ ID NO: 8111

SEQ ID NO: 49543 - DNA, 201 bp, Bos taurus; identical to SEQ ID NO: 8112

SEQ ID NO: 49544 - DNA, 201 bp, Bos taurus; identical to SEQ ID NO: 8113

SEQ ID NO: 49545 - DNA, 201 bp, Bos taurus; identical to SEQ ID NO: 8114

SEQ ID NO: 49546 - DNA, 201 bp, Bos taurus; identical to SEQ ID NO: 8115

SEQ ID NO: 49547 - DNA, 201 bp, Bos taurus; identical to SEQ ID NO: 8116

SEQ ID NO: 49548 - DNA, 201 bp, Bos taurus; identical to SEQ ID NO: 8117

SEQ ID NO: 49549 - DNA, 201 bp, Bos taurus; identical to SEQ ID NO: 8118

SEQ ID NO: 49550 - DNA, 201 bp, Bos taurus; identical to SEQ ID NO: 8119

SEQ ID NO: 49551 - DNA, 201 bp, Bos taurus; identical to SEQ ID NO: 8120

SEQ ID NO: 49552 - DNA, 201 bp, Bos taurus; identical to SEQ ID NO: 8121

SEQ ID NO: 49553 - DNA, 201 bp, Bos taurus; identical to SEQ ID NO: 8122

SEQ ID NO: 49554 - DNA, 201 bp, Bos taurus; identical to SEQ ID NO: 8123

SEQ ID NO: 49555 - DNA, 201 bp, Bos taurus; identical to SEQ ID NO: 8124

SEQ ID NO: 49556 - DNA, 201 bp, Bos taurus; identical to SEQ ID NO: 8125

SEQ ID NO: 49557 - DNA, 201 bp, Bos taurus; identical to SEQ ID NO: 8126

SEQ ID NO: 49558 - DNA, 201 bp, Bos taurus; identical to SEQ ID NO: 8127

SEQ ID NO: 49559 - DNA, 201 bp, Bos taurus; identical to SEQ ID NO: 8128

SEQ ID NO: 49560 - DNA, 201 bp, Bos taurus; identical to SEQ ID NO: 8129

SEQ ID NO: 49561 - DNA, 201 bp, Bos taurus; identical to SEQ ID NO: 8131

SEQ ID NO: 49562 - DNA, 201 bp, Bos taurus; identical to SEQ ID NO: 8132

SEQ ID NO: 49563 - DNA, 201 bp, Bos taurus; identical to SEQ ID NO: 8133

SEQ ID NO: 49564 - DNA, 201 bp, Bos taurus; identical to SEQ ID NO: 8134

SEQ ID NO: 49565 - DNA, 201 bp, Bos taurus; identical to SEQ ID NO: 8135

SEQ ID NO: 49566 - DNA, 201 bp, Bos taurus; identical to SEQ ID NO: 8136

SEQ ID NO: 49567 - DNA, 201 bp, Bos taurus; identical to SEQ ID NO: 8137

SEQ ID NO: 49568 - DNA, 201 bp, Bos taurus; identical to SEQ ID NO: 8138

SEQ ID NO: 49569 - DNA, 201 bp, Bos taurus; identical to SEQ ID NO: 8140

SEQ ID NO: 49570 - DNA, 201 bp, Bos taurus; identical to SEQ ID NO: 8141

SEQ ID NO: 49571 - DNA, 201 bp, Bos taurus; identical to SEQ ID NO: 8142

SEQ ID NO: 49572 - DNA, 201 bp, Bos taurus; identical to SEQ ID NO: 8143

SEQ ID NO: 49573 - DNA, 201 bp, Bos taurus; identical to SEQ ID NO: 8144

SEQ ID NO: 49574 - DNA, 201 bp, Bos taurus; identical to SEQ ID NO: 8145

SEQ ID NO: 49575 - DNA, 201 bp, Bos taurus; identical to SEQ ID NO: 8146

SEQ ID NO: 49576 - DNA, 201 bp, Bos taurus; identical to SEQ ID NO: 8147

SEQ ID NO: 49577 - DNA, 201 bp, Bos taurus; identical to SEQ ID NO: 8148

SEQ ID NO: 49578 - DNA, 201 bp, Bos taurus; identical to SEQ ID NO: 8149

SEQ ID NO: 49579 - DNA, 201 bp, Bos taurus; identical to SEQ ID NO: 8150

SEQ ID NO: 49580 - DNA, 201 bp, Bos taurus; identical to SEQ ID NO: 8151

SEQ ID NO: 49581 - DNA, 201 bp, Bos taurus; identical to SEQ ID NO: 8152

SEQ ID NO: 49582 - DNA, 201 bp, Bos taurus; identical to SEQ ID NO: 8153

SEQ ID NO: 49583 - DNA, 201 bp, Bos taurus; identical to SEQ ID NO: 8154

SEQ ID NO: 49584 - DNA, 201 bp, Bos taurus; identical to SEQ ID NO: 8155

SEQ ID NO: 49585 - DNA, 201 bp, Bos taurus; identical to SEQ ID NO: 8156

SEQ ID NO: 49586 - DNA, 201 bp, Bos taurus; identical to SEQ ID NO: 8157

SEQ ID NO: 49587 - DNA, 201 bp, Bos taurus; identical to SEQ ID NO: 8158

SEQ ID NO: 49588 - DNA, 201 bp, Bos taurus; identical to SEQ ID NO: 8159

SEQ ID NO: 49589 - DNA, 201 bp, Bos taurus; identical to SEQ ID NO: 8160

SEQ ID NO: 49590 - DNA, 201 bp, Bos taurus; identical to SEQ ID NO: 8161

SEQ ID NO: 49591 - DNA, 201 bp, Bos taurus; identical to SEQ ID NO: 8162

SEQ ID NO: 49592 - DNA, 201 bp, Bos taurus; identical to SEQ ID NO: 8163

SEQ ID NO: 49593 - DNA, 201 bp, Bos taurus; identical to SEQ ID NO: 8164

SEQ ID NO: 49594 - DNA, 201 bp, Bos taurus; identical to SEQ ID NO: 8166

SEQ ID NO: 49595 - DNA, 201 bp, Bos taurus; identical to SEQ ID NO: 8167

SEQ ID NO: 49596 - DNA, 201 bp, Bos taurus; identical to SEQ ID NO: 8168

SEQ ID NO: 49597 - DNA, 201 bp, Bos taurus; identical to SEQ ID NO: 8169

SEQ ID NO: 49598 - DNA, 201 bp, Bos taurus; identical to SEQ ID NO: 8170

SEQ ID NO: 49599 - DNA, 201 bp, Bos taurus; identical to SEQ ID NO: 8171

SEQ ID NO: 49600 - DNA, 201 bp, Bos taurus; identical to SEQ ID NO: 8172

SEQ ID NO: 49601 - DNA, 201 bp, Bos taurus; identical to SEQ ID NO: 8173

SEQ ID NO: 49602 - DNA, 201 bp, Bos taurus; identical to SEQ ID NO: 8174

SEQ ID NO: 49603 - DNA, 201 bp, Bos taurus; identical to SEQ ID NO: 8175

SEQ ID NO: 49604 - DNA, 201 bp, Bos taurus; identical to SEQ ID NO: 8176

SEQ ID NO: 49605 - DNA, 201 bp, Bos taurus; identical to SEQ ID NO: 8177

SEQ ID NO: 49606 - DNA, 201 bp, Bos taurus; identical to SEQ ID NO: 8178

SEQ ID NO: 49607 - DNA, 201 bp, Bos taurus; identical to SEQ ID NO: 8179

SEQ ID NO: 49608 - DNA, 201 bp, Bos taurus; identical to SEQ ID NO: 8180

SEQ ID NO: 49609 - DNA, 201 bp, Bos taurus; identical to SEQ ID NO: 8181

SEQ ID NO: 49610 - DNA, 201 bp, Bos taurus; identical to SEQ ID NO: 8182

SEQ ID NO: 49611 - DNA, 201 bp, Bos taurus; identical to SEQ ID NO: 8183

SEQ ID NO: 49612 - DNA, 201 bp, Bos taurus; identical to SEQ ID NO: 8184

SEQ ID NO: 49613 - DNA, 201 bp, Bos taurus; identical to SEQ ID NO: 8185

SEQ ID NO: 49614 - DNA, 201 bp, Bos taurus; identical to SEQ ID NO: 8186

SEQ ID NO: 49615 - DNA, 201 bp, Bos taurus; identical to SEQ ID NO: 8187

SEQ ID NO: 49616 - DNA, 201 bp, Bos taurus; identical to SEQ ID NO: 8188

SEQ ID NO: 49617 - DNA, 201 bp, Bos taurus; identical to SEQ ID NO: 8189

SEQ ID NO: 49618 - DNA, 201 bp, Bos taurus; identical to SEQ ID NO: 8190

SEQ ID NO: 49619 - DNA, 201 bp, Bos taurus; identical to SEQ ID NO: 8191

SEQ ID NO: 49620 - DNA, 201 bp, Bos taurus; identical to SEQ ID NO: 8192

SEQ ID NO: 49621 - DNA, 201 bp, Bos taurus; identical to SEQ ID NO: 8193

SEQ ID NO: 49622 - DNA, 201 bp, Bos taurus; identical to SEQ ID NO: 8194

SEQ ID NO: 49623 - DNA, 201 bp, Bos taurus; identical to SEQ ID NO: 8195

SEQ ID NO: 49624 - DNA, 201 bp, Bos taurus; identical to SEQ ID NO: 8196

SEQ ID NO: 49625 - DNA, 201 bp, Bos taurus; identical to SEQ ID NO: 8197

SEQ ID NO: 49626 - DNA, 201 bp, Bos taurus; identical to SEQ ID NO: 8198

SEQ ID NO: 49627 - DNA, 201 bp, Bos taurus; identical to SEQ ID NO: 8199

SEQ ID NO: 49628 - DNA, 201 bp, Bos taurus; identical to SEQ ID NO: 8200

SEQ ID NO: 49629 - DNA, 201 bp, Bos taurus; identical to SEQ ID NO: 8201

SEQ ID NO: 49630 - DNA, 201 bp, Bos taurus; identical to SEQ ID NO: 8202

SEQ ID NO: 49631 - DNA, 201 bp, Bos taurus; identical to SEQ ID NO: 8203

SEQ ID NO: 49632 - DNA, 201 bp, Bos taurus; identical to SEQ ID NO: 8204

SEQ ID NO: 49633 - DNA, 201 bp, Bos taurus; identical to SEQ ID NO: 8205

SEQ ID NO: 49634 - DNA, 201 bp, Bos taurus; identical to SEQ ID NO: 8206

SEQ ID NO: 49635 - DNA, 201 bp, Bos taurus; identical to SEQ ID NO: 8207

SEQ ID NO: 49636 - DNA, 201 bp, Bos taurus; identical to SEQ ID NO: 8208

SEQ ID NO: 49637 - DNA, 201 bp, Bos taurus; identical to SEQ ID NO: 8209

SEQ ID NO: 49638 - DNA, 201 bp, Bos taurus; identical to SEQ ID NO: 8210

SEQ ID NO: 49639 - DNA, 201 bp, Bos taurus; identical to SEQ ID NO: 8211

SEQ ID NO: 49640 - DNA, 201 bp, Bos taurus; identical to SEQ ID NO: 8212

SEQ ID NO: 49641 - DNA, 201 bp, Bos taurus; identical to SEQ ID NO: 8213

SEQ ID NO: 49642 - DNA, 201 bp, Bos taurus; identical to SEQ ID NO: 8214

SEQ ID NO: 49643 - DNA, 201 bp, Bos taurus; identical to SEQ ID NO: 8215

SEQ ID NO: 49644 - DNA, 201 bp, Bos taurus; identical to SEQ ID NO: 8216

SEQ ID NO: 49645 - DNA, 201 bp, Bos taurus; identical to SEQ ID NO: 8217

SEQ ID NO: 49646 - DNA, 201 bp, Bos taurus; identical to SEQ ID NO: 8218

SEQ ID NO: 49647 - DNA, 201 bp, Bos taurus; identical to SEQ ID NO: 8219

SEQ ID NO: 49648 - DNA, 201 bp, Bos taurus; identical to SEQ ID NO: 8220

SEQ ID NO: 49649 - DNA, 201 bp, Bos taurus; identical to SEQ ID NO: 8221

SEQ ID NO: 49650 - DNA, 201 bp, Bos taurus; identical to SEQ ID NO: 8222

SEQ ID NO: 49651 - DNA, 201 bp, Bos taurus; identical to SEQ ID NO: 8223

SEQ ID NO: 49652 - DNA, 201 bp, Bos taurus; identical to SEQ ID NO: 8224

SEQ ID NO: 49653 - DNA, 201 bp, Bos taurus; identical to SEQ ID NO: 8225

SEQ ID NO: 49654 - DNA, 201 bp, Bos taurus; identical to SEQ ID NO: 8226

SEQ ID NO: 49655 - DNA, 201 bp, Bos taurus; identical to SEQ ID NO: 8228

SEQ ID NO: 49656 - DNA, 201 bp, Bos taurus; identical to SEQ ID NO: 8229

SEQ ID NO: 49657 - DNA, 201 bp, Bos taurus; identical to SEQ ID NO: 8231

SEQ ID NO: 49658 - DNA, 201 bp, Bos taurus; identical to SEQ ID NO: 8232

SEQ ID NO: 49659 - DNA, 201 bp, Bos taurus; identical to SEQ ID NO: 8234

SEQ ID NO: 49660 - DNA, 201 bp, Bos taurus; identical to SEQ ID NO: 8235

SEQ ID NO: 49661 - DNA, 201 bp, Bos taurus; identical to SEQ ID NO: 8236

SEQ ID NO: 49662 - DNA, 201 bp, Bos taurus; identical to SEQ ID NO: 8237

SEQ ID NO: 49663 - DNA, 201 bp, Bos taurus; identical to SEQ ID NO: 8238

SEQ ID NO: 49664 - DNA, 201 bp, Bos taurus; identical to SEQ ID NO: 8239

SEQ ID NO: 49665 - DNA, 201 bp, Bos taurus; identical to SEQ ID NO: 8240

SEQ ID NO: 49666 - DNA, 201 bp, Bos taurus; identical to SEQ ID NO: 8241

SEQ ID NO: 49667 - DNA, 201 bp, Bos taurus; identical to SEQ ID NO: 8242

SEQ ID NO: 49668 - DNA, 201 bp, Bos taurus; identical to SEQ ID NO: 8243

SEQ ID NO: 49669 - DNA, 201 bp, Bos taurus; identical to SEQ ID NO: 8244

SEQ ID NO: 49670 - DNA, 201 bp, Bos taurus; identical to SEQ ID NO: 8245

SEQ ID NO: 49671 - DNA, 201 bp, Bos taurus; identical to SEQ ID NO: 8246

SEQ ID NO: 49672 - DNA, 201 bp, Bos taurus; identical to SEQ ID NO: 8247

SEQ ID NO: 49673 - DNA, 201 bp, Bos taurus; identical to SEQ ID NO: 8248

SEQ ID NO: 49674 - DNA, 201 bp, Bos taurus; identical to SEQ ID NO: 8249

SEQ ID NO: 49675 - DNA, 201 bp, Bos taurus; identical to SEQ ID NO: 8250

SEQ ID NO: 49676 - DNA, 201 bp, Bos taurus; identical to SEQ ID NO: 8251

SEQ ID NO: 49677 - DNA, 201 bp, Bos taurus; identical to SEQ ID NO: 8252

SEQ ID NO: 49678 - DNA, 201 bp, Bos taurus; identical to SEQ ID NO: 8253

SEQ ID NO: 49679 - DNA, 201 bp, Bos taurus; identical to SEQ ID NO: 8254

SEQ ID NO: 49680 - DNA, 201 bp, Bos taurus
gccattgctctgatgacgttcggcactatgtatcccatgagcgtgtacagtgggaaagtgttactccaggtaatggtcatctttcagtatgcatgcttagaattagccatgttcttttaccagattataaaaataaacgtgttcatctgccagattatgaaatttttaggagggtcctgttggagatgaagccaaacagta

SEQ ID NO: 49681 - DNA, 201 bp, Bos taurus; identical to SEQ ID NO: 8256

SEQ ID NO: 49682 - DNA, 201 bp, Bos taurus; identical to SEQ ID NO: 8259

SEQ ID NO: 49683 - DNA, 201 bp, Bos taurus; identical to SEQ ID NO: 8260

SEQ ID NO: 49684 - DNA, 201 bp, Bos taurus; identical to SEQ ID NO: 8261

SEQ ID NO: 49685 - DNA, 201 bp, Bos taurus
cagcgtgagtgcctgcaggtcagatgggcaccgggtcctggaagtgggggactgagtctcttctccagtgctcttggaggtggatattctgccaactggatgaagtacaaataatcaaaatcataaaatgaggttctgccatgacattaaaaaaaaccattcccagcactgtcccactctgccccacccaacgccagctgg

SEQ ID NO: 49686 - DNA, 201 bp, Bos taurus; identical to SEQ ID NO: 8262

SEQ ID NO: 49687 - DNA, 201 bp, Bos taurus; identical to SEQ ID NO: 8263

SEQ ID NO: 49688 - DNA, 201 bp, Bos taurus; identical to SEQ ID NO: 8264

SEQ ID NO: 49689 - DNA, 201 bp, Bos taurus
tacatcagatcgaatttattgtcttttaatactgttctggaaaggtaaggtttttggtagtattggtttttataaaatgctgattggagaggtttactattctaacccttttaaattccattattgtacaattcaacatgctggggggtcagatcaaaatgtgtttttaagaaattgcagaaaggttttaatatgtctagg

SEQ ID NO: 49690 - DNA, 201 bp, Bos taurus; identical to SEQ ID NO: 8266

SEQ ID NO: 49691 - DNA, 201 bp, Bos taurus; identical to SEQ ID NO: 8267

SEQ ID NO: 49692 - DNA, 201 bp, Bos taurus; identical to SEQ ID NO: 8269

SEQ ID NO: 49693 - DNA, 201 bp, Bos taurus; identical to SEQ ID NO: 8271

SEQ ID NO: 49694 - DNA, 201 bp, Bos taurus; identical to SEQ ID NO: 8272

SEQ ID NO: 49695 - DNA, 201 bp, Bos taurus; identical to SEQ ID NO: 8273

SEQ ID NO: 49696 - DNA, 201 bp, Bos taurus
ttctgagtagtaaagaggttgtttatgcgaactcaaccaagccagtgtaaagtcccatctgattctgaaggccattgcctctcaccatctcattatgaccgaatggctgggctctctggttcagatagcattgccttctgcatgtggtggggctttactagcctatcttttatggctagatattgggaaacagaatcttca

SEQ ID NO: 49697 - DNA, 201 bp, Bos taurus; identical to SEQ ID NO: 8275

SEQ ID NO: 49698 - DNA, 201 bp, Bos taurus; identical to SEQ ID NO: 8277

SEQ ID NO: 49699 - DNA, 201 bp, Bos taurus; identical to SEQ ID NO: 8278

SEQ ID NO: 49700 - DNA, 201 bp, Bos taurus; identical to SEQ ID NO: 8279

SEQ ID NO: 49701 - DNA, 201 bp, Bos taurus; identical to SEQ ID NO: 8280

SEQ ID NO: 49702 - DNA, 201 bp, Bos taurus; identical to SEQ ID NO: 8281

SEQ ID NO: 49703 - DNA, 201 bp, Bos taurus
taaacaaagaccctgaagaattgtcctgtatcagtgatttaaggcacctctttaccgtgcttctcttcattagagaggatgctcataccctttttctctgagtgtgtatttctgcctagcttctatcctaaataaactatttctctgtgtgctctcctattcactgtactgggtctaataataaatgctgaacctgttttt

SEQ ID NO: 49704 - DNA, 201 bp, Bos taurus
accctagaatagctcaagccatgtagatagtgaaggaaaattcatttaaaggcaattatgtttcctctcattttgttttactttttcatgctgtcagccccggaagtgtaaagagcttctaaatggctggtgctggtaagtagtcaaatatttagaagccaagggtctttaatcacctaagtgctttacaatgaatactga

SEQ ID NO: 49705 - DNA, 201 bp, Bos taurus; identical to SEQ ID NO: 8282

SEQ ID NO: 49706 - DNA, 201 bp, Bos taurus; identical to SEQ ID NO: 8284

SEQ ID NO: 49707 - DNA, 201 bp, Bos taurus
atcaattcaaggccaatcctgttttaatctgttgagaccttagccagtaaatcctctaggactagatgtgctggaaaggtcctgcaaagtgatatttgttgtattaaaagcacccttggcctgccttacgatgcatagtgattggtttccaaaccttaaactggtctcattaaatgggaaatttttttaaatttaaattat

SEQ ID NO: 49708 - DNA, 201 bp, Bos taurus
ccagttttttcacggtgcagtcaacacaggcttctcacacaagcgggaaaggacagtggcgaggccaggagcgatgtgtttctgctcggcgctccacggcggggcctcgctgaatggcttgttgtttcagagggagcctagaaccagaaagcagacaaacagaagcccacacaaatgtaaatgttgtataaaatcagatac

SEQ ID NO: 49709 - DNA, 201 bp, Bos taurus; identical to SEQ ID NO: 8288

SEQ ID NO: 49710 - DNA, 201 bp, Bos taurus; identical to SEQ ID NO: 8290

SEQ ID NO: 49711 - DNA, 201 bp, Bos taurus; identical to SEQ ID NO: 8291

SEQ ID NO: 49712 - DNA, 201 bp, Bos taurus; identical to SEQ ID NO: 8292

SEQ ID NO: 49713 - DNA, 201 bp, Bos taurus; identical to SEQ ID NO: 8293

SEQ ID NO: 49714 - DNA, 201 bp, Bos taurus; identical to SEQ ID NO: 8294

SEQ ID NO: 49715 - DNA, 201 bp, Bos taurus; identical to SEQ ID NO: 8295

SEQ ID NO: 49716 - DNA, 201 bp, Bos taurus; identical to SEQ ID NO: 8297

SEQ ID NO: 49717 - DNA, 201 bp, Bos taurus; identical to SEQ ID NO: 8298

SEQ ID NO: 49718 - DNA, 201 bp, Bos taurus; identical to SEQ ID NO: 8299

SEQ ID NO: 49719 - DNA, 201 bp, Bos taurus
caaggccaagcagagaggagctctgcaaacagagtgatgagtgagaggaaatacccacatgcccccaccctatcctcatcccctaggagctgagagagacgtgaaagaaatggcctcacagcatgaaaactagaaaaggctagaagacaatgaagaaatagcatgccaccagtcatttctactcatgcaagatgagtaggc

SEQ ID NO: 49720 - DNA, 201 bp, Bos taurus
gttgggaactgcactttgagaactgcttctagggccttctctcagaggagcctttagccatgcacagaatagaaggtagagacaaaactgccttgcccaggagaaacaaggcctatcctggtcatctggccattctcctggcctcctcaggccattcacatcttccagaagcacctcttcctccaggaatcttggacctcg

SEQ ID NO: 49721 - DNA, 201 bp, Bos taurus; identical to SEQ ID NO: 8300

SEQ ID NO: 49722 - DNA, 201 bp, Bos taurus
aagagctcttagacagcatctaatccaatccccaaactgatttaagtaactcgtctttatcctacatccaactctaccctaacagttcacttaatgaattcttttaaaataatcttcatgtgaatgaggtaaaactattgtttttttgaggtaatgaggtaaaactattgaactttggaaacagaattagcgtgaaacctt

SEQ ID NO: 49723 - DNA, 201 bp, Bos taurus; identical to SEQ ID NO: 8301

SEQ ID NO: 49724 - DNA, 201 bp, Bos taurus
catacaaaatcttttaactcctatagtataaactgcaaagagtgcttttatttcatatgctcatacaaatgtcttttttcccctagttgatgtgtgaaaagttgggagctcaacaaatggttttgccaggcaaaaaccattaatcagagtgagatggggttttagctgcaaaagatgagcccttcaaaagccccatctgta

SEQ ID NO: 49725 - DNA, 201 bp, Bos taurus; identical to SEQ ID NO: 8302

SEQ ID NO: 49726 - DNA, 201 bp, Bos taurus; identical to SEQ ID NO: 8303

SEQ ID NO: 49727 - DNA, 201 bp, Bos taurus; identical to SEQ ID NO: 8304

SEQ ID NO: 49728 - DNA, 201 bp, Bos taurus; identical to SEQ ID NO: 8305

SEQ ID NO: 49729 - DNA, 201 bp, Bos taurus; identical to SEQ ID NO: 8306

SEQ ID NO: 49730 - DNA, 201 bp, Bos taurus; identical to SEQ ID NO: 8307

SEQ ID NO: 49731 - DNA, 201 bp, Bos taurus; identical to SEQ ID NO: 8308

SEQ ID NO: 49732 - DNA, 201 bp, Bos taurus; identical to SEQ ID NO: 8309

SEQ ID NO: 49733 - DNA, 201 bp, Bos taurus; identical to SEQ ID NO: 8310

SEQ ID NO: 49734 - DNA, 201 bp, Bos taurus; identical to SEQ ID NO: 8311

SEQ ID NO: 49735 - DNA, 201 bp, Bos taurus; identical to SEQ ID NO: 8312

SEQ ID NO: 49736 - DNA, 201 bp, Bos taurus; identical to SEQ ID NO: 8313

SEQ ID NO: 49737 - DNA, 201 bp, Bos taurus; identical to SEQ ID NO: 8314

SEQ ID NO: 49738 - DNA, 201 bp, Bos taurus; identical to SEQ ID NO: 8315

SEQ ID NO: 49739 - DNA, 201 bp, Bos taurus; identical to SEQ ID NO: 8316

SEQ ID NO: 49740 - DNA, 201 bp, Bos taurus; identical to SEQ ID NO: 8317

SEQ ID NO: 49741 - DNA, 201 bp, Bos taurus; identical to SEQ ID NO: 8318

SEQ ID NO: 49742 - DNA, 201 bp, Bos taurus; identical to SEQ ID NO: 8319

SEQ ID NO: 49743 - DNA, 201 bp, Bos taurus; identical to SEQ ID NO: 8320

SEQ ID NO: 49744 - DNA, 201 bp, Bos taurus; identical to SEQ ID NO: 8321

SEQ ID NO: 49745 - DNA, 201 bp, Bos taurus; identical to SEQ ID NO: 8322

SEQ ID NO: 49746 - DNA, 201 bp, Bos taurus; identical to SEQ ID NO: 8323

SEQ ID NO: 49747 - DNA, 201 bp, Bos taurus; identical to SEQ ID NO: 8324

SEQ ID NO: 49748 - DNA, 201 bp, Bos taurus; identical to SEQ ID NO: 8325

SEQ ID NO: 49749 - DNA, 201 bp, Bos taurus; identical to SEQ ID NO: 8326

SEQ ID NO: 49750 - DNA, 201 bp, Bos taurus; identical to SEQ ID NO: 8327

SEQ ID NO: 49751 - DNA, 201 bp, Bos taurus; identical to SEQ ID NO: 8328

SEQ ID NO: 49752 - DNA, 201 bp, Bos taurus; identical to SEQ ID NO: 8329

SEQ ID NO: 49753 - DNA, 201 bp, Bos taurus; identical to SEQ ID NO: 8330

SEQ ID NO: 49754 - DNA, 201 bp, Bos taurus; identical to SEQ ID NO: 8331

SEQ ID NO: 49755 - DNA, 201 bp, Bos taurus; identical to SEQ ID NO: 8332

SEQ ID NO: 49756 - DNA, 201 bp, Bos taurus; identical to SEQ ID NO: 8333

SEQ ID NO: 49757 - DNA, 201 bp, Bos taurus; identical to SEQ ID NO: 8334

SEQ ID NO: 49758 - DNA, 201 bp, Bos taurus; identical to SEQ ID NO: 8335

SEQ ID NO: 49759 - DNA, 201 bp, Bos taurus; identical to SEQ ID NO: 8336

SEQ ID NO: 49760 - DNA, 201 bp, Bos taurus; identical to SEQ ID NO: 8337

SEQ ID NO: 49761 - DNA, 201 bp, Bos taurus; identical to SEQ ID NO: 8338

SEQ ID NO: 49762 - DNA, 201 bp, Bos taurus; identical to SEQ ID NO: 8339

SEQ ID NO: 49763 - DNA, 201 bp, Bos taurus; identical to SEQ ID NO: 8340

SEQ ID NO: 49764 - DNA, 201 bp, Bos taurus; identical to SEQ ID NO: 8342

SEQ ID NO: 49765 - DNA, 201 bp, Bos taurus; identical to SEQ ID NO: 8343

SEQ ID NO: 49766 - DNA, 201 bp, Bos taurus; identical to SEQ ID NO: 8344

SEQ ID NO: 49767 - DNA, 201 bp, Bos taurus; identical to SEQ ID NO: 8345

SEQ ID NO: 49768 - DNA, 201 bp, Bos taurus; identical to SEQ ID NO: 8346

SEQ ID NO: 49769 - DNA, 201 bp, Bos taurus; identical to SEQ ID NO: 8347

SEQ ID NO: 49770 - DNA, 201 bp, Bos taurus; identical to SEQ ID NO: 8348

SEQ ID NO: 49771 - DNA, 201 bp, Bos taurus; identical to SEQ ID NO: 8349

SEQ ID NO: 49772 - DNA, 201 bp, Bos taurus; identical to SEQ ID NO: 8350

SEQ ID NO: 49773 - DNA, 201 bp, Bos taurus; identical to SEQ ID NO: 8351

SEQ ID NO: 49774 - DNA, 201 bp, Bos taurus; identical to SEQ ID NO: 8352

SEQ ID NO: 49775 - DNA, 201 bp, Bos taurus; identical to SEQ ID NO: 8353

SEQ ID NO: 49776 - DNA, 201 bp, Bos taurus; identical to SEQ ID NO: 8354

SEQ ID NO: 49777 - DNA, 201 bp, Bos taurus; identical to SEQ ID NO: 8355

SEQ ID NO: 49778 - DNA, 201 bp, Bos taurus; identical to SEQ ID NO: 8357

SEQ ID NO: 49779 - DNA, 201 bp, Bos taurus; identical to SEQ ID NO: 8358

SEQ ID NO: 49780 - DNA, 201 bp, Bos taurus; identical to SEQ ID NO: 8359

SEQ ID NO: 49781 - DNA, 201 bp, Bos taurus; identical to SEQ ID NO: 8360

SEQ ID NO: 49782 - DNA, 201 bp, Bos taurus; identical to SEQ ID NO: 8361

SEQ ID NO: 49783 - DNA, 201 bp, Bos taurus; identical to SEQ ID NO: 8362

SEQ ID NO: 49784 - DNA, 201 bp, Bos taurus; identical to SEQ ID NO: 8363

SEQ ID NO: 49785 - DNA, 201 bp, Bos taurus; identical to SEQ ID NO: 8364

SEQ ID NO: 49786 - DNA, 201 bp, Bos taurus; identical to SEQ ID NO: 8365

SEQ ID NO: 49787 - DNA, 201 bp, Bos taurus
ttagtccaataagaggtttgggactttcaaatcacaaccacagtacggctgaatggccaggcccgacagtttagtcacgctgcttttgtggccatcttcccactgagcactcgactcagttataccattaaaattagtacaattccaaagaggctttggtccctagggcccctccgttatggaaaggtgtgaacagaaaat

SEQ ID NO: 49788 - DNA, 201 bp, Bos taurus
ggtgtggaaagcagggagggcagaacaacctctgagactctagccaactgcagtatatattaagggcagcccagatggccgctagccaacaacccgtgccgggtaatttgcaagctgcactttctccttttgaaggtctctttctccaggatacggggaggaggtctgtcccttcccacttctgcacctgccacctgagca

SEQ ID NO: 49789 - DNA, 201 bp, Bos taurus; identical to SEQ ID NO: 8366

SEQ ID NO: 49790 - DNA, 201 bp, Bos taurus
gctggaatgacccaggcaggagaggctgctttccagtgaagagtggggccgggtgcaggtgtgtgcagtgaagggtgggctcagcaggctggggtgctcacacctgcactttccaaaggcttggcccttgagctgctcctgggagaaaacctctgagccctgggaagatcctgctggatagcagtgtctttgttcacctgg

SEQ ID NO: 49791 - DNA, 201 bp, Bos taurus; identical to SEQ ID NO: 8367

SEQ ID NO: 49792 - DNA, 201 bp, Bos taurus
tccattacaagaaaaagaaagttctttccgtatcaatatgaactggtttcaaggtgtttaaagtgaaaatgaaaataagataccgaacagtattttgtttcattatttgtgtaaacacaaaagcacacggacacctagaaagtggacactagtcacccccggggcagtctgcagcttagggacatgagaaggactgattct

SEQ ID NO: 49793 - DNA, 201 bp, Bos taurus; identical to SEQ ID NO: 8368

SEQ ID NO: 49794 - DNA, 201 bp, Bos taurus; identical to SEQ ID NO: 8369

SEQ ID NO: 49795 - DNA, 201 bp, Bos taurus
aaagaggcaaacatctagctatacaggaggcaagggagctggagtctaactgcatttcttaaagccttaaaaccagtactctgggatttagccttgtcctccactcagccttcacaggtaccgtgctactaattcctgagttgtgggagggggaggggtgtgtgtggcgtggactggcctgatttggcttgttccttgtag

SEQ ID NO: 49796 - DNA, 201 bp, Bos taurus; identical to SEQ ID NO: 8371

SEQ ID NO: 49797 - DNA, 201 bp, Bos taurus; identical to SEQ ID NO: 8372

SEQ ID NO: 49798 - DNA, 201 bp, Bos taurus; identical to SEQ ID NO: 8373

SEQ ID NO: 49799 - DNA, 201 bp, Bos taurus; identical to SEQ ID NO: 8374

SEQ ID NO: 49800 - DNA, 201 bp, Bos taurus; identical to SEQ ID NO: 8375

SEQ ID NO: 49801 - DNA, 201 bp, Bos taurus; identical to SEQ ID NO: 8376

SEQ ID NO: 49802 - DNA, 201 bp, Bos taurus; identical to SEQ ID NO: 8377

SEQ ID NO: 49803 - DNA, 201 bp, Bos taurus; identical to SEQ ID NO: 8379

SEQ ID NO: 49804 - DNA, 201 bp, Bos taurus; identical to SEQ ID NO: 8380

SEQ ID NO: 49805 - DNA, 201 bp, Bos taurus; identical to SEQ ID NO: 8381

SEQ ID NO: 49806 - DNA, 201 bp, Bos taurus; identical to SEQ ID NO: 8382

SEQ ID NO: 49807 - DNA, 201 bp, Bos taurus
tggtagttggggtacggggccttagttacttagcagcatgtgggatcttctgactagggtttgaacctgtgtcccctgcactggcaggcagattcttaacgactggcccaccaggggaaccccaaggtttattctttaaagggagcagagaatgtctgaactggagacaccagggaccacttatggatgctgggtgctgag

SEQ ID NO: 49808 - DNA, 201 bp, Bos taurus; identical to SEQ ID NO: 8383

SEQ ID NO: 49809 - DNA, 201 bp, Bos taurus; identical to SEQ ID NO: 8387

SEQ ID NO: 49810 - DNA, 201 bp, Bos taurus; identical to SEQ ID NO: 8388

SEQ ID NO: 49811 - DNA, 201 bp, Bos taurus; identical to SEQ ID NO: 8390

SEQ ID NO: 49812 - DNA, 201 bp, Bos taurus; identical to SEQ ID NO: 8391

SEQ ID NO: 49813 - DNA, 201 bp, Bos taurus; identical to SEQ ID NO: 8392

SEQ ID NO: 49814 - DNA, 201 bp, Bos taurus; identical to SEQ ID NO: 8393

SEQ ID NO: 49815 - DNA, 201 bp, Bos taurus
gtgaaggccagggaagcctggtgtactgcagtccaaggagtctcaaagactcagatacaactgagcgactaaacaataacaatctaaatgggaacaaactggatgtttttaaggccatccagtatgatgaagccatatcaatactgaattaatacatcaccaaagaaattatatatgcagaatatcaaactaataataatg

SEQ ID NO: 49816 - DNA, 201 bp, Bos taurus; identical to SEQ ID NO: 8394

SEQ ID NO: 49817 - DNA, 201 bp, Bos taurus
gtcacttaaaataactttttgctgtgtggttgaggcaccaagttgatgcattgcttggttcattttatctttgattcttataaactgttgtttggctttatatttttcctatatttgggtaaagtatttatgtgtttctcaacaaaagtattaagtaaaatattttctgtgaagtttggtttctgtccctgattccttcaa

SEQ ID NO: 49818 - DNA, 201 bp, Bos taurus; identical to SEQ ID NO: 8395

SEQ ID NO: 49819 - DNA, 201 bp, Bos taurus; identical to SEQ ID NO: 8396

SEQ ID NO: 49820 - DNA, 201 bp, Bos taurus; identical to SEQ ID NO: 8397

SEQ ID NO: 49821 - DNA, 201 bp, Bos taurus
ctggtgtgctgtggtccattaggtcatagggagtcagacacgactgagcaactgagttgactaagagagatagtcaatttcagttctagtgaaaggtaccgagtaagcctgggacattgggatatgacataaagtacagagcttattgtatattaccatggccatgtcaaaaagaaacaagaacaaagttccaccatctga

SEQ ID NO: 49822 - DNA, 201 bp, Bos taurus
cagcaagttttaataatattaaatatgtgttggaatatgtgccatgttcagacacatctcagtctgaagcatcttgcatactgatgccaaaggagacttatttaaactttaaattttttatttcagttttttttttttttttggtttaccttaaaaaatagaattagtagacaaaatcaaccacttaatttacattttaga

SEQ ID NO: 49823 - DNA, 201 bp, Bos taurus
ttgtttacaacaataaactcaagatataaagggaaagctgagtgtcagaatcttttgggaaatgttttgacattgaactcttcaagcaggatggaatctttccttttctcctcactcaaccccattatgcctctcccttcacctcaagatgatgtctttccctttcagtagctctgagaaggagtttgttaaaacttaatt

SEQ ID NO: 49824 - DNA, 201 bp, Bos taurus
gtgctgcagtccatggagttacaaagagttggacaaaactgagcaactgaacaacaacaaagagagtaagttggaaagttttccgtaaatcaagttcttccgttccctcctatctatgccaatactttcatttttattgcattattatatagaaaggttttgagatagcccacccccttttcctctacttatcttttttca

SEQ ID NO: 49825 - DNA, 201 bp, Bos taurus
aggatgctagtaaagttttgaccaactggaaatgaacatgtgtccctgtgttagaatgatcaataatcactcatgctttcagttatgtatttacctcaagaagcagaaatgatctttagcctagtgtcaaatattaagatgtaggcccatgaccttttccagtaaaatatgtacagttacttagaatatggttttgcacat

SEQ ID NO: 49826 - DNA, 201 bp, Bos taurus; identical to SEQ ID NO: 8398

SEQ ID NO: 49827 - DNA, 201 bp, Bos taurus
agtagtcactggatgtcagcattgtttcactaaaatctgtttaccagtattatttttgactgggaaatttataattcttaagtataccaaaatcaccctatattgttttgatcttagagacaaagggaaaaagtcatgtgagcaaaggcaaaagcctcttaaaaaaaagtatgattgattatctttcagtagctaaatttc

SEQ ID NO: 49828 - DNA, 201 bp, Bos taurus; identical to SEQ ID NO: 8399

SEQ ID NO: 49829 - DNA, 201 bp, Bos taurus; identical to SEQ ID NO: 8400

SEQ ID NO: 49830 - DNA, 201 bp, Bos taurus; identical to SEQ ID NO: 8401

SEQ ID NO: 49831 - DNA, 201 bp, Bos taurus
aaaaacaactgactgactctagggccctgggacctcgatttaagtcattaccaaagaggggtgtctccagctggtaagtgttggtgatgctttcagttcctgttctggccctgtttataaaagtttcactctttcgctattcctgctttgcatgtaaaggtgatgctaaaactgagcttggtttgtaactacagacagctt

SEQ ID NO: 49832 - DNA, 201 bp, Bos taurus
catggaaactaatggacaggggccaaagatactgctaacatcctaaaatacacaggatattatcccccaccatgaagaattatctgcccctgaatatcaacagcatcaaggtcaagaaatccaggcctagggaaatacccatgtgtataaatgataggcagatgaaaagttaaagttagaaacacaatacagtaagttcaa

SEQ ID NO: 49833 - DNA, 201 bp, Bos taurus
catggactgtagtgcaccaggcacctctgtccatggaattctccaggcaaaagtatggagtgggtagctattctcttctccagaggatctttccaacccaaggattgaaattaggtctccggcattacaggggaattctttactttctaggccatgagggaagcccaaagcctacatggttaactctgaatttagcatttt

SEQ ID NO: 49834 - DNA, 201 bp, Bos taurus; identical to SEQ ID NO: 8402

SEQ ID NO: 49835 - DNA, 201 bp, Bos taurus; identical to SEQ ID NO: 8403

SEQ ID NO: 49836 - DNA, 201 bp, Bos taurus; identical to SEQ ID NO: 8404

SEQ ID NO: 49837 - DNA, 201 bp, Bos taurus; identical to SEQ ID NO: 8405

SEQ ID NO: 49838 - DNA, 201 bp, Bos taurus
gaaataacaaacaaggccctctgacaggagctggtttctagcaagtggtttcagggcaggcactctgctataggggtttagctagactaaggaaaaaatcactttccacaggctagtggggccagcgtattccttcaggattacgtttatttttatctaaatcagaccatctaccccaatgcctaagcctcaaaactaggt

SEQ ID NO: 49839 - DNA, 201 bp, Bos taurus
ccagtgagccacatgatgtgtccagtttctgacacagatgctcggaaaccagaggccttcagctgtctggggtgtggccagtcattgtgcgaaaggccccggactccagcatcagcacccctaccctttctggaagatgtgggagaattcagttaaggagggggacagggtcagtctaagcaaattctcaggtccacttgg

SEQ ID NO: 49840 - DNA, 201 bp, Bos taurus
gcttatcatatagttggaatctttcaaagtttgaaactttgttttgaaagcctcggggcatcattgctggatggtaagcaggagaaagataaaatcagcttgggcctttccccatgtctattgtctaggaggatggggaggcgggaattaccaacttgaagctcaaggagccctgatgagattccactccccagtctgtcc

SEQ ID NO: 49841 - DNA, 201 bp, Bos taurus
ctctattctgcctggctttggggaaccatatgggccctagggcgctctcatctgcttccccacacacccatgcgcaggtcctcctagggcctgagcacccggctactcctaggtttgaattcaggcatccagggctgcccatctccggtctgatgctgagacaggagagtggcttttgaggcctggagtctgggattaaat

SEQ ID NO: 49842 - DNA, 201 bp, Bos taurus; identical to SEQ ID NO: 8406

SEQ ID NO: 49843 - DNA, 201 bp, Bos taurus; identical to SEQ ID NO: 8407

SEQ ID NO: 49844 - DNA, 201 bp, Bos taurus
cttctggtggtatttctctctatgttgaattttcttagtgtctgaggttatttttagctgttacttcagtgagcttcaaggttgcacgacctgttttaactgcccgtgtctctgattactccttgccatgacagcattttcgtgtgatgctcgggaaagaaatgagatcttttcttccaggcctttgactcaaagcagaac

SEQ ID NO: 49845 - DNA, 201 bp, Bos taurus; identical to SEQ ID NO: 8409

SEQ ID NO: 49846 - DNA, 201 bp, Bos taurus; identical to SEQ ID NO: 8410

SEQ ID NO: 49847 - DNA, 201 bp, Bos taurus; identical to SEQ ID NO: 8411

SEQ ID NO: 49848 - DNA, 201 bp, Bos taurus
gatcagcagaatcattagattccagaaaatgcagaacctctgaggcctctgtattcttccattctgatgtcagactactggcagcccacgctgagctgccttataagaaagtgcagctaggccactagaaagaagcagaggaaggaggggccagctggcattgctggggtttggaagctctgcactgcagattctgttaac

SEQ ID NO: 49849 - DNA, 201 bp, Bos taurus
gcacttaatccttaatgcacagttaaaaactaagtttggaaaaaaaaaacttaagtgtgagccagagggggctctttgggcttaataaagaggcccttatttcctacagtgaaaaaaccgacatgggattagacagttacaagagctctgaagatacctagatcttcagcctagggaggtttgctatacagctagggccct

SEQ ID NO: 49850 - DNA, 201 bp, Bos taurus
atgtgtttattggaaatagtttctaacaaagtattaaattatcattatgattctgaaaatagtccttatggagcaaacttttaatacctattattagcatcattactatatgtactaacttgaaagttatgtacaattctttctcgaaaaactcaattttaagcaaatcaaactaacatatgccctctggtctcagttccc

SEQ ID NO: 49851 - DNA, 201 bp, Bos taurus
aacagtgttggctacctgtagtaggaggcagctaatgagttttagcattattatttaatattacaattgtagtcatcactacaccctttcttctaaatcttttgtgttgtttcttcttttgttaactttgctaagaacttcccaaatatgattgtaagctgactgcagggcacgaagatgaggtgataactgctgctgctg

SEQ ID NO: 49852 - DNA, 201 bp, Bos taurus; identical to SEQ ID NO: 8413

SEQ ID NO: 49853 - DNA, 201 bp, Bos taurus; identical to SEQ ID NO: 8414

SEQ ID NO: 49854 - DNA, 201 bp, Bos taurus
cttagtaaagagggattgaaaatattatatttttattaaattaaataaaattcttatcaatccatctaatgtaacaaacagaaattaaatagcaaagcatagattagtcacaccataagttcagtcatcaagtaagtcagttgtaggtgtaacatatttaacttaaaataatccttccaaagccgctgtgtatacaagccc

SEQ ID NO: 49855 - DNA, 201 bp, Bos taurus; identical to SEQ ID NO: 8415

SEQ ID NO: 49856 - DNA, 201 bp, Bos taurus; identical to SEQ ID NO: 8416

SEQ ID NO: 49857 - DNA, 201 bp, Bos taurus; identical to SEQ ID NO: 8417

SEQ ID NO: 49858 - DNA, 201 bp, Bos taurus
cacccatgatggaactcaaatagtactttggtctttatttccattatcatctgggagttttatgtatattgtctcatttttcatcttcacaatgatatggcatctgtattttcgttattaaacacagagatctggatatcaagaaggattacattgcccatctattttccttagtaatataagatctgggattcaaatcca

SEQ ID NO: 49859 - DNA, 201 bp, Bos taurus; identical to SEQ ID NO: 8418

SEQ ID NO: 49860 - DNA, 201 bp, Bos taurus; identical to SEQ ID NO: 8419

SEQ ID NO: 49861 - DNA, 201 bp, Bos taurus; identical to SEQ ID NO: 8421

SEQ ID NO: 49862 - DNA, 201 bp, Bos taurus; identical to SEQ ID NO: 8422

SEQ ID NO: 49863 - DNA, 201 bp, Bos taurus
acacaggcccctgccctttgatttctccatccttagttttggcccttacactgtttgtctatttacagtcgtcagcaaaattgttctgagtgtctgtgtgcgctgtgcttgagggcctggggtgtgcaaaaccccatgaggaataagaaggatgtgatggtgggaccttctgtggaccactctcataggtcaaacaggatt

SEQ ID NO: 49864 - DNA, 201 bp, Bos taurus; identical to SEQ ID NO: 8424

SEQ ID NO: 49865 - DNA, 201 bp, Bos taurus
attgataataggtacctacgtgactttggaatacttggccatcgtgcctccttttaacacaaaactgagacaagtttaaagtccgatcaaggacttgacgaaggagggatggccacttgaggatcttaaatgaccacgtggatgtgaggtggaggtagttgatttcaacttggccattcctgcacctccatggttgaagtc

SEQ ID NO: 49866 - DNA, 201 bp, Bos taurus
actaagcatcaggtacgactgctcctctgtaaagtgtaacttcagaaaactgcccttttctaaatgccttgctttacagaagagggggattcctaggtggcgctagtggtaaaaagcccacctgccaatgcaggagaggcaaaatttaatccctgggatgggaagatcccctggtagaggaaatggcaaccactccaatat

SEQ ID NO: 49867 - DNA, 201 bp, Bos taurus; identical to SEQ ID NO: 8425

SEQ ID NO: 49868 - DNA, 201 bp, Bos taurus; identical to SEQ ID NO: 8426

SEQ ID NO: 49869 - DNA, 201 bp, Bos taurus; identical to SEQ ID NO: 8427

SEQ ID NO: 49870 - DNA, 201 bp, Bos taurus; identical to SEQ ID NO: 8428

SEQ ID NO: 49871 - DNA, 201 bp, Bos taurus; identical to SEQ ID NO: 8429

SEQ ID NO: 49872 - DNA, 201 bp, Bos taurus
ggggaaatatcaatgaatatatagtcggccagattctccccagggcaaaacagaaaaggatcagcatgcaaatctgcccagattactctgtggatctcaatacagggatttgggggccattccaggagagctggggctagtagtagaaggaggaaacctgtcaccatcagcacctcccccccaggcccctcaggactaata

SEQ ID NO: 49873 - DNA, 201 bp, Bos taurus
ctaaggcaggtagaatattttattccattattagctataaaattttaaatactgagatcccttgagaattaatcaagaaaaatcatgtgtttaaaaaaaagcctagtacagtttctgacttgggtttaaatttatactaaagaatgtaagatcttttcttgcaagtaggttttgatgaaaatacagagcataatgcataac

SEQ ID NO: 49874 - DNA, 201 bp, Bos taurus
tcccctgggcagaggagcctggcaggctacagtccacagcgttgcaaagaatgggccatgactgagcaacttttactcactcacaggccagggtaggaaacgacacacagtgcatgaacgcacgtgccactggctacagttcagtcacatggctacggttcagtcacatggctacagttcagtcacatggccacacctgac

SEQ ID NO: 49875 - DNA, 201 bp, Bos taurus; identical to SEQ ID NO: 8431

SEQ ID NO: 49876 - DNA, 201 bp, Bos taurus; identical to SEQ ID NO: 8433

SEQ ID NO: 49877 - DNA, 201 bp, Bos taurus; identical to SEQ ID NO: 8434

SEQ ID NO: 49878 - DNA, 201 bp, Bos taurus
actggaaccactttagcagttctaaaagagccagctctgatccatttccaagaatccacatctggtgatatatgggatgaggcaaactgatcaaagtacctgagtgccaacagtacagggaaaagcagagccaagtgaagagcaggctgtggcttgggggtaaaatgcagtgactaaaatgacaatggactgcacctcata

SEQ ID NO: 49879 - DNA, 201 bp, Bos taurus; identical to SEQ ID NO: 8435

SEQ ID NO: 49880 - DNA, 201 bp, Bos taurus; identical to SEQ ID NO: 8436

SEQ ID NO: 49881 - DNA, 201 bp, Bos taurus; identical to SEQ ID NO: 8437

SEQ ID NO: 49882 - DNA, 201 bp, Bos taurus; identical to SEQ ID NO: 8438

SEQ ID NO: 49883 - DNA, 201 bp, Bos taurus; identical to SEQ ID NO: 8439

SEQ ID NO: 49884 - DNA, 201 bp, Bos taurus; identical to SEQ ID NO: 8440

SEQ ID NO: 49885 - DNA, 201 bp, Bos taurus
ccaagaaacaattcacaaacacgctctccaagggagtgggtttagacccgaaggagccaggtaggcttggagacttggcagtggaattctgggcagaaagagctgcaggtcctaagactaggggctggagcagctcttggaactataggagcctgagtctctgagtttgatgatcaggggcaaggtcagaaacgtaggtga

SEQ ID NO: 49886 - DNA, 201 bp, Bos taurus
aggatgtctgaggctgtgggaccccggcctccgtctcctttctgggagctcctgtggttggatttgggcttgttcatggacccagcccctgatgaacccgaaaggggccccaaaaccagatgctgtgctcagttcttcattttatttttaccaagacatctcagtcaagtgtcaggaacacttatcttatttaagataaga

SEQ ID NO: 49887 - DNA, 201 bp, Bos taurus
agacgttgcatgggtttcttgtactccccctggggtctgaggcagacacacatggggcaaactttgaatagcctcgacaagaatgtgtaaagggcattgtggcaaagtgaacgcagggcctgccccctgctccacagcattaaaaggagcaggaaggaactgtggcagagaagggacaatggcgtgacctggggtaagcat

SEQ ID NO: 49888 - DNA, 201 bp, Bos taurus; identical to SEQ ID NO: 8441

SEQ ID NO: 49889 - DNA, 201 bp, Bos taurus
cacttctccacaatttcctactgcttattccttgccaaccatcagacctatgtaacatacatggcctgctcttgtggatgctagaattcaaggtgctgacagtcaaaggctttaagctttccattggatttgccacagatgaatcgtgtggtccattattttacagatatttaatgctatgcatgataaaattttactttt

SEQ ID NO: 49890 - DNA, 201 bp, Bos taurus
tactggcacaatttctctcataaaatagaaatgatagcactgccctcatagacatctctgtggtgaatctgattattttagctgccttgctggccaataatagcccctgtggcagctcaatcatgtggcatttggaattgattttaaaacaggcagaaacactgactgctgttcttaatttaaaattatttcatgcttaag

SEQ ID NO: 49891 - DNA, 201 bp, Bos taurus
catgaatgtattgctttattatcaaaggagagctaagagtgtgtcacagattggtgggttgatccctgtagatccaaatgaggtgtaggagaccctggcccctttcctttcccaagtgactgacacggacgggaagcaccctggcaagacacttgtcctcttctgaaccccattgtatggcctattgtcatctttacttcc

SEQ ID NO: 49892 - DNA, 201 bp, Bos taurus
actaggtaatttcacccagatggtgtaatcaaaatcaaaatgtttatgttgccaagttcaccaaaaggggagacagagctctcaggagaagagaatcccacacttaggcaacattagatgcaccgagaacaagtttcacttgtcacatgtccttcgagttggtgtccaacgacactaaactcattctttgtattaataatc

SEQ ID NO: 49893 - DNA, 201 bp, Bos taurus
gtgagagcctcgcttccagatttatggtaagggatggatagttctgtccagcctgccaactaatatccaagcagacatgaacaggccgcttttctccctcatttcctgaagggatacagccctgtgcggtgttcagtgagtcctgacgctgcgaagtggctggtgcagggtgactggtccagtcaccctgggccctcccca

SEQ ID NO: 49894 - DNA, 201 bp, Bos taurus
cacgcatccagccttttggtagtgccttgacctccctcatcattcaccctgtactccagctaaactgccctatcctcctgctccctgaatggatcctgcatgttccaacctcaggtgagggcctttgcatttgccattttctctcctgggacacttgttcccggggctccctctctccccgtctcagatctttgttcagtg

SEQ ID NO: 49895 - DNA, 201 bp, Bos taurus; identical to SEQ ID NO: 8445

SEQ ID NO: 49896 - DNA, 201 bp, Bos taurus; identical to SEQ ID NO: 8447

SEQ ID NO: 49897 - DNA, 201 bp, Bos taurus; identical to SEQ ID NO: 8448

SEQ ID NO: 49898 - DNA, 201 bp, Bos taurus
tggccaccctttcagccccagctcccaggagaaccaaggtcaaggccctgtgaagggatggcaaagaggcggctggttggcccatcactgtccttttctggacctgtggcagacattgttaatcaatcaccacactctgcctctgagccagaatggggtttctgctcctcaacctggccttgcgggtggatataacatatc

SEQ ID NO: 49899 - DNA, 201 bp, Bos taurus
ccagggccgtggagacctggtgttccaacctcttgtcccaccttccaccctaagtctacatactgagtccctccggtatctatgaggtttaggttacctgagcacattaggcccttggactacaacaaggggccggtatgctgagaagcagcagtgtgcatctggttttaccctggacttgctgcgtgaccttggtctctg

SEQ ID NO: 49900 - DNA, 201 bp, Bos taurus; identical to SEQ ID NO: 8450

SEQ ID NO: 49901 - DNA, 201 bp, Bos taurus; identical to SEQ ID NO: 8451

SEQ ID NO: 49902 - DNA, 201 bp, Bos taurus; identical to SEQ ID NO: 8452

SEQ ID NO: 49903 - DNA, 201 bp, Bos taurus
atgctcctgggttatcggtgagtttttatagtttgtaaagggagaattgtgaccgagcagctggcacaggccctggccaccccaggctagcagctgaggggatgtgcagacactggtgaggaggctacgagcccagctgcagccctacaaggcatttcctttcttactgtgttctgcaaaaaatgcatgctcactgggaga

SEQ ID NO: 49904 - DNA, 201 bp, Bos taurus; identical to SEQ ID NO: 8453

SEQ ID NO: 49905 - DNA, 201 bp, Bos taurus; identical to SEQ ID NO: 8456

SEQ ID NO: 49906 - DNA, 201 bp, Bos taurus; identical to SEQ ID NO: 8457

SEQ ID NO: 49907 - DNA, 201 bp, Bos taurus; identical to SEQ ID NO: 8458

SEQ ID NO: 49908 - DNA, 201 bp, Bos taurus; identical to SEQ ID NO: 8459

SEQ ID NO: 49909 - DNA, 201 bp, Bos taurus; identical to SEQ ID NO: 8460

SEQ ID NO: 49910 - DNA, 201 bp, Bos taurus
aaaggggcatctgatttctccctccctcgtggcctgaacaccagctcccatttatgtaactaacaatgtgagagggggctgcaggctgtctgggggtaatgggcccagggacaggtatcaggaaatgaaggttccaatcccagctgattcactatgtgccactgagacaagagctcaaagactgagcctcatcttcaaaaa

SEQ ID NO: 49911 - DNA, 201 bp, Bos taurus
acagtgtttggagggaacagacctagggccccatactctgaccaccctccaacctcctctccagccacaagtccaataccgccttcttggccattccctgtctctggaaccaaccaaccctgaggttagccctttattgcccaccaaccaggagctccaagattcattaggattattccactgagatggaggccattgtca

SEQ ID NO: 49912 - DNA, 201 bp, Bos taurus
cacatgctgaacttcatccttatttcttgaaagcaggttggctctccagattctgtctctgcctgaagaacctccaacctcaccctgctgtgaaataccccatcccacaggccagtgtgacctggggcaggttatgtaacccttctgggtctcagggttcggttctttgtaaaatggggtaatgatagtgaattaaatgag

SEQ ID NO: 49913 - DNA, 201 bp, Bos taurus; identical to SEQ ID NO: 8461

SEQ ID NO: 49914 - DNA, 201 bp, Bos taurus
tgctggaccccacacagacaacacggaaagcctactagagggcagtgacgaggccaagctgccgttcataaagccttcctgtcacacacagggccaacacagtacaaggagcagtaggggactttctgccttcctggaaagataaactacacatatttgttagagagaagaatgtcacaactaaaggctgaaacatgctta

SEQ ID NO: 49915 - DNA, 201 bp, Bos taurus
agtgatgtctctgttttttaatatgaaggtggaagaggggaggtaaacaggagggaaggattactgtggctgatgctgttctttcaacttcctgttaagcgggtgtcatggccttctccagaggtccacatcgtagttgagtggtacccaagttcttggctcatattagggcaaggaagcaacagattctattggcaaaat

SEQ ID NO: 49916 - DNA, 201 bp, Bos taurus
tctttgcatcctagacattttcttgaagaggggaagcagggaggtgttgaatgactagcagaagggcacacaggaagggcagtggcctggaaaattgtttccctactcactctctggtgaatggacactgattcccacctccccaccttggctgaccaaaccctgacacaaccctgcacaggcccagtgggctccatggat

SEQ ID NO: 49917 - DNA, 201 bp, Bos taurus
tcatgcaggtagaaaattgtcagcacagcatgctcaaaggggtgggaaggcagtaagaggcagaggctattccaccctacttgcaatcctcaggggcctacataaggaaaagggcttttgagcatacctccaaggctatcttctagagggacggagtccactaaggtcctgtccacccaccagggtcaaggacagattgct

SEQ ID NO: 49918 - DNA, 201 bp, Bos taurus
ctaaatgccaaactgaacaggggcataatgtgtgtattctgtggtcccagcaatttagtaattgtcagaaaaccaccctgagaccatctgttggcctcacccttgtactgccttccccgagaatgagagaaatgcagggtgttgggcaggtgagctgagaggctgctccactagggtggacctctggaccaacatctttgg

SEQ ID NO: 49919 - DNA, 201 bp, Bos taurus; identical to SEQ ID NO: 8468

SEQ ID NO: 49920 - DNA, 201 bp, Bos taurus
acaacagagcaagacagttgccagcccagtttctaacttcttaatggcctagtctggtagagggaatgttccagcagaagtcatagatacaggtgcaaatcctgtttctattgccttgatttggccatggacaaaatttgcttttctcttagcattcttctttaaagaagcatatcatagggctgaattataaggatcaaa

SEQ ID NO: 49921 - DNA, 201 bp, Bos taurus; identical to SEQ ID NO: 8469

SEQ ID NO: 49922 - DNA, 201 bp, Bos taurus; identical to SEQ ID NO: 8470

SEQ ID NO: 49923 - DNA, 201 bp, Bos taurus
gtcatctgcatatctgaggttattgatattcctcccagcaatcttgattccagcttgtgcttcttccagtcagggtaccttattacatttaattgccatggcttcttaggctgtgacaatctttcatatcttgagagaaatagtcaaatttgaactagctttcataggaaatgtttgacaatattgaggactattgtttct

SEQ ID NO: 49924 - DNA, 201 bp, Bos taurus
cttttcatggcctttatttcaaagtctattttctgatatgagtattgctactcctgctttcttttggtttccatttgcgtgatctatctttttccttgttttgaggtgggcctcttatagaaaaggtatataggggtcttgtttttgtatccattcaaccagtttttgtcttttggttggggcattccacccattttcatt

SEQ ID NO: 49925 - DNA, 201 bp, Bos taurus; identical to SEQ ID NO: 8472

SEQ ID NO: 49926 - DNA, 201 bp, Bos taurus; identical to SEQ ID NO: 8473

SEQ ID NO: 49927 - DNA, 201 bp, Bos taurus
ttgtaaaatatacagagaagctgactatagagaactaagtaaaataaaatgaggcaacattaccaataggaaagagtcagcatagactcagaatgaggtttatatttctaagagaaaataaagggggaataaactttcaaacttaaagttagcttaattttctatctctacattaaatattcaaatatggacatatatgtt

SEQ ID NO: 49928 - DNA, 201 bp, Bos taurus; identical to SEQ ID NO: 8475

SEQ ID NO: 49929 - DNA, 201 bp, Bos taurus
ggaaataagtaggcttgaatttcaggccagatctaaccatatgaatttgaggaagcatttttatatgtatgtcctcagggatgagaggaactaccccaacgtccaagatcagggccggtggtccagaggagctactccacgcctgaggtcaggggagccggccaggaggaactacctcacgtccaaggagtggtggctgcc

SEQ ID NO: 49930 - DNA, 201 bp, Bos taurus; identical to SEQ ID NO: 8478

SEQ ID NO: 49931 - DNA, 201 bp, Bos taurus; identical to SEQ ID NO: 8480

SEQ ID NO: 49932 - DNA, 201 bp, Bos taurus; identical to SEQ ID NO: 8481

SEQ ID NO: 49933 - DNA, 201 bp, Bos taurus; identical to SEQ ID NO: 8483

SEQ ID NO: 49934 - DNA, 201 bp, Bos taurus
acttatgccttagagtcttgatgccagaagaagagaaaaagtaatttattaaaacagtcaacttttaaaaacagttttacaggaagggatgtagaatgtactctcagcattacctcagttgaaataaaggtaaggtattaaagtgaggaaattttggaagatattttcctgctcatttgtgggttggtgggtttttgtttt

SEQ ID NO: 49935 - DNA, 201 bp, Bos taurus; identical to SEQ ID NO: 8484

SEQ ID NO: 49936 - DNA, 201 bp, Bos taurus
atgagtacatgagtataaaaaccctactcaaaatagcaattgcagtggtcagaggatcttgttttgcagaaattttctgtaaacttattaggatacccttatctgtgtctgtctttgcttcttgaaaccagctgattgcttcttcccctcaagtacaatacttcatgcatgtcttcaactcaggatctcaaggtattctgt

SEQ ID NO: 49937 - DNA, 201 bp, Bos taurus; identical to SEQ ID NO: 8486

SEQ ID NO: 49938 - DNA, 201 bp, Bos taurus; identical to SEQ ID NO: 8487

SEQ ID NO: 49939 - DNA, 201 bp, Bos taurus; identical to SEQ ID NO: 8488

SEQ ID NO: 49940 - DNA, 201 bp, Bos taurus; identical to SEQ ID NO: 8489

SEQ ID NO: 49941 - DNA, 201 bp, Bos taurus; identical to SEQ ID NO: 8490

SEQ ID NO: 49942 - DNA, 201 bp, Bos taurus; identical to SEQ ID NO: 8491

SEQ ID NO: 49943 - DNA, 201 bp, Bos taurus; identical to SEQ ID NO: 8492

SEQ ID NO: 49944 - DNA, 201 bp, Bos taurus; identical to SEQ ID NO: 8493

SEQ ID NO: 49945 - DNA, 201 bp, Bos taurus; identical to SEQ ID NO: 8494

SEQ ID NO: 49946 - DNA, 201 bp, Bos taurus; identical to SEQ ID NO: 8495

SEQ ID NO: 49947 - DNA, 201 bp, Bos taurus; identical to SEQ ID NO: 8496

SEQ ID NO: 49948 - DNA, 201 bp, Bos taurus; identical to SEQ ID NO: 8498

SEQ ID NO: 49949 - DNA, 201 bp, Bos taurus; identical to SEQ ID NO: 8500

SEQ ID NO: 49950 - DNA, 201 bp, Bos taurus; identical to SEQ ID NO: 8501

SEQ ID NO: 49951 - DNA, 201 bp, Bos taurus; identical to SEQ ID NO: 8502

SEQ ID NO: 49952 - DNA, 201 bp, Bos taurus; identical to SEQ ID NO: 8503

SEQ ID NO: 49953 - DNA, 201 bp, Bos taurus; identical to SEQ ID NO: 8504

SEQ ID NO: 49954 - DNA, 201 bp, Bos taurus; identical to SEQ ID NO: 8505

SEQ ID NO: 49955 - DNA, 201 bp, Bos taurus; identical to SEQ ID NO: 8508

SEQ ID NO: 49956 - DNA, 201 bp, Bos taurus; identical to SEQ ID NO: 8510

SEQ ID NO: 49957 - DNA, 201 bp, Bos taurus; identical to SEQ ID NO: 8511

SEQ ID NO: 49958 - DNA, 201 bp, Bos taurus
cttccgggaggaaggtttctagggcacaaatgttaaggaggttctcataagggcagtacaagtggtggttcagccccctagtgtgaatgcaatcttaaattttgccccctaagtgcctcactcacatcactctggtctctgcaatagcccatttttggaattacctcactgccttatcaattggcttccaaattttcagtg

SEQ ID NO: 49959 - DNA, 201 bp, Bos taurus
cttctcatcttttaattgtaaatagtgtataaaattttttcactgttgtcttttatttaggattaaccagttttttaaaaaatgtattctcaggaaacacgtgtgtaccataatatgtctcagtacagggttatcagcatatgtggcattgtgatataagagtgaactttcatgttcaagcttatccctttaattacctta

SEQ ID NO: 49960 - DNA, 201 bp, Bos taurus
ttaacaacaacaaaaaaaaagctatacacaatacatattacaacattacaaataaactactctgaacagtgtggggaaaagaagagaactgaaagaaaaatggctctaacgctattgcttgcaccttcctagtgttgacattcttgccgcttttcatttattttcttttccaaatttctgaaaagggattacaaagtaaat

SEQ ID NO: 49961 - DNA, 201 bp, Bos taurus; identical to SEQ ID NO: 8514

SEQ ID NO: 49962 - DNA, 201 bp, Bos taurus; identical to SEQ ID NO: 8515

SEQ ID NO: 49963 - DNA, 201 bp, Bos taurus; identical to SEQ ID NO: 8516

SEQ ID NO: 49964 - DNA, 201 bp, Bos taurus
aaggcattgtccagtatcaaaagaaatttaaaaggcaattacttactggcaaaggtacttcctgactttagagacaaaacgttgacagaaccaatcaagaaaaagtgttctggtagtgtaggccttcttattgtaaaaccaaaagactggtgttatcttttcccttcatggtttaggagttagcagctttatagataaggg

SEQ ID NO: 49965 - DNA, 201 bp, Bos taurus; identical to SEQ ID NO: 8517

SEQ ID NO: 49966 - DNA, 201 bp, Bos taurus; identical to SEQ ID NO: 8518

SEQ ID NO: 49967 - DNA, 201 bp, Bos taurus; identical to SEQ ID NO: 8519

SEQ ID NO: 49968 - DNA, 201 bp, Bos taurus; identical to SEQ ID NO: 8520

SEQ ID NO: 49969 - DNA, 201 bp, Bos taurus; identical to SEQ ID NO: 8521

SEQ ID NO: 49970 - DNA, 201 bp, Bos taurus; identical to SEQ ID NO: 8522

SEQ ID NO: 49971 - DNA, 201 bp, Bos taurus; identical to SEQ ID NO: 8524

SEQ ID NO: 49972 - DNA, 201 bp, Bos taurus; identical to SEQ ID NO: 8525

SEQ ID NO: 49973 - DNA, 201 bp, Bos taurus; identical to SEQ ID NO: 8526

SEQ ID NO: 49974 - DNA, 201 bp, Bos taurus; identical to SEQ ID NO: 8527

SEQ ID NO: 49975 - DNA, 201 bp, Bos taurus; identical to SEQ ID NO: 8528

SEQ ID NO: 49976 - DNA, 201 bp, Bos taurus; identical to SEQ ID NO: 8529

SEQ ID NO: 49977 - DNA, 201 bp, Bos taurus; identical to SEQ ID NO: 8530

SEQ ID NO: 49978 - DNA, 201 bp, Bos taurus
accatagtcaggttgtcttgaggacaagaatcagggctcagtgaggacccgtcaggccctaatgaggatgacaggtcccagtgaggcaaagagtctggccatagtgaggaacagagtcaggtttcagagaagaccagagtcagtccatagagaggaccagagtcagggcacagtgaggcacaatgtcagtttccagtgagg

SEQ ID NO: 49979 - DNA, 201 bp, Bos taurus; identical to SEQ ID NO: 8532

SEQ ID NO: 49980 - DNA, 201 bp, Bos taurus; identical to SEQ ID NO: 8533

SEQ ID NO: 49981 - DNA, 201 bp, Bos taurus
gcacttctaattccctttgagaacttttcctttgcattcacaacctggctatctgtttggtacaagaggcctagattttggcctatctcaacttttgacatgtcttcctctctgtgctcaatcattcgtaccttttgatttaaagtgagagatgtgtgactcttcctctcacttgaacacgcagaggccatggtagggtta

SEQ ID NO: 49982 - DNA, 201 bp, Bos taurus
gggaactaaaaatgtagctttgaatttcccccaacacacacacagaaggaagtgagccatcatcggaagcttagaggggagggccctggcccccagcagccgcagaaccctttgctcaagtctgcagagctgctggcaattagaggatctcccccaagtgggggaggggccctcgcctccttccctggtgctgcttttctg

SEQ ID NO: 49983 - DNA, 201 bp, Bos taurus; identical to SEQ ID NO: 8534

SEQ ID NO: 49984 - DNA, 201 bp, Bos taurus
cttaagagtaaagctttgtcagacctcttattgggagggtgataaggcttttgcatttgcctatccacccatccatcctttgtctcaacgtcaaggcctgcgccgggtcaaggctttatcgcacgcaaccacacaggactagaggggggacttgacgcaggagtaagatgtggagggaggacctctggatcccccccaccg

SEQ ID NO: 49985 - DNA, 201 bp, Bos taurus
agcttgggttctgcagtcactcaggcctggatttgactctctgaaaggtttccccgctctgtgaaattaggataaaaggacccacctgctgtgggaaaccggcatgctctcaggccacaggtgggagtataccagatgcccaaggtaccggtgtgagtcctcttcacctcagcatttcttctgactcttgatactgtgggt

SEQ ID NO: 49986 - DNA, 201 bp, Bos taurus; identical to SEQ ID NO: 8537

SEQ ID NO: 49987 - DNA, 201 bp, Bos taurus
ggcctggaacaccacgcccgtcaccacccgggagaacacagcctcctccccatgctctaccggttcactgcagggagccccggccacagaaccgaccctcggtgaacccagatttagaggcagaccgtgctcctgtgacctccaaccctcacagcactggagggcagggcaagacttacgggggcatctcgggagcctgct

SEQ ID NO: 49988 - DNA, 201 bp, Bos taurus
gtgccttacaacccaccccataaaatcaatcaagtagcagaagattttatatgcttctcatttattttccaaaatacattctgtgagtgccaactgtgtgctgggcctgggaaagagtggcaagtgcagtgtagaagggcaatacatttctctggacttcccttatgtgtttttaagggaattaagtgaactgaaagggaa

SEQ ID NO: 49989 - DNA, 201 bp, Bos taurus; identical to SEQ ID NO: 8538

SEQ ID NO: 49990 - DNA, 201 bp, Bos taurus; identical to SEQ ID NO: 8539

SEQ ID NO: 49991 - DNA, 201 bp, Bos taurus; identical to SEQ ID NO: 8540

SEQ ID NO: 49992 - DNA, 201 bp, Bos taurus; identical to SEQ ID NO: 8541

SEQ ID NO: 49993 - DNA, 201 bp, Bos taurus; identical to SEQ ID NO: 8542

SEQ ID NO: 49994 - DNA, 201 bp, Bos taurus
gatagtaaatgaagtagaatcagagaaggaaggctcagcaaagggtctcactgcttctgctacagggagcccagtagcaccttttagatggcatttcatatcttcatcttgctcttttaacacaactacgatagattacataaatcaattatttttgtttgttgtgggctcctggaatcaaagtaaactgaatgataatta

SEQ ID NO: 49995 - DNA, 201 bp, Bos taurus; identical to SEQ ID NO: 8544

SEQ ID NO: 49996 - DNA, 201 bp, Bos taurus; identical to SEQ ID NO: 8545

SEQ ID NO: 49997 - DNA, 201 bp, Bos taurus; identical to SEQ ID NO: 8546

SEQ ID NO: 49998 - DNA, 201 bp, Bos taurus; identical to SEQ ID NO: 8547

SEQ ID NO: 49999 - DNA, 201 bp, Bos taurus; identical to SEQ ID NO: 8548

SEQ ID NO: 50000 - DNA, 201 bp, Bos taurus; identical to SEQ ID NO: 8550

SEQ ID NO: 50001 - DNA, 201 bp, Bos taurus; identical to SEQ ID NO: 8551

SEQ ID NO: 50002 - DNA, 201 bp, Bos taurus
atacattgtgcaaataataggtccttaaaagcacagaggacaaagatatggagatcttagcaaaggctctgagagaccatgggactttagatttgaaggaaagttgagagatatcaatagggaaagaacacagcagataggagggtccttccaaacaaagctcagcaggaaaacttgatctagtgcattccatcatgaaga

SEQ ID NO: 50003 - DNA, 201 bp, Bos taurus; identical to SEQ ID NO: 8552

SEQ ID NO: 50004 - DNA, 201 bp, Bos taurus; identical to SEQ ID NO: 8554

SEQ ID NO: 50005 - DNA, 201 bp, Bos taurus; identical to SEQ ID NO: 8555

SEQ ID NO: 50006 - DNA, 201 bp, Bos taurus; identical to SEQ ID NO: 8558

SEQ ID NO: 50007 - DNA, 201 bp, Bos taurus; identical to SEQ ID NO: 8559

SEQ ID NO: 50008 - DNA, 201 bp, Bos taurus; identical to SEQ ID NO: 8560

SEQ ID NO: 50009 - DNA, 201 bp, Bos taurus; identical to SEQ ID NO: 8561

SEQ ID NO: 50010 - DNA, 201 bp, Bos taurus; identical to SEQ ID NO: 8562

SEQ ID NO: 50011 - DNA, 201 bp, Bos taurus; identical to SEQ ID NO: 8563

SEQ ID NO: 50012 - DNA, 201 bp, Bos taurus; identical to SEQ ID NO: 8564

SEQ ID NO: 50013 - DNA, 201 bp, Bos taurus; identical to SEQ ID NO: 8565

SEQ ID NO: 50014 - DNA, 201 bp, Bos taurus; identical to SEQ ID NO: 8566

SEQ ID NO: 50015 - DNA, 201 bp, Bos taurus; identical to SEQ ID NO: 8569

SEQ ID NO: 50016 - DNA, 201 bp, Bos taurus
gcctttccccagatggttgccccagccctgccctgcttctgcttctctccacttggtcagcagaggtgaactaacacagcagtcctctagcccagcagcctggggccaggcctcacatacatacacgaggagttctgagggtgcggaggcccttcctcaggctgagggccttggaataaagggagcagctgctggaaaata

SEQ ID NO: 50017 - DNA, 201 bp, Bos taurus; identical to SEQ ID NO: 8570

SEQ ID NO: 50018 - DNA, 201 bp, Bos taurus; identical to SEQ ID NO: 8571

SEQ ID NO: 50019 - DNA, 201 bp, Bos taurus; identical to SEQ ID NO: 8572

SEQ ID NO: 50020 - DNA, 201 bp, Bos taurus; identical to SEQ ID NO: 8575

SEQ ID NO: 50021 - DNA, 201 bp, Bos taurus
caaggggagcagatggccgaagtggaagcacagacaggggccattgtgggtcttgtttgggaagtggctccattttctaggagcagagtcgtgtatctaaggtgatacagggaggtgggcctccggtctggactttcttcggtgggacatggggaccagggaaaggtttcaagcagtcttgacaagattggaattccttcc

SEQ ID NO: 50022 - DNA, 201 bp, Bos taurus; identical to SEQ ID NO: 8576

SEQ ID NO: 50023 - DNA, 201 bp, Bos taurus
gcaccaggaggcctcagtccgctagcctgaactccacccataacaccctgtacggtttctgccaagtctgtcatctgtcacctgtgttgaagggactagcccaaggcctcctacacaaagttcctcagcactggctgggactcccctctggctcagccagtccaagaaccagacaggggcagagccggaggcgcaggggac

SEQ ID NO: 50024 - DNA, 201 bp, Bos taurus; identical to SEQ ID NO: 8577

SEQ ID NO: 50025 - DNA, 201 bp, Bos taurus; identical to SEQ ID NO: 8578

SEQ ID NO: 50026 - DNA, 201 bp, Bos taurus; identical to SEQ ID NO: 8579

SEQ ID NO: 50027 - DNA, 201 bp, Bos taurus; identical to SEQ ID NO: 8580

SEQ ID NO: 50028 - DNA, 201 bp, Bos taurus; identical to SEQ ID NO: 8581

SEQ ID NO: 50029 - DNA, 201 bp, Bos taurus
tgcttttttggctacaccccaagctgaggtaccattagatcaatgtcactcaaactcctggagagccacattcccacagcaaaaagtcccaaactaagttatttcgaaaagcattcctatcagtgatgaggcagtagatgccctcaagccaatcatccatgtaatctggcatttcaggagcttcatttgcccagccaaaaa

SEQ ID NO: 50030 - DNA, 201 bp, Bos taurus; identical to SEQ ID NO: 8582

SEQ ID NO: 50031 - DNA, 201 bp, Bos taurus; identical to SEQ ID NO: 8583

SEQ ID NO: 50032 - DNA, 201 bp, Bos taurus
acaaaaaggagactgtgctcggtccctcagtctcatgacagccccaggtcatcaacccccaaccttctgagaactgtccttatgggcccatgagcaccacgccctctgacatcagagcagaaccccctctgcctgccctgtctgggttaacaacactcctgttctcccaggcagaagcccaggagtgactatttgaccctg

SEQ ID NO: 50033 - DNA, 201 bp, Bos taurus; identical to SEQ ID NO: 8586

SEQ ID NO: 50034 - DNA, 201 bp, Bos taurus; identical to SEQ ID NO: 8587

SEQ ID NO: 50035 - DNA, 201 bp, Bos taurus
tgaccccaccggtggcccttttagctactccactggctaaaaggaaattggaagggtcaaggtcctgcttccaaagtcttggggcccaactccaatcaccccaggaaggctgggcagggaggcatgtagagcctctctcgggagtgggcacgggggacctctctggctctctctgcctcaaggccacttccggccaatcag

SEQ ID NO: 50036 - DNA, 201 bp, Bos taurus; identical to SEQ ID NO: 8590

SEQ ID NO: 50037 - DNA, 201 bp, Bos taurus; identical to SEQ ID NO: 8591

SEQ ID NO: 50038 - DNA, 201 bp, Bos taurus; identical to SEQ ID NO: 8592

SEQ ID NO: 50039 - DNA, 201 bp, Bos taurus; identical to SEQ ID NO: 8593

SEQ ID NO: 50040 - DNA, 201 bp, Bos taurus
gacccgcctggttcgggcgtgtctgatgccctaggagagcccccataggaggcttatgcctttccttgttgcagcatcatttgccaagacaggtgggaaatgcagggttgcgtctcaacagggggcctcccttcgcttcctcgtcagtgtgagctccccttccctcttctgttcctgccttgtctctcaaggcaccgcatc

SEQ ID NO: 50041 - DNA, 201 bp, Bos taurus
ccccatccagacaacttccttggttcagggtctccccgaccggaacacttcttaagcccaagtcccgccccttccggttcagagccggaagtgccttggactttcgcctttcaaccttccggcctcgttaagtatctcagacctattttgctctggagtcttatttgtaagagtagctacgtcagcacgtttcggcgtgag

SEQ ID NO: 50042 - DNA, 201 bp, Bos taurus
cacgtggagctgccacgggggcaagttttcagggactcctgggtctacttggcttttatccttgtcaagacttcccgagaggccacacagaagctgcagcagcaacctagagatctttgcattgcatccgattctgaggtcccgggagaggctatgggtccagagtccggccacgcccccctcagtgccccagtccagccc

SEQ ID NO: 50043 - DNA, 201 bp, Bos taurus
ctgaggctaagtcaaagggattaacccctttcccccagccctgaccttccatgtaagaaatgcaccctcctgggtcaccacacagtgagaagagaggccatacacaaaggctgcagcagacagcccagcagagttggtgggtagccagcctccatgccagccactggagagatgtccctggctgattctagggcccgcagt

SEQ ID NO: 50044 - DNA, 201 bp, Bos taurus
cctcctgcagagcctgcaacatgagtgctggtgcccaggccatctctctcagcagcactgaagggcaaggacatgtcctacccagccagcctcttccccacaggactgatattacaggccactcagggagggctgtcctagtgctgggattctgggcacacttgtgagaaaggtgagtgaatttatgaagcaggaaaggtc

SEQ ID NO: 50045 - DNA, 201 bp, Bos taurus
ggttacctgaggctggaagctctgacaggcaaaggcagagctggagaaggatgtcctcttcctgctcggagccacatgacggcctcggcctccctgggcggtgttctcctgtcaaatgtaggagccgggaccagagaagacattctgccactgttcagccgatccatgcagcatccatcaccaagcatcgagagcctttgg

SEQ ID NO: 50046 - DNA, 201 bp, Bos taurus; identical to SEQ ID NO: 8594

SEQ ID NO: 50047 - DNA, 201 bp, Bos taurus
ttccaacccccctaatctgatggggttttctcagtgatgttatggagtcatagaggtgacagtcacaaactgggccacctcccagtggcctttttccctcgaagggttggtggcagaggaagatcagccccttttcagtgtgtgcacttacctggtttaatttggagatagcagaggacagaggagcatggcatgctacag

SEQ ID NO: 50048 - DNA, 201 bp, Bos taurus; identical to SEQ ID NO: 8595

SEQ ID NO: 50049 - DNA, 201 bp, Bos taurus
agctttgtactatagtctgaagtcagggagcatgattcctccagctccattcttctttctcatgagtgttttggctacttgagtattaggggtcttctgcgtttccatacaaatttaaaatttttttgctctatttctgtgaaaaatactactggtagtttgatatggatttcaatgaatatactcaagttcagtgaatgt

SEQ ID NO: 50050 - DNA, 201 bp, Bos taurus; identical to SEQ ID NO: 8596

SEQ ID NO: 50051 - DNA, 201 bp, Bos taurus
gtaattagcctccaattaaataaacttataataaaaaaaccaactttttgataaaaagtatctacttaacccagaaagaaatgtattgtgagaaagtcagtgtgactgcagacctccttactaaattaaccggtaatgtccatttctcataaaaaggtttatattttatttatacttgatagttcagtagatctaacataa

SEQ ID NO: 50052 - DNA, 201 bp, Bos taurus; identical to SEQ ID NO: 8597

SEQ ID NO: 50053 - DNA, 201 bp, Bos taurus; identical to SEQ ID NO: 8598

SEQ ID NO: 50054 - DNA, 201 bp, Bos taurus; identical to SEQ ID NO: 8599

SEQ ID NO: 50055 - DNA, 201 bp, Bos taurus; identical to SEQ ID NO: 8600

SEQ ID NO: 50056 - DNA, 201 bp, Bos taurus; identical to SEQ ID NO: 8601

SEQ ID NO: 50057 - DNA, 201 bp, Bos taurus; identical to SEQ ID NO: 8602

SEQ ID NO: 50058 - DNA, 201 bp, Bos taurus; identical to SEQ ID NO: 8603

SEQ ID NO: 50059 - DNA, 201 bp, Bos taurus; identical to SEQ ID NO: 8604

SEQ ID NO: 50060 - DNA, 201 bp, Bos taurus; identical to SEQ ID NO: 8605

SEQ ID NO: 50061 - DNA, 201 bp, Bos taurus; identical to SEQ ID NO: 8606

SEQ ID NO: 50062 - DNA, 201 bp, Bos taurus; identical to SEQ ID NO: 8608

SEQ ID NO: 50063 - DNA, 201 bp, Bos taurus; identical to SEQ ID NO: 8610

SEQ ID NO: 50064 - DNA, 201 bp, Bos taurus; identical to SEQ ID NO: 8611

SEQ ID NO: 50065 - DNA, 201 bp, Bos taurus; identical to SEQ ID NO: 8612

SEQ ID NO: 50066 - DNA, 201 bp, Bos taurus; identical to SEQ ID NO: 8613

SEQ ID NO: 50067 - DNA, 201 bp, Bos taurus; identical to SEQ ID NO: 8614

SEQ ID NO: 50068 - DNA, 201 bp, Bos taurus; identical to SEQ ID NO: 8615

SEQ ID NO: 50069 - DNA, 201 bp, Bos taurus; identical to SEQ ID NO: 8616

SEQ ID NO: 50070 - DNA, 201 bp, Bos taurus; identical to SEQ ID NO: 8617

SEQ ID NO: 50071 - DNA, 201 bp, Bos taurus; identical to SEQ ID NO: 8618

SEQ ID NO: 50072 - DNA, 201 bp, Bos taurus; identical to SEQ ID NO: 8619

SEQ ID NO: 50073 - DNA, 201 bp, Bos taurus; identical to SEQ ID NO: 8620

SEQ ID NO: 50074 - DNA, 201 bp, Bos taurus; identical to SEQ ID NO: 8621

SEQ ID NO: 50075 - DNA, 201 bp, Bos taurus; identical to SEQ ID NO: 8622

SEQ ID NO: 50076 - DNA, 201 bp, Bos taurus; identical to SEQ ID NO: 8623

SEQ ID NO: 50077 - DNA, 201 bp, Bos taurus; identical to SEQ ID NO: 8626

SEQ ID NO: 50078 - DNA, 201 bp, Bos taurus
tctttctccgtggctatacatggcgcacatggattggacaggcaccattaagcagccatgccctgggcagttgtattcctagtaattgtcgtgtcactgttcacagcaaggttcactttcctctggatcctgacagagattggctctcataacaaaaaggggagttaagcctttttaaccctgcatctcaaaagagcagag

SEQ ID NO: 50079 - DNA, 201 bp, Bos taurus; identical to SEQ ID NO: 8628

SEQ ID NO: 50080 - DNA, 201 bp, Bos taurus
taaaggtcatttagatcaagagcctcaacttatgactacatctaaaaaataaaaaaatggcttgactgatatcccactctcagacaatggtagagctgataattgtctataagtctatgcctccatcatcgcacatacagaccacggcacgtagcatagggcactactataaatattcaaaacaaattttaaggaaagaat

SEQ ID NO: 50081 - DNA, 201 bp, Bos taurus; identical to SEQ ID NO: 8629

SEQ ID NO: 50082 - DNA, 201 bp, Bos taurus
gggagtcttcagggccctctgtgcccacactgatgcctatcgggaagatgaatgaagagtagtggacaggacttacctgggacgggacccactgccagcccacctgctccaaggccaaaaacagtgaggaccacttcagaatgcaggccttcttgccttgccagagcttttatttcacagagcatcccacagtgcaattcc

SEQ ID NO: 50083 - DNA, 201 bp, Bos taurus; identical to SEQ ID NO: 8630

SEQ ID NO: 50084 - DNA, 201 bp, Bos taurus; identical to SEQ ID NO: 8631

SEQ ID NO: 50085 - DNA, 201 bp, Bos taurus
caaacttaattaccgcctttactactaagggctctgtatttgccgattttcctactcactgaaatttatttgcaacccacaaatgcacccccaaatcaatattctcagggcctcttgggatcactggtggacatgcccaatgtggggaaaagccaagccctcttctcaatccccctgctgacactcacattcccagcaaaa

SEQ ID NO: 50086 - DNA, 201 bp, Bos taurus
agaggcctgagttgttataccttatctctcctccatgtcacctcttaatctccaacaggttaacctgggcatttgctcatggaggaagcaagattcagagatagcacacggaaatgcacaggcccttttgaggcctgggctcagaactggcatactatcacttctgctgcatcttattggctaaagcaaatcacaaggcag

SEQ ID NO: 50087 - DNA, 201 bp, Bos taurus
ttcctatctggaaagtcctgccatccccccgagggtccctagacaaaaaaaaaaaaaaaccaaactggccagccgggccagctatctcctgcttcttcctcgccagctgcctctctccctgccatttgttccacccaaaaccaattcggaccatttgctccagccagtcaggccccaaatgggacctcagaactttccctt

SEQ ID NO: 50088 - DNA, 201 bp, Bos taurus
ctgcgaactcaccccaaggatggggtccttgcctgcccaacactaccacccagaaatagctcccagcccctcatgccagggccggggctgcacttactgcccaggattcctaaaagtgccttgacatctggaaaactgccttctgctcccttactttaagaagagaggcttaggccatcccaagatcagattcaatctaac

SEQ ID NO: 50089 - DNA, 201 bp, Bos taurus
tgctttaaagaaagaaaccaacacaaagctttgctcagctacttatgaatcaacccagttctgacttgcattattgatttgttgcgtgaccttgaggtccctcagcctaagtttttgcttctataacatggggagaaatacaagcataccttggagatgctgagggtccctcaccacaccaccacaataaagccaatatca

SEQ ID NO: 50090 - DNA, 201 bp, Bos taurus; identical to SEQ ID NO: 8632

SEQ ID NO: 50091 - DNA, 201 bp, Bos taurus; identical to SEQ ID NO: 8633

SEQ ID NO: 50092 - DNA, 201 bp, Bos taurus
cagggaggcctggcgtgctgcagtccacggggtcgcaaagaataagacatgactagcaactgaactgaactgatacctagcagaggaatcgctggatatgaagctctgctctcctatgtaggccaccctgaagcatagaaagttgaagtatagtaccctagggttcctgctcttggtttcctgcaaaggaaacgtttcagg

SEQ ID NO: 50093 - DNA, 201 bp, Bos taurus; identical to SEQ ID NO: 8636

SEQ ID NO: 50094 - DNA, 201 bp, Bos taurus; identical to SEQ ID NO: 8637

SEQ ID NO: 50095 - DNA, 201 bp, Bos taurus; identical to SEQ ID NO: 8638

SEQ ID NO: 50096 - DNA, 201 bp, Bos taurus
tctggccacccctcctttatggaagaagaaaattctagattgtcagagccagagattcccctgaagaatccaaccccctgttcctagagatgaggagaccaaggcctaatgagatgaaatatcttacctatggtcatacaaccagttaaagattgtagcacctgcccttcttcccctgtgttctaccacatactacccaag

SEQ ID NO: 50097 - DNA, 201 bp, Bos taurus
ggggagagttcaaatcaatagaaagaaaccctgtttgtccaattgcttgacatcacacaaccacagcttcaactagatgagtcagtttgatcttactgagttttcccttccttttggttagaaaaagtttcaggacaaagatgtggaggtatggctacagctcagaaaagtaaaaccccagaacctgcctagataattcca

SEQ ID NO: 50098 - DNA, 201 bp, Bos taurus
agcgaccccatggactgtagcctgccaggctcctccatccgtgggattttccaggcaagagtactggggtggggtgccattgccttctccagtgccattgcctctccacacacaatagtgactctttctacactactgtggctcagtagcaaagaatctgcctaacaatgcaggagactcgggttctatccctgggtctgg

SEQ ID NO: 50099 - DNA, 201 bp, Bos taurus; identical to SEQ ID NO: 8639

SEQ ID NO: 50100 - DNA, 201 bp, Bos taurus; identical to SEQ ID NO: 8642

SEQ ID NO: 50101 - DNA, 201 bp, Bos taurus; identical to SEQ ID NO: 8643

SEQ ID NO: 50102 - DNA, 201 bp, Bos taurus; identical to SEQ ID NO: 8646

SEQ ID NO: 50103 - DNA, 201 bp, Bos taurus; identical to SEQ ID NO: 8649

SEQ ID NO: 50104 - DNA, 201 bp, Bos taurus; identical to SEQ ID NO: 8651

SEQ ID NO: 50105 - DNA, 201 bp, Bos taurus; identical to SEQ ID NO: 8652

SEQ ID NO: 50106 - DNA, 201 bp, Bos taurus; identical to SEQ ID NO: 8653

SEQ ID NO: 50107 - DNA, 201 bp, Bos taurus; identical to SEQ ID NO: 8654

SEQ ID NO: 50108 - DNA, 201 bp, Bos taurus; identical to SEQ ID NO: 8655

SEQ ID NO: 50109 - DNA, 201 bp, Bos taurus; identical to SEQ ID NO: 8657

SEQ ID NO: 50110 - DNA, 201 bp, Bos taurus; identical to SEQ ID NO: 8658

SEQ ID NO: 50111 - DNA, 201 bp, Bos taurus; identical to SEQ ID NO: 8659

SEQ ID NO: 50112 - DNA, 201 bp, Bos taurus; identical to SEQ ID NO: 8660

SEQ ID NO: 50113 - DNA, 201 bp, Bos taurus; identical to SEQ ID NO: 8661

SEQ ID NO: 50114 - DNA, 201 bp, Bos taurus; identical to SEQ ID NO: 8662

SEQ ID NO: 50115 - DNA, 201 bp, Bos taurus; identical to SEQ ID NO: 8663

SEQ ID NO: 50116 - DNA, 201 bp, Bos taurus; identical to SEQ ID NO: 8664

SEQ ID NO: 50117 - DNA, 201 bp, Bos taurus; identical to SEQ ID NO: 8665

SEQ ID NO: 50118 - DNA, 201 bp, Bos taurus; identical to SEQ ID NO: 8666

SEQ ID NO: 50119 - DNA, 201 bp, Bos taurus; identical to SEQ ID NO: 8667

SEQ ID NO: 50120 - DNA, 201 bp, Bos taurus; identical to SEQ ID NO: 8668

SEQ ID NO: 50121 - DNA, 201 bp, Bos taurus
tggggaagggtgagaattagtctctcactagtctttttttttaattcaaacttttcattttaattaattaatcaacggccataccgtgtggcatattgatctagttgcccaaccagggattgaaccctcaccccctgcactggaagctcagagtcccaactgttggacccggggaagtcctctctggtcctcctgagcggg

SEQ ID NO: 50122 - DNA, 201 bp, Bos taurus
tgggttgttttgcaggagggaccctggataagaaatgcgcgtgggccttcgcagccttgactttgacagggtagcccaaggccggctgttatttcatcactgaccctgccagccaggaccgttgcccttgctgctgctgaaggcagagcctggaactcccagtcaggggtttttctctgcttcctcctccttcctggccac

SEQ ID NO: 50123 - DNA, 201 bp, Bos taurus; identical to SEQ ID NO: 8672

SEQ ID NO: 50124 - DNA, 201 bp, Bos taurus; identical to SEQ ID NO: 8674

SEQ ID NO: 50125 - DNA, 201 bp, Bos taurus; identical to SEQ ID NO: 8675

SEQ ID NO: 50126 - DNA, 201 bp, Bos taurus; identical to SEQ ID NO: 8676

SEQ ID NO: 50127 - DNA, 201 bp, Bos taurus; identical to SEQ ID NO: 8677

SEQ ID NO: 50128 - DNA, 201 bp, Bos taurus
ctcaggaagggaggtagtagtaggaggtcaaagttgcttatggtttttatacaggatgaaaggatttgacttcagcctccacatttatttcccttttattccttttcatttctactattttttggtagttttattatatatattatgtatatattatatatattatgtgtatatagtaataaaagtctaatttataaatat

SEQ ID NO: 50129 - DNA, 201 bp, Bos taurus; identical to SEQ ID NO: 8681

SEQ ID NO: 50130 - DNA, 201 bp, Bos taurus; identical to SEQ ID NO: 8685

SEQ ID NO: 50131 - DNA, 201 bp, Bos taurus; identical to SEQ ID NO: 8686

SEQ ID NO: 50132 - DNA, 201 bp, Bos taurus; identical to SEQ ID NO: 8687

SEQ ID NO: 50133 - DNA, 201 bp, Bos taurus; identical to SEQ ID NO: 8688

SEQ ID NO: 50134 - DNA, 201 bp, Bos taurus; identical to SEQ ID NO: 8689

SEQ ID NO: 50135 - DNA, 201 bp, Bos taurus; identical to SEQ ID NO: 8690

SEQ ID NO: 50136 - DNA, 201 bp, Bos taurus; identical to SEQ ID NO: 8691

SEQ ID NO: 50137 - DNA, 201 bp, Bos taurus; identical to SEQ ID NO: 8692

SEQ ID NO: 50138 - DNA, 201 bp, Bos taurus; identical to SEQ ID NO: 8693

SEQ ID NO: 50139 - DNA, 201 bp, Bos taurus; identical to SEQ ID NO: 8694

SEQ ID NO: 50140 - DNA, 201 bp, Bos taurus; identical to SEQ ID NO: 8695

SEQ ID NO: 50141 - DNA, 201 bp, Bos taurus
ccaggcctttatccctccttgcccctaaaacaacctcaacctctttgccattcacatcttgagactctactgcccactccccgtccctgaagtagctacaccctgtctcctgggccagcttagcctgtggtccagggctgttagcagactttaggttcaggggcagtgcttaccatcctttgttccatgtggcaaacccca

SEQ ID NO: 50142 - DNA, 201 bp, Bos taurus
acatcgcatgtcatcagtgacggcgggtcatgtagccacacctgacttaaagtgaggtgactagtggccggactgatgctaatgctgagccccgagggccgacagctcctgccagctgagcctggaagtgcagccctttgtttctgctcctgtgcaggagcccagcctcgagatcagcccctcggccagatcatctgtccc

SEQ ID NO: 50143 - DNA, 201 bp, Bos taurus; identical to SEQ ID NO: 8697

SEQ ID NO: 50144 - DNA, 201 bp, Bos taurus
tgcagccaggcccttcccccgcccccgtcaggtttcctgggaggagggggctgaagggaatgaactttgtgcatctgactacccgtctgactacccttggaggcccccaagggctcatcagcacagcacctcctcctggtctgcccgtctgccccattagtgccctttgttggctaaggcaactcccgtggacagaaaagc

SEQ ID NO: 50145 - DNA, 201 bp, Bos taurus; identical to SEQ ID NO: 8699

SEQ ID NO: 50146 - DNA, 201 bp, Bos taurus; identical to SEQ ID NO: 8700

SEQ ID NO: 50147 - DNA, 201 bp, Bos taurus; identical to SEQ ID NO: 8701

SEQ ID NO: 50148 - DNA, 201 bp, Bos taurus; identical to SEQ ID NO: 8702

SEQ ID NO: 50149 - DNA, 201 bp, Bos taurus; identical to SEQ ID NO: 8706

SEQ ID NO: 50150 - DNA, 201 bp, Bos taurus; identical to SEQ ID NO: 8707

SEQ ID NO: 50151 - DNA, 201 bp, Bos taurus; identical to SEQ ID NO: 8708

SEQ ID NO: 50152 - DNA, 201 bp, Bos taurus; identical to SEQ ID NO: 8709

SEQ ID NO: 50153 - DNA, 201 bp, Bos taurus; identical to SEQ ID NO: 8710

SEQ ID NO: 50154 - DNA, 201 bp, Bos taurus; identical to SEQ ID NO: 8711

SEQ ID NO: 50155 - DNA, 201 bp, Bos taurus; identical to SEQ ID NO: 8713

SEQ ID NO: 50156 - DNA, 201 bp, Bos taurus; identical to SEQ ID NO: 8715

SEQ ID NO: 50157 - DNA, 201 bp, Bos taurus; identical to SEQ ID NO: 8716

SEQ ID NO: 50158 - DNA, 201 bp, Bos taurus; identical to SEQ ID NO: 8718

SEQ ID NO: 50159 - DNA, 201 bp, Bos taurus; identical to SEQ ID NO: 8720

SEQ ID NO: 50160 - DNA, 201 bp, Bos taurus; identical to SEQ ID NO: 8722

SEQ ID NO: 50161 - DNA, 201 bp, Bos taurus; identical to SEQ ID NO: 8723

SEQ ID NO: 50162 - DNA, 201 bp, Bos taurus; identical to SEQ ID NO: 8726

SEQ ID NO: 50163 - DNA, 201 bp, Bos taurus; identical to SEQ ID NO: 8727

SEQ ID NO: 50164 - DNA, 201 bp, Bos taurus; identical to SEQ ID NO: 8728

SEQ ID NO: 50165 - DNA, 201 bp, Bos taurus; identical to SEQ ID NO: 8729

SEQ ID NO: 50166 - DNA, 201 bp, Bos taurus; identical to SEQ ID NO: 8730

SEQ ID NO: 50167 - DNA, 201 bp, Bos taurus; identical to SEQ ID NO: 8731

SEQ ID NO: 50168 - DNA, 201 bp, Bos taurus; identical to SEQ ID NO: 8733

SEQ ID NO: 50169 - DNA, 201 bp, Bos taurus; identical to SEQ ID NO: 8734

SEQ ID NO: 50170 - DNA, 201 bp, Bos taurus; identical to SEQ ID NO: 8735

SEQ ID NO: 50171 - DNA, 201 bp, Bos taurus; identical to SEQ ID NO: 8740

SEQ ID NO: 50172 - DNA, 201 bp, Bos taurus; identical to SEQ ID NO: 8741

SEQ ID NO: 50173 - DNA, 201 bp, Bos taurus; identical to SEQ ID NO: 8746

SEQ ID NO: 50174 - DNA, 201 bp, Bos taurus; identical to SEQ ID NO: 8747

SEQ ID NO: 50175 - DNA, 201 bp, Bos taurus; identical to SEQ ID NO: 8748

SEQ ID NO: 50176 - DNA, 201 bp, Bos taurus; identical to SEQ ID NO: 8752

SEQ ID NO: 50177 - DNA, 201 bp, Bos taurus; identical to SEQ ID NO: 8753

SEQ ID NO: 50178 - DNA, 201 bp, Bos taurus; identical to SEQ ID NO: 8754

SEQ ID NO: 50179 - DNA, 201 bp, Bos taurus; identical to SEQ ID NO: 8755

SEQ ID NO: 50180 - DNA, 201 bp, Bos taurus; identical to SEQ ID NO: 8756

SEQ ID NO: 50181 - DNA, 201 bp, Bos taurus; identical to SEQ ID NO: 8757

SEQ ID NO: 50182 - DNA, 201 bp, Bos taurus; identical to SEQ ID NO: 8759

SEQ ID NO: 50183 - DNA, 201 bp, Bos taurus; identical to SEQ ID NO: 8760

SEQ ID NO: 50184 - DNA, 201 bp, Bos taurus; identical to SEQ ID NO: 8761

SEQ ID NO: 50185 - DNA, 201 bp, Bos taurus; identical to SEQ ID NO: 8762

SEQ ID NO: 50186 - DNA, 201 bp, Bos taurus; identical to SEQ ID NO: 8763

SEQ ID NO: 50187 - DNA, 201 bp, Bos taurus
cagggctcttggcctggcatggtgggaggatgcacacgcatgcgggtcatgaggctcctggggcagaatgccgtagcacccaggggatcctccccaccccctttgctcccggggcccaacagaggaaaatgaggaaatccctgtgtcctcccgcagcttttggcccccaggctctgaggacaaagccacatgggggtggtt

SEQ ID NO: 50188 - DNA, 201 bp, Bos taurus
tttaggagctctgcacgtgctgactccttggcctggaagaacgactctcagacctttgcttgctgtctgtcagttctcaagctatggattttccctggccggtgtgactaagtaacccttgccccacatcaagctttaacgcatcactggttttacttattcaaggtgataaaatgctatctttaagtgatttacggcctt

SEQ ID NO: 50189 - DNA, 201 bp, Bos taurus; identical to SEQ ID NO: 8764

SEQ ID NO: 50190 - DNA, 201 bp, Bos taurus; identical to SEQ ID NO: 8766

SEQ ID NO: 50191 - DNA, 201 bp, Bos taurus; identical to SEQ ID NO: 8767

SEQ ID NO: 50192 - DNA, 201 bp, Bos taurus; identical to SEQ ID NO: 8768

SEQ ID NO: 50193 - DNA, 201 bp, Bos taurus; identical to SEQ ID NO: 8771

SEQ ID NO: 50194 - DNA, 201 bp, Bos taurus; identical to SEQ ID NO: 8772

SEQ ID NO: 50195 - DNA, 201 bp, Bos taurus; identical to SEQ ID NO: 8773

SEQ ID NO: 50196 - DNA, 201 bp, Bos taurus; identical to SEQ ID NO: 8774

SEQ ID NO: 50197 - DNA, 201 bp, Bos taurus; identical to SEQ ID NO: 8778

SEQ ID NO: 50198 - DNA, 201 bp, Bos taurus
cgaggcatccgtgcactttgctgctcgctgccttctctgagtgtaatcaaacatcaagctaagtagcaaataaatctctcgatctcataagctgcacagcaagatcatgtaaatgcaaatgaaggacctggtttcaagctgtcgaggggggaggggaggacacgccggggccctatcactgtgaccgcctcgcacaccaag

SEQ ID NO: 50199 - DNA, 201 bp, Bos taurus; identical to SEQ ID NO: 8779

SEQ ID NO: 50200 - DNA, 201 bp, Bos taurus; identical to SEQ ID NO: 8783

SEQ ID NO: 50201 - DNA, 201 bp, Bos taurus
aggttctgggtggacaggatttcaggggtcattgttggatcctctacaactaggccacttgcccctcgctgcagccctgggaggcaggccctgtcgggccgttttgcagatgagctgcgcacctgtgccatgtggggctgaaaggttgttgtcaaatcacgcgaagacactgggattcttggcccccggaggagaagaatt

SEQ ID NO: 50202 - DNA, 201 bp, Bos taurus; identical to SEQ ID NO: 8784

SEQ ID NO: 50203 - DNA, 201 bp, Bos taurus
gcacgcagtgagaggctgtggcctcctttgtcctaaattctgacatggagattctagaccgtgcaaaggatagagtttcctgaggcagcctgagtcacacagacagatgtcttggcctgccttacagagtcgagaagcttaaagagataggcaaagactagccctctgaggaacctacaaacggtgcttcacctcaacaaa

SEQ ID NO: 50204 - DNA, 201 bp, Bos taurus; identical to SEQ ID NO: 8785

SEQ ID NO: 50205 - DNA, 201 bp, Bos taurus; identical to SEQ ID NO: 8786

SEQ ID NO: 50206 - DNA, 201 bp, Bos taurus
ggggtggggggtgctgggatggctggccacagggccactcacctgagatctggttcagggagaccctggaggcctcacgcccctggccaggggttgccttctcttcaactccactttcagttccactcaggatgcctgaagtgaaagtaaaagtgagtcactcatttgcatctgactctttgccaccccgtggactacgga

SEQ ID NO: 50207 - DNA, 201 bp, Bos taurus; identical to SEQ ID NO: 8788

SEQ ID NO: 50208 - DNA, 201 bp, Bos taurus; identical to SEQ ID NO: 8789

SEQ ID NO: 50209 - DNA, 201 bp, Bos taurus; identical to SEQ ID NO: 8791

SEQ ID NO: 50210 - DNA, 201 bp, Bos taurus; identical to SEQ ID NO: 8792

SEQ ID NO: 50211 - DNA, 201 bp, Bos taurus; identical to SEQ ID NO: 8793

SEQ ID NO: 50212 - DNA, 201 bp, Bos taurus; identical to SEQ ID NO: 8794

SEQ ID NO: 50213 - DNA, 201 bp, Bos taurus
tccggacgtttaattcaccttgtcccctggccgccagcgggcaaatcgctccgtaactcgatcagccaagggacaattggatcagagagcgcttatccgccggcccctctcaccgtgcgaatgtcagaggccccccgggcacagagacctgctctttccaaagtctcagctttgaaaagcaggtggtgaggctcgggcttt

SEQ ID NO: 50214 - DNA, 201 bp, Bos taurus
cagttaagccaggctcttgagtgaattcaggggtgggatggagcgacccggacccttccccagctcccaggaatcaaacgaggctgagaggctggccggcgtgctctccattacagtcctgtgggcaagcccagcatgcagggggctgaataaatacttcccggacggagtggggagacaggtgcagagggccaaagctct

SEQ ID NO: 50215 - DNA, 201 bp, Bos taurus
gctacgtccagctggaggccactggacagctgtcactttcagtgaacatcttcaggcgtcctctggtttttgcattttagaaaaaccagtgcattgttttcaggcccaaacatttgtggggcctcttagaaaggccgtggggaccgaggcaggttgtccacttgggtgaggggtctcatcttcagtttcaactcctcctgg

SEQ ID NO: 50216 - DNA, 201 bp, Bos taurus
agtgaagttgatgggccttcattcgaaccataaaaatctactgctgttgagtgaaagtctctgaaacggggaagcagagcgacgcgggcagggagggctttgtagctcacggtctctcggggggcctgggacacccagagaaggcggccttctctgacccggcctgacgcaccctcgccagacactgctcgggacacgacg

SEQ ID NO: 50217 - DNA, 201 bp, Bos taurus
gaaggctgaggctggaagccagtgatgaggacatagaaagaaaaatgtgagggcccgggtccctgatgattccgtgtcagggtcacaccggccctgaaccacctacttcctttacgaaagagtaaacgcttctaactttaggctgcagttgtgtcggggttttggctacaaccagcagagtctcctctgatgcaggcccgt

SEQ ID NO: 50218 - DNA, 201 bp, Bos taurus; identical to SEQ ID NO: 8795

SEQ ID NO: 50219 - DNA, 201 bp, Bos taurus
ctctggctctagggtcatagcgcctgcatcgtggggcaagggggggggtgctgggtgctgtcgaggccacccctcccaggccagagctgagcagatctgcaggaacttccagcatctcacagtttaaatctgaaaccacgagagactgcagccttactcccctgtcgcccccgaagtgccctccagtctggacaagggccc

SEQ ID NO: 50220 - DNA, 201 bp, Bos taurus; identical to SEQ ID NO: 8796

SEQ ID NO: 50221 - DNA, 201 bp, Bos taurus
agggtgggagggcagtgccagaaggggctgggcacagggccagggaagaggagagcacagcccagcccatctcaggcggggaggagagaaagaaggaactggggagcaggaaggccaaggccccgccaggcaggatggacaggccaggaagccaggagcaggctctggcctgggaaccaggacaggagagggctccctccc

SEQ ID NO: 50222 - DNA, 201 bp, Bos taurus; identical to SEQ ID NO: 8798

SEQ ID NO: 50223 - DNA, 201 bp, Bos taurus
cacagcagccgggcctcctcttgtttactctcagctgattccatctcatttcctgcttggtatttgctctattacactgttaaattttgtgaaatcagacaccaacctcataagcttgcatatcctctcacacagcatctagaccagcacctcccggctccacgctgcctgcagacccctcggaaacggcactttaaacac

SEQ ID NO: 50224 - DNA, 201 bp, Bos taurus; identical to SEQ ID NO: 8799

SEQ ID NO: 50225 - DNA, 201 bp, Bos taurus
tcccggagaggctgggctgggccgcgcctgcccccacgccctcctgaccccggtgtcacccccagtttgggatcgtgttcgacgctgggtcctcccacacatccctctttgtgtatcagtggccggccaacaaggagaacgacaccggcatagtcagccaggccctggcctgccaggcggaaggtcagtggacagtctgcc

SEQ ID NO: 50226 - DNA, 201 bp, Bos taurus; identical to SEQ ID NO: 8801

SEQ ID NO: 50227 - DNA, 201 bp, Bos taurus
atcttttatgtctcctgcgttgcaagaaggttctctaccgctgagccacctgggaagccctgaggcaatatacctaaatgtattaaaaggcaagcaacgagcccttctgcccttcctctctccctccctccatttatctttctataagtgaaagtcgctcagtcgtgtctgactctttgcgacccatggactatacggtcc

SEQ ID NO: 50228 - DNA, 201 bp, Bos taurus; identical to SEQ ID NO: 8803

SEQ ID NO: 50229 - DNA, 201 bp, Bos taurus
aggaagacaaggagggttgccgcacatccagggtgaggcgggggccccatgcgtagaccccgggtctgggcactaaattctcatcaccaaatgccctcccgtgacaacaggaagaggttggtggccgggcagaagcttgctcagcatctggggctctggctgctccgaccgggggtctggccatcctgaccagcccgagtc

SEQ ID NO: 50230 - DNA, 201 bp, Bos taurus
tccatgggctcacaggaccaagggtgtctctcaggcctcagtccgctcacctgcaaaacagcagccgtcacgccttcgcatccaagtctgaggattcgacgagaatggacgtcccaggccgggggcccctgcgacaatggttatgttaaggggacatgcctggctgggctgggactaagggctcagacgggcacccgcggt

SEQ ID NO: 50231 - DNA, 201 bp, Bos taurus; identical to SEQ ID NO: 8804

SEQ ID NO: 50232 - DNA, 201 bp, Bos taurus; identical to SEQ ID NO: 8807

SEQ ID NO: 50233 - DNA, 201 bp, Bos taurus; identical to SEQ ID NO: 8809

SEQ ID NO: 50234 - DNA, 201 bp, Bos taurus; identical to SEQ ID NO: 8810

SEQ ID NO: 50235 - DNA, 201 bp, Bos taurus; identical to SEQ ID NO: 8811

SEQ ID NO: 50236 - DNA, 201 bp, Bos taurus
caaggagatccaaccagtccatcctaaaggaaatcaatcctgaatattcattggaaggactgatgctgaaactgaaattccagtactttggccaccttatgttaagaactcatttgaaaaaaccctgatgcttggatgagatggttggatggcatcactgattcaatggacatgagtttgagtaagctctgggagttggtg

SEQ ID NO: 50237 - DNA, 201 bp, Bos taurus; identical to SEQ ID NO: 8812

SEQ ID NO: 50238 - DNA, 201 bp, Bos taurus; identical to SEQ ID NO: 8813

SEQ ID NO: 50239 - DNA, 201 bp, Bos taurus; identical to SEQ ID NO: 8814

SEQ ID NO: 50240 - DNA, 201 bp, Bos taurus; identical to SEQ ID NO: 8815

SEQ ID NO: 50241 - DNA, 201 bp, Bos taurus
gttggagggagggaggagggaatcctttggccaaaacaactgacaaaatttactactttgctttgaaggagtgcttcttaggaatctcttggagcctgttacctctccgttttcttcagttaggccacagttatttctgtagaatcttaataagtggagtgggcatagggtggggaaaagtggttatcagtgctaactgac

SEQ ID NO: 50242 - DNA, 201 bp, Bos taurus
ctgttttggagaagcagtgaagatttccaggaattgggccaccacccaatttttggtctttgatagtaggcattggaactgtcatggtgtctctaagtgtgtcattttacttgctgaggtgttacaatgagtgtatactgaggctccaggagatagtgaaggatagggaagtctggcacgctgtagtcaatggggtcgcaa

SEQ ID NO: 50243 - DNA, 201 bp, Bos taurus; identical to SEQ ID NO: 8818

SEQ ID NO: 50244 - DNA, 201 bp, Bos taurus; identical to SEQ ID NO: 8819

SEQ ID NO: 50245 - DNA, 201 bp, Bos taurus; identical to SEQ ID NO: 8820

SEQ ID NO: 50246 - DNA, 201 bp, Bos taurus; identical to SEQ ID NO: 8821

SEQ ID NO: 50247 - DNA, 201 bp, Bos taurus; identical to SEQ ID NO: 8823

SEQ ID NO: 50248 - DNA, 201 bp, Bos taurus; identical to SEQ ID NO: 8824

SEQ ID NO: 50249 - DNA, 201 bp, Bos taurus
tgtttctgaccatccagcagattaacacagacttgctcagagggtcactggcagaggtcttgagagcagcaagagccacttttccaggctctgcttatgttgtatttttcctgtctcactggcctgagggagtcacatgcttggcccagagtcagcatattagtctgctcaggctgcctccacaaagcaccacagactggg

SEQ ID NO: 50250 - DNA, 201 bp, Bos taurus; identical to SEQ ID NO: 8827

SEQ ID NO: 50251 - DNA, 201 bp, Bos taurus; identical to SEQ ID NO: 8829

SEQ ID NO: 50252 - DNA, 201 bp, Bos taurus
gttgacactagatctaggacccacaggcctaaaactaggtaactccaaagctggccacacccaccagtggccagcagcctccacataaagcagggcctcagaactaacctgaccaggggttagccaagcatatcagatcaccaagagtaatcagcctgctacaatagaaggacccacacagcttacacagggggagaccct

SEQ ID NO: 50253 - DNA, 201 bp, Bos taurus
ttccttaagttccaaaatttactagagacatgatgaagaagcctgtattttacaactgtagcaactgtcaagaatctttttaggtcactatattatccttcgtcaaagatcaatagaagtcacttattgtgctttttgtgggtgggattagaagggagaccactgatgggcataattcaaatcacatactgtgtgggtaag

SEQ ID NO: 50254 - DNA, 201 bp, Bos taurus
atatgagaaataacatattaatcattcaacagttgctgcttaacccatactaagtaatttacggcaaaggtgaaagaggagaaatgactcaaaactgcaattgtaacctacaataaatattgagcaaatattacattctgtccttttcatcctttctttagtaggctatactctctatggtagctagttttggtggtaaat

SEQ ID NO: 50255 - DNA, 201 bp, Bos taurus
tatacataacattccctgacgagtatctgaagcaaaactagcccatgttgccaattaaaagggaagtagttaagttagggagagaccatcttgagtgagccgatgagggaaacagatttatgaagaggatgctccagctctattcagaggtagtatagatacatgcatttttttttttctaatttgaaaacaagcatgagg

SEQ ID NO: 50256 - DNA, 201 bp, Bos taurus
tttgttttaattcccaaatgtcgtattctttttcagaaggcaagtgtgtgataaattataaactcaaattatgtattaacatgtgcgggacactctggggttagaatagagatagtaataagtttgaataatttcttgatttgggtctaaaaacatgatgagtttggaaattaaaaataaaaacccaaactgtatatcaat

SEQ ID NO: 50257 - DNA, 201 bp, Bos taurus
aaattgtaaagcatatgaagcttatatggcttttttctatttacattctgaatagaataatattcttaattttatagaacttatgtctctatagcttatatactagtgtgctagatttttctaaataaaacatttccttggctaataaaactacaagttgtattataaagctttagtgaaagtgactttaatttagaatta

SEQ ID NO: 50258 - DNA, 201 bp, Bos taurus; identical to SEQ ID NO: 8830

SEQ ID NO: 50259 - DNA, 201 bp, Bos taurus; identical to SEQ ID NO: 8831

SEQ ID NO: 50260 - DNA, 201 bp, Bos taurus; identical to SEQ ID NO: 8832

SEQ ID NO: 50261 - DNA, 201 bp, Bos taurus; identical to SEQ ID NO: 8833

SEQ ID NO: 50262 - DNA, 201 bp, Bos taurus; identical to SEQ ID NO: 8834

SEQ ID NO: 50263 - DNA, 201 bp, Bos taurus; identical to SEQ ID NO: 8836

SEQ ID NO: 50264 - DNA, 201 bp, Bos taurus; identical to SEQ ID NO: 8837

SEQ ID NO: 50265 - DNA, 201 bp, Bos taurus; identical to SEQ ID NO: 8838

SEQ ID NO: 50266 - DNA, 201 bp, Bos taurus; identical to SEQ ID NO: 8839

SEQ ID NO: 50267 - DNA, 201 bp, Bos taurus
agtttggtggaagatgccatctctggggccgcgactgcagcagccccttaacttcccactctggctgtcacacacctgcctctctgcctcccctgggagacgggcctatattgcagcctgatagctctcctttggtattcactcaatcgtttgttctgtgagtgcttcaggcttcattcagcattagagccttgtgcggca

SEQ ID NO: 50268 - DNA, 201 bp, Bos taurus; identical to SEQ ID NO: 8841

SEQ ID NO: 50269 - DNA, 201 bp, Bos taurus; identical to SEQ ID NO: 8842

SEQ ID NO: 50270 - DNA, 201 bp, Bos taurus; identical to SEQ ID NO: 8844

SEQ ID NO: 50271 - DNA, 201 bp, Bos taurus; identical to SEQ ID NO: 8846

SEQ ID NO: 50272 - DNA, 201 bp, Bos taurus; identical to SEQ ID NO: 8848

SEQ ID NO: 50273 - DNA, 201 bp, Bos taurus; identical to SEQ ID NO: 8850

SEQ ID NO: 50274 - DNA, 201 bp, Bos taurus; identical to SEQ ID NO: 8851

SEQ ID NO: 50275 - DNA, 201 bp, Bos taurus; identical to SEQ ID NO: 8852

SEQ ID NO: 50276 - DNA, 201 bp, Bos taurus; identical to SEQ ID NO: 8854

SEQ ID NO: 50277 - DNA, 201 bp, Bos taurus
tcaaaaattgtaagtaattttaccaaattaataaagcctttttagtgttggaattcagatttgtctcaactcacatgctatagcctccgttatattgcttgttatcctattttcaagtacaaaatattatgagaataagataatgtagttatgcataaggattttctcacttacagaaaatattatgtgggtttgtattga

SEQ ID NO: 50278 - DNA, 201 bp, Bos taurus
tgctgaggcgatcattaacatcatgcatcagatcgttcttgttctccctgctacaaggcagctggcagggctgtgctttctggttggccctcatattggagtggaaccacgtgatgagtttttgctgataacctgagaatggaaatgaggtttggtcctcctggccagagtatcagctgtctggccacgattttctgggtc

SEQ ID NO: 50279 - DNA, 201 bp, Bos taurus
atatatgcaatatatacaatgatccgtttaactgatctatccgttcagttaaaagttatgtcacggctttggtccaccgtcatggagtggcctgcaattttctgcctagcactttaccattcttttggcagctcacaatctccatcttcctcctggctttgaaagaaactaggatatttgcaaagacctcatgatctggct

SEQ ID NO: 50280 - DNA, 201 bp, Bos taurus; identical to SEQ ID NO: 8856

SEQ ID NO: 50281 - DNA, 201 bp, Bos taurus; identical to SEQ ID NO: 8857

SEQ ID NO: 50282 - DNA, 201 bp, Bos taurus
ttaacaaaaacaataataatacagaaaagctcaagtttcccctaattcctccatctcaggcttatccccaccaccagcatttcaagattgaaaaacctctaagctctgtattcctaaggaaaacctcactttcttatgcacttttaaaattaatagtttgaaatacattctctttatggatgtgatagaatagaaaaacaa

SEQ ID NO: 50283 - DNA, 201 bp, Bos taurus; identical to SEQ ID NO: 8858

SEQ ID NO: 50284 - DNA, 201 bp, Bos taurus
gcttcttaatgtcaggcctctcatcttcctcattcttatttctcccctgcaagaccataagcaaacaataggtgcttaataattaagaagagtgcttaccatgtgtcaggccccaaactaaggaccttgcatttgttcactcacctactcttctccacaggcttgtgagatgggcactatttatatccttattttatagat

SEQ ID NO: 50285 - DNA, 201 bp, Bos taurus; identical to SEQ ID NO: 8859

SEQ ID NO: 50286 - DNA, 201 bp, Bos taurus; identical to SEQ ID NO: 8861

SEQ ID NO: 50287 - DNA, 201 bp, Bos taurus; identical to SEQ ID NO: 8864

SEQ ID NO: 50288 - DNA, 201 bp, Bos taurus; identical to SEQ ID NO: 8865

SEQ ID NO: 50289 - DNA, 201 bp, Bos taurus
taaaaaagggctttatgacagtagtgtggaatttttaagaactcagagacagctctcagaggaagtaatatctaagctgaggcctgaagaacagatgggtgttagccaaatagaatgagagccacggtaccaagcagggtgacagcacgtgcagaggcccagaaagtaaagggagcacacagagttgggaagtccagcccc

SEQ ID NO: 50290 - DNA, 201 bp, Bos taurus
agctgattaaaaacagtctttaaaaatctccccaaagcagggacttccctggcagtctagaggtttagactctgcacttccacagcaggggccacaggctcgatcctgtgtgcggtgtcaaaagaaaagagattccccaatgaagacaatccttctcaaaggtaagatgcaaaatgagcacacttccaagttgcttgtacc

SEQ ID NO: 50291 - DNA, 201 bp, Bos taurus; identical to SEQ ID NO: 8867

SEQ ID NO: 50292 - DNA, 201 bp, Bos taurus
gcctctggcatgagtgtgttgctcccaaaacacaccacatgctgttctaattaggaagaagtctggaaatcatattccaagctgtgttagctttcacgaacatcacctacaaggtgttcaaagctgataacattctcaaagatgaaggccgaagcagggagtggggaaagaaaacaggacacgctggcctctgcatcagac

SEQ ID NO: 50293 - DNA, 201 bp, Bos taurus
gctgtgtatgtgcggccatgacctggtcacctggagatgaaaggggtcatcgaagggaactggagagaacatagcacagagtccagaaaccccaggttaatgtggggccctggggctgaactgcggggagctgggtggccgctatatttcctgtgtactgcccacgtctcctctgtctcctgcgatgtgactctaattctt

SEQ ID NO: 50294 - DNA, 201 bp, Bos taurus
gctgacagacagaaaaggcacatttttactttttcactatgtcaaatgatagacttgtcttttcctgagtccccacattattttagctgttttagcaaactacatttgagtctctgggccagaagcttctatgaccgtggcatctgcaaataattgataacttaacgtgccccctcaagaggtaaggtcaattcaagcagt

SEQ ID NO: 50295 - DNA, 201 bp, Bos taurus
ctccattccatgagtgaccgctgcaggtgctcaaggccggtttcccaaagccggacacggcctcccatatcaacagtgacaacgccacctctgccccactcggccagcagtgcgtctgtgtccgagatagtagacagccatgtggtatatggtgagagagagtctgacctgaaaaagaatcacggcgttcaaccgattgaa

SEQ ID NO: 50296 - DNA, 201 bp, Bos taurus
tggcctccagctgttaactcttttaggtccagcttcacaaacatacgctctgctctggggctcccggaaacttcctcagatctgtgtcttgtctgatagctcatgtacccaatcccagggcccccctttgcttcccgcaggtcttattccctactaaactgtctgcacacaccaccccacactcccatttgcttccacaag

SEQ ID NO: 50297 - DNA, 201 bp, Bos taurus; identical to SEQ ID NO: 8868

SEQ ID NO: 50298 - DNA, 201 bp, Bos taurus; identical to SEQ ID NO: 8870

SEQ ID NO: 50299 - DNA, 201 bp, Bos taurus; identical to SEQ ID NO: 8871

SEQ ID NO: 50300 - DNA, 201 bp, Bos taurus; identical to SEQ ID NO: 8872

SEQ ID NO: 50301 - DNA, 201 bp, Bos taurus; identical to SEQ ID NO: 8873

SEQ ID NO: 50302 - DNA, 201 bp, Bos taurus; identical to SEQ ID NO: 8874

SEQ ID NO: 50303 - DNA, 201 bp, Bos taurus; identical to SEQ ID NO: 8875

SEQ ID NO: 50304 - DNA, 201 bp, Bos taurus; identical to SEQ ID NO: 8876

SEQ ID NO: 50305 - DNA, 201 bp, Bos taurus; identical to SEQ ID NO: 8877

SEQ ID NO: 50306 - DNA, 201 bp, Bos taurus; identical to SEQ ID NO: 8878

SEQ ID NO: 50307 - DNA, 201 bp, Bos taurus; identical to SEQ ID NO: 8879

SEQ ID NO: 50308 - DNA, 201 bp, Bos taurus; identical to SEQ ID NO: 8880

SEQ ID NO: 50309 - DNA, 201 bp, Bos taurus; identical to SEQ ID NO: 8881

SEQ ID NO: 50310 - DNA, 201 bp, Bos taurus
gcctccgagccatcagcacatgctcaactgactcctagacttcattttaaaaacataagtcggagataaattgaagagttttaagacaacggcattaaccgcaagcgtaaggcccttgtgggcatgcgacactgtgactgcaccagtagcatccccgtgaacctggccttggttagaaacgctgtgttcaaggttgtgcag

SEQ ID NO: 50311 - DNA, 201 bp, Bos taurus
atcatttatcaagggctggtaatcatactccataatgcctcccctatataagttgtcctctccattcccactgttcttcactgccaaggtcaagttctgaccctgcctcctgccttgagtattgaaccaccctataacaggactttttcccatgtaatacgtcacatacttgcagtcaagatttgcctgtgctctacaatt

SEQ ID NO: 50312 - DNA, 201 bp, Bos taurus
acagggaaggtatggtcctgtttgcctgggcaaggcaggaaggctctcagacaaagtagcctccaaaggatgagagcatcggagtggcattggaggagaaggtgatgtaatcagagaagagcaagtcaggagtcatacacagggctgggaaggagaagaaagtgtgaaaggaggtgggcagaggttagatcttgaagcatc

SEQ ID NO: 50313 - DNA, 201 bp, Bos taurus; identical to SEQ ID NO: 8882

SEQ ID NO: 50314 - DNA, 201 bp, Bos taurus
ttcaggaagaaagaatgcactctctcagcctgtcttcaagctgggacatttatcatctcctgccttcagatttggcctggaaattacatcatcatctctcctgcctctcaggcctttgaactcagactagaagcataccttcagctctcctggtcttcagcttgtcaactgcagattttaggacttctgagcctccatagg

SEQ ID NO: 50315 - DNA, 201 bp, Bos taurus
agtgtgcttgttatactcgttagtgatgcaaagattgatacacaaagataattgtttcagcatggtttgttatggagaaaaatgagtagcattctcaaatctcttagtaagggattaattaagtaaactggggacattttaaaattgcttaatatttttaatttgaaacagtctcaagcaggagaaaagttggaagaacaa

SEQ ID NO: 50316 - DNA, 201 bp, Bos taurus; identical to SEQ ID NO: 8889

SEQ ID NO: 50317 - DNA, 201 bp, Bos taurus
tcccatggccacttttcttgggcctggtccttttgtaaagaagtaaaagcttcctcagacactctcccttccccgcaagagtgccagctttgtcttggtggttggaacttgtaacttggccatgcttagctgcagagggcctgggagaggaagtattaacattttctagcttctgtagcggagggctggcagtgcagagga

SEQ ID NO: 50318 - DNA, 201 bp, Bos taurus; identical to SEQ ID NO: 8893

SEQ ID NO: 50319 - DNA, 201 bp, Bos taurus; identical to SEQ ID NO: 8894

SEQ ID NO: 50320 - DNA, 201 bp, Bos taurus; identical to SEQ ID NO: 8895

SEQ ID NO: 50321 - DNA, 201 bp, Bos taurus; identical to SEQ ID NO: 8896

SEQ ID NO: 50322 - DNA, 201 bp, Bos taurus; identical to SEQ ID NO: 8897

SEQ ID NO: 50323 - DNA, 201 bp, Bos taurus; identical to SEQ ID NO: 8898

SEQ ID NO: 50324 - DNA, 201 bp, Bos taurus
ctctggccttggtcatggcacccagggatcacgaagataatccttttggtttagttcagataccttgtgggttgtgagagacggtggtctctgagttgccgtgttaaagtcaggcctggggtcttcaggtgctggtccttattccctgaggatggtgctaggatggctgggctctatctaaacgaatgtgtccgagcatca

SEQ ID NO: 50325 - DNA, 201 bp, Bos taurus
ttcttcaccttgaggcatcagcagccttctaataaaacctgttgctttgaggagaaagatagtcattagcctggtgaatcaacccttaatatagaaatatgtttgctcatgggaaaaggtgatgtttatggtgtgcttttggagaaggcagtggcaccccactccagtactcctgactggaaaatcccatggacggaggag

SEQ ID NO: 50326 - DNA, 201 bp, Bos taurus; identical to SEQ ID NO: 8899

SEQ ID NO: 50327 - DNA, 201 bp, Bos taurus; identical to SEQ ID NO: 8900

SEQ ID NO: 50328 - DNA, 201 bp, Bos taurus; identical to SEQ ID NO: 8901

SEQ ID NO: 50329 - DNA, 201 bp, Bos taurus; identical to SEQ ID NO: 8902

SEQ ID NO: 50330 - DNA, 201 bp, Bos taurus; identical to SEQ ID NO: 8903

SEQ ID NO: 50331 - DNA, 201 bp, Bos taurus; identical to SEQ ID NO: 8905

SEQ ID NO: 50332 - DNA, 201 bp, Bos taurus; identical to SEQ ID NO: 8906

SEQ ID NO: 50333 - DNA, 201 bp, Bos taurus; identical to SEQ ID NO: 8907

SEQ ID NO: 50334 - DNA, 201 bp, Bos taurus; identical to SEQ ID NO: 8908

SEQ ID NO: 50335 - DNA, 201 bp, Bos taurus; identical to SEQ ID NO: 8909

SEQ ID NO: 50336 - DNA, 201 bp, Bos taurus; identical to SEQ ID NO: 8910

SEQ ID NO: 50337 - DNA, 201 bp, Bos taurus; identical to SEQ ID NO: 8911

SEQ ID NO: 50338 - DNA, 201 bp, Bos taurus; identical to SEQ ID NO: 8912

SEQ ID NO: 50339 - DNA, 201 bp, Bos taurus; identical to SEQ ID NO: 8913

SEQ ID NO: 50340 - DNA, 201 bp, Bos taurus; identical to SEQ ID NO: 8914

SEQ ID NO: 50341 - DNA, 201 bp, Bos taurus; identical to SEQ ID NO: 8915

SEQ ID NO: 50342 - DNA, 201 bp, Bos taurus; identical to SEQ ID NO: 8916

SEQ ID NO: 50343 - DNA, 201 bp, Bos taurus; identical to SEQ ID NO: 8917

SEQ ID NO: 50344 - DNA, 201 bp, Bos taurus; identical to SEQ ID NO: 8918

SEQ ID NO: 50345 - DNA, 201 bp, Bos taurus; identical to SEQ ID NO: 8919

SEQ ID NO: 50346 - DNA, 201 bp, Bos taurus; identical to SEQ ID NO: 8920

SEQ ID NO: 50347 - DNA, 201 bp, Bos taurus; identical to SEQ ID NO: 8922

SEQ ID NO: 50348 - DNA, 201 bp, Bos taurus; identical to SEQ ID NO: 8923

SEQ ID NO: 50349 - DNA, 201 bp, Bos taurus; identical to SEQ ID NO: 8924

SEQ ID NO: 50350 - DNA, 201 bp, Bos taurus; identical to SEQ ID NO: 8926

SEQ ID NO: 50351 - DNA, 201 bp, Bos taurus; identical to SEQ ID NO: 8927

SEQ ID NO: 50352 - DNA, 201 bp, Bos taurus; identical to SEQ ID NO: 8928

SEQ ID NO: 50353 - DNA, 201 bp, Bos taurus; identical to SEQ ID NO: 8929

SEQ ID NO: 50354 - DNA, 201 bp, Bos taurus; identical to SEQ ID NO: 8930

SEQ ID NO: 50355 - DNA, 201 bp, Bos taurus; identical to SEQ ID NO: 8931

SEQ ID NO: 50356 - DNA, 201 bp, Bos taurus; identical to SEQ ID NO: 8933

SEQ ID NO: 50357 - DNA, 201 bp, Bos taurus; identical to SEQ ID NO: 8934

SEQ ID NO: 50358 - DNA, 201 bp, Bos taurus; identical to SEQ ID NO: 8937

SEQ ID NO: 50359 - DNA, 201 bp, Bos taurus; identical to SEQ ID NO: 8939

SEQ ID NO: 50360 - DNA, 201 bp, Bos taurus; identical to SEQ ID NO: 8940

SEQ ID NO: 50361 - DNA, 201 bp, Bos taurus; identical to SEQ ID NO: 8943

SEQ ID NO: 50362 - DNA, 201 bp, Bos taurus; identical to SEQ ID NO: 8944

SEQ ID NO: 50363 - DNA, 201 bp, Bos taurus; identical to SEQ ID NO: 8945

SEQ ID NO: 50364 - DNA, 201 bp, Bos taurus; identical to SEQ ID NO: 8947

SEQ ID NO: 50365 - DNA, 201 bp, Bos taurus; identical to SEQ ID NO: 8949

SEQ ID NO: 50366 - DNA, 201 bp, Bos taurus; identical to SEQ ID NO: 8950

SEQ ID NO: 50367 - DNA, 201 bp, Bos taurus; identical to SEQ ID NO: 8951

SEQ ID NO: 50368 - DNA, 201 bp, Bos taurus; identical to SEQ ID NO: 8952

SEQ ID NO: 50369 - DNA, 201 bp, Bos taurus; identical to SEQ ID NO: 8954

SEQ ID NO: 50370 - DNA, 201 bp, Bos taurus; identical to SEQ ID NO: 8956

SEQ ID NO: 50371 - DNA, 201 bp, Bos taurus; identical to SEQ ID NO: 8960

SEQ ID NO: 50372 - DNA, 201 bp, Bos taurus; identical to SEQ ID NO: 8961

SEQ ID NO: 50373 - DNA, 201 bp, Bos taurus; identical to SEQ ID NO: 8962

SEQ ID NO: 50374 - DNA, 201 bp, Bos taurus; identical to SEQ ID NO: 8963

SEQ ID NO: 50375 - DNA, 201 bp, Bos taurus; identical to SEQ ID NO: 8964

SEQ ID NO: 50376 - DNA, 201 bp, Bos taurus; identical to SEQ ID NO: 8967

SEQ ID NO: 50377 - DNA, 201 bp, Bos taurus; identical to SEQ ID NO: 8968

SEQ ID NO: 50378 - DNA, 201 bp, Bos taurus; identical to SEQ ID NO: 8971

SEQ ID NO: 50379 - DNA, 201 bp, Bos taurus; identical to SEQ ID NO: 8974

SEQ ID NO: 50380 - DNA, 201 bp, Bos taurus; identical to SEQ ID NO: 8978

SEQ ID NO: 50381 - DNA, 201 bp, Bos taurus; identical to SEQ ID NO: 8979

SEQ ID NO: 50382 - DNA, 201 bp, Bos taurus; identical to SEQ ID NO: 8980

SEQ ID NO: 50383 - DNA, 201 bp, Bos taurus; identical to SEQ ID NO: 8981

SEQ ID NO: 50384 - DNA, 201 bp, Bos taurus; identical to SEQ ID NO: 8982

SEQ ID NO: 50385 - DNA, 201 bp, Bos taurus; identical to SEQ ID NO: 8983

SEQ ID NO: 50386 - DNA, 201 bp, Bos taurus; identical to SEQ ID NO: 8984

SEQ ID NO: 50387 - DNA, 201 bp, Bos taurus
gccaaaacgccaactctgactttgggggattagtcttgctcaagagacattgcttacttattaagattgagattagttggcaacaaggacagaggtgaacaagtagccagaggtggccacaaagtttatatcacatcatttgcagagtcgccaccttccatgtggggctcagcctgcctagagccccatgcttcatttgca

SEQ ID NO: 50388 - DNA, 201 bp, Bos taurus; identical to SEQ ID NO: 8985

SEQ ID NO: 50389 - DNA, 201 bp, Bos taurus
ggagaagggaatggctacccactccagtattctggcctgaagaattccatggactatatagtccatgggttcgcaaagagtcggacacaactgagcaactttccctttcatgaggaatggggcctcatagaggaaagaacatgggcctcatctagacagggttgttgttcccatgggggaatggagaccccatgtatgtag

SEQ ID NO: 50390 - DNA, 201 bp, Bos taurus; identical to SEQ ID NO: 8989

SEQ ID NO: 50391 - DNA, 201 bp, Bos taurus; identical to SEQ ID NO: 8990

SEQ ID NO: 50392 - DNA, 201 bp, Bos taurus; identical to SEQ ID NO: 8991

SEQ ID NO: 50393 - DNA, 201 bp, Bos taurus; identical to SEQ ID NO: 8992

SEQ ID NO: 50394 - DNA, 201 bp, Bos taurus
aggctcccgtgtctgcccagcccatcagagaggttgctacactcttgtcgatgagtgtcatcagcaaacttggcaactgggccagctccctccagcctcccgaaggattcaatgaaggatccttctggaatagggggagcccagacccatgttccctttcaggaggccccctttctccgtcatttctgtgtcaccagggct

SEQ ID NO: 50395 - DNA, 201 bp, Bos taurus
ctcccacagtgattcatctggccacgttacagcacaaatgtgtcagttttcagggacttggagagctcttaagcaagcacaggtgtgttgttgaggatgctgatatgcaaaggagcaacagtagacagatccatgccccgaggaggctgccagccagtgaggaccagcccagtttccaactggacccccttgatgtggagc

SEQ ID NO: 50396 - DNA, 201 bp, Bos taurus; identical to SEQ ID NO: 8993

SEQ ID NO: 50397 - DNA, 201 bp, Bos taurus; identical to SEQ ID NO: 8995

SEQ ID NO: 50398 - DNA, 201 bp, Bos taurus; identical to SEQ ID NO: 8997

SEQ ID NO: 50399 - DNA, 201 bp, Bos taurus; identical to SEQ ID NO: 8998

SEQ ID NO: 50400 - DNA, 201 bp, Bos taurus; identical to SEQ ID NO: 9001

SEQ ID NO: 50401 - DNA, 201 bp, Bos taurus; identical to SEQ ID NO: 9002

SEQ ID NO: 50402 - DNA, 201 bp, Bos taurus; identical to SEQ ID NO: 9003

SEQ ID NO: 50403 - DNA, 201 bp, Bos taurus; identical to SEQ ID NO: 9004

SEQ ID NO: 50404 - DNA, 201 bp, Bos taurus; identical to SEQ ID NO: 9005

SEQ ID NO: 50405 - DNA, 201 bp, Bos taurus; identical to SEQ ID NO: 9009

SEQ ID NO: 50406 - DNA, 201 bp, Bos taurus; identical to SEQ ID NO: 9010

SEQ ID NO: 50407 - DNA, 201 bp, Bos taurus
tcttatctaaaagcgtgctcagagcccatgcccagggcctggtctgaaggatatgagcgggtccagaaccagtgggcctctgagtgatgccacatcctgaggagtcacgtcagggaagccaccgagcctggtgctcaggcttccattttggccttgagtcatggagccaattatcctcagaagatccttctccttaatgat

SEQ ID NO: 50408 - DNA, 201 bp, Bos taurus; identical to SEQ ID NO: 9011

SEQ ID NO: 50409 - DNA, 201 bp, Bos taurus; identical to SEQ ID NO: 9012

SEQ ID NO: 50410 - DNA, 201 bp, Bos taurus; identical to SEQ ID NO: 9013

SEQ ID NO: 50411 - DNA, 201 bp, Bos taurus; identical to SEQ ID NO: 9014

SEQ ID NO: 50412 - DNA, 201 bp, Bos taurus; identical to SEQ ID NO: 9015

SEQ ID NO: 50413 - DNA, 201 bp, Bos taurus; identical to SEQ ID NO: 9017

SEQ ID NO: 50414 - DNA, 201 bp, Bos taurus; identical to SEQ ID NO: 9018

SEQ ID NO: 50415 - DNA, 201 bp, Bos taurus; identical to SEQ ID NO: 9019

SEQ ID NO: 50416 - DNA, 201 bp, Bos taurus
gcttcattgccccttggcatgtggaatcttcctggaccagggattgaacccatgtcccctgcatttggcaggcagatactttacattaaaccaccagagacgtctccaagtgtatgcattttaacaaaaacaattcatagtcccttcagagtctccaaatcaataaaaatgaaactactagactactgatggggtatctta

SEQ ID NO: 50417 - DNA, 201 bp, Bos taurus; identical to SEQ ID NO: 9020

SEQ ID NO: 50418 - DNA, 201 bp, Bos taurus; identical to SEQ ID NO: 9021

SEQ ID NO: 50419 - DNA, 201 bp, Bos taurus; identical to SEQ ID NO: 9022

SEQ ID NO: 50420 - DNA, 201 bp, Bos taurus; identical to SEQ ID NO: 9026

SEQ ID NO: 50421 - DNA, 201 bp, Bos taurus
ggctcaagcgggccaagatggacaagtccatgtttgtgaaggtgaagaccctgggcgttggcgcctttggggaggtgtgcctggcctgcaaggtggacacgcacgcgctgtatgccatgaagacccttagaaagaaggacgtcctgaaccgcaaccaggtggcccacgtcaaggcagagcgggacatcctggcggaggcgg

SEQ ID NO: 50422 - DNA, 201 bp, Bos taurus; identical to SEQ ID NO: 9028

SEQ ID NO: 50423 - DNA, 201 bp, Bos taurus; identical to SEQ ID NO: 9030

SEQ ID NO: 50424 - DNA, 201 bp, Bos taurus
ggcagccttccctctcttactacagagcacagagaagaggtccaaaccatctgcctgacactcacagcactatctaaagaccaaggggacaaaggccaaggttttggaaacaccccaggagtgagccgagctgccctacaggggataagccctcccagaagcctgtcaaccgtgggacaagaagcaagaggcctatgggac

SEQ ID NO: 50425 - DNA, 201 bp, Bos taurus
ccccacccctacccagaggaaggagagacagtctgcaggattaaaccagtccttttgcccaaaaaacgatgtcctggccccaaataaccctttctttccttttgctatgacttccttgccccgccctacagcttataaaaagcttctgttctgcacagctccctcagagggccctgctgtctcctaaaatggatgctaccc

SEQ ID NO: 50426 - DNA, 201 bp, Bos taurus
gtgtgcctccccttctgaggggggtgggtgtgcgggggcccaacagcagggtggatgccagcagaattgaggtggtctctgagtatctccttggtctgtaggtttccagagtctggaggaggggccaggatggaggctccgttctgctggcctgtaccccgtgtccctgactctaggactcccccactccagggccttgga

SEQ ID NO: 50427 - DNA, 201 bp, Bos taurus
agtgactaacacaacacacagattgtggttgaaagaaatggatgagaaacaactttggacacaagtgagcgactagcacaaatacttaggtggccagatgagtaaagaagggagagagcaaatgtatactacttaaaaaaaaatttggatacaaagaggtagaggtacagtggacctacaacttaatatagggccaaagca

SEQ ID NO: 50428 - DNA, 201 bp, Bos taurus; identical to SEQ ID NO: 9032

SEQ ID NO: 50429 - DNA, 201 bp, Bos taurus
tgggggtgcagttcctaacacagctgagtatgggacttggtgtgtccttaaggttgggttagtttgctagtggccaaggccagggcccagctggtctcagcgtagggtctgggatgctgtcattgggaacatagttttcttgtgtcttttatctgtcacctggtgaggctggtttagagatgaatgcaggcttcctggatc

SEQ ID NO: 50430 - DNA, 201 bp, Bos taurus
tgttctccgaattgataatttagtggagaccttcattaatcagttatgccaatgtatgatgagacgtattcttatgaaggtaagttggaattacttccttaaggaagtgacaactgatgtgagatctgaagaaagagtaggaattaacagtgtgaaaatatatttttaaggcttcttcatagaagtagcaacctatataaa

SEQ ID NO: 50431 - DNA, 201 bp, Bos taurus; identical to SEQ ID NO: 9033

SEQ ID NO: 50432 - DNA, 201 bp, Bos taurus; identical to SEQ ID NO: 9036

SEQ ID NO: 50433 - DNA, 201 bp, Bos taurus; identical to SEQ ID NO: 9037

SEQ ID NO: 50434 - DNA, 201 bp, Bos taurus; identical to SEQ ID NO: 9038

SEQ ID NO: 50435 - DNA, 201 bp, Bos taurus; identical to SEQ ID NO: 9041

SEQ ID NO: 50436 - DNA, 201 bp, Bos taurus; identical to SEQ ID NO: 9042

SEQ ID NO: 50437 - DNA, 201 bp, Bos taurus; identical to SEQ ID NO: 9043

SEQ ID NO: 50438 - DNA, 201 bp, Bos taurus; identical to SEQ ID NO: 9044

SEQ ID NO: 50439 - DNA, 201 bp, Bos taurus; identical to SEQ ID NO: 9047

SEQ ID NO: 50440 - DNA, 201 bp, Bos taurus; identical to SEQ ID NO: 9048

SEQ ID NO: 50441 - DNA, 201 bp, Bos taurus
ggcttcctggtaaaacatgagacagcttaacctttccttttttcaaatttatagttttgaaggccatttagacttagaatatcaaaaatgtattcataatctactaacttgtttttgttgccttggagtttatagataacatattcaaacaagtgatgtcatgtttgagtaacagttaaaactcaggcttttttccattaa

SEQ ID NO: 50442 - DNA, 201 bp, Bos taurus; identical to SEQ ID NO: 9049

SEQ ID NO: 50443 - DNA, 201 bp, Bos taurus; identical to SEQ ID NO: 9050

SEQ ID NO: 50444 - DNA, 201 bp, Bos taurus; identical to SEQ ID NO: 9051

SEQ ID NO: 50445 - DNA, 201 bp, Bos taurus; identical to SEQ ID NO: 9054

SEQ ID NO: 50446 - DNA, 201 bp, Bos taurus; identical to SEQ ID NO: 9055

SEQ ID NO: 50447 - DNA, 201 bp, Bos taurus; identical to SEQ ID NO: 9057

SEQ ID NO: 50448 - DNA, 201 bp, Bos taurus; identical to SEQ ID NO: 9058

SEQ ID NO: 50449 - DNA, 201 bp, Bos taurus
ctgtatgaatacagtgtgcacagttatgaaagcagccattaacctttaagccgtatccagctccttctgagcacaatcatttactcggagacatcaagttaacatcaactgagctgttatcatttcacagacctatgaaagtatttatttggcatttacagtctatggtctcttcacctgcggtttattttcctatggttc

SEQ ID NO: 50450 - DNA, 201 bp, Bos taurus; identical to SEQ ID NO: 9060

SEQ ID NO: 50451 - DNA, 201 bp, Bos taurus; identical to SEQ ID NO: 9061

SEQ ID NO: 50452 - DNA, 201 bp, Bos taurus; identical to SEQ ID NO: 9062

SEQ ID NO: 50453 - DNA, 201 bp, Bos taurus; identical to SEQ ID NO: 9065

SEQ ID NO: 50454 - DNA, 201 bp, Bos taurus; identical to SEQ ID NO: 9066

SEQ ID NO: 50455 - DNA, 201 bp, Bos taurus; identical to SEQ ID NO: 9068

SEQ ID NO: 50456 - DNA, 201 bp, Bos taurus; identical to SEQ ID NO: 9069

SEQ ID NO: 50457 - DNA, 201 bp, Bos taurus; identical to SEQ ID NO: 9070

SEQ ID NO: 50458 - DNA, 201 bp, Bos taurus; identical to SEQ ID NO: 9071

SEQ ID NO: 50459 - DNA, 201 bp, Bos taurus; identical to SEQ ID NO: 9072

SEQ ID NO: 50460 - DNA, 201 bp, Bos taurus
gaaaaacattgtatttgcaaaattacacatagaaatactctgagatctaagagagttctccagagatcatttgtgtttgaatcaataaaggacccacgacgattagttatctggataactttaaagcattgtcttagatggagattatttgaagccgaaccacacttcctgtgaaaccctatatttttgtttcatctttgc

SEQ ID NO: 50461 - DNA, 201 bp, Bos taurus; identical to SEQ ID NO: 9073

SEQ ID NO: 50462 - DNA, 201 bp, Bos taurus; identical to SEQ ID NO: 9074

SEQ ID NO: 50463 - DNA, 201 bp, Bos taurus; identical to SEQ ID NO: 9075

SEQ ID NO: 50464 - DNA, 201 bp, Bos taurus; identical to SEQ ID NO: 9076

SEQ ID NO: 50465 - DNA, 201 bp, Bos taurus
cagaaagtataattctggatgatatatgatttcagaaacttgggcccagagatgtccagtgactgggcagggtcccatatgccgcaggtggcaggacccacgatgcctgaatttgggccaggtgggacttattgaaatttggttctgtgagggaatactcctaaaaatctaatgtaaattttcttcattaagaaataagga

SEQ ID NO: 50466 - DNA, 201 bp, Bos taurus; identical to SEQ ID NO: 9077

SEQ ID NO: 50467 - DNA, 201 bp, Bos taurus; identical to SEQ ID NO: 9078

SEQ ID NO: 50468 - DNA, 201 bp, Bos taurus; identical to SEQ ID NO: 9081

SEQ ID NO: 50469 - DNA, 201 bp, Bos taurus; identical to SEQ ID NO: 9082

SEQ ID NO: 50470 - DNA, 201 bp, Bos taurus; identical to SEQ ID NO: 9083

SEQ ID NO: 50471 - DNA, 201 bp, Bos taurus
caaatggaagctggaatggagaataccttcaaaatcccaaagcaaaataacgtgccaccctatgtgctgcagacccaaccacgccatcaatcaaatacaagagtaaagatatgctagatgtcaaacacgtacctctcctacaagactcttctcaggaaggaggagacgaaaagcaaaggaggtaaacaaaggaggaggaac

SEQ ID NO: 50472 - DNA, 201 bp, Bos taurus; identical to SEQ ID NO: 9084

SEQ ID NO: 50473 - DNA, 201 bp, Bos taurus; identical to SEQ ID NO: 9085

SEQ ID NO: 50474 - DNA, 201 bp, Bos taurus; identical to SEQ ID NO: 9086

SEQ ID NO: 50475 - DNA, 201 bp, Bos taurus
cagccctttgacctttgggctctttacagaaccaaaaccaacctaaaataaatcactgggaacatacagatgacagaaaatgaccatcgcgttgtcttcttatataccctttattgttatatttagaaaatgaacttccctcaacttttgacatagccaccctatatctttttgatctttggttatattttgctatgcaaa

SEQ ID NO: 50476 - DNA, 201 bp, Bos taurus; identical to SEQ ID NO: 9087

SEQ ID NO: 50477 - DNA, 201 bp, Bos taurus; identical to SEQ ID NO: 9088

SEQ ID NO: 50478 - DNA, 201 bp, Bos taurus; identical to SEQ ID NO: 9089

SEQ ID NO: 50479 - DNA, 201 bp, Bos taurus; identical to SEQ ID NO: 9090

SEQ ID NO: 50480 - DNA, 201 bp, Bos taurus; identical to SEQ ID NO: 9091

SEQ ID NO: 50481 - DNA, 201 bp, Bos taurus; identical to SEQ ID NO: 9092

SEQ ID NO: 50482 - DNA, 201 bp, Bos taurus; identical to SEQ ID NO: 9093

SEQ ID NO: 50483 - DNA, 201 bp, Bos taurus
tctatttgatggccactcagtattaacatatgaaagatttaaatgctttttcataggatccatacgctcatggaacaaaagaccctaaaaccaaggctcctcttccttagagcagcaggcagcactaaaaaaagtgttgcctcacctttcctgattaattctggacacctcctaaacccctactcctggattcagttcagt

SEQ ID NO: 50484 - DNA, 201 bp, Bos taurus
aatagtatcaggctggccaaatcactctttgaaaaacatttaatttgagtatcgtttggtcagtagataaccaaagacattcattttagagtgttttagggtttaaggatatatttatagtgcattttggcaattataagcaattagtttttaggttaaaaatagccttgaagacagctttacagtacttcagattctttc

SEQ ID NO: 50485 - DNA, 201 bp, Bos taurus
tcagattcctagggaagttttagaaaaaaatattcttgagcttccagaagaaggagcagaagagaacccttcttctgtattttgaaatacatcagagcacgctttctcctaacattgcctgccattaggggagactagttaaccaaagcctaacacggtgtatcatcagagcctatttgacctggagaaacaatccaccca

SEQ ID NO: 50486 - DNA, 201 bp, Bos taurus; identical to SEQ ID NO: 9094

SEQ ID NO: 50487 - DNA, 201 bp, Bos taurus; identical to SEQ ID NO: 9095

SEQ ID NO: 50488 - DNA, 201 bp, Bos taurus; identical to SEQ ID NO: 9096

SEQ ID NO: 50489 - DNA, 201 bp, Bos taurus
tggagctttgtttttggcaagaggaacagatttggaagaacccacaggcctaacagagctaatagagaaagcatgctgttgatccaatgattctccggcaggaaccaaatctgccttggccagtggcacattgaaggagccaacacaccattaggcagaggctcaagtaagcaggtggtttctgtcaatggatggcctaca

SEQ ID NO: 50490 - DNA, 201 bp, Bos taurus
aattgggtgggaggcctctcttctctttgcgtcttttgggttggcatgccctcacaccacgaggatgtaatttcctttactttccaaataaaatgaagctataacatggagctgtaccactggtccatccaagggctgtaacactggtctgtcgcctcaaatttttgttgcaatgagacagaaccgaggaaattacaaact

SEQ ID NO: 50491 - DNA, 201 bp, Bos taurus; identical to SEQ ID NO: 9097

SEQ ID NO: 50492 - DNA, 201 bp, Bos taurus
tatatgctttctccatgttctttgtgtaaaataaaagtagtactattcgctgtctttaattatttaatgtttttcctttgtgtcttttctcgtccaattacaacataaaccccttaggccctggtcaactgtcacacttcttagacacatagcacagtcctactcaggaaagaaccactccaaacaacaacaaaaagtata

SEQ ID NO: 50493 - DNA, 201 bp, Bos taurus; identical to SEQ ID NO: 9098

SEQ ID NO: 50494 - DNA, 201 bp, Bos taurus; identical to SEQ ID NO: 9099

SEQ ID NO: 50495 - DNA, 201 bp, Bos taurus; identical to SEQ ID NO: 9100

SEQ ID NO: 50496 - DNA, 201 bp, Bos taurus
ggttagtgttgtcttagaaggttattttgactgttgggtaagcagtgggtaaatcctgatttcaggtgtttgtacacacaatttaagatacattgtgtgtgtatgtgtttgtagttggcttttctggcccagtcagtgcggactgtgcaatgcagggagagactgtgtcaagttttatcttcattagatgtttaagaattc

SEQ ID NO: 50497 - DNA, 201 bp, Bos taurus
cgagcagatgtaaatcaggaaccactgcttgttagagaagtgttgtctttaccagcttggcagtcatttaggggttattgaagccaggtgctgggctattcaacgtatttaaatattcaaattaggattaaagatttttccatgggaaagacagcatattcaagaattccatagcaaacagtaccttaatttatttcttct

SEQ ID NO: 50498 - DNA, 201 bp, Bos taurus; identical to SEQ ID NO: 9101

SEQ ID NO: 50499 - DNA, 201 bp, Bos taurus; identical to SEQ ID NO: 9102

SEQ ID NO: 50500 - DNA, 201 bp, Bos taurus
acagacaatatttgaggacatatgctttgaaaatgtagattcttccacccctccttgtattaactctcccaatctctaggtgaccaatggcctacatatgcaggattactactttatcaagtgaaaacaagaacactggatggtttgtaaaatgttttcaaatctctttacgtttatttggccgtgtctggtcgtagtcat

SEQ ID NO: 50501 - DNA, 201 bp, Bos taurus; identical to SEQ ID NO: 9103

SEQ ID NO: 50502 - DNA, 201 bp, Bos taurus
tctttgcttatgtaactcaaactgatcttttctaaaattccttagagagattcttccttacccctactttagttttttgatactgagagagtcaattctttgggaggttgataagaggtctggggtccccaaggaggagaaaggggtctggggctctccaaacagagttagggatctggaattctcaaggaggaggaaagg

SEQ ID NO: 50503 - DNA, 201 bp, Bos taurus; identical to SEQ ID NO: 9104

SEQ ID NO: 50504 - DNA, 201 bp, Bos taurus
gtttactgtgtaaggagtattgacatcacttctttttttctaaatgataacgaggatagaacagagtctatatcttatccttttctgatagtgggcttagttgggcagctgagaaaggaaataaaagagagaggctgaaaagcccaaatagaactttatctacttcacaatgttgaaaaagcccaaccctgtaccataaat

SEQ ID NO: 50505 - DNA, 201 bp, Bos taurus
ttatctgtcctttgttgtcaagctgtcttgtatcatctactttcagagtgcttaggcccatctacttttcaattcaattccatccaaaagacttttaaatgaaatcaaactactttagtacccaattatgagtaagaaaatgatcctgcttttatagcttggtgcccaggggacacaagtcataaggtgcttctgattcac

SEQ ID NO: 50506 - DNA, 201 bp, Bos taurus; identical to SEQ ID NO: 9105

SEQ ID NO: 50507 - DNA, 201 bp, Bos taurus
ccattgtctccccacaaacaacctagaatgtctcccagtcttccaaccataaaacagatggttatgccaacttgagatgtagaccatgaagaaaatgacacgtgctttcagctaaagctatgagaaatttgtgctttatatgctcaggatagcaaccttcaggcacacaaacggatattattatagtatatcagtttgtat

SEQ ID NO: 50508 - DNA, 201 bp, Bos taurus; identical to SEQ ID NO: 9106

SEQ ID NO: 50509 - DNA, 201 bp, Bos taurus; identical to SEQ ID NO: 9107

SEQ ID NO: 50510 - DNA, 201 bp, Bos taurus
gacaaaggaaattgtctatttaaagaagctctgaaatgaattatttttaatgcaaatagatattatgttgggattttgaaataaattttgagtaataatatggttcaaaaatccaaaggtattattttaagtcaactacacatcaacttttaaaaaatgaaaaaaattattgaaaaatccaaagatattaaatggtctaca

SEQ ID NO: 50511 - DNA, 201 bp, Bos taurus; identical to SEQ ID NO: 9108

SEQ ID NO: 50512 - DNA, 201 bp, Bos taurus; identical to SEQ ID NO: 9109

SEQ ID NO: 50513 - DNA, 201 bp, Bos taurus
agagccagcagtcatctgcccttgactgaagtcagggcccacgagcccagcaaagaagccctggtgagagggttcaccatgagaagaagaaagccaaggtggagctcagatggcacctggcgaagagggctggcaaggaagagaagccacggggacatagagaaacatggttagagaggctggagaagaaccaggacagcc

SEQ ID NO: 50514 - DNA, 201 bp, Bos taurus; identical to SEQ ID NO: 9110

SEQ ID NO: 50515 - DNA, 201 bp, Bos taurus
ctgttatagtctatacatttttttctgttaccttatgtcacttgtgaagtgaagcagccataaatcatttaaaatatattatccttctgtgtcagtcagcgaagtcctctaggaggcggatgccaagataacattacaagggcaagaaatctgtgtgtgtgtgtggaggggggggtgcctatgacagagcaaggggtgggg

SEQ ID NO: 50516 - DNA, 201 bp, Bos taurus; identical to SEQ ID NO: 9111

SEQ ID NO: 50517 - DNA, 201 bp, Bos taurus; identical to SEQ ID NO: 9112

SEQ ID NO: 50518 - DNA, 201 bp, Bos taurus
aacagacaaaaggccactcacataagaagaatcagattttagcttctggtctagtttagaagtaggacatcatactggaaagatgatgccttcaacttactgtaacattaatgttaagtaaggaattaatactgtaaaattttaagaattaagtgatcagaaaccaaggtattaatggtcagtatgaattgtctctgctgt

SEQ ID NO: 50519 - DNA, 201 bp, Bos taurus; identical to SEQ ID NO: 9113

SEQ ID NO: 50520 - DNA, 201 bp, Bos taurus; identical to SEQ ID NO: 9114

SEQ ID NO: 50521 - DNA, 201 bp, Bos taurus; identical to SEQ ID NO: 9115

SEQ ID NO: 50522 - DNA, 201 bp, Bos taurus; identical to SEQ ID NO: 9116

SEQ ID NO: 50523 - DNA, 201 bp, Bos taurus
tgatagtttcaaatgcatccaaagaaaaccatggaaaacttgactggctttgtaattcagaatttaagaagaccaatgtttttctaaaatctaaatacaacatgtctttgggcagaagctgtagaattgggtacaaactagtactttctggtgtttggccactaagaggaaacgaaagagaggccaaaagttgaaaatata

SEQ ID NO: 50524 - DNA, 201 bp, Bos taurus; identical to SEQ ID NO: 9117

SEQ ID NO: 50525 - DNA, 201 bp, Bos taurus; identical to SEQ ID NO: 9118

SEQ ID NO: 50526 - DNA, 201 bp, Bos taurus; identical to SEQ ID NO: 9119

SEQ ID NO: 50527 - DNA, 201 bp, Bos taurus; identical to SEQ ID NO: 9121

SEQ ID NO: 50528 - DNA, 201 bp, Bos taurus; identical to SEQ ID NO: 9122

SEQ ID NO: 50529 - DNA, 201 bp, Bos taurus; identical to SEQ ID NO: 9123

SEQ ID NO: 50530 - DNA, 201 bp, Bos taurus; identical to SEQ ID NO: 9124

SEQ ID NO: 50531 - DNA, 201 bp, Bos taurus; identical to SEQ ID NO: 9125

SEQ ID NO: 50532 - DNA, 201 bp, Bos taurus
acacatttatgagctggctccccttaagattctctgtagtctggaaagatgattggcctacacgtaactgactgccactgtggccttgttagccactccaactgaatgaactgtctgcagggaagctgctgctgctgctgctaagtcgcttcagtcgtgtccgactctgtgcggccccacagacggcagcccaccaggctc

SEQ ID NO: 50533 - DNA, 201 bp, Bos taurus
ctggaggaggaaggatcccaggctcagaggtcagcaggtagaggacaatctcagtcagatttatcgttttgcctggggccagatttgtctaaaagcttcacgcttttgcacagatctcccccaggattatcagctcacggaggggtcacgtgcgtatggccccactctcacccctctgggtaaacatcagaaaatctggca

SEQ ID NO: 50534 - DNA, 201 bp, Bos taurus
cagagctatcaggcatttgatcattttactgttgtttgtattaccaaatgaaaggaaaacagtttggggctgagtattttcagtgttaccagtgactcagtaccaggtacaagactcattttacttaagattgtaggttgaactcaaactggagtccttgaaaagaaagaccagttctttatccagtgcattaaagaaagt

SEQ ID NO: 50535 - DNA, 201 bp, Bos taurus; identical to SEQ ID NO: 9130

SEQ ID NO: 50536 - DNA, 201 bp, Bos taurus
tgtatgtgcttaagttttcatttctctggaataaatacccaggagtgcaattgctgggtcatatggtagttgtgttgcaagtgttgttttgtaaaaaaccgccagaccatttttcagagcagccatatcattttatgttcccgctagcaatacgtgaatagtccagtttctccatctcttcttcagcatgtagtgttgtca

SEQ ID NO: 50537 - DNA, 201 bp, Bos taurus; identical to SEQ ID NO: 9133

SEQ ID NO: 50538 - DNA, 201 bp, Bos taurus; identical to SEQ ID NO: 9134

SEQ ID NO: 50539 - DNA, 201 bp, Bos taurus; identical to SEQ ID NO: 9135

SEQ ID NO: 50540 - DNA, 201 bp, Bos taurus; identical to SEQ ID NO: 9136

SEQ ID NO: 50541 - DNA, 201 bp, Bos taurus; identical to SEQ ID NO: 9137

SEQ ID NO: 50542 - DNA, 201 bp, Bos taurus; identical to SEQ ID NO: 9138

SEQ ID NO: 50543 - DNA, 201 bp, Bos taurus; identical to SEQ ID NO: 9139

SEQ ID NO: 50544 - DNA, 201 bp, Bos taurus; identical to SEQ ID NO: 9140

SEQ ID NO: 50545 - DNA, 201 bp, Bos taurus; identical to SEQ ID NO: 9141

SEQ ID NO: 50546 - DNA, 201 bp, Bos taurus
tttattatctgccaggaataaggtaagtgagcacaaagtgttcataaacagaagtgaacacaaagacttttttctattctcatttttaaatatgacaaaatcagcaaaagtctagatacggaaaaacaggcactatgatccacaactttggatataaactagtgccacaattttgagaagtagttttgtgatacacaataa

SEQ ID NO: 50547 - DNA, 201 bp, Bos taurus; identical to SEQ ID NO: 9147

SEQ ID NO: 50548 - DNA, 201 bp, Bos taurus
gacattaacaatgcttagagaacagatgttcctagtactgttcttaatgaaagggtggccttcaaaaggtactagtggcctcaaggttgcacgagcctaacgtgcacatcttaaggaagatatccatctccttcatgctcactgtgtttgttctacgtgagttcacaacaaaagcaaacagatgttttcttaagcaattct

SEQ ID NO: 50549 - DNA, 201 bp, Bos taurus
ccaaactttgtgagaaatatgtgtatttggtaagaatatttggtaaggtatttggtaagaatcacattctgtttttggtggtatatctggaatatgaaacacaacttagatgtatagatgaaaaaaggcttttcacaattcccttcatgtctaaattttggaatgcattgttttacagaactaataactcaaatctagctc

SEQ ID NO: 50550 - DNA, 201 bp, Bos taurus; identical to SEQ ID NO: 9149

SEQ ID NO: 50551 - DNA, 201 bp, Bos taurus; identical to SEQ ID NO: 9150

SEQ ID NO: 50552 - DNA, 201 bp, Bos taurus; identical to SEQ ID NO: 9152

SEQ ID NO: 50553 - DNA, 201 bp, Bos taurus; identical to SEQ ID NO: 9154

SEQ ID NO: 50554 - DNA, 201 bp, Bos taurus; identical to SEQ ID NO: 9155

SEQ ID NO: 50555 - DNA, 201 bp, Bos taurus; identical to SEQ ID NO: 9156

SEQ ID NO: 50556 - DNA, 201 bp, Bos taurus
cagactggaagacagtatcgctaaaagtattaatactgcccaaaaaaatctacagactcaatgctgcaagcatcatgctacctggcctcaaaatgtaatataaagctatagtaatcaaaacggtgcagtaccagcataagaatagatacatgagacgatggaactggcccattctctaatgacacacagaaacacaccaaa

SEQ ID NO: 50557 - DNA, 201 bp, Bos taurus; identical to SEQ ID NO: 9157

SEQ ID NO: 50558 - DNA, 201 bp, Bos taurus; identical to SEQ ID NO: 9159

SEQ ID NO: 50559 - DNA, 201 bp, Bos taurus; identical to SEQ ID NO: 9161

SEQ ID NO: 50560 - DNA, 201 bp, Bos taurus; identical to SEQ ID NO: 9162

SEQ ID NO: 50561 - DNA, 201 bp, Bos taurus; identical to SEQ ID NO: 9163

SEQ ID NO: 50562 - DNA, 201 bp, Bos taurus; identical to SEQ ID NO: 9164

SEQ ID NO: 50563 - DNA, 201 bp, Bos taurus; identical to SEQ ID NO: 9165

SEQ ID NO: 50564 - DNA, 201 bp, Bos taurus
ggatgaaatgttcccttggtatctctaattttcttgaagagatttctagtctttcccattctattgttttcctctatttattttcactgagtgcaaattcaagattcagaaaactaacatcatggtatccagtcccatcacttcatgacaaatacatggggaaacaatggaaacagtgacagacgttatttggcgggaggg

SEQ ID NO: 50565 - DNA, 201 bp, Bos taurus; identical to SEQ ID NO: 9166

SEQ ID NO: 50566 - DNA, 201 bp, Bos taurus
gagcctggtgggctgctgtctatggggccgcacagagttggacacgactgaagtgacttagcagtagcatacctccttcctgttcactaccaaataaacagtaggcctcataagaatgttattaaaaatagaatgttcaaagtatttttaaattaaaaccatacttatttatattttataagatactaatgctactattca

SEQ ID NO: 50567 - DNA, 201 bp, Bos taurus
ctacctgacataggtgcagtggagtccaccaaacatttctaaagaggtaaaacttcaaaagagaactgacaaacattttatgaaacttctttttgcaggtggatgttaaaggccgaacagggagtggaggtaatcctcccaggctgcatcagaaagcttgaacagatgaagtgaaaacacatcaatttgagattaaaaaga

SEQ ID NO: 50568 - DNA, 201 bp, Bos taurus
ttggtgccatggcctgacatgtacttggtgcttcatattgagatgttacaaacatgttcagtgtcacacagctgttagtggccaccaggattttaatagccgacctttgcctagggttactggatcattggttcaggacactaatctgtatctcattctatgttgaaagagtttgaggatatgtcacatctcaatttaggc

SEQ ID NO: 50569 - DNA, 201 bp, Bos taurus
gtggattgtttagagactgtttctgccctttttgttgttttttttccatctaaatattatttcttttaagaacttagaatcagatttataagatctcgctgcctttgctaatagggcaatccatcttaagatctctaaaaaaaatgtatcctttatgttaacagacaaaatttttcccaaatgtatccatgttctgatctg

SEQ ID NO: 50570 - DNA, 201 bp, Bos taurus; identical to SEQ ID NO: 9168

SEQ ID NO: 50571 - DNA, 201 bp, Bos taurus; identical to SEQ ID NO: 9169

SEQ ID NO: 50572 - DNA, 201 bp, Bos taurus
gaatattttatcagactgataatgtatatggaacaaagagaatgaaaatacccaagattgctcactggaaaaaggaaaaataaaaataatagtgaaagatgttttaattctgtttaggtctagttctacctcagaacatctctccaccttttttgtgccacatttaagtgggaaagtgaagatgtatgtcagatttatttt

SEQ ID NO: 50573 - DNA, 201 bp, Bos taurus
tggaaatagactaaatagcaaacaaatttgccccctgggtgggggggtggggaagaacagaagaaggtggggaactaagtcttgtctataaaaaaaaatactcatggtttgaatacaagactgtcatgggttgaatacaagactgacaagtagataaaagatatagaagcataaacccaataaaataaaccaggaatattt

SEQ ID NO: 50574 - DNA, 201 bp, Bos taurus
aaatgtaaaagcctggaaagaaatgagtattcgctcatgaattacaaagtgccataagttatccttaaaacaggctaatttgtaagtatattcttggttagaatgaagttggttgcctctcctaaaatatactagggttgtttaaaaaacgttcttcagttataattctgtattttatctcagtaatatgttcagctcgtg

SEQ ID NO: 50575 - DNA, 201 bp, Bos taurus
tatctcctaccatcatgtccatattacagaattacatagcaactttagttttctaaaaaataccttcatttccactaccttatgtgattgtagaacactctatgtacagtgaccgctgaaatgaaaaaaaaaaaaaaaaaaaatgatgataggcatatttaaacaattttccaaaaactacatctgtagtaattgggagag

SEQ ID NO: 50576 - DNA, 201 bp, Bos taurus; identical to SEQ ID NO: 9170

SEQ ID NO: 50577 - DNA, 201 bp, Bos taurus
tcaattattttgtccttgtaaggatgttctcccttatcctatctactgtaattttctaggaatctcacttgttctgaaaagttttgttgtatacttagttgattccctgatactaggtttctgtgttcaatagattcagcctattttgcatttgtattaatctctcttgatgtttgactacaaatttgatttgttcttgat

SEQ ID NO: 50578 - DNA, 201 bp, Bos taurus
catgtcattccatggcaaacaaatattgccttgcttaatatgtgagcaaacagtacaaagtacacatgctttctaaatccaagatctagactccattattaactgaacaggggcctctgaggcctaccagctatctagaaggccccatgtcaggtatttctaatctatgtttctgaatcattggatgccactttaggggtt

SEQ ID NO: 50579 - DNA, 201 bp, Bos taurus; identical to SEQ ID NO: 9171

SEQ ID NO: 50580 - DNA, 201 bp, Bos taurus; identical to SEQ ID NO: 9172

SEQ ID NO: 50581 - DNA, 201 bp, Bos taurus; identical to SEQ ID NO: 9173

SEQ ID NO: 50582 - DNA, 201 bp, Bos taurus; identical to SEQ ID NO: 9174

SEQ ID NO: 50583 - DNA, 201 bp, Bos taurus; identical to SEQ ID NO: 9175

SEQ ID NO: 50584 - DNA, 201 bp, Bos taurus; identical to SEQ ID NO: 9177

SEQ ID NO: 50585 - DNA, 201 bp, Bos taurus
cattcttttatttctttttacaatttattgattataattatctagtctaactagactagtctaaatatctagtctaagtagaccatctcatctctaaagtgaatagattttcggtttgctgtaaagtagacaatcctaggggctgctttggtaactcaattggtagagaatctgtctgcaatgctgaagaccctcatttga

SEQ ID NO: 50586 - DNA, 201 bp, Bos taurus; identical to SEQ ID NO: 9179

SEQ ID NO: 50587 - DNA, 201 bp, Bos taurus
atattcatcctaaagatagttgtaagaattgctttttgcctttagcatatcaaaatatttcacattcgcacctgataggttcccatacaatttcattacaatatttcattatttatgatgttgtacatctaagatacaaaactgtggtttctcctctgttttgtcctccaaatcttttggaacaatgtgcatgcaggaatt

SEQ ID NO: 50588 - DNA, 201 bp, Bos taurus; identical to SEQ ID NO: 9180

SEQ ID NO: 50589 - DNA, 201 bp, Bos taurus
agtgaaaattatcttctgtaattggccccaaattcacaccgcctacctatgttgcctttttgtttcccctcacacagtctacttcatatattgtgtcagggttctttgtcagggaaaaacaaatattttaaaatacataaagaatcatttgaatatatcagcaaaatggccaaattttacatatctacatttattaggatt

SEQ ID NO: 50590 - DNA, 201 bp, Bos taurus; identical to SEQ ID NO: 9185

SEQ ID NO: 50591 - DNA, 201 bp, Bos taurus
tctaatatggcctgagaatttcttaggtttttcacagcatgcttaaggttagaatcagttagtcctgagcctacatgtatgtgtgcatgcatgcaaagtccccatgtttggccgaagcagacatctcacataaaatttcttataatcatgatcacctctatattaatcgagtgcagcagttaccttcctactcttcacttt

SEQ ID NO: 50592 - DNA, 201 bp, Bos taurus; identical to SEQ ID NO: 9190

SEQ ID NO: 50593 - DNA, 201 bp, Bos taurus; identical to SEQ ID NO: 9191

SEQ ID NO: 50594 - DNA, 201 bp, Bos taurus; identical to SEQ ID NO: 9192

SEQ ID NO: 50595 - DNA, 201 bp, Bos taurus; identical to SEQ ID NO: 9193

SEQ ID NO: 50596 - DNA, 201 bp, Bos taurus; identical to SEQ ID NO: 9194

SEQ ID NO: 50597 - DNA, 201 bp, Bos taurus
ccaattactctttagacattttagaagttagccttgagtggctgcagtgtaagttcatcctgacaagaaacttgatctatctgctaactccttccttgtacggcttctattgcttcactttcagccatgagaattgttaaataaactgtcgttactgacccttttaaagagctcatccattgcctggctgcgcattgatga

SEQ ID NO: 50598 - DNA, 201 bp, Bos taurus
aaggggattatctgtttcaggaaagccttgtagggtcttgcttggttatagaggcacctacccagtctgtaggcctgagctctggcctggatgcttgctgcaggcagacaaaggggtaagtgccttcctaggagatgacatgggagaagacccaaataggccaatgtaggagaaaaaaagcgaaaaacaaaacaaaaaacc

SEQ ID NO: 50599 - DNA, 201 bp, Bos taurus; identical to SEQ ID NO: 9195

SEQ ID NO: 50600 - DNA, 201 bp, Bos taurus; identical to SEQ ID NO: 9196

SEQ ID NO: 50601 - DNA, 201 bp, Bos taurus; identical to SEQ ID NO: 9197

SEQ ID NO: 50602 - DNA, 201 bp, Bos taurus
atcaagagagtggatggagtaatttcagtctgaagttctgacaggctcaagatccaggaagttttagttctagtccaaaggcaagaaaaaagccaatgtctcagtttataggccatgagacaggaaatattctctattgcttggtggagggatggcctttttattctgttcaagcttttaactgattgaatgaggcccagt

SEQ ID NO: 50603 - DNA, 201 bp, Bos taurus; identical to SEQ ID NO: 9201

SEQ ID NO: 50604 - DNA, 201 bp, Bos taurus; identical to SEQ ID NO: 9202

SEQ ID NO: 50605 - DNA, 201 bp, Bos taurus; identical to SEQ ID NO: 9203

SEQ ID NO: 50606 - DNA, 201 bp, Bos taurus; identical to SEQ ID NO: 9204

SEQ ID NO: 50607 - DNA, 201 bp, Bos taurus; identical to SEQ ID NO: 9205

SEQ ID NO: 50608 - DNA, 201 bp, Bos taurus; identical to SEQ ID NO: 9206

SEQ ID NO: 50609 - DNA, 201 bp, Bos taurus; identical to SEQ ID NO: 9208

SEQ ID NO: 50610 - DNA, 201 bp, Bos taurus; identical to SEQ ID NO: 9209

SEQ ID NO: 50611 - DNA, 201 bp, Bos taurus; identical to SEQ ID NO: 9210

SEQ ID NO: 50612 - DNA, 201 bp, Bos taurus; identical to SEQ ID NO: 9214

SEQ ID NO: 50613 - DNA, 201 bp, Bos taurus; identical to SEQ ID NO: 9215

SEQ ID NO: 50614 - DNA, 201 bp, Bos taurus; identical to SEQ ID NO: 9216

SEQ ID NO: 50615 - DNA, 201 bp, Bos taurus; identical to SEQ ID NO: 9217

SEQ ID NO: 50616 - DNA, 201 bp, Bos taurus; identical to SEQ ID NO: 9218

SEQ ID NO: 50617 - DNA, 201 bp, Bos taurus; identical to SEQ ID NO: 9219

SEQ ID NO: 50618 - DNA, 201 bp, Bos taurus; identical to SEQ ID NO: 9222

SEQ ID NO: 50619 - DNA, 201 bp, Bos taurus; identical to SEQ ID NO: 9223

SEQ ID NO: 50620 - DNA, 201 bp, Bos taurus; identical to SEQ ID NO: 9224

SEQ ID NO: 50621 - DNA, 201 bp, Bos taurus; identical to SEQ ID NO: 9225

SEQ ID NO: 50622 - DNA, 201 bp, Bos taurus; identical to SEQ ID NO: 9226

SEQ ID NO: 50623 - DNA, 201 bp, Bos taurus
actaccgaattactcagacttggtgaaatatataaatatgagactacttgttgcacacgttttaagaatttcaagatggccactgcagaatgtcaaaccaatatggcacccttctaagcttgggtgttgagggattgtgtataggtcacacacccaagacgctggccctgccaccaaacctcagttcatcacttgtgttat

SEQ ID NO: 50624 - DNA, 201 bp, Bos taurus
gaaccaggtggttgttgctaccttctggcctcctctgcttctgaaatgctgagtgaggctacaaaaaaaagatgatgccaagtgcgatcagggagaaatgcaaagcacatgtatctggccaagcaagtattactttgcagtctattagctatggttaaatatttaacacttttgaaagctctgggttgatgacattctcaa

SEQ ID NO: 50625 - DNA, 201 bp, Bos taurus
cttttctttcaattcttaataatttttatcttgaaatgtgtaaaaaataacagacaagtacagtgagaaacataaagaacccttgtggagtcttccctggtgatccaggggttaagactcctcacttccactgcaggggtcacaggttcaatcctcggtcggggaactaagatactgcctcaaagaaaagacaagaaaaga

SEQ ID NO: 50626 - DNA, 201 bp, Bos taurus; identical to SEQ ID NO: 9228

SEQ ID NO: 50627 - DNA, 201 bp, Bos taurus; identical to SEQ ID NO: 9230

SEQ ID NO: 50628 - DNA, 201 bp, Bos taurus; identical to SEQ ID NO: 9231

SEQ ID NO: 50629 - DNA, 201 bp, Bos taurus; identical to SEQ ID NO: 9232

SEQ ID NO: 50630 - DNA, 201 bp, Bos taurus; identical to SEQ ID NO: 9233

SEQ ID NO: 50631 - DNA, 201 bp, Bos taurus; identical to SEQ ID NO: 9234

SEQ ID NO: 50632 - DNA, 201 bp, Bos taurus; identical to SEQ ID NO: 9235

SEQ ID NO: 50633 - DNA, 201 bp, Bos taurus; identical to SEQ ID NO: 9236

SEQ ID NO: 50634 - DNA, 201 bp, Bos taurus; identical to SEQ ID NO: 9237

SEQ ID NO: 50635 - DNA, 201 bp, Bos taurus; identical to SEQ ID NO: 9238

SEQ ID NO: 50636 - DNA, 201 bp, Bos taurus; identical to SEQ ID NO: 9239

SEQ ID NO: 50637 - DNA, 201 bp, Bos taurus; identical to SEQ ID NO: 9240

SEQ ID NO: 50638 - DNA, 201 bp, Bos taurus; identical to SEQ ID NO: 9242

SEQ ID NO: 50639 - DNA, 201 bp, Bos taurus; identical to SEQ ID NO: 9248

SEQ ID NO: 50640 - DNA, 201 bp, Bos taurus; identical to SEQ ID NO: 9249

SEQ ID NO: 50641 - DNA, 201 bp, Bos taurus; identical to SEQ ID NO: 9250

SEQ ID NO: 50642 - DNA, 201 bp, Bos taurus; identical to SEQ ID NO: 9252

SEQ ID NO: 50643 - DNA, 201 bp, Bos taurus
tacggttgacccttaacaacagggctttgaactttgagtccattcaaacagggatttttttccccccagtaataaatactatagtactagtcttcccaggaggcgctagcggaaaagaacctgcctgccaatgcaggagacgtaagagaggaggatttgatcccccggttgagaagatctcctggagaagggtatggcaac

SEQ ID NO: 50644 - DNA, 201 bp, Bos taurus; identical to SEQ ID NO: 9253

SEQ ID NO: 50645 - DNA, 201 bp, Bos taurus; identical to SEQ ID NO: 9255

SEQ ID NO: 50646 - DNA, 201 bp, Bos taurus; identical to SEQ ID NO: 9256

SEQ ID NO: 50647 - DNA, 201 bp, Bos taurus; identical to SEQ ID NO: 9260

SEQ ID NO: 50648 - DNA, 201 bp, Bos taurus
gggcctttcagtgaattagagagggcaaatggtgcatgagggtgtcaggctatggtttgtgggtagaaggcatgctcaggtcatgaattacttcagagtttacctgccattgtcctggcccaatcactcattcctcaaagtgcaacagttcagtccaacaaaaccttgcctgagcagctactgaggaccaggaactgtgct

SEQ ID NO: 50649 - DNA, 201 bp, Bos taurus
tctctccccttctcccaccttccccgctaccacccttctctcacccaaattccctgctattacccttttctcacccagattgctgcaatggcctgttgcctgctctttcttctaggactgccttcacaggggagtgaccagtgccaccacgtggagatccacgcatatggaggccccattctcagggctcactgctctgtg

SEQ ID NO: 50650 - DNA, 201 bp, Bos taurus
tatgggtacagacagctgattcacacaaactaacacagcactgtaaaagcaactatatccaataaagactaattttaaaaaatgcagataacatgaccattgggtttatctaccaggattaagtaacagaattcacgtgatgtgcttagcacagtgcttaggacacagtaagtcttgaataaatggaaggttttttaaaaa

SEQ ID NO: 50651 - DNA, 201 bp, Bos taurus
acagagaaagacaaatactttatgttgtcacttatatgtggaatctaaaaaaatgcaacaaactggtgaatataacaaagcagaaacagatttactgatacagagaacaaaccagtggttaccagtgagaagagggaaaagggttagggttagataggggtaagaggttaagaggtaagaggttaagagggtaagaggtta

SEQ ID NO: 50652 - DNA, 201 bp, Bos taurus
aggcagcagatggtttgcagatttggagcgaggattccagaggggaccagggtgatgttggggagagagtggccaggggcccagtggcagatggacaaagcggagcggagagccactgggctctgcttacgcctccttgggccttttcagatggttacacaatgacagttgatagcaaattaaggatgaaatgttttaagc

SEQ ID NO: 50653 - DNA, 201 bp, Bos taurus; identical to SEQ ID NO: 9262

SEQ ID NO: 50654 - DNA, 201 bp, Bos taurus
gtgtcgttatcgggctagtgtgtcggtttctgggcctggttttcctgttgttggaatgtgcaatgctcgaagctcagaacattgaaatgaatctaaaggcgagtccagctgttggccggcaatgagccttttcctcctgcatctcactgggccttcatcctgcttagggagttggcagcattaaatcccgcccccccaccc

SEQ ID NO: 50655 - DNA, 201 bp, Bos taurus
gccaagcccaccctcctcctccagctgtggccgggtgtcaggaacctagttctcgagggatgggtgtagctccccttcggtgccaaggtcagaacctcgctctggcagaggaccaggcggccagttcccagggctcgcgttacaccgcagcgcccacagttggcagccgaacccattatcactcttgctctgagggtggcc

SEQ ID NO: 50656 - DNA, 201 bp, Bos taurus; identical to SEQ ID NO: 9263

SEQ ID NO: 50657 - DNA, 201 bp, Bos taurus; identical to SEQ ID NO: 9264

SEQ ID NO: 50658 - DNA, 201 bp, Bos taurus; identical to SEQ ID NO: 9266

SEQ ID NO: 50659 - DNA, 201 bp, Bos taurus; identical to SEQ ID NO: 9267

SEQ ID NO: 50660 - DNA, 201 bp, Bos taurus
ttggccattttgctttaaaaagaagaaagaaacttgttttataattacctagtctatgaagagatgccacatttcttcccacatcagaggagcaagactttaacaaatccaaagctggcccacttggctgaagaatggaaacaactgacgacattgctcccaaaagctttacagacaagatggcatagcttgctgggagtt

SEQ ID NO: 50661 - DNA, 201 bp, Bos taurus
tgccacgaggtatacaggtacctatacccaggaaaacacagaagctgctgtttaagacacaggcacaagtctcctcgtccccagccaagtgactgaggccggcagggtcccccgggggcagcaggggagcccagatggcaccctatgtccgcacgttcatcctctcaccagggcctgaggaggttgccccagtctctgcca

SEQ ID NO: 50662 - DNA, 201 bp, Bos taurus; identical to SEQ ID NO: 9268

SEQ ID NO: 50663 - DNA, 201 bp, Bos taurus
ttcccttctccaggggatctttgtcacccagggattgaacccctatctcctgaattggcaggcaagttctttgctgctgagccaccagggctcccagttagacatttaatttattagttactgtgtgacaactatgaaactgtattgttttcttttttattattacgtcattcattcttcacattcaaaattacttgccca

SEQ ID NO: 50664 - DNA, 201 bp, Bos taurus
tttgcatggcatgttttttttttctctcttttgctagctacttatttcactgtgagctctgcaaacatggtgggccgcagaggtgccaggcaccatcatggtgtccaaaaattggctttgtgcatatgctgaattagagattggctggcagaagcagttcacagatcctggattggcagggattcctcatgaaaggaggca

SEQ ID NO: 50665 - DNA, 201 bp, Bos taurus; identical to SEQ ID NO: 9270

SEQ ID NO: 50666 - DNA, 201 bp, Bos taurus; identical to SEQ ID NO: 9271

SEQ ID NO: 50667 - DNA, 201 bp, Bos taurus; identical to SEQ ID NO: 9272

SEQ ID NO: 50668 - DNA, 201 bp, Bos taurus
gacggcagctgttgaacgcagcctctatttcccaggagctgtgaatgcaacttctcttcagcgccagggccagtgtatgccaaccgaagggccaaaacccgccagtcagcaactggtgtacatgtctggcaaggagcagcattgaccttgaggtgtgctagtcaccttcaaccttaaaatccccaaagggccaagtgagcc

SEQ ID NO: 50669 - DNA, 201 bp, Bos taurus; identical to SEQ ID NO: 9277

SEQ ID NO: 50670 - DNA, 201 bp, Bos taurus; identical to SEQ ID NO: 9278

SEQ ID NO: 50671 - DNA, 201 bp, Bos taurus; identical to SEQ ID NO: 9280

SEQ ID NO: 50672 - DNA, 201 bp, Bos taurus; identical to SEQ ID NO: 9281

SEQ ID NO: 50673 - DNA, 201 bp, Bos taurus; identical to SEQ ID NO: 9283

SEQ ID NO: 50674 - DNA, 201 bp, Bos taurus
agaaagtttgctctaagcttgtaaaaccgaacagatagttcttcctagctctagagacgttttgtctaaataaataagacaagaacctacccttctggacagagttgggagcaaatgaaatcaattcttcagctgatatgttttagtgtccccttaacactggtagttttataaatgcttgtgattcaaagtccaatgaag

SEQ ID NO: 50675 - DNA, 201 bp, Bos taurus; identical to SEQ ID NO: 9284

SEQ ID NO: 50676 - DNA, 201 bp, Bos taurus
gagccacactactgagcctacgtgccgtcactactgaggcctgagcacctagagcccgtaggcgacaagagaagccactacagtgagaagcccgtgtgccacaactagaggaggcccggcacagccaaaaagaaagaaataaattaaattttaaaaaagaaagaacacttgagggacttccccggtggtccagtggctaag

SEQ ID NO: 50677 - DNA, 201 bp, Bos taurus
atgttggaattttggcttttaggtggtgagcaggaagatttctgtctatatttttgttctcctccttcctgttccctttcactctgttctaatggtgccttcatcctgcacttctcaggatcacagttcataccaggattgatggcattgctggtattcacaagctccagtagtactcaggacactgcatccagttcccaa

SEQ ID NO: 50678 - DNA, 201 bp, Bos taurus
agaggtgcagaagggatagaaacaaaagtccttgtcacgaccatacttggttcatctttatctttgtgtacttttccccctggctctttaataacattcagcacaaatttctttgtactaaggacatctggaattggtgaaatcgctgattttttgtgatgggtccgtagcctcatatctacatttttcacatcaagcttt

SEQ ID NO: 50679 - DNA, 201 bp, Bos taurus; identical to SEQ ID NO: 9286

SEQ ID NO: 50680 - DNA, 201 bp, Bos taurus; identical to SEQ ID NO: 9287

SEQ ID NO: 50681 - DNA, 201 bp, Bos taurus; identical to SEQ ID NO: 9288

SEQ ID NO: 50682 - DNA, 201 bp, Bos taurus; identical to SEQ ID NO: 9289

SEQ ID NO: 50683 - DNA, 201 bp, Bos taurus; identical to SEQ ID NO: 9290

SEQ ID NO: 50684 - DNA, 201 bp, Bos taurus; identical to SEQ ID NO: 9291

SEQ ID NO: 50685 - DNA, 201 bp, Bos taurus; identical to SEQ ID NO: 9292

SEQ ID NO: 50686 - DNA, 201 bp, Bos taurus; identical to SEQ ID NO: 9293

SEQ ID NO: 50687 - DNA, 201 bp, Bos taurus; identical to SEQ ID NO: 9294

SEQ ID NO: 50688 - DNA, 201 bp, Bos taurus; identical to SEQ ID NO: 9295

SEQ ID NO: 50689 - DNA, 201 bp, Bos taurus; identical to SEQ ID NO: 9296

SEQ ID NO: 50690 - DNA, 201 bp, Bos taurus; identical to SEQ ID NO: 9297

SEQ ID NO: 50691 - DNA, 201 bp, Bos taurus; identical to SEQ ID NO: 9298

SEQ ID NO: 50692 - DNA, 201 bp, Bos taurus; identical to SEQ ID NO: 9301

SEQ ID NO: 50693 - DNA, 201 bp, Bos taurus; identical to SEQ ID NO: 9302

SEQ ID NO: 50694 - DNA, 201 bp, Bos taurus; identical to SEQ ID NO: 9303

SEQ ID NO: 50695 - DNA, 201 bp, Bos taurus; identical to SEQ ID NO: 9304

SEQ ID NO: 50696 - DNA, 201 bp, Bos taurus; identical to SEQ ID NO: 9305

SEQ ID NO: 50697 - DNA, 201 bp, Bos taurus; identical to SEQ ID NO: 9306

SEQ ID NO: 50698 - DNA, 201 bp, Bos taurus
tactcagcctcatctgaccctaaaaggtccgatttaatccagaaaagaatgaccttgacgttatgagattctattatctctatttccccactttttggtgcaccttgtaaatgaatgccactcacttctattatattttaaaaagacttccaccaaggaaaagtgagtcagttgaggaaaaagaaaagaaaaaaacaagaa

SEQ ID NO: 50699 - DNA, 201 bp, Bos taurus; identical to SEQ ID NO: 9309

SEQ ID NO: 50700 - DNA, 201 bp, Bos taurus
aacacgtaaataaacgtgttttccttttgacaaactaaagcttgtatctatcacaccacaggttttcccaaaacccactagccccacactcacttctgtagatgtgaagtcagtttcccaccaaccggcagacctgcttcaggtcagccttatgaatggactctctatgccattcactcagccccttgcctttctggagca

SEQ ID NO: 50701 - DNA, 201 bp, Bos taurus; identical to SEQ ID NO: 9310

SEQ ID NO: 50702 - DNA, 201 bp, Bos taurus; identical to SEQ ID NO: 9311

SEQ ID NO: 50703 - DNA, 201 bp, Bos taurus; identical to SEQ ID NO: 9312

SEQ ID NO: 50704 - DNA, 201 bp, Bos taurus; identical to SEQ ID NO: 9313

SEQ ID NO: 50705 - DNA, 201 bp, Bos taurus; identical to SEQ ID NO: 9314

SEQ ID NO: 50706 - DNA, 201 bp, Bos taurus; identical to SEQ ID NO: 9315

SEQ ID NO: 50707 - DNA, 201 bp, Bos taurus; identical to SEQ ID NO: 9317

SEQ ID NO: 50708 - DNA, 201 bp, Bos taurus; identical to SEQ ID NO: 9320

SEQ ID NO: 50709 - DNA, 201 bp, Bos taurus; identical to SEQ ID NO: 9321

SEQ ID NO: 50710 - DNA, 201 bp, Bos taurus
ttttgcaattcttactagaaatggagcctttgtttacctttagggctgtgtatgtatttttttttttaatttttggtgtggctctttacacaaattgaaaacaatttgaggggaaaacagtgaagcctcctgaacacaggacttgggaacaaatcccctggtttgtttactgagccccagttgggcctatcagttctccgg

SEQ ID NO: 50711 - DNA, 201 bp, Bos taurus; identical to SEQ ID NO: 9323

SEQ ID NO: 50712 - DNA, 201 bp, Bos taurus; identical to SEQ ID NO: 9325

SEQ ID NO: 50713 - DNA, 201 bp, Bos taurus
gtgtgtgcttatctgccctctgaatattaggagataaataaagaagattctttgctggggacactgttcagagatttccccccattttaaaagctgtttgttttcttagacttcttttatattttggatataagttctttatccaatatgtgttttgttaatatttctccttgcctgtgcctttttttttaaatcctctta

SEQ ID NO: 50714 - DNA, 201 bp, Bos taurus; identical to SEQ ID NO: 9329

SEQ ID NO: 50715 - DNA, 201 bp, Bos taurus; identical to SEQ ID NO: 9331

SEQ ID NO: 50716 - DNA, 201 bp, Bos taurus; identical to SEQ ID NO: 9332

SEQ ID NO: 50717 - DNA, 201 bp, Bos taurus; identical to SEQ ID NO: 9334

SEQ ID NO: 50718 - DNA, 201 bp, Bos taurus; identical to SEQ ID NO: 9335

SEQ ID NO: 50719 - DNA, 201 bp, Bos taurus; identical to SEQ ID NO: 9336

SEQ ID NO: 50720 - DNA, 201 bp, Bos taurus; identical to SEQ ID NO: 9340

SEQ ID NO: 50721 - DNA, 201 bp, Bos taurus
tgcgtcctgtagatggttgggcaggaggctttccctctaccaccaggaatccagcgtcttcacggaccagcatctgcagagccaacgcatcacgagaaattttaggtgttcaccacatgtgcatcctccctgagctcactagagctccaccagaccaccctccagtgtctccatcttgtccagaacttgtgtctgcctcat

SEQ ID NO: 50722 - DNA, 201 bp, Bos taurus; identical to SEQ ID NO: 9342

SEQ ID NO: 50723 - DNA, 201 bp, Bos taurus; identical to SEQ ID NO: 9344

SEQ ID NO: 50724 - DNA, 201 bp, Bos taurus
gaaagttacgctgacaaagacagaccaacaggaggaaagcatacatgttgacttaatgttttacatgaaatggaaaccttcacaaggaaacgaaggtctgtggaagtgtttggatggacgtgagggttttcacactggctctgatgaggaatggacagtcctggaggaatgcggctgatcaagcagtagcaggtaagtgtc

SEQ ID NO: 50725 - DNA, 201 bp, Bos taurus; identical to SEQ ID NO: 9345

SEQ ID NO: 50726 - DNA, 201 bp, Bos taurus; identical to SEQ ID NO: 9346

SEQ ID NO: 50727 - DNA, 201 bp, Bos taurus
agacaggaggggggagtggagctgcccaccctcatgcccagagccagtgcctggagtgcccagcaccctctgtggggaagcaggggggggccctccccacggtctcagcttcccctcctgcagcttgctgtgcctggggctgaggtccactcctgatggcttccggaggccaggctgtccctccccgggtgccagcccagt

SEQ ID NO: 50728 - DNA, 201 bp, Bos taurus; identical to SEQ ID NO: 9347

SEQ ID NO: 50729 - DNA, 201 bp, Bos taurus
ccgtggagtttaagccccgatttagtgagctctgcatcattcctgcaagttccgttttgacatttcctctcaaataaagtatcagacactctagggaagacgcacgttgtctccccagaacgatccccagggaggatcttgcttggccttggcaatcattcttgctggcgtgatttgtatccagaactaggactgtctgac

SEQ ID NO: 50730 - DNA, 201 bp, Bos taurus; identical to SEQ ID NO: 9348

SEQ ID NO: 50731 - DNA, 201 bp, Bos taurus; identical to SEQ ID NO: 9350

SEQ ID NO: 50732 - DNA, 201 bp, Bos taurus; identical to SEQ ID NO: 9351

SEQ ID NO: 50733 - DNA, 201 bp, Bos taurus; identical to SEQ ID NO: 9354

SEQ ID NO: 50734 - DNA, 201 bp, Bos taurus; identical to SEQ ID NO: 9355

SEQ ID NO: 50735 - DNA, 201 bp, Bos taurus; identical to SEQ ID NO: 9356

SEQ ID NO: 50736 - DNA, 201 bp, Bos taurus; identical to SEQ ID NO: 9357

SEQ ID NO: 50737 - DNA, 201 bp, Bos taurus; identical to SEQ ID NO: 9358

SEQ ID NO: 50738 - DNA, 201 bp, Bos taurus; identical to SEQ ID NO: 9359

SEQ ID NO: 50739 - DNA, 201 bp, Bos taurus; identical to SEQ ID NO: 9361

SEQ ID NO: 50740 - DNA, 201 bp, Bos taurus; identical to SEQ ID NO: 9362

SEQ ID NO: 50741 - DNA, 201 bp, Bos taurus; identical to SEQ ID NO: 9363

SEQ ID NO: 50742 - DNA, 201 bp, Bos taurus; identical to SEQ ID NO: 9365

SEQ ID NO: 50743 - DNA, 201 bp, Bos taurus; identical to SEQ ID NO: 9366

SEQ ID NO: 50744 - DNA, 201 bp, Bos taurus; identical to SEQ ID NO: 9371

SEQ ID NO: 50745 - DNA, 201 bp, Bos taurus
ctccaggctgtttgtctttgactgatgactcatttggcataaactagccttattgaggtgaattcctcctgtaccaagtttaatacatgtcacgaaagataggatgtgttggtgattatggaaaggtaggggggatgtggaattatatcttctgatgtcaggtggaagaatggggttgggtgggtgggggaaggagttgtc

SEQ ID NO: 50746 - DNA, 201 bp, Bos taurus; identical to SEQ ID NO: 9373

SEQ ID NO: 50747 - DNA, 201 bp, Bos taurus; identical to SEQ ID NO: 9374

SEQ ID NO: 50748 - DNA, 201 bp, Bos taurus
aaggatggactgaggcccccgtttaagcggagaaactgaggctcagggaggtgaagtaaccagcccgggctgtgctctggtggctgccagcactgtgaccggagcctgtctttgggtatcagatcctgtactcttagcatcttcaagtctctcagctgctcccgctgagagactgtaccaaacacatgaaagcaggggcca

SEQ ID NO: 50749 - DNA, 201 bp, Bos taurus; identical to SEQ ID NO: 9375

SEQ ID NO: 50750 - DNA, 201 bp, Bos taurus; identical to SEQ ID NO: 9376

SEQ ID NO: 50751 - DNA, 201 bp, Bos taurus
tttgagcaagttccaggggatagtgaaggacagggaaacctgatgtgctgcagtccatggggtgacaaatgttcagatatgactgagtgactgaacaacaacgacatattagaacaaacagttgtgtccctgcagtcttctgattcaaagatgaaagcacatatgcagatgcgttttaaggtgatttccactcagaatgaa

SEQ ID NO: 50752 - DNA, 201 bp, Bos taurus
gttggttctaatgagtttatgtcacgtccttgggatatgtcattcttttaaaggttgtgccctgccctcttcctgtctcataaggacatattgtacaacacggtaaatatagccaatattctgaaataactataatggagaataactttaaaaattgtggattatggacttccctgatagtctagaggttaagaatctgct

SEQ ID NO: 50753 - DNA, 201 bp, Bos taurus
atacatatggcacagtggccctctaaaatttcacctacccattcacaggtccacagagaaaccccacagcatcgtgtagttgctccaaaactttctccatggttgggcgtgtgcattttctttgatagctgctttcatgtttggtctatggtgtgcctgcatatcttttattgcacttatgttccctaagatgaactgaga

SEQ ID NO: 50754 - DNA, 201 bp, Bos taurus; identical to SEQ ID NO: 9377

SEQ ID NO: 50755 - DNA, 201 bp, Bos taurus; identical to SEQ ID NO: 9378

SEQ ID NO: 50756 - DNA, 201 bp, Bos taurus; identical to SEQ ID NO: 9379

SEQ ID NO: 50757 - DNA, 201 bp, Bos taurus
actgttctagcactgtgctagaacagtgaattcaggtaacaacttgaactcaagtaacaactcagtgagatatgaactattatgatcacggtattacaaatgagggaactgaggcccagaacacttaagacccttggccaaggacccatagccaggaaagaaaatcaccaggattccagggcagagcctggcttcagaatc

SEQ ID NO: 50758 - DNA, 201 bp, Bos taurus; identical to SEQ ID NO: 9380

SEQ ID NO: 50759 - DNA, 201 bp, Bos taurus; identical to SEQ ID NO: 9381

SEQ ID NO: 50760 - DNA, 201 bp, Bos taurus; identical to SEQ ID NO: 9382

SEQ ID NO: 50761 - DNA, 201 bp, Bos taurus; identical to SEQ ID NO: 9383

SEQ ID NO: 50762 - DNA, 201 bp, Bos taurus
agcgtgggcactgggcacagctgtgggatttctccatctgctggccttcaccctggctcatctgaaagccgtagggctgtgcctgtgaaatggcttttgttctcacattttaggtgctctgagggccccaaatggcaaaatggagaggagtagccagggaagagggcccagtgaggctcccttagtctccagcaggtcttc

SEQ ID NO: 50763 - DNA, 201 bp, Bos taurus
gagattcaaacaagaccatggcttagaaatgctgaagcctgctataaatgagatgcaaacagctgtgcaagttcagagtcagtaggtcagaagttgaagaaaagaaggaggcttggtggggaagggcagcccaactcctggagggcataacaggtgatagaaggttcaggaaagcagcatctggggaaggggtgggaactc

SEQ ID NO: 50764 - DNA, 201 bp, Bos taurus; identical to SEQ ID NO: 9384

SEQ ID NO: 50765 - DNA, 201 bp, Bos taurus
aggcatgcaatgttttcttggttattttggtaatggcagcacctttagcagtttcattcatgcagtcaggaagcaggttagtgggaagctagaattggaaagactgatatggggaggagaaatagagaaacaaaagctaaatttctcatttttcctccaaccttaacagagccctcaagactactctggattgtgttagat

SEQ ID NO: 50766 - DNA, 201 bp, Bos taurus; identical to SEQ ID NO: 9385

SEQ ID NO: 50767 - DNA, 201 bp, Bos taurus; identical to SEQ ID NO: 9386

SEQ ID NO: 50768 - DNA, 201 bp, Bos taurus; identical to SEQ ID NO: 9387

SEQ ID NO: 50769 - DNA, 201 bp, Bos taurus; identical to SEQ ID NO: 9388

SEQ ID NO: 50770 - DNA, 201 bp, Bos taurus
tttttaacaggctgaggcccaggaatcatttcctattggatgcaaagctcttcatggaggaaccaaatctttggtctccccggaggtctcagcatctctcgtggccagtccttgtcctgggacattaggagtttttcttgtttgtggaagatctctgttttgagtgtgctctgcacacccccagcgcagcctgctggggag

SEQ ID NO: 50771 - DNA, 201 bp, Bos taurus; identical to SEQ ID NO: 9389

SEQ ID NO: 50772 - DNA, 201 bp, Bos taurus; identical to SEQ ID NO: 9390

SEQ ID NO: 50773 - DNA, 201 bp, Bos taurus; identical to SEQ ID NO: 9391

SEQ ID NO: 50774 - DNA, 201 bp, Bos taurus; identical to SEQ ID NO: 9392

SEQ ID NO: 50775 - DNA, 201 bp, Bos taurus; identical to SEQ ID NO: 9393

SEQ ID NO: 50776 - DNA, 201 bp, Bos taurus; identical to SEQ ID NO: 9394

SEQ ID NO: 50777 - DNA, 201 bp, Bos taurus; identical to SEQ ID NO: 9396

SEQ ID NO: 50778 - DNA, 201 bp, Bos taurus; identical to SEQ ID NO: 9397

SEQ ID NO: 50779 - DNA, 201 bp, Bos taurus; identical to SEQ ID NO: 9398

SEQ ID NO: 50780 - DNA, 201 bp, Bos taurus; identical to SEQ ID NO: 9399

SEQ ID NO: 50781 - DNA, 201 bp, Bos taurus; identical to SEQ ID NO: 9400

SEQ ID NO: 50782 - DNA, 201 bp, Bos taurus; identical to SEQ ID NO: 9403

SEQ ID NO: 50783 - DNA, 201 bp, Bos taurus; identical to SEQ ID NO: 9404

SEQ ID NO: 50784 - DNA, 201 bp, Bos taurus; identical to SEQ ID NO: 9405

SEQ ID NO: 50785 - DNA, 201 bp, Bos taurus; identical to SEQ ID NO: 9407

SEQ ID NO: 50786 - DNA, 201 bp, Bos taurus
actcagtttgcctgaaatatcagatttatggtttcagagcagtaaaattggttatgtcacaaggaaacactgaggatttgcagattttcttcaggcattccaggttttctaaagtttttgcaaagggaggtgacatgatcagagctctacttccaaataccagtctggtagtagtctttagtggagatcagagataagaga

SEQ ID NO: 50787 - DNA, 201 bp, Bos taurus; identical to SEQ ID NO: 9415

SEQ ID NO: 50788 - DNA, 201 bp, Bos taurus
cacaagggagattgaaaaaaaaatgtttttctttgctttcctcctggttcttctaatatctttaatcatcttggactcccaacccatccagtctcatccatactaatataatagatacttttaggacttgatggaattctcataaaactcagcatctcaagctagggagggaatatgggggctttcactggatgtttagac

SEQ ID NO: 50789 - DNA, 201 bp, Bos taurus
taattctgtcacatttgaataatatttcatgaactgatccttaggaagcactggaggaagagtttaacagacaactcaattatacctattaaattgtttgtaatcctctgaggccttatcatctgaatagacggttctagaaaattcactcaaacatgtacacatttatacattcatcccacaaaatgtggtacaaactcc

SEQ ID NO: 50790 - DNA, 201 bp, Bos taurus
gtgtgtgtgcacgcgtgtgtgctaaatccagggggcctggcaaatagaaagccttgatacaagcacactgactgaagggctgtttggtatcgtttctgataatgacagacctgagcgttcatgaaccctgctcatctgtctcctgcagaccttcttttctgtgtcagatggtgagcatgctcagtaggtttttatctgtat

SEQ ID NO: 50791 - DNA, 201 bp, Bos taurus; identical to SEQ ID NO: 9417

SEQ ID NO: 50792 - DNA, 201 bp, Bos taurus; identical to SEQ ID NO: 9418

SEQ ID NO: 50793 - DNA, 201 bp, Bos taurus; identical to SEQ ID NO: 9419

SEQ ID NO: 50794 - DNA, 201 bp, Bos taurus; identical to SEQ ID NO: 9420

SEQ ID NO: 50795 - DNA, 201 bp, Bos taurus; identical to SEQ ID NO: 9421

SEQ ID NO: 50796 - DNA, 201 bp, Bos taurus; identical to SEQ ID NO: 9422

SEQ ID NO: 50797 - DNA, 201 bp, Bos taurus; identical to SEQ ID NO: 9423

SEQ ID NO: 50798 - DNA, 201 bp, Bos taurus; identical to SEQ ID NO: 9424

SEQ ID NO: 50799 - DNA, 201 bp, Bos taurus; identical to SEQ ID NO: 9425

SEQ ID NO: 50800 - DNA, 201 bp, Bos taurus; identical to SEQ ID NO: 9427

SEQ ID NO: 50801 - DNA, 201 bp, Bos taurus; identical to SEQ ID NO: 9428

SEQ ID NO: 50802 - DNA, 201 bp, Bos taurus; identical to SEQ ID NO: 9429

SEQ ID NO: 50803 - DNA, 201 bp, Bos taurus; identical to SEQ ID NO: 9431

SEQ ID NO: 50804 - DNA, 201 bp, Bos taurus; identical to SEQ ID NO: 9432

SEQ ID NO: 50805 - DNA, 201 bp, Bos taurus; identical to SEQ ID NO: 9433

SEQ ID NO: 50806 - DNA, 201 bp, Bos taurus
ctccatttcatccttgccaatggtgtcacctgctctgctgcaaatattttatccccaaaagacaagtctcttaaatgccaaaccaaatggaaacaaaggtgagaggacatatattcacatttagagtctggacatctgaatcaatacgtatggctcagagcattaacccactttattgacatagcagccttcttctgagct

SEQ ID NO: 50807 - DNA, 201 bp, Bos taurus; identical to SEQ ID NO: 9435

SEQ ID NO: 50808 - DNA, 201 bp, Bos taurus
cgcacagagtcagacacgactgaagcggcttagcagcagcagcagcatacatgtatatatttccttgctctgtcacctgagagggcctagatgcaatgacgactcagtagtaatacgcacacctagtgccctgatcttgcttttatatatgtattttctggccacgccatgcaacttgtgagattttagttcctcaaccag

SEQ ID NO: 50809 - DNA, 201 bp, Bos taurus; identical to SEQ ID NO: 9437

SEQ ID NO: 50810 - DNA, 201 bp, Bos taurus; identical to SEQ ID NO: 9438

SEQ ID NO: 50811 - DNA, 201 bp, Bos taurus
actctgcatattttggcagcttccctaagtgtactaataactcatgccaagtacagttggaatgcttcatgagtccagactcagaaagcaactgaatcaagcagtgttcatcttaaaatgatggctgatttgtggtgagtcaagaaacactggactatatatcttaaggtctggaagatccaaaggataagctaatgtgat

SEQ ID NO: 50812 - DNA, 201 bp, Bos taurus; identical to SEQ ID NO: 9439

SEQ ID NO: 50813 - DNA, 201 bp, Bos taurus
tcaattactttcgtgtgttgtttgtcttcagtacctgtcatcaaccaaatgtttctccatttttatatgtgtaatgaatttttgtggcaattatgttgtcgtgaatcactgtgatattgaccttaccaaatatgttttgcctatatcatatcacctgaattattaaattgtaactttagggtaaaatgaaactactatgaa

SEQ ID NO: 50814 - DNA, 201 bp, Bos taurus; identical to SEQ ID NO: 9441

SEQ ID NO: 50815 - DNA, 201 bp, Bos taurus
catgagattgaatagaaaactacttttatttttcatctcaaataatataaaccaccccatttcaaatatgggaactagtattagatatctacagaattgttgttgctcagtcactaagtcgtgtctgaccctttgcaaccccatggactggagcacgccaggacactgcatttgaaaatcaagatacttcaagaagtagtt

SEQ ID NO: 50816 - DNA, 201 bp, Bos taurus
actaaatggactactatttgaaagaatactacattaatggtaaaacaattattctcaggaaagagaacatctgaataagactgggagaaaataaaagataatggggtcagggaggaatttacgtctagattttaatgctgtctttgaatgtcttaatctttatatctagtttttaatgctgtctttgaatgccttagtctc

SEQ ID NO: 50817 - DNA, 201 bp, Bos taurus; identical to SEQ ID NO: 9442

SEQ ID NO: 50818 - DNA, 201 bp, Bos taurus; identical to SEQ ID NO: 9443

SEQ ID NO: 50819 - DNA, 201 bp, Bos taurus; identical to SEQ ID NO: 9444

SEQ ID NO: 50820 - DNA, 201 bp, Bos taurus; identical to SEQ ID NO: 9445

SEQ ID NO: 50821 - DNA, 201 bp, Bos taurus
cattctcttggtgcaggcagtcctttccctcctgatttctgcagttctttggagctccaggttagagcatcagcttgaaaagtggactgtgggatataaatagatacttctcagggtccatcagagggccagcctctccccagccctccctctgcatacccacaggaaaacaaaatgaactctcagctgggttttccccct

SEQ ID NO: 50822 - DNA, 201 bp, Bos taurus
cacactgaaattttttcagagaactgactacctccagcagagtatctctaattaccttgggtcaatcagaagctccattgttccaaaagctggagagaccacccctgagaagtccctacaagtcctcaccaacttgaacgatgtctgcccttgactctcttggaatctggtccaattatgatgaacattcatggaccacgt

SEQ ID NO: 50823 - DNA, 201 bp, Bos taurus
atttcttgtacctcctgcatttggcaggcagattctttatcactgagccaccaggtaagtctcaccctgtttcatgtttgactacaaatatttataggccgccagcctggaggtcttcacatctctgtctctggcaggtaactgaaggtcggcttaactctccggggaagaagactgatggctcgtggggctgaaccgcag

SEQ ID NO: 50824 - DNA, 201 bp, Bos taurus; identical to SEQ ID NO: 9447

SEQ ID NO: 50825 - DNA, 201 bp, Bos taurus; identical to SEQ ID NO: 9449

SEQ ID NO: 50826 - DNA, 201 bp, Bos taurus; identical to SEQ ID NO: 9450

SEQ ID NO: 50827 - DNA, 201 bp, Bos taurus
cttaaaattggccactatgcacacagagaacattagcactgtgacataatgggcatgtctgtgagcttgcttgtgatgctcacttcacagtgcacacctgcgtcaaatcatcacattgtgatgattaaacatacacaatttttatcttaaacatacacaatttttatctattttatgccaataaagctggaaaaaaatctt

SEQ ID NO: 50828 - DNA, 201 bp, Bos taurus
taagatctttaaaagtaacagttaacatctttgtccttttcgtttggctctttgacctacagtgtgatcaaagtcaggttccggtgaatgtcagtagcaaagtaacatgttttcaggacccagagtgaagttataaatcgactctttgtggtggtgcagatggaaagaagtgttcactgccccaaaactctgtgagaactt

SEQ ID NO: 50829 - DNA, 201 bp, Bos taurus; identical to SEQ ID NO: 9452

SEQ ID NO: 50830 - DNA, 201 bp, Bos taurus; identical to SEQ ID NO: 9453

SEQ ID NO: 50831 - DNA, 201 bp, Bos taurus
ggaagcctgctaacgtggtggagctgggagagaccgtgtcttccgccggggtctgtgcttcagggcacagctgctgctccctgagccctcttcccgctctcggcctctgagagagcccccctttcttggtgtcctggctggcgaccctggcagctctgtaacaccagccgtgcttcttctctggcatcttcagcttttcct

SEQ ID NO: 50832 - DNA, 201 bp, Bos taurus
actatcctgtcctaacccaggagtctctgggtgaggtggtgagccttctagcagcttttgagtgctcaatccatgcccaccaattttgtggcttttcttgtgtctgaaattcccatcaacagtagcctttatttacataagacaaacaaatgtacaccttaacacaccaggaataaccaagagctgtcattgcatcctggc

SEQ ID NO: 50833 - DNA, 201 bp, Bos taurus
tttgtagttgcaagtacaagtaattaactgtgatcaaatcatcaaacctaaaatgaatatctccctgctagcatgaaacatcctcattaatcttatactaagtcaaccaaccatttgcatattgtactagaaaagtgctgctaaaaagaattctagttcctcatctgccttggcattgatgaatgaatagccttcctaata

SEQ ID NO: 50834 - DNA, 201 bp, Bos taurus; identical to SEQ ID NO: 9454

SEQ ID NO: 50835 - DNA, 201 bp, Bos taurus; identical to SEQ ID NO: 9455

SEQ ID NO: 50836 - DNA, 201 bp, Bos taurus; identical to SEQ ID NO: 9456

SEQ ID NO: 50837 - DNA, 201 bp, Bos taurus
ctccagctcggggcctccttgccatgccccaatcctcctttcagcacctgaaggagcaaactgttagctgataaatgatcaaaaagcttccagcaaaaacaggatttggacaaggagctcagaagcagcataaggtcccgcaggttcaagcttttgcctgcttcaccttcatctgctacttctccccgatgggaatcagat

SEQ ID NO: 50838 - DNA, 201 bp, Bos taurus; identical to SEQ ID NO: 9457

SEQ ID NO: 50839 - DNA, 201 bp, Bos taurus; identical to SEQ ID NO: 9458

SEQ ID NO: 50840 - DNA, 201 bp, Bos taurus; identical to SEQ ID NO: 9459

SEQ ID NO: 50841 - DNA, 201 bp, Bos taurus; identical to SEQ ID NO: 9464

SEQ ID NO: 50842 - DNA, 201 bp, Bos taurus; identical to SEQ ID NO: 9465

SEQ ID NO: 50843 - DNA, 201 bp, Bos taurus; identical to SEQ ID NO: 9466

SEQ ID NO: 50844 - DNA, 201 bp, Bos taurus; identical to SEQ ID NO: 9467

SEQ ID NO: 50845 - DNA, 201 bp, Bos taurus; identical to SEQ ID NO: 9468

SEQ ID NO: 50846 - DNA, 201 bp, Bos taurus
caggcacaaaaaccacctgcagttctattttgaccaagaattctcatgtggagatgattttcaaaatgatggagaatagagacaaaggccagtgtgccctaaggaggctgggtttcacatttaatgcccaagggagagaggaaaggcacttcaggaagaagggatctggccactagggctcacagagaggcaagaatcagg

SEQ ID NO: 50847 - DNA, 201 bp, Bos taurus
gaatcggagtggccctggctaatacttcacccatgccttacatcagtgtgttttgtaaggatctccacctgcagatgagaaaaccctgcatgctgggtgacgtgtgtctgccctggccttctccacgactcagagcaagcaaactgctaggctcttttctgactccctgtcactgtcccctcagacactgccgttaatcat

SEQ ID NO: 50848 - DNA, 201 bp, Bos taurus; identical to SEQ ID NO: 9471

SEQ ID NO: 50849 - DNA, 201 bp, Bos taurus; identical to SEQ ID NO: 9472

SEQ ID NO: 50850 - DNA, 201 bp, Bos taurus; identical to SEQ ID NO: 9475

SEQ ID NO: 50851 - DNA, 201 bp, Bos taurus
aaactgtacagcaccatataaacacagattattcctgttattttattatcatcaatctacacagaaaatctcaagaggctgggaggaaggcattattaacccacatttttgagttgacagaacacagaggaaagggaagaatatgcagttcacagactcagaaaagctgtggctgcttactgttccggaagaaaggaaata

SEQ ID NO: 50852 - DNA, 201 bp, Bos taurus
tcaccccagttcagtatcctctcctgaactgttggtctgcagggtagtaactatatctgtgactctggaaagaatctcatcaagtggcccatcaactctcagttgtaaacaatagcagtggaaggtttgatggtccatgaatgggcatttgtaaggatcatctcatcatgatgcttttatctcaattatctggcctcatgg

SEQ ID NO: 50853 - DNA, 201 bp, Bos taurus
tgcatgaaaaatgggataccacagtcccaaagttctagtaaaatagtgtgaacacagtttataaaataggtggaatcagatgatcacttcaggcaaactagtcacataggaaagaattttttaaattctgcgcggcactctcttgtgtgtgccctccaaaatgaattacttggaaatatgaccgaagaaaatgagcttact

SEQ ID NO: 50854 - DNA, 201 bp, Bos taurus
ttgaactgccagcttatcagaatttatcaagggaaggaaaggagagctgtttcaggaacccacacacatgtagaaacacagggcctaatgagaatatccacgttggcaccatcctaaaaataaaaaaaggaaaaagaaaaaatgagagcaaaagatcacagcttggaataggccaggcctacagtcagactccagcaccca

SEQ ID NO: 50855 - DNA, 201 bp, Bos taurus; identical to SEQ ID NO: 9477

SEQ ID NO: 50856 - DNA, 201 bp, Bos taurus; identical to SEQ ID NO: 9478

SEQ ID NO: 50857 - DNA, 201 bp, Bos taurus; identical to SEQ ID NO: 9479

SEQ ID NO: 50858 - DNA, 201 bp, Bos taurus
ggagggggatgggcgagggcgtccgcgtcccctactcggccgcccgccttctctcctcggtgattccttccaggtgattcacatgggcaggtgattcacgtgcgcaggtgcttctaggctttcggcctggagagctaaaacaccatcctctgtggtgctttgagagcttgggcttcactggcaaaacctgagtcccaggcc

SEQ ID NO: 50859 - DNA, 201 bp, Bos taurus
cctagcaaaatttctaataagtggtagaaggcagggggacccacccatgttacttctgggagattattctacatatttgtttttaatttgagataaagaaactaaacaaatctttggttataactaaaatgtaactgttacccttgtaagttcaaggcatttttcttaattttgaacatgttgcattcttcctgtttaaac

SEQ ID NO: 50860 - DNA, 201 bp, Bos taurus
gcagaatgacattattgtcaggagccaaagcagcagttcttactaacgtatataaatgtttttagtgtttctctggggccatagagtctctcacctgtctgtcttctgtatgtttgctttattctttatcttcataacaacttcagacccacatggtctcccacccaagtgtataagacacatactatatttggcctgtgc

SEQ ID NO: 50861 - DNA, 201 bp, Bos taurus
ggtagggctgtgggccaggcttcacgtttgcccttgggtgggtggggccttaggctgtgctccctgcctgcacatttccacagactggactccatgagctggcagggttaaatggacagatgggtaatcaggctgtgccccaaagttgatcaaggctacagatggggctttgcaatcagataggccattggttgtgttctg

SEQ ID NO: 50862 - DNA, 201 bp, Bos taurus; identical to SEQ ID NO: 9482

SEQ ID NO: 50863 - DNA, 201 bp, Bos taurus; identical to SEQ ID NO: 9484

SEQ ID NO: 50864 - DNA, 201 bp, Bos taurus
attattatgcactcatagaatggaatgccgtgtagcctttaaacagaatgaacagctccataaaaatcaaggcgcagaacaatgtcacacccatatatgtgtgcatgtatatgattgcagacagggatatttaaacatgcataaactatctctgaaacagtttgaaagagatatgattttaagttcacaaagaaattgctg

SEQ ID NO: 50865 - DNA, 201 bp, Bos taurus; identical to SEQ ID NO: 9487

SEQ ID NO: 50866 - DNA, 201 bp, Bos taurus; identical to SEQ ID NO: 9489

SEQ ID NO: 50867 - DNA, 201 bp, Bos taurus; identical to SEQ ID NO: 9490

SEQ ID NO: 50868 - DNA, 201 bp, Bos taurus; identical to SEQ ID NO: 9491

SEQ ID NO: 50869 - DNA, 201 bp, Bos taurus; identical to SEQ ID NO: 9493

SEQ ID NO: 50870 - DNA, 201 bp, Bos taurus; identical to SEQ ID NO: 9494

SEQ ID NO: 50871 - DNA, 201 bp, Bos taurus
ccccagaccgcagtccgcatagcccgcagccgcgcatcttcagcaccttggcttgtgtgttaggctagcctttccaagccaaccttcccaggccgtctcccccagcttttgaaataaaccccccaaacgggtgcagtcaactcaagatcgccttccaccgcgcccgccgagacccccccttctgcggtcatccccaggccg

SEQ ID NO: 50872 - DNA, 201 bp, Bos taurus
ccctgcgtgtccttgccatgtggctggataccccctggtgttacctctacccttcctgaagagcaagtgcaacagtgtcccttctctggtgactgttcttcgtcctatgggcctaaataatcctgcagatgtgttcgtgtgtttcatcctaaatctccttattaagatttagctccccttttcttgtaacagaagtactag

SEQ ID NO: 50873 - DNA, 201 bp, Bos taurus
gcaggcaacagagcatgggacaaactgctttgggtctaaccaaccgttccctatcataatgccaaatctgatgaagggacttcagggaaacctcgggttttgggcttctccccttcatgctggaatgattcaaaactgtgtatacaaactgattattctgaccaaatgacgtgatatgaacttccatgagaatgacagctc

SEQ ID NO: 50874 - DNA, 201 bp, Bos taurus; identical to SEQ ID NO: 9495

SEQ ID NO: 50875 - DNA, 201 bp, Bos taurus
ttacctggattttttgacaaggttgaatcaagtgaaaatagactccattcattgaacctttgattgagggtgggtggtgattcatacattctaaaggttagaaactcttaggacacttaggactttgcctctttgagatgttggctggcctctctccatttcaatggaaacagttgtggtcagtctaatactataaagaga

SEQ ID NO: 50876 - DNA, 201 bp, Bos taurus; identical to SEQ ID NO: 9496

SEQ ID NO: 50877 - DNA, 201 bp, Bos taurus
acgtatcaccttttaagtttccagttatgaaggctgagctccgcagatttgccatgagattcccagtttccacaagcccctcaggcctttctcaacatcctgctggtgccttcttgtcccctccagaccatgtcccttgtgacagccattgtgttctactggccgtggtcaccgcggcctcagccttggtagcccagcacg

SEQ ID NO: 50878 - DNA, 201 bp, Bos taurus; identical to SEQ ID NO: 9497

SEQ ID NO: 50879 - DNA, 201 bp, Bos taurus; identical to SEQ ID NO: 9498

SEQ ID NO: 50880 - DNA, 201 bp, Bos taurus
tcacatcagagtccacacagccctccctcagtcagcatcagcaccgctaaaaacaaagagtgggtcctttgtcagccaggtggcagacctgggcctccccaagaaacctcacctcacaccccagaagggtctcttaagccaaaccaatctactcctccccagctgctgcttccgcctccccgggcatggagggacccgcgg

SEQ ID NO: 50881 - DNA, 201 bp, Bos taurus; identical to SEQ ID NO: 9499

SEQ ID NO: 50882 - DNA, 201 bp, Bos taurus; identical to SEQ ID NO: 9500

SEQ ID NO: 50883 - DNA, 201 bp, Bos taurus; identical to SEQ ID NO: 9501

SEQ ID NO: 50884 - DNA, 201 bp, Bos taurus; identical to SEQ ID NO: 9502

SEQ ID NO: 50885 - DNA, 201 bp, Bos taurus; identical to SEQ ID NO: 9503

SEQ ID NO: 50886 - DNA, 201 bp, Bos taurus
ataaaacctcaccttcttctaagacaattataatccgaagaaatcattccttctttggatttctttaagctcaaggaacagtctcgtgtggaaaggcccctgaccccctaaatgttcttccctggatgctgagcattaaaaaagagaacacaagaacaagttcatggtagagtagtaatataatgataaatgtaacttcag

SEQ ID NO: 50887 - DNA, 201 bp, Bos taurus
aaaaatgaaatgaatatagtgtctcccccttctttcgtattctgcactgtcacagagaaaaaagtctcaagcatccactctggccacatcacactcacactgcaacacgcagagaaggggctctggctggacaacagggtccagaagccactggcacgcgcccaaaaggatgctccccaaagcccttaattatgagacctg

SEQ ID NO: 50888 - DNA, 201 bp, Bos taurus
catcagcaggcctgtgctggcgtgtcacacaagactggctcctacagccgaccctgtctctgcctcttaaaggcattgtttgcgctgctccacaaatgttaccattgattaaactgaatctggccaatgcaaaggctggagggctgattcaatgcctgggagtatttcataaatactgcatctgaaagtgatagtttttct

SEQ ID NO: 50889 - DNA, 201 bp, Bos taurus
atattgtattttttttaagtttaaaataatattgtatattgtccttgtttacttgaagaggagcttgttttatggctagaacatcattacttacttttttctttacttactgtttttaatagtctcactgcttccccaggtctgtttctatttattgtatgttgtgggaaaacagctaaaaacacatttcttattgagtga

SEQ ID NO: 50890 - DNA, 201 bp, Bos taurus; identical to SEQ ID NO: 9504

SEQ ID NO: 50891 - DNA, 201 bp, Bos taurus
tctagggcaacagaaagttcttctcatgccccagccttagactcaacctctttcttctccaaggagctctggtgctttttagggggaaatggtagtaattcgattctgggacagagtcacttccgttgtgacaaaagcagggcagaaagttcccagttttacaacttggccactgtttctcaaacctcagttatctaggac

SEQ ID NO: 50892 - DNA, 201 bp, Bos taurus; identical to SEQ ID NO: 9505

SEQ ID NO: 50893 - DNA, 201 bp, Bos taurus
tccaggagttggtgatggacagggaggcctggcgtgctgccgtccatggggtcccaaaaagtcagacatgactgagtgactgaattgactgactgactgataaggataatctttagtttgtcataactattgcaactattttgttcttatttgacattaaccttttaatttttaagaatattgatgtaaatgatcatctat

SEQ ID NO: 50894 - DNA, 201 bp, Bos taurus; identical to SEQ ID NO: 9506

SEQ ID NO: 50895 - DNA, 201 bp, Bos taurus
taatcgttgagtgaatgagtgaatcttccttcactttgaatactgggaaatgaagcttagggaaagtaatcaagtcactttagaaatgaattgttttaatatccaagtatgtgggtctctagtgatctggcttctcctaggaatgaacttcagagcatctagacaggaaccagagaaggcaatggcaccccactccagtac

SEQ ID NO: 50896 - DNA, 201 bp, Bos taurus
ctatgcctgtcatgtcccattatagaatgaatacctaaatgaagatattgatgctagagttattgaatatgaagataaccggcctctcctagacatgtttctgcagaagccaatgggtttactgtccctccttgatgaagaaagtagatttcccaaggccacagaccaaactcttataggtgggttttaaattcagtatgt

SEQ ID NO: 50897 - DNA, 201 bp, Bos taurus; identical to SEQ ID NO: 9507

SEQ ID NO: 50898 - DNA, 201 bp, Bos taurus; identical to SEQ ID NO: 9508

SEQ ID NO: 50899 - DNA, 201 bp, Bos taurus; identical to SEQ ID NO: 9509

SEQ ID NO: 50900 - DNA, 201 bp, Bos taurus; identical to SEQ ID NO: 9511

SEQ ID NO: 50901 - DNA, 201 bp, Bos taurus; identical to SEQ ID NO: 9512

SEQ ID NO: 50902 - DNA, 201 bp, Bos taurus; identical to SEQ ID NO: 9513

SEQ ID NO: 50903 - DNA, 201 bp, Bos taurus; identical to SEQ ID NO: 9514

SEQ ID NO: 50904 - DNA, 201 bp, Bos taurus; identical to SEQ ID NO: 9515

SEQ ID NO: 50905 - DNA, 201 bp, Bos taurus; identical to SEQ ID NO: 9516

SEQ ID NO: 50906 - DNA, 201 bp, Bos taurus; identical to SEQ ID NO: 9517

SEQ ID NO: 50907 - DNA, 201 bp, Bos taurus; identical to SEQ ID NO: 9518

SEQ ID NO: 50908 - DNA, 201 bp, Bos taurus; identical to SEQ ID NO: 9519

SEQ ID NO: 50909 - DNA, 201 bp, Bos taurus; identical to SEQ ID NO: 9520

SEQ ID NO: 50910 - DNA, 201 bp, Bos taurus; identical to SEQ ID NO: 9521

SEQ ID NO: 50911 - DNA, 201 bp, Bos taurus; identical to SEQ ID NO: 9522

SEQ ID NO: 50912 - DNA, 201 bp, Bos taurus; identical to SEQ ID NO: 9523

SEQ ID NO: 50913 - DNA, 201 bp, Bos taurus; identical to SEQ ID NO: 9524

SEQ ID NO: 50914 - DNA, 201 bp, Bos taurus; identical to SEQ ID NO: 9525

SEQ ID NO: 50915 - DNA, 201 bp, Bos taurus; identical to SEQ ID NO: 9526

SEQ ID NO: 50916 - DNA, 201 bp, Bos taurus; identical to SEQ ID NO: 9527

SEQ ID NO: 50917 - DNA, 201 bp, Bos taurus; identical to SEQ ID NO: 9528

SEQ ID NO: 50918 - DNA, 201 bp, Bos taurus; identical to SEQ ID NO: 9529

SEQ ID NO: 50919 - DNA, 201 bp, Bos taurus; identical to SEQ ID NO: 9530

SEQ ID NO: 50920 - DNA, 201 bp, Bos taurus
ctgttctaacctttcctgaaggaggaattcacctctttcctgaaagaggaattcacttgaattcaccatggcttcattcacatgttcacgcttctggccattgaaactgtcttgctatcttaactcagtccagtcctgcaaaatgccatctgccagaaacagcagggaaagcagcaggccaggtttggattaagcctgcca

SEQ ID NO: 50921 - DNA, 201 bp, Bos taurus; identical to SEQ ID NO: 9531

SEQ ID NO: 50922 - DNA, 201 bp, Bos taurus
ccacacggaggccagggcagagatgggagtgaagctgccacacgccaagggaaggcagagccacctgaagctggaagaggcaggaagaatcctcccccgtatgtgtggaaaggagcacgacctggccgtcacaacttgacttcagatttccagcctcctgaactgggagagaacaaatttatgttctcagccacccaattt

SEQ ID NO: 50923 - DNA, 201 bp, Bos taurus
cacatgcaatatacacatgggcagaaaaagagctgtgggagacagtgaggctgggaaatagccccgactccatcatttcctgtgactgcatgctgaaatttgcaaattcatcatattgcaggcaagatttaggttgaggcaaaggtagtggaacacctgaataggtagaaagtaacagcatattcttagacatgcacttgg

SEQ ID NO: 50924 - DNA, 201 bp, Bos taurus; identical to SEQ ID NO: 9532

SEQ ID NO: 50925 - DNA, 201 bp, Bos taurus
aagtttacagattgctgtttactcactgatctatccaatcccaatgttttatagttgatgataccaagtccccaataattaaaaaccataagttaaaacccctgtctccagaaacttaaaaccatttactttggattcaaatcacaattatgatccaatgtaactatacaaccttaagaaaactatttaatttgtccaatc

SEQ ID NO: 50926 - DNA, 201 bp, Bos taurus
gggctcattgtgtagggccatcaagccctaaaagccaggggccggcactctgttctgtggacaacaagggcacatctcaggctttccagaagaagaacgatgagattagatctgtttatcaggccaagcgttcaagaagccatatgtggggtggatggcagctgggagtgacttgcctcgggaggccagttccagaaactg

SEQ ID NO: 50927 - DNA, 201 bp, Bos taurus; identical to SEQ ID NO: 9533

SEQ ID NO: 50928 - DNA, 201 bp, Bos taurus; identical to SEQ ID NO: 9534

SEQ ID NO: 50929 - DNA, 201 bp, Bos taurus; identical to SEQ ID NO: 9535

SEQ ID NO: 50930 - DNA, 201 bp, Bos taurus; identical to SEQ ID NO: 9536

SEQ ID NO: 50931 - DNA, 201 bp, Bos taurus
ttctttgcagagtgggattctctttgatggtttgcagaaaggcaaggctcacatctacagtgcagctttaaagatgcgcccacaaagaaagcccagattgtgggcccattttctcagagcaaatagaagatttgtgtgggccacacagaggcacattttgagagtgggtttatggattagtgggccacatgaatgacgtgc

SEQ ID NO: 50932 - DNA, 201 bp, Bos taurus; identical to SEQ ID NO: 9537

SEQ ID NO: 50933 - DNA, 201 bp, Bos taurus; identical to SEQ ID NO: 9538

SEQ ID NO: 50934 - DNA, 201 bp, Bos taurus
cgatgaggcccgtgcagagaaatattctgttctcaatatcagtgacagatgttcttcaacacataaatagatgacttttaccttgtaaatacccaatcaccgagccaggaaatggccctatttcatatccagctaaaagaaaacttaagacaaacctgttggatacacaaaatgtggtacatccatataatggaatattat

SEQ ID NO: 50935 - DNA, 201 bp, Bos taurus; identical to SEQ ID NO: 9539

SEQ ID NO: 50936 - DNA, 201 bp, Bos taurus
attattgcttttggagtcatatttcagaaaatagttgaaaactttgttggctcaagtaagtttggttgctcagttttatgatttgaaaaatattaacttatgcatctgtttatttgcagtatttatgccctttcacagagataaatcatgaaatggcaccatttcaaatatgtaagcatcatgtagtaaaaaaattaacat

SEQ ID NO: 50937 - DNA, 201 bp, Bos taurus; identical to SEQ ID NO: 9540

SEQ ID NO: 50938 - DNA, 201 bp, Bos taurus; identical to SEQ ID NO: 9542

SEQ ID NO: 50939 - DNA, 201 bp, Bos taurus; identical to SEQ ID NO: 9543

SEQ ID NO: 50940 - DNA, 201 bp, Bos taurus
atgcaaatagaaataaagagcacaataaatgtattgcatttgaatcacccccaaaccacccaccaccccagtctgtgaagaaattgtcttccacgaactgatccctgatgtcaaaaagttggggaccgctacactaaaggataggttgattctttaactgggatatccgtctcaggggttatgtgtcatatactttctctc

SEQ ID NO: 50941 - DNA, 201 bp, Bos taurus; identical to SEQ ID NO: 9544

SEQ ID NO: 50942 - DNA, 201 bp, Bos taurus
gagcacagttgagcacacataagcattcaggccttatttacagatgtatatacagagattccattgctttcaaatcccacagtttgatagaaaattgcacccaccatctgaagctgttcaagcacacagtgcagacacagtgacaagaacacatttttgagtgtggccttgatactgatccattggtaaagcaagacttga

SEQ ID NO: 50943 - DNA, 201 bp, Bos taurus; identical to SEQ ID NO: 9545

SEQ ID NO: 50944 - DNA, 201 bp, Bos taurus
atcttagtatttatcaataagcatactatagcagaagaaaaatgtttttcatattaccttagtttgtaaatgccttagacagtgggagaatcctatccagctggaaatatctcctacctggccttttcagaagaatgaatcaacaggaatgtgttcattcaccttcaacccgaagatgaatttttattttaaaaaacatta

SEQ ID NO: 50945 - DNA, 201 bp, Bos taurus
cacagccacctttgggactgttagaagtaggatccagccatcacaggccaacacttagatttagtagggttctcaccagacaaaatagtctcagacacttgtctttctttaaactgttcttactggcccagtatacaatgttattaaaatcaagtttatgaagtagccaggtaggtattttttgtttttaattaggcgtta

SEQ ID NO: 50946 - DNA, 201 bp, Bos taurus; identical to SEQ ID NO: 9546

SEQ ID NO: 50947 - DNA, 201 bp, Bos taurus; identical to SEQ ID NO: 9547

SEQ ID NO: 50948 - DNA, 201 bp, Bos taurus; identical to SEQ ID NO: 9549

SEQ ID NO: 50949 - DNA, 201 bp, Bos taurus
agttgtgagtcacagtgatttttgttggccgcggttcctgcaggtttggtggcacaggagtgactccatcagtgtgtttgtgtggttcccagaaaccagcgtccgtaggcctcccgcttccctgctcaggacctgccttgttatgtctgtcagggaggaggcggagatgacagacctgtgatatgtgaaaggggtttcagg

SEQ ID NO: 50950 - DNA, 201 bp, Bos taurus
cctggcctctgaagttccagggttggattgtatgtttccaggtattagtgggcgatatgagaggaagaagagggggcggcacaggaaaagggggtccctacgttaagcaagtggccaaagctgtccacggtggtgtgtggcagtaagggcattgatttgttcctggctctgacagctgggcggccttgcacaagtccccta

SEQ ID NO: 50951 - DNA, 201 bp, Bos taurus; identical to SEQ ID NO: 9550

SEQ ID NO: 50952 - DNA, 201 bp, Bos taurus; identical to SEQ ID NO: 9552

SEQ ID NO: 50953 - DNA, 201 bp, Bos taurus; identical to SEQ ID NO: 9553

SEQ ID NO: 50954 - DNA, 201 bp, Bos taurus; identical to SEQ ID NO: 9554

SEQ ID NO: 50955 - DNA, 201 bp, Bos taurus; identical to SEQ ID NO: 9555

SEQ ID NO: 50956 - DNA, 201 bp, Bos taurus; identical to SEQ ID NO: 9556

SEQ ID NO: 50957 - DNA, 201 bp, Bos taurus; identical to SEQ ID NO: 9557

SEQ ID NO: 50958 - DNA, 201 bp, Bos taurus; identical to SEQ ID NO: 9558

SEQ ID NO: 50959 - DNA, 201 bp, Bos taurus; identical to SEQ ID NO: 9559

SEQ ID NO: 50960 - DNA, 201 bp, Bos taurus; identical to SEQ ID NO: 9561

SEQ ID NO: 50961 - DNA, 201 bp, Bos taurus; identical to SEQ ID NO: 9563

SEQ ID NO: 50962 - DNA, 201 bp, Bos taurus
cttttcaggacttttcaaacttaggatagaactagccaccacttacactttgcattcccaccaatatgtgattcctcatattctttcaatgatcctttttcaaatgttgtcaatttgcttggtaaaaagcaagaaaaaatgtaataggtttataatacttttcatgcaaataatacatagaaacaaacacaaacaataaag

SEQ ID NO: 50963 - DNA, 201 bp, Bos taurus; identical to SEQ ID NO: 9564

SEQ ID NO: 50964 - DNA, 201 bp, Bos taurus; identical to SEQ ID NO: 9565

SEQ ID NO: 50965 - DNA, 201 bp, Bos taurus; identical to SEQ ID NO: 9566

SEQ ID NO: 50966 - DNA, 201 bp, Bos taurus
ggaaatatttggccaggggaggggagtttacttttaaacatgatggggtgacatcagcaacatggctgaaagacaggtgcctcatcatttttctcgccactaacaacactttggcctccatccatggacatactcaaaggaggaaaaaccctgccaaccaagggtactctatccagaaaagtctttcaggaatgaaggata

SEQ ID NO: 50967 - DNA, 201 bp, Bos taurus; identical to SEQ ID NO: 9569

SEQ ID NO: 50968 - DNA, 201 bp, Bos taurus; identical to SEQ ID NO: 9570

SEQ ID NO: 50969 - DNA, 201 bp, Bos taurus; identical to SEQ ID NO: 9572

SEQ ID NO: 50970 - DNA, 201 bp, Bos taurus; identical to SEQ ID NO: 9574

SEQ ID NO: 50971 - DNA, 201 bp, Bos taurus; identical to SEQ ID NO: 9575

SEQ ID NO: 50972 - DNA, 201 bp, Bos taurus; identical to SEQ ID NO: 9576

SEQ ID NO: 50973 - DNA, 201 bp, Bos taurus
agaagcctttctgcggtcatctgcaactcaacagcctgacgatgctggtctgaagaagccttggggaccctcgggacagcacattgcacctgtgttcaccgcacagaggcagcccttacagtgacccagatggagacacctccatccgtgagtgtgtaaccagaatagagcccagccacctcaggaacagacagagttgag

SEQ ID NO: 50974 - DNA, 201 bp, Bos taurus; identical to SEQ ID NO: 9578

SEQ ID NO: 50975 - DNA, 201 bp, Bos taurus; identical to SEQ ID NO: 9579

SEQ ID NO: 50976 - DNA, 201 bp, Bos taurus; identical to SEQ ID NO: 9582

SEQ ID NO: 50977 - DNA, 201 bp, Bos taurus
ttttgtcttacagttgtgtggaaaacagaatctggaagggatgaatgtggatattattaataccttcatacctttgtcttctctttcttttggcctgtactctcatcctgtacctgtgttgtcaattcctgcttatttttcaaagcgagctcaaataccaccctttgagaagccttgtgttgctccccagaagtggcccct

SEQ ID NO: 50978 - DNA, 201 bp, Bos taurus; identical to SEQ ID NO: 9583

SEQ ID NO: 50979 - DNA, 201 bp, Bos taurus; identical to SEQ ID NO: 9584

SEQ ID NO: 50980 - DNA, 201 bp, Bos taurus; identical to SEQ ID NO: 9585

SEQ ID NO: 50981 - DNA, 201 bp, Bos taurus; identical to SEQ ID NO: 9586

SEQ ID NO: 50982 - DNA, 201 bp, Bos taurus
cgcacgggtcccgacagccacgggtcacccatcacgggaccaaggctccaaagcaggctgcctctgaggacagacactctgggccgtcactccagccgccgtgtgtcccatctggaaggagtcagctgggtgagcgcacagaacagcccctgcagaggcccacgtggatgctccaggaattaattacctccagcccgtggt

SEQ ID NO: 50983 - DNA, 201 bp, Bos taurus; identical to SEQ ID NO: 9587

SEQ ID NO: 50984 - DNA, 201 bp, Bos taurus; identical to SEQ ID NO: 9590

SEQ ID NO: 50985 - DNA, 201 bp, Bos taurus; identical to SEQ ID NO: 9591

SEQ ID NO: 50986 - DNA, 201 bp, Bos taurus; identical to SEQ ID NO: 9592

SEQ ID NO: 50987 - DNA, 201 bp, Bos taurus; identical to SEQ ID NO: 9593

SEQ ID NO: 50988 - DNA, 201 bp, Bos taurus; identical to SEQ ID NO: 9594

SEQ ID NO: 50989 - DNA, 201 bp, Bos taurus; identical to SEQ ID NO: 9595

SEQ ID NO: 50990 - DNA, 201 bp, Bos taurus
cgttactgggttctcactgcctgggacacaatctcctgcccagatcacctggggaccaggtcctggacagccagggaccacccccatggcccacagcccattgacaggattcaaattatctgaccctaaatctgctctgcctgctcatgaccttgcctggccctttccttcccacagaagccacctccattcctctctctc

SEQ ID NO: 50991 - DNA, 201 bp, Bos taurus; identical to SEQ ID NO: 9596

SEQ ID NO: 50992 - DNA, 201 bp, Bos taurus
gcctgagctcacacagaccagagttagtatgaatctacatttctgggttttccaggatgaagtaaatttgaagtcttttatcacatgatcccttctttatttatccctaaggaatcttatctggccccgtggattttttttttttaacttttaattttgaaataattatagagtcacaggcagttgcaaaatcagttgcaa

SEQ ID NO: 50993 - DNA, 201 bp, Bos taurus; identical to SEQ ID NO: 9597

SEQ ID NO: 50994 - DNA, 201 bp, Bos taurus; identical to SEQ ID NO: 9598

SEQ ID NO: 50995 - DNA, 201 bp, Bos taurus; identical to SEQ ID NO: 9599

SEQ ID NO: 50996 - DNA, 201 bp, Bos taurus; identical to SEQ ID NO: 9600

SEQ ID NO: 50997 - DNA, 201 bp, Bos taurus
ttcagttttacttaggacaaatatgtgatccactgaaaggtgatgtttttcaacttcccagatgggcatggccatatgacttggtttgggccaatgagttgaaagtaaaagtgttgtgtgaggtctcttcaagagcagatgcacctctttctctgttccttactttgtcagtgggcctagaacatggatgtgatggatggc

SEQ ID NO: 50998 - DNA, 201 bp, Bos taurus; identical to SEQ ID NO: 9601

SEQ ID NO: 50999 - DNA, 201 bp, Bos taurus
gagtggcaaatggtcaggaaccttgaatggcttctaggagtcacattgggttcctggccagagacatcagtcctacaaccactaggaactaaattattccagtgaacatagaagaagaccatgagacttgaatgagaatttcagttccaggttcacatttgacttcagtctggtgagtcctcaagcagagggacccagcca

SEQ ID NO: 51000 - DNA, 201 bp, Bos taurus; identical to SEQ ID NO: 9602

SEQ ID NO: 51001 - DNA, 201 bp, Bos taurus; identical to SEQ ID NO: 9603

SEQ ID NO: 51002 - DNA, 201 bp, Bos taurus; identical to SEQ ID NO: 9605

SEQ ID NO: 51003 - DNA, 201 bp, Bos taurus
tctcctagatggggaggaggaggaagaggccacacagacatctaccatttttggctacaaagcatttctccctgttcctaaggtcacttcctgtgccattcgggaaatactccttccccatctaggagaacataagatccctgcctttccctagaagtgtgacctctggggtcctctgctgttacttacctcttcttcccc

SEQ ID NO: 51004 - DNA, 201 bp, Bos taurus; identical to SEQ ID NO: 9606

SEQ ID NO: 51005 - DNA, 201 bp, Bos taurus; identical to SEQ ID NO: 9607

SEQ ID NO: 51006 - DNA, 201 bp, Bos taurus; identical to SEQ ID NO: 9608

SEQ ID NO: 51007 - DNA, 201 bp, Bos taurus; identical to SEQ ID NO: 9609

SEQ ID NO: 51008 - DNA, 201 bp, Bos taurus; identical to SEQ ID NO: 9610

SEQ ID NO: 51009 - DNA, 201 bp, Bos taurus; identical to SEQ ID NO: 9611

SEQ ID NO: 51010 - DNA, 201 bp, Bos taurus; identical to SEQ ID NO: 9612

SEQ ID NO: 51011 - DNA, 201 bp, Bos taurus; identical to SEQ ID NO: 9613

SEQ ID NO: 51012 - DNA, 201 bp, Bos taurus; identical to SEQ ID NO: 9614

SEQ ID NO: 51013 - DNA, 201 bp, Bos taurus; identical to SEQ ID NO: 9618

SEQ ID NO: 51014 - DNA, 201 bp, Bos taurus; identical to SEQ ID NO: 9619

SEQ ID NO: 51015 - DNA, 201 bp, Bos taurus; identical to SEQ ID NO: 9620

SEQ ID NO: 51016 - DNA, 201 bp, Bos taurus; identical to SEQ ID NO: 9621

SEQ ID NO: 51017 - DNA, 201 bp, Bos taurus
taatttcccagccctcagctccactcctaatccccttctccacctgcatccagagctgttttccccaaacaaaatctgctcatttttcttccatggcccggtgtagccatcacctccacaagtcatcccaagggcaaaggaagggcaaacactttggggttcccagagaccttctcctcgtggcctcatatccttaaccag

SEQ ID NO: 51018 - DNA, 201 bp, Bos taurus; identical to SEQ ID NO: 9622

SEQ ID NO: 51019 - DNA, 201 bp, Bos taurus; identical to SEQ ID NO: 9624

SEQ ID NO: 51020 - DNA, 201 bp, Bos taurus; identical to SEQ ID NO: 9625

SEQ ID NO: 51021 - DNA, 201 bp, Bos taurus
ccgtcccctccgctctgccaagggctggaacacagcctccctggaggagcagaaagtccagaagcagacctgacaacgcctggtgactttcttgtgtgcctgagggccacaagtgggcaaaggaagaaaaccacacccacctgccagccattgacaatcttctggttgaaaatcccaaactcatagcggatcccgtagccg

SEQ ID NO: 51022 - DNA, 201 bp, Bos taurus; identical to SEQ ID NO: 9629

SEQ ID NO: 51023 - DNA, 201 bp, Bos taurus; identical to SEQ ID NO: 9630

SEQ ID NO: 51024 - DNA, 201 bp, Bos taurus
ctccactctagctgacctcacctggaggtgcacagcccagacctgcctctggtctgcttctgacacacccaacatatctcatgtggtggtgagagtcccaaagagagtgaggtcaaaggccaatggctaaaatcctgagggcactgcagctatgactggagtgacaacagatgagccagtatagaccactggagcctggat

SEQ ID NO: 51025 - DNA, 201 bp, Bos taurus
gcaaatcaggtcacacgttacttcttcagagagctcacttttttgaatactacctatagccaccatcactccattattttctgtaacatagggtcagtacattggggccctcaggctaaatagcgcttactgcctattttcctaaataaaattgtattggaatgcagccacatttattttttaagattgcctgtggctgtt

SEQ ID NO: 51026 - DNA, 201 bp, Bos taurus; identical to SEQ ID NO: 9631

SEQ ID NO: 51027 - DNA, 201 bp, Bos taurus; identical to SEQ ID NO: 9632

SEQ ID NO: 51028 - DNA, 201 bp, Bos taurus
ctgtccatgggattctccaggcaagaatattggagtgggtcaccatgcattcctccaggggatcatcctgaccctaggatcaaacccacaaagaggccaagttcaacaaaaccgggtggtctggatcttgtactagaacaagaaccccaaatacaccaaggtagtttgggcacccactgttacaggaactggcccctaatt

SEQ ID NO: 51029 - DNA, 201 bp, Bos taurus; identical to SEQ ID NO: 9633

SEQ ID NO: 51030 - DNA, 201 bp, Bos taurus
acagcttcctacaaatagaatgtcctaattcagtatgtcagttggatcattcgatgaggtgaataaatcatttgtaatcagaataaaagaaataatgtatacaaagaaaagccaaaaatgcaaattaaggaaaacatgcattttgctggctttctttgataatctacttgcatgtgttaaaaaaaaaaaaatagcacacca

SEQ ID NO: 51031 - DNA, 201 bp, Bos taurus; identical to SEQ ID NO: 9634

SEQ ID NO: 51032 - DNA, 201 bp, Bos taurus
actttctgataaaaagatgttatttttatttggttaacattaaaactggatttggaagaaccatgcaaattcatacttgtaataaatgcatttatgtagggacatttaaatttcccattcacaagtacatacgctctttctgaataaggtactttattgcctggcataaggcacttatgcaaaggtttagaaataccaggc

SEQ ID NO: 51033 - DNA, 201 bp, Bos taurus
cctgctcttaaccacatttccaccccctgcctcccagtcagagactcacagtgctgagttgcaaggcagcgactccagcaatagggccgcaggtctgatgaagactttctcgttgagttttgggggggttttgttttagtttcttgcctcaccacaggccttgtggggtctcagtgccccaaccaagtatcaaacccaggc

SEQ ID NO: 51034 - DNA, 201 bp, Bos taurus; identical to SEQ ID NO: 9635

SEQ ID NO: 51035 - DNA, 201 bp, Bos taurus
taatgtctcagatggcaccagcccctccgggtccctacctcagtgaaacgtagcgccttcctgctggcctggcattgtagttaatgagatgtgggtatcactgaggaaaaagtaaaaagaagaaatacatgaagatatttggttaaaacatgtgatcagtaattcggcagttatggaacgaaatcaatggcaaacagaaat

SEQ ID NO: 51036 - DNA, 201 bp, Bos taurus
tggtttgtcttgacctttgtttctgcccttggccgtgagaacactgcttgctggaagaaaggtgctttccctgggtctggactgagagggtctggcacagaggggcagcctgggagggccacagagacaccgtccacatgagcccagaggctgggggtgtgcagagcccgtagtacctggggcgtctctggacttggacag

SEQ ID NO: 51037 - DNA, 201 bp, Bos taurus; identical to SEQ ID NO: 9639

SEQ ID NO: 51038 - DNA, 201 bp, Bos taurus; identical to SEQ ID NO: 9642

SEQ ID NO: 51039 - DNA, 201 bp, Bos taurus; identical to SEQ ID NO: 9643

SEQ ID NO: 51040 - DNA, 201 bp, Bos taurus
gagttcggccccaggcgtgcaggacttggaaggcgtgcgggtgagccctgtgcacagcggtggcagccctctgccaaagcaggttctctcccagtcagccggagacgctcctgaggcctctggtgggcgagcgtcagggctgaaagaaccagagcggacgggtggagaagaggaggaggcactgcgtctgcaggaaggctg

SEQ ID NO: 51041 - DNA, 201 bp, Bos taurus; identical to SEQ ID NO: 9644

SEQ ID NO: 51042 - DNA, 201 bp, Bos taurus; identical to SEQ ID NO: 9645

SEQ ID NO: 51043 - DNA, 201 bp, Bos taurus; identical to SEQ ID NO: 9647

SEQ ID NO: 51044 - DNA, 201 bp, Bos taurus; identical to SEQ ID NO: 9648

SEQ ID NO: 51045 - DNA, 201 bp, Bos taurus; identical to SEQ ID NO: 9650

SEQ ID NO: 51046 - DNA, 201 bp, Bos taurus; identical to SEQ ID NO: 9652

SEQ ID NO: 51047 - DNA, 201 bp, Bos taurus; identical to SEQ ID NO: 9653

SEQ ID NO: 51048 - DNA, 201 bp, Bos taurus; identical to SEQ ID NO: 9654

SEQ ID NO: 51049 - DNA, 201 bp, Bos taurus; identical to SEQ ID NO: 9655

SEQ ID NO: 51050 - DNA, 201 bp, Bos taurus; identical to SEQ ID NO: 9656

SEQ ID NO: 51051 - DNA, 201 bp, Bos taurus; identical to SEQ ID NO: 9657

SEQ ID NO: 51052 - DNA, 201 bp, Bos taurus; identical to SEQ ID NO: 9661

SEQ ID NO: 51053 - DNA, 201 bp, Bos taurus
tttgggtggactccgggtgttggtgatggacagggaggcctcgtgtgatgcagttcatggggttgcaaagagtctgacatgtctgagcaactgaaatgaactgaactgaactgcacatttttacctttaaggcattcactgctacatccaagagattctacatcagtaaaaaggcagtgatttagagaagaactgtgtttg

SEQ ID NO: 51054 - DNA, 201 bp, Bos taurus
agatctatgggatggctatcaggcatattaacatgtatgttgggagtctctgtaaaagaggagagagaaaagggcagaaaaaagtttttgaagaaataacagccaaatagtttccaaatattttattaaaagctagtccacagatccaacaaactcaatcatttccaaggagagccacacctagagacatcatggtcaaac

SEQ ID NO: 51055 - DNA, 201 bp, Bos taurus; identical to SEQ ID NO: 9664

SEQ ID NO: 51056 - DNA, 201 bp, Bos taurus; identical to SEQ ID NO: 9667

SEQ ID NO: 51057 - DNA, 201 bp, Bos taurus; identical to SEQ ID NO: 9668

SEQ ID NO: 51058 - DNA, 201 bp, Bos taurus
cattagaacctgaagcaaaatgaaaaatcagtaatacttatcctatttattcaaaagatttatattttattcatcatgggttttgtattgtcatttttttaaaaatatttcttatcttgagagacaagatagaatacaacagtccagcaagaaaaggagacctacagccactgagccccatagccagagcccagacactgg

SEQ ID NO: 51059 - DNA, 201 bp, Bos taurus
tgttaactaaaggccaaaatgcccagctgaggactaacagatttgcatgattctttgtgtcaaccactgactaggactgccataattgaacatgcatttgccatgtgggtggtctcctgtcctaggttaaacaacatcttcctaatgtgacccaagggaaatgggatgggtctgtaagagctaacaatattcaccccattt

SEQ ID NO: 51060 - DNA, 201 bp, Bos taurus; identical to SEQ ID NO: 9670

SEQ ID NO: 51061 - DNA, 201 bp, Bos taurus; identical to SEQ ID NO: 9671

SEQ ID NO: 51062 - DNA, 201 bp, Bos taurus; identical to SEQ ID NO: 9672

SEQ ID NO: 51063 - DNA, 201 bp, Bos taurus; identical to SEQ ID NO: 9673

SEQ ID NO: 51064 - DNA, 201 bp, Bos taurus; identical to SEQ ID NO: 9674

SEQ ID NO: 51065 - DNA, 201 bp, Bos taurus; identical to SEQ ID NO: 9675

SEQ ID NO: 51066 - DNA, 201 bp, Bos taurus; identical to SEQ ID NO: 9677

SEQ ID NO: 51067 - DNA, 201 bp, Bos taurus
ggaaagagcaaacagttcaaggcaaatgttgcaggatcctcctctcaaatacttaaaattaccaattagcttaagatagaagatatttcgggaaactttacacacataactttctttaatcatttttaaaggaaggtcacctaaaacttaatacaaatccaggtggccaaacatctttggctccctgacaaattgacagta

SEQ ID NO: 51068 - DNA, 201 bp, Bos taurus; identical to SEQ ID NO: 9678

SEQ ID NO: 51069 - DNA, 201 bp, Bos taurus; identical to SEQ ID NO: 9679

SEQ ID NO: 51070 - DNA, 201 bp, Bos taurus
tggagccaagaaactacggaagctggaggagaaacaagcacgaaaagcccaacgtgaggcaagcaggagggatggggtgcagctctgagaggtgggaaagggccctgccttccatgtctcctatgtagtagaccgtcccctcatgttgggtgggtgtttgatgcttgcctaactccatctcctgtaaccatggtctttggc

SEQ ID NO: 51071 - DNA, 201 bp, Bos taurus; identical to SEQ ID NO: 9686

SEQ ID NO: 51072 - DNA, 201 bp, Bos taurus; identical to SEQ ID NO: 9687

SEQ ID NO: 51073 - DNA, 201 bp, Bos taurus; identical to SEQ ID NO: 9688

SEQ ID NO: 51074 - DNA, 201 bp, Bos taurus; identical to SEQ ID NO: 9690

SEQ ID NO: 51075 - DNA, 201 bp, Bos taurus; identical to SEQ ID NO: 9691

SEQ ID NO: 51076 - DNA, 201 bp, Bos taurus; identical to SEQ ID NO: 9692

SEQ ID NO: 51077 - DNA, 201 bp, Bos taurus; identical to SEQ ID NO: 9693

SEQ ID NO: 51078 - DNA, 201 bp, Bos taurus
ctcactctttatttttcggccgaggcatgcaggaacgtggctccccgaccaaggaccgaaacctcacccccggcagggaaggtgtggagccctaaccagaagaccaccaggaaatgccctcttaatctttatgtaactgaatatatcaaatctttgtaaatgtatcaatctattttcccccatttttgttcaataaatcct

SEQ ID NO: 51079 - DNA, 201 bp, Bos taurus
ctctccccaaccccgcaaagcaaacttgtggaccggcttcccaccagcagaagcgacagagctcttgggtcgatgcctggctggggccgtgattctgctttggcatcgtggggggtctccctgcctggtctcttctgttctctccctgcccctgcaattgtttctggggccccaggcaccctgccaatcaggacatctggg

SEQ ID NO: 51080 - DNA, 201 bp, Bos taurus
agcatgaggaggggaagtggggccggctgctggctgtgtgtagggggctggcagcctctcgctaggctgcgtccaccaggcagcacccgtataccctgttgtggccatgtggaggtgtggaccatgtggagatgggtctgttgatgccgcgcgtgtggactcgtgtgtttcagggctgatgtgggaggtaccggctgatct

SEQ ID NO: 51081 - DNA, 201 bp, Bos taurus; identical to SEQ ID NO: 9694

SEQ ID NO: 51082 - DNA, 201 bp, Bos taurus; identical to SEQ ID NO: 9695

SEQ ID NO: 51083 - DNA, 201 bp, Bos taurus; identical to SEQ ID NO: 9696

SEQ ID NO: 51084 - DNA, 201 bp, Bos taurus; identical to SEQ ID NO: 9697

SEQ ID NO: 51085 - DNA, 201 bp, Bos taurus; identical to SEQ ID NO: 9698

SEQ ID NO: 51086 - DNA, 201 bp, Bos taurus; identical to SEQ ID NO: 9699

SEQ ID NO: 51087 - DNA, 201 bp, Bos taurus
cttgtttaaaatgagaatcctcacgctttacctcagacctactgagtcagaaaccccagggacggagccgcaggtctgtgccaacagcctcaggtggccccgctgccccgtggagttggggctggggtcctcgctccccagcactgggtggcgttcacgtggttccttcatctccccaaaccgtggtgtctatgaatttaa

SEQ ID NO: 51088 - DNA, 201 bp, Bos taurus
gcggaattgtacacaaaacttctctaaactttcgggatgaacagaagctgtgatttctgaaatgatcagactgtaggggcatgcggcccctgggactcacggggactatgcacagtgtgtaaggaccagcccagacaccactctcgtcaaccggctccgggatcgagttaccagtaacgagctacaatccaacggccattt

SEQ ID NO: 51089 - DNA, 201 bp, Bos taurus
agatccgtgacagatggatgccttgcctgtgtttatccacccaaggcggcctcccttatgcagcaagcagagggatgctggttggtggccactgctggaggttccagccatgggtaacacatccatatgttcatggacactgtctcctcaatgccccactggcttcaaggcctcgggatcagaacaagtgtccttcctcac

SEQ ID NO: 51090 - DNA, 201 bp, Bos taurus; identical to SEQ ID NO: 9700

SEQ ID NO: 51091 - DNA, 201 bp, Bos taurus; identical to SEQ ID NO: 9701

SEQ ID NO: 51092 - DNA, 201 bp, Bos taurus; identical to SEQ ID NO: 9702

SEQ ID NO: 51093 - DNA, 201 bp, Bos taurus
tcggatattagaaactcatcttcttgaaatatcttacttacctagaactgcctggtcacctaactgagatttatttccaaaatctcatttggaaaaattagggagattatttcttggggaaatattacacatcacaatgggagaacattttatttcagagaaatggttcttttccatttgatctgcctttaaaatccaccc

SEQ ID NO: 51094 - DNA, 201 bp, Bos taurus
gcagcagcagggctatctgggaaggcatatacaattgattggtgtgtgtaattgtcagacgtattgaatggacacttaagatctgtgcatgttaatgcccgtaatttataccccaattaaaatgacagtcacatagataaaggtgtctatgtgggattctgcagggaagttctatgaccctggaaactttttgcagaggaa

SEQ ID NO: 51095 - DNA, 201 bp, Bos taurus; identical to SEQ ID NO: 9703

SEQ ID NO: 51096 - DNA, 201 bp, Bos taurus
ggtggacgtggggagacaccactgttatctatacatgtgcaacaacggctatagcaaactcaggccttccctcataaataaaatcttatgatcatgtgacgttctgttttcctattgtcaggagtgatgggagcatctcatttgcaaagagtcttgggaaaacaaaatctgtagaaaacatcatgagatctcaccctttgc

SEQ ID NO: 51097 - DNA, 201 bp, Bos taurus
tgggtatggggcccgctgccactgtgtgagctgccagcaataccatccttgcttccacatgtccacaaaggcagctctcgagactggaagcttctttagctgggcagaaggccaagcggggcgagctggcgagctttttatctcggctctgaactcgtgctctgaggttcagacttaactcagattctcacatgttgggga

SEQ ID NO: 51098 - DNA, 201 bp, Bos taurus
acctgggggagttctcgcataatcccatgctgtttacatttttccagacctctccccagattcccaccttggcttctgctggccattgactcctcactgttgtctttaagtttggtttgggctctgcaaggtctcaagcaacaaaagtgaggttgacttcactctggcccagagacagcatagctcccctacaatgtatgg

SEQ ID NO: 51099 - DNA, 201 bp, Bos taurus
gagagtcttgtctggagggtcggccacttcaccccacgctgcatgtagtatgaaagctgccgcatcaaacatagagacactaatcactggtaactattcttggccctgctaagtgatgcttttcctgctgtgttcctgaaaattcagcttctcatctagaattcatccggagtgcctgcccgtgaattaataattttgagt

SEQ ID NO: 51100 - DNA, 201 bp, Bos taurus; identical to SEQ ID NO: 9704

SEQ ID NO: 51101 - DNA, 201 bp, Bos taurus; identical to SEQ ID NO: 9706

SEQ ID NO: 51102 - DNA, 201 bp, Bos taurus; identical to SEQ ID NO: 9707

SEQ ID NO: 51103 - DNA, 201 bp, Bos taurus; identical to SEQ ID NO: 9709

SEQ ID NO: 51104 - DNA, 201 bp, Bos taurus; identical to SEQ ID NO: 9711

SEQ ID NO: 51105 - DNA, 201 bp, Bos taurus
acaaagtgtgtgaacaagcccacgacaatggggatttgattgaaacccaagccccgtgttctagaagtttccatggcctgtgagggatgccacgccctcccccacttcatcccacaccgatggaaaggtgaaggtttattactgtcattttcatttaatagaggccatcgtagcccctaaaggttaattaattttcacaag

SEQ ID NO: 51106 - DNA, 201 bp, Bos taurus; identical to SEQ ID NO: 9712

SEQ ID NO: 51107 - DNA, 201 bp, Bos taurus
tgaacagtcacgtccaacctgagcgccgatggccttgaccaccctgcctcccccgtggatgggggtggggatgtgctgggctgctgcatttggaggccagagcttcatacaaccaggctccctttcagcttccttccttctgtctgaggtccagcccgcatccggtcagcatgaaatacaccacagatgacctcgtccccg

SEQ ID NO: 51108 - DNA, 201 bp, Bos taurus
gtgcagtaactgtcacctacacagtgtaaccaagccccaggccgctgcatgttaacaagcggaggtgggcttttcagcttcctgacatcacaaggtcaccgggcagacactcacacatggccagttggaggggtggttgtcccatccagtcttaaccgacttagcttgaactagacacagctgactccaagttcttggaac

SEQ ID NO: 51109 - DNA, 201 bp, Bos taurus; identical to SEQ ID NO: 9713

SEQ ID NO: 51110 - DNA, 201 bp, Bos taurus; identical to SEQ ID NO: 9714

SEQ ID NO: 51111 - DNA, 201 bp, Bos taurus; identical to SEQ ID NO: 9715

SEQ ID NO: 51112 - DNA, 201 bp, Bos taurus; identical to SEQ ID NO: 9716

SEQ ID NO: 51113 - DNA, 201 bp, Bos taurus; identical to SEQ ID NO: 9717

SEQ ID NO: 51114 - DNA, 201 bp, Bos taurus; identical to SEQ ID NO: 9718

SEQ ID NO: 51115 - DNA, 201 bp, Bos taurus; identical to SEQ ID NO: 9719

SEQ ID NO: 51116 - DNA, 201 bp, Bos taurus; identical to SEQ ID NO: 9720

SEQ ID NO: 51117 - DNA, 201 bp, Bos taurus
gggaccccagagccctggagcacagagatgctgttctctctttagcgaggaaataacagtaggataggagtggatttcattcttcaaggaacagagaccacgtgtgtgattggcagagctccctcgggaagacaggttctcatttagccagtctgagtgacaccttgaacaccatggctatcgatgggtatttgtgaggag

SEQ ID NO: 51118 - DNA, 201 bp, Bos taurus; identical to SEQ ID NO: 9721

SEQ ID NO: 51119 - DNA, 201 bp, Bos taurus; identical to SEQ ID NO: 9722

SEQ ID NO: 51120 - DNA, 201 bp, Bos taurus
agctcccattgctgaaggcacctcctaaactctttaaaatttatttatctaattaaaaacctctcagcagcccaacacactggaagatttcatttttaaccaacacacagtcaacccaacctgtctgggcagggcagtcccatcccaggagcatcacccccaccgggccttgggaggccagggtgaccagaacagccatcc

SEQ ID NO: 51121 - DNA, 201 bp, Bos taurus; identical to SEQ ID NO: 9724

SEQ ID NO: 51122 - DNA, 201 bp, Bos taurus
gaagaggcaggtatagccagagttctatgttcagcaggagtaagatgaggaagcttccaattatcagtttctgtgttctaggactagaggctgcagatcagatctgcagagacaaagaccaaaggagtgatggatcggaagagagtgaagaagatctaagaacgtgtggcaggcaggtggagaccgagctgaaggcagaag

SEQ ID NO: 51123 - DNA, 201 bp, Bos taurus; identical to SEQ ID NO: 9726

SEQ ID NO: 51124 - DNA, 201 bp, Bos taurus; identical to SEQ ID NO: 9728

SEQ ID NO: 51125 - DNA, 201 bp, Bos taurus; identical to SEQ ID NO: 9729

SEQ ID NO: 51126 - DNA, 201 bp, Bos taurus; identical to SEQ ID NO: 9730

SEQ ID NO: 51127 - DNA, 201 bp, Bos taurus; identical to SEQ ID NO: 9731

SEQ ID NO: 51128 - DNA, 201 bp, Bos taurus; identical to SEQ ID NO: 9732

SEQ ID NO: 51129 - DNA, 201 bp, Bos taurus; identical to SEQ ID NO: 9733

SEQ ID NO: 51130 - DNA, 201 bp, Bos taurus; identical to SEQ ID NO: 9735

SEQ ID NO: 51131 - DNA, 201 bp, Bos taurus; identical to SEQ ID NO: 9737

SEQ ID NO: 51132 - DNA, 201 bp, Bos taurus; identical to SEQ ID NO: 9738

SEQ ID NO: 51133 - DNA, 201 bp, Bos taurus; identical to SEQ ID NO: 9739

SEQ ID NO: 51134 - DNA, 201 bp, Bos taurus; identical to SEQ ID NO: 9744

SEQ ID NO: 51135 - DNA, 201 bp, Bos taurus; identical to SEQ ID NO: 9748

SEQ ID NO: 51136 - DNA, 201 bp, Bos taurus; identical to SEQ ID NO: 9751

SEQ ID NO: 51137 - DNA, 201 bp, Bos taurus; identical to SEQ ID NO: 9752

SEQ ID NO: 51138 - DNA, 201 bp, Bos taurus; identical to SEQ ID NO: 9753

SEQ ID NO: 51139 - DNA, 201 bp, Bos taurus; identical to SEQ ID NO: 9754

SEQ ID NO: 51140 - DNA, 201 bp, Bos taurus; identical to SEQ ID NO: 9755

SEQ ID NO: 51141 - DNA, 201 bp, Bos taurus; identical to SEQ ID NO: 9757

SEQ ID NO: 51142 - DNA, 201 bp, Bos taurus; identical to SEQ ID NO: 9759

SEQ ID NO: 51143 - DNA, 201 bp, Bos taurus; identical to SEQ ID NO: 9760

SEQ ID NO: 51144 - DNA, 201 bp, Bos taurus; identical to SEQ ID NO: 9761

SEQ ID NO: 51145 - DNA, 201 bp, Bos taurus; identical to SEQ ID NO: 9762

SEQ ID NO: 51146 - DNA, 201 bp, Bos taurus; identical to SEQ ID NO: 9763

SEQ ID NO: 51147 - DNA, 201 bp, Bos taurus; identical to SEQ ID NO: 9766

SEQ ID NO: 51148 - DNA, 201 bp, Bos taurus; identical to SEQ ID NO: 9769

SEQ ID NO: 51149 - DNA, 201 bp, Bos taurus; identical to SEQ ID NO: 9772

SEQ ID NO: 51150 - DNA, 201 bp, Bos taurus; identical to SEQ ID NO: 9773

SEQ ID NO: 51151 - DNA, 201 bp, Bos taurus; identical to SEQ ID NO: 9774

SEQ ID NO: 51152 - DNA, 201 bp, Bos taurus; identical to SEQ ID NO: 9775

SEQ ID NO: 51153 - DNA, 201 bp, Bos taurus; identical to SEQ ID NO: 9776

SEQ ID NO: 51154 - DNA, 201 bp, Bos taurus; identical to SEQ ID NO: 9777

SEQ ID NO: 51155 - DNA, 201 bp, Bos taurus; identical to SEQ ID NO: 9778

SEQ ID NO: 51156 - DNA, 201 bp, Bos taurus; identical to SEQ ID NO: 9780

SEQ ID NO: 51157 - DNA, 201 bp, Bos taurus; identical to SEQ ID NO: 9781

SEQ ID NO: 51158 - DNA, 201 bp, Bos taurus; identical to SEQ ID NO: 9782

SEQ ID NO: 51159 - DNA, 201 bp, Bos taurus; identical to SEQ ID NO: 9783

SEQ ID NO: 51160 - DNA, 201 bp, Bos taurus; identical to SEQ ID NO: 9784

SEQ ID NO: 51161 - DNA, 201 bp, Bos taurus; identical to SEQ ID NO: 9785

SEQ ID NO: 51162 - DNA, 201 bp, Bos taurus; identical to SEQ ID NO: 9786

SEQ ID NO: 51163 - DNA, 201 bp, Bos taurus; identical to SEQ ID NO: 9790

SEQ ID NO: 51164 - DNA, 201 bp, Bos taurus; identical to SEQ ID NO: 9792

SEQ ID NO: 51165 - DNA, 201 bp, Bos taurus; identical to SEQ ID NO: 9793

SEQ ID NO: 51166 - DNA, 201 bp, Bos taurus; identical to SEQ ID NO: 9795

SEQ ID NO: 51167 - DNA, 201 bp, Bos taurus; identical to SEQ ID NO: 9796

SEQ ID NO: 51168 - DNA, 201 bp, Bos taurus; identical to SEQ ID NO: 9799

SEQ ID NO: 51169 - DNA, 201 bp, Bos taurus; identical to SEQ ID NO: 9801

SEQ ID NO: 51170 - DNA, 201 bp, Bos taurus; identical to SEQ ID NO: 9802

SEQ ID NO: 51171 - DNA, 201 bp, Bos taurus; identical to SEQ ID NO: 9804

SEQ ID NO: 51172 - DNA, 201 bp, Bos taurus; identical to SEQ ID NO: 9805

SEQ ID NO: 51173 - DNA, 201 bp, Bos taurus; identical to SEQ ID NO: 9807

SEQ ID NO: 51174 - DNA, 201 bp, Bos taurus; identical to SEQ ID NO: 9808

SEQ ID NO: 51175 - DNA, 201 bp, Bos taurus; identical to SEQ ID NO: 9810

SEQ ID NO: 51176 - DNA, 201 bp, Bos taurus; identical to SEQ ID NO: 9811

SEQ ID NO: 51177 - DNA, 201 bp, Bos taurus; identical to SEQ ID NO: 9812

SEQ ID NO: 51178 - DNA, 201 bp, Bos taurus; identical to SEQ ID NO: 9813

SEQ ID NO: 51179 - DNA, 201 bp, Bos taurus; identical to SEQ ID NO: 9814

SEQ ID NO: 51180 - DNA, 201 bp, Bos taurus; identical to SEQ ID NO: 9815

SEQ ID NO: 51181 - DNA, 201 bp, Bos taurus; identical to SEQ ID NO: 9818

SEQ ID NO: 51182 - DNA, 201 bp, Bos taurus; identical to SEQ ID NO: 9819

SEQ ID NO: 51183 - DNA, 201 bp, Bos taurus; identical to SEQ ID NO: 9822

SEQ ID NO: 51184 - DNA, 201 bp, Bos taurus; identical to SEQ ID NO: 9823

SEQ ID NO: 51185 - DNA, 201 bp, Bos taurus; identical to SEQ ID NO: 9825

SEQ ID NO: 51186 - DNA, 201 bp, Bos taurus; identical to SEQ ID NO: 9827

SEQ ID NO: 51187 - DNA, 201 bp, Bos taurus; identical to SEQ ID NO: 9828

SEQ ID NO: 51188 - DNA, 201 bp, Bos taurus; identical to SEQ ID NO: 9830

SEQ ID NO: 51189 - DNA, 201 bp, Bos taurus; identical to SEQ ID NO: 9831

SEQ ID NO: 51190 - DNA, 201 bp, Bos taurus; identical to SEQ ID NO: 9832

SEQ ID NO: 51191 - DNA, 201 bp, Bos taurus; identical to SEQ ID NO: 9834

SEQ ID NO: 51192 - DNA, 201 bp, Bos taurus; identical to SEQ ID NO: 9835

SEQ ID NO: 51193 - DNA, 201 bp, Bos taurus; identical to SEQ ID NO: 9836

SEQ ID NO: 51194 - DNA, 201 bp, Bos taurus
aagagtactggagtggggtgccattgtcttctccgattttgtactaagagctatacatatattttttccctctaataaggatccaactagctatatctgtccccactgaacagatgaggaacctgaggctcgaagcgaacatgtaatttccctgaagacacagagacctggggccaggtctgagattgaaacttgggatgc

SEQ ID NO: 51195 - DNA, 201 bp, Bos taurus; identical to SEQ ID NO: 9838

SEQ ID NO: 51196 - DNA, 201 bp, Bos taurus; identical to SEQ ID NO: 9841

SEQ ID NO: 51197 - DNA, 201 bp, Bos taurus
ggactaagaaaaagtccaagaagctcaagtactgcgaccaaggggcagctcagaataaaagggatcttcaggttcaacaggggccaacccctggaggctgcatcatggatttatttgtcctttaacaccagagcaaagtcatataacaattgtgctatttcacttagaagtggaaattgatgttcagagaggccaggagac

SEQ ID NO: 51198 - DNA, 201 bp, Bos taurus; identical to SEQ ID NO: 9843

SEQ ID NO: 51199 - DNA, 201 bp, Bos taurus
aagtcatgagggaaaagataaaagatttaggggaaagatccaggaatcctaacatgcaaagacacaggttccagatggagacaaaataggagtagaaaaagaggcaaatatcaaactcagaccagaagaagatttccctgaactgaggaaagatctagatagcctgtgcactccctggaaacaaaagtgcttctggctaag

SEQ ID NO: 51200 - DNA, 201 bp, Bos taurus
ttactgctatggcaggaaatattccattcctcgggtcttataaggcagatattattggaatggggtgggggtaggggagatttttgcacactagacacattcagtcatatctggagatattcttcatcgtcataactgagtttgctactggcatctagtgggtagatgctgctaaatattctacaatgcacaggatacaca

SEQ ID NO: 51201 - DNA, 201 bp, Bos taurus
agactcattgaagataagccacgaacaagccataggcggtcttattctggaagcagatctaggtaatgtattgaagggtattgggggagacagtatttgctacaaacaaaagaaaattcaagcagcagtatttcaattactgctgaattgaaattaggtcaatttttagtttcttttgttattggcattgttgggttcttt

SEQ ID NO: 51202 - DNA, 201 bp, Bos taurus; identical to SEQ ID NO: 9844

SEQ ID NO: 51203 - DNA, 201 bp, Bos taurus; identical to SEQ ID NO: 9845

SEQ ID NO: 51204 - DNA, 201 bp, Bos taurus; identical to SEQ ID NO: 9846

SEQ ID NO: 51205 - DNA, 201 bp, Bos taurus
aggtgacagcaaagcatgggcctcctgcccgagatcctgggcccaaagggtcaagccgagatggtcactcccccaccccacaaaactccttgcttgggaaccccggacctccggcccctctgccttagcacgtgagagtcctcttctccacccctttcacctgcctctgtatttgacatgttcttacttgctgtgccctgc

SEQ ID NO: 51206 - DNA, 201 bp, Bos taurus; identical to SEQ ID NO: 9847

SEQ ID NO: 51207 - DNA, 201 bp, Bos taurus; identical to SEQ ID NO: 9850

SEQ ID NO: 51208 - DNA, 201 bp, Bos taurus; identical to SEQ ID NO: 9852

SEQ ID NO: 51209 - DNA, 201 bp, Bos taurus
atccatggtcagccctccctcgtcttgcggcccgatctcctccccaggctgcggagcctccccgggtctgaacctgctctcctccagcctctgggcccctatttctcccctgtgcctctaatccagctgaggaagggacttccgtttcttgaaaatccccagggggcctccatgcactctccctgtctggtccttcctggc

SEQ ID NO: 51210 - DNA, 201 bp, Bos taurus; identical to SEQ ID NO: 9855

SEQ ID NO: 51211 - DNA, 201 bp, Bos taurus; identical to SEQ ID NO: 9856

SEQ ID NO: 51212 - DNA, 201 bp, Bos taurus; identical to SEQ ID NO: 9857

SEQ ID NO: 51213 - DNA, 201 bp, Bos taurus; identical to SEQ ID NO: 9858

SEQ ID NO: 51214 - DNA, 201 bp, Bos taurus; identical to SEQ ID NO: 9859

SEQ ID NO: 51215 - DNA, 201 bp, Bos taurus; identical to SEQ ID NO: 9860

SEQ ID NO: 51216 - DNA, 201 bp, Bos taurus; identical to SEQ ID NO: 9861

SEQ ID NO: 51217 - DNA, 201 bp, Bos taurus; identical to SEQ ID NO: 9862

SEQ ID NO: 51218 - DNA, 201 bp, Bos taurus; identical to SEQ ID NO: 9863

SEQ ID NO: 51219 - DNA, 201 bp, Bos taurus; identical to SEQ ID NO: 9865

SEQ ID NO: 51220 - DNA, 201 bp, Bos taurus; identical to SEQ ID NO: 9866

SEQ ID NO: 51221 - DNA, 201 bp, Bos taurus; identical to SEQ ID NO: 9867

SEQ ID NO: 51222 - DNA, 201 bp, Bos taurus; identical to SEQ ID NO: 9868

SEQ ID NO: 51223 - DNA, 201 bp, Bos taurus; identical to SEQ ID NO: 9869

SEQ ID NO: 51224 - DNA, 201 bp, Bos taurus; identical to SEQ ID NO: 9870

SEQ ID NO: 51225 - DNA, 201 bp, Bos taurus; identical to SEQ ID NO: 9871

SEQ ID NO: 51226 - DNA, 201 bp, Bos taurus; identical to SEQ ID NO: 9872

SEQ ID NO: 51227 - DNA, 201 bp, Bos taurus; identical to SEQ ID NO: 9873

SEQ ID NO: 51228 - DNA, 201 bp, Bos taurus; identical to SEQ ID NO: 9874

SEQ ID NO: 51229 - DNA, 201 bp, Bos taurus; identical to SEQ ID NO: 9875

SEQ ID NO: 51230 - DNA, 201 bp, Bos taurus; identical to SEQ ID NO: 9876

SEQ ID NO: 51231 - DNA, 201 bp, Bos taurus; identical to SEQ ID NO: 9877

SEQ ID NO: 51232 - DNA, 201 bp, Bos taurus; identical to SEQ ID NO: 9878

SEQ ID NO: 51233 - DNA, 201 bp, Bos taurus; identical to SEQ ID NO: 9879

SEQ ID NO: 51234 - DNA, 201 bp, Bos taurus; identical to SEQ ID NO: 9880

SEQ ID NO: 51235 - DNA, 201 bp, Bos taurus; identical to SEQ ID NO: 9881

SEQ ID NO: 51236 - DNA, 201 bp, Bos taurus; identical to SEQ ID NO: 9882

SEQ ID NO: 51237 - DNA, 201 bp, Bos taurus; identical to SEQ ID NO: 9883

SEQ ID NO: 51238 - DNA, 201 bp, Bos taurus; identical to SEQ ID NO: 9884

SEQ ID NO: 51239 - DNA, 201 bp, Bos taurus; identical to SEQ ID NO: 9885

SEQ ID NO: 51240 - DNA, 201 bp, Bos taurus; identical to SEQ ID NO: 9886

SEQ ID NO: 51241 - DNA, 201 bp, Bos taurus; identical to SEQ ID NO: 9887

SEQ ID NO: 51242 - DNA, 201 bp, Bos taurus; identical to SEQ ID NO: 9888

SEQ ID NO: 51243 - DNA, 201 bp, Bos taurus; identical to SEQ ID NO: 9889

SEQ ID NO: 51244 - DNA, 201 bp, Bos taurus; identical to SEQ ID NO: 9890

SEQ ID NO: 51245 - DNA, 201 bp, Bos taurus; identical to SEQ ID NO: 9891

SEQ ID NO: 51246 - DNA, 201 bp, Bos taurus; identical to SEQ ID NO: 9892

SEQ ID NO: 51247 - DNA, 201 bp, Bos taurus; identical to SEQ ID NO: 9893

SEQ ID NO: 51248 - DNA, 201 bp, Bos taurus; identical to SEQ ID NO: 9894

SEQ ID NO: 51249 - DNA, 201 bp, Bos taurus; identical to SEQ ID NO: 9895

SEQ ID NO: 51250 - DNA, 201 bp, Bos taurus; identical to SEQ ID NO: 9896

SEQ ID NO: 51251 - DNA, 201 bp, Bos taurus; identical to SEQ ID NO: 9897

SEQ ID NO: 51252 - DNA, 201 bp, Bos taurus; identical to SEQ ID NO: 9898

SEQ ID NO: 51253 - DNA, 201 bp, Bos taurus; identical to SEQ ID NO: 9899

SEQ ID NO: 51254 - DNA, 201 bp, Bos taurus; identical to SEQ ID NO: 9900

SEQ ID NO: 51255 - DNA, 201 bp, Bos taurus; identical to SEQ ID NO: 9901

SEQ ID NO: 51256 - DNA, 201 bp, Bos taurus; identical to SEQ ID NO: 9902

SEQ ID NO: 51257 - DNA, 201 bp, Bos taurus; identical to SEQ ID NO: 9903

SEQ ID NO: 51258 - DNA, 201 bp, Bos taurus; identical to SEQ ID NO: 9904

SEQ ID NO: 51259 - DNA, 201 bp, Bos taurus; identical to SEQ ID NO: 9905

SEQ ID NO: 51260 - DNA, 201 bp, Bos taurus; identical to SEQ ID NO: 9906

SEQ ID NO: 51261 - DNA, 201 bp, Bos taurus; identical to SEQ ID NO: 9907

SEQ ID NO: 51262 - DNA, 201 bp, Bos taurus; identical to SEQ ID NO: 9908

SEQ ID NO: 51263 - DNA, 201 bp, Bos taurus; identical to SEQ ID NO: 9909

SEQ ID NO: 51264 - DNA, 201 bp, Bos taurus; identical to SEQ ID NO: 9910

SEQ ID NO: 51265 - DNA, 201 bp, Bos taurus; identical to SEQ ID NO: 9911

SEQ ID NO: 51266 - DNA, 201 bp, Bos taurus; identical to SEQ ID NO: 9912

SEQ ID NO: 51267 - DNA, 201 bp, Bos taurus; identical to SEQ ID NO: 9913

SEQ ID NO: 51268 - DNA, 201 bp, Bos taurus; identical to SEQ ID NO: 9914

SEQ ID NO: 51269 - DNA, 201 bp, Bos taurus; identical to SEQ ID NO: 9915

SEQ ID NO: 51270 - DNA, 201 bp, Bos taurus; identical to SEQ ID NO: 9917

SEQ ID NO: 51271 - DNA, 201 bp, Bos taurus; identical to SEQ ID NO: 9918

SEQ ID NO: 51272 - DNA, 201 bp, Bos taurus; identical to SEQ ID NO: 9919

SEQ ID NO: 51273 - DNA, 201 bp, Bos taurus; identical to SEQ ID NO: 9920

SEQ ID NO: 51274 - DNA, 201 bp, Bos taurus; identical to SEQ ID NO: 9921

SEQ ID NO: 51275 - DNA, 201 bp, Bos taurus; identical to SEQ ID NO: 9922

SEQ ID NO: 51276 - DNA, 201 bp, Bos taurus; identical to SEQ ID NO: 9923

SEQ ID NO: 51277 - DNA, 201 bp, Bos taurus; identical to SEQ ID NO: 9924

SEQ ID NO: 51278 - DNA, 201 bp, Bos taurus; identical to SEQ ID NO: 9925

SEQ ID NO: 51279 - DNA, 201 bp, Bos taurus; identical to SEQ ID NO: 9926

SEQ ID NO: 51280 - DNA, 201 bp, Bos taurus; identical to SEQ ID NO: 9927

SEQ ID NO: 51281 - DNA, 201 bp, Bos taurus; identical to SEQ ID NO: 9928

SEQ ID NO: 51282 - DNA, 201 bp, Bos taurus; identical to SEQ ID NO: 9929

SEQ ID NO: 51283 - DNA, 201 bp, Bos taurus; identical to SEQ ID NO: 9930

SEQ ID NO: 51284 - DNA, 201 bp, Bos taurus; identical to SEQ ID NO: 9931

SEQ ID NO: 51285 - DNA, 201 bp, Bos taurus; identical to SEQ ID NO: 9932

SEQ ID NO: 51286 - DNA, 201 bp, Bos taurus; identical to SEQ ID NO: 9933

SEQ ID NO: 51287 - DNA, 201 bp, Bos taurus; identical to SEQ ID NO: 9934

SEQ ID NO: 51288 - DNA, 201 bp, Bos taurus; identical to SEQ ID NO: 9935

SEQ ID NO: 51289 - DNA, 201 bp, Bos taurus
aagctcagtctaggctgtcatttacaattgccttgttattttaaaagtggccgtttctggattttattattttctcttcatctcgatcatttttctccaatgtgtttctccaccattcggtcacccttgggcagctctcagttgactctacccggaaaacctctgctgtaagatttcagctgtgcgtttgctgtagctgac

SEQ ID NO: 51290 - DNA, 201 bp, Bos taurus
tttttgaattcatcagagaaatatatgtacagctcataacaggaatagaagctgcaaagataattcacccactttaagtgccaagtcacagtactcaccaccttccatcttaagtgaagtgtgacagtcgtcagtcatgtccaactctttgcggcctcatggactttagcctgccaggctcctctgtccatagaattctcc

SEQ ID NO: 51291 - DNA, 201 bp, Bos taurus; identical to SEQ ID NO: 9939

SEQ ID NO: 51292 - DNA, 201 bp, Bos taurus; identical to SEQ ID NO: 9940

SEQ ID NO: 51293 - DNA, 201 bp, Bos taurus; identical to SEQ ID NO: 9942

SEQ ID NO: 51294 - DNA, 201 bp, Bos taurus; identical to SEQ ID NO: 9943

SEQ ID NO: 51295 - DNA, 201 bp, Bos taurus; identical to SEQ ID NO: 9944

SEQ ID NO: 51296 - DNA, 201 bp, Bos taurus; identical to SEQ ID NO: 9945

SEQ ID NO: 51297 - DNA, 201 bp, Bos taurus; identical to SEQ ID NO: 9946

SEQ ID NO: 51298 - DNA, 201 bp, Bos taurus; identical to SEQ ID NO: 9947

SEQ ID NO: 51299 - DNA, 201 bp, Bos taurus; identical to SEQ ID NO: 9948

SEQ ID NO: 51300 - DNA, 201 bp, Bos taurus; identical to SEQ ID NO: 9949

SEQ ID NO: 51301 - DNA, 201 bp, Bos taurus; identical to SEQ ID NO: 9951

SEQ ID NO: 51302 - DNA, 201 bp, Bos taurus; identical to SEQ ID NO: 9952

SEQ ID NO: 51303 - DNA, 201 bp, Bos taurus; identical to SEQ ID NO: 9953

SEQ ID NO: 51304 - DNA, 201 bp, Bos taurus; identical to SEQ ID NO: 9954

SEQ ID NO: 51305 - DNA, 201 bp, Bos taurus; identical to SEQ ID NO: 9955

SEQ ID NO: 51306 - DNA, 201 bp, Bos taurus; identical to SEQ ID NO: 9956

SEQ ID NO: 51307 - DNA, 201 bp, Bos taurus; identical to SEQ ID NO: 9957

SEQ ID NO: 51308 - DNA, 201 bp, Bos taurus; identical to SEQ ID NO: 9958

SEQ ID NO: 51309 - DNA, 201 bp, Bos taurus; identical to SEQ ID NO: 9959

SEQ ID NO: 51310 - DNA, 201 bp, Bos taurus; identical to SEQ ID NO: 9960

SEQ ID NO: 51311 - DNA, 201 bp, Bos taurus; identical to SEQ ID NO: 9961

SEQ ID NO: 51312 - DNA, 201 bp, Bos taurus; identical to SEQ ID NO: 9962

SEQ ID NO: 51313 - DNA, 201 bp, Bos taurus; identical to SEQ ID NO: 9963

SEQ ID NO: 51314 - DNA, 201 bp, Bos taurus; identical to SEQ ID NO: 9964

SEQ ID NO: 51315 - DNA, 201 bp, Bos taurus; identical to SEQ ID NO: 9965

SEQ ID NO: 51316 - DNA, 201 bp, Bos taurus; identical to SEQ ID NO: 9966

SEQ ID NO: 51317 - DNA, 201 bp, Bos taurus; identical to SEQ ID NO: 9967

SEQ ID NO: 51318 - DNA, 201 bp, Bos taurus; identical to SEQ ID NO: 9968

SEQ ID NO: 51319 - DNA, 201 bp, Bos taurus; identical to SEQ ID NO: 9969

SEQ ID NO: 51320 - DNA, 201 bp, Bos taurus; identical to SEQ ID NO: 9970

SEQ ID NO: 51321 - DNA, 201 bp, Bos taurus; identical to SEQ ID NO: 9971

SEQ ID NO: 51322 - DNA, 201 bp, Bos taurus; identical to SEQ ID NO: 9972

SEQ ID NO: 51323 - DNA, 201 bp, Bos taurus; identical to SEQ ID NO: 9973

SEQ ID NO: 51324 - DNA, 201 bp, Bos taurus; identical to SEQ ID NO: 9974

SEQ ID NO: 51325 - DNA, 201 bp, Bos taurus; identical to SEQ ID NO: 9975

SEQ ID NO: 51326 - DNA, 201 bp, Bos taurus; identical to SEQ ID NO: 9976

SEQ ID NO: 51327 - DNA, 201 bp, Bos taurus; identical to SEQ ID NO: 9977

SEQ ID NO: 51328 - DNA, 201 bp, Bos taurus; identical to SEQ ID NO: 9978

SEQ ID NO: 51329 - DNA, 201 bp, Bos taurus; identical to SEQ ID NO: 9979

SEQ ID NO: 51330 - DNA, 201 bp, Bos taurus; identical to SEQ ID NO: 9980

SEQ ID NO: 51331 - DNA, 201 bp, Bos taurus; identical to SEQ ID NO: 9981

SEQ ID NO: 51332 - DNA, 201 bp, Bos taurus; identical to SEQ ID NO: 9982

SEQ ID NO: 51333 - DNA, 201 bp, Bos taurus; identical to SEQ ID NO: 9983

SEQ ID NO: 51334 - DNA, 201 bp, Bos taurus; identical to SEQ ID NO: 9984

SEQ ID NO: 51335 - DNA, 201 bp, Bos taurus; identical to SEQ ID NO: 9985

SEQ ID NO: 51336 - DNA, 201 bp, Bos taurus; identical to SEQ ID NO: 9986

SEQ ID NO: 51337 - DNA, 201 bp, Bos taurus; identical to SEQ ID NO: 9987

SEQ ID NO: 51338 - DNA, 201 bp, Bos taurus; identical to SEQ ID NO: 9988

SEQ ID NO: 51339 - DNA, 201 bp, Bos taurus; identical to SEQ ID NO: 9989

SEQ ID NO: 51340 - DNA, 201 bp, Bos taurus; identical to SEQ ID NO: 9990

SEQ ID NO: 51341 - DNA, 201 bp, Bos taurus; identical to SEQ ID NO: 9991

SEQ ID NO: 51342 - DNA, 201 bp, Bos taurus; identical to SEQ ID NO: 9992

SEQ ID NO: 51343 - DNA, 201 bp, Bos taurus; identical to SEQ ID NO: 9993

SEQ ID NO: 51344 - DNA, 201 bp, Bos taurus; identical to SEQ ID NO: 9994

SEQ ID NO: 51345 - DNA, 201 bp, Bos taurus; identical to SEQ ID NO: 9995

SEQ ID NO: 51346 - DNA, 201 bp, Bos taurus; identical to SEQ ID NO: 9996

SEQ ID NO: 51347 - DNA, 201 bp, Bos taurus; identical to SEQ ID NO: 9997

SEQ ID NO: 51348 - DNA, 201 bp, Bos taurus; identical to SEQ ID NO: 9998

SEQ ID NO: 51349 - DNA, 201 bp, Bos taurus; identical to SEQ ID NO: 9999

SEQ ID NO: 51350 - DNA, 201 bp, Bos taurus; identical to SEQ ID NO: 10000

SEQ ID NO: 51351 - DNA, 201 bp, Bos taurus; identical to SEQ ID NO: 10001

SEQ ID NO: 51352 - DNA, 201 bp, Bos taurus; identical to SEQ ID NO: 10002

SEQ ID NO: 51353 - DNA, 201 bp, Bos taurus; identical to SEQ ID NO: 10003

SEQ ID NO: 51354 - DNA, 201 bp, Bos taurus; identical to SEQ ID NO: 10004

SEQ ID NO: 51355 - DNA, 201 bp, Bos taurus; identical to SEQ ID NO: 10005

SEQ ID NO: 51356 - DNA, 201 bp, Bos taurus; identical to SEQ ID NO: 10006

SEQ ID NO: 51357 - DNA, 201 bp, Bos taurus; identical to SEQ ID NO: 10007

SEQ ID NO: 51358 - DNA, 201 bp, Bos taurus; identical to SEQ ID NO: 10008

SEQ ID NO: 51359 - DNA, 201 bp, Bos taurus; identical to SEQ ID NO: 10009

SEQ ID NO: 51360 - DNA, 201 bp, Bos taurus; identical to SEQ ID NO: 10010

SEQ ID NO: 51361 - DNA, 201 bp, Bos taurus; identical to SEQ ID NO: 10011

SEQ ID NO: 51362 - DNA, 201 bp, Bos taurus; identical to SEQ ID NO: 10012

SEQ ID NO: 51363 - DNA, 201 bp, Bos taurus; identical to SEQ ID NO: 10013

SEQ ID NO: 51364 - DNA, 201 bp, Bos taurus; identical to SEQ ID NO: 10014

SEQ ID NO: 51365 - DNA, 201 bp, Bos taurus; identical to SEQ ID NO: 10015

SEQ ID NO: 51366 - DNA, 201 bp, Bos taurus; identical to SEQ ID NO: 10016

SEQ ID NO: 51367 - DNA, 201 bp, Bos taurus; identical to SEQ ID NO: 10017

SEQ ID NO: 51368 - DNA, 201 bp, Bos taurus; identical to SEQ ID NO: 10018

SEQ ID NO: 51369 - DNA, 201 bp, Bos taurus; identical to SEQ ID NO: 10019

SEQ ID NO: 51370 - DNA, 201 bp, Bos taurus; identical to SEQ ID NO: 10020

SEQ ID NO: 51371 - DNA, 201 bp, Bos taurus; identical to SEQ ID NO: 10021

SEQ ID NO: 51372 - DNA, 201 bp, Bos taurus; identical to SEQ ID NO: 10022

SEQ ID NO: 51373 - DNA, 201 bp, Bos taurus; identical to SEQ ID NO: 10023

SEQ ID NO: 51374 - DNA, 201 bp, Bos taurus; identical to SEQ ID NO: 10024

SEQ ID NO: 51375 - DNA, 201 bp, Bos taurus; identical to SEQ ID NO: 10025

SEQ ID NO: 51376 - DNA, 201 bp, Bos taurus; identical to SEQ ID NO: 10026

SEQ ID NO: 51377 - DNA, 201 bp, Bos taurus; identical to SEQ ID NO: 10027

SEQ ID NO: 51378 - DNA, 201 bp, Bos taurus; identical to SEQ ID NO: 10028

SEQ ID NO: 51379 - DNA, 201 bp, Bos taurus; identical to SEQ ID NO: 10029

SEQ ID NO: 51380 - DNA, 201 bp, Bos taurus; identical to SEQ ID NO: 10030

SEQ ID NO: 51381 - DNA, 201 bp, Bos taurus; identical to SEQ ID NO: 10031

SEQ ID NO: 51382 - DNA, 201 bp, Bos taurus; identical to SEQ ID NO: 10032

SEQ ID NO: 51383 - DNA, 201 bp, Bos taurus; identical to SEQ ID NO: 10033

SEQ ID NO: 51384 - DNA, 201 bp, Bos taurus; identical to SEQ ID NO: 10034

SEQ ID NO: 51385 - DNA, 201 bp, Bos taurus; identical to SEQ ID NO: 10035

SEQ ID NO: 51386 - DNA, 201 bp, Bos taurus; identical to SEQ ID NO: 10036

SEQ ID NO: 51387 - DNA, 201 bp, Bos taurus; identical to SEQ ID NO: 10037

SEQ ID NO: 51388 - DNA, 201 bp, Bos taurus; identical to SEQ ID NO: 10038

SEQ ID NO: 51389 - DNA, 201 bp, Bos taurus; identical to SEQ ID NO: 10039

SEQ ID NO: 51390 - DNA, 201 bp, Bos taurus; identical to SEQ ID NO: 10040

SEQ ID NO: 51391 - DNA, 201 bp, Bos taurus; identical to SEQ ID NO: 10041

SEQ ID NO: 51392 - DNA, 201 bp, Bos taurus; identical to SEQ ID NO: 10042

SEQ ID NO: 51393 - DNA, 201 bp, Bos taurus; identical to SEQ ID NO: 10043

SEQ ID NO: 51394 - DNA, 201 bp, Bos taurus; identical to SEQ ID NO: 10044

SEQ ID NO: 51395 - DNA, 201 bp, Bos taurus; identical to SEQ ID NO: 10045

SEQ ID NO: 51396 - DNA, 201 bp, Bos taurus; identical to SEQ ID NO: 10046

SEQ ID NO: 51397 - DNA, 201 bp, Bos taurus; identical to SEQ ID NO: 10047

SEQ ID NO: 51398 - DNA, 201 bp, Bos taurus; identical to SEQ ID NO: 10048

SEQ ID NO: 51399 - DNA, 201 bp, Bos taurus; identical to SEQ ID NO: 10049

SEQ ID NO: 51400 - DNA, 201 bp, Bos taurus; identical to SEQ ID NO: 10050

SEQ ID NO: 51401 - DNA, 201 bp, Bos taurus; identical to SEQ ID NO: 10051

SEQ ID NO: 51402 - DNA, 201 bp, Bos taurus; identical to SEQ ID NO: 10052

SEQ ID NO: 51403 - DNA, 201 bp, Bos taurus; identical to SEQ ID NO: 10053

SEQ ID NO: 51404 - DNA, 201 bp, Bos taurus; identical to SEQ ID NO: 10054

SEQ ID NO: 51405 - DNA, 201 bp, Bos taurus; identical to SEQ ID NO: 10055

SEQ ID NO: 51406 - DNA, 201 bp, Bos taurus; identical to SEQ ID NO: 10056

SEQ ID NO: 51407 - DNA, 201 bp, Bos taurus; identical to SEQ ID NO: 10057

SEQ ID NO: 51408 - DNA, 201 bp, Bos taurus; identical to SEQ ID NO: 10058

SEQ ID NO: 51409 - DNA, 201 bp, Bos taurus; identical to SEQ ID NO: 10059

SEQ ID NO: 51410 - DNA, 201 bp, Bos taurus; identical to SEQ ID NO: 10060

SEQ ID NO: 51411 - DNA, 201 bp, Bos taurus; identical to SEQ ID NO: 10061

SEQ ID NO: 51412 - DNA, 201 bp, Bos taurus; identical to SEQ ID NO: 10062

SEQ ID NO: 51413 - DNA, 201 bp, Bos taurus; identical to SEQ ID NO: 10063

SEQ ID NO: 51414 - DNA, 201 bp, Bos taurus; identical to SEQ ID NO: 10064

SEQ ID NO: 51415 - DNA, 201 bp, Bos taurus; identical to SEQ ID NO: 10065

SEQ ID NO: 51416 - DNA, 201 bp, Bos taurus; identical to SEQ ID NO: 10066

SEQ ID NO: 51417 - DNA, 201 bp, Bos taurus; identical to SEQ ID NO: 10067

SEQ ID NO: 51418 - DNA, 201 bp, Bos taurus; identical to SEQ ID NO: 10068

SEQ ID NO: 51419 - DNA, 201 bp, Bos taurus; identical to SEQ ID NO: 10069

SEQ ID NO: 51420 - DNA, 201 bp, Bos taurus; identical to SEQ ID NO: 10070

SEQ ID NO: 51421 - DNA, 201 bp, Bos taurus; identical to SEQ ID NO: 10071

SEQ ID NO: 51422 - DNA, 201 bp, Bos taurus; identical to SEQ ID NO: 10072

SEQ ID NO: 51423 - DNA, 201 bp, Bos taurus; identical to SEQ ID NO: 10074

SEQ ID NO: 51424 - DNA, 201 bp, Bos taurus; identical to SEQ ID NO: 10075

SEQ ID NO: 51425 - DNA, 201 bp, Bos taurus; identical to SEQ ID NO: 10076

SEQ ID NO: 51426 - DNA, 201 bp, Bos taurus; identical to SEQ ID NO: 10077

SEQ ID NO: 51427 - DNA, 201 bp, Bos taurus; identical to SEQ ID NO: 10078

SEQ ID NO: 51428 - DNA, 201 bp, Bos taurus; identical to SEQ ID NO: 10079

SEQ ID NO: 51429 - DNA, 201 bp, Bos taurus; identical to SEQ ID NO: 10080

SEQ ID NO: 51430 - DNA, 201 bp, Bos taurus; identical to SEQ ID NO: 10081

SEQ ID NO: 51431 - DNA, 201 bp, Bos taurus; identical to SEQ ID NO: 10082

SEQ ID NO: 51432 - DNA, 201 bp, Bos taurus; identical to SEQ ID NO: 10083

SEQ ID NO: 51433 - DNA, 201 bp, Bos taurus; identical to SEQ ID NO: 10084

SEQ ID NO: 51434 - DNA, 201 bp, Bos taurus; identical to SEQ ID NO: 10085

SEQ ID NO: 51435 - DNA, 201 bp, Bos taurus; identical to SEQ ID NO: 10086

SEQ ID NO: 51436 - DNA, 201 bp, Bos taurus; identical to SEQ ID NO: 10087

SEQ ID NO: 51437 - DNA, 201 bp, Bos taurus; identical to SEQ ID NO: 10088

SEQ ID NO: 51438 - DNA, 201 bp, Bos taurus; identical to SEQ ID NO: 10089

SEQ ID NO: 51439 - DNA, 201 bp, Bos taurus; identical to SEQ ID NO: 10090

SEQ ID NO: 51440 - DNA, 201 bp, Bos taurus; identical to SEQ ID NO: 10091

SEQ ID NO: 51441 - DNA, 201 bp, Bos taurus; identical to SEQ ID NO: 10092

SEQ ID NO: 51442 - DNA, 201 bp, Bos taurus; identical to SEQ ID NO: 10093

SEQ ID NO: 51443 - DNA, 201 bp, Bos taurus; identical to SEQ ID NO: 10094

SEQ ID NO: 51444 - DNA, 201 bp, Bos taurus; identical to SEQ ID NO: 10095

SEQ ID NO: 51445 - DNA, 201 bp, Bos taurus; identical to SEQ ID NO: 10096

SEQ ID NO: 51446 - DNA, 201 bp, Bos taurus; identical to SEQ ID NO: 10097

SEQ ID NO: 51447 - DNA, 201 bp, Bos taurus; identical to SEQ ID NO: 10098

SEQ ID NO: 51448 - DNA, 201 bp, Bos taurus; identical to SEQ ID NO: 10099

SEQ ID NO: 51449 - DNA, 201 bp, Bos taurus; identical to SEQ ID NO: 10100

SEQ ID NO: 51450 - DNA, 201 bp, Bos taurus; identical to SEQ ID NO: 10101

SEQ ID NO: 51451 - DNA, 201 bp, Bos taurus; identical to SEQ ID NO: 10102

SEQ ID NO: 51452 - DNA, 201 bp, Bos taurus; identical to SEQ ID NO: 10103

SEQ ID NO: 51453 - DNA, 201 bp, Bos taurus; identical to SEQ ID NO: 10104

SEQ ID NO: 51454 - DNA, 201 bp, Bos taurus; identical to SEQ ID NO: 10105

SEQ ID NO: 51455 - DNA, 201 bp, Bos taurus; identical to SEQ ID NO: 10106

SEQ ID NO: 51456 - DNA, 201 bp, Bos taurus; identical to SEQ ID NO: 10107

SEQ ID NO: 51457 - DNA, 201 bp, Bos taurus; identical to SEQ ID NO: 10108

SEQ ID NO: 51458 - DNA, 201 bp, Bos taurus; identical to SEQ ID NO: 10109

SEQ ID NO: 51459 - DNA, 201 bp, Bos taurus; identical to SEQ ID NO: 10110

SEQ ID NO: 51460 - DNA, 201 bp, Bos taurus; identical to SEQ ID NO: 10112

SEQ ID NO: 51461 - DNA, 201 bp, Bos taurus; identical to SEQ ID NO: 10113

SEQ ID NO: 51462 - DNA, 201 bp, Bos taurus
aggcaggagggaggctggcactccaggccaaggagcagccagcaccgagcccatcttgcccctgaagctgaggtgcagccccccacaccatgaggttgcggtcccaatgcagctacaaggggcctgagatcaggctccctgccctgtgttctcccgccagggccactctacactacatacacttgatgcccaacccctgtt

SEQ ID NO: 51463 - DNA, 201 bp, Bos taurus; identical to SEQ ID NO: 10114

SEQ ID NO: 51464 - DNA, 201 bp, Bos taurus; identical to SEQ ID NO: 10115

SEQ ID NO: 51465 - DNA, 201 bp, Bos taurus; identical to SEQ ID NO: 10116

SEQ ID NO: 51466 - DNA, 201 bp, Bos taurus; identical to SEQ ID NO: 10117

SEQ ID NO: 51467 - DNA, 201 bp, Bos taurus; identical to SEQ ID NO: 10118

SEQ ID NO: 51468 - DNA, 201 bp, Bos taurus; identical to SEQ ID NO: 10119

SEQ ID NO: 51469 - DNA, 201 bp, Bos taurus; identical to SEQ ID NO: 10120

SEQ ID NO: 51470 - DNA, 201 bp, Bos taurus; identical to SEQ ID NO: 10121

SEQ ID NO: 51471 - DNA, 201 bp, Bos taurus; identical to SEQ ID NO: 10122

SEQ ID NO: 51472 - DNA, 201 bp, Bos taurus; identical to SEQ ID NO: 10123

SEQ ID NO: 51473 - DNA, 201 bp, Bos taurus; identical to SEQ ID NO: 10129

SEQ ID NO: 51474 - DNA, 201 bp, Bos taurus; identical to SEQ ID NO: 10130

SEQ ID NO: 51475 - DNA, 201 bp, Bos taurus; identical to SEQ ID NO: 10131

SEQ ID NO: 51476 - DNA, 201 bp, Bos taurus; identical to SEQ ID NO: 10132

SEQ ID NO: 51477 - DNA, 201 bp, Bos taurus; identical to SEQ ID NO: 10134

SEQ ID NO: 51478 - DNA, 201 bp, Bos taurus; identical to SEQ ID NO: 10136

SEQ ID NO: 51479 - DNA, 201 bp, Bos taurus; identical to SEQ ID NO: 10137

SEQ ID NO: 51480 - DNA, 201 bp, Bos taurus; identical to SEQ ID NO: 10138

SEQ ID NO: 51481 - DNA, 201 bp, Bos taurus; identical to SEQ ID NO: 10140

SEQ ID NO: 51482 - DNA, 201 bp, Bos taurus; identical to SEQ ID NO: 10141

SEQ ID NO: 51483 - DNA, 201 bp, Bos taurus; identical to SEQ ID NO: 10142

SEQ ID NO: 51484 - DNA, 201 bp, Bos taurus; identical to SEQ ID NO: 10146

SEQ ID NO: 51485 - DNA, 201 bp, Bos taurus; identical to SEQ ID NO: 10149

SEQ ID NO: 51486 - DNA, 201 bp, Bos taurus; identical to SEQ ID NO: 10150

SEQ ID NO: 51487 - DNA, 201 bp, Bos taurus; identical to SEQ ID NO: 10151

SEQ ID NO: 51488 - DNA, 201 bp, Bos taurus; identical to SEQ ID NO: 10154

SEQ ID NO: 51489 - DNA, 201 bp, Bos taurus; identical to SEQ ID NO: 10155

SEQ ID NO: 51490 - DNA, 201 bp, Bos taurus; identical to SEQ ID NO: 10156

SEQ ID NO: 51491 - DNA, 201 bp, Bos taurus; identical to SEQ ID NO: 10157

SEQ ID NO: 51492 - DNA, 201 bp, Bos taurus; identical to SEQ ID NO: 10159

SEQ ID NO: 51493 - DNA, 201 bp, Bos taurus; identical to SEQ ID NO: 10160

SEQ ID NO: 51494 - DNA, 201 bp, Bos taurus; identical to SEQ ID NO: 10162

SEQ ID NO: 51495 - DNA, 201 bp, Bos taurus; identical to SEQ ID NO: 10163

SEQ ID NO: 51496 - DNA, 201 bp, Bos taurus; identical to SEQ ID NO: 10165

SEQ ID NO: 51497 - DNA, 201 bp, Bos taurus; identical to SEQ ID NO: 10166

SEQ ID NO: 51498 - DNA, 201 bp, Bos taurus; identical to SEQ ID NO: 10168

SEQ ID NO: 51499 - DNA, 201 bp, Bos taurus; identical to SEQ ID NO: 10169

SEQ ID NO: 51500 - DNA, 201 bp, Bos taurus; identical to SEQ ID NO: 10170

SEQ ID NO: 51501 - DNA, 201 bp, Bos taurus; identical to SEQ ID NO: 10171

SEQ ID NO: 51502 - DNA, 201 bp, Bos taurus
tgccagtttatatgttgaagtttctacccctagtaggtcagaaagtgaatgtatttgaagatagagtttctaaagaggtaactaaattgcagtgatgttataggcctgactctaatcccataggactgttgtcctcataaaaagaggaggtcaggacgcagccagacagaggcaagaccctgttaagttacaggagaggac

SEQ ID NO: 51503 - DNA, 201 bp, Bos taurus; identical to SEQ ID NO: 10173

SEQ ID NO: 51504 - DNA, 201 bp, Bos taurus; identical to SEQ ID NO: 10174

SEQ ID NO: 51505 - DNA, 201 bp, Bos taurus; identical to SEQ ID NO: 10176

SEQ ID NO: 51506 - DNA, 201 bp, Bos taurus
agactccaaggcccctgccatccctgtagttatatctctttacatacgcccatgaggatccctttcccaacctacctccagggcctgcctaaactcccattatccatcatctgaactcctaatacatcctggtacccttgctcatccacggtcccaggaaggtgcttctttccaggacatccttcccccacctccagtatc

SEQ ID NO: 51507 - DNA, 201 bp, Bos taurus; identical to SEQ ID NO: 10177

SEQ ID NO: 51508 - DNA, 201 bp, Bos taurus; identical to SEQ ID NO: 10180

SEQ ID NO: 51509 - DNA, 201 bp, Bos taurus; identical to SEQ ID NO: 10181

SEQ ID NO: 51510 - DNA, 201 bp, Bos taurus; identical to SEQ ID NO: 10184

SEQ ID NO: 51511 - DNA, 201 bp, Bos taurus; identical to SEQ ID NO: 10186

SEQ ID NO: 51512 - DNA, 201 bp, Bos taurus; identical to SEQ ID NO: 10187

SEQ ID NO: 51513 - DNA, 201 bp, Bos taurus; identical to SEQ ID NO: 10188

SEQ ID NO: 51514 - DNA, 201 bp, Bos taurus; identical to SEQ ID NO: 10189

SEQ ID NO: 51515 - DNA, 201 bp, Bos taurus; identical to SEQ ID NO: 10190

SEQ ID NO: 51516 - DNA, 201 bp, Bos taurus; identical to SEQ ID NO: 10191

SEQ ID NO: 51517 - DNA, 201 bp, Bos taurus; identical to SEQ ID NO: 10192

SEQ ID NO: 51518 - DNA, 201 bp, Bos taurus; identical to SEQ ID NO: 10193

SEQ ID NO: 51519 - DNA, 201 bp, Bos taurus; identical to SEQ ID NO: 10194

SEQ ID NO: 51520 - DNA, 201 bp, Bos taurus; identical to SEQ ID NO: 10197

SEQ ID NO: 51521 - DNA, 201 bp, Bos taurus; identical to SEQ ID NO: 10199

SEQ ID NO: 51522 - DNA, 201 bp, Bos taurus; identical to SEQ ID NO: 10200

SEQ ID NO: 51523 - DNA, 201 bp, Bos taurus; identical to SEQ ID NO: 10201

SEQ ID NO: 51524 - DNA, 201 bp, Bos taurus; identical to SEQ ID NO: 10202

SEQ ID NO: 51525 - DNA, 201 bp, Bos taurus
acttctgagtccaggagcccagtgttcacgtgagttatttgttgtattaaccaatgaggactaacctctctgtgaaaagcttctgtgtttaaggcactggactgatgaccctttggtgtgaattcataaattaatttctccagtgatttgagcaattaacaagaatatccgatacagcttttctaataggtacacatgcta

SEQ ID NO: 51526 - DNA, 201 bp, Bos taurus
tttctaccacttctctgggcaagactcagacctactgattgtgtttataattaaggaataacgagaaatacgactcaggggtacagataagcaggtacacgggaaacatccattttccttaaccttagtagatttcactgctcacttgcatgagtgcagaaggtataaatctctaaggaccctttactaaaatcgggaggg

SEQ ID NO: 51527 - DNA, 201 bp, Bos taurus; identical to SEQ ID NO: 10203

SEQ ID NO: 51528 - DNA, 201 bp, Bos taurus; identical to SEQ ID NO: 10204

SEQ ID NO: 51529 - DNA, 201 bp, Bos taurus; identical to SEQ ID NO: 10205

SEQ ID NO: 51530 - DNA, 201 bp, Bos taurus; identical to SEQ ID NO: 10206

SEQ ID NO: 51531 - DNA, 201 bp, Bos taurus
aaatgggcaggggaattctgaactggagagaaggtgaaggatagtgtgtatagctggaatgggaagatagcttttgagatggaaaatgcacttaaactagccatgaacttgagagcatttgtgtagacaaaaagtcaccttaatgaaggcattcttgagaaatccacctttacatcatagcttattcaagaatataccact

SEQ ID NO: 51532 - DNA, 201 bp, Bos taurus
gctggcagaatccctgactacctttggtctttgctcatggaggatactatatttagctgtctagctaccaaaggttccattaattttggatatttcccctctacaatctgtttaagggcagtgacaagatatttcctgagtgacctgtcccttctgaaaagaatacataacctgaacgccagcactttttgtcatcaagat

SEQ ID NO: 51533 - DNA, 201 bp, Bos taurus
ctttgaaagctacattattcaatatgccagtggtcctttccataatggcaacatattagcaattcatgctgctctaatacagtggacttccttgatgtaccgcactccctacagacccagaggggcacccctgctttagctgcatgtgtcctgcacagcacctacccaagtgatggttggcaaaacagctgtgcagtggtc

SEQ ID NO: 51534 - DNA, 201 bp, Bos taurus
ttaaccaaaattaaactgtatttgcttgattgcatagatcctcttcctacagaaggcattgacttgagaggagggagaatattcagcttttagaaaatgacttgaaggcttttaaatgcgcacaattcatagtcttacagtagattaaaactggagcagaattacaataggagcagaagctcttacaaagaaaaaaaaaag

SEQ ID NO: 51535 - DNA, 201 bp, Bos taurus
aagagccacctgacatctgggttttgtctttcctcttctaattctatacaaatagttttcttgatttaagtaatcctaaatattcgtggcttctacctaacgtatacttcccattcacaccctaaaaagctgcactcagaaacaagccaacatttaatgatggaaaagtgatgctagcaattcacagaaatcacacgtcag

SEQ ID NO: 51536 - DNA, 201 bp, Bos taurus
cttcatgaatgaaagaactttaaagccagaaaaatctttaggattgaatgaaagaactttaaagccagagaaatctttaggattttttttaggtagatatgatatttaagtattaatccataatgtaacaatggaggaacaaccaagaacaatttatttccctataaaaatagttgcatttttattactatagaaggtatg

SEQ ID NO: 51537 - DNA, 201 bp, Bos taurus
caaagataaagcattaattccaaactttagaaaccattctcctatttcctcactgcccttattatttatagattttccacttttttttataccttgaattgtccagataataattttaattctccacatcaatcatggcaacaaacactgccacagaaataagtaaccttaggcaagtctctttacctcgcaattcctaat

SEQ ID NO: 51538 - DNA, 201 bp, Bos taurus
ttggcctttttttttttttttagttgcctcaagtcattttgaaaagaggtaggaagtctaaaaaatagttcaaaatataggagtccctttccccctctcgatgcatgatttctaaggccaattaaaatgccatttcctccaggaagcaacggggatttcctgaacttcaatccattagtactccttctgtaccaccagcac

SEQ ID NO: 51539 - DNA, 201 bp, Bos taurus
ttcactaattcaaaaatcacacattttcaagatagcaagagactcttcagctccaagttaggctgatggtggctgccaaatccctactcctcccatgaaatcgtccatggttgattaagaaagtgactctaccctcaacctgccctgtttccacaggtagtccctgatctctgccctgattaagtgcgccctgcttccttc

SEQ ID NO: 51540 - DNA, 201 bp, Bos taurus
aacccttacctttttcaccatggaataggcaacaataaagctaaatccttcagctgtttgatctttaagaaatccaccttaaagaactgaccttcaagaatagaatttttaaatggttatacaagcccattgaaagaaaaatcctcaatgatatggtactcatatatgtgatgctaatgtcatatactatgaaagcaggca

SEQ ID NO: 51541 - DNA, 201 bp, Bos taurus
cacacggttattgaaaatctaaacctatatgttgctttccctagtgtcactttatttaagattgcaggttgaagctattgtaatcttaggtaaatcagtaattaacttagcacaaagacataatagagagatgaaatcataagacctaagaggcatttttaaagaagaattttaataaatatctagcagaatataatcctt

SEQ ID NO: 51542 - DNA, 201 bp, Bos taurus
ttaatatctttggccaaaacaacatcacaacaagaaaccgacgagtttttctgtgggtgcaaatgatcacagacaagctcattttatttcatgtttacataaaaatacaaataattgtattagtacatcctcctaatccattcttggcttgagaattgtaagcgcatagaaagagaatttgttcccagagctttttcagct

SEQ ID NO: 51543 - DNA, 201 bp, Bos taurus
acgtgtacagcttatctaaacatgactgagataatccactgttgatgagtgattccaggtgtttgttaaattgcgatccatcaccaccaacacaaggttagcccagcaattcttatatatatatttatgtattcctatataagaatagtttgcataggttgacatatgcctcatttctctgtaagattccatatcttaaaa

SEQ ID NO: 51544 - DNA, 201 bp, Bos taurus
agatgttttaagagtcatttctattaataatctgtagttaacagatctgaatctctcaatctagtgttttacttcacaaaattctaattcccagaagtcagaaattaatcttaatggagtaatatagttttaatcagcccataaggttaataaattgggttgattgaaatacacatcattagacagcgaattttggcagat

SEQ ID NO: 51545 - DNA, 201 bp, Bos taurus; identical to SEQ ID NO: 10211

SEQ ID NO: 51546 - DNA, 201 bp, Bos taurus; identical to SEQ ID NO: 10216

SEQ ID NO: 51547 - DNA, 201 bp, Bos taurus; identical to SEQ ID NO: 10217

SEQ ID NO: 51548 - DNA, 201 bp, Bos taurus; identical to SEQ ID NO: 10219

SEQ ID NO: 51549 - DNA, 201 bp, Bos taurus; identical to SEQ ID NO: 10220

SEQ ID NO: 51550 - DNA, 201 bp, Bos taurus; identical to SEQ ID NO: 10222

SEQ ID NO: 51551 - DNA, 201 bp, Bos taurus; identical to SEQ ID NO: 10223

SEQ ID NO: 51552 - DNA, 201 bp, Bos taurus; identical to SEQ ID NO: 10224

SEQ ID NO: 51553 - DNA, 201 bp, Bos taurus; identical to SEQ ID NO: 10225

SEQ ID NO: 51554 - DNA, 201 bp, Bos taurus; identical to SEQ ID NO: 10226

SEQ ID NO: 51555 - DNA, 201 bp, Bos taurus; identical to SEQ ID NO: 10227

SEQ ID NO: 51556 - DNA, 201 bp, Bos taurus; identical to SEQ ID NO: 10228

SEQ ID NO: 51557 - DNA, 201 bp, Bos taurus; identical to SEQ ID NO: 10229

SEQ ID NO: 51558 - DNA, 201 bp, Bos taurus; identical to SEQ ID NO: 10230

SEQ ID NO: 51559 - DNA, 201 bp, Bos taurus; identical to SEQ ID NO: 10231

SEQ ID NO: 51560 - DNA, 201 bp, Bos taurus; identical to SEQ ID NO: 10233

SEQ ID NO: 51561 - DNA, 201 bp, Bos taurus; identical to SEQ ID NO: 10239

SEQ ID NO: 51562 - DNA, 201 bp, Bos taurus; identical to SEQ ID NO: 10240

SEQ ID NO: 51563 - DNA, 201 bp, Bos taurus
aggcctcctagggggagagtccatgctgagaatgaggagcatcagcagggagaaggggtgttgggatgcaccaggggaagggaggaggaagcatgctccaggcagagagaacagaagcacaaaggccagatggcaaaagagcaggagtccctggaaatgtagcgtggctggagaagatgcaacagggaggagggttggcag

SEQ ID NO: 51564 - DNA, 201 bp, Bos taurus; identical to SEQ ID NO: 10242

SEQ ID NO: 51565 - DNA, 201 bp, Bos taurus
tgcacaggacaaaccaagctcagacctggttctgcatgggttctggcctccagggtatcttctttgaaatttcctacggcctcctctagtgcctggggtcgccgagagccagcagagccccttggtggggcatcctagcttggaccagggtccacgtgggccccagttccttttgatccccaccccctgtgctctccgacc

SEQ ID NO: 51566 - DNA, 201 bp, Bos taurus; identical to SEQ ID NO: 10243

SEQ ID NO: 51567 - DNA, 201 bp, Bos taurus; identical to SEQ ID NO: 10244

SEQ ID NO: 51568 - DNA, 201 bp, Bos taurus; identical to SEQ ID NO: 10245

SEQ ID NO: 51569 - DNA, 201 bp, Bos taurus; identical to SEQ ID NO: 10246

SEQ ID NO: 51570 - DNA, 201 bp, Bos taurus
atgtgatgtcacacaattcatacagaaagtgttattaagaaaattagttacttagttctggagagaaacatatccaacttaggcgtttgtaagaggaagaactagagtttgaattatgttctctccactctacatcgtaagggctttctacagtttcatgttgctggattaactaataaatttcccgattcactcatgtat

SEQ ID NO: 51571 - DNA, 201 bp, Bos taurus
gcagtgtggcctaagattctgtgagaaggaaaaggaaacacatacctagaatatttattaattataattaattgggataaattacagctctttccagagtggaagaggcccaatgtaatagactggccagcatggggctggtggatgtttttcaagggatagtgctgcagcaggggctctggattttttctgggttgccat

SEQ ID NO: 51572 - DNA, 201 bp, Bos taurus
aacaaggactggaggcaaaccagaggctagatgagatgaggacggattttccctgctggtttcacagacagcaggccctacagacacctcggttttgaacgtccatccctcagagctgtgagcaatacattcatcctgctttacgccatgcagtttgtgttacttggttacagcagccctgggcgactaacagccacggct

SEQ ID NO: 51573 - DNA, 201 bp, Bos taurus; identical to SEQ ID NO: 10248

SEQ ID NO: 51574 - DNA, 201 bp, Bos taurus
gataactaaatatgagggatgatagtcaaatttgctttaaaatggatttttcaaagtaaaaccttaaagtttgatggtagaggttgttttgtgtgtttttttttttcaaataggcaaaaataagccagattaagaaaagttatataagaatcaactgtattactggactttttccctccaggattgcaggcaacttgaaaa

SEQ ID NO: 51575 - DNA, 201 bp, Bos taurus
gatcttctagttgaaaggatcgcagtaggcctcccaggtcagtgcttcgcaaactgaatttggagacttcaaggaacccacagaccattcttagggagaccgagggcctatcttctgaccatttttgttctctttctgttttcatgcatcttgatttcagtgtctctgtttgcacttaggtttacatgggcttaccaggtg

SEQ ID NO: 51576 - DNA, 201 bp, Bos taurus; identical to SEQ ID NO: 10251

SEQ ID NO: 51577 - DNA, 201 bp, Bos taurus; identical to SEQ ID NO: 10255

SEQ ID NO: 51578 - DNA, 201 bp, Bos taurus; identical to SEQ ID NO: 10256

SEQ ID NO: 51579 - DNA, 201 bp, Bos taurus; identical to SEQ ID NO: 10257

SEQ ID NO: 51580 - DNA, 201 bp, Bos taurus; identical to SEQ ID NO: 10260

SEQ ID NO: 51581 - DNA, 201 bp, Bos taurus; identical to SEQ ID NO: 10261

SEQ ID NO: 51582 - DNA, 201 bp, Bos taurus; identical to SEQ ID NO: 10262

SEQ ID NO: 51583 - DNA, 201 bp, Bos taurus; identical to SEQ ID NO: 10263

SEQ ID NO: 51584 - DNA, 201 bp, Bos taurus; identical to SEQ ID NO: 10264

SEQ ID NO: 51585 - DNA, 201 bp, Bos taurus; identical to SEQ ID NO: 10265

SEQ ID NO: 51586 - DNA, 201 bp, Bos taurus; identical to SEQ ID NO: 10268

SEQ ID NO: 51587 - DNA, 201 bp, Bos taurus; identical to SEQ ID NO: 10269

SEQ ID NO: 51588 - DNA, 201 bp, Bos taurus; identical to SEQ ID NO: 10270

SEQ ID NO: 51589 - DNA, 201 bp, Bos taurus; identical to SEQ ID NO: 10271

SEQ ID NO: 51590 - DNA, 201 bp, Bos taurus; identical to SEQ ID NO: 10272

SEQ ID NO: 51591 - DNA, 201 bp, Bos taurus; identical to SEQ ID NO: 10273

SEQ ID NO: 51592 - DNA, 201 bp, Bos taurus; identical to SEQ ID NO: 10274

SEQ ID NO: 51593 - DNA, 201 bp, Bos taurus; identical to SEQ ID NO: 10275

SEQ ID NO: 51594 - DNA, 201 bp, Bos taurus; identical to SEQ ID NO: 10276

SEQ ID NO: 51595 - DNA, 201 bp, Bos taurus; identical to SEQ ID NO: 10278

SEQ ID NO: 51596 - DNA, 201 bp, Bos taurus; identical to SEQ ID NO: 10279

SEQ ID NO: 51597 - DNA, 201 bp, Bos taurus; identical to SEQ ID NO: 10280

SEQ ID NO: 51598 - DNA, 201 bp, Bos taurus; identical to SEQ ID NO: 10281

SEQ ID NO: 51599 - DNA, 201 bp, Bos taurus; identical to SEQ ID NO: 10282

SEQ ID NO: 51600 - DNA, 201 bp, Bos taurus; identical to SEQ ID NO: 10284

SEQ ID NO: 51601 - DNA, 201 bp, Bos taurus; identical to SEQ ID NO: 10288

SEQ ID NO: 51602 - DNA, 201 bp, Bos taurus; identical to SEQ ID NO: 10289

SEQ ID NO: 51603 - DNA, 201 bp, Bos taurus; identical to SEQ ID NO: 10290

SEQ ID NO: 51604 - DNA, 201 bp, Bos taurus; identical to SEQ ID NO: 10291

SEQ ID NO: 51605 - DNA, 201 bp, Bos taurus; identical to SEQ ID NO: 10293

SEQ ID NO: 51606 - DNA, 201 bp, Bos taurus; identical to SEQ ID NO: 10294

SEQ ID NO: 51607 - DNA, 201 bp, Bos taurus; identical to SEQ ID NO: 10296

SEQ ID NO: 51608 - DNA, 201 bp, Bos taurus; identical to SEQ ID NO: 10298

SEQ ID NO: 51609 - DNA, 201 bp, Bos taurus; identical to SEQ ID NO: 10299

SEQ ID NO: 51610 - DNA, 201 bp, Bos taurus; identical to SEQ ID NO: 10301

SEQ ID NO: 51611 - DNA, 201 bp, Bos taurus; identical to SEQ ID NO: 10303

SEQ ID NO: 51612 - DNA, 201 bp, Bos taurus; identical to SEQ ID NO: 10304

SEQ ID NO: 51613 - DNA, 201 bp, Bos taurus; identical to SEQ ID NO: 10305

SEQ ID NO: 51614 - DNA, 201 bp, Bos taurus; identical to SEQ ID NO: 10306

SEQ ID NO: 51615 - DNA, 201 bp, Bos taurus; identical to SEQ ID NO: 10307

SEQ ID NO: 51616 - DNA, 201 bp, Bos taurus; identical to SEQ ID NO: 10308

SEQ ID NO: 51617 - DNA, 201 bp, Bos taurus; identical to SEQ ID NO: 10309

SEQ ID NO: 51618 - DNA, 201 bp, Bos taurus; identical to SEQ ID NO: 10311

SEQ ID NO: 51619 - DNA, 201 bp, Bos taurus; identical to SEQ ID NO: 10315

SEQ ID NO: 51620 - DNA, 201 bp, Bos taurus; identical to SEQ ID NO: 10316

SEQ ID NO: 51621 - DNA, 201 bp, Bos taurus; identical to SEQ ID NO: 10317

SEQ ID NO: 51622 - DNA, 201 bp, Bos taurus; identical to SEQ ID NO: 10318

SEQ ID NO: 51623 - DNA, 201 bp, Bos taurus; identical to SEQ ID NO: 10319

SEQ ID NO: 51624 - DNA, 201 bp, Bos taurus; identical to SEQ ID NO: 10320

SEQ ID NO: 51625 - DNA, 201 bp, Bos taurus; identical to SEQ ID NO: 10322

SEQ ID NO: 51626 - DNA, 201 bp, Bos taurus; identical to SEQ ID NO: 10323

SEQ ID NO: 51627 - DNA, 201 bp, Bos taurus; identical to SEQ ID NO: 10325

SEQ ID NO: 51628 - DNA, 201 bp, Bos taurus; identical to SEQ ID NO: 10327

SEQ ID NO: 51629 - DNA, 201 bp, Bos taurus; identical to SEQ ID NO: 10328

SEQ ID NO: 51630 - DNA, 201 bp, Bos taurus; identical to SEQ ID NO: 10329

SEQ ID NO: 51631 - DNA, 201 bp, Bos taurus; identical to SEQ ID NO: 10330

SEQ ID NO: 51632 - DNA, 201 bp, Bos taurus; identical to SEQ ID NO: 10331

SEQ ID NO: 51633 - DNA, 201 bp, Bos taurus; identical to SEQ ID NO: 10332

SEQ ID NO: 51634 - DNA, 201 bp, Bos taurus; identical to SEQ ID NO: 10334

SEQ ID NO: 51635 - DNA, 201 bp, Bos taurus; identical to SEQ ID NO: 10336

SEQ ID NO: 51636 - DNA, 201 bp, Bos taurus; identical to SEQ ID NO: 10337

SEQ ID NO: 51637 - DNA, 201 bp, Bos taurus; identical to SEQ ID NO: 10338

SEQ ID NO: 51638 - DNA, 201 bp, Bos taurus; identical to SEQ ID NO: 10340

SEQ ID NO: 51639 - DNA, 201 bp, Bos taurus; identical to SEQ ID NO: 10341

SEQ ID NO: 51640 - DNA, 201 bp, Bos taurus; identical to SEQ ID NO: 10343

SEQ ID NO: 51641 - DNA, 201 bp, Bos taurus; identical to SEQ ID NO: 10346

SEQ ID NO: 51642 - DNA, 201 bp, Bos taurus; identical to SEQ ID NO: 10347

SEQ ID NO: 51643 - DNA, 201 bp, Bos taurus; identical to SEQ ID NO: 10348

SEQ ID NO: 51644 - DNA, 201 bp, Bos taurus; identical to SEQ ID NO: 10349

SEQ ID NO: 51645 - DNA, 201 bp, Bos taurus; identical to SEQ ID NO: 10353

SEQ ID NO: 51646 - DNA, 201 bp, Bos taurus; identical to SEQ ID NO: 10356

SEQ ID NO: 51647 - DNA, 201 bp, Bos taurus; identical to SEQ ID NO: 10357

SEQ ID NO: 51648 - DNA, 201 bp, Bos taurus; identical to SEQ ID NO: 10358

SEQ ID NO: 51649 - DNA, 201 bp, Bos taurus; identical to SEQ ID NO: 10360

SEQ ID NO: 51650 - DNA, 201 bp, Bos taurus; identical to SEQ ID NO: 10362

SEQ ID NO: 51651 - DNA, 201 bp, Bos taurus; identical to SEQ ID NO: 10364

SEQ ID NO: 51652 - DNA, 201 bp, Bos taurus; identical to SEQ ID NO: 10366

SEQ ID NO: 51653 - DNA, 201 bp, Bos taurus; identical to SEQ ID NO: 10367

SEQ ID NO: 51654 - DNA, 201 bp, Bos taurus; identical to SEQ ID NO: 10368

SEQ ID NO: 51655 - DNA, 201 bp, Bos taurus; identical to SEQ ID NO: 10370

SEQ ID NO: 51656 - DNA, 201 bp, Bos taurus; identical to SEQ ID NO: 10371

SEQ ID NO: 51657 - DNA, 201 bp, Bos taurus; identical to SEQ ID NO: 10372

SEQ ID NO: 51658 - DNA, 201 bp, Bos taurus
ctgctttttcccctacaatcttatgtacaagtagtgaattatatttattcgcaactctccagaaaactcatggaattttttttctttagtctaataacatcgttggtactttagtttcacttataaaatattgtattgctttaatgaaagtaagagcaactcgtgacatttcaccatgtgttagtgctgaaaatgttttgc

SEQ ID NO: 51659 - DNA, 201 bp, Bos taurus; identical to SEQ ID NO: 10373

SEQ ID NO: 51660 - DNA, 201 bp, Bos taurus; identical to SEQ ID NO: 10374

SEQ ID NO: 51661 - DNA, 201 bp, Bos taurus; identical to SEQ ID NO: 10375

SEQ ID NO: 51662 - DNA, 201 bp, Bos taurus; identical to SEQ ID NO: 10378

SEQ ID NO: 51663 - DNA, 201 bp, Bos taurus; identical to SEQ ID NO: 10379

SEQ ID NO: 51664 - DNA, 201 bp, Bos taurus; identical to SEQ ID NO: 10380

SEQ ID NO: 51665 - DNA, 201 bp, Bos taurus; identical to SEQ ID NO: 10385

SEQ ID NO: 51666 - DNA, 201 bp, Bos taurus
atgtgacaatttaaccaagtgttatttgggctaaagaagttaggaaatatattcctgggtttcctaggaattatagagctgccagtggggtgatccatttccagtgtgaaccaaaggaagaaatgacagttttcacagacatgtgctatgctcttccaaggacaaagctcaaattcctgacagggctaagtaatccactta

SEQ ID NO: 51667 - DNA, 201 bp, Bos taurus
tggtggcctggttgaataattctagtcccttctcacttggaagtgaacagacaatagaagttaatttagtttctgaaagaggctttttagtcactggcagcaaccgggcaacagtaatttgcaaaccctgccctttattaaaattcattgttgctttcagagttagagaactgtaatttcagagatccaagcaagaccaaa

SEQ ID NO: 51668 - DNA, 201 bp, Bos taurus
tttgtttgtttagttttatttgcctatttttgtctgtgctgtgtcttgttgctacatgggctttgctctagttgtcaggagtgggggctactctctagttgcagtgtgagggcatctctgtggtgtcttctcttgttgctgagcacaggctctagggtgtgtgagattcagtagttgtggctctagggctctagagcacag

SEQ ID NO: 51669 - DNA, 201 bp, Bos taurus
gtggaagttccagcttatactacttcaaatgagtatgatctcatactcaaaatcagagcaagatcagttattttcagtatctaaataagtgtcacagtaattaaatgtaaataaaatttgattttaagaaaaataaatttctgcaaattattaagcttttttcttcttaataccaataattttgattttattttgtgactt

SEQ ID NO: 51670 - DNA, 201 bp, Bos taurus
tgatggcaaataatttcccatgtttaagggaaaagaaacagtgagactaaagtatggtgaaggtaaagttgctttgtatgagatgagtgagaagggtggatgaagaccagaatttctaggccttctgaggactgagtaaggagtcaaaatttaattcaaggttaatgaaaagtaaagcttggtagtgacatgtcagttgga

SEQ ID NO: 51671 - DNA, 201 bp, Bos taurus
ttaccctttatagatttctcctttgccaactcgtctcatattatttgcaccaaaactgaactagcggtcagtttctttattttttcatcatttttcaccttttagtatgcttttctctcaacctcaactgctccctctcatcggcttcctacatctattaaatgcagtttttccatatattttttttatataataattcag

SEQ ID NO: 51672 - DNA, 201 bp, Bos taurus; identical to SEQ ID NO: 10386

SEQ ID NO: 51673 - DNA, 201 bp, Bos taurus; identical to SEQ ID NO: 10387

SEQ ID NO: 51674 - DNA, 201 bp, Bos taurus; identical to SEQ ID NO: 10388

SEQ ID NO: 51675 - DNA, 201 bp, Bos taurus
aacattttcaagactcccgagctcttgatatatggtggtgaataacatagaacccttggctgagagaagctgttttggtgtgtgggtcaaatggaagagaatattttataggataggttgataacactgataaaaatgaaaggaactatggaagcacataagagacagttttcctgatctgtttactgcaaggagagcttt

SEQ ID NO: 51676 - DNA, 201 bp, Bos taurus; identical to SEQ ID NO: 10389

SEQ ID NO: 51677 - DNA, 201 bp, Bos taurus; identical to SEQ ID NO: 10390

SEQ ID NO: 51678 - DNA, 201 bp, Bos taurus; identical to SEQ ID NO: 10392

SEQ ID NO: 51679 - DNA, 201 bp, Bos taurus
gtgatagaaatgagaggtcacattctggaaggatcattttcatgggaatcagatcacaaaatataatgacaggaataatatggacaagagtagcaatagtccaagagctaaaatcttcaggtttcaagggatgagagtgtgtcttaagaagaggtcagttcagttcagttcagtcgctcagtcatgtctgactctttgcaa

SEQ ID NO: 51680 - DNA, 201 bp, Bos taurus; identical to SEQ ID NO: 10395

SEQ ID NO: 51681 - DNA, 201 bp, Bos taurus; identical to SEQ ID NO: 10396

SEQ ID NO: 51682 - DNA, 201 bp, Bos taurus
ccactgggatctgggtgtatctgtccattaaaatcagcactctgtggatttgttagtcctactccataaatcaggtactgacttgcgtcaggtcagctaacgtgaaaagctagtggagctgatggaattccagctgagccttttcagttctaaaagatgaggctattaaagtgctgcactcaatatgccagaaaatttgga

SEQ ID NO: 51683 - DNA, 201 bp, Bos taurus
gaagcagtagcaaacaaactacccttcttccttatcagtggttgattgttcttgctcctttacagcaaaacaaaagtctctaaatatgactgtatgtattaatcctgtcaaaaagtcagctatttttttaactcatccattaatacattttcattaaatatacagctgtagaaaaattcacactttataagcatgcatctc

SEQ ID NO: 51684 - DNA, 201 bp, Bos taurus; identical to SEQ ID NO: 10397

SEQ ID NO: 51685 - DNA, 201 bp, Bos taurus; identical to SEQ ID NO: 10398

SEQ ID NO: 51686 - DNA, 201 bp, Bos taurus; identical to SEQ ID NO: 10399

SEQ ID NO: 51687 - DNA, 201 bp, Bos taurus; identical to SEQ ID NO: 10401

SEQ ID NO: 51688 - DNA, 201 bp, Bos taurus
aatctagtaatgttatgtgtgaatcttttaattcccatataaagatgttgacactttattgtgcatataattttaatggaagctttcattaaagatttcataaagtatctcccacaaatattccaaggatcttctctccatttttttcacttcatttttctgtatgttcttaatcttgctagaaatctacaactaaatatt

SEQ ID NO: 51689 - DNA, 201 bp, Bos taurus; identical to SEQ ID NO: 10402

SEQ ID NO: 51690 - DNA, 201 bp, Bos taurus
ctggaaatctcatgaacagaagagcttggtgggggctacagtccatggggttgcaaagactcaaacacgactgagtgactaagcgtgtacacagggtttgtggagatgccatgaatacagataatatccctggtggtgatggcttgtgggatacccagggaagccaataactggtcagaaaaggtcattagggaccaagcc

SEQ ID NO: 51691 - DNA, 201 bp, Bos taurus; identical to SEQ ID NO: 10403

SEQ ID NO: 51692 - DNA, 201 bp, Bos taurus; identical to SEQ ID NO: 10404

SEQ ID NO: 51693 - DNA, 201 bp, Bos taurus; identical to SEQ ID NO: 10405

SEQ ID NO: 51694 - DNA, 201 bp, Bos taurus; identical to SEQ ID NO: 10406

SEQ ID NO: 51695 - DNA, 201 bp, Bos taurus; identical to SEQ ID NO: 10407

SEQ ID NO: 51696 - DNA, 201 bp, Bos taurus; identical to SEQ ID NO: 10408

SEQ ID NO: 51697 - DNA, 201 bp, Bos taurus; identical to SEQ ID NO: 10410

SEQ ID NO: 51698 - DNA, 201 bp, Bos taurus; identical to SEQ ID NO: 10412

SEQ ID NO: 51699 - DNA, 201 bp, Bos taurus
ttcattcttgcagtaaacataaggaaatggtttcagtcttgaaaatgtgcaaaaggcgggcaactctgccacctgtcatttgtcccttgtgtctttgtcactaatttgttttttactaggctgccagcatctcaagttatgctacttctagaaaagtttaattgggttttttgaccctttggtatgaactgtatactgata

SEQ ID NO: 51700 - DNA, 201 bp, Bos taurus; identical to SEQ ID NO: 10414

SEQ ID NO: 51701 - DNA, 201 bp, Bos taurus; identical to SEQ ID NO: 10415

SEQ ID NO: 51702 - DNA, 201 bp, Bos taurus; identical to SEQ ID NO: 10418

SEQ ID NO: 51703 - DNA, 201 bp, Bos taurus; identical to SEQ ID NO: 10419

SEQ ID NO: 51704 - DNA, 201 bp, Bos taurus; identical to SEQ ID NO: 10420

SEQ ID NO: 51705 - DNA, 201 bp, Bos taurus; identical to SEQ ID NO: 10421

SEQ ID NO: 51706 - DNA, 201 bp, Bos taurus; identical to SEQ ID NO: 10422

SEQ ID NO: 51707 - DNA, 201 bp, Bos taurus; identical to SEQ ID NO: 10423

SEQ ID NO: 51708 - DNA, 201 bp, Bos taurus; identical to SEQ ID NO: 10425

SEQ ID NO: 51709 - DNA, 201 bp, Bos taurus; identical to SEQ ID NO: 10426

SEQ ID NO: 51710 - DNA, 201 bp, Bos taurus; identical to SEQ ID NO: 10427

SEQ ID NO: 51711 - DNA, 201 bp, Bos taurus; identical to SEQ ID NO: 10428

SEQ ID NO: 51712 - DNA, 201 bp, Bos taurus; identical to SEQ ID NO: 10430

SEQ ID NO: 51713 - DNA, 201 bp, Bos taurus; identical to SEQ ID NO: 10431

SEQ ID NO: 51714 - DNA, 201 bp, Bos taurus; identical to SEQ ID NO: 10433

SEQ ID NO: 51715 - DNA, 201 bp, Bos taurus; identical to SEQ ID NO: 10435

SEQ ID NO: 51716 - DNA, 201 bp, Bos taurus; identical to SEQ ID NO: 10436

SEQ ID NO: 51717 - DNA, 201 bp, Bos taurus; identical to SEQ ID NO: 10437

SEQ ID NO: 51718 - DNA, 201 bp, Bos taurus; identical to SEQ ID NO: 10438

SEQ ID NO: 51719 - DNA, 201 bp, Bos taurus; identical to SEQ ID NO: 10439

SEQ ID NO: 51720 - DNA, 201 bp, Bos taurus; identical to SEQ ID NO: 10440

SEQ ID NO: 51721 - DNA, 201 bp, Bos taurus; identical to SEQ ID NO: 10441

SEQ ID NO: 51722 - DNA, 201 bp, Bos taurus; identical to SEQ ID NO: 10442

SEQ ID NO: 51723 - DNA, 201 bp, Bos taurus; identical to SEQ ID NO: 10443

SEQ ID NO: 51724 - DNA, 201 bp, Bos taurus; identical to SEQ ID NO: 10446

SEQ ID NO: 51725 - DNA, 201 bp, Bos taurus; identical to SEQ ID NO: 10447

SEQ ID NO: 51726 - DNA, 201 bp, Bos taurus; identical to SEQ ID NO: 10449

SEQ ID NO: 51727 - DNA, 201 bp, Bos taurus; identical to SEQ ID NO: 10450

SEQ ID NO: 51728 - DNA, 201 bp, Bos taurus; identical to SEQ ID NO: 10451

SEQ ID NO: 51729 - DNA, 201 bp, Bos taurus; identical to SEQ ID NO: 10453

SEQ ID NO: 51730 - DNA, 201 bp, Bos taurus; identical to SEQ ID NO: 10456

SEQ ID NO: 51731 - DNA, 201 bp, Bos taurus; identical to SEQ ID NO: 10457

SEQ ID NO: 51732 - DNA, 201 bp, Bos taurus; identical to SEQ ID NO: 10459

SEQ ID NO: 51733 - DNA, 201 bp, Bos taurus; identical to SEQ ID NO: 10460

SEQ ID NO: 51734 - DNA, 201 bp, Bos taurus; identical to SEQ ID NO: 10461

SEQ ID NO: 51735 - DNA, 201 bp, Bos taurus; identical to SEQ ID NO: 10463

SEQ ID NO: 51736 - DNA, 201 bp, Bos taurus; identical to SEQ ID NO: 10464

SEQ ID NO: 51737 - DNA, 201 bp, Bos taurus; identical to SEQ ID NO: 10465

SEQ ID NO: 51738 - DNA, 201 bp, Bos taurus; identical to SEQ ID NO: 10471

SEQ ID NO: 51739 - DNA, 201 bp, Bos taurus; identical to SEQ ID NO: 10472

SEQ ID NO: 51740 - DNA, 201 bp, Bos taurus; identical to SEQ ID NO: 10473

SEQ ID NO: 51741 - DNA, 201 bp, Bos taurus; identical to SEQ ID NO: 10474

SEQ ID NO: 51742 - DNA, 201 bp, Bos taurus; identical to SEQ ID NO: 10475

SEQ ID NO: 51743 - DNA, 201 bp, Bos taurus; identical to SEQ ID NO: 10476

SEQ ID NO: 51744 - DNA, 201 bp, Bos taurus; identical to SEQ ID NO: 10478

SEQ ID NO: 51745 - DNA, 201 bp, Bos taurus; identical to SEQ ID NO: 10481

SEQ ID NO: 51746 - DNA, 201 bp, Bos taurus; identical to SEQ ID NO: 10483

SEQ ID NO: 51747 - DNA, 201 bp, Bos taurus; identical to SEQ ID NO: 10484

SEQ ID NO: 51748 - DNA, 201 bp, Bos taurus; identical to SEQ ID NO: 10485

SEQ ID NO: 51749 - DNA, 201 bp, Bos taurus; identical to SEQ ID NO: 10487

SEQ ID NO: 51750 - DNA, 201 bp, Bos taurus; identical to SEQ ID NO: 10488

SEQ ID NO: 51751 - DNA, 201 bp, Bos taurus; identical to SEQ ID NO: 10489

SEQ ID NO: 51752 - DNA, 201 bp, Bos taurus; identical to SEQ ID NO: 10490

SEQ ID NO: 51753 - DNA, 201 bp, Bos taurus; identical to SEQ ID NO: 10491

SEQ ID NO: 51754 - DNA, 201 bp, Bos taurus; identical to SEQ ID NO: 10493

SEQ ID NO: 51755 - DNA, 201 bp, Bos taurus; identical to SEQ ID NO: 10494

SEQ ID NO: 51756 - DNA, 201 bp, Bos taurus; identical to SEQ ID NO: 10495

SEQ ID NO: 51757 - DNA, 201 bp, Bos taurus; identical to SEQ ID NO: 10496

SEQ ID NO: 51758 - DNA, 201 bp, Bos taurus; identical to SEQ ID NO: 10497

SEQ ID NO: 51759 - DNA, 201 bp, Bos taurus; identical to SEQ ID NO: 10498

SEQ ID NO: 51760 - DNA, 201 bp, Bos taurus; identical to SEQ ID NO: 10499

SEQ ID NO: 51761 - DNA, 201 bp, Bos taurus; identical to SEQ ID NO: 10501

SEQ ID NO: 51762 - DNA, 201 bp, Bos taurus; identical to SEQ ID NO: 10502

SEQ ID NO: 51763 - DNA, 201 bp, Bos taurus; identical to SEQ ID NO: 10504

SEQ ID NO: 51764 - DNA, 201 bp, Bos taurus; identical to SEQ ID NO: 10505

SEQ ID NO: 51765 - DNA, 201 bp, Bos taurus; identical to SEQ ID NO: 10506

SEQ ID NO: 51766 - DNA, 201 bp, Bos taurus; identical to SEQ ID NO: 10508

SEQ ID NO: 51767 - DNA, 201 bp, Bos taurus; identical to SEQ ID NO: 10510

SEQ ID NO: 51768 - DNA, 201 bp, Bos taurus; identical to SEQ ID NO: 10511

SEQ ID NO: 51769 - DNA, 201 bp, Bos taurus; identical to SEQ ID NO: 10512

SEQ ID NO: 51770 - DNA, 201 bp, Bos taurus; identical to SEQ ID NO: 10514

SEQ ID NO: 51771 - DNA, 201 bp, Bos taurus; identical to SEQ ID NO: 10517

SEQ ID NO: 51772 - DNA, 201 bp, Bos taurus; identical to SEQ ID NO: 10518

SEQ ID NO: 51773 - DNA, 201 bp, Bos taurus; identical to SEQ ID NO: 10519

SEQ ID NO: 51774 - DNA, 201 bp, Bos taurus; identical to SEQ ID NO: 10522

SEQ ID NO: 51775 - DNA, 201 bp, Bos taurus; identical to SEQ ID NO: 10524

SEQ ID NO: 51776 - DNA, 201 bp, Bos taurus; identical to SEQ ID NO: 10529

SEQ ID NO: 51777 - DNA, 201 bp, Bos taurus; identical to SEQ ID NO: 10531

SEQ ID NO: 51778 - DNA, 201 bp, Bos taurus; identical to SEQ ID NO: 10533

SEQ ID NO: 51779 - DNA, 201 bp, Bos taurus; identical to SEQ ID NO: 10535

SEQ ID NO: 51780 - DNA, 201 bp, Bos taurus; identical to SEQ ID NO: 10536

SEQ ID NO: 51781 - DNA, 201 bp, Bos taurus; identical to SEQ ID NO: 10539

SEQ ID NO: 51782 - DNA, 201 bp, Bos taurus; identical to SEQ ID NO: 10540

SEQ ID NO: 51783 - DNA, 201 bp, Bos taurus; identical to SEQ ID NO: 10541

SEQ ID NO: 51784 - DNA, 201 bp, Bos taurus; identical to SEQ ID NO: 10542

SEQ ID NO: 51785 - DNA, 201 bp, Bos taurus; identical to SEQ ID NO: 10543

SEQ ID NO: 51786 - DNA, 201 bp, Bos taurus; identical to SEQ ID NO: 10544

SEQ ID NO: 51787 - DNA, 201 bp, Bos taurus; identical to SEQ ID NO: 10545

SEQ ID NO: 51788 - DNA, 201 bp, Bos taurus; identical to SEQ ID NO: 10546

SEQ ID NO: 51789 - DNA, 201 bp, Bos taurus; identical to SEQ ID NO: 10548

SEQ ID NO: 51790 - DNA, 201 bp, Bos taurus; identical to SEQ ID NO: 10549

SEQ ID NO: 51791 - DNA, 201 bp, Bos taurus; identical to SEQ ID NO: 10550

SEQ ID NO: 51792 - DNA, 201 bp, Bos taurus; identical to SEQ ID NO: 10551

SEQ ID NO: 51793 - DNA, 201 bp, Bos taurus; identical to SEQ ID NO: 10552

SEQ ID NO: 51794 - DNA, 201 bp, Bos taurus; identical to SEQ ID NO: 10553

SEQ ID NO: 51795 - DNA, 201 bp, Bos taurus; identical to SEQ ID NO: 10554

SEQ ID NO: 51796 - DNA, 201 bp, Bos taurus; identical to SEQ ID NO: 10555

SEQ ID NO: 51797 - DNA, 201 bp, Bos taurus; identical to SEQ ID NO: 10556

SEQ ID NO: 51798 - DNA, 201 bp, Bos taurus; identical to SEQ ID NO: 10557

SEQ ID NO: 51799 - DNA, 201 bp, Bos taurus; identical to SEQ ID NO: 10558

SEQ ID NO: 51800 - DNA, 201 bp, Bos taurus; identical to SEQ ID NO: 10559

SEQ ID NO: 51801 - DNA, 201 bp, Bos taurus; identical to SEQ ID NO: 10560

SEQ ID NO: 51802 - DNA, 201 bp, Bos taurus; identical to SEQ ID NO: 10561

SEQ ID NO: 51803 - DNA, 201 bp, Bos taurus; identical to SEQ ID NO: 10562

SEQ ID NO: 51804 - DNA, 201 bp, Bos taurus; identical to SEQ ID NO: 10563

SEQ ID NO: 51805 - DNA, 201 bp, Bos taurus; identical to SEQ ID NO: 10564

SEQ ID NO: 51806 - DNA, 201 bp, Bos taurus; identical to SEQ ID NO: 10565

SEQ ID NO: 51807 - DNA, 201 bp, Bos taurus; identical to SEQ ID NO: 10566

SEQ ID NO: 51808 - DNA, 201 bp, Bos taurus; identical to SEQ ID NO: 10567

SEQ ID NO: 51809 - DNA, 201 bp, Bos taurus; identical to SEQ ID NO: 10568

SEQ ID NO: 51810 - DNA, 201 bp, Bos taurus; identical to SEQ ID NO: 10569

SEQ ID NO: 51811 - DNA, 201 bp, Bos taurus; identical to SEQ ID NO: 10570

SEQ ID NO: 51812 - DNA, 201 bp, Bos taurus; identical to SEQ ID NO: 10571

SEQ ID NO: 51813 - DNA, 201 bp, Bos taurus; identical to SEQ ID NO: 10572

SEQ ID NO: 51814 - DNA, 201 bp, Bos taurus; identical to SEQ ID NO: 10573

SEQ ID NO: 51815 - DNA, 201 bp, Bos taurus; identical to SEQ ID NO: 10574

SEQ ID NO: 51816 - DNA, 201 bp, Bos taurus; identical to SEQ ID NO: 10575

SEQ ID NO: 51817 - DNA, 201 bp, Bos taurus; identical to SEQ ID NO: 10576

SEQ ID NO: 51818 - DNA, 201 bp, Bos taurus; identical to SEQ ID NO: 10577

SEQ ID NO: 51819 - DNA, 201 bp, Bos taurus; identical to SEQ ID NO: 10578

SEQ ID NO: 51820 - DNA, 201 bp, Bos taurus; identical to SEQ ID NO: 10579

SEQ ID NO: 51821 - DNA, 201 bp, Bos taurus; identical to SEQ ID NO: 10580

SEQ ID NO: 51822 - DNA, 201 bp, Bos taurus; identical to SEQ ID NO: 10581

SEQ ID NO: 51823 - DNA, 201 bp, Bos taurus; identical to SEQ ID NO: 10582

SEQ ID NO: 51824 - DNA, 201 bp, Bos taurus; identical to SEQ ID NO: 10583

SEQ ID NO: 51825 - DNA, 201 bp, Bos taurus; identical to SEQ ID NO: 10584

SEQ ID NO: 51826 - DNA, 201 bp, Bos taurus; identical to SEQ ID NO: 10585

SEQ ID NO: 51827 - DNA, 201 bp, Bos taurus; identical to SEQ ID NO: 10586

SEQ ID NO: 51828 - DNA, 201 bp, Bos taurus; identical to SEQ ID NO: 10587

SEQ ID NO: 51829 - DNA, 201 bp, Bos taurus; identical to SEQ ID NO: 10588

SEQ ID NO: 51830 - DNA, 201 bp, Bos taurus; identical to SEQ ID NO: 10589

SEQ ID NO: 51831 - DNA, 201 bp, Bos taurus; identical to SEQ ID NO: 10590

SEQ ID NO: 51832 - DNA, 201 bp, Bos taurus; identical to SEQ ID NO: 10591

SEQ ID NO: 51833 - DNA, 201 bp, Bos taurus; identical to SEQ ID NO: 10592

SEQ ID NO: 51834 - DNA, 201 bp, Bos taurus; identical to SEQ ID NO: 10593

SEQ ID NO: 51835 - DNA, 201 bp, Bos taurus; identical to SEQ ID NO: 10594

SEQ ID NO: 51836 - DNA, 201 bp, Bos taurus; identical to SEQ ID NO: 10595

SEQ ID NO: 51837 - DNA, 201 bp, Bos taurus; identical to SEQ ID NO: 10599

SEQ ID NO: 51838 - DNA, 201 bp, Bos taurus; identical to SEQ ID NO: 10600

SEQ ID NO: 51839 - DNA, 201 bp, Bos taurus; identical to SEQ ID NO: 10601

SEQ ID NO: 51840 - DNA, 201 bp, Bos taurus; identical to SEQ ID NO: 10602

SEQ ID NO: 51841 - DNA, 201 bp, Bos taurus; identical to SEQ ID NO: 10603

SEQ ID NO: 51842 - DNA, 201 bp, Bos taurus; identical to SEQ ID NO: 10604

SEQ ID NO: 51843 - DNA, 201 bp, Bos taurus; identical to SEQ ID NO: 10605

SEQ ID NO: 51844 - DNA, 201 bp, Bos taurus; identical to SEQ ID NO: 10606

SEQ ID NO: 51845 - DNA, 201 bp, Bos taurus; identical to SEQ ID NO: 10607

SEQ ID NO: 51846 - DNA, 201 bp, Bos taurus; identical to SEQ ID NO: 10610

SEQ ID NO: 51847 - DNA, 201 bp, Bos taurus; identical to SEQ ID NO: 10611

SEQ ID NO: 51848 - DNA, 201 bp, Bos taurus; identical to SEQ ID NO: 10613

SEQ ID NO: 51849 - DNA, 201 bp, Bos taurus; identical to SEQ ID NO: 10614

SEQ ID NO: 51850 - DNA, 201 bp, Bos taurus; identical to SEQ ID NO: 10615

SEQ ID NO: 51851 - DNA, 201 bp, Bos taurus; identical to SEQ ID NO: 10616

SEQ ID NO: 51852 - DNA, 201 bp, Bos taurus; identical to SEQ ID NO: 10617

SEQ ID NO: 51853 - DNA, 201 bp, Bos taurus; identical to SEQ ID NO: 10619

SEQ ID NO: 51854 - DNA, 201 bp, Bos taurus; identical to SEQ ID NO: 10620

SEQ ID NO: 51855 - DNA, 201 bp, Bos taurus; identical to SEQ ID NO: 10621

SEQ ID NO: 51856 - DNA, 201 bp, Bos taurus; identical to SEQ ID NO: 10622

SEQ ID NO: 51857 - DNA, 201 bp, Bos taurus; identical to SEQ ID NO: 10623

SEQ ID NO: 51858 - DNA, 201 bp, Bos taurus; identical to SEQ ID NO: 10624

SEQ ID NO: 51859 - DNA, 201 bp, Bos taurus; identical to SEQ ID NO: 10627

SEQ ID NO: 51860 - DNA, 201 bp, Bos taurus; identical to SEQ ID NO: 10628

SEQ ID NO: 51861 - DNA, 201 bp, Bos taurus; identical to SEQ ID NO: 10629

SEQ ID NO: 51862 - DNA, 201 bp, Bos taurus; identical to SEQ ID NO: 10630

SEQ ID NO: 51863 - DNA, 201 bp, Bos taurus; identical to SEQ ID NO: 10631

SEQ ID NO: 51864 - DNA, 201 bp, Bos taurus; identical to SEQ ID NO: 10632

SEQ ID NO: 51865 - DNA, 201 bp, Bos taurus; identical to SEQ ID NO: 10633

SEQ ID NO: 51866 - DNA, 201 bp, Bos taurus; identical to SEQ ID NO: 10634

SEQ ID NO: 51867 - DNA, 201 bp, Bos taurus; identical to SEQ ID NO: 10635

SEQ ID NO: 51868 - DNA, 201 bp, Bos taurus; identical to SEQ ID NO: 10636

SEQ ID NO: 51869 - DNA, 201 bp, Bos taurus; identical to SEQ ID NO: 10637

SEQ ID NO: 51870 - DNA, 201 bp, Bos taurus; identical to SEQ ID NO: 10638

SEQ ID NO: 51871 - DNA, 201 bp, Bos taurus; identical to SEQ ID NO: 10639

SEQ ID NO: 51872 - DNA, 201 bp, Bos taurus; identical to SEQ ID NO: 10643

SEQ ID NO: 51873 - DNA, 201 bp, Bos taurus; identical to SEQ ID NO: 10644

SEQ ID NO: 51874 - DNA, 201 bp, Bos taurus; identical to SEQ ID NO: 10645

SEQ ID NO: 51875 - DNA, 201 bp, Bos taurus; identical to SEQ ID NO: 10648

SEQ ID NO: 51876 - DNA, 201 bp, Bos taurus; identical to SEQ ID NO: 10649

SEQ ID NO: 51877 - DNA, 201 bp, Bos taurus; identical to SEQ ID NO: 10650

SEQ ID NO: 51878 - DNA, 201 bp, Bos taurus; identical to SEQ ID NO: 10652

SEQ ID NO: 51879 - DNA, 201 bp, Bos taurus; identical to SEQ ID NO: 10653

SEQ ID NO: 51880 - DNA, 201 bp, Bos taurus; identical to SEQ ID NO: 10654

SEQ ID NO: 51881 - DNA, 201 bp, Bos taurus; identical to SEQ ID NO: 10655

SEQ ID NO: 51882 - DNA, 201 bp, Bos taurus; identical to SEQ ID NO: 10656

SEQ ID NO: 51883 - DNA, 201 bp, Bos taurus; identical to SEQ ID NO: 10657

SEQ ID NO: 51884 - DNA, 201 bp, Bos taurus; identical to SEQ ID NO: 10658

SEQ ID NO: 51885 - DNA, 201 bp, Bos taurus
gattttgagattaatgtttgtcattgcaagattataaactcaaactagagatgtgttttaacaatagagaaaaacagttcaaaataagtacgataattaataagaaagctagaattactgtctctaaattattaagacttcacatgtaaatggtgaaaatagcgaaagaggcttctacactgatttctgtttggatctagt

SEQ ID NO: 51886 - DNA, 201 bp, Bos taurus
gtagttaacttgaaaataaatcaagacagttgtcttaacttttaagcatctattaaagttgtaatatgcaggagacacctgatcatgcagaatatctaaacagggaaaataagaattagaataagaacactgaataatttctttattctaaattagtatttatcagaacaactagacaatatattttaacagatggcattt

SEQ ID NO: 51887 - DNA, 201 bp, Bos taurus; identical to SEQ ID NO: 10660

SEQ ID NO: 51888 - DNA, 201 bp, Bos taurus; identical to SEQ ID NO: 10661

SEQ ID NO: 51889 - DNA, 201 bp, Bos taurus; identical to SEQ ID NO: 10662

SEQ ID NO: 51890 - DNA, 201 bp, Bos taurus; identical to SEQ ID NO: 10665

SEQ ID NO: 51891 - DNA, 201 bp, Bos taurus
gtttgggccagttcaattacctcaattattcatagttctatttctgtgatcacgttttgagaagtgtgataccaacatgtcaccacagattcatgccccacgaaaacatgcaaatgggattttgaaaaatgcaaataaggatccataacccatgcccatccataaaggaagcttgattgtgtctctttaggcaacattttt

SEQ ID NO: 51892 - DNA, 201 bp, Bos taurus
tcactctacgcccaaattgaaatggtctgccacagtcttcacttacagcaacttgccagaagttcacacagcattcttctgtgtcatcctacacccacggggtcatgtggctgaagtagctgagcagtttgcatgtcaaccacatattatagcaatcttcttttcatttcacacaaaggaaacaaatcaaagcaaaaaaat

SEQ ID NO: 51893 - DNA, 201 bp, Bos taurus; identical to SEQ ID NO: 10668

SEQ ID NO: 51894 - DNA, 201 bp, Bos taurus; identical to SEQ ID NO: 10669

SEQ ID NO: 51895 - DNA, 201 bp, Bos taurus; identical to SEQ ID NO: 10670

SEQ ID NO: 51896 - DNA, 201 bp, Bos taurus; identical to SEQ ID NO: 10671

SEQ ID NO: 51897 - DNA, 201 bp, Bos taurus; identical to SEQ ID NO: 10672

SEQ ID NO: 51898 - DNA, 201 bp, Bos taurus
accctcctccctcctccctccccataccctccctctgggtcatcgcagtgcaccagccccaagcatccagtatcgtgcatcgaacctggactggcgactcgttagaaatcactgactagctttacgaacgtgaaacttcgttcaagttttctttttttcttttttttttaaacttgatttattttagtttacttttggcca

SEQ ID NO: 51899 - DNA, 201 bp, Bos taurus; identical to SEQ ID NO: 10673

SEQ ID NO: 51900 - DNA, 201 bp, Bos taurus; identical to SEQ ID NO: 10674

SEQ ID NO: 51901 - DNA, 201 bp, Bos taurus; identical to SEQ ID NO: 10675

SEQ ID NO: 51902 - DNA, 201 bp, Bos taurus
tcgactctgtattggtgtcctgatatccagaagtcaaaaccagactggtggtagacacccatatttcaaggaagcaggtctggcttccttttttctctctatttgaacaactggtgcatttaatagagaactgtgttcatcttttcaaactcgctttccacttttgtattttcttcttctcatgatatttttcaggaaaag

SEQ ID NO: 51903 - DNA, 201 bp, Bos taurus; identical to SEQ ID NO: 10676

SEQ ID NO: 51904 - DNA, 201 bp, Bos taurus; identical to SEQ ID NO: 10677

SEQ ID NO: 51905 - DNA, 201 bp, Bos taurus; identical to SEQ ID NO: 10678

SEQ ID NO: 51906 - DNA, 201 bp, Bos taurus
gactctgctaccacagcctccttcccaggccagggaactgggctattccagttccttttctccaattagacttccaaaggaagtcacttcatctgggcctcaagtttttatctacagttgctacctggatttaaaatcccaacttctccccacagttcagtcgctcagtcatgtctgactcttcgcgaccccatgaatcgc

SEQ ID NO: 51907 - DNA, 201 bp, Bos taurus; identical to SEQ ID NO: 10679

SEQ ID NO: 51908 - DNA, 201 bp, Bos taurus
ccataacctgtcctcacgaatatggagaagccaaagaaaaactctgcccaaagactgtgtgtgtgggtcttgcatcaagccaggattgacagccttcttcctggccagcgacatatgtaattttaagtttctagtaatcacacacataaaaaagaaataagtgaaattaatttcaataatagattttatttaacaaagtat

SEQ ID NO: 51909 - DNA, 201 bp, Bos taurus; identical to SEQ ID NO: 10680

SEQ ID NO: 51910 - DNA, 201 bp, Bos taurus; identical to SEQ ID NO: 10681

SEQ ID NO: 51911 - DNA, 201 bp, Bos taurus; identical to SEQ ID NO: 10682

SEQ ID NO: 51912 - DNA, 201 bp, Bos taurus; identical to SEQ ID NO: 10683

SEQ ID NO: 51913 - DNA, 201 bp, Bos taurus; identical to SEQ ID NO: 10684

SEQ ID NO: 51914 - DNA, 201 bp, Bos taurus
ttactcagaaaatcttggtttaggagttttcctgttggcccagtggataagaatctggatgcaagttccatccctggtctaggagctaactacatgctgcgggacaactaagcctgtgtgctcggccacgagtgcagccaaaaaaatttttttacataaattctaaaaaagaaatttgtttagaagtaggggaaaggtaca

SEQ ID NO: 51915 - DNA, 201 bp, Bos taurus
tgtcagcttgcgggagtctccctgcctaggtcagtaacttgtacagatgcattatgtgtttctaccaggactgactgatgcctcactcaggagggccctgggctatgggaaaatgctctagagatgctgggaggaggcagaggaaggaaggcgcagacatagaaaatggctgtctcttctccatccccggccttggacact

SEQ ID NO: 51916 - DNA, 201 bp, Bos taurus; identical to SEQ ID NO: 10685

SEQ ID NO: 51917 - DNA, 201 bp, Bos taurus; identical to SEQ ID NO: 10686

SEQ ID NO: 51918 - DNA, 201 bp, Bos taurus; identical to SEQ ID NO: 10687

SEQ ID NO: 51919 - DNA, 201 bp, Bos taurus
tgttactgcaaagcaccttccaaatgtcagctgacttaaaacaatcagggcggtacatgcaaaaatggattctgaagagcgttttttgatcaaaagacacctgcctagacttctgactagaattaggaatcagtgtatctgtgtgatggaaattcctctatgtgtcctactcagtaaacccaaactcctctcatcctgtcc

SEQ ID NO: 51920 - DNA, 201 bp, Bos taurus; identical to SEQ ID NO: 10688

SEQ ID NO: 51921 - DNA, 201 bp, Bos taurus; identical to SEQ ID NO: 10689

SEQ ID NO: 51922 - DNA, 201 bp, Bos taurus
tcagccattttgggagcttattttaccatgaggatgctggtgctgtcaagtgccattctggaatccttcctctggattattagcactgggaactggccttacctgctagtctaccagtgccagtactaccctcagcctaagtgcctaccttggcaggaacacacgcccacccaccagcaggccagctgccttaaggcctcc

SEQ ID NO: 51923 - DNA, 201 bp, Bos taurus; identical to SEQ ID NO: 10690

SEQ ID NO: 51924 - DNA, 201 bp, Bos taurus; identical to SEQ ID NO: 10691

SEQ ID NO: 51925 - DNA, 201 bp, Bos taurus; identical to SEQ ID NO: 10692

SEQ ID NO: 51926 - DNA, 201 bp, Bos taurus
caactagaggcaagttttccccttctttataacttatcgttaaaaactatataatcaccttttagggtgttggaggaatatttaggccccattttttatacgtctgtaggaatggagagaatttctataagagtgaaagtaataggaagacctgtttttctccatttctttacttccaactctccacagagaaggcacacc

SEQ ID NO: 51927 - DNA, 201 bp, Bos taurus; identical to SEQ ID NO: 10693

SEQ ID NO: 51928 - DNA, 201 bp, Bos taurus; identical to SEQ ID NO: 10694

SEQ ID NO: 51929 - DNA, 201 bp, Bos taurus
actgatcagattatgggctaggaatgtcaggttgggacaaatcaatatctctcaatttgggaagataggaaagatactttatcataccgttgatccagcactggagtttcgctgggcaggatatgggtgccaggaaatggaaagtgtggatgagaatgaaataaatccaagcaatcaataacagactctagggaggatgag

SEQ ID NO: 51930 - DNA, 201 bp, Bos taurus; identical to SEQ ID NO: 10695

SEQ ID NO: 51931 - DNA, 201 bp, Bos taurus
gttagcacatattactcaagtaccttatatatcacaccagctgttctgttctggcatgtattcatcactggggaaagttttaacctttgatggtgtacttcgcatactagtaagaagtgattccatttcaaaacctcattttagttgctcttctattgaaaacctcctggtagcaactatcacaggatgtatgactgtgaa

SEQ ID NO: 51932 - DNA, 201 bp, Bos taurus; identical to SEQ ID NO: 10697

SEQ ID NO: 51933 - DNA, 201 bp, Bos taurus; identical to SEQ ID NO: 10698

SEQ ID NO: 51934 - DNA, 201 bp, Bos taurus
ctccccagtctcacccagctatagcccggaaccccctctcctcttggatgtcagaggagggcaagtgaggaatctggtcttctatcatcacttagcagttacttcagtatggttacttcaaaaggcagcaaaagcagaagtataaatccagagtctcgtaatatacagaaaggttgatttcaattgaaaatcatttgtcag

SEQ ID NO: 51935 - DNA, 201 bp, Bos taurus; identical to SEQ ID NO: 10699

SEQ ID NO: 51936 - DNA, 201 bp, Bos taurus; identical to SEQ ID NO: 10700

SEQ ID NO: 51937 - DNA, 201 bp, Bos taurus
tggtggtgtttcttgcttaaagaacactcacaaacagatgagtcacttcccagagggttaatgagtctctcccaaggcctcagtgttacaggagaagcatatgtattggataccaagcatttatctctttcatctcttccagttgaggcataaagcacttctgaaggacatgacacagccctcttgatgaggactggaagt

SEQ ID NO: 51938 - DNA, 201 bp, Bos taurus; identical to SEQ ID NO: 10701

SEQ ID NO: 51939 - DNA, 201 bp, Bos taurus; identical to SEQ ID NO: 10702

SEQ ID NO: 51940 - DNA, 201 bp, Bos taurus
ctacagccacagtgtgtaataattacttagttaagatggcattaaatttgcacaggaagatattttgagagagagactgcgttcatgtagcttttattacgttgtattgttataactgttctattttatttttagtagttgttagcttcttcagtttggagaaggcaatggcaacccaatccagtactcttgcctggaaaa

SEQ ID NO: 51941 - DNA, 201 bp, Bos taurus; identical to SEQ ID NO: 10703

SEQ ID NO: 51942 - DNA, 201 bp, Bos taurus; identical to SEQ ID NO: 10704

SEQ ID NO: 51943 - DNA, 201 bp, Bos taurus; identical to SEQ ID NO: 10705

SEQ ID NO: 51944 - DNA, 201 bp, Bos taurus
agcatgtgccacgtgggctttagatccaggtggcaatgcacactgggaagctgcagagattaaactactgttgcccctgactccgagaggccatatcactctatggttttagatggtagtgttttagactctagggaaaacccattcaaaatggaggttgggccaaatttctttgtcttattgaatatgcttttttcctct

SEQ ID NO: 51945 - DNA, 201 bp, Bos taurus; identical to SEQ ID NO: 10706

SEQ ID NO: 51946 - DNA, 201 bp, Bos taurus
cttggcgctcttcacggcattgccgcctctgttggtgtgagcagttcctgaagaaaaggggcttcttgtgctgaggcttcaactccccacccatcagtcccagggcccagtgtagaccacagcctctctgcccctgcagaagagagctcacgaggagtccagccagtttcctctcccacaggaagtaggagctgcgtatgt

SEQ ID NO: 51947 - DNA, 201 bp, Bos taurus; identical to SEQ ID NO: 10707

SEQ ID NO: 51948 - DNA, 201 bp, Bos taurus
aattttgttaattttacctcagtagaaccagaaggaaaaaaaagattggactccatggggtagagttggagcagtaggtggaaagttacagagtgacagatttcagcacagaagcagccaaatgtgagatcgaccagcttcagcaggaggatttctttgtcagaagtttttgagcaggagctgggtaaaccctgggaaaag

SEQ ID NO: 51949 - DNA, 201 bp, Bos taurus
tgtgggggccgggcaccttacatggccaggcttcagagccacgaagccgtcttaccagtcatagatgtcaccatcgcaggtgacaggagtaacctggagcgttaggggcctcactactcaaatcctgtagtttccattttgaacagctctcaaatctctccagtgtctgtcctcgcagctcctaccataggccaggccatc

SEQ ID NO: 51950 - DNA, 201 bp, Bos taurus
gagaaatgtctatttagttctttggcccattttttgattgggtcattttgtctgctgcttttggatgaaatattctataatatcaattaagtccatcttgcctaatgtgtcattgaaggcctgtgcttccttattcttctgaatgatctgaccactgatgaaggtggggtgttagagtcctcccactattttgtgttactg

SEQ ID NO: 51951 - DNA, 201 bp, Bos taurus; identical to SEQ ID NO: 10708

SEQ ID NO: 51952 - DNA, 201 bp, Bos taurus
aacaaggtctccaaattggctgccaccagtatatctgtccccaaggggtgttccagttgcctcttgcctctccaagagactatccaagatctgcaagaggactgaccatggttcctttcaaatgatcatctctgcactgggttggaacatgagattttgcatatacccttcaagtgcaaagtctctgtttcctacagtcct

SEQ ID NO: 51953 - DNA, 201 bp, Bos taurus; identical to SEQ ID NO: 10709

SEQ ID NO: 51954 - DNA, 201 bp, Bos taurus; identical to SEQ ID NO: 10710

SEQ ID NO: 51955 - DNA, 201 bp, Bos taurus; identical to SEQ ID NO: 10711

SEQ ID NO: 51956 - DNA, 201 bp, Bos taurus
ctccatcttctgggatattctgaggaaattacagtcacccaagaaatggaagtgggtagcaagtgtcaattagcttctgtcccgcgtgtccccacacttccagagatgctctggggaaggtagcaaggatgtgagggcccaaggtgggtgctgtcagctggagcgtgtgtgaaactggctgaagtctgcagagtggttgcc

SEQ ID NO: 51957 - DNA, 201 bp, Bos taurus; identical to SEQ ID NO: 10712

SEQ ID NO: 51958 - DNA, 201 bp, Bos taurus
ccatgaaaggtcacgacagaagcagacaggagggaatgtaaacacctaactctcatgaacgggtctgagaccaccagtcatttcactgcttcagggggccctgtatctagggacggtctcggtagggcttctggttggaatggggcaacctctgtggtggttgggagacagccggccatttcctcttggtccccctcactg

SEQ ID NO: 51959 - DNA, 201 bp, Bos taurus; identical to SEQ ID NO: 10713

SEQ ID NO: 51960 - DNA, 201 bp, Bos taurus; identical to SEQ ID NO: 10714

SEQ ID NO: 51961 - DNA, 201 bp, Bos taurus; identical to SEQ ID NO: 10715

SEQ ID NO: 51962 - DNA, 201 bp, Bos taurus; identical to SEQ ID NO: 10716

SEQ ID NO: 51963 - DNA, 201 bp, Bos taurus; identical to SEQ ID NO: 10717

SEQ ID NO: 51964 - DNA, 201 bp, Bos taurus
tggtgatggaaaacttaggccacagtacttaaacaataagaagccattgtagggttttaatttgggagaggataataacagatttatttgaaaaaattcaagagaataggttgaaagtggccagaagtaaggaaaccagagtgaaggctagtgcaatcattcagttgggaggttatgatagcttggattaggaaaaagtag

SEQ ID NO: 51965 - DNA, 201 bp, Bos taurus; identical to SEQ ID NO: 10718

SEQ ID NO: 51966 - DNA, 201 bp, Bos taurus; identical to SEQ ID NO: 10719

SEQ ID NO: 51967 - DNA, 201 bp, Bos taurus; identical to SEQ ID NO: 10720

SEQ ID NO: 51968 - DNA, 201 bp, Bos taurus; identical to SEQ ID NO: 10721

SEQ ID NO: 51969 - DNA, 201 bp, Bos taurus; identical to SEQ ID NO: 10722

SEQ ID NO: 51970 - DNA, 201 bp, Bos taurus
ggattaagttactgtctgtacatctacctctgaacagcgccacagagcgagaaaaagacaggagcccgaacaggaagagtgttcctaacgccagccaatttgacgtcacggtataatgctccaggcggtatcgctgaaacacgaagtggtaacatttctagaaagaaagaaaactgctctgaaaaaaagatacaccttgca

SEQ ID NO: 51971 - DNA, 201 bp, Bos taurus; identical to SEQ ID NO: 10723

SEQ ID NO: 51972 - DNA, 201 bp, Bos taurus
actgccagaggaaatgaagctgtggccctaattggttaattataagggaaccctgcagcagcaaaaccctgccctctgaatcaaggcttccctttctacacggttggcctctggtctcagtctgattgccatcctgcctgaatatgcacaacagaattttcttctaccaccttccgtgaagaaagcccttgcctccacaca

SEQ ID NO: 51973 - DNA, 201 bp, Bos taurus; identical to SEQ ID NO: 10724

SEQ ID NO: 51974 - DNA, 201 bp, Bos taurus; identical to SEQ ID NO: 10725

SEQ ID NO: 51975 - DNA, 201 bp, Bos taurus
gctaacggcgacctcctccgagaggactgataccacacgccacgcctcccagggctgctgcagccggagccgctgtccctgcggcaggtcactgctgacctgtgccttcacaagagacactcagaccctcaaatacaggtctggctcagtctcttgtggggatcactgctcctttcccttcatcctggtgtgcacaaagtt

SEQ ID NO: 51976 - DNA, 201 bp, Bos taurus; identical to SEQ ID NO: 10726

SEQ ID NO: 51977 - DNA, 201 bp, Bos taurus; identical to SEQ ID NO: 10727

SEQ ID NO: 51978 - DNA, 201 bp, Bos taurus; identical to SEQ ID NO: 10728

SEQ ID NO: 51979 - DNA, 201 bp, Bos taurus; identical to SEQ ID NO: 10729

SEQ ID NO: 51980 - DNA, 201 bp, Bos taurus; identical to SEQ ID NO: 10730

SEQ ID NO: 51981 - DNA, 201 bp, Bos taurus; identical to SEQ ID NO: 10731

SEQ ID NO: 51982 - DNA, 201 bp, Bos taurus; identical to SEQ ID NO: 10732

SEQ ID NO: 51983 - DNA, 201 bp, Bos taurus; identical to SEQ ID NO: 10733

SEQ ID NO: 51984 - DNA, 201 bp, Bos taurus; identical to SEQ ID NO: 10734

SEQ ID NO: 51985 - DNA, 201 bp, Bos taurus; identical to SEQ ID NO: 10735

SEQ ID NO: 51986 - DNA, 201 bp, Bos taurus; identical to SEQ ID NO: 10736

SEQ ID NO: 51987 - DNA, 201 bp, Bos taurus
aggaaggcaccatccatcttcctggcccaagaaccaagaaaccaaaatagacttgttgagctagtggtacaatatcgccaggaagtttgtttacggtcagatttcctagggcttgagaggccatgctatgacttttctttttttctttactctttttatctcctcctccctgtatttctcacttaaaaaaaaaacttttta

SEQ ID NO: 51988 - DNA, 201 bp, Bos taurus; identical to SEQ ID NO: 10737

SEQ ID NO: 51989 - DNA, 201 bp, Bos taurus; identical to SEQ ID NO: 10738

SEQ ID NO: 51990 - DNA, 201 bp, Bos taurus; identical to SEQ ID NO: 10739

SEQ ID NO: 51991 - DNA, 201 bp, Bos taurus
tcaagttccggaggtgttttagggccagggttagacacaaaccctgcttttctgcttccttttcacctgcttccccacattgccaccctctgtggtttatcctacccttacagcaggggcccccgtgccatcgcacaaatgaggcaagtagacagagtccagatctccttctggggtgggcagtaaggggcaccgggattc

SEQ ID NO: 51992 - DNA, 201 bp, Bos taurus; identical to SEQ ID NO: 10740

SEQ ID NO: 51993 - DNA, 201 bp, Bos taurus
cccagccttctttaaggtgagaatttttatagcagacactgtgttttaaaagccagcgtttaatattttttaaaaagaagacctctagattttggtgtttgttatctgccagtatgaaaatggatgattaaccaagcaagattccaagaagtcctttggaaaatggtggggtcagtccttcattccaagtcagtcatgagt

SEQ ID NO: 51994 - DNA, 201 bp, Bos taurus; identical to SEQ ID NO: 10741

SEQ ID NO: 51995 - DNA, 201 bp, Bos taurus; identical to SEQ ID NO: 10742

SEQ ID NO: 51996 - DNA, 201 bp, Bos taurus
tctgtgctgaaaaatagtgctgctttttgctgaccttagtacccatttcagcatcatgagatttacggccatccctgatggcctcttgtgacactgattaatactgactgcttaattaaagtgaaacagtgacatgctttggggattttatttaccctcactcttccctttttacatattagcatcttctggagtttgcta

SEQ ID NO: 51997 - DNA, 201 bp, Bos taurus; identical to SEQ ID NO: 10743

SEQ ID NO: 51998 - DNA, 201 bp, Bos taurus; identical to SEQ ID NO: 10744

SEQ ID NO: 51999 - DNA, 201 bp, Bos taurus; identical to SEQ ID NO: 10745

SEQ ID NO: 52000 - DNA, 201 bp, Bos taurus; identical to SEQ ID NO: 10746

SEQ ID NO: 52001 - DNA, 201 bp, Bos taurus; identical to SEQ ID NO: 10747

SEQ ID NO: 52002 - DNA, 201 bp, Bos taurus; identical to SEQ ID NO: 10748

SEQ ID NO: 52003 - DNA, 201 bp, Bos taurus
ttcctgcacatatccctactaggctgcctgccatgccctatacatctgatctcctgaacaccttgagaatgtttttattcccaccttccacagtttatgccacttttccattccaggccgcgaccacttccttcctgcttggtcccttacaatagcctctcaaagacgggtttctccttgttaattaactcgtgctctgct

SEQ ID NO: 52004 - DNA, 201 bp, Bos taurus; identical to SEQ ID NO: 10751

SEQ ID NO: 52005 - DNA, 201 bp, Bos taurus; identical to SEQ ID NO: 10752

SEQ ID NO: 52006 - DNA, 201 bp, Bos taurus; identical to SEQ ID NO: 10754

SEQ ID NO: 52007 - DNA, 201 bp, Bos taurus
tctgaaaagatctctcaggaagaaattagtagaagggttccagaaagcacccacgtcctagtttccagcttgccttatcaagagaggcctcctgctctttgcctttcaccctccctcctgtctgtatgcttggctacccacacctcctccccacagcctcctacggcctgtctcatgcatgccccatgcatgtaacacagt

SEQ ID NO: 52008 - DNA, 201 bp, Bos taurus
ggaagaagtgccatggcctcctcatgtgggctgtcgccaccacctcgggtgctcagagaatacaaggaatttcacaattggcaggcccttcacttaactcggagctcccaggagttgggctgtcaggggagagtttcacgttgctgccagtcccttctgaattgctaatacaagaaagatgcagatccctgctggaggccc

SEQ ID NO: 52009 - DNA, 201 bp, Bos taurus; identical to SEQ ID NO: 10755

SEQ ID NO: 52010 - DNA, 201 bp, Bos taurus; identical to SEQ ID NO: 10758

SEQ ID NO: 52011 - DNA, 201 bp, Bos taurus; identical to SEQ ID NO: 10759

SEQ ID NO: 52012 - DNA, 201 bp, Bos taurus; identical to SEQ ID NO: 10762

SEQ ID NO: 52013 - DNA, 201 bp, Bos taurus
ctccaggttttagggtccagactggttcagcaccatctgtcatgattgtactcacccacgttgcacagccaatatggcattgtctcttcgcactcacccacaaattggctcctgtacaactcctccccattattggcctctgttctcagactgggcctccagaattctagcgaatacttctggcatcttaaagttctcata

SEQ ID NO: 52014 - DNA, 201 bp, Bos taurus
attaagatatatctatagacactagaatgtgaagtaggagatgctaagtgttgaaagagaggcacagatacctagctacaggaatcagagggaagagacagaagttccacgtgggtgattcaaggaagacttcatggaagaagtggcattcaagataggctttgaaaatggataagattttgccacaagttgataagagga

SEQ ID NO: 52015 - DNA, 201 bp, Bos taurus
cagccaacagaactgtgatttctccagccacacagcatcactctagggaagcaccccagatgcataaaactctctggaagagcaaaatggcccacagtgcccctcaagtagccctggtcattgccaagttcattcccaaacctttgggaccaagggacctggggccagactcaaggagaacttgcactccttgcaggggca

SEQ ID NO: 52016 - DNA, 201 bp, Bos taurus; identical to SEQ ID NO: 10763

SEQ ID NO: 52017 - DNA, 201 bp, Bos taurus; identical to SEQ ID NO: 10765

SEQ ID NO: 52018 - DNA, 201 bp, Bos taurus; identical to SEQ ID NO: 10766

SEQ ID NO: 52019 - DNA, 201 bp, Bos taurus; identical to SEQ ID NO: 10767

SEQ ID NO: 52020 - DNA, 201 bp, Bos taurus
tgctccctcagtcctcacagaaatcctgagaatgggtcctattagagtcctgattattcagatgaggacattaaggcacagagagatggccatacacatattccctaagtttgcacagctaataaagcgtggagccaggatttaaaccctgatgttttcattctgtctactctggaagtattcatcagtgatggccatgtt

SEQ ID NO: 52021 - DNA, 201 bp, Bos taurus; identical to SEQ ID NO: 10769

SEQ ID NO: 52022 - DNA, 201 bp, Bos taurus; identical to SEQ ID NO: 10770

SEQ ID NO: 52023 - DNA, 201 bp, Bos taurus; identical to SEQ ID NO: 10771

SEQ ID NO: 52024 - DNA, 201 bp, Bos taurus; identical to SEQ ID NO: 10775

SEQ ID NO: 52025 - DNA, 201 bp, Bos taurus; identical to SEQ ID NO: 10777

SEQ ID NO: 52026 - DNA, 201 bp, Bos taurus; identical to SEQ ID NO: 10779

SEQ ID NO: 52027 - DNA, 201 bp, Bos taurus; identical to SEQ ID NO: 10780

SEQ ID NO: 52028 - DNA, 201 bp, Bos taurus; identical to SEQ ID NO: 10781

SEQ ID NO: 52029 - DNA, 201 bp, Bos taurus; identical to SEQ ID NO: 10782

SEQ ID NO: 52030 - DNA, 201 bp, Bos taurus
agaagccacatgtgcaaaggccctgaggcagaaggcgcatgcatgaaaggagccactgtggctctggaacagaagagactggttggagaaggatgcagacgccagtccaggcaggcctggtggttcctgggtgaattcaactcttattctcaggagaatgggaagcctctgaagggccttaagagagctgttgcaagcaag

SEQ ID NO: 52031 - DNA, 201 bp, Bos taurus; identical to SEQ ID NO: 10783

SEQ ID NO: 52032 - DNA, 201 bp, Bos taurus; identical to SEQ ID NO: 10785

SEQ ID NO: 52033 - DNA, 201 bp, Bos taurus; identical to SEQ ID NO: 10786

SEQ ID NO: 52034 - DNA, 201 bp, Bos taurus; identical to SEQ ID NO: 10787

SEQ ID NO: 52035 - DNA, 201 bp, Bos taurus; identical to SEQ ID NO: 10789

SEQ ID NO: 52036 - DNA, 201 bp, Bos taurus; identical to SEQ ID NO: 10790

SEQ ID NO: 52037 - DNA, 201 bp, Bos taurus; identical to SEQ ID NO: 10791

SEQ ID NO: 52038 - DNA, 201 bp, Bos taurus
atccaaagaaagcatgagtgcccaacacagactcaaaaagccaagttcactaggtcccacatcatcactgttgtgatcacaaacactagtccctctccgggactctgtcatctcttcccacctggaccctcaacctcagtacctggagactcactgtgagtctccatatggccctccagaagccgtgtccagcgtgagggc

SEQ ID NO: 52039 - DNA, 201 bp, Bos taurus; identical to SEQ ID NO: 10793

SEQ ID NO: 52040 - DNA, 201 bp, Bos taurus; identical to SEQ ID NO: 10794

SEQ ID NO: 52041 - DNA, 201 bp, Bos taurus
ttcagattgttcttatgcacctggtgccattatatccttgtggtcaataactttctccttgttgtggcttactccacaaattaaaataactttttggcccattatattttggtttgtgtattttatctctcatccagcatagtactggatacctggtagattcttagtggaaaattatttgaaaagtcaaagatatcgaca

SEQ ID NO: 52042 - DNA, 201 bp, Bos taurus
tgggatgggggctcctctggcctcacacttgggggggcggcagcagcagcagcgaggtcccagaactgccttatgccagagacccctggcacatctccccgtgggcctggggcctggggggtccacctgcaggctcctgggggcagtcaggcctaggaggtctctgtgtggcctctgggaggcctggcagccctcccctcc

SEQ ID NO: 52043 - DNA, 201 bp, Bos taurus
tgtggttgctgctttctgtgagctgaacagggtacatgagtgactgtgctgagtattccctgcagagaaaagcctgtgtaccagcagcaggtccgattggtttgactggcctgggacctggaggcctacggccatggctgccttgttctgggcaagccaccccatccctctgccggggcacgtgccccggtgctgccagag

SEQ ID NO: 52044 - DNA, 201 bp, Bos taurus; identical to SEQ ID NO: 10795

SEQ ID NO: 52045 - DNA, 201 bp, Bos taurus; identical to SEQ ID NO: 10796

SEQ ID NO: 52046 - DNA, 201 bp, Bos taurus; identical to SEQ ID NO: 10798

SEQ ID NO: 52047 - DNA, 201 bp, Bos taurus; identical to SEQ ID NO: 10801

SEQ ID NO: 52048 - DNA, 201 bp, Bos taurus; identical to SEQ ID NO: 10802

SEQ ID NO: 52049 - DNA, 201 bp, Bos taurus; identical to SEQ ID NO: 10803

SEQ ID NO: 52050 - DNA, 201 bp, Bos taurus; identical to SEQ ID NO: 10804

SEQ ID NO: 52051 - DNA, 201 bp, Bos taurus; identical to SEQ ID NO: 10805

SEQ ID NO: 52052 - DNA, 201 bp, Bos taurus; identical to SEQ ID NO: 10806

SEQ ID NO: 52053 - DNA, 201 bp, Bos taurus; identical to SEQ ID NO: 10807

SEQ ID NO: 52054 - DNA, 201 bp, Bos taurus
ttgagagggacacatgggtgatatttacatcctcaactgcattatctgggaagtgggtgttttaactacttcctttttacggactaagaacacacagccccagagaggccagcacctagaagcacgaggatttgaaaccaggtctgtttcctccaggagctctcccactggaaaggcagacagatggcagaagttatttta

SEQ ID NO: 52055 - DNA, 201 bp, Bos taurus; identical to SEQ ID NO: 10808

SEQ ID NO: 52056 - DNA, 201 bp, Bos taurus; identical to SEQ ID NO: 10809

SEQ ID NO: 52057 - DNA, 201 bp, Bos taurus
tgcaatacagtgctccatactaatctataaaggaaattatgccaaatgtcattactctgggtggtccaagggttgattatattaagtagattattctaacgttttgtttttcccacagaaacatcatctacactgtttgaaatgcagctctctaaaaggcagttaaattattaactcccatctagatcctaaatgagtgtt

SEQ ID NO: 52058 - DNA, 201 bp, Bos taurus; identical to SEQ ID NO: 10810

SEQ ID NO: 52059 - DNA, 201 bp, Bos taurus; identical to SEQ ID NO: 10813

SEQ ID NO: 52060 - DNA, 201 bp, Bos taurus; identical to SEQ ID NO: 10814

SEQ ID NO: 52061 - DNA, 201 bp, Bos taurus
tctagccgtgagtgtgtgtgtgcacgcacgcgcaggtccagccaccttccggggctaccagcctcattccctggcgttcccctcgggccctcaagactgtcgtcacgccagtgctctgtgtttcccctcctgtttgattctccaagtcaaactgccctggccacggcgtgttccttcccggtgggagtcttgcctgcacta

SEQ ID NO: 52062 - DNA, 201 bp, Bos taurus; identical to SEQ ID NO: 10815

SEQ ID NO: 52063 - DNA, 201 bp, Bos taurus; identical to SEQ ID NO: 10818

SEQ ID NO: 52064 - DNA, 201 bp, Bos taurus; identical to SEQ ID NO: 10819

SEQ ID NO: 52065 - DNA, 201 bp, Bos taurus; identical to SEQ ID NO: 10820

SEQ ID NO: 52066 - DNA, 201 bp, Bos taurus; identical to SEQ ID NO: 10821

SEQ ID NO: 52067 - DNA, 201 bp, Bos taurus; identical to SEQ ID NO: 10822

SEQ ID NO: 52068 - DNA, 201 bp, Bos taurus; identical to SEQ ID NO: 10823

SEQ ID NO: 52069 - DNA, 201 bp, Bos taurus; identical to SEQ ID NO: 10824

SEQ ID NO: 52070 - DNA, 201 bp, Bos taurus; identical to SEQ ID NO: 10825

SEQ ID NO: 52071 - DNA, 201 bp, Bos taurus
gtctgatgttgtagccacaaaatcccagtccctcccaaatgagtaaaccaggtctcggccaggacgcggctgatttataaagcgcatatggtgggcccttgctggctttcctgccaggaagggggcgaaccagctcccccccaaatccctgacccatctccccaagaacgggcctgccaggctagcagctcagccctggtg

SEQ ID NO: 52072 - DNA, 201 bp, Bos taurus; identical to SEQ ID NO: 10827

SEQ ID NO: 52073 - DNA, 201 bp, Bos taurus; identical to SEQ ID NO: 10830

SEQ ID NO: 52074 - DNA, 201 bp, Bos taurus
tgtcaccacagagcattgagtagagttccctgtgttgtacagtaggttctcattggttatctattttatacacagtatatacggcaatcccaatctcccagttcatctcaccccacttctctccccttggttttcatacatttgttctctaagtctgtgtctctatttctgctttgcaaataggttcatctgcaccatttt

SEQ ID NO: 52075 - DNA, 201 bp, Bos taurus
aacaggtctctcatttcccgaccttcagaggggctgtctgttctttctgggtggacctttgtgactctgccttttctctctggacggcgccgctgccccttaggccaagccgcaatcatggagccggctgatatggcgacagcaaaggtaggatggaaatgctgccggccgcactgtgcgtaagtggcttcgcttggcgag

SEQ ID NO: 52076 - DNA, 201 bp, Bos taurus; identical to SEQ ID NO: 10834

SEQ ID NO: 52077 - DNA, 201 bp, Bos taurus
ccagcctgggtagggattaacgaagtttttccagaaaggaaggtgcctaagccgagtcctagaggagtgcaataggaagagagttgggtgtggaggggaaatgcattccagacaagaactcaatcaatgcttgcgaaacagagctggagcagagaatccagactgagttgaagctggagtcaggcttgtccaggcacttct

SEQ ID NO: 52078 - DNA, 201 bp, Bos taurus; identical to SEQ ID NO: 10835

SEQ ID NO: 52079 - DNA, 201 bp, Bos taurus; identical to SEQ ID NO: 10837

SEQ ID NO: 52080 - DNA, 201 bp, Bos taurus; identical to SEQ ID NO: 10839

SEQ ID NO: 52081 - DNA, 201 bp, Bos taurus
taattttctgaatgccttttctctgagctacaagccttctttgctgtttttggtttggaagttttctggaatttagtagcttgtttctccaaattaggtatacctattgagattttgcagtttatatgaccttgtaacataatcactttctgaaaagggccttatggccacataggctggagaagttatggccctctttac

SEQ ID NO: 52082 - DNA, 201 bp, Bos taurus
ttttagctcaatggattttatgattaaagagatttttaagagcatactgttttacttataatttgttgaaaagtactaatttattttgggaccatgtattataaagttttcagtaccggagaaagttttaggtgtcagtgcaatgatttttctctgcatataatattcaagtgtcagtgaaatatgcaaaattgggaaaat

SEQ ID NO: 52083 - DNA, 201 bp, Bos taurus; identical to SEQ ID NO: 10844

SEQ ID NO: 52084 - DNA, 201 bp, Bos taurus; identical to SEQ ID NO: 10845

SEQ ID NO: 52085 - DNA, 201 bp, Bos taurus; identical to SEQ ID NO: 10846

SEQ ID NO: 52086 - DNA, 201 bp, Bos taurus
atgtattatccatcttcactgaaggaggtaaataattacatatattttcattgtataggctcaaggatgttttctgacaaaaataaaagtagtaactgacttcaaacttataaatacagaaatcagattggtagttgccagatgcaaggttttgggggcgggtgggaaaaataagggggtcaaaaggtaggaaagaaaaat

SEQ ID NO: 52087 - DNA, 201 bp, Bos taurus; identical to SEQ ID NO: 10849

SEQ ID NO: 52088 - DNA, 201 bp, Bos taurus
cgtaaaatcgcaactatgatacatttgaaggaagtatatgtaccgtgaagctttgtagaatgggatttgacctaatcatggaggccatggaagtgacagctgaactgaaaggtgagacataaaaggaattcagtatgtgaagacatgaaggaagactgttctaagaggaagaacagcaaatttaaaggcctgtggcaggag

SEQ ID NO: 52089 - DNA, 201 bp, Bos taurus; identical to SEQ ID NO: 10850

SEQ ID NO: 52090 - DNA, 201 bp, Bos taurus; identical to SEQ ID NO: 10851

SEQ ID NO: 52091 - DNA, 201 bp, Bos taurus; identical to SEQ ID NO: 10852

SEQ ID NO: 52092 - DNA, 201 bp, Bos taurus; identical to SEQ ID NO: 10853

SEQ ID NO: 52093 - DNA, 201 bp, Bos taurus; identical to SEQ ID NO: 10854

SEQ ID NO: 52094 - DNA, 201 bp, Bos taurus; identical to SEQ ID NO: 10855

SEQ ID NO: 52095 - DNA, 201 bp, Bos taurus; identical to SEQ ID NO: 10856

SEQ ID NO: 52096 - DNA, 201 bp, Bos taurus; identical to SEQ ID NO: 10857

SEQ ID NO: 52097 - DNA, 201 bp, Bos taurus; identical to SEQ ID NO: 10858

SEQ ID NO: 52098 - DNA, 201 bp, Bos taurus; identical to SEQ ID NO: 10859

SEQ ID NO: 52099 - DNA, 201 bp, Bos taurus
tgcttactctgggcttaaacaagattgaggggggtagggagaagagacaaaagaaagtgaattaacatttgcggagtaatctaattaggagccaaagcctatatgtcttaagatcttggtaaattctcaactcttcagatacattctgagatcctagcttcacctctcttcctctgttccctcagctcttccaattattct

SEQ ID NO: 52100 - DNA, 201 bp, Bos taurus
tgtctcctgcattggcaggcagattctttaccattgcaccacctgggaagcccaaacttagtagtttaaaaaccttaaatttattatcttacagttctgggaatcaagtctaaaatgcctgtcagcagggctattttcttctggaggttccagaggagaatctattttcttgccttttctagtttggggaggccatctgca

SEQ ID NO: 52101 - DNA, 201 bp, Bos taurus
caataaaagaagaaaatctagagattcacaaatatgtggaaattaaaccacacagtcttaaacaaccaatgggtcaaagaggaaatcaaaagaaaataatttgagatgaatgaaaacaaatcacaagataccaaaactttgagattcagcaaaagcagtccttaggggtaaatttatagatgtgaacatctataaaaagat

SEQ ID NO: 52102 - DNA, 201 bp, Bos taurus; identical to SEQ ID NO: 10863

SEQ ID NO: 52103 - DNA, 201 bp, Bos taurus; identical to SEQ ID NO: 10864

SEQ ID NO: 52104 - DNA, 201 bp, Bos taurus
cataagtattttatttaacagctgttatgttagccatcagtggcattattaatcgatggctacatgtttgtttcttccttgggaggctttgtgggccccacggcagctagaaaccaaggggcctgaggacgagtcccgtatgcctcccgctgagccttgcttcatctttctgcagaccacaatcctctatctctgaagtga

SEQ ID NO: 52105 - DNA, 201 bp, Bos taurus; identical to SEQ ID NO: 10865

SEQ ID NO: 52106 - DNA, 201 bp, Bos taurus; identical to SEQ ID NO: 10866

SEQ ID NO: 52107 - DNA, 201 bp, Bos taurus
gtcttctactctgaggcatagcaaccatctcacagaggcccagagcagcccgtggtcccccagtggatcaccttggccctccctgcctccagctgccctgagagcagaagtccggtcacctgatggtggtcacagccacaggtaaaggcagcaaatgccacggagaaagatgaaaggtgagggccaacatggccttggcaa

SEQ ID NO: 52108 - DNA, 201 bp, Bos taurus; identical to SEQ ID NO: 10867

SEQ ID NO: 52109 - DNA, 201 bp, Bos taurus
cccttgccttaaatcactaccctataagtgatcagtaaatgttaattgattgaatgaatgaataagtcgtaagaggcctttgttatttactcacgcttagggaacaggatccagctttggtggtggtggaatgctttcaatgtttctaagaataccatctcattcccatcttgaaacattggccagtcttgatatttatag

SEQ ID NO: 52110 - DNA, 201 bp, Bos taurus
gggccatttgctactcagctctagctaactgtgggtcatgggttgccataaccttagattttcaacaatctgaaagtccacattttcaggtgaaatgtgacatttaagcattggtagataatctgaattttatagaaccagtgtgggtcacattatgcagtttcagcagaacatgcatgttgtgtaccgcttaaaaaaaaa

SEQ ID NO: 52111 - DNA, 201 bp, Bos taurus
acttggcaccaacacaagcccacaatgtgaggttatgatggggagctgcacagcataccaccatgctgtaaagctaagattgtaatatggcaacctgatcaccccactgtacctcccatgatagcatcacacatgtattataatatttcaacactctgacaataaccagcatattataaaaccctgacctcacagctttca

SEQ ID NO: 52112 - DNA, 201 bp, Bos taurus
cattccctccggtagctccactcccaggcccagggagtggctggggcagagcaaacagattcgcgcgggctaggtctggagtcaggctgagccgggagattgcgctccaggccagggctggggtcaagggaaggatggggtaccgagcactctccccaggcgaccctgtccgatgagctgtcagaggcagcagatagagag

SEQ ID NO: 52113 - DNA, 201 bp, Bos taurus; identical to SEQ ID NO: 10868

SEQ ID NO: 52114 - DNA, 201 bp, Bos taurus; identical to SEQ ID NO: 10869

SEQ ID NO: 52115 - DNA, 201 bp, Bos taurus; identical to SEQ ID NO: 10870

SEQ ID NO: 52116 - DNA, 201 bp, Bos taurus
agggaaggaggacattcacacaggccaatctcaccacctcttctcccagcccccacacacagcctccctctctaatggcatcaaagccacgacgggctgctcccactgacgagggccctaagcctcagtgtcagggacatgcagagcagggattcattatcttggaccctgcgctggttcccgagagaggctgtaacaaag

SEQ ID NO: 52117 - DNA, 201 bp, Bos taurus; identical to SEQ ID NO: 10872

SEQ ID NO: 52118 - DNA, 201 bp, Bos taurus; identical to SEQ ID NO: 10873

SEQ ID NO: 52119 - DNA, 201 bp, Bos taurus; identical to SEQ ID NO: 10874

SEQ ID NO: 52120 - DNA, 201 bp, Bos taurus; identical to SEQ ID NO: 10875

SEQ ID NO: 52121 - DNA, 201 bp, Bos taurus; identical to SEQ ID NO: 10877

SEQ ID NO: 52122 - DNA, 201 bp, Bos taurus; identical to SEQ ID NO: 10878

SEQ ID NO: 52123 - DNA, 201 bp, Bos taurus
ttcaggatcccctttgtgagacggaggtgtgctaagtattacagggctgtacggcactaacttaactaaccccacccacttctctcattccgtttcaactaatcctttcctctcttagcggaacgctcttctgctcactaaactctatcagcttctgttttccacaactgtccacagtcttctgcattagaaagaatcgca

SEQ ID NO: 52124 - DNA, 201 bp, Bos taurus
acagtatcttttctttttttatattggcctcagactcatggcttttttatgcaagggaatccccactagcggttacattctaatcttgtgtcctttcttttctattctcaaatgtacctggaaagctgtatttacatctcagggttaaactctatgtaatttgtttgggtctctttctatgcataatgaggccataattat

SEQ ID NO: 52125 - DNA, 201 bp, Bos taurus
atgaggtcgcaaagagtcggacacgactgagcaactgaacaacaacaagcctctggggcaaggcatacatgtagttctgtggtaaaggcattaacttctcggggaaggccgcctgcatcagcaatgtgagagatagctgtgggttctattctgacctcaccggttccggtttgtccttatgaattctagtttgccctcact

SEQ ID NO: 52126 - DNA, 201 bp, Bos taurus; identical to SEQ ID NO: 10879

SEQ ID NO: 52127 - DNA, 201 bp, Bos taurus; identical to SEQ ID NO: 10880

SEQ ID NO: 52128 - DNA, 201 bp, Bos taurus; identical to SEQ ID NO: 10881

SEQ ID NO: 52129 - DNA, 201 bp, Bos taurus; identical to SEQ ID NO: 10882

SEQ ID NO: 52130 - DNA, 201 bp, Bos taurus; identical to SEQ ID NO: 10883

SEQ ID NO: 52131 - DNA, 201 bp, Bos taurus
cacttgatgctcagggataagcatttcatctaaaccagggcccagtcacatgccaggagctgcttctcaaaaggtgtgtaattctctgctatagatgacatgactttgctccagactctcaggggccaactttatgattcttttgctgggttttgcagtgagctctagattgcatctttccccatcattgccacttccaac

SEQ ID NO: 52132 - DNA, 201 bp, Bos taurus; identical to SEQ ID NO: 10885

SEQ ID NO: 52133 - DNA, 201 bp, Bos taurus; identical to SEQ ID NO: 10886

SEQ ID NO: 52134 - DNA, 201 bp, Bos taurus; identical to SEQ ID NO: 10887

SEQ ID NO: 52135 - DNA, 201 bp, Bos taurus; identical to SEQ ID NO: 10891

SEQ ID NO: 52136 - DNA, 201 bp, Bos taurus
agcccgtgggctgttcggttcttaaagctgaggggccttgagtcaggaattcagagataacagacacctgcctctgcttgaggccctccaccctggcctccgagtcctcattaaagaaatcagacagacaggattgagcgcttggtctgcaagtctgcccatgacactccttggctctggggttaaaactcccacctctca

SEQ ID NO: 52137 - DNA, 201 bp, Bos taurus; identical to SEQ ID NO: 10892

SEQ ID NO: 52138 - DNA, 201 bp, Bos taurus; identical to SEQ ID NO: 10893

SEQ ID NO: 52139 - DNA, 201 bp, Bos taurus; identical to SEQ ID NO: 10894

SEQ ID NO: 52140 - DNA, 201 bp, Bos taurus
tcttggagaagagttttggatgaaaaagaaaagaattgctttattactttgccaggcaaaaggggacatagtggactcatggcctcaaaactgtgtatcccgaccaagggggattttttaaggagttttatggcactgtttcaagggtgaagttgttgataggaattaaaatgtgtgcagggcttgcattcctttaatctg

SEQ ID NO: 52141 - DNA, 201 bp, Bos taurus; identical to SEQ ID NO: 10897

SEQ ID NO: 52142 - DNA, 201 bp, Bos taurus; identical to SEQ ID NO: 10898

SEQ ID NO: 52143 - DNA, 201 bp, Bos taurus; identical to SEQ ID NO: 10899

SEQ ID NO: 52144 - DNA, 201 bp, Bos taurus
gtccatgaagctaagagaagacctaattatctcaatgccaaaagaccctctccaagacatattatagtaaaactgtcaaaagtcaatgacaaagacataacatttaaggcatcctggggataaagaactgatacagaacaaccaggaaacaaaatggcagtataattcctcattcatcaatcatcaccctgaatgtaaatg

SEQ ID NO: 52145 - DNA, 201 bp, Bos taurus; identical to SEQ ID NO: 10901

SEQ ID NO: 52146 - DNA, 201 bp, Bos taurus; identical to SEQ ID NO: 10902

SEQ ID NO: 52147 - DNA, 201 bp, Bos taurus; identical to SEQ ID NO: 10904

SEQ ID NO: 52148 - DNA, 201 bp, Bos taurus; identical to SEQ ID NO: 10905

SEQ ID NO: 52149 - DNA, 201 bp, Bos taurus; identical to SEQ ID NO: 10906

SEQ ID NO: 52150 - DNA, 201 bp, Bos taurus
ggccccctggcagcagtagctagtgatagaactacatacaagtgggactggagttgaactcaaaggggacaggggtgtttccagtatgcagtcagaaccacgacatcaggcctgacactggtgtgctggtttgcattcccataacagtcctccttaatcataagctctacctggattccaagctccctcaaagacattatt

SEQ ID NO: 52151 - DNA, 201 bp, Bos taurus; identical to SEQ ID NO: 10907

SEQ ID NO: 52152 - DNA, 201 bp, Bos taurus
attcattaaactacacttcaacattcccattaaataaacagagttaatagaagggagaatagaggtgggatgaggagggatgtggctccaaatgcagcaaggagcttgtgcgtgtaagtgatttaaacattactcatttattcagtacaaattaagtgttttatagaaattcaactagaataagcagattaaactatgaat

SEQ ID NO: 52153 - DNA, 201 bp, Bos taurus; identical to SEQ ID NO: 10908

SEQ ID NO: 52154 - DNA, 201 bp, Bos taurus
agtcattatgctcatatttcatatccaatggctcagtctgaatgccctctgtactaacactcattgggattcttggcctggagtcagcgcactgttagatcggggttcattctgtgttatgtaccttgtggctgtgattgggaatttcctaattacagtgataatcaaatataaaaacagactctctctctctctctctct

SEQ ID NO: 52155 - DNA, 201 bp, Bos taurus
ctatagtataaaacattcacccttcactatctgaaacgtcagaacattttatcctttatggcttctctgtgtattatcagagattatccctggtaagtcactggggatagagattctgcattgattatgagaaactggagggttggcttcaaaaagaatgtgtatgccatgtcatccaatatagttccaggatgaaaaaaa

SEQ ID NO: 52156 - DNA, 201 bp, Bos taurus
tgagcccctcttttgtactgactgctgcagccaccatcatgcaagtgtcagggcaagagttgttgtctttcaccattgatgctgctgcttctgcctaagttgcttcagtctacttggtatgattaaagagtgaaacaggtttttctttctattaccataactctgtagggataaggctgcaagttgttataagacaatcaa

SEQ ID NO: 52157 - DNA, 201 bp, Bos taurus
agacaaaagccaccagagagcctcctctggtccactaagagctagcgataccagcagaagcagcgcattgcactttcaatctggccaaatcctgcaattccctatctgtgtcctcagaaacctcatggacatcagcagtgtttttatccctatagatttgaggcacagccatgacaaagactcactttcaggttgctggcc

SEQ ID NO: 52158 - DNA, 201 bp, Bos taurus; identical to SEQ ID NO: 10911

SEQ ID NO: 52159 - DNA, 201 bp, Bos taurus; identical to SEQ ID NO: 10912

SEQ ID NO: 52160 - DNA, 201 bp, Bos taurus
gacagaggagcctgagaggctacaatcctctcagggttgcaaagagttggacatgactgagcgactaggcacacacaccaatgaaactgcagtgaaatccaagtatagcaagaaaattgcaattcctctaaaggctttagtttgtttatagatatgcgatccatataggaagaaattgttattaaatcttatcctatcagt

SEQ ID NO: 52161 - DNA, 201 bp, Bos taurus; identical to SEQ ID NO: 10914

SEQ ID NO: 52162 - DNA, 201 bp, Bos taurus; identical to SEQ ID NO: 10915

SEQ ID NO: 52163 - DNA, 201 bp, Bos taurus
tgaggcgagctgatttgcattttttaaaaagatctttctggctgctttgagaagaatggattgtaggggagcactcgaggagggcagttaagaggctgttggcagtagtctgagtgagaaatgatagttttggagttgggggcgagggggagtgtgagtagggtggcagagatggcgagatgaaattagaatgctttgaag

SEQ ID NO: 52164 - DNA, 201 bp, Bos taurus
cagcccttttggctaaatgcagtttcattttcagaagtgactaccctcatttggaagttagaaagctgacttttcaatcgaggctacagatgaagatactaattaaaaggcctcctgttattcagatcccacatctccagctttcaatcaactttccagagggcagggcagacttgagaatccccctgcaaagcacagaag

SEQ ID NO: 52165 - DNA, 201 bp, Bos taurus; identical to SEQ ID NO: 10916

SEQ ID NO: 52166 - DNA, 201 bp, Bos taurus
aatgtcttcaccattgattctgatacctctgcatcacagaggagattgtattataaacctgataggttgttgggcttttggtttttttaatgcaagtgccggacttaagctttgattgcctatacatctacttcaaagatggctatctttttcggggggtgggaagaggggagcaaataatttttaattttctttctttct

SEQ ID NO: 52167 - DNA, 201 bp, Bos taurus; identical to SEQ ID NO: 10917

SEQ ID NO: 52168 - DNA, 201 bp, Bos taurus
gggggccaaaggagcccaagtgactcactgactacaaggaagtgagtttggttcccagctcagtgtgaggatttcctccaaggcatcaccaccagagcaagggccccaccccactcaggcctcctgcatgggagggcaaggcctggggttcgatactcacctgctgacttcttggacattgttggctcgagcagcttccat

SEQ ID NO: 52169 - DNA, 201 bp, Bos taurus; identical to SEQ ID NO: 10918

SEQ ID NO: 52170 - DNA, 201 bp, Bos taurus; identical to SEQ ID NO: 10919

SEQ ID NO: 52171 - DNA, 201 bp, Bos taurus; identical to SEQ ID NO: 10920

SEQ ID NO: 52172 - DNA, 201 bp, Bos taurus; identical to SEQ ID NO: 10921

SEQ ID NO: 52173 - DNA, 201 bp, Bos taurus
ggaccagggcccttgtcactgatcactggtctagtggctaggatctggtgcttttactgctgtaacatggtctcaatctctggctgggaatccaaatcccattccaagcctttgtaggctgaggccacacaagattaacaggaaggctatttgtacatccagatgagaccttcgaagacacaggaggaaaaaaagcaaggt

SEQ ID NO: 52174 - DNA, 201 bp, Bos taurus; identical to SEQ ID NO: 10922

SEQ ID NO: 52175 - DNA, 201 bp, Bos taurus
ctcatcctctgccacccccttctacccaggcttttctgtgggccatatgctcccctgtacagacccctctgctctaaaccatgcacagcactagtgcattttctctccaattggccacttagtttctctgttctgtattcatgagctcccttgattctggtcagctatttttaaaatatataacatggatataattcttgt

SEQ ID NO: 52176 - DNA, 201 bp, Bos taurus; identical to SEQ ID NO: 10924

SEQ ID NO: 52177 - DNA, 201 bp, Bos taurus
aaagaatttcaatgagcagagattgggatgaagggcattttatgatgagggaatggtagaaacagaagccaaaatcaagaatgttcaagtagtattgtgattatagtctaaggcaaagcgaagcagggaataaacataaaaaggctatatgggcttcactaattagagttgtgactgtcatgtttttaggaagatatcgtt

SEQ ID NO: 52178 - DNA, 201 bp, Bos taurus
gctctgccctcaccaccattggtccggcccctccaggccccgccccgaagcgctcaccgatcgcgcagatcttgcgctcgcccagccaaactccggtgtaaggtgggggccgcgcgcgggcgccgggtaggcccaggagctcgcacagtcgcaccgcgcacgcctccagcgcggccacgtgggcgcgcaggcgcaggccga

SEQ ID NO: 52179 - DNA, 201 bp, Bos taurus; identical to SEQ ID NO: 10929

SEQ ID NO: 52180 - DNA, 201 bp, Bos taurus; identical to SEQ ID NO: 10932

SEQ ID NO: 52181 - DNA, 201 bp, Bos taurus
tgagtacaaagcagactctctcatcggccctcgggcaggaaccaggtcccaccccactctgtccccagggttcagcacagggcctggcacagagcaaagacggatgaatgagcgaagggctgaataaaatgaatgttctggcaaagaaaccctccctgatcacagtgtgccgagctctccagggccgggaaccgtttctat

SEQ ID NO: 52182 - DNA, 201 bp, Bos taurus; identical to SEQ ID NO: 10934

SEQ ID NO: 52183 - DNA, 201 bp, Bos taurus; identical to SEQ ID NO: 10935

SEQ ID NO: 52184 - DNA, 201 bp, Bos taurus; identical to SEQ ID NO: 10936

SEQ ID NO: 52185 - DNA, 201 bp, Bos taurus
ggccaggctcagagtgaggtttaaggaacaggaggctgaggtttagggctttgtacagcaaacttctatggagatgggagtgggcagggcagacggggtctctgaggatgtctggcctgctgtctgggaaactactgtccagtccagggttcaggaattcatccccccgagtaaggaagagccctgggaggtgcttgggct

SEQ ID NO: 52186 - DNA, 201 bp, Bos taurus; identical to SEQ ID NO: 10937

SEQ ID NO: 52187 - DNA, 201 bp, Bos taurus; identical to SEQ ID NO: 10938

SEQ ID NO: 52188 - DNA, 201 bp, Bos taurus
gaggagacatatccttggctactctgcagctcactggaatacttctgattccttccagcgtttaatgatgtgactttgggagaagcaactagtggatttatgtaaggtcgtatcacttcattggttaaatctctagatagtgtttctgctcacctgtttctaatctagttctctgttcttttttataaatagaatcaagtt

SEQ ID NO: 52189 - DNA, 201 bp, Bos taurus; identical to SEQ ID NO: 10939

SEQ ID NO: 52190 - DNA, 201 bp, Bos taurus; identical to SEQ ID NO: 10940

SEQ ID NO: 52191 - DNA, 201 bp, Bos taurus; identical to SEQ ID NO: 10941

SEQ ID NO: 52192 - DNA, 201 bp, Bos taurus; identical to SEQ ID NO: 10942

SEQ ID NO: 52193 - DNA, 201 bp, Bos taurus; identical to SEQ ID NO: 10943

SEQ ID NO: 52194 - DNA, 201 bp, Bos taurus; identical to SEQ ID NO: 10944

SEQ ID NO: 52195 - DNA, 201 bp, Bos taurus; identical to SEQ ID NO: 10946

SEQ ID NO: 52196 - DNA, 201 bp, Bos taurus; identical to SEQ ID NO: 10947

SEQ ID NO: 52197 - DNA, 201 bp, Bos taurus; identical to SEQ ID NO: 10951

SEQ ID NO: 52198 - DNA, 201 bp, Bos taurus
ctttaagcctggccccctttctctgctcccaactgttcacaggtccctcaccctacagtcattcccctggtgaaacagaacacggcagacaccccagttggtgctcctcaggccctgagcccagtgtgtctttcccaccacaaatccatcctccacctgaagtcttccattagctcaatcagaacaaggtatccctcctct

SEQ ID NO: 52199 - DNA, 201 bp, Bos taurus; identical to SEQ ID NO: 10953

SEQ ID NO: 52200 - DNA, 201 bp, Bos taurus; identical to SEQ ID NO: 10954

SEQ ID NO: 52201 - DNA, 201 bp, Bos taurus; identical to SEQ ID NO: 10955

SEQ ID NO: 52202 - DNA, 201 bp, Bos taurus; identical to SEQ ID NO: 10959

SEQ ID NO: 52203 - DNA, 201 bp, Bos taurus; identical to SEQ ID NO: 10960

SEQ ID NO: 52204 - DNA, 201 bp, Bos taurus
tttcccatagtgagaaacctgactttcattgttcttgatatatttatttatttgcttaatctctctgcatgtagctgatttcctgatactgctaggcccccaccccctctttgcaaatagacctgccctttgctgaggttggtgtcctctgcgtagcacgcagcttactttgttaggcctgactcatggctatttgatagt

SEQ ID NO: 52205 - DNA, 201 bp, Bos taurus
tgaactcagggctttgcatggtctccagataatggaaaaccccctctgtccatggaaaagcggcttctcctgccattccacagacccaaaagggacctgaggtttgggtgttctcaaggagatacacccagatttccacattcctgttctcagggtcccactccttccctgtggggccctaacacttgcagaactataaat

SEQ ID NO: 52206 - DNA, 201 bp, Bos taurus; identical to SEQ ID NO: 10961

SEQ ID NO: 52207 - DNA, 201 bp, Bos taurus; identical to SEQ ID NO: 10962

SEQ ID NO: 52208 - DNA, 201 bp, Bos taurus
attatttattactcgactaacatctgcctctgtcttttagactctgtctggtctagtccccagactctgtgatcaccagagttttctgtctttccctggatggctcactgcctagcacatgcatggtgcacaggatgcaatccagtttcatgaccttcttacttgaagactaagcatattcctgccttggggcctctgcac

SEQ ID NO: 52209 - DNA, 201 bp, Bos taurus; identical to SEQ ID NO: 10963

SEQ ID NO: 52210 - DNA, 201 bp, Bos taurus; identical to SEQ ID NO: 10964

SEQ ID NO: 52211 - DNA, 201 bp, Bos taurus; identical to SEQ ID NO: 10965

SEQ ID NO: 52212 - DNA, 201 bp, Bos taurus; identical to SEQ ID NO: 10966

SEQ ID NO: 52213 - DNA, 201 bp, Bos taurus; identical to SEQ ID NO: 10967

SEQ ID NO: 52214 - DNA, 201 bp, Bos taurus; identical to SEQ ID NO: 10968

SEQ ID NO: 52215 - DNA, 201 bp, Bos taurus; identical to SEQ ID NO: 10969

SEQ ID NO: 52216 - DNA, 201 bp, Bos taurus
tccaaactgctttcgttgtcccatcatgtcctctacagtcttgtctgttgtttctcttttataaagacacctgtgattacaaagggcccctcaagataatccaggataatcccctcaacacaagattctaaatctgatcatatccacaaagacccttttaaaatataagatgatagtcacaaggcccatggactagacctg

SEQ ID NO: 52217 - DNA, 201 bp, Bos taurus
attggattaaaatcaagagacgctttttatcaggaactaataaatatgtttggcaacagttttatttgtatgggaggaaacagcaactgcaaagtatcagcgtcaactgggtgactgtaactatatcacaagatctcatttcacaacactgagttataacagcaggaggctaattctgcaaccacaatttaggcaaagctc

SEQ ID NO: 52218 - DNA, 201 bp, Bos taurus; identical to SEQ ID NO: 10970

SEQ ID NO: 52219 - DNA, 201 bp, Bos taurus; identical to SEQ ID NO: 10971

SEQ ID NO: 52220 - DNA, 201 bp, Bos taurus; identical to SEQ ID NO: 10972

SEQ ID NO: 52221 - DNA, 201 bp, Bos taurus
ggggagaagaccagaaattattcatgtaattttaattccccacatccctaaattggcagatctttcaaccatgcacaaagcaaaagtatagctgcaacttcctgaaatcataacagattcctcatatttgtagaatcgtgagaccttcacggtctgttacgctatttactcttctagcatctctcagttgctcagatgcca

SEQ ID NO: 52222 - DNA, 201 bp, Bos taurus; identical to SEQ ID NO: 10973

SEQ ID NO: 52223 - DNA, 201 bp, Bos taurus; identical to SEQ ID NO: 10974

SEQ ID NO: 52224 - DNA, 201 bp, Bos taurus; identical to SEQ ID NO: 10975

SEQ ID NO: 52225 - DNA, 201 bp, Bos taurus; identical to SEQ ID NO: 10976

SEQ ID NO: 52226 - DNA, 201 bp, Bos taurus; identical to SEQ ID NO: 10977

SEQ ID NO: 52227 - DNA, 201 bp, Bos taurus
aaacttgcttctaggcactgggacagtctccaccccaaatctagcctgattgcgaacctcctgtgtgcagttcctattattgaaagctggccaagggactgttctgtttagggtggatcagacattggacatgagagttggggtgcctacctattcagtttgtgtgccattaagtgttagatacagctggggctgtgaaga

SEQ ID NO: 52228 - DNA, 201 bp, Bos taurus; identical to SEQ ID NO: 10981

SEQ ID NO: 52229 - DNA, 201 bp, Bos taurus
aaggcacatacttgaagtctaccagtacatcagagtaatttccctcataataacatatttacattttaatccttgaaacaaccctttgaaaggtgtgactattgttcccgttataaagacaaggaagccaaaatagggagggtaaagcaactcgttcctccagcttgttgcctacttcataaagcttagatatgctgccta

SEQ ID NO: 52230 - DNA, 201 bp, Bos taurus; identical to SEQ ID NO: 10982

SEQ ID NO: 52231 - DNA, 201 bp, Bos taurus; identical to SEQ ID NO: 10983

SEQ ID NO: 52232 - DNA, 201 bp, Bos taurus; identical to SEQ ID NO: 10984

SEQ ID NO: 52233 - DNA, 201 bp, Bos taurus; identical to SEQ ID NO: 10985

SEQ ID NO: 52234 - DNA, 201 bp, Bos taurus
tcccggtgtttctgttgctgtctttttgatgtcacaaagcgaagttgataaacacattcaagtcacaattaaaaaacattttcactgaccagttgccaccgacgatatcatcagacagcttcgttgctgctgtaacaatgcgtttaatggtgttgatgtgcaggcgagaaggtgcttccctttatctggtccttacctcgc

SEQ ID NO: 52235 - DNA, 201 bp, Bos taurus; identical to SEQ ID NO: 10987

SEQ ID NO: 52236 - DNA, 201 bp, Bos taurus; identical to SEQ ID NO: 10988

SEQ ID NO: 52237 - DNA, 201 bp, Bos taurus; identical to SEQ ID NO: 10989

SEQ ID NO: 52238 - DNA, 201 bp, Bos taurus; identical to SEQ ID NO: 10990

SEQ ID NO: 52239 - DNA, 201 bp, Bos taurus; identical to SEQ ID NO: 10992

SEQ ID NO: 52240 - DNA, 201 bp, Bos taurus; identical to SEQ ID NO: 10994

SEQ ID NO: 52241 - DNA, 201 bp, Bos taurus; identical to SEQ ID NO: 10996

SEQ ID NO: 52242 - DNA, 201 bp, Bos taurus; identical to SEQ ID NO: 10997

SEQ ID NO: 52243 - DNA, 201 bp, Bos taurus; identical to SEQ ID NO: 10998

SEQ ID NO: 52244 - DNA, 201 bp, Bos taurus
atatgactgcagagatgagtggtaccatccttaggcctgggcctattctggccctccacagtctgcatgtctccatggggcagggcctatgtggggccaaagagccatgccctcccttctagaatctagaatctgcatcatgctgtgtatacccaaaccctggaattccctgtccacatctgcctccatggcctatgtggg

SEQ ID NO: 52245 - DNA, 201 bp, Bos taurus; identical to SEQ ID NO: 10999

SEQ ID NO: 52246 - DNA, 201 bp, Bos taurus; identical to SEQ ID NO: 11000

SEQ ID NO: 52247 - DNA, 201 bp, Bos taurus
cgctcaggtggcgatggcgtggtcagtggcgtgtccggggtgacttgtcacactgcagcctcaacggccagagtgggccagccgtgtgacagccctgccctcagagaagagcatttccaagcagagggcacagcaaatgtgaggacctgaggtggaaaggacattggtgatttgaaggagatacaaggccggtgtggctgg

SEQ ID NO: 52248 - DNA, 201 bp, Bos taurus; identical to SEQ ID NO: 11001

SEQ ID NO: 52249 - DNA, 201 bp, Bos taurus; identical to SEQ ID NO: 11005

SEQ ID NO: 52250 - DNA, 201 bp, Bos taurus; identical to SEQ ID NO: 11006

SEQ ID NO: 52251 - DNA, 201 bp, Bos taurus; identical to SEQ ID NO: 11007

SEQ ID NO: 52252 - DNA, 201 bp, Bos taurus; identical to SEQ ID NO: 11008

SEQ ID NO: 52253 - DNA, 201 bp, Bos taurus; identical to SEQ ID NO: 11009

SEQ ID NO: 52254 - DNA, 201 bp, Bos taurus; identical to SEQ ID NO: 11010

SEQ ID NO: 52255 - DNA, 201 bp, Bos taurus; identical to SEQ ID NO: 11012

SEQ ID NO: 52256 - DNA, 201 bp, Bos taurus; identical to SEQ ID NO: 11013

SEQ ID NO: 52257 - DNA, 201 bp, Bos taurus; identical to SEQ ID NO: 11014

SEQ ID NO: 52258 - DNA, 201 bp, Bos taurus; identical to SEQ ID NO: 11015

SEQ ID NO: 52259 - DNA, 201 bp, Bos taurus; identical to SEQ ID NO: 11016

SEQ ID NO: 52260 - DNA, 201 bp, Bos taurus
ttacaatttttttttcaattcttaggtgtgggcagaagaaaaaactggtgatcaacaatgggaatggaaccatggaggagagaaagcccagcggactcaatggagaagctagcaagtctcaggagatggtgcatttggtgaacaaggggtcgtcagagacccaagaccagttcatgacggcagatgagacgcggaacttgc

SEQ ID NO: 52261 - DNA, 201 bp, Bos taurus; identical to SEQ ID NO: 11018

SEQ ID NO: 52262 - DNA, 201 bp, Bos taurus; identical to SEQ ID NO: 11019

SEQ ID NO: 52263 - DNA, 201 bp, Bos taurus; identical to SEQ ID NO: 11021

SEQ ID NO: 52264 - DNA, 201 bp, Bos taurus; identical to SEQ ID NO: 11022

SEQ ID NO: 52265 - DNA, 201 bp, Bos taurus; identical to SEQ ID NO: 11023

SEQ ID NO: 52266 - DNA, 201 bp, Bos taurus; identical to SEQ ID NO: 11024

SEQ ID NO: 52267 - DNA, 201 bp, Bos taurus; identical to SEQ ID NO: 11025

SEQ ID NO: 52268 - DNA, 201 bp, Bos taurus; identical to SEQ ID NO: 11027

SEQ ID NO: 52269 - DNA, 201 bp, Bos taurus
aaaaaaaaaacaaaaaacaggccaatttgtcagaggccaggcccacatttctacctttccagtttcccaagtttccaggctgctgccctggctcagttagcgctcgtttcttccgcacaaaggcccgggcctcccactcatctctctccattgtggctccagggggagggtcctttgccccaagatacagtaacttgtcct

SEQ ID NO: 52270 - DNA, 201 bp, Bos taurus
ttggaaggtggaacagatgtctccagtttagaaaggatatctaataaagtctgaaacattggatggcacttctcagtcctcaaactccctcatgaagacatgatccttaggtcttcactttcttgaggaagggggagaaggcactcattaaatattttctgggaccagttagcagtagcaaagtagggagttccatgtcag

SEQ ID NO: 52271 - DNA, 201 bp, Bos taurus; identical to SEQ ID NO: 11028

SEQ ID NO: 52272 - DNA, 201 bp, Bos taurus; identical to SEQ ID NO: 11029

SEQ ID NO: 52273 - DNA, 201 bp, Bos taurus; identical to SEQ ID NO: 11035

SEQ ID NO: 52274 - DNA, 201 bp, Bos taurus; identical to SEQ ID NO: 11036

SEQ ID NO: 52275 - DNA, 201 bp, Bos taurus
acaaagctacatacaaaactacaagtttgaaactttcaaagatgtgaaggtgaatgccatcagggtcaggtgtgaatgaggttgcggcctgccctccatctgccgttgctgacgatccttcagctctacacctcccacctcctgttggaaacccttgcagattcactcaatgccaggccctgtatgctagtggttatactg

SEQ ID NO: 52276 - DNA, 201 bp, Bos taurus; identical to SEQ ID NO: 11038

SEQ ID NO: 52277 - DNA, 201 bp, Bos taurus; identical to SEQ ID NO: 11041

SEQ ID NO: 52278 - DNA, 201 bp, Bos taurus; identical to SEQ ID NO: 11043

SEQ ID NO: 52279 - DNA, 201 bp, Bos taurus; identical to SEQ ID NO: 11046

SEQ ID NO: 52280 - DNA, 201 bp, Bos taurus; identical to SEQ ID NO: 11047

SEQ ID NO: 52281 - DNA, 201 bp, Bos taurus; identical to SEQ ID NO: 11048

SEQ ID NO: 52282 - DNA, 201 bp, Bos taurus
gaaggaatgccttttttaaggcagtggtctccaacacttttggcaccggagaccagttttgtagaagacaatttttccatggacagagtgggggatgatggtttggagatgattctcataaagagaaagcaacctagatcccttcatgtgtagttcacagagggcttgtgtttctattgttaccaagttcaagatttttcc

SEQ ID NO: 52283 - DNA, 201 bp, Bos taurus; identical to SEQ ID NO: 11050

SEQ ID NO: 52284 - DNA, 201 bp, Bos taurus
catcagggaagccaattatagacaaaatgtggtcaaccaagagaagaagaattccataaataaagctaatccagtaaacatcaggttggccaaaaagttcctatgggcttttcaatatgatgttatgagacatcacatgtataacacatggaaaaacccaaatgaacatacataatatcatatggtaatacccaaagaact

SEQ ID NO: 52285 - DNA, 201 bp, Bos taurus; identical to SEQ ID NO: 11057

SEQ ID NO: 52286 - DNA, 201 bp, Bos taurus; identical to SEQ ID NO: 11059

SEQ ID NO: 52287 - DNA, 201 bp, Bos taurus; identical to SEQ ID NO: 11060

SEQ ID NO: 52288 - DNA, 201 bp, Bos taurus; identical to SEQ ID NO: 11061

SEQ ID NO: 52289 - DNA, 201 bp, Bos taurus; identical to SEQ ID NO: 11062

SEQ ID NO: 52290 - DNA, 201 bp, Bos taurus; identical to SEQ ID NO: 11064

SEQ ID NO: 52291 - DNA, 201 bp, Bos taurus; identical to SEQ ID NO: 11066

SEQ ID NO: 52292 - DNA, 201 bp, Bos taurus; identical to SEQ ID NO: 11067

SEQ ID NO: 52293 - DNA, 201 bp, Bos taurus
gggaatgccaggttcctggggataaagaaaggatgatggcagggaggtacccagggagcctgctgatgctcggtaatacttgttactatggctggggaaacggaaaagtgcagtttcccaacctctgaggcaaaccggctaaagacaatggaagttttctaggaggcaattgagtcttcgtaggcttgagatatttatgtg

SEQ ID NO: 52294 - DNA, 201 bp, Bos taurus; identical to SEQ ID NO: 11068

SEQ ID NO: 52295 - DNA, 201 bp, Bos taurus
aatcttaggggcctgtactgtaactttcctaccggggcttggcagagacaccacatggcatctttgttcagtacaaatacctcagtgacatgagatcagctgagccatatggctcaagtggcaaagcaacagcctggatctgtgacaaaggattttcttgctctgagcctcactcaagataagtagcccttgacatcaccc

SEQ ID NO: 52296 - DNA, 201 bp, Bos taurus; identical to SEQ ID NO: 11069

SEQ ID NO: 52297 - DNA, 201 bp, Bos taurus; identical to SEQ ID NO: 11070

SEQ ID NO: 52298 - DNA, 201 bp, Bos taurus; identical to SEQ ID NO: 11071

SEQ ID NO: 52299 - DNA, 201 bp, Bos taurus
cgcactgctttagaaccaccgcagggcctatggcagaggttctgtaatgttctctctgacactacagttcaggagactgagatggcacagctgaaaagtcgcatggccaggatttgaacctaagcactgagcttctctggtggctcagacggtaaagaatctgcctgcaatgcagcagacccaggttcaattcctgggtcg

SEQ ID NO: 52300 - DNA, 201 bp, Bos taurus; identical to SEQ ID NO: 11072

SEQ ID NO: 52301 - DNA, 201 bp, Bos taurus; identical to SEQ ID NO: 11073

SEQ ID NO: 52302 - DNA, 201 bp, Bos taurus; identical to SEQ ID NO: 11074

SEQ ID NO: 52303 - DNA, 201 bp, Bos taurus; identical to SEQ ID NO: 11075

SEQ ID NO: 52304 - DNA, 201 bp, Bos taurus; identical to SEQ ID NO: 11076

SEQ ID NO: 52305 - DNA, 201 bp, Bos taurus
cttgcattcccactgtctgtctcaatatgcacccatgggatgtggtctgggagcccagtagcctcgctggactgaagtttagctgggcgactggcccacgagtactcaacagagaactcatagtaggcacctgagtcctgccatgaaagccagtctctaagaaagggggaactgttccacctgtagcagccttgcctggcg

SEQ ID NO: 52306 - DNA, 201 bp, Bos taurus
tgtgggaacaaaatagaagctcttgtgttataaattttatatctgtgcttgaagtattgggaataaacactgtcagaagaactaagacccctggggtggaaaggaccacctatttgtgccctgaggggtgcttaagccttcccaagggaaccctctcaatcttaatcttttccaccactcccaccggccccgataccaaga

SEQ ID NO: 52307 - DNA, 201 bp, Bos taurus
aaaaaccctcaccaactcctcccctcctacttcctaatattttaaaatatccttaatctaaatgagcgatacaaggtccaaggaactgttttgtaaccattgcctgtgtatattctgcacaagtgaatctgggtttgaaatttactattacatagcttgatgtttcaatcttgactgttcaatatgaatacatgtaacttt

SEQ ID NO: 52308 - DNA, 201 bp, Bos taurus
gctgattttgagataataattgatagtgacaggatgaaaaaagctgattttgagataaccaatagaaagactataaaatgcagtcatgagaactcaaagagcacactggttcaagactgtttaatgtagtggaaacaagccctacacatttcagtacgtcttgagtgcatagctcctctctggccagcaacaggttcacgc

SEQ ID NO: 52309 - DNA, 201 bp, Bos taurus
ccatctcttatctatcaaaaaaaaaaaaaagaaaagttcattcaggtttttccataagaaggtatggcaaaacccaattgaaatttttggccaacccaatgtataaagtctataaaataaactgctgtctgtagaagtggcaagcagctcggcgattcccccttgtttgtgtgggcaagttctctccactctcagtggcct

SEQ ID NO: 52310 - DNA, 201 bp, Bos taurus; identical to SEQ ID NO: 11078

SEQ ID NO: 52311 - DNA, 201 bp, Bos taurus
agttggccagtgattacgattgtttgagccccaaagaaaccttcaaggaggccaaactatttaataccttcttcagatgtagccacagaagattggggaaaagagaattttccagaactggactggccagattagcttcctctgccagagcaagtcttgactgttcaggccagtaggatttacctacctcgaaggcagtgg

SEQ ID NO: 52312 - DNA, 201 bp, Bos taurus; identical to SEQ ID NO: 11080

SEQ ID NO: 52313 - DNA, 201 bp, Bos taurus; identical to SEQ ID NO: 11081

SEQ ID NO: 52314 - DNA, 201 bp, Bos taurus
atgcccacatctggacgccgactcttcggggccggctgagcgtccacctgcccctctgggcgccatgaccggtgccccttctccaccccctgccctttctcatcgctttctcctttatccccagaggaatttggcgtattgagttacttcatatttcttctgaactctccttttctctagctttaaagattaagtattttt

SEQ ID NO: 52315 - DNA, 201 bp, Bos taurus; identical to SEQ ID NO: 11082

SEQ ID NO: 52316 - DNA, 201 bp, Bos taurus; identical to SEQ ID NO: 11083

SEQ ID NO: 52317 - DNA, 201 bp, Bos taurus; identical to SEQ ID NO: 11084

SEQ ID NO: 52318 - DNA, 201 bp, Bos taurus; identical to SEQ ID NO: 11085

SEQ ID NO: 52319 - DNA, 201 bp, Bos taurus; identical to SEQ ID NO: 11086

SEQ ID NO: 52320 - DNA, 201 bp, Bos taurus; identical to SEQ ID NO: 11087

SEQ ID NO: 52321 - DNA, 201 bp, Bos taurus; identical to SEQ ID NO: 11088

SEQ ID NO: 52322 - DNA, 201 bp, Bos taurus; identical to SEQ ID NO: 11089

SEQ ID NO: 52323 - DNA, 201 bp, Bos taurus; identical to SEQ ID NO: 11090

SEQ ID NO: 52324 - DNA, 201 bp, Bos taurus; identical to SEQ ID NO: 11091

SEQ ID NO: 52325 - DNA, 201 bp, Bos taurus; identical to SEQ ID NO: 11092

SEQ ID NO: 52326 - DNA, 201 bp, Bos taurus; identical to SEQ ID NO: 11093

SEQ ID NO: 52327 - DNA, 201 bp, Bos taurus; identical to SEQ ID NO: 11094

SEQ ID NO: 52328 - DNA, 201 bp, Bos taurus; identical to SEQ ID NO: 11095

SEQ ID NO: 52329 - DNA, 201 bp, Bos taurus; identical to SEQ ID NO: 11096

SEQ ID NO: 52330 - DNA, 201 bp, Bos taurus; identical to SEQ ID NO: 11097

SEQ ID NO: 52331 - DNA, 201 bp, Bos taurus; identical to SEQ ID NO: 11098

SEQ ID NO: 52332 - DNA, 201 bp, Bos taurus; identical to SEQ ID NO: 11101

SEQ ID NO: 52333 - DNA, 201 bp, Bos taurus; identical to SEQ ID NO: 11102

SEQ ID NO: 52334 - DNA, 201 bp, Bos taurus; identical to SEQ ID NO: 11103

SEQ ID NO: 52335 - DNA, 201 bp, Bos taurus; identical to SEQ ID NO: 11104

SEQ ID NO: 52336 - DNA, 201 bp, Bos taurus
ctgttctgtgtcgtcaggtgtcttgcttcaatgagttagagatctgtatccatcctgatggggtcatcccagtgctgactttcctcagggatcacagcaatgcacaattcaaatccttggctgacttgacggcggtggacatccccacccggcagaaccgttttgaggtcagtcaggagatttgaggtttggagcatgaag

SEQ ID NO: 52337 - DNA, 201 bp, Bos taurus; identical to SEQ ID NO: 11105

SEQ ID NO: 52338 - DNA, 201 bp, Bos taurus; identical to SEQ ID NO: 11106

SEQ ID NO: 52339 - DNA, 201 bp, Bos taurus; identical to SEQ ID NO: 11107

SEQ ID NO: 52340 - DNA, 201 bp, Bos taurus
acacatttgtgatcataagtattgatacatgtcttcaaatgtacaactttgagccagacctgggatgtaatgagccttctgtgtagctctttggcctcccaaattactttcaacctgattgtctttatcacattcagttcagttcagtcactcagtcatgtccgactctttgcggcccccatggactgcagcacaccaggc

SEQ ID NO: 52341 - DNA, 201 bp, Bos taurus; identical to SEQ ID NO: 11111

SEQ ID NO: 52342 - DNA, 201 bp, Bos taurus; identical to SEQ ID NO: 11113

SEQ ID NO: 52343 - DNA, 201 bp, Bos taurus
tctcaccgtatttttcattgacattcatcctaaggttttttcacttggtaatttctccttctgcctatataatacattttcccattatagtctcagtttataagttaattaataagtacagagacacggttgtccttcaaaagaatgttcctgtgacctcacaccagacaccattatatccacactctagagtcaagaaag

SEQ ID NO: 52344 - DNA, 201 bp, Bos taurus; identical to SEQ ID NO: 11114

SEQ ID NO: 52345 - DNA, 201 bp, Bos taurus; identical to SEQ ID NO: 11115

SEQ ID NO: 52346 - DNA, 201 bp, Bos taurus; identical to SEQ ID NO: 11116

SEQ ID NO: 52347 - DNA, 201 bp, Bos taurus; identical to SEQ ID NO: 11117

SEQ ID NO: 52348 - DNA, 201 bp, Bos taurus; identical to SEQ ID NO: 11118

SEQ ID NO: 52349 - DNA, 201 bp, Bos taurus; identical to SEQ ID NO: 11119

SEQ ID NO: 52350 - DNA, 201 bp, Bos taurus
cgttgattgacaagatgaatgaataattggatggatgaatggataaagaggtaccactgcatccccaaatacttgcaagaggcctggaaccttaggaatccacacagtctgtcatttttagctttttcctccaatttccattctagataagaatttatgccctagaaaacatccttttcaacacggccctatggatggtat

SEQ ID NO: 52351 - DNA, 201 bp, Bos taurus; identical to SEQ ID NO: 11120

SEQ ID NO: 52352 - DNA, 201 bp, Bos taurus
caaatgcgagaggaagtggaaggaagtttcaacaacaaatttgctgcattttgctcttaatagaagagacgctcctccagcagatgcccctggcctatcaatccagtcctctgaacctggggacagcacaagatgggcagaagtcttacgagagctccctgtcctgctccttcccggggcctgcacttataccactaaccc

SEQ ID NO: 52353 - DNA, 201 bp, Bos taurus
cctgagctccagcagaggagcgggaagccggaactcttcccttcaaggcgttttggcagcacgtcaagtgatggaggcccggaggacgggtcgtctaccatcgagaaaatccgagagcgttacgagaacggaggcgatgtgtgaagtgcctcatcagaaggaacgtctgctttgtccgtagacagaggagggcagacaccg

SEQ ID NO: 52354 - DNA, 201 bp, Bos taurus
ctccggaagagctctcgtcactggacacaaactctttgctcttgaagctctcgctcagctgccttgatgaagacttcgatgatgagccccgggagggtgtagattttttctccatcttcactttgactttcttcttcttcttggacttgtccctaggtgagcaagagggaagggggtgctgggccctcaggttccccacat

SEQ ID NO: 52355 - DNA, 201 bp, Bos taurus; identical to SEQ ID NO: 11123

SEQ ID NO: 52356 - DNA, 201 bp, Bos taurus; identical to SEQ ID NO: 11124

SEQ ID NO: 52357 - DNA, 201 bp, Bos taurus; identical to SEQ ID NO: 11125

SEQ ID NO: 52358 - DNA, 201 bp, Bos taurus; identical to SEQ ID NO: 11127

SEQ ID NO: 52359 - DNA, 201 bp, Bos taurus; identical to SEQ ID NO: 11128

SEQ ID NO: 52360 - DNA, 201 bp, Bos taurus; identical to SEQ ID NO: 11129

SEQ ID NO: 52361 - DNA, 201 bp, Bos taurus
cgctgaggactgagtccctccccaccggagccttgccacagactgtttgggcttcctcatgccatgggggctgggctccaggaagcaggcagaggaagccagtgttaaggcctggaaaccgccacagcatcgctcccatccttctctgctgtaacacgcttccctggtggctcagacggtaaaaagtccaccgcagtgtag

SEQ ID NO: 52362 - DNA, 201 bp, Bos taurus
aatgaggaatgagacttgggcaaagcagaagagcagggaagaactggtgaggaggaaggagcaagactggccacatggccgctcccgccacttagacctgtgctcctggtggcggcacgtccttgactgaagtttaattctggtggtggtcctgggcacgtggtctgccttacatccctgcagacaaggtggggccagtaa

SEQ ID NO: 52363 - DNA, 201 bp, Bos taurus
taatattcagaatatacaaaaaactggcctaactcagtaacaaacaatgcaattaaaaatgggcaaaaggcttgaatacacagttcttcaatgaagacacatgcatggccaacaggcatgttaaaagatgctcaacatcactaatcataaggtttacaaaatcaaaatgaaatgttacctcacacccattaggatggccac

SEQ ID NO: 52364 - DNA, 201 bp, Bos taurus; identical to SEQ ID NO: 11134

SEQ ID NO: 52365 - DNA, 201 bp, Bos taurus; identical to SEQ ID NO: 11135

SEQ ID NO: 52366 - DNA, 201 bp, Bos taurus; identical to SEQ ID NO: 11136

SEQ ID NO: 52367 - DNA, 201 bp, Bos taurus; identical to SEQ ID NO: 11138

SEQ ID NO: 52368 - DNA, 201 bp, Bos taurus; identical to SEQ ID NO: 11141

SEQ ID NO: 52369 - DNA, 201 bp, Bos taurus
ggcagtgttccttgggaggtgggcagatgggtgggccttggtttccacgatcaggtctgagtctaccctcaagcctttaaatagcagttaaccttgggccagttcctgaacccagctgggctttaatccctgctctggaaatcaggaacagcagaacttacctttcaagcctggcccgaggatcccttgagatcacgtgag

SEQ ID NO: 52370 - DNA, 201 bp, Bos taurus; identical to SEQ ID NO: 11142

SEQ ID NO: 52371 - DNA, 201 bp, Bos taurus
ttttcagcagtctccagccctgttggtttgaacgtctggaagcaaataggaaagacaaaaaattatggttgaaagaggttggtcagcaggctgcataatacgggcgaagcactgtgcgaggtcaaaacagggaatcaagaagggctgtgcgtgatggcctgtttggtcatccttcttaaatgataaataccccattctcag

SEQ ID NO: 52372 - DNA, 201 bp, Bos taurus
ttactacctattttaaacatatgtttctcctagaatcgttattgtggttttttgggggggggcggtaatattgggaagacccgattttctgatgctactaccttatacccacagttgcccagaaacctggggaaaaacgagctggttgttcacaagtgcactttaatttgctcgactgaacatcccagagctagtaggtgg

SEQ ID NO: 52373 - DNA, 201 bp, Bos taurus
agagaccagggagacagatatggtgagaaagccatgctctgttctaagacttctcagtacaaggcatctccacgtggaaccatgcctgcccaccagaggattgagacaacaggaaagtgattgaagttaatacaagaaacagattggtttaagtaagaggaagagaaactaatttctgttaaatatacaccatctgtcagg

SEQ ID NO: 52374 - DNA, 201 bp, Bos taurus; identical to SEQ ID NO: 11143

SEQ ID NO: 52375 - DNA, 201 bp, Bos taurus; identical to SEQ ID NO: 11144

SEQ ID NO: 52376 - DNA, 201 bp, Bos taurus; identical to SEQ ID NO: 11146

SEQ ID NO: 52377 - DNA, 201 bp, Bos taurus
ccacgtgacgaagcatccactgagaggaaaggccactgctctggggaattggggggggcggggccgggcagcctcctcccacatgtgcatccagacccccaggtgtgcccaggggtgagtcctctgcggggctccaattcactgccctgagttgcaataaagccacagagttgattccaggcctgcttggcagtgtctctc

SEQ ID NO: 52378 - DNA, 201 bp, Bos taurus; identical to SEQ ID NO: 11148

SEQ ID NO: 52379 - DNA, 201 bp, Bos taurus; identical to SEQ ID NO: 11149

SEQ ID NO: 52380 - DNA, 201 bp, Bos taurus; identical to SEQ ID NO: 11150

SEQ ID NO: 52381 - DNA, 201 bp, Bos taurus; identical to SEQ ID NO: 11151

SEQ ID NO: 52382 - DNA, 201 bp, Bos taurus
aggagcctggaagagcctgagtcaacactatcgctgacattgcttctatggctaaagatggcccagccttcaaaacatgactccaatccttttctcctcacctctcttctcctttcttatttcatctcccatgcccttctctccctctcttcttcaccattttcactttatttattttcctttcttctttttgttgctatt

SEQ ID NO: 52383 - DNA, 201 bp, Bos taurus
cactaggctacaggggtgggcagggctctccctggttccttcagtgatgtcttcgaagggctgcccaccccgcttgcctgcggtggggccccacatggtgtttcagtgcctcgacgctattgcttcccctttgtctggggcagtcatctctctgactagctctcagcacagccccaggggtgatgaggccttagaccatga

SEQ ID NO: 52384 - DNA, 201 bp, Bos taurus
gccttgggggagaagttgagagggcttacaaaggcttctgtcttttcctgtgctttctgttgattcttaatgatggaaaagtcagaatggaacagagcactggcctggagagggccagtgactaccttgggtggaaggaaggaggagtgactggcagaggatgtctgggacctggcaattccttgactacttagtggttat

SEQ ID NO: 52385 - DNA, 201 bp, Bos taurus; identical to SEQ ID NO: 11153

SEQ ID NO: 52386 - DNA, 201 bp, Bos taurus
ttcatactgacccatcattagcctcttccacactgctgagcacttggagtataacctcagttctctgtgtaatggcattcttggtctcttgcatgataaggtgttccacatctgtcatgcatatttcttgttctagatctagaatcatccacttttcaaaggagttctgcttcattttagtgagaaatggtatttagagag

SEQ ID NO: 52387 - DNA, 201 bp, Bos taurus
ggccctcatggcagcgcttgagctttcctttttcaagtcccaccgatcactcctcaaagaaacagaaacaaaaactagtttctactctgatggaaacagacggcccacttcttacgcagatgtgctttcaggccctaaacacttgccatgaataaaaacggaatcaaagatatgataaagatacatccttagatcataaaa

SEQ ID NO: 52388 - DNA, 201 bp, Bos taurus; identical to SEQ ID NO: 11154

SEQ ID NO: 52389 - DNA, 201 bp, Bos taurus; identical to SEQ ID NO: 11155

SEQ ID NO: 52390 - DNA, 201 bp, Bos taurus; identical to SEQ ID NO: 11156

SEQ ID NO: 52391 - DNA, 201 bp, Bos taurus; identical to SEQ ID NO: 11157

SEQ ID NO: 52392 - DNA, 201 bp, Bos taurus
ctcttcttactttgtattattgtattttgtttatgtatctattgtctgtttgacccccattgaaatataagtcagggtttttaattgaccactcttttctattgcttttattgaccactctattctattgcttagtaagtagtacctggttcgtatctgacacagaatagacactatttgttcagtaaatgaatggacata

SEQ ID NO: 52393 - DNA, 201 bp, Bos taurus; identical to SEQ ID NO: 11158

SEQ ID NO: 52394 - DNA, 201 bp, Bos taurus
ctcatttcagaaatgttaaaatatgtataggggaagaagggagatgcatattatgatgaagagaaaatggtaatcaggagacagtcaaaccaatggcctacttaaattcatcagtaaatgcagtcagcatgatttattgacctgttctgtgatagagaacctttttaggtgagaggtttttgtgtgttgatggacacactg

SEQ ID NO: 52395 - DNA, 201 bp, Bos taurus; identical to SEQ ID NO: 11160

SEQ ID NO: 52396 - DNA, 201 bp, Bos taurus; identical to SEQ ID NO: 11161

SEQ ID NO: 52397 - DNA, 201 bp, Bos taurus
ctgggtgtctcctgggacatggggctcagctggtgtccagtgcaaggcaggccctggatcccttgatgggcgatggcgagcagctcaaacagctctggcccagaacgccattgaccattgctaccctctcccagctctggcagcatttaaagtcctggtctcaccagccctgggacttggtgaccaggcctgggaagggcc

SEQ ID NO: 52398 - DNA, 201 bp, Bos taurus; identical to SEQ ID NO: 11162

SEQ ID NO: 52399 - DNA, 201 bp, Bos taurus; identical to SEQ ID NO: 11164

SEQ ID NO: 52400 - DNA, 201 bp, Bos taurus; identical to SEQ ID NO: 11165

SEQ ID NO: 52401 - DNA, 201 bp, Bos taurus; identical to SEQ ID NO: 11166

SEQ ID NO: 52402 - DNA, 201 bp, Bos taurus; identical to SEQ ID NO: 11167

SEQ ID NO: 52403 - DNA, 201 bp, Bos taurus; identical to SEQ ID NO: 11169

SEQ ID NO: 52404 - DNA, 201 bp, Bos taurus; identical to SEQ ID NO: 11170

SEQ ID NO: 52405 - DNA, 201 bp, Bos taurus
cactatgaccatcccacagatgaggaaaatgagactcagagaggtgacatgactgtcctaagatcacacaagtttctcttgagtacctgagaccaggccatgggaccctcaagctcagattctttcacgatgtcatccttcatgctgttatgcccaccgaccttcctcggccttcccaggacaggcctttgcccttttctg

SEQ ID NO: 52406 - DNA, 201 bp, Bos taurus; identical to SEQ ID NO: 11172

SEQ ID NO: 52407 - DNA, 201 bp, Bos taurus; identical to SEQ ID NO: 11174

SEQ ID NO: 52408 - DNA, 201 bp, Bos taurus
aggtctcagggtcccacctggccagactcaacgcttctctgacagagaagtcagagctggagaaaccctgaccggctgtgcagctgggcccacagagatccggggaaacgtgactcgtgtgggaaagactccgaggtgagacagcaaagcgctgggcacctccctgaccaaagccagggtgtctccctccccccaagaggc

SEQ ID NO: 52409 - DNA, 201 bp, Bos taurus
tttgaacagcagatttagcatttttttccctttttttcttcttagcaccttcttacatttttctctttttcatggtgtttggtttttttgctctttttctcccatctattttcaaagaatcttatttcagagatactcagtaagtagaattttcctctgtgtgttactattccttgcagaaaaaggtgacgtaaaataaag

SEQ ID NO: 52410 - DNA, 201 bp, Bos taurus; identical to SEQ ID NO: 11175

SEQ ID NO: 52411 - DNA, 201 bp, Bos taurus
tctcactgcggtgacttttcttgttgtgtgtcacaggctctaggtcatggcctcagtagttgtggtatgtgggctcagtagctgtggcttgtgagttgctgcatggcatgtggaatcttcctgggccaaggatctaacccatgtactctgcatcaacagatagattcttatccactgtactacaaaggaagtccgccaaat

SEQ ID NO: 52412 - DNA, 201 bp, Bos taurus; identical to SEQ ID NO: 11176

SEQ ID NO: 52413 - DNA, 201 bp, Bos taurus
atagacttactaaaagattgatatgtattatttcaagtgttggaattaagatgtctcctggacaccttggattaattagagaacattccagtttagctttaaaaggggtctatgtctgtgagggagttatagacccagactgccaaggagaaatatgggtaattttacaaaaggaaaaaaaaggatgatctatttatcaat

SEQ ID NO: 52414 - DNA, 201 bp, Bos taurus; identical to SEQ ID NO: 11177

SEQ ID NO: 52415 - DNA, 201 bp, Bos taurus
agagatttcaaggattcagcccactacaaacccaagtatttttatccttaagtagttataacctaaggaagaaaaggaagatgacttcatttcttctattggactagcaactcagagtctttaaggtttgtaccaaagaaagaactcgggaccgcactacctcttcattcaggcagtgaatggaaataggttcctagtagg

SEQ ID NO: 52416 - DNA, 201 bp, Bos taurus
tctgtagtttaaacattgaatagcatatcttcttggtcatcataatcaagccatctgtgttgttctgcatagaaattggaaggaaaatctagaagtacacggtgatttcctttgacagctttagagaggtataatttacatgccataaaattcattcatgttaagtgtagaatacaaccacgttaatatatttacaaattt

SEQ ID NO: 52417 - DNA, 201 bp, Bos taurus
cttttgaatatgctgtaactgaaattcagagcagattttggtttttctctttcgcaagccatttatgtgctcacaaacagaccaaactcactatcaaaatggcctatttttacaaacaaaaaattacaaagactatttgaatgtactctctttcacattcttatttggctattatttagataaatccattgaaatgaaagg

SEQ ID NO: 52418 - DNA, 201 bp, Bos taurus; identical to SEQ ID NO: 11186

SEQ ID NO: 52419 - DNA, 201 bp, Bos taurus
tcatggttcattagggaacttaaatgtgtttctctcttttcttttaacacagagagtttctctctgaaaaggctcttaaaattttaatttttattcccttatatttctcttgctcttttattccagtgtcccaggagacttttgcttttaaaaccatatagctttactacagtatcatttgctattagtcattgcaagttg

SEQ ID NO: 52420 - DNA, 201 bp, Bos taurus; identical to SEQ ID NO: 11187

SEQ ID NO: 52421 - DNA, 201 bp, Bos taurus; identical to SEQ ID NO: 11189

SEQ ID NO: 52422 - DNA, 201 bp, Bos taurus; identical to SEQ ID NO: 11190

SEQ ID NO: 52423 - DNA, 201 bp, Bos taurus; identical to SEQ ID NO: 11191

SEQ ID NO: 52424 - DNA, 201 bp, Bos taurus
gacctaaccaatggggataaaagaaacactaaaacgcatgccagttttcaatgtcagagacccaggaccctcctacctggttagagcttctgctaaattgctcctcttctgcatttcttcctagatcactgcctccccaggatccccagttacactactgtacttaccaagttttctatgagactttgttcttcattaaaa

SEQ ID NO: 52425 - DNA, 201 bp, Bos taurus; identical to SEQ ID NO: 11192

SEQ ID NO: 52426 - DNA, 201 bp, Bos taurus
agactccacatctccttgggcctgcctgcaagggagcttccctgtgcacggaaactcctcctgtttcaggactccctccctccttcggggcaaaaggtcctgcccagaacttctctgtctttcccctttttaggtctccatcctctctcctacctcttttcacgttgcttagactgttaccctggaggcctgggttcttct

SEQ ID NO: 52427 - DNA, 201 bp, Bos taurus
aaaggagaagggatgggggtctgggactacagaggggaggaatacaatttacagggagatgggaagagccagtgtctggaaaataaacatttatcatgccatgtagagataatgggacaagaagaatttcttgagaatcaagaacaatgatagattttttcttataatatttagtcttttgtcttcaattcctagaaaact

SEQ ID NO: 52428 - DNA, 201 bp, Bos taurus; identical to SEQ ID NO: 11195

SEQ ID NO: 52429 - DNA, 201 bp, Bos taurus; identical to SEQ ID NO: 11198

SEQ ID NO: 52430 - DNA, 201 bp, Bos taurus
aatattaatgaaactatcgttaaaaaaaatgaatgtattcccaaaggtgtatatgtcaacccctttttcttgagaagagtgtgagcttttaggaatgtaacaaaggaagaaagttacacacacaaacacatatacacagattgttattcttctttccttgaaaacaggtaacttgcgaaaaaacttaaatttgtacttaat

SEQ ID NO: 52431 - DNA, 201 bp, Bos taurus; identical to SEQ ID NO: 11199

SEQ ID NO: 52432 - DNA, 201 bp, Bos taurus; identical to SEQ ID NO: 11200

SEQ ID NO: 52433 - DNA, 201 bp, Bos taurus; identical to SEQ ID NO: 11201

SEQ ID NO: 52434 - DNA, 201 bp, Bos taurus; identical to SEQ ID NO: 11203

SEQ ID NO: 52435 - DNA, 201 bp, Bos taurus; identical to SEQ ID NO: 11204

SEQ ID NO: 52436 - DNA, 201 bp, Bos taurus; identical to SEQ ID NO: 11205

SEQ ID NO: 52437 - DNA, 201 bp, Bos taurus
aaggtttcactgtattctctgttgaaattcctaagaaagcctaatttacacagataatgaaccctatccatatttacaaataactttagtccttgttgttaaaaaatgggttcacactagtatgtgtgtgtatctgtgtgtgtgtgtgttcaattgtgttcaactctttgggaccccatgaactatagcctgccaggctcc

SEQ ID NO: 52438 - DNA, 201 bp, Bos taurus; identical to SEQ ID NO: 11207

SEQ ID NO: 52439 - DNA, 201 bp, Bos taurus; identical to SEQ ID NO: 11208

SEQ ID NO: 52440 - DNA, 201 bp, Bos taurus; identical to SEQ ID NO: 11209

SEQ ID NO: 52441 - DNA, 201 bp, Bos taurus; identical to SEQ ID NO: 11211

SEQ ID NO: 52442 - DNA, 201 bp, Bos taurus; identical to SEQ ID NO: 11212

SEQ ID NO: 52443 - DNA, 201 bp, Bos taurus
gagatgagaaggagtctagagactagcctgttgaagatgggtgaggacaaggaagaagaaacaagggcaggtctggccttcggcattccatggaagatgccgtgcttatgcctgcttggggaaagcaacatcatcccaacaagatgagtgggggccagaggggacccaggtgagaataagacaagcatgaaccctcatgtg

SEQ ID NO: 52444 - DNA, 201 bp, Bos taurus; identical to SEQ ID NO: 11214

SEQ ID NO: 52445 - DNA, 201 bp, Bos taurus; identical to SEQ ID NO: 11215

SEQ ID NO: 52446 - DNA, 201 bp, Bos taurus; identical to SEQ ID NO: 11216

SEQ ID NO: 52447 - DNA, 201 bp, Bos taurus
atttttgttacagaaaagattcatacaatcatttcatattgtttaagttttataaagaaaataaattagggaatgtgatggagcatgactccatggggccatttttgtgggtcagagcctttagctgaatgaccagatgaactagcaatgatgagactgagagcagaatcttctagagagagggtatgcaaggttcaacag

SEQ ID NO: 52448 - DNA, 201 bp, Bos taurus; identical to SEQ ID NO: 11219

SEQ ID NO: 52449 - DNA, 201 bp, Bos taurus; identical to SEQ ID NO: 11220

SEQ ID NO: 52450 - DNA, 201 bp, Bos taurus
tttggtaaagaagttaactaaaaatcatacaacgaggtgctttgtttctctcaaagcttggttttggttcttccagtagaaacctgggagtggcctctccagttctcaggggctggttctcaagtagccccaggactgagtcttttctccatctcttatccccaggcccccatcccccaaggactgattatctcctcaaac

SEQ ID NO: 52451 - DNA, 201 bp, Bos taurus
gagcagaggggagcccctaggatggttggaaaaggaaaacagggactcttgtagaatatatacataccacattaacactaaatgatagacaatattgattgtggtaagatgcgtttaccttgtagttgttacatattaaagttgcaaaaggaagagttcatctttgttccttcctctcccacctggaatttttaaagctgt

SEQ ID NO: 52452 - DNA, 201 bp, Bos taurus
aatgatatgatccctaccccgagaacctggcctttctgtggtctcctatgaattgtgtaggctgtggtgtatcttcactctggctggacttcaacttgaacttctgtcacactgggtggcctctctagtctctgcccaggtatttgggttacttttctgtgattccctcctcttgtaactcaccatcaaatccagtctttt

SEQ ID NO: 52453 - DNA, 201 bp, Bos taurus
gcatcaaaaagaataaactacttaggaataaacctaaggaggtgaaagatttgtactctgaaatctgtaaaactctgatgaaagaaattgaaaataacacgaactaatggaaagatgtactgtgcccatggattgaaaaatgagtattgcttatatgttcaacaggcatcccaaaatgtatgtggccaatacctttcctca

SEQ ID NO: 52454 - DNA, 201 bp, Bos taurus; identical to SEQ ID NO: 11221

SEQ ID NO: 52455 - DNA, 201 bp, Bos taurus; identical to SEQ ID NO: 11223

SEQ ID NO: 52456 - DNA, 201 bp, Bos taurus
atttgataatattgtgtctgatagccttttgatgaaacagcagattgtactcagttggttatatctgtgtgaaatgacatatgcttgaaacagaaaataagcacccagccactgaatgtattgcacataacaggaactctcttgtcaggggcagtaccatttattgtacactgcacatttaaaatttttaaaattaattat

SEQ ID NO: 52457 - DNA, 201 bp, Bos taurus
ccttttccattcttctttttattttgttcttttgtaatgcccacctcattctttttttgctttgcaggggtttgcagcagatacaggtctgtctgcacaccggaagcctaacatgcaacatacaagatttgtgtgtgtggtgtgtgtgtcttttttagcgaactgatggttgtgaagattattttcctagagtaacatatt

SEQ ID NO: 52458 - DNA, 201 bp, Bos taurus; identical to SEQ ID NO: 11226

SEQ ID NO: 52459 - DNA, 201 bp, Bos taurus; identical to SEQ ID NO: 11227

SEQ ID NO: 52460 - DNA, 201 bp, Bos taurus
tagtgagcaacactgaaactaggttaacacaaactgactccacattgttcaaaagtggatgacagtaatacaaattgataaaattatttttagagacatgaaaactgccataataatactaataaataagatctttatgtctggcacaagtggcaagagctatatgtgcatatgctttgtttcttggttggaaaagttgaa

SEQ ID NO: 52461 - DNA, 201 bp, Bos taurus; identical to SEQ ID NO: 11229

SEQ ID NO: 52462 - DNA, 201 bp, Bos taurus
ctcagtgtgtatatgctatacaagtcagacagttcccactagcaccagcacacagtgaagattcatctataaaccaagcttatcttttctttcttttcttctcaaccacctggtcatagtgaatttccctaggtatgtgggttggagggaatgttaacaaaacagcaggggtagataccgtggaagctgggccagcagttg

SEQ ID NO: 52463 - DNA, 201 bp, Bos taurus
gaagacaggtttattttctcctggctaatgcagcagctgtagcagcagccatggcgtaacctaacacaacacaacctctctccttcttggcacagcagccgtagccgaggacacactatattctctcttctcatggctgacccaatcaacacagccgtgatgcgacagtaatggagccgttttctagacagggctcacata

SEQ ID NO: 52464 - DNA, 201 bp, Bos taurus
ctgatttgtgcaaagagtgaaggttatagggttaattctttttttttttcagtattattcattcggtaaatatagtttactggttttatgtacaaggaaggtaggttgtctgagtatgcacagaaatgacagctatgccaaaggaagaaggaagagcgaccatttggggttagtggtgaagaacttaaaattaaattttat

SEQ ID NO: 52465 - DNA, 201 bp, Bos taurus; identical to SEQ ID NO: 11231

SEQ ID NO: 52466 - DNA, 201 bp, Bos taurus; identical to SEQ ID NO: 11232

SEQ ID NO: 52467 - DNA, 201 bp, Bos taurus
acctttgaaaaatattctgttaactgattattggggatatcagttaatgcatttctgatgtcaaaacatcagtatttctgctttgtaaatttaccttttcctcattaatcctgaaagctatccatcttcaagggtgtctccaagaagtgttttcaaaggacttggagcttgtgataagatttccttgagaaaaggtcataa

SEQ ID NO: 52468 - DNA, 201 bp, Bos taurus; identical to SEQ ID NO: 11233

SEQ ID NO: 52469 - DNA, 201 bp, Bos taurus; identical to SEQ ID NO: 11234

SEQ ID NO: 52470 - DNA, 201 bp, Bos taurus; identical to SEQ ID NO: 11235

SEQ ID NO: 52471 - DNA, 201 bp, Bos taurus; identical to SEQ ID NO: 11236

SEQ ID NO: 52472 - DNA, 201 bp, Bos taurus; identical to SEQ ID NO: 11237

SEQ ID NO: 52473 - DNA, 201 bp, Bos taurus; identical to SEQ ID NO: 11238

SEQ ID NO: 52474 - DNA, 201 bp, Bos taurus
gttacagactgagttcagggattttctgggcccactgtgagagggaccctatctaaaactctgttgatcacctgaccttcatagtcccttctgtggctgaagggccacagtgatattttggatcttttggaattagtgtccaatatttccccagagattcaattattaatatttcctttaccacaatgtaccctggtaaag

SEQ ID NO: 52475 - DNA, 201 bp, Bos taurus
aacgtgtctgttcattataagaagacactactatttatggggtggattggcacaagaggatgtggcagagagagagctggccagttctgaaacacactacagacctgttaatttgatattattctctgacgacaacagcaagggttttaacacaggggtgagatacggcccgagttgcgttctaaaaaggtaattctggca

SEQ ID NO: 52476 - DNA, 201 bp, Bos taurus; identical to SEQ ID NO: 11241

SEQ ID NO: 52477 - DNA, 201 bp, Bos taurus; identical to SEQ ID NO: 11242

SEQ ID NO: 52478 - DNA, 201 bp, Bos taurus; identical to SEQ ID NO: 11243

SEQ ID NO: 52479 - DNA, 201 bp, Bos taurus; identical to SEQ ID NO: 11244

SEQ ID NO: 52480 - DNA, 201 bp, Bos taurus
aatggtcagatcaaaggatgcctatttatattgatgacattaatggtcagaaaagtcataccttctgaaatgtcattgtcctagtgtacaattctgccccaaaatcagattcaccccatgagaggtggggagagagacctagaaacagtattgtactgaaacagtctccattgtccatcctagacatcatattaaaaagga

SEQ ID NO: 52481 - DNA, 201 bp, Bos taurus; identical to SEQ ID NO: 11245

SEQ ID NO: 52482 - DNA, 201 bp, Bos taurus; identical to SEQ ID NO: 11246

SEQ ID NO: 52483 - DNA, 201 bp, Bos taurus; identical to SEQ ID NO: 11247

SEQ ID NO: 52484 - DNA, 201 bp, Bos taurus; identical to SEQ ID NO: 11248

SEQ ID NO: 52485 - DNA, 201 bp, Bos taurus; identical to SEQ ID NO: 11250

SEQ ID NO: 52486 - DNA, 201 bp, Bos taurus; identical to SEQ ID NO: 11251

SEQ ID NO: 52487 - DNA, 201 bp, Bos taurus; identical to SEQ ID NO: 11252

SEQ ID NO: 52488 - DNA, 201 bp, Bos taurus
gcttcatgctaacagtgatcatcagaaagaactgagcgttgtcaaaggttatctttccattcaaaggtaccacatgagaggcggagatagaacttcatacaaaatttcgtcctgtgaatagaaatcattgaatgactgtccaaagaggccaggagggttttaataaaatatccaaagaccagggcaacagtgaccttgaat

SEQ ID NO: 52489 - DNA, 201 bp, Bos taurus; identical to SEQ ID NO: 11253

SEQ ID NO: 52490 - DNA, 201 bp, Bos taurus; identical to SEQ ID NO: 11254

SEQ ID NO: 52491 - DNA, 201 bp, Bos taurus
gatatagcttgtttgtagcttgtttcatttgtgcttcctgattagtccttgtaacagtttcatttatctgctgcagcgccgttcacctggcttaaatgaagcaactcttgtctcctctattctactctggtatccatcaattccatctccatacaccccagggaaattccattctcttggcaataggcagagcacttctta

SEQ ID NO: 52492 - DNA, 201 bp, Bos taurus; identical to SEQ ID NO: 11256

SEQ ID NO: 52493 - DNA, 201 bp, Bos taurus
cccttccccaaaccaagaagatgtgagggccattgtctgaaatcctcatccagagaaaccctgtattctggaagaccagtccacaggcaaggatgtgtgttgttactaaagatgggccattccttgaaaatatgctgaacactgaaactctggctcccttttgcttaatgaccaaaatgaaagtggttgcctcaaagaggc

SEQ ID NO: 52494 - DNA, 201 bp, Bos taurus; identical to SEQ ID NO: 11257

SEQ ID NO: 52495 - DNA, 201 bp, Bos taurus; identical to SEQ ID NO: 11258

SEQ ID NO: 52496 - DNA, 201 bp, Bos taurus; identical to SEQ ID NO: 11259

SEQ ID NO: 52497 - DNA, 201 bp, Bos taurus; identical to SEQ ID NO: 11260

SEQ ID NO: 52498 - DNA, 201 bp, Bos taurus; identical to SEQ ID NO: 11261

SEQ ID NO: 52499 - DNA, 201 bp, Bos taurus; identical to SEQ ID NO: 11262

SEQ ID NO: 52500 - DNA, 201 bp, Bos taurus; identical to SEQ ID NO: 11263

SEQ ID NO: 52501 - DNA, 201 bp, Bos taurus; identical to SEQ ID NO: 11264

SEQ ID NO: 52502 - DNA, 201 bp, Bos taurus; identical to SEQ ID NO: 11265

SEQ ID NO: 52503 - DNA, 201 bp, Bos taurus; identical to SEQ ID NO: 11266

SEQ ID NO: 52504 - DNA, 201 bp, Bos taurus; identical to SEQ ID NO: 11267

SEQ ID NO: 52505 - DNA, 201 bp, Bos taurus; identical to SEQ ID NO: 11268

SEQ ID NO: 52506 - DNA, 201 bp, Bos taurus; identical to SEQ ID NO: 11269

SEQ ID NO: 52507 - DNA, 201 bp, Bos taurus; identical to SEQ ID NO: 11270

SEQ ID NO: 52508 - DNA, 201 bp, Bos taurus; identical to SEQ ID NO: 11271

SEQ ID NO: 52509 - DNA, 201 bp, Bos taurus; identical to SEQ ID NO: 11272

SEQ ID NO: 52510 - DNA, 201 bp, Bos taurus; identical to SEQ ID NO: 11273

SEQ ID NO: 52511 - DNA, 201 bp, Bos taurus; identical to SEQ ID NO: 11274

SEQ ID NO: 52512 - DNA, 201 bp, Bos taurus; identical to SEQ ID NO: 11275

SEQ ID NO: 52513 - DNA, 201 bp, Bos taurus; identical to SEQ ID NO: 11276

SEQ ID NO: 52514 - DNA, 201 bp, Bos taurus; identical to SEQ ID NO: 11277

SEQ ID NO: 52515 - DNA, 201 bp, Bos taurus; identical to SEQ ID NO: 11279

SEQ ID NO: 52516 - DNA, 201 bp, Bos taurus; identical to SEQ ID NO: 11281

SEQ ID NO: 52517 - DNA, 201 bp, Bos taurus; identical to SEQ ID NO: 11282

SEQ ID NO: 52518 - DNA, 201 bp, Bos taurus; identical to SEQ ID NO: 11283

SEQ ID NO: 52519 - DNA, 201 bp, Bos taurus; identical to SEQ ID NO: 11284

SEQ ID NO: 52520 - DNA, 201 bp, Bos taurus; identical to SEQ ID NO: 11285

SEQ ID NO: 52521 - DNA, 201 bp, Bos taurus; identical to SEQ ID NO: 11286

SEQ ID NO: 52522 - DNA, 201 bp, Bos taurus; identical to SEQ ID NO: 11287

SEQ ID NO: 52523 - DNA, 201 bp, Bos taurus; identical to SEQ ID NO: 11291

SEQ ID NO: 52524 - DNA, 201 bp, Bos taurus; identical to SEQ ID NO: 11292

SEQ ID NO: 52525 - DNA, 201 bp, Bos taurus; identical to SEQ ID NO: 11293

SEQ ID NO: 52526 - DNA, 201 bp, Bos taurus; identical to SEQ ID NO: 11297

SEQ ID NO: 52527 - DNA, 201 bp, Bos taurus; identical to SEQ ID NO: 11299

SEQ ID NO: 52528 - DNA, 201 bp, Bos taurus; identical to SEQ ID NO: 11304

SEQ ID NO: 52529 - DNA, 201 bp, Bos taurus; identical to SEQ ID NO: 11306

SEQ ID NO: 52530 - DNA, 201 bp, Bos taurus; identical to SEQ ID NO: 11307

SEQ ID NO: 52531 - DNA, 201 bp, Bos taurus; identical to SEQ ID NO: 11308

SEQ ID NO: 52532 - DNA, 201 bp, Bos taurus; identical to SEQ ID NO: 11309

SEQ ID NO: 52533 - DNA, 201 bp, Bos taurus; identical to SEQ ID NO: 11310

SEQ ID NO: 52534 - DNA, 201 bp, Bos taurus; identical to SEQ ID NO: 11313

SEQ ID NO: 52535 - DNA, 201 bp, Bos taurus
aaaagttacagcagaaatcagcaatatattttattacaagacttaacattagcaatgctttattatagttccatagtttttaaggacatcaataacttgactcaaaaaaaaaaaaaaaaaaactatgttcaaaggcatggctcaagtttttcaagccatattttacaaagtatgccataattacattttgctctgatctat

SEQ ID NO: 52536 - DNA, 201 bp, Bos taurus; identical to SEQ ID NO: 11314

SEQ ID NO: 52537 - DNA, 201 bp, Bos taurus; identical to SEQ ID NO: 11315

SEQ ID NO: 52538 - DNA, 201 bp, Bos taurus; identical to SEQ ID NO: 11318

SEQ ID NO: 52539 - DNA, 201 bp, Bos taurus; identical to SEQ ID NO: 11319

SEQ ID NO: 52540 - DNA, 201 bp, Bos taurus; identical to SEQ ID NO: 11320

SEQ ID NO: 52541 - DNA, 201 bp, Bos taurus; identical to SEQ ID NO: 11321

SEQ ID NO: 52542 - DNA, 201 bp, Bos taurus; identical to SEQ ID NO: 11322

SEQ ID NO: 52543 - DNA, 201 bp, Bos taurus; identical to SEQ ID NO: 11324

SEQ ID NO: 52544 - DNA, 201 bp, Bos taurus; identical to SEQ ID NO: 11325

SEQ ID NO: 52545 - DNA, 201 bp, Bos taurus; identical to SEQ ID NO: 11327

SEQ ID NO: 52546 - DNA, 201 bp, Bos taurus; identical to SEQ ID NO: 11328

SEQ ID NO: 52547 - DNA, 201 bp, Bos taurus; identical to SEQ ID NO: 11329

SEQ ID NO: 52548 - DNA, 201 bp, Bos taurus; identical to SEQ ID NO: 11330

SEQ ID NO: 52549 - DNA, 201 bp, Bos taurus; identical to SEQ ID NO: 11331

SEQ ID NO: 52550 - DNA, 201 bp, Bos taurus; identical to SEQ ID NO: 11332

SEQ ID NO: 52551 - DNA, 201 bp, Bos taurus; identical to SEQ ID NO: 11333

SEQ ID NO: 52552 - DNA, 201 bp, Bos taurus; identical to SEQ ID NO: 11334

SEQ ID NO: 52553 - DNA, 201 bp, Bos taurus
ggagctgcagagtgagcgggggcttcagatgcactggggcactgagttggagtaaaaagggggtgcccacagtagcactcgacagggacagactcgggccgcttcgcctggttccctgagtgcagccaagtctggattcagaagcgtttccatgggaaggctgctctgtgagtccagacgagatatagtgctagggccatc

SEQ ID NO: 52554 - DNA, 201 bp, Bos taurus; identical to SEQ ID NO: 11335

SEQ ID NO: 52555 - DNA, 201 bp, Bos taurus; identical to SEQ ID NO: 11337

SEQ ID NO: 52556 - DNA, 201 bp, Bos taurus; identical to SEQ ID NO: 11338

SEQ ID NO: 52557 - DNA, 201 bp, Bos taurus; identical to SEQ ID NO: 11340

SEQ ID NO: 52558 - DNA, 201 bp, Bos taurus
taaagagcctcttgatgagggtgaaagaggagagtaaaaagctggcttaaacttaatgtcaaaacaaacaaacaaaacccaaacccaaagttaacacaccgtagttggctgttatgtctctggtttctgctaatctacaacagaagccctcagaattttgttgactttttatgataatgatttgctctaaggggccacact

SEQ ID NO: 52559 - DNA, 201 bp, Bos taurus; identical to SEQ ID NO: 11341

SEQ ID NO: 52560 - DNA, 201 bp, Bos taurus
agcggggagctggagtccctgtgccagggtgagggcagccactgaagcagatgctgggcaactgagaagaactattgatttcagtcgctcagattcctcagggcggccgcctaccccctccctctggtgggagggcagaggtagctgggagctgtgttgcccaccactgcccatcaccagcttctggcttcaaacagaagg

SEQ ID NO: 52561 - DNA, 201 bp, Bos taurus; identical to SEQ ID NO: 11343

SEQ ID NO: 52562 - DNA, 201 bp, Bos taurus; identical to SEQ ID NO: 11344

SEQ ID NO: 52563 - DNA, 201 bp, Bos taurus
caatgtggaactaactcatagatgagagatgaataaaggatagtgagaaaaatttagaatgatgtgttagggacctgataaaaacagagagagcaggaagttatagtgtaagcacattaggagagcagtcctgggagctggaggagtaggagacattgtgaaaaaagaaaaccaaatctaagagtcggataggattttaaa

SEQ ID NO: 52564 - DNA, 201 bp, Bos taurus; identical to SEQ ID NO: 11346

SEQ ID NO: 52565 - DNA, 201 bp, Bos taurus; identical to SEQ ID NO: 11347

SEQ ID NO: 52566 - DNA, 201 bp, Bos taurus; identical to SEQ ID NO: 11348

SEQ ID NO: 52567 - DNA, 201 bp, Bos taurus
actcactacagtcctaagagctatggccaggattattatcctgttttacagatgagaaaactgaaatggacaggttcaattgacttgcacgaagtcacacagtgaataaacagcaggccacggaggcaaggctaggcctagtgcaggtgttcgtaaccaccattaaaggttggttgattcagtgagttaaattcagcaaac

SEQ ID NO: 52568 - DNA, 201 bp, Bos taurus; identical to SEQ ID NO: 11349

SEQ ID NO: 52569 - DNA, 201 bp, Bos taurus
aatggtacatttgctaaatgtttaaaaaggttagttacatttacatgagctaccactgccctgttttcatctccagctgttactcctattggatgttaccctatcattaaacaagtttctgtcattattgaacttacctataaaattaacttaaaatactattttttgcctcttaagttactgataatgctcacatattaa

SEQ ID NO: 52570 - DNA, 201 bp, Bos taurus; identical to SEQ ID NO: 11351

SEQ ID NO: 52571 - DNA, 201 bp, Bos taurus; identical to SEQ ID NO: 11352

SEQ ID NO: 52572 - DNA, 201 bp, Bos taurus
tgaactctctcattgtaattttcttatttctggtagttgccttttcttttccacttagagaatttcctttaatgtttgttggaaagctggcctgatactgctgaattctcttagcttttgtttgtctgtaaagcttttgatttctctgtggaatctgaagggcggctgcttaaagtcttcctgaccatggcctgcccactg

SEQ ID NO: 52573 - DNA, 201 bp, Bos taurus; identical to SEQ ID NO: 11355

SEQ ID NO: 52574 - DNA, 201 bp, Bos taurus; identical to SEQ ID NO: 11356

SEQ ID NO: 52575 - DNA, 201 bp, Bos taurus; identical to SEQ ID NO: 11357

SEQ ID NO: 52576 - DNA, 201 bp, Bos taurus; identical to SEQ ID NO: 11358

SEQ ID NO: 52577 - DNA, 201 bp, Bos taurus; identical to SEQ ID NO: 11361

SEQ ID NO: 52578 - DNA, 201 bp, Bos taurus; identical to SEQ ID NO: 11364

SEQ ID NO: 52579 - DNA, 201 bp, Bos taurus
ccatctatatctgtatcctgagatcaagggaagctttgactttcaccaaggatactctctgaatgctgtgcagctttgggtcaacaaagctgtcttctgttagctgccttgtttgataagacattccattcattcagttgtttgtgtgtttatgcatgctaagttgcttcagtcatatctgactctacgaccctatggact

SEQ ID NO: 52580 - DNA, 201 bp, Bos taurus
ttaacatcagaacttccacttttcaataagaaggccttcattcaatgtactttgtttgggggtggtatgagggaattcactgttcgctggtcacaggtacaaatgtaatttggggctggcccagctgagctccccccatcgcctgatatgaccttggactgtcagcctccatctttgttattatgtggataggattttcta

SEQ ID NO: 52581 - DNA, 201 bp, Bos taurus
aaacagagctttgggttacctgcatgattctgagaatgtaatgcgcctaacccaaccctaccttcagttatgtatgttttatattacaactgtgtatccctttggaagaaatgtttttgaagtggttccaggtgtgtgtgaagtgatgacacttgtctggaggccgtatcagtcacacaggtcctgccctgtgtctggatt

SEQ ID NO: 52582 - DNA, 201 bp, Bos taurus
tctgtgacatgggcaccattacttgtgggaaaggaaactgaggctcagaaatgttaagaaattttcttaaggtcacacaactggttaagtagttgggccaggaagagactttagtgtgtgtatgtgtccaaatcctatccaagacaggaattatttcttcgacatctctcatagccattagactctgtgaaccatatggtg

SEQ ID NO: 52583 - DNA, 201 bp, Bos taurus; identical to SEQ ID NO: 11367

SEQ ID NO: 52584 - DNA, 201 bp, Bos taurus; identical to SEQ ID NO: 11368

SEQ ID NO: 52585 - DNA, 201 bp, Bos taurus
catttctataagctgctgcagtattcgaccctggtgacatagaaaaaaataagatgtgattatagggttacatttcatatgactgcttggaatttcctagcaggtgggtttgctgaacagatatagataaatacacaggcatacaagaaactattttttttaaatacagtacttgtttttcaaagagataccctaggactc

SEQ ID NO: 52586 - DNA, 201 bp, Bos taurus
aaataacaatggaaacctgacattgttgtttttaataaaatagatttattggaatctacttttgaatctttggttttggcacaccaccagtttggaaacattggtattctacattgtgatagagacttgatatcaaattagaatatgtgctgcagaactttaatattaaaaactatttttttaaagaaggaaaattcatcc

SEQ ID NO: 52587 - DNA, 201 bp, Bos taurus
atttggtgctcatactggctgaggcctcagatggggtgagaaaggatggcattgcctacagaaggcagcttagctcagtctacattggaacacacatgcacgggcctcagccaggtctgacgagtagagtctgcagtcttgaaaaactaactcaatatctgtgagtcatttttctcatttgtaaaatgagattaatgacag

SEQ ID NO: 52588 - DNA, 201 bp, Bos taurus
ttattcttttgttctaagtagaaatgtctgacttgtttccagactgaagaacttgggacaagttgtgttgtcaacatccaatgcaagttatcagaatttacatatactcaaaggccaggtcctttttaagtctatgattatatactatgtttggcactctgacctggaaaaaggctggatcttcaaaagaagtcctgaaag

SEQ ID NO: 52589 - DNA, 201 bp, Bos taurus; identical to SEQ ID NO: 11369

SEQ ID NO: 52590 - DNA, 201 bp, Bos taurus; identical to SEQ ID NO: 11370

SEQ ID NO: 52591 - DNA, 201 bp, Bos taurus; identical to SEQ ID NO: 11371

SEQ ID NO: 52592 - DNA, 201 bp, Bos taurus; identical to SEQ ID NO: 11372

SEQ ID NO: 52593 - DNA, 201 bp, Bos taurus; identical to SEQ ID NO: 11373

SEQ ID NO: 52594 - DNA, 201 bp, Bos taurus; identical to SEQ ID NO: 11374

SEQ ID NO: 52595 - DNA, 201 bp, Bos taurus; identical to SEQ ID NO: 11375

SEQ ID NO: 52596 - DNA, 201 bp, Bos taurus; identical to SEQ ID NO: 11376

SEQ ID NO: 52597 - DNA, 201 bp, Bos taurus; identical to SEQ ID NO: 11379

SEQ ID NO: 52598 - DNA, 201 bp, Bos taurus; identical to SEQ ID NO: 11380

SEQ ID NO: 52599 - DNA, 201 bp, Bos taurus; identical to SEQ ID NO: 11381

SEQ ID NO: 52600 - DNA, 201 bp, Bos taurus; identical to SEQ ID NO: 11382

SEQ ID NO: 52601 - DNA, 201 bp, Bos taurus; identical to SEQ ID NO: 11383

SEQ ID NO: 52602 - DNA, 201 bp, Bos taurus; identical to SEQ ID NO: 11384

SEQ ID NO: 52603 - DNA, 201 bp, Bos taurus; identical to SEQ ID NO: 11385

SEQ ID NO: 52604 - DNA, 201 bp, Bos taurus; identical to SEQ ID NO: 11386

SEQ ID NO: 52605 - DNA, 201 bp, Bos taurus; identical to SEQ ID NO: 11387

SEQ ID NO: 52606 - DNA, 201 bp, Bos taurus
agatcgcagaggaaatgtggaggaatgtgaatggtattattttatccagcaaaaaacagagacttgtctgcttctctttcccagcacggcctcactacgacgtcataatgttcgatgtggacagtaaggacccaaccctgggaatgagctgtccacccccagcatttgtggcccagcttttcctgcagaaggtcaaaagca

SEQ ID NO: 52607 - DNA, 201 bp, Bos taurus; identical to SEQ ID NO: 11391

SEQ ID NO: 52608 - DNA, 201 bp, Bos taurus; identical to SEQ ID NO: 11392

SEQ ID NO: 52609 - DNA, 201 bp, Bos taurus; identical to SEQ ID NO: 11393

SEQ ID NO: 52610 - DNA, 201 bp, Bos taurus; identical to SEQ ID NO: 11395

SEQ ID NO: 52611 - DNA, 201 bp, Bos taurus
ggaccagtcagcgagcaacttccttaggtcacatcttttctaactaagagggagcatggggcccaagcagaagctttcagagtaggctcagtcctaggggtagcaattacctaccagacaaggtacacagaaggccctatacccaagcctccagccggcctaacatcgctcccctcccctccctcacacccaccattcttc

SEQ ID NO: 52612 - DNA, 201 bp, Bos taurus
gaagatttcttctggcccttacaagtcttgtctgggagcagtttgaaggacttccttatccctgagagagagccaagaccaggagtggagtgacacctccttggatgtcccctgcacaccccaaatccagtgggtccccctgactcattccctccaagagctccccatgccagggagcagtaccaccaccacccccccaac

SEQ ID NO: 52613 - DNA, 201 bp, Bos taurus; identical to SEQ ID NO: 11397

SEQ ID NO: 52614 - DNA, 201 bp, Bos taurus; identical to SEQ ID NO: 11398

SEQ ID NO: 52615 - DNA, 201 bp, Bos taurus; identical to SEQ ID NO: 11399

SEQ ID NO: 52616 - DNA, 201 bp, Bos taurus; identical to SEQ ID NO: 11401

SEQ ID NO: 52617 - DNA, 201 bp, Bos taurus; identical to SEQ ID NO: 11402

SEQ ID NO: 52618 - DNA, 201 bp, Bos taurus; identical to SEQ ID NO: 11403

SEQ ID NO: 52619 - DNA, 201 bp, Bos taurus; identical to SEQ ID NO: 11404

SEQ ID NO: 52620 - DNA, 201 bp, Bos taurus
gttttctcatttgtaaaatgggggtaacaatccctaccttgtggggttgatgtgaggattagataagctaaaatgcatgaagtgtttagaacaggcctgcgtattctagactcacttcagggtgagtgtgcacgcatttgctgcacaccagggagtagatgtgagggttggaggaggtagccctctatgtatctgggggcg

SEQ ID NO: 52621 - DNA, 201 bp, Bos taurus; identical to SEQ ID NO: 11407

SEQ ID NO: 52622 - DNA, 201 bp, Bos taurus; identical to SEQ ID NO: 11408

SEQ ID NO: 52623 - DNA, 201 bp, Bos taurus; identical to SEQ ID NO: 11409

SEQ ID NO: 52624 - DNA, 201 bp, Bos taurus; identical to SEQ ID NO: 11411

SEQ ID NO: 52625 - DNA, 201 bp, Bos taurus; identical to SEQ ID NO: 11412

SEQ ID NO: 52626 - DNA, 201 bp, Bos taurus; identical to SEQ ID NO: 11413

SEQ ID NO: 52627 - DNA, 201 bp, Bos taurus; identical to SEQ ID NO: 11414

SEQ ID NO: 52628 - DNA, 201 bp, Bos taurus
gctggctgctaagcttccctggtgcctcatttcctgtgaatgcagctcactcctgataacaaagccctcacgatgggccaggtctgcctttcatccacgctcccttgagtaccgccctcagacccccagctcagtcctcaggaccactcagcctgctctgcccacctgctctgcctaccctgttccagggcctggaacctt

SEQ ID NO: 52629 - DNA, 201 bp, Bos taurus
gttaattaatgaataataaaaaagggagaagatgactgcaaggatgaaagcctgggctcccaggtgcctagggggacatagccggcccccagggacatcagctcttgttgggagttgccaagggctgtcatctcgtcactctctcccacaggtagaggcctgggtgggtgtgggtgggggggcaataaaatctaaaatgcc

SEQ ID NO: 52630 - DNA, 201 bp, Bos taurus; identical to SEQ ID NO: 11416

SEQ ID NO: 52631 - DNA, 201 bp, Bos taurus; identical to SEQ ID NO: 11417

SEQ ID NO: 52632 - DNA, 201 bp, Bos taurus; identical to SEQ ID NO: 11418

SEQ ID NO: 52633 - DNA, 201 bp, Bos taurus; identical to SEQ ID NO: 11419

SEQ ID NO: 52634 - DNA, 201 bp, Bos taurus
ctcctcccacagtccttggccgtgagcccctcaaagtgatcagacgaccagcagatccgagcccaccctccttcagcgtggaccagaccagggtgaacccccggcctctggaaacaaaaccaccaactgagagaagtcagtccaaccctccgtcctgagccctttaaacacacgccacagagactggagtcagaggacaga

SEQ ID NO: 52635 - DNA, 201 bp, Bos taurus; identical to SEQ ID NO: 11421

SEQ ID NO: 52636 - DNA, 201 bp, Bos taurus; identical to SEQ ID NO: 11422

SEQ ID NO: 52637 - DNA, 201 bp, Bos taurus; identical to SEQ ID NO: 11423

SEQ ID NO: 52638 - DNA, 201 bp, Bos taurus
ccacctgtctagggaccctgggtatgactcctggattggccacaggggggcgcacagctccttgtgagccactccccacctccacccctgcttgcctgagccaacctgagttacctggccacctacagtcagagaggggtgggtcaccaactggggcctacccacatcccaccctgatgagagcccacccacgcctccaac

SEQ ID NO: 52639 - DNA, 201 bp, Bos taurus; identical to SEQ ID NO: 11424

SEQ ID NO: 52640 - DNA, 201 bp, Bos taurus; identical to SEQ ID NO: 11426

SEQ ID NO: 52641 - DNA, 201 bp, Bos taurus; identical to SEQ ID NO: 11427

SEQ ID NO: 52642 - DNA, 201 bp, Bos taurus
gggacccacagcctgatcttcttccattccttccaggcccccctggcttctaagaatctcagtaccagctgcagactggacaccattctcttgcaacacatgaagtatggccaaagagtctttgcagtggctctgttgtgactgatgtaatttaaaaaaattaaattaattaatttattatttttgactgccttgtgtctt

SEQ ID NO: 52643 - DNA, 201 bp, Bos taurus; identical to SEQ ID NO: 11429

SEQ ID NO: 52644 - DNA, 201 bp, Bos taurus; identical to SEQ ID NO: 11430

SEQ ID NO: 52645 - DNA, 201 bp, Bos taurus
aggcaggtacttggtcacgaaattaagacattgtataagactgtcagttgtgtactttggaaatcagctccacagatttcccttcctcattttcccaaaggtatcatcggccatttagatggagagtctctcagaatttgacctctcaaacaagaagtccatcaacctctggttcccatctcccttccaagccttatttca

SEQ ID NO: 52646 - DNA, 201 bp, Bos taurus
ctctctggcctggcccaaggcccagggtaaacagatgctgaaatggacaggaagccccagagccatgaaggtgaggcttgtgcatgtcaagtatcgggacgtcaccctttcctgccaccaggcctctcacaccctttcctgccacttcccagcagttcccctgccctgtgccttcactcaccctgctcttcaaggtatcca

SEQ ID NO: 52647 - DNA, 201 bp, Bos taurus; identical to SEQ ID NO: 11432

SEQ ID NO: 52648 - DNA, 201 bp, Bos taurus; identical to SEQ ID NO: 11433

SEQ ID NO: 52649 - DNA, 201 bp, Bos taurus; identical to SEQ ID NO: 11434

SEQ ID NO: 52650 - DNA, 201 bp, Bos taurus; identical to SEQ ID NO: 11435

SEQ ID NO: 52651 - DNA, 201 bp, Bos taurus; identical to SEQ ID NO: 11436

SEQ ID NO: 52652 - DNA, 201 bp, Bos taurus
attcaaaagagtgtatgtaacatatgtaaacaactaaaagaacagtaatacaacaagcacggtctacccagcccccgacctgaaggcgcatgacccataatggggttgtcttgctcttttctgtcacctctgcatacccccgagcccacaccttcctgaatgctatgtgcctcccaaactgtcttttcctttttaaaaaaa

SEQ ID NO: 52653 - DNA, 201 bp, Bos taurus; identical to SEQ ID NO: 11438

SEQ ID NO: 52654 - DNA, 201 bp, Bos taurus; identical to SEQ ID NO: 11439

SEQ ID NO: 52655 - DNA, 201 bp, Bos taurus; identical to SEQ ID NO: 11440

SEQ ID NO: 52656 - DNA, 201 bp, Bos taurus; identical to SEQ ID NO: 11441

SEQ ID NO: 52657 - DNA, 201 bp, Bos taurus
tgtcatgcctgagattggaggacagtgtgcaggtttcccaccacaaaacaagcctcccggcatggacagggcggtcggccacgctcagctcgaaccaggatgagctgatggtgcctgggggacacgtgaggagtctgacacctggaaccatggggcatgtgccctgagaggctcagcagcttccggccttctaggtgatgc

SEQ ID NO: 52658 - DNA, 201 bp, Bos taurus; identical to SEQ ID NO: 11448

SEQ ID NO: 52659 - DNA, 201 bp, Bos taurus; identical to SEQ ID NO: 11449

SEQ ID NO: 52660 - DNA, 201 bp, Bos taurus; identical to SEQ ID NO: 11451

SEQ ID NO: 52661 - DNA, 201 bp, Bos taurus; identical to SEQ ID NO: 11452

SEQ ID NO: 52662 - DNA, 201 bp, Bos taurus; identical to SEQ ID NO: 11453

SEQ ID NO: 52663 - DNA, 201 bp, Bos taurus; identical to SEQ ID NO: 11455

SEQ ID NO: 52664 - DNA, 201 bp, Bos taurus; identical to SEQ ID NO: 11456

SEQ ID NO: 52665 - DNA, 201 bp, Bos taurus; identical to SEQ ID NO: 11457

SEQ ID NO: 52666 - DNA, 201 bp, Bos taurus
cttctgtgacaggcagcatggtagcccctgagaagcctgttttcaacaagagacattcctttcagagtaaccaaccaacatccaagcggaagccacgtcagggcctgtccaggtggagccgtctctgaaccccaagcagccctgagccggggccccacaggacggctccatgcactccagggaaagcgccagctccttcct

SEQ ID NO: 52667 - DNA, 201 bp, Bos taurus; identical to SEQ ID NO: 11458

SEQ ID NO: 52668 - DNA, 201 bp, Bos taurus; identical to SEQ ID NO: 11459

SEQ ID NO: 52669 - DNA, 201 bp, Bos taurus; identical to SEQ ID NO: 11460

SEQ ID NO: 52670 - DNA, 201 bp, Bos taurus; identical to SEQ ID NO: 11461

SEQ ID NO: 52671 - DNA, 201 bp, Bos taurus; identical to SEQ ID NO: 11462

SEQ ID NO: 52672 - DNA, 201 bp, Bos taurus
tgctggccaccttcctggacagtttccattcatagctgagatgactgtgtccaaatgcaagccaattccatcagttccttacttaaaaccttttatggacttctttctgctccctggccaaagcagagcttcctaccagggacctgcaagtccctgggccccccgtggtatagcccccactgacctctctcattgttcctt

SEQ ID NO: 52673 - DNA, 201 bp, Bos taurus
ctccctgttcccatccccaggactgatcaccagggagaagatgctacagaaggatgaagggtggggggagggaacctttgtggccataaaccattaattagaggcaatttccaaaatgtaggcattatggtgccagattttatgtctgggattccatcaatcctggcctttatttcccctctgtctcagccctgagagtgg

SEQ ID NO: 52674 - DNA, 201 bp, Bos taurus; identical to SEQ ID NO: 11468

SEQ ID NO: 52675 - DNA, 201 bp, Bos taurus; identical to SEQ ID NO: 11469

SEQ ID NO: 52676 - DNA, 201 bp, Bos taurus
gcaggtggattctttaccagctgagccacaaggggagcctctagatggggagggctcagcccaaacccccatctggccataactgttacagatgcagaagcctgatttttattaaaacagagaagcatcctggtgaccaactcagaagtcacagagggatgagccagaagctgatttcatgacttccgtgggagaaaggcc

SEQ ID NO: 52677 - DNA, 201 bp, Bos taurus; identical to SEQ ID NO: 11470

SEQ ID NO: 52678 - DNA, 201 bp, Bos taurus; identical to SEQ ID NO: 11472

SEQ ID NO: 52679 - DNA, 201 bp, Bos taurus; identical to SEQ ID NO: 11475

SEQ ID NO: 52680 - DNA, 201 bp, Bos taurus
cagcacagaagaccccagagcttcaaaattcagcccctcttgccttaaacaactgcattcttattccaaacaaccttggccacattaggcaggcatccccaaacctgagtgggtcccagaacttcaggaccacctgctaatgcaaattcccaggccctgctcaccagagtgctcatttagtgacttggagtggtatcctgg

SEQ ID NO: 52681 - DNA, 201 bp, Bos taurus
gaaaagaatgctaagtgaatacatttctttgatctgcagagtgtcaaaatggcaagataatacaggctgctctttctttcctcccaaaaccaaccttggataaactattgaaaaatgaacaagccacaaagatgtggcttccataaagtaagaacagaaaatagtaacaaaaggttggaaactctggctaaaacctgtctt

SEQ ID NO: 52682 - DNA, 201 bp, Bos taurus
gttactcagacttccaggtgtctaagtatctcaagagaaaacagcttacaccacaacaatctggctatatccaggatcaggacacacccttctaaatagtatcatatagaggatctcctaccacccattaaagaaattccactctatttcaaggatctcgttccatatagaactcttcctgatttgggcctcaaacttaac

SEQ ID NO: 52683 - DNA, 201 bp, Bos taurus
ttgtctcaccgccctggcattctttttgctccctgggaaagttgatctttaacaagggatgttcacttgtccctctcattactttggctgaaggctttgcggatgaactgctgagtgtccagccagcatttgacatccttttctcttgaatggtgaaattcaaatcatgtgttgctgtctttcctctccaatcattttctt

SEQ ID NO: 52684 - DNA, 201 bp, Bos taurus
gtggaaagggctctgaggggccgcaggcatgtgtgagtggatgaatgcacactcctggggcctctgtcacaagggccatcaggggataggccaacatcactgcccttggcttttacccccaccaagtaacccctgcccgcctgtggtcagctagagacacccagattacctttcagcaggggcagaggcctggagtagggg

SEQ ID NO: 52685 - DNA, 201 bp, Bos taurus; identical to SEQ ID NO: 11476

SEQ ID NO: 52686 - DNA, 201 bp, Bos taurus
ctaaaatgtatcttctgtattcaatctccatcagccctctggaaaatcacagcaaatactaattggcaatatttacacaatccttgccatgatatacttacaagtatttgattaaattatacaaaccagcaacaatgagcagaatctgactatattacagaaagagttttccatctctcaaaagcaataaagtatttttct

SEQ ID NO: 52687 - DNA, 201 bp, Bos taurus; identical to SEQ ID NO: 11481

SEQ ID NO: 52688 - DNA, 201 bp, Bos taurus; identical to SEQ ID NO: 11482

SEQ ID NO: 52689 - DNA, 201 bp, Bos taurus
agattagcatttgattcagtagactgagtagacttccacacgcaccaaggtgggtgggaatcatgaaatccatttcaggccatactgaacaaaaaagcaacagagggcagaattctctctcgcttgagctgggatgtcgatcttttcctgcccttgaacatcagagctactaggtctcaggcccttagacttggactcctt

SEQ ID NO: 52690 - DNA, 201 bp, Bos taurus; identical to SEQ ID NO: 11483

SEQ ID NO: 52691 - DNA, 201 bp, Bos taurus; identical to SEQ ID NO: 11484

SEQ ID NO: 52692 - DNA, 201 bp, Bos taurus; identical to SEQ ID NO: 11485

SEQ ID NO: 52693 - DNA, 201 bp, Bos taurus; identical to SEQ ID NO: 11486

SEQ ID NO: 52694 - DNA, 201 bp, Bos taurus; identical to SEQ ID NO: 11487

SEQ ID NO: 52695 - DNA, 201 bp, Bos taurus; identical to SEQ ID NO: 11489

SEQ ID NO: 52696 - DNA, 201 bp, Bos taurus; identical to SEQ ID NO: 11490

SEQ ID NO: 52697 - DNA, 201 bp, Bos taurus; identical to SEQ ID NO: 11492

SEQ ID NO: 52698 - DNA, 201 bp, Bos taurus; identical to SEQ ID NO: 11493

SEQ ID NO: 52699 - DNA, 201 bp, Bos taurus
gctttcagtggaacaattttcctaacggagtgactctgctgccaccacccttctccagaaaagaccccaaagacacttaaattggccaaaggtgagccagtggaagcagctgagctgcccttgtctgtccaaatccctccagcacgaggcaggcagtcacaccccatcgtctggacattcacacagagaccggtgcgggtg

SEQ ID NO: 52700 - DNA, 201 bp, Bos taurus
ttgctgtaaagctgtcaggtggagctacagtcaattgcaggctagactggggctggagggtccacttccaaaatggtgcactcacatcatgctagttattggtaggaggcctcagatcatcccccattgggcttccatttccatgggctacttgagtgttcttggaatacaggggctggcttcaatcagaatgaggactcc

SEQ ID NO: 52701 - DNA, 201 bp, Bos taurus; identical to SEQ ID NO: 11494

SEQ ID NO: 52702 - DNA, 201 bp, Bos taurus; identical to SEQ ID NO: 11496

SEQ ID NO: 52703 - DNA, 201 bp, Bos taurus; identical to SEQ ID NO: 11497

SEQ ID NO: 52704 - DNA, 201 bp, Bos taurus; identical to SEQ ID NO: 11498

SEQ ID NO: 52705 - DNA, 201 bp, Bos taurus; identical to SEQ ID NO: 11499

SEQ ID NO: 52706 - DNA, 201 bp, Bos taurus; identical to SEQ ID NO: 11500

SEQ ID NO: 52707 - DNA, 201 bp, Bos taurus; identical to SEQ ID NO: 11502

SEQ ID NO: 52708 - DNA, 201 bp, Bos taurus
aatgctttcagtgtggaaaactgtgtagaaaggttaataaacttggtgggaaggagagcacaagggaaggaaaagattatcccaaccattgagctgtatcgtgatttagtgagaagagcctacatgttggcatcaggcaattctgttcaccactgtgaccctggtcaccacactactgagccccacatgaaaacaggtact

SEQ ID NO: 52709 - DNA, 201 bp, Bos taurus; identical to SEQ ID NO: 11503

SEQ ID NO: 52710 - DNA, 201 bp, Bos taurus; identical to SEQ ID NO: 11504

SEQ ID NO: 52711 - DNA, 201 bp, Bos taurus; identical to SEQ ID NO: 11507

SEQ ID NO: 52712 - DNA, 201 bp, Bos taurus; identical to SEQ ID NO: 11508

SEQ ID NO: 52713 - DNA, 201 bp, Bos taurus; identical to SEQ ID NO: 11509

SEQ ID NO: 52714 - DNA, 201 bp, Bos taurus; identical to SEQ ID NO: 11510

SEQ ID NO: 52715 - DNA, 201 bp, Bos taurus; identical to SEQ ID NO: 11511

SEQ ID NO: 52716 - DNA, 201 bp, Bos taurus
gccaagtgcctctaatgctctcctgggtattttatgattcatctcgctagaacctctttatcttctcgaaagtttgctgagctgtcaatcctcctttagctgacctcagataacatcatatcctgctctctgttcctgggaccctcttttgtgggtctgagtcctgtctagatgatgcaggctctgcccagaccaccacaa

SEQ ID NO: 52717 - DNA, 201 bp, Bos taurus; identical to SEQ ID NO: 11512

SEQ ID NO: 52718 - DNA, 201 bp, Bos taurus; identical to SEQ ID NO: 11513

SEQ ID NO: 52719 - DNA, 201 bp, Bos taurus
tcaactaccatctccactttgttggaggcccccaccctctgcaggggacgtgatcctgctagggaaacttaatagaggtagtcttgttgaggcttcagaagtaggagagcaggcctttgactaacttctgaccctagctggactgtgtgtgagcctgcaagcacaccaattgttaccagcaagccaagcagcactttagat

SEQ ID NO: 52720 - DNA, 201 bp, Bos taurus; identical to SEQ ID NO: 11516

SEQ ID NO: 52721 - DNA, 201 bp, Bos taurus
gagcaacgttcctggtggtctggtgctaagacttcacgatcctaatgcggggaacctgggtttgatccgggtcagtgacctagatcgcacatgctccaaccagagattccacacaccgcaacgaagaccaaatatcctaagtgccacaactaagacccggcacagccaaataaataaacgattttttaaaaaaagaaaaac

SEQ ID NO: 52722 - DNA, 201 bp, Bos taurus; identical to SEQ ID NO: 11518

SEQ ID NO: 52723 - DNA, 201 bp, Bos taurus; identical to SEQ ID NO: 11520

SEQ ID NO: 52724 - DNA, 201 bp, Bos taurus
tgtgcgggctgtgggcccctccaggcagacaccacttctctttggtggcctcctccgtcttctcacgtccgtcagttacagggcctctcagttgtgcctcctacactaactttaaacccttctccattgcctttatcctctctaaacatgcactatggcccaaagctccctgactagttttctcttcaatccaaccactgt

SEQ ID NO: 52725 - DNA, 201 bp, Bos taurus; identical to SEQ ID NO: 11523

SEQ ID NO: 52726 - DNA, 201 bp, Bos taurus; identical to SEQ ID NO: 11524

SEQ ID NO: 52727 - DNA, 201 bp, Bos taurus; identical to SEQ ID NO: 11526

SEQ ID NO: 52728 - DNA, 201 bp, Bos taurus; identical to SEQ ID NO: 11527

SEQ ID NO: 52729 - DNA, 201 bp, Bos taurus; identical to SEQ ID NO: 11532

SEQ ID NO: 52730 - DNA, 201 bp, Bos taurus
tcgaatatcagagtggcagagacgaactgctcccacttctgcactgacccctctgtgaggtcttctctggacccttcattgctctctgcaccacagggaaaggccagcagagtaatacctgtggccatgtggagcattctcatttgacgtgattgaggggaaaacccaaaacataaaagaaagttggtgctggaaaggagt

SEQ ID NO: 52731 - DNA, 201 bp, Bos taurus; identical to SEQ ID NO: 11536

SEQ ID NO: 52732 - DNA, 201 bp, Bos taurus; identical to SEQ ID NO: 11537

SEQ ID NO: 52733 - DNA, 201 bp, Bos taurus; identical to SEQ ID NO: 11538

SEQ ID NO: 52734 - DNA, 201 bp, Bos taurus; identical to SEQ ID NO: 11539

SEQ ID NO: 52735 - DNA, 201 bp, Bos taurus; identical to SEQ ID NO: 11540

SEQ ID NO: 52736 - DNA, 201 bp, Bos taurus; identical to SEQ ID NO: 11541

SEQ ID NO: 52737 - DNA, 201 bp, Bos taurus; identical to SEQ ID NO: 11542

SEQ ID NO: 52738 - DNA, 201 bp, Bos taurus; identical to SEQ ID NO: 11543

SEQ ID NO: 52739 - DNA, 201 bp, Bos taurus; identical to SEQ ID NO: 11544

SEQ ID NO: 52740 - DNA, 201 bp, Bos taurus; identical to SEQ ID NO: 11545

SEQ ID NO: 52741 - DNA, 201 bp, Bos taurus; identical to SEQ ID NO: 11546

SEQ ID NO: 52742 - DNA, 201 bp, Bos taurus; identical to SEQ ID NO: 11547

SEQ ID NO: 52743 - DNA, 201 bp, Bos taurus; identical to SEQ ID NO: 11548

SEQ ID NO: 52744 - DNA, 201 bp, Bos taurus; identical to SEQ ID NO: 11549

SEQ ID NO: 52745 - DNA, 201 bp, Bos taurus; identical to SEQ ID NO: 11550

SEQ ID NO: 52746 - DNA, 201 bp, Bos taurus; identical to SEQ ID NO: 11554

SEQ ID NO: 52747 - DNA, 201 bp, Bos taurus; identical to SEQ ID NO: 11556

SEQ ID NO: 52748 - DNA, 201 bp, Bos taurus; identical to SEQ ID NO: 11557

SEQ ID NO: 52749 - DNA, 201 bp, Bos taurus; identical to SEQ ID NO: 11559

SEQ ID NO: 52750 - DNA, 201 bp, Bos taurus; identical to SEQ ID NO: 11562

SEQ ID NO: 52751 - DNA, 201 bp, Bos taurus; identical to SEQ ID NO: 11563

SEQ ID NO: 52752 - DNA, 201 bp, Bos taurus; identical to SEQ ID NO: 11564

SEQ ID NO: 52753 - DNA, 201 bp, Bos taurus; identical to SEQ ID NO: 11565

SEQ ID NO: 52754 - DNA, 201 bp, Bos taurus; identical to SEQ ID NO: 11567

SEQ ID NO: 52755 - DNA, 201 bp, Bos taurus; identical to SEQ ID NO: 11568

SEQ ID NO: 52756 - DNA, 201 bp, Bos taurus; identical to SEQ ID NO: 11570

SEQ ID NO: 52757 - DNA, 201 bp, Bos taurus; identical to SEQ ID NO: 11572

SEQ ID NO: 52758 - DNA, 201 bp, Bos taurus; identical to SEQ ID NO: 11574

SEQ ID NO: 52759 - DNA, 201 bp, Bos taurus; identical to SEQ ID NO: 11577

SEQ ID NO: 52760 - DNA, 201 bp, Bos taurus; identical to SEQ ID NO: 11578

SEQ ID NO: 52761 - DNA, 201 bp, Bos taurus; identical to SEQ ID NO: 11580

SEQ ID NO: 52762 - DNA, 201 bp, Bos taurus; identical to SEQ ID NO: 11581

SEQ ID NO: 52763 - DNA, 201 bp, Bos taurus; identical to SEQ ID NO: 11582

SEQ ID NO: 52764 - DNA, 201 bp, Bos taurus; identical to SEQ ID NO: 11583

SEQ ID NO: 52765 - DNA, 201 bp, Bos taurus; identical to SEQ ID NO: 11585

SEQ ID NO: 52766 - DNA, 201 bp, Bos taurus; identical to SEQ ID NO: 11587

SEQ ID NO: 52767 - DNA, 201 bp, Bos taurus; identical to SEQ ID NO: 11588

SEQ ID NO: 52768 - DNA, 201 bp, Bos taurus; identical to SEQ ID NO: 11589

SEQ ID NO: 52769 - DNA, 201 bp, Bos taurus; identical to SEQ ID NO: 11590

SEQ ID NO: 52770 - DNA, 201 bp, Bos taurus; identical to SEQ ID NO: 11591

SEQ ID NO: 52771 - DNA, 201 bp, Bos taurus; identical to SEQ ID NO: 11592

SEQ ID NO: 52772 - DNA, 201 bp, Bos taurus; identical to SEQ ID NO: 11593

SEQ ID NO: 52773 - DNA, 201 bp, Bos taurus; identical to SEQ ID NO: 11595

SEQ ID NO: 52774 - DNA, 201 bp, Bos taurus; identical to SEQ ID NO: 11597

SEQ ID NO: 52775 - DNA, 201 bp, Bos taurus; identical to SEQ ID NO: 11598

SEQ ID NO: 52776 - DNA, 201 bp, Bos taurus; identical to SEQ ID NO: 11599

SEQ ID NO: 52777 - DNA, 201 bp, Bos taurus
atctaatcaagaaattccatagctgcagcaaagtgagcaaaagggagagcctaggtggaaataaattcagagagataaggaccctatggcaaaggccccttgattaaatgggaaaccacaggaagggcagcaggtcttaaactaaggcataaaatgggatctgctttcttttaaaataataggctgaagggggccaaggaa

SEQ ID NO: 52778 - DNA, 201 bp, Bos taurus; identical to SEQ ID NO: 11600

SEQ ID NO: 52779 - DNA, 201 bp, Bos taurus; identical to SEQ ID NO: 11601

SEQ ID NO: 52780 - DNA, 201 bp, Bos taurus; identical to SEQ ID NO: 11602

SEQ ID NO: 52781 - DNA, 201 bp, Bos taurus; identical to SEQ ID NO: 11603

SEQ ID NO: 52782 - DNA, 201 bp, Bos taurus
ctttaaaatgggttcccaaaatccaatatgcaggtctcagagaatatccaagagactagtgaaaggccactgaattatgggtataccaaataaatacgatggcacctaacaaccaaagctgcaatgacatcacccccaggaaaatgctggctgtcaaattctacaccccactgcctcaagtctgctcatttccaagtccag

SEQ ID NO: 52783 - DNA, 201 bp, Bos taurus; identical to SEQ ID NO: 11605

SEQ ID NO: 52784 - DNA, 201 bp, Bos taurus; identical to SEQ ID NO: 11606

SEQ ID NO: 52785 - DNA, 201 bp, Bos taurus
ttttcaaggtatcgtactataagattaaaatgtattattttgtgtttgttttttatgtattatttgtgtgaaaaatatcataaatctattacagtacagtcctattaatatacagccaacggtgttagttggctacctaggctaactctgttggacttacaaacacattggacttaggagggtgacctcaggatggaactt

SEQ ID NO: 52786 - DNA, 201 bp, Bos taurus
tggctgattcattctgctgtacagcagaaacgaatgcgagatggtgaggcaactagactccaataaaactaaaggcagaaaacaaatgtaatctacttatttcttatgggctacacagcccattaggaacaccatgaaatgtgactatatttacactgccccagctgagaatcctcaaagtggctgccatggacttagccc

SEQ ID NO: 52787 - DNA, 201 bp, Bos taurus; identical to SEQ ID NO: 11609

SEQ ID NO: 52788 - DNA, 201 bp, Bos taurus
tattggtaataataaacttcttttaaaaaatgtgttgttaggccattgccctggaatacaatctcaacagagacaacaaatttgactcatagtgacttctctttgctcataagtgggagggtggcctgtggtcagtacaaaattcgagtttggagagaaacactctctgtctcaaaggttggcttagatgctgtttgatgg

SEQ ID NO: 52789 - DNA, 201 bp, Bos taurus; identical to SEQ ID NO: 11610

SEQ ID NO: 52790 - DNA, 201 bp, Bos taurus; identical to SEQ ID NO: 11611

SEQ ID NO: 52791 - DNA, 201 bp, Bos taurus; identical to SEQ ID NO: 11612

SEQ ID NO: 52792 - DNA, 201 bp, Bos taurus; identical to SEQ ID NO: 11614

SEQ ID NO: 52793 - DNA, 201 bp, Bos taurus; identical to SEQ ID NO: 11615

SEQ ID NO: 52794 - DNA, 201 bp, Bos taurus
ggtggtaaaacaagtagttacggggtagactctgaaaccagaccaccatctttaaatctagacactgccatcagcagcgtcacccgacctctctggccccttgttttctcacgtgtaaagtccaccccccccaccaccgccatcgagttgtgacaggggctattgcatgtgaagcagctggcccatggacagcccttactg

SEQ ID NO: 52795 - DNA, 201 bp, Bos taurus
gcctgtggcaggccttttcattgttgtacccacttgtttttccctgttcagtgcttgaggtgattttagtcaaacccggttctctatcgatatcctcaatgcatgtagcccgtgcagtctggaattgtgcttgtctgctcaaaccaagaaccaaatgtacacattcataccccttgcacatagtctccctcattattcatt

SEQ ID NO: 52796 - DNA, 201 bp, Bos taurus
gattttggtgaagaatctatggctgaggaccctaagaaaagtcagttactttcagtgtctctggctcttcaagacttaaggcttaagaaacctctaggaacacaccccagggttgctgaagattttggtaggcaagcagggaagagatttcatcatgagatttaagaggctcaggaaggtaactgcctagaaaccctttca

SEQ ID NO: 52797 - DNA, 201 bp, Bos taurus
gtccaaaggccaaatcaaatggatggagccaacgcgaggagttaaggtagcggaatctatatcccatgttttgagggattatttcctttagctattgaatcaggatctcgaagtcaggccttacttctgtgattaacaaaacctttgaggataatgaggggaatatggaaatggatttaagtttctcaaagaaaaagagct

SEQ ID NO: 52798 - DNA, 201 bp, Bos taurus; identical to SEQ ID NO: 11621

SEQ ID NO: 52799 - DNA, 201 bp, Bos taurus; identical to SEQ ID NO: 11622

SEQ ID NO: 52800 - DNA, 201 bp, Bos taurus; identical to SEQ ID NO: 11623

SEQ ID NO: 52801 - DNA, 201 bp, Bos taurus; identical to SEQ ID NO: 11625

SEQ ID NO: 52802 - DNA, 201 bp, Bos taurus
tagtttgccagctgttttcttacaaacaattatataccttcattcctttacagaggaatttactaatcacgaggttggaaaataatgtacttctcttgttcattatatgttaataatcatgaataagaaagtctgtctcagtgaagaaaacttacaaagctactttattgcattctgaatttgagtgttaaaacttgagat

SEQ ID NO: 52803 - DNA, 201 bp, Bos taurus
gagccccaggacacctgagtcccctaagtcaagggattatcaggactcaggagacctgggacccagtcgaagtttcccctccagccaatggcgtaacttagtgcaagccataaatgcttcttccatgttccagtctgtaaaatttatttcatatttattatcagctgaaggaggaaatggcaacctgctccagtattctgc

SEQ ID NO: 52804 - DNA, 201 bp, Bos taurus
ctcactctaggccttctgatcacctacccttggaccactcctttgggtgacgtagaggtatcacagggctggtgcatggaactcacttttccactcctctccagggtgaggctgaccttggccatgctgggtatgtccccctagctagaggtttcctgaccaagcacctttctgctatggcatttcccctgcttggcccca

SEQ ID NO: 52805 - DNA, 201 bp, Bos taurus; identical to SEQ ID NO: 11627

SEQ ID NO: 52806 - DNA, 201 bp, Bos taurus; identical to SEQ ID NO: 11628

SEQ ID NO: 52807 - DNA, 201 bp, Bos taurus; identical to SEQ ID NO: 11629

SEQ ID NO: 52808 - DNA, 201 bp, Bos taurus; identical to SEQ ID NO: 11630

SEQ ID NO: 52809 - DNA, 201 bp, Bos taurus; identical to SEQ ID NO: 11631

SEQ ID NO: 52810 - DNA, 201 bp, Bos taurus
attttattggaaagggcacccgggtggagagcagtagggtaagggaacccaggagaacagttccgccacatggctcacagttttatggtgtttgggattaatttctgggttgtctttagcccatcattctgactcacagtccatcctggtggtgcatgccttgttcagccaagatggatgccagcgagaaggattctggga

SEQ ID NO: 52811 - DNA, 201 bp, Bos taurus
agcaacttccgttggttcttaaagataaagcttattgatgtgattttcagggtcccacaccacctggctctgacttctctctgctacctattctgtgtcacgtgacacaccctctcgctccctccactccagccacactgaccttcacacacactccccgcactctctccagctacgacacccatcctgtgctgttcctcc

SEQ ID NO: 52812 - DNA, 201 bp, Bos taurus
atggcacagccccgtggacggcccacggtggcagctgtgaagggagtggttctggggattccagcgagaccaggctcctggcgtgagacagcgtgagtgcagggcctctcttctgacttattactggtttgataaatcgggtgtgctttctcatttacccagctgaaagaatatagcttttagcttagttttctttagagc

SEQ ID NO: 52813 - DNA, 201 bp, Bos taurus
tgggtagggcttgcatgtgacgtggtggccactggggagggatggagtggagcggaaggaggaagtgcaggtggagcacacagaaagtatgaaaagtggtaggagcctggtagttcatctccatgaatgcctgccacagaattagatcttcaggaggcagtggttcagaggagggttcaaggagaggctgaaggaccattc

SEQ ID NO: 52814 - DNA, 201 bp, Bos taurus; identical to SEQ ID NO: 11636

SEQ ID NO: 52815 - DNA, 201 bp, Bos taurus; identical to SEQ ID NO: 11637

SEQ ID NO: 52816 - DNA, 201 bp, Bos taurus
cacctactgatgggatgcacagggccttgtggaaaaaaaaaaaaaaacaaaacacagtgtctagcagctcaggaaagaagtgtttacattatgacagcaggtgaggccaggaagggcttcccagaggaggtaatattctagctgggttttgtaggataaatagaaattggctagtaggggtgggaagtgctctctagggag

SEQ ID NO: 52817 - DNA, 201 bp, Bos taurus; identical to SEQ ID NO: 11638

SEQ ID NO: 52818 - DNA, 201 bp, Bos taurus; identical to SEQ ID NO: 11640

SEQ ID NO: 52819 - DNA, 201 bp, Bos taurus; identical to SEQ ID NO: 11642

SEQ ID NO: 52820 - DNA, 201 bp, Bos taurus; identical to SEQ ID NO: 11643

SEQ ID NO: 52821 - DNA, 201 bp, Bos taurus; identical to SEQ ID NO: 11644

SEQ ID NO: 52822 - DNA, 201 bp, Bos taurus
agaaaagttaaataaaccttattacattatcaaacacaaaaatcaatattcttttatccccaatccttcctaaggccagaaagagtataaggaaaaaaatatgcattgtgcaggttaaatgtatatttttaatgtacttgtttgggaatcaaaaggcctgaatatttcttccatctgagatacagcaaactgtgtacaaat

SEQ ID NO: 52823 - DNA, 201 bp, Bos taurus; identical to SEQ ID NO: 11647

SEQ ID NO: 52824 - DNA, 201 bp, Bos taurus; identical to SEQ ID NO: 11649

SEQ ID NO: 52825 - DNA, 201 bp, Bos taurus; identical to SEQ ID NO: 11650

SEQ ID NO: 52826 - DNA, 201 bp, Bos taurus; identical to SEQ ID NO: 11651

SEQ ID NO: 52827 - DNA, 201 bp, Bos taurus; identical to SEQ ID NO: 11654

SEQ ID NO: 52828 - DNA, 201 bp, Bos taurus; identical to SEQ ID NO: 11655

SEQ ID NO: 52829 - DNA, 201 bp, Bos taurus
cccttaaggagttactgatattttcctcaaagtgatggcctgatcagccataacaggctacgtctcagagtccgtggaggcgacaccttccaagcgtgaccagactacctggcaggccatcaccctggaaatcacttccacctgaaactcttcactgcccggcagaatctcactccggctgggtcggcagcactccttccc

SEQ ID NO: 52830 - DNA, 201 bp, Bos taurus; identical to SEQ ID NO: 11656

SEQ ID NO: 52831 - DNA, 201 bp, Bos taurus; identical to SEQ ID NO: 11660

SEQ ID NO: 52832 - DNA, 201 bp, Bos taurus; identical to SEQ ID NO: 11661

SEQ ID NO: 52833 - DNA, 201 bp, Bos taurus; identical to SEQ ID NO: 11662

SEQ ID NO: 52834 - DNA, 201 bp, Bos taurus
tcacaggtgggatcttacttccctgaccggggattgaacctgcatcgcctgtattggaagcactggagtcactgggccaccagggaagtccctcattcttttctaactaacccaagttctcctcagcctgcaaaaggcaattcagaccccacttctcccatgtcgcttcccttggccactttatcccaccctggcgggata

SEQ ID NO: 52835 - DNA, 201 bp, Bos taurus; identical to SEQ ID NO: 11663

SEQ ID NO: 52836 - DNA, 201 bp, Bos taurus; identical to SEQ ID NO: 11666

SEQ ID NO: 52837 - DNA, 201 bp, Bos taurus; identical to SEQ ID NO: 11667

SEQ ID NO: 52838 - DNA, 201 bp, Bos taurus; identical to SEQ ID NO: 11671

SEQ ID NO: 52839 - DNA, 201 bp, Bos taurus; identical to SEQ ID NO: 11672

SEQ ID NO: 52840 - DNA, 201 bp, Bos taurus; identical to SEQ ID NO: 11674

SEQ ID NO: 52841 - DNA, 201 bp, Bos taurus; identical to SEQ ID NO: 11676

SEQ ID NO: 52842 - DNA, 201 bp, Bos taurus; identical to SEQ ID NO: 11677

SEQ ID NO: 52843 - DNA, 201 bp, Bos taurus; identical to SEQ ID NO: 11678

SEQ ID NO: 52844 - DNA, 201 bp, Bos taurus
tccattacacttattgtgtactttattttattattactacatcagctccgcctcagatgatcaggcatcaggtcctggagtttgggggcccctcatctagtacagtcaactagagattcgtgtagacacttgtccacataaatttggatcacagtggaggagtttggcctaatcaaatgaatttgggactccacgtattta

SEQ ID NO: 52845 - DNA, 201 bp, Bos taurus; identical to SEQ ID NO: 11680

SEQ ID NO: 52846 - DNA, 201 bp, Bos taurus; identical to SEQ ID NO: 11682

SEQ ID NO: 52847 - DNA, 201 bp, Bos taurus; identical to SEQ ID NO: 11684

SEQ ID NO: 52848 - DNA, 201 bp, Bos taurus; identical to SEQ ID NO: 11685

SEQ ID NO: 52849 - DNA, 201 bp, Bos taurus; identical to SEQ ID NO: 11686

SEQ ID NO: 52850 - DNA, 201 bp, Bos taurus; identical to SEQ ID NO: 11687

SEQ ID NO: 52851 - DNA, 201 bp, Bos taurus; identical to SEQ ID NO: 11689

SEQ ID NO: 52852 - DNA, 201 bp, Bos taurus; identical to SEQ ID NO: 11690

SEQ ID NO: 52853 - DNA, 201 bp, Bos taurus; identical to SEQ ID NO: 11691

SEQ ID NO: 52854 - DNA, 201 bp, Bos taurus
accagagtgagaatacagaaagggcctgaggagataccggaaggcacaacagctggaaacgtccctaaccgaggaaacggaacagtcacccaagtccaggcggcccagagagtcaggtacagtattaaaccagagaggaatatcccatgacacattgtaatcaaaatgacaaaaacttagaatacagagagaatattatga

SEQ ID NO: 52855 - DNA, 201 bp, Bos taurus; identical to SEQ ID NO: 11692

SEQ ID NO: 52856 - DNA, 201 bp, Bos taurus; identical to SEQ ID NO: 11693

SEQ ID NO: 52857 - DNA, 201 bp, Bos taurus; identical to SEQ ID NO: 11694

SEQ ID NO: 52858 - DNA, 201 bp, Bos taurus; identical to SEQ ID NO: 11695

SEQ ID NO: 52859 - DNA, 201 bp, Bos taurus; identical to SEQ ID NO: 11696

SEQ ID NO: 52860 - DNA, 201 bp, Bos taurus; identical to SEQ ID NO: 11697

SEQ ID NO: 52861 - DNA, 201 bp, Bos taurus; identical to SEQ ID NO: 11698

SEQ ID NO: 52862 - DNA, 201 bp, Bos taurus; identical to SEQ ID NO: 11701

SEQ ID NO: 52863 - DNA, 201 bp, Bos taurus; identical to SEQ ID NO: 11702

SEQ ID NO: 52864 - DNA, 201 bp, Bos taurus; identical to SEQ ID NO: 11703

SEQ ID NO: 52865 - DNA, 201 bp, Bos taurus
gtccgtctgtggtggggttggaataggatcagtgggtgatttggattctcagttccaagagtgaccactacctgtggcctcagccattgaaaatgcagatactggtgccttaagtgtttcctcctcctcaatgagactcattccctaggatgatcaaaaggcagaaaatgatatggccatgaaacgagcagctttgttgga

SEQ ID NO: 52866 - DNA, 201 bp, Bos taurus; identical to SEQ ID NO: 11704

SEQ ID NO: 52867 - DNA, 201 bp, Bos taurus; identical to SEQ ID NO: 11706

SEQ ID NO: 52868 - DNA, 201 bp, Bos taurus; identical to SEQ ID NO: 11707

SEQ ID NO: 52869 - DNA, 201 bp, Bos taurus; identical to SEQ ID NO: 11708

SEQ ID NO: 52870 - DNA, 201 bp, Bos taurus; identical to SEQ ID NO: 11709

SEQ ID NO: 52871 - DNA, 201 bp, Bos taurus; identical to SEQ ID NO: 11710

SEQ ID NO: 52872 - DNA, 201 bp, Bos taurus; identical to SEQ ID NO: 11711

SEQ ID NO: 52873 - DNA, 201 bp, Bos taurus; identical to SEQ ID NO: 11712

SEQ ID NO: 52874 - DNA, 201 bp, Bos taurus; identical to SEQ ID NO: 11713

SEQ ID NO: 52875 - DNA, 201 bp, Bos taurus; identical to SEQ ID NO: 11714

SEQ ID NO: 52876 - DNA, 201 bp, Bos taurus; identical to SEQ ID NO: 11715

SEQ ID NO: 52877 - DNA, 201 bp, Bos taurus; identical to SEQ ID NO: 11716

SEQ ID NO: 52878 - DNA, 201 bp, Bos taurus; identical to SEQ ID NO: 11717

SEQ ID NO: 52879 - DNA, 201 bp, Bos taurus; identical to SEQ ID NO: 11718

SEQ ID NO: 52880 - DNA, 201 bp, Bos taurus; identical to SEQ ID NO: 11719

SEQ ID NO: 52881 - DNA, 201 bp, Bos taurus; identical to SEQ ID NO: 11720

SEQ ID NO: 52882 - DNA, 201 bp, Bos taurus; identical to SEQ ID NO: 11721

SEQ ID NO: 52883 - DNA, 201 bp, Bos taurus; identical to SEQ ID NO: 11722

SEQ ID NO: 52884 - DNA, 201 bp, Bos taurus; identical to SEQ ID NO: 11724

SEQ ID NO: 52885 - DNA, 201 bp, Bos taurus; identical to SEQ ID NO: 11727

SEQ ID NO: 52886 - DNA, 201 bp, Bos taurus; identical to SEQ ID NO: 11728

SEQ ID NO: 52887 - DNA, 201 bp, Bos taurus
agcagtttcagtggggccaggccagcagggtagagttctgagcctgaacgtgttcacatgaaagaccagattcattgccaggagacaaattctaagagccagtggacagcacacataggtgctgcccccccccccccgcccccatcactgcaggtctcctccaactggtgtcatcttcagagcagcagcagcaaaagagga

SEQ ID NO: 52888 - DNA, 201 bp, Bos taurus; identical to SEQ ID NO: 11730

SEQ ID NO: 52889 - DNA, 201 bp, Bos taurus; identical to SEQ ID NO: 11731

SEQ ID NO: 52890 - DNA, 201 bp, Bos taurus; identical to SEQ ID NO: 11732

SEQ ID NO: 52891 - DNA, 201 bp, Bos taurus; identical to SEQ ID NO: 11733

SEQ ID NO: 52892 - DNA, 201 bp, Bos taurus; identical to SEQ ID NO: 11734

SEQ ID NO: 52893 - DNA, 201 bp, Bos taurus; identical to SEQ ID NO: 11735

SEQ ID NO: 52894 - DNA, 201 bp, Bos taurus
cgtttgagaaagataaggaatgtaacatttgttccttgatggtaataactcaaaacgctcccctcccttccttcataacactaattccatccatggggccgtgataagtcactggaggctctcaggaggttcatcacccacacgatttgatacaaaaacatctgtgctgatgcacacagctttgtatcattacagatgata

SEQ ID NO: 52895 - DNA, 201 bp, Bos taurus; identical to SEQ ID NO: 11737

SEQ ID NO: 52896 - DNA, 201 bp, Bos taurus; identical to SEQ ID NO: 11738

SEQ ID NO: 52897 - DNA, 201 bp, Bos taurus
cagggaccccagaccaaataaactcacatctcattaaggtcacaggaagggagtgtccccctccagcgctgactgcaagccttggccctccaccccacccacccaagaccgcagtgtctcttccaggggggtaaacagatctaaaacgcatcccccttaagtggaagagccctgaggggatggccacagcctgccaggaac

SEQ ID NO: 52898 - DNA, 201 bp, Bos taurus; identical to SEQ ID NO: 11739

SEQ ID NO: 52899 - DNA, 201 bp, Bos taurus; identical to SEQ ID NO: 11740

SEQ ID NO: 52900 - DNA, 201 bp, Bos taurus
tcagggcatgctgagcccactgccttactgcttggggcccccatccccagatgcaagcttgtccctgtacccttggctctctgcccaaatgatgcctcctcgctggggcctccccgaccctctcatcataagtgggtatcccctaccctttgttttttagcactttactgtgttggaatgacacacaattatttgcacgct

SEQ ID NO: 52901 - DNA, 201 bp, Bos taurus
gctatcgtatgacccagcaatcccattcctgggcatgtatctggagaaaacaataatacaaaaacatacatgcaccccaatgttcatatagccaagacacgaaggcaacctaagtatccatcaacagatgaatggatgaagaagatgtggtacatatatattaatacagcaaaatatcagtcagccatataaaagaatgaa

SEQ ID NO: 52902 - DNA, 201 bp, Bos taurus
taaacagacagagttcttcccgggataggtcaaggtcagtgttgaggtcactggcaaggaagtctggagtggcttggactgaagctactgtgtcttggggaaaaaagacttgttttcattgctttagtcatgagcacaaatcatgactccaaagcttgaaaacccaaagacagcacagcagcctcttatgatgtcactgtt

SEQ ID NO: 52903 - DNA, 201 bp, Bos taurus; identical to SEQ ID NO: 11742

SEQ ID NO: 52904 - DNA, 201 bp, Bos taurus
caacaaatattcatttgctaaaggtatgaatactggtggcaagttcttaaaacatttttaaaaagaatttaatgtttggaagagacattaaataggtctggatgctaaaactgagattattctttaaaaaacaagacagacttctacaagtaccctatattctatatttgcaaaatacaaaaatgaacaaaaatgataaac

SEQ ID NO: 52905 - DNA, 201 bp, Bos taurus
tgggcatgtacataaacatatttgttcgtgaatgtgctgttttaaacaaagtggtcagggaaaaacttaaaagaggcatcatctttctgtaagacacagtagagtgagggagtgcagagccccaggccgaggaaacagtaaacacagagatgggaggtggggacaggcccagcttctccaggagcaggagacagtttgcgg

SEQ ID NO: 52906 - DNA, 201 bp, Bos taurus; identical to SEQ ID NO: 11743

SEQ ID NO: 52907 - DNA, 201 bp, Bos taurus; identical to SEQ ID NO: 11744

SEQ ID NO: 52908 - DNA, 201 bp, Bos taurus
aatgaactctagccagattttcagaatccaggccgaattctgtctctatctttacacctttctagaactagaaaattcaattccttgaacccattatttgctctctacattatgcagttcatttggtgttattatcttgtaacttttggggtcagtgttgtcttgagttgacatttacttttattttttgaacagtagaaa

SEQ ID NO: 52909 - DNA, 201 bp, Bos taurus; identical to SEQ ID NO: 11747

SEQ ID NO: 52910 - DNA, 201 bp, Bos taurus
tcagtgaggccagaccctcgccttctccatatgtagagaagcactaatttcattactttgagaagtctggctttctatacttaacagtgatctgtttgatattctgactacctggtttttgttgcaaaaactcctctaaaccctggctcctcccttacccctttggagcagtccctcagcactacctgacaggctggttcc

SEQ ID NO: 52911 - DNA, 201 bp, Bos taurus; identical to SEQ ID NO: 11748

SEQ ID NO: 52912 - DNA, 201 bp, Bos taurus; identical to SEQ ID NO: 11749

SEQ ID NO: 52913 - DNA, 201 bp, Bos taurus; identical to SEQ ID NO: 11750

SEQ ID NO: 52914 - DNA, 201 bp, Bos taurus; identical to SEQ ID NO: 11751

SEQ ID NO: 52915 - DNA, 201 bp, Bos taurus; identical to SEQ ID NO: 11752

SEQ ID NO: 52916 - DNA, 201 bp, Bos taurus; identical to SEQ ID NO: 11753

SEQ ID NO: 52917 - DNA, 201 bp, Bos taurus; identical to SEQ ID NO: 11754

SEQ ID NO: 52918 - DNA, 201 bp, Bos taurus; identical to SEQ ID NO: 11755

SEQ ID NO: 52919 - DNA, 201 bp, Bos taurus
gctcctggcatctagtgggtagaggccagcagtactgctaaacatcccacatggcacaggacagtccctcactaactatgaattatccagcctgaaatatcagtaggcccacagttgagaaatgatgatctctggaccatagtacattaattactccccttccctccctcgttttcttcccaggtgccaaggttgtcttcc

SEQ ID NO: 52920 - DNA, 201 bp, Bos taurus
gccgcagtcacacatatgtcacgtcctttttagctccgctcccctcgcaacccgcccctctaggtcatttcagagtgccaggccaggcgcccgacttctcacggggtacccgtcctactcagggtagtgtgtacgcgataatggcgctttctccattcgtcccactctttccttccctcactggccttttcgttttctaaa

SEQ ID NO: 52921 - DNA, 201 bp, Bos taurus; identical to SEQ ID NO: 11757

SEQ ID NO: 52922 - DNA, 201 bp, Bos taurus
gggcagaaacttcttaagtaagattttaagaaaccacttattggcctttcatattaaaaacatatcattttaaaagatactcaagaaaatgaaaaggtgtgttatagactgggttgaaatactggtacaacttatacatgataaaggatttatataaaggatatataagaaactcttccatttaattataagacaagcaat

SEQ ID NO: 52923 - DNA, 201 bp, Bos taurus
tttataagaagttataatcagggcaggaatatatttacaaaatgtcataccataaaaacaaattataatagctgttgtttcagtaccagagatttcatggcggattaataagatttttttgtgctgttattactttttttccttagtaggagattgtgtaagccaattttctaagtgaggaaaatgaaaataatcaggtgc

SEQ ID NO: 52924 - DNA, 201 bp, Bos taurus; identical to SEQ ID NO: 11758

SEQ ID NO: 52925 - DNA, 201 bp, Bos taurus; identical to SEQ ID NO: 11759

SEQ ID NO: 52926 - DNA, 201 bp, Bos taurus; identical to SEQ ID NO: 11760

SEQ ID NO: 52927 - DNA, 201 bp, Bos taurus; identical to SEQ ID NO: 11761

SEQ ID NO: 52928 - DNA, 201 bp, Bos taurus; identical to SEQ ID NO: 11762

SEQ ID NO: 52929 - DNA, 201 bp, Bos taurus; identical to SEQ ID NO: 11763

SEQ ID NO: 52930 - DNA, 201 bp, Bos taurus; identical to SEQ ID NO: 11764

SEQ ID NO: 52931 - DNA, 201 bp, Bos taurus
tggggtctcaagagtcagacacttagccactaagccaccactagacttggcaacatttcaagtaatcttaaatttaggcttatgtggcctgattgagaaatgtttggtgctgaacatggagctgggatgactaagattttctgttttgttattaccttcacttggctcctgtacccaggcagtctgtgatacaggccagct

SEQ ID NO: 52932 - DNA, 201 bp, Bos taurus
tatgaagagattgttttttcagctttattaaatatcttttgatatgtatggagacagtttaaatcttatttgacctgttgcattcccagcttaaatctttattcctcattatgtgttattatttaattatgctcttggatttttcatactattattattttaggatatttagatgtaaagttcttttaatctttgttgttt

SEQ ID NO: 52933 - DNA, 201 bp, Bos taurus; identical to SEQ ID NO: 11765

SEQ ID NO: 52934 - DNA, 201 bp, Bos taurus; identical to SEQ ID NO: 11766

SEQ ID NO: 52935 - DNA, 201 bp, Bos taurus
gcatgttatgtttatcagaagatttccaactacaaaacttccttgctggctgggaagaagggaagctacatttgacaagaagaggcaaggggaaggcccagaactgcactgaacaaaataattccagggaatgccagcctctaaggggatgggtgcagttattttctacaagtgtcaagctgcttacttttgacccgcaga

SEQ ID NO: 52936 - DNA, 201 bp, Bos taurus; identical to SEQ ID NO: 11767

SEQ ID NO: 52937 - DNA, 201 bp, Bos taurus; identical to SEQ ID NO: 11768

SEQ ID NO: 52938 - DNA, 201 bp, Bos taurus; identical to SEQ ID NO: 11769

SEQ ID NO: 52939 - DNA, 201 bp, Bos taurus; identical to SEQ ID NO: 11770

SEQ ID NO: 52940 - DNA, 201 bp, Bos taurus; identical to SEQ ID NO: 11771

SEQ ID NO: 52941 - DNA, 201 bp, Bos taurus; identical to SEQ ID NO: 11772

SEQ ID NO: 52942 - DNA, 201 bp, Bos taurus; identical to SEQ ID NO: 11775

SEQ ID NO: 52943 - DNA, 201 bp, Bos taurus
tcaaatggccttttttgtagactgtacatcctttctttaaaggacattagtcatatctgagtaggacttcaccactgtcatctcatttaacctttgctgacaaggcacaggagggcctagaggagctatcccacattgaagatcaggaagggcggcagtgaggagatacccctcatccaaggtaaggagcaatggctgcgc

SEQ ID NO: 52944 - DNA, 201 bp, Bos taurus
gtctcattcaattgagttgttaatcttccttaattgcaaatttggaccttatggggatcactcattattgcagtggacatttgtcattttcctgagactctagtatatggggaattccatatcttatgagtcttggtaagagataagctggactccctttagagaagtggattgtctcattatcttacagacattctagtt

SEQ ID NO: 52945 - DNA, 201 bp, Bos taurus; identical to SEQ ID NO: 11777

SEQ ID NO: 52946 - DNA, 201 bp, Bos taurus; identical to SEQ ID NO: 11778

SEQ ID NO: 52947 - DNA, 201 bp, Bos taurus
atatcagcaggggttaggtttaagtacacacacaaaaatagcagtttaaataaggttgctttcatgcaaaagaatctcgagggtggccatctggagagatcatgttggttgtacttggttatcaaagacttgtggtcctcccaactcttccttctaccactagggagagtttcaggagctccatgagcagctcagctagta

SEQ ID NO: 52948 - DNA, 201 bp, Bos taurus; identical to SEQ ID NO: 11779

SEQ ID NO: 52949 - DNA, 201 bp, Bos taurus; identical to SEQ ID NO: 11780

SEQ ID NO: 52950 - DNA, 201 bp, Bos taurus
tttcttcagctgtaaaatgggaataatacccatcttactatatgggaatttttgaagcatgtgaaataacacaaccacaaggtaacaagcaccaaacaaacgttcattgttttgcttccacttttccagattgggtttgcatttccccaaaccatgtctctcggagaaggcaatggcaccccactccagtactcttgcctg

SEQ ID NO: 52951 - DNA, 201 bp, Bos taurus; identical to SEQ ID NO: 11781

SEQ ID NO: 52952 - DNA, 201 bp, Bos taurus; identical to SEQ ID NO: 11782

SEQ ID NO: 52953 - DNA, 201 bp, Bos taurus; identical to SEQ ID NO: 11783

SEQ ID NO: 52954 - DNA, 201 bp, Bos taurus; identical to SEQ ID NO: 11784

SEQ ID NO: 52955 - DNA, 201 bp, Bos taurus; identical to SEQ ID NO: 11785

SEQ ID NO: 52956 - DNA, 201 bp, Bos taurus; identical to SEQ ID NO: 11786

SEQ ID NO: 52957 - DNA, 201 bp, Bos taurus; identical to SEQ ID NO: 11787

SEQ ID NO: 52958 - DNA, 201 bp, Bos taurus; identical to SEQ ID NO: 11788

SEQ ID NO: 52959 - DNA, 201 bp, Bos taurus; identical to SEQ ID NO: 11789

SEQ ID NO: 52960 - DNA, 201 bp, Bos taurus; identical to SEQ ID NO: 11790

SEQ ID NO: 52961 - DNA, 201 bp, Bos taurus; identical to SEQ ID NO: 11791

SEQ ID NO: 52962 - DNA, 201 bp, Bos taurus; identical to SEQ ID NO: 11792

SEQ ID NO: 52963 - DNA, 201 bp, Bos taurus; identical to SEQ ID NO: 11793

SEQ ID NO: 52964 - DNA, 201 bp, Bos taurus; identical to SEQ ID NO: 11794

SEQ ID NO: 52965 - DNA, 201 bp, Bos taurus; identical to SEQ ID NO: 11795

SEQ ID NO: 52966 - DNA, 201 bp, Bos taurus; identical to SEQ ID NO: 11796

SEQ ID NO: 52967 - DNA, 201 bp, Bos taurus; identical to SEQ ID NO: 11797

SEQ ID NO: 52968 - DNA, 201 bp, Bos taurus; identical to SEQ ID NO: 11798

SEQ ID NO: 52969 - DNA, 201 bp, Bos taurus; identical to SEQ ID NO: 11799

SEQ ID NO: 52970 - DNA, 201 bp, Bos taurus; identical to SEQ ID NO: 11800

SEQ ID NO: 52971 - DNA, 201 bp, Bos taurus; identical to SEQ ID NO: 11801

SEQ ID NO: 52972 - DNA, 201 bp, Bos taurus; identical to SEQ ID NO: 11802

SEQ ID NO: 52973 - DNA, 201 bp, Bos taurus; identical to SEQ ID NO: 11803

SEQ ID NO: 52974 - DNA, 201 bp, Bos taurus; identical to SEQ ID NO: 11804

SEQ ID NO: 52975 - DNA, 201 bp, Bos taurus; identical to SEQ ID NO: 11805

SEQ ID NO: 52976 - DNA, 201 bp, Bos taurus; identical to SEQ ID NO: 11806

SEQ ID NO: 52977 - DNA, 201 bp, Bos taurus; identical to SEQ ID NO: 11807

SEQ ID NO: 52978 - DNA, 201 bp, Bos taurus; identical to SEQ ID NO: 11808

SEQ ID NO: 52979 - DNA, 201 bp, Bos taurus; identical to SEQ ID NO: 11809

SEQ ID NO: 52980 - DNA, 201 bp, Bos taurus; identical to SEQ ID NO: 11810

SEQ ID NO: 52981 - DNA, 201 bp, Bos taurus; identical to SEQ ID NO: 11811

SEQ ID NO: 52982 - DNA, 201 bp, Bos taurus; identical to SEQ ID NO: 11812

SEQ ID NO: 52983 - DNA, 201 bp, Bos taurus; identical to SEQ ID NO: 11813

SEQ ID NO: 52984 - DNA, 201 bp, Bos taurus; identical to SEQ ID NO: 11814

SEQ ID NO: 52985 - DNA, 201 bp, Bos taurus; identical to SEQ ID NO: 11815

SEQ ID NO: 52986 - DNA, 201 bp, Bos taurus; identical to SEQ ID NO: 11817

SEQ ID NO: 52987 - DNA, 201 bp, Bos taurus; identical to SEQ ID NO: 11818

SEQ ID NO: 52988 - DNA, 201 bp, Bos taurus; identical to SEQ ID NO: 11819

SEQ ID NO: 52989 - DNA, 201 bp, Bos taurus; identical to SEQ ID NO: 11820

SEQ ID NO: 52990 - DNA, 201 bp, Bos taurus; identical to SEQ ID NO: 11821

SEQ ID NO: 52991 - DNA, 201 bp, Bos taurus; identical to SEQ ID NO: 11822

SEQ ID NO: 52992 - DNA, 201 bp, Bos taurus; identical to SEQ ID NO: 11823

SEQ ID NO: 52993 - DNA, 201 bp, Bos taurus; identical to SEQ ID NO: 11824

SEQ ID NO: 52994 - DNA, 201 bp, Bos taurus; identical to SEQ ID NO: 11825

SEQ ID NO: 52995 - DNA, 201 bp, Bos taurus; identical to SEQ ID NO: 11826

SEQ ID NO: 52996 - DNA, 201 bp, Bos taurus; identical to SEQ ID NO: 11827

SEQ ID NO: 52997 - DNA, 201 bp, Bos taurus; identical to SEQ ID NO: 11828

SEQ ID NO: 52998 - DNA, 201 bp, Bos taurus; identical to SEQ ID NO: 11829

SEQ ID NO: 52999 - DNA, 201 bp, Bos taurus; identical to SEQ ID NO: 11830

SEQ ID NO: 53000 - DNA, 201 bp, Bos taurus; identical to SEQ ID NO: 11831

SEQ ID NO: 53001 - DNA, 201 bp, Bos taurus; identical to SEQ ID NO: 11832

SEQ ID NO: 53002 - DNA, 201 bp, Bos taurus; identical to SEQ ID NO: 11833

SEQ ID NO: 53003 - DNA, 201 bp, Bos taurus; identical to SEQ ID NO: 11834

SEQ ID NO: 53004 - DNA, 201 bp, Bos taurus; identical to SEQ ID NO: 11835

SEQ ID NO: 53005 - DNA, 201 bp, Bos taurus; identical to SEQ ID NO: 11836

SEQ ID NO: 53006 - DNA, 201 bp, Bos taurus; identical to SEQ ID NO: 11837

SEQ ID NO: 53007 - DNA, 201 bp, Bos taurus; identical to SEQ ID NO: 11838

SEQ ID NO: 53008 - DNA, 201 bp, Bos taurus; identical to SEQ ID NO: 11839

SEQ ID NO: 53009 - DNA, 201 bp, Bos taurus; identical to SEQ ID NO: 11840

SEQ ID NO: 53010 - DNA, 201 bp, Bos taurus; identical to SEQ ID NO: 11841

SEQ ID NO: 53011 - DNA, 201 bp, Bos taurus; identical to SEQ ID NO: 11842

SEQ ID NO: 53012 - DNA, 201 bp, Bos taurus; identical to SEQ ID NO: 11843

SEQ ID NO: 53013 - DNA, 201 bp, Bos taurus; identical to SEQ ID NO: 11844

SEQ ID NO: 53014 - DNA, 201 bp, Bos taurus; identical to SEQ ID NO: 11845

SEQ ID NO: 53015 - DNA, 201 bp, Bos taurus; identical to SEQ ID NO: 11846

SEQ ID NO: 53016 - DNA, 201 bp, Bos taurus; identical to SEQ ID NO: 11847

SEQ ID NO: 53017 - DNA, 201 bp, Bos taurus; identical to SEQ ID NO: 11848

SEQ ID NO: 53018 - DNA, 201 bp, Bos taurus; identical to SEQ ID NO: 11850

SEQ ID NO: 53019 - DNA, 201 bp, Bos taurus; identical to SEQ ID NO: 11851

SEQ ID NO: 53020 - DNA, 201 bp, Bos taurus; identical to SEQ ID NO: 11852

SEQ ID NO: 53021 - DNA, 201 bp, Bos taurus; identical to SEQ ID NO: 11853

SEQ ID NO: 53022 - DNA, 201 bp, Bos taurus; identical to SEQ ID NO: 11855

SEQ ID NO: 53023 - DNA, 201 bp, Bos taurus; identical to SEQ ID NO: 11856

SEQ ID NO: 53024 - DNA, 201 bp, Bos taurus; identical to SEQ ID NO: 11857

SEQ ID NO: 53025 - DNA, 201 bp, Bos taurus; identical to SEQ ID NO: 11858

SEQ ID NO: 53026 - DNA, 201 bp, Bos taurus; identical to SEQ ID NO: 11859

SEQ ID NO: 53027 - DNA, 201 bp, Bos taurus; identical to SEQ ID NO: 11860

SEQ ID NO: 53028 - DNA, 201 bp, Bos taurus; identical to SEQ ID NO: 11861

SEQ ID NO: 53029 - DNA, 201 bp, Bos taurus; identical to SEQ ID NO: 11862

SEQ ID NO: 53030 - DNA, 201 bp, Bos taurus; identical to SEQ ID NO: 11863

SEQ ID NO: 53031 - DNA, 201 bp, Bos taurus; identical to SEQ ID NO: 11864

SEQ ID NO: 53032 - DNA, 201 bp, Bos taurus; identical to SEQ ID NO: 11865

SEQ ID NO: 53033 - DNA, 201 bp, Bos taurus; identical to SEQ ID NO: 11866

SEQ ID NO: 53034 - DNA, 201 bp, Bos taurus; identical to SEQ ID NO: 11867

SEQ ID NO: 53035 - DNA, 201 bp, Bos taurus; identical to SEQ ID NO: 11868

SEQ ID NO: 53036 - DNA, 201 bp, Bos taurus; identical to SEQ ID NO: 11869

SEQ ID NO: 53037 - DNA, 201 bp, Bos taurus; identical to SEQ ID NO: 11870

SEQ ID NO: 53038 - DNA, 201 bp, Bos taurus; identical to SEQ ID NO: 11871

SEQ ID NO: 53039 - DNA, 201 bp, Bos taurus; identical to SEQ ID NO: 11872

SEQ ID NO: 53040 - DNA, 201 bp, Bos taurus; identical to SEQ ID NO: 11873

SEQ ID NO: 53041 - DNA, 201 bp, Bos taurus; identical to SEQ ID NO: 11874

SEQ ID NO: 53042 - DNA, 201 bp, Bos taurus; identical to SEQ ID NO: 11875

SEQ ID NO: 53043 - DNA, 201 bp, Bos taurus
caggaatgaccttatctttggtggatcagtgctctgcatgtcctgtctactggatcttgtcattcagataaatgagcttccttttgttgcggaagggggaccacttccagggcccgaaactgggctcttgtctaacacttggaaatgaattgtccaaggagacacatttgctgacaaagcaaaagattttattgggaaagg

SEQ ID NO: 53044 - DNA, 201 bp, Bos taurus; identical to SEQ ID NO: 11876

SEQ ID NO: 53045 - DNA, 201 bp, Bos taurus; identical to SEQ ID NO: 11877

SEQ ID NO: 53046 - DNA, 201 bp, Bos taurus; identical to SEQ ID NO: 11878

SEQ ID NO: 53047 - DNA, 201 bp, Bos taurus; identical to SEQ ID NO: 11879

SEQ ID NO: 53048 - DNA, 201 bp, Bos taurus; identical to SEQ ID NO: 11880

SEQ ID NO: 53049 - DNA, 201 bp, Bos taurus; identical to SEQ ID NO: 11881

SEQ ID NO: 53050 - DNA, 201 bp, Bos taurus; identical to SEQ ID NO: 11882

SEQ ID NO: 53051 - DNA, 201 bp, Bos taurus; identical to SEQ ID NO: 11883

SEQ ID NO: 53052 - DNA, 201 bp, Bos taurus; identical to SEQ ID NO: 11884

SEQ ID NO: 53053 - DNA, 201 bp, Bos taurus; identical to SEQ ID NO: 11886

SEQ ID NO: 53054 - DNA, 201 bp, Bos taurus; identical to SEQ ID NO: 11887

SEQ ID NO: 53055 - DNA, 201 bp, Bos taurus; identical to SEQ ID NO: 11888

SEQ ID NO: 53056 - DNA, 201 bp, Bos taurus; identical to SEQ ID NO: 11889

SEQ ID NO: 53057 - DNA, 201 bp, Bos taurus; identical to SEQ ID NO: 11890

SEQ ID NO: 53058 - DNA, 201 bp, Bos taurus; identical to SEQ ID NO: 11891

SEQ ID NO: 53059 - DNA, 201 bp, Bos taurus; identical to SEQ ID NO: 11892

SEQ ID NO: 53060 - DNA, 201 bp, Bos taurus; identical to SEQ ID NO: 11893

SEQ ID NO: 53061 - DNA, 201 bp, Bos taurus; identical to SEQ ID NO: 11894

SEQ ID NO: 53062 - DNA, 201 bp, Bos taurus; identical to SEQ ID NO: 11895

SEQ ID NO: 53063 - DNA, 201 bp, Bos taurus; identical to SEQ ID NO: 11896

SEQ ID NO: 53064 - DNA, 201 bp, Bos taurus; identical to SEQ ID NO: 11897

SEQ ID NO: 53065 - DNA, 201 bp, Bos taurus; identical to SEQ ID NO: 11898

SEQ ID NO: 53066 - DNA, 201 bp, Bos taurus; identical to SEQ ID NO: 11899

SEQ ID NO: 53067 - DNA, 201 bp, Bos taurus; identical to SEQ ID NO: 11902

SEQ ID NO: 53068 - DNA, 201 bp, Bos taurus; identical to SEQ ID NO: 11903

SEQ ID NO: 53069 - DNA, 201 bp, Bos taurus; identical to SEQ ID NO: 11907

SEQ ID NO: 53070 - DNA, 201 bp, Bos taurus; identical to SEQ ID NO: 11908

SEQ ID NO: 53071 - DNA, 201 bp, Bos taurus; identical to SEQ ID NO: 11911

SEQ ID NO: 53072 - DNA, 201 bp, Bos taurus; identical to SEQ ID NO: 11913

SEQ ID NO: 53073 - DNA, 201 bp, Bos taurus; identical to SEQ ID NO: 11914

SEQ ID NO: 53074 - DNA, 201 bp, Bos taurus; identical to SEQ ID NO: 11916

SEQ ID NO: 53075 - DNA, 201 bp, Bos taurus; identical to SEQ ID NO: 11917

SEQ ID NO: 53076 - DNA, 201 bp, Bos taurus; identical to SEQ ID NO: 11920

SEQ ID NO: 53077 - DNA, 201 bp, Bos taurus; identical to SEQ ID NO: 11921

SEQ ID NO: 53078 - DNA, 201 bp, Bos taurus; identical to SEQ ID NO: 11924

SEQ ID NO: 53079 - DNA, 201 bp, Bos taurus; identical to SEQ ID NO: 11925

SEQ ID NO: 53080 - DNA, 201 bp, Bos taurus; identical to SEQ ID NO: 11926

SEQ ID NO: 53081 - DNA, 201 bp, Bos taurus; identical to SEQ ID NO: 11927

SEQ ID NO: 53082 - DNA, 201 bp, Bos taurus; identical to SEQ ID NO: 11928

SEQ ID NO: 53083 - DNA, 201 bp, Bos taurus; identical to SEQ ID NO: 11929

SEQ ID NO: 53084 - DNA, 201 bp, Bos taurus; identical to SEQ ID NO: 11930

SEQ ID NO: 53085 - DNA, 201 bp, Bos taurus; identical to SEQ ID NO: 11931

SEQ ID NO: 53086 - DNA, 201 bp, Bos taurus; identical to SEQ ID NO: 11933

SEQ ID NO: 53087 - DNA, 201 bp, Bos taurus; identical to SEQ ID NO: 11934

SEQ ID NO: 53088 - DNA, 201 bp, Bos taurus; identical to SEQ ID NO: 11935

SEQ ID NO: 53089 - DNA, 201 bp, Bos taurus; identical to SEQ ID NO: 11937

SEQ ID NO: 53090 - DNA, 201 bp, Bos taurus; identical to SEQ ID NO: 11939

SEQ ID NO: 53091 - DNA, 201 bp, Bos taurus; identical to SEQ ID NO: 11940

SEQ ID NO: 53092 - DNA, 201 bp, Bos taurus; identical to SEQ ID NO: 11941

SEQ ID NO: 53093 - DNA, 201 bp, Bos taurus; identical to SEQ ID NO: 11943

SEQ ID NO: 53094 - DNA, 201 bp, Bos taurus; identical to SEQ ID NO: 11944

SEQ ID NO: 53095 - DNA, 201 bp, Bos taurus; identical to SEQ ID NO: 11945

SEQ ID NO: 53096 - DNA, 201 bp, Bos taurus; identical to SEQ ID NO: 11946

SEQ ID NO: 53097 - DNA, 201 bp, Bos taurus; identical to SEQ ID NO: 11948

SEQ ID NO: 53098 - DNA, 201 bp, Bos taurus; identical to SEQ ID NO: 11949

SEQ ID NO: 53099 - DNA, 201 bp, Bos taurus; identical to SEQ ID NO: 11950

SEQ ID NO: 53100 - DNA, 201 bp, Bos taurus; identical to SEQ ID NO: 11951

SEQ ID NO: 53101 - DNA, 201 bp, Bos taurus; identical to SEQ ID NO: 11952

SEQ ID NO: 53102 - DNA, 201 bp, Bos taurus; identical to SEQ ID NO: 11954

SEQ ID NO: 53103 - DNA, 201 bp, Bos taurus; identical to SEQ ID NO: 11955

SEQ ID NO: 53104 - DNA, 201 bp, Bos taurus; identical to SEQ ID NO: 11956

SEQ ID NO: 53105 - DNA, 201 bp, Bos taurus; identical to SEQ ID NO: 11957

SEQ ID NO: 53106 - DNA, 201 bp, Bos taurus; identical to SEQ ID NO: 11958

SEQ ID NO: 53107 - DNA, 201 bp, Bos taurus
attatcactgacattataatgttttatttgcatccttatttatttacttagttacttataatctgtctaactgacaaaatattaaatgccctgaaagcaggaaatttctctaagttatctgtcaccatatttaatcccctggaactatagtggtaaacggttcattctcagtaagtgttaatcaataaataaattatatga

SEQ ID NO: 53108 - DNA, 201 bp, Bos taurus; identical to SEQ ID NO: 11959

SEQ ID NO: 53109 - DNA, 201 bp, Bos taurus; identical to SEQ ID NO: 11960

SEQ ID NO: 53110 - DNA, 201 bp, Bos taurus; identical to SEQ ID NO: 11967

SEQ ID NO: 53111 - DNA, 201 bp, Bos taurus; identical to SEQ ID NO: 11968

SEQ ID NO: 53112 - DNA, 201 bp, Bos taurus; identical to SEQ ID NO: 11971

SEQ ID NO: 53113 - DNA, 201 bp, Bos taurus; identical to SEQ ID NO: 11972

SEQ ID NO: 53114 - DNA, 201 bp, Bos taurus; identical to SEQ ID NO: 11975

SEQ ID NO: 53115 - DNA, 201 bp, Bos taurus; identical to SEQ ID NO: 11977

SEQ ID NO: 53116 - DNA, 201 bp, Bos taurus; identical to SEQ ID NO: 11978

SEQ ID NO: 53117 - DNA, 201 bp, Bos taurus; identical to SEQ ID NO: 11979

SEQ ID NO: 53118 - DNA, 201 bp, Bos taurus; identical to SEQ ID NO: 11980

SEQ ID NO: 53119 - DNA, 201 bp, Bos taurus; identical to SEQ ID NO: 11982

SEQ ID NO: 53120 - DNA, 201 bp, Bos taurus; identical to SEQ ID NO: 11986

SEQ ID NO: 53121 - DNA, 201 bp, Bos taurus; identical to SEQ ID NO: 11990

SEQ ID NO: 53122 - DNA, 201 bp, Bos taurus; identical to SEQ ID NO: 11993

SEQ ID NO: 53123 - DNA, 201 bp, Bos taurus; identical to SEQ ID NO: 11994

SEQ ID NO: 53124 - DNA, 201 bp, Bos taurus; identical to SEQ ID NO: 11996

SEQ ID NO: 53125 - DNA, 201 bp, Bos taurus; identical to SEQ ID NO: 11999

SEQ ID NO: 53126 - DNA, 201 bp, Bos taurus; identical to SEQ ID NO: 12000

SEQ ID NO: 53127 - DNA, 201 bp, Bos taurus; identical to SEQ ID NO: 12001

SEQ ID NO: 53128 - DNA, 201 bp, Bos taurus; identical to SEQ ID NO: 12005

SEQ ID NO: 53129 - DNA, 201 bp, Bos taurus; identical to SEQ ID NO: 12006

SEQ ID NO: 53130 - DNA, 201 bp, Bos taurus; identical to SEQ ID NO: 12010

SEQ ID NO: 53131 - DNA, 201 bp, Bos taurus; identical to SEQ ID NO: 12011

SEQ ID NO: 53132 - DNA, 201 bp, Bos taurus; identical to SEQ ID NO: 12012

SEQ ID NO: 53133 - DNA, 201 bp, Bos taurus; identical to SEQ ID NO: 12013

SEQ ID NO: 53134 - DNA, 201 bp, Bos taurus; identical to SEQ ID NO: 12016

SEQ ID NO: 53135 - DNA, 201 bp, Bos taurus; identical to SEQ ID NO: 12020

SEQ ID NO: 53136 - DNA, 201 bp, Bos taurus; identical to SEQ ID NO: 12021

SEQ ID NO: 53137 - DNA, 201 bp, Bos taurus; identical to SEQ ID NO: 12022

SEQ ID NO: 53138 - DNA, 201 bp, Bos taurus; identical to SEQ ID NO: 12023

SEQ ID NO: 53139 - DNA, 201 bp, Bos taurus; identical to SEQ ID NO: 12024

SEQ ID NO: 53140 - DNA, 201 bp, Bos taurus; identical to SEQ ID NO: 12025

SEQ ID NO: 53141 - DNA, 201 bp, Bos taurus; identical to SEQ ID NO: 12026

SEQ ID NO: 53142 - DNA, 201 bp, Bos taurus; identical to SEQ ID NO: 12027

SEQ ID NO: 53143 - DNA, 201 bp, Bos taurus; identical to SEQ ID NO: 12029

SEQ ID NO: 53144 - DNA, 201 bp, Bos taurus; identical to SEQ ID NO: 12030

SEQ ID NO: 53145 - DNA, 201 bp, Bos taurus; identical to SEQ ID NO: 12031

SEQ ID NO: 53146 - DNA, 201 bp, Bos taurus; identical to SEQ ID NO: 12032

SEQ ID NO: 53147 - DNA, 201 bp, Bos taurus; identical to SEQ ID NO: 12033

SEQ ID NO: 53148 - DNA, 201 bp, Bos taurus; identical to SEQ ID NO: 12035

SEQ ID NO: 53149 - DNA, 201 bp, Bos taurus; identical to SEQ ID NO: 12036

SEQ ID NO: 53150 - DNA, 201 bp, Bos taurus; identical to SEQ ID NO: 12037

SEQ ID NO: 53151 - DNA, 201 bp, Bos taurus; identical to SEQ ID NO: 12038

SEQ ID NO: 53152 - DNA, 201 bp, Bos taurus; identical to SEQ ID NO: 12040

SEQ ID NO: 53153 - DNA, 201 bp, Bos taurus; identical to SEQ ID NO: 12042

SEQ ID NO: 53154 - DNA, 201 bp, Bos taurus; identical to SEQ ID NO: 12046

SEQ ID NO: 53155 - DNA, 201 bp, Bos taurus; identical to SEQ ID NO: 12047

SEQ ID NO: 53156 - DNA, 201 bp, Bos taurus; identical to SEQ ID NO: 12048

SEQ ID NO: 53157 - DNA, 201 bp, Bos taurus; identical to SEQ ID NO: 12049

SEQ ID NO: 53158 - DNA, 201 bp, Bos taurus; identical to SEQ ID NO: 12050

SEQ ID NO: 53159 - DNA, 201 bp, Bos taurus; identical to SEQ ID NO: 12051

SEQ ID NO: 53160 - DNA, 201 bp, Bos taurus; identical to SEQ ID NO: 12053

SEQ ID NO: 53161 - DNA, 201 bp, Bos taurus
tttcagtggctgatactagaaggggtgagcccagacccctctagcacatggatccacatacctaacatggcacacatcaagatgtgggcctgtgttttagcagtagatctcaaggcaggctggtgtcttcagcagttgagccctgcctttgaacttgcctgggggccatttaggtcccaggctcttccaggcaatagcctt

SEQ ID NO: 53162 - DNA, 201 bp, Bos taurus; identical to SEQ ID NO: 12054

SEQ ID NO: 53163 - DNA, 201 bp, Bos taurus; identical to SEQ ID NO: 12055

SEQ ID NO: 53164 - DNA, 201 bp, Bos taurus; identical to SEQ ID NO: 12056

SEQ ID NO: 53165 - DNA, 201 bp, Bos taurus; identical to SEQ ID NO: 12057

SEQ ID NO: 53166 - DNA, 201 bp, Bos taurus; identical to SEQ ID NO: 12058

SEQ ID NO: 53167 - DNA, 201 bp, Bos taurus
tgaaatttgaggatgttaaattagcaaggagaaaaggaatcacatgatacagaggatgcggaaaagcaagtggggcgggcaattagaggtggagtgaggcgggcagagaggctggggctgccaggaaaggtaagagttttcatccatgtgtgccccaaatgaggacgaggtcctaaatgcctgatttcaagtcaagttctc

SEQ ID NO: 53168 - DNA, 201 bp, Bos taurus; identical to SEQ ID NO: 12059

SEQ ID NO: 53169 - DNA, 201 bp, Bos taurus; identical to SEQ ID NO: 12060

SEQ ID NO: 53170 - DNA, 201 bp, Bos taurus; identical to SEQ ID NO: 12061

SEQ ID NO: 53171 - DNA, 201 bp, Bos taurus; identical to SEQ ID NO: 12062

SEQ ID NO: 53172 - DNA, 201 bp, Bos taurus; identical to SEQ ID NO: 12064

SEQ ID NO: 53173 - DNA, 201 bp, Bos taurus; identical to SEQ ID NO: 12065

SEQ ID NO: 53174 - DNA, 201 bp, Bos taurus; identical to SEQ ID NO: 12067

SEQ ID NO: 53175 - DNA, 201 bp, Bos taurus; identical to SEQ ID NO: 12068

SEQ ID NO: 53176 - DNA, 201 bp, Bos taurus; identical to SEQ ID NO: 12069

SEQ ID NO: 53177 - DNA, 201 bp, Bos taurus; identical to SEQ ID NO: 12070

SEQ ID NO: 53178 - DNA, 201 bp, Bos taurus; identical to SEQ ID NO: 12073

SEQ ID NO: 53179 - DNA, 201 bp, Bos taurus; identical to SEQ ID NO: 12076

SEQ ID NO: 53180 - DNA, 201 bp, Bos taurus; identical to SEQ ID NO: 12077

SEQ ID NO: 53181 - DNA, 201 bp, Bos taurus; identical to SEQ ID NO: 12078

SEQ ID NO: 53182 - DNA, 201 bp, Bos taurus; identical to SEQ ID NO: 12079

SEQ ID NO: 53183 - DNA, 201 bp, Bos taurus
tggttagtctttcctttcttcggtccatccagccaatatttgcgtcagagaggcacctgaagctggggatccagcagtacccacgacagacaaaccccaccctctgggaacttctgtatggcaagttagagtatgaaagtaaaccagggaataaacaaagtaagctccagttctgacaagggttatggaaacatagaacag

SEQ ID NO: 53184 - DNA, 201 bp, Bos taurus
cttgacttttctgagaatttgctgaattttccactttgcctttattttttgcttttagcagggtcactgagttactgttggcatacaatgaaaggggtgcgtgcatatgtggtcagccttgtctgactctttgtgatctcatggactgtagtctgccagactcctctgtccatgggattctctaggcaagaatactggagt

SEQ ID NO: 53185 - DNA, 201 bp, Bos taurus; identical to SEQ ID NO: 12081

SEQ ID NO: 53186 - DNA, 201 bp, Bos taurus
agtggcaactggaaaggtgaccacagcttagtgagggcgccagcaacagacctagagcctggatccaaagagtctcagataaggaaatggagacatgagacatgacttcacatgtgtgatagctcctataacagaaaagagacgggagtttaggattaggtggtgtggcttttattcccagccccactgcaaaaatattaa

SEQ ID NO: 53187 - DNA, 201 bp, Bos taurus
ctaaggaggtatcccacatcagaggtttgtctccctttgcctggcctgtcttcttaattccccagctatgcttaccctggcattggatgtttcccttattcctcagacttgtttgctttggcctggattttccttaattatccaagtgtctgcactgacctggaatgtcccccttatttcccaggtgtatctactttgacc

SEQ ID NO: 53188 - DNA, 201 bp, Bos taurus; identical to SEQ ID NO: 12082

SEQ ID NO: 53189 - DNA, 201 bp, Bos taurus; identical to SEQ ID NO: 12083

SEQ ID NO: 53190 - DNA, 201 bp, Bos taurus; identical to SEQ ID NO: 12084

SEQ ID NO: 53191 - DNA, 201 bp, Bos taurus; identical to SEQ ID NO: 12085

SEQ ID NO: 53192 - DNA, 201 bp, Bos taurus; identical to SEQ ID NO: 12086

SEQ ID NO: 53193 - DNA, 201 bp, Bos taurus; identical to SEQ ID NO: 12087

SEQ ID NO: 53194 - DNA, 201 bp, Bos taurus
aggcactcgtgtgatttcacgtgtctgtaatgggcaatgagatcacaaaggcatctcaggaacaatccaagcccaggattcttttatgcatcctgtgatttactgctcatatatttaagttgtctggtccacattgactttgaaggtcattttttgggcaacctgctttgattaaatttttccaaagcatgccaagtattt

SEQ ID NO: 53195 - DNA, 201 bp, Bos taurus; identical to SEQ ID NO: 12088

SEQ ID NO: 53196 - DNA, 201 bp, Bos taurus; identical to SEQ ID NO: 12089

SEQ ID NO: 53197 - DNA, 201 bp, Bos taurus; identical to SEQ ID NO: 12090

SEQ ID NO: 53198 - DNA, 201 bp, Bos taurus; identical to SEQ ID NO: 12091

SEQ ID NO: 53199 - DNA, 201 bp, Bos taurus
tggagaggacttataccaaaaagagtcagcctggctgagtttttgccccatttattgttgttacagctgaagtcacagcaggaagcagaagagatacagttagagtggagagaaagttacagagagattattcatagaggtgtgggcagggagaaaggcccaataagtgactaaagcagcaggaagttcttacctccctgg

SEQ ID NO: 53200 - DNA, 201 bp, Bos taurus; identical to SEQ ID NO: 12093

SEQ ID NO: 53201 - DNA, 201 bp, Bos taurus; identical to SEQ ID NO: 12094

SEQ ID NO: 53202 - DNA, 201 bp, Bos taurus
catgctgaaaccgggcccagtgccatcatctgagaaactctagacccaagaattctgctgcaggaacatctgttgcagaagcagactctgtccttttttttcccaacatttattttatattggcctggagttgattaatgaagtgttggtttcaggtatacaacaaagtaattcatttatacatacactatgttatctatt

SEQ ID NO: 53203 - DNA, 201 bp, Bos taurus; identical to SEQ ID NO: 12095

SEQ ID NO: 53204 - DNA, 201 bp, Bos taurus
ttttcactggcttgtggccacaccgctgctcctctccacgtgggctgctgttctgtccatgtccagcctcctctgcctctcccagttaaggactctgggactgcattcagggcccataatccaggatgctctcatccccaaatcctgggcttaattacaccctttttccatagaaggtgacatttacagtttctaaggatc

SEQ ID NO: 53205 - DNA, 201 bp, Bos taurus; identical to SEQ ID NO: 12098

SEQ ID NO: 53206 - DNA, 201 bp, Bos taurus; identical to SEQ ID NO: 12099

SEQ ID NO: 53207 - DNA, 201 bp, Bos taurus
gtcagctcacatcatccttactctgctctccgtactctgccatgcatggaggcaagtcaccccacttattctctgtctggatgccaatttcaaaagggaacagaattggcccctttcttgaggaagactggagaccccttttctacttgggtcaacctgttctgctgctgctgctgctgctaagtcgcttcagtcgtgtcc

SEQ ID NO: 53208 - DNA, 201 bp, Bos taurus; identical to SEQ ID NO: 12100

SEQ ID NO: 53209 - DNA, 201 bp, Bos taurus; identical to SEQ ID NO: 12101

SEQ ID NO: 53210 - DNA, 201 bp, Bos taurus; identical to SEQ ID NO: 12102

SEQ ID NO: 53211 - DNA, 201 bp, Bos taurus
tactggccattgcctattacttcccagagaaattacaataaaggctcttgtccacattttcctcccctttctctgcctcctgagtgacactgctgcttccacaagtggtcctgggtggcctgacatgccccttcctcatgggaatggtaacaaactatgttttttctatctgagacttatggttataacttccttttactt

SEQ ID NO: 53212 - DNA, 201 bp, Bos taurus; identical to SEQ ID NO: 12103

SEQ ID NO: 53213 - DNA, 201 bp, Bos taurus; identical to SEQ ID NO: 12104

SEQ ID NO: 53214 - DNA, 201 bp, Bos taurus
taacagctcacttgattgtgggaatgtgcacctgagcctgcaaaacacagtcttgcattttaaaactcggcaataaatacgagaaatccattcattgagatccatcttcattactgaaatggaaatagattcactgagacattattgactatctcacgagatagcacatacatctgcatcacatttccataacatgactgt

SEQ ID NO: 53215 - DNA, 201 bp, Bos taurus
gaaagaaactctgccgacacaccagtgagtatggaagaagagtcttccccagctgaacctcagatgagaatgctcgcgtttaacgctgggatccccaacttccaggccacaggccagtatcaggccattaggcagttttgttctatgggagcctaggattaattaggaactgggccacacagcaggaggtgagtggcagac

SEQ ID NO: 53216 - DNA, 201 bp, Bos taurus
ttaatataaatgataaagtatgtccaaaaaatcagagcagggcagggggccacaggaggaggtcagatcatgtcaggcctgtgggcccacaggagaactttggtttttgctcaagacagcaagaggcaaaggtggaggctgggagacctgtcaggaggccaagataggaccctggcttgacacggagggagttcaattctg

SEQ ID NO: 53217 - DNA, 201 bp, Bos taurus
ctattgactcaaatccatcccaccatctggaaggggcttctgcaaacagcatggggcccagatggatttgttaggagagttgtgagcagagatcagctgagagggagggaacgacagagtgagaaagagaagcaaagtgacagacagagacagagggtgaggaagagaaacaaagtgggatccacttgccatttgcccatt

SEQ ID NO: 53218 - DNA, 201 bp, Bos taurus
caggggcaagagactaggaccagggaggaggccaagagcccaggccatggggcatctatgacagcacagatccgggcaaagtaggaagagtcagcacagctgtgatgaggggaaggggaggccttagggctctgagttcaagaaagaaagctggtgtcccagcaacgatgcctgcccgtcctccaaaccctgcaagagaac

SEQ ID NO: 53219 - DNA, 201 bp, Bos taurus; identical to SEQ ID NO: 12108

SEQ ID NO: 53220 - DNA, 201 bp, Bos taurus
tgcattgcagggcagattcttaaaccactggaccaccagggaagtccatttgtctccttatatttcttcttctcctcctccttctcatgtctcacccctcactgcccctgcacccatcccctggggggtatgtctttaaataggacatgtatgtccttgtgccacaggtggtgctgggggtctgcttggaacagtggtccg

SEQ ID NO: 53221 - DNA, 201 bp, Bos taurus
gagagagcaatcactgttcagcgtacagcgaaaagtgggatgcacatccatgctgactgctccgcacccaacacgggccagaaacccacggcagaaagacgagctcatggggatttccctggtccagtggctgagaatctgccttccaatgcaaggggcctgggttcgagccctggtctaggaacatcccacaagcctcgg

SEQ ID NO: 53222 - DNA, 201 bp, Bos taurus; identical to SEQ ID NO: 12112

SEQ ID NO: 53223 - DNA, 201 bp, Bos taurus; identical to SEQ ID NO: 12113

SEQ ID NO: 53224 - DNA, 201 bp, Bos taurus; identical to SEQ ID NO: 12114

SEQ ID NO: 53225 - DNA, 201 bp, Bos taurus; identical to SEQ ID NO: 12115

SEQ ID NO: 53226 - DNA, 201 bp, Bos taurus; identical to SEQ ID NO: 12116

SEQ ID NO: 53227 - DNA, 201 bp, Bos taurus; identical to SEQ ID NO: 12117

SEQ ID NO: 53228 - DNA, 201 bp, Bos taurus; identical to SEQ ID NO: 12118

SEQ ID NO: 53229 - DNA, 201 bp, Bos taurus
gggctacagtccataaggtcacaaagaatcagacataattgaagtgactgagtacacacataccctaagttacccatccagctttgcgcttgattccagagcttccaatgtggtaaccatcaggcatgtgtggctattgaggccttgaagtgtggctagttcaaactgagatgtggtgtattgtgctgtatgagtttaaag

SEQ ID NO: 53230 - DNA, 201 bp, Bos taurus; identical to SEQ ID NO: 12119

SEQ ID NO: 53231 - DNA, 201 bp, Bos taurus; identical to SEQ ID NO: 12120

SEQ ID NO: 53232 - DNA, 201 bp, Bos taurus; identical to SEQ ID NO: 12121

SEQ ID NO: 53233 - DNA, 201 bp, Bos taurus; identical to SEQ ID NO: 12122

SEQ ID NO: 53234 - DNA, 201 bp, Bos taurus; identical to SEQ ID NO: 12123

SEQ ID NO: 53235 - DNA, 201 bp, Bos taurus; identical to SEQ ID NO: 12125

SEQ ID NO: 53236 - DNA, 201 bp, Bos taurus
cttaaaggccacacagccagtgaatagagagctagaaattgaaccttagtttatattattttaagcaatgcgcagactatattggcaatgaaaccttaaggaagtggctggcagaaaggccagaccagtacttgatgttcagacttgctgttgagaatatactttcctgtttgtatgcaggatttttgctcagtcctggga

SEQ ID NO: 53237 - DNA, 201 bp, Bos taurus; identical to SEQ ID NO: 12128

SEQ ID NO: 53238 - DNA, 201 bp, Bos taurus; identical to SEQ ID NO: 12130

SEQ ID NO: 53239 - DNA, 201 bp, Bos taurus; identical to SEQ ID NO: 12131

SEQ ID NO: 53240 - DNA, 201 bp, Bos taurus; identical to SEQ ID NO: 12132

SEQ ID NO: 53241 - DNA, 201 bp, Bos taurus
aagcactggacagctctggttggatggaagtggcggaaagggtgaaatcccatgagtagaaatggactgggtacagagtctacaaggtttgtggagctgaggacctcttccggcatcagggaagggactaagagatcagctatttctaggtaacagatggaataaaaaggagcctttgaaatttagggtggaagagctgtg

SEQ ID NO: 53242 - DNA, 201 bp, Bos taurus; identical to SEQ ID NO: 12134

SEQ ID NO: 53243 - DNA, 201 bp, Bos taurus; identical to SEQ ID NO: 12135

SEQ ID NO: 53244 - DNA, 201 bp, Bos taurus; identical to SEQ ID NO: 12137

SEQ ID NO: 53245 - DNA, 201 bp, Bos taurus; identical to SEQ ID NO: 12138

SEQ ID NO: 53246 - DNA, 201 bp, Bos taurus; identical to SEQ ID NO: 12140

SEQ ID NO: 53247 - DNA, 201 bp, Bos taurus; identical to SEQ ID NO: 12142

SEQ ID NO: 53248 - DNA, 201 bp, Bos taurus; identical to SEQ ID NO: 12143

SEQ ID NO: 53249 - DNA, 201 bp, Bos taurus; identical to SEQ ID NO: 12144

SEQ ID NO: 53250 - DNA, 201 bp, Bos taurus; identical to SEQ ID NO: 12145

SEQ ID NO: 53251 - DNA, 201 bp, Bos taurus; identical to SEQ ID NO: 12146

SEQ ID NO: 53252 - DNA, 201 bp, Bos taurus; identical to SEQ ID NO: 12147

SEQ ID NO: 53253 - DNA, 201 bp, Bos taurus; identical to SEQ ID NO: 12148

SEQ ID NO: 53254 - DNA, 201 bp, Bos taurus; identical to SEQ ID NO: 12151

SEQ ID NO: 53255 - DNA, 201 bp, Bos taurus; identical to SEQ ID NO: 12152

SEQ ID NO: 53256 - DNA, 201 bp, Bos taurus; identical to SEQ ID NO: 12153

SEQ ID NO: 53257 - DNA, 201 bp, Bos taurus; identical to SEQ ID NO: 12154

SEQ ID NO: 53258 - DNA, 201 bp, Bos taurus; identical to SEQ ID NO: 12155

SEQ ID NO: 53259 - DNA, 201 bp, Bos taurus; identical to SEQ ID NO: 12158

SEQ ID NO: 53260 - DNA, 201 bp, Bos taurus; identical to SEQ ID NO: 12159

SEQ ID NO: 53261 - DNA, 201 bp, Bos taurus; identical to SEQ ID NO: 12160

SEQ ID NO: 53262 - DNA, 201 bp, Bos taurus; identical to SEQ ID NO: 12161

SEQ ID NO: 53263 - DNA, 201 bp, Bos taurus; identical to SEQ ID NO: 12162

SEQ ID NO: 53264 - DNA, 201 bp, Bos taurus; identical to SEQ ID NO: 12163

SEQ ID NO: 53265 - DNA, 201 bp, Bos taurus; identical to SEQ ID NO: 12164

SEQ ID NO: 53266 - DNA, 201 bp, Bos taurus; identical to SEQ ID NO: 12168

SEQ ID NO: 53267 - DNA, 201 bp, Bos taurus; identical to SEQ ID NO: 12169

SEQ ID NO: 53268 - DNA, 201 bp, Bos taurus; identical to SEQ ID NO: 12170

SEQ ID NO: 53269 - DNA, 201 bp, Bos taurus; identical to SEQ ID NO: 12171

SEQ ID NO: 53270 - DNA, 201 bp, Bos taurus; identical to SEQ ID NO: 12173

SEQ ID NO: 53271 - DNA, 201 bp, Bos taurus; identical to SEQ ID NO: 12174

SEQ ID NO: 53272 - DNA, 201 bp, Bos taurus; identical to SEQ ID NO: 12177

SEQ ID NO: 53273 - DNA, 201 bp, Bos taurus; identical to SEQ ID NO: 12178

SEQ ID NO: 53274 - DNA, 201 bp, Bos taurus; identical to SEQ ID NO: 12179

SEQ ID NO: 53275 - DNA, 201 bp, Bos taurus
gctctggggtctcttggttttcaggcgtcctaatagattccagctcccctctctccacctcccctccaccccccagctgttgcagaaaaccacagtcaacctcttcttgctctcagctgccaagttttctctaagtaaacacagaatgtagcagtagatcagctcagttgcattcccagcactgtaggttgggtcaaggct

SEQ ID NO: 53276 - DNA, 201 bp, Bos taurus; identical to SEQ ID NO: 12182

SEQ ID NO: 53277 - DNA, 201 bp, Bos taurus
cagtcactgaagggttcttagcaggtgagggtcacactgggactcgtgtttgggagggaacactgccccttgctcaccttcgtagtgtcatctagcatcacgccttccggccttccctgggctctggtccctctgatcttctctcattttcagtgatgaaaatgcttccatccttccaggcttctacagaagccattcctt

SEQ ID NO: 53278 - DNA, 201 bp, Bos taurus
gtggtctgcatctagctctctgactgtctcccactttacctccttgggcttaccatgctgcagtcgtatctgctctcctcctttttcttaaagagctgtatctgttcctacctcagggcctttgcctctgcggttccctctgcctgggactccctttctcaagttcctttcatggctgattcctttcattgcttaaggctt

SEQ ID NO: 53279 - DNA, 201 bp, Bos taurus; identical to SEQ ID NO: 12187

SEQ ID NO: 53280 - DNA, 201 bp, Bos taurus
cagcaatggtggggaaatcatctctggggctggaacaaggctgtatcctctttgtgctcatttctccccgccccatctcccctgtgcacgtggccttgccacccctttacaaagatggtgcagtggttaacagtgtgagcttgagtcagtacttgttgaaactgagttccaggcctgccagtaacttgctgggggatggtg

SEQ ID NO: 53281 - DNA, 201 bp, Bos taurus; identical to SEQ ID NO: 12188

SEQ ID NO: 53282 - DNA, 201 bp, Bos taurus
ttagatatttttctttaaatagatcattttgaaaagatttatttctagctgttttctttggctcattactaatatgtattgttagtgtcctgataacccacttcagccttctttctgaggtaaaggcattaaagtatttttttaaaatgaccttctggaagcttaatttgcctcattctcaatgtgtgctcagtcgctgag

SEQ ID NO: 53283 - DNA, 201 bp, Bos taurus; identical to SEQ ID NO: 12189

SEQ ID NO: 53284 - DNA, 201 bp, Bos taurus; identical to SEQ ID NO: 12190

SEQ ID NO: 53285 - DNA, 201 bp, Bos taurus; identical to SEQ ID NO: 12191

SEQ ID NO: 53286 - DNA, 201 bp, Bos taurus
ttacactattatttaacctggattctgtccagactcagcccttccagacagcggcagcgtccagtgcagtgggcgatgggaggctggcctcagaatcaacaccctgtgatttctggaattcggaggcagtctccactgtccttgcactcccttggtcggcagatcttgggtgccaggcagccttattacaacctggcacag

SEQ ID NO: 53287 - DNA, 201 bp, Bos taurus; identical to SEQ ID NO: 12192

SEQ ID NO: 53288 - DNA, 201 bp, Bos taurus
ggatacactcatgaggactctgggtgtaagtgacagaaaatcaactccaattgacattcatcaaagtagggaagtagagagataataattctcctgttgaactacagaaaaaggcaggcaggaaataggctctagggatgcccagaatcaaggactcagaccctgcagtcctctgtctccactctttttcaaagccagctc

SEQ ID NO: 53289 - DNA, 201 bp, Bos taurus
tgtactagatttaattttatagagcacacaagaggagtccagcaagcttacctgtgactctcagaaaacgaactttttttttccaccaccatctttgattaaaaaaaaagagcaatgtctagaatcatgcccttgggttgagagaccatatgggtagagaaacaacaactggaacagaagttaggagccatgcattctagg

SEQ ID NO: 53290 - DNA, 201 bp, Bos taurus
ctgactctgtgactacaaagatggtgcccttattgcatcaagcaccgaggctccaaggccaaccgggcatgagggctgggccgctcccccctccccaaccctgaccttacgggacgccctctgcagaggtaaacggcgggtgggagctggcaaagcaggcccagggcacagggttaggccctgataacccgagatcaaagc

SEQ ID NO: 53291 - DNA, 201 bp, Bos taurus
tgccttccgagtgcctggcaccgtgccaacctcgctcctgtgctacctcacccatcctccccatcatgctctgaggccagtaattactatcacggcattaccctcagagcctctgtgctctcagattcccatgatgtcacatcacagagcaggtctcagctgtcacttccagtcccctagcagaggccacagatacacggg

SEQ ID NO: 53292 - DNA, 201 bp, Bos taurus
ttttgacaagagaccctgtgacttgtagagtcaaaaattttctttctgtggcctcttgcagaaaaagtttgctggcctcatgtctaaagaaaaggttggcgactaccccctgatttttcaaaatggaaaacagcgctacaaatccggagaaagtctggaggcctttgaagtgaagtgaaatgaaagtcgctcagttgtgtc

SEQ ID NO: 53293 - DNA, 201 bp, Bos taurus; identical to SEQ ID NO: 12193

SEQ ID NO: 53294 - DNA, 201 bp, Bos taurus; identical to SEQ ID NO: 12194

SEQ ID NO: 53295 - DNA, 201 bp, Bos taurus; identical to SEQ ID NO: 12195

SEQ ID NO: 53296 - DNA, 201 bp, Bos taurus; identical to SEQ ID NO: 12196

SEQ ID NO: 53297 - DNA, 201 bp, Bos taurus; identical to SEQ ID NO: 12198

SEQ ID NO: 53298 - DNA, 201 bp, Bos taurus; identical to SEQ ID NO: 12199

SEQ ID NO: 53299 - DNA, 201 bp, Bos taurus; identical to SEQ ID NO: 12200

SEQ ID NO: 53300 - DNA, 201 bp, Bos taurus; identical to SEQ ID NO: 12201

SEQ ID NO: 53301 - DNA, 201 bp, Bos taurus; identical to SEQ ID NO: 12202

SEQ ID NO: 53302 - DNA, 201 bp, Bos taurus; identical to SEQ ID NO: 12203

SEQ ID NO: 53303 - DNA, 201 bp, Bos taurus; identical to SEQ ID NO: 12204

SEQ ID NO: 53304 - DNA, 201 bp, Bos taurus; identical to SEQ ID NO: 12205

SEQ ID NO: 53305 - DNA, 201 bp, Bos taurus; identical to SEQ ID NO: 12206

SEQ ID NO: 53306 - DNA, 201 bp, Bos taurus; identical to SEQ ID NO: 12207

SEQ ID NO: 53307 - DNA, 201 bp, Bos taurus; identical to SEQ ID NO: 12208

SEQ ID NO: 53308 - DNA, 201 bp, Bos taurus; identical to SEQ ID NO: 12209

SEQ ID NO: 53309 - DNA, 201 bp, Bos taurus
gttagccggcctggcgtcttaacccacaggccccactttcggtgcccggaatcacaaccaatgaaccactgccaagaatggacccccacacctaatccatcagtaagaggtggccgagctactgcagaagccaccccgaatctgaccaccttctttgcaccccctagtcccccaggctgtgtcactgctccccatcactgg

SEQ ID NO: 53310 - DNA, 201 bp, Bos taurus; identical to SEQ ID NO: 12210

SEQ ID NO: 53311 - DNA, 201 bp, Bos taurus; identical to SEQ ID NO: 12211

SEQ ID NO: 53312 - DNA, 201 bp, Bos taurus; identical to SEQ ID NO: 12216

SEQ ID NO: 53313 - DNA, 201 bp, Bos taurus; identical to SEQ ID NO: 12217

SEQ ID NO: 53314 - DNA, 201 bp, Bos taurus; identical to SEQ ID NO: 12218

SEQ ID NO: 53315 - DNA, 201 bp, Bos taurus; identical to SEQ ID NO: 12220

SEQ ID NO: 53316 - DNA, 201 bp, Bos taurus; identical to SEQ ID NO: 12224

SEQ ID NO: 53317 - DNA, 201 bp, Bos taurus; identical to SEQ ID NO: 12225

SEQ ID NO: 53318 - DNA, 201 bp, Bos taurus; identical to SEQ ID NO: 12226

SEQ ID NO: 53319 - DNA, 201 bp, Bos taurus
gggacagctgccttctgctgcacccgtgtgagatgcagtcccgcgcaggcgcagtccctcggcgggagcgcagacaggaggcgggaggcaggtgggcctatttctcggtaagtgacaactggaggacttgctgcagctccgcctcctcctcgcgcagccgcagctcgcgctcctccagctctttggcggagagctccatgg

SEQ ID NO: 53320 - DNA, 201 bp, Bos taurus; identical to SEQ ID NO: 12227

SEQ ID NO: 53321 - DNA, 201 bp, Bos taurus; identical to SEQ ID NO: 12228

SEQ ID NO: 53322 - DNA, 201 bp, Bos taurus; identical to SEQ ID NO: 12229

SEQ ID NO: 53323 - DNA, 201 bp, Bos taurus
gtatccgggggagtgatgttgacaataataataacaacaccataacagcactggcctgtcaccgaggttgacaaagtgcgggctctgggcctggcagcctctggggaatttcagctctacagtcagcggtgctgcctttgtgagccggttcagggaaaggcggggaggcctcgagctcactctaatacccctcttcctcac

SEQ ID NO: 53324 - DNA, 201 bp, Bos taurus
cgggcagttatgaacatgggatctgaaagcaggcgagcctgggtttgaattctggctaggacacttcttgattgcgtgtcttggaatgaggtctttcagccgagcttcagtttgtgtgctgagtgctgagtcgtatctgactccttgcgaccccgtggattgcagccctccaggctcctctctccatgggattccccaggc

SEQ ID NO: 53325 - DNA, 201 bp, Bos taurus; identical to SEQ ID NO: 12230

SEQ ID NO: 53326 - DNA, 201 bp, Bos taurus
tgccgtctctcccctgcacaggtgcgctggccagggtccaggtgttcgggaagtggcacagtgtcccaaggaagcaggcgacctacggcgacactgggctgacctacacgttttcaggcctcactctgtctccgaagccctggatccccgttctggagcgtgtacgggatcgtgtttctctggtgactggacagaccttca

SEQ ID NO: 53327 - DNA, 201 bp, Bos taurus; identical to SEQ ID NO: 12233

SEQ ID NO: 53328 - DNA, 201 bp, Bos taurus; identical to SEQ ID NO: 12234

SEQ ID NO: 53329 - DNA, 201 bp, Bos taurus; identical to SEQ ID NO: 12235

SEQ ID NO: 53330 - DNA, 201 bp, Bos taurus; identical to SEQ ID NO: 12236

SEQ ID NO: 53331 - DNA, 201 bp, Bos taurus
caacatcagggctattgggccttctgctgtctctgcctcggatgccttcccccaccttgtgctacaagtggtttttcatccttcagccaccagttcaatcgtcacctcctcagagaggccctggtggctcagctggcaacgaacccgcctacaacgtgggagacctgggttcgatccctgtgttgggaagatcccctggag

SEQ ID NO: 53332 - DNA, 201 bp, Bos taurus
ttagaaggcagctgggtgggtgtcttgggccaaggaagcccagcacgactaagtactacagtcaccagccagaaaaaagagaaggggcagcacgtgagcacgcagcctgaggccgtccgtgggtgctagatgtccctgaggccttggcctggcacatagtaggtgcttgtggatgatttcctgtgaataaactgcaggagt

SEQ ID NO: 53333 - DNA, 201 bp, Bos taurus; identical to SEQ ID NO: 12237

SEQ ID NO: 53334 - DNA, 201 bp, Bos taurus; identical to SEQ ID NO: 12238

SEQ ID NO: 53335 - DNA, 201 bp, Bos taurus; identical to SEQ ID NO: 12239

SEQ ID NO: 53336 - DNA, 201 bp, Bos taurus; identical to SEQ ID NO: 12240

SEQ ID NO: 53337 - DNA, 201 bp, Bos taurus
tgagcaactgaactgaactgcagcacccagtggagggttgatgagaggctgagggtgaggcactgccaggccccatctgaagggtaccaggagctagctaagcaatgggtaggctgtgtagcagcaggtcagagcctcaggcatcaggtgtaccaagctttcagattttgcttactactttaattttgtcaatgatggaaa

SEQ ID NO: 53338 - DNA, 201 bp, Bos taurus
tttcaataaaatggggtcacggcacctcctgggaggattatattactgtgagagtcttttcaggtggggattctgccaatgagactttggtactggccttcctcccttgtggaatcaaaaactaagacacctttccctgtctctccttgggggtgcactggaaacagtgtccctggaggccagcagacacacagtgtccac

SEQ ID NO: 53339 - DNA, 201 bp, Bos taurus
catgtgctctttttgcgccagtggccgcaggacggattcctctcctccgactgatcaagcctgggagggcagagtgtagagtcagccctgtgagagtaaaagagggggcccagaggagagtcgaggcgaaacgtccagacagggaggtggaactccggccaggaaaccacaggcgtccaccttgacagcctgagggcgctg

SEQ ID NO: 53340 - DNA, 201 bp, Bos taurus
actgcgtgggccagcagctgccttcagaatcatcctgggtgtttgctaaaattcacattgctagaccccaccccatacctacagagtcagaggttggaacagaggtgggccgaacttggctttttttttttttttttttttttttgcgctaatgcatttgagaatgccctgctcctgagccctcaaaactgcaatacattg

SEQ ID NO: 53341 - DNA, 201 bp, Bos taurus; identical to SEQ ID NO: 12243

SEQ ID NO: 53342 - DNA, 201 bp, Bos taurus; identical to SEQ ID NO: 12244

SEQ ID NO: 53343 - DNA, 201 bp, Bos taurus; identical to SEQ ID NO: 12246

SEQ ID NO: 53344 - DNA, 201 bp, Bos taurus; identical to SEQ ID NO: 12247

SEQ ID NO: 53345 - DNA, 201 bp, Bos taurus; identical to SEQ ID NO: 12248

SEQ ID NO: 53346 - DNA, 201 bp, Bos taurus; identical to SEQ ID NO: 12249

SEQ ID NO: 53347 - DNA, 201 bp, Bos taurus; identical to SEQ ID NO: 12250

SEQ ID NO: 53348 - DNA, 201 bp, Bos taurus
ttctgccccctccatgctcgtgcctcctggcatcattgcttctgtaacgccatccgggaatgtgggctccagggcttccacccaacaaaacacactcctcgggccacagttctcagctctgatctgcatttgtttccagcctcctgggacacaccgcccttgaagacttcccgattccacgactgtccggagagagagaca

SEQ ID NO: 53349 - DNA, 201 bp, Bos taurus; identical to SEQ ID NO: 12251

SEQ ID NO: 53350 - DNA, 201 bp, Bos taurus; identical to SEQ ID NO: 12252

SEQ ID NO: 53351 - DNA, 201 bp, Bos taurus; identical to SEQ ID NO: 12253

SEQ ID NO: 53352 - DNA, 201 bp, Bos taurus; identical to SEQ ID NO: 12254

SEQ ID NO: 53353 - DNA, 201 bp, Bos taurus; identical to SEQ ID NO: 12255

SEQ ID NO: 53354 - DNA, 201 bp, Bos taurus
cgtgtgggccgtggtgaaggctctggggaagagccagctgaagtcaggaaagacctcggtgctcaaaaggagatgctggggctgggctgtggctcaggccgaatggaggagtggtgtctgctgtggggcgggtggggtggtgggtggttagaagcatactcagccttccaagattttggccgctgctgctgctaagttgct

SEQ ID NO: 53355 - DNA, 201 bp, Bos taurus
aatacatgttagaatgctgtattaaaatatctttgggaaaattcacaaacatgctgatcttggttacttgggaggagggcccctgggtggctagtgcaaaaggggggacttttcacagtttattgtttaataccttctggattttgaactatgcattgggttggccaaaaagttcattcggatgtttccagatgacgttac

SEQ ID NO: 53356 - DNA, 201 bp, Bos taurus; identical to SEQ ID NO: 12257

SEQ ID NO: 53357 - DNA, 201 bp, Bos taurus; identical to SEQ ID NO: 12259

SEQ ID NO: 53358 - DNA, 201 bp, Bos taurus
tctgagctcttaatctgagagaagggcaacggccacatcctgagccctcggtacctttatttcacttgataaggggcctgcttcacgctgtttgtgccccggctgactgtccctgaaggggtggacacagagtggtacccagacatcatgagagggcccagcacttgggagctcaggctctgaagtgcggcagcctgggtt

SEQ ID NO: 53359 - DNA, 201 bp, Bos taurus; identical to SEQ ID NO: 12260

SEQ ID NO: 53360 - DNA, 201 bp, Bos taurus; identical to SEQ ID NO: 12261

SEQ ID NO: 53361 - DNA, 201 bp, Bos taurus; identical to SEQ ID NO: 12263

SEQ ID NO: 53362 - DNA, 201 bp, Bos taurus
tgtgaaatggggatggtggaccctagcacatagtagactcttcttaaatattagctcttgttgttacagcactgaggcctcagtcacctcttttcaatctgttaatatgaaaataaaattttaaatgtgcaaaaagatagccaccggggtccccctgtccctgaggccttccagggtggagggtccccctccatgtactcc

SEQ ID NO: 53363 - DNA, 201 bp, Bos taurus
ccaggttccctcagagcagaaaacttcatcacattcaggtagaagcagagagagtccagactctgtgaagagaagcatctgctaggagaggattaaggcacggccaatggggcagtattcgaacccaggcagccagccgcagagcctgggtttttactccaccatccacagccggagaggggcagggggcttccctgatgg

SEQ ID NO: 53364 - DNA, 201 bp, Bos taurus; identical to SEQ ID NO: 12266

SEQ ID NO: 53365 - DNA, 201 bp, Bos taurus
aattccagctgtgccattcacacgttgggtgaccttggccaagtcttcctccagcccctcatctggaaagcagagatgaagctagtgcccttttccctggttgctgctggatcgccaaggccagaacacaccagggaaggttgtcagcccctgcagggttaaggccgtgcctcgtcacgtggctggttgcccttcttactg

SEQ ID NO: 53366 - DNA, 201 bp, Bos taurus
aaataaaaagaatgctatggtttgaaactcctactattgtggcaaattaaatctttaaatcattggaaaagctgaagtattactatcacgtatgcagtatgcccaagattacaagggcataaacttaaaagatattaataaaggagggctaattctctgagcacgtgctacttttgaaatcttgggaaattcacacaaagg

SEQ ID NO: 53367 - DNA, 201 bp, Bos taurus; identical to SEQ ID NO: 12268

SEQ ID NO: 53368 - DNA, 201 bp, Bos taurus; identical to SEQ ID NO: 12269

SEQ ID NO: 53369 - DNA, 201 bp, Bos taurus; identical to SEQ ID NO: 12270

SEQ ID NO: 53370 - DNA, 201 bp, Bos taurus; identical to SEQ ID NO: 12272

SEQ ID NO: 53371 - DNA, 201 bp, Bos taurus
gggcctggactgtcctgaccatctgctccagggctccaaagccagatgctgagtggcattctgttgtctctagctatgcagcttatcagcctcctggccttcctttcctgggcaacatacctctgcatgggcggctatgataatgtgtaccgtctacaggcacagagataaaggcccagggctggctcaggagggggcagg

SEQ ID NO: 53372 - DNA, 201 bp, Bos taurus; identical to SEQ ID NO: 12273

SEQ ID NO: 53373 - DNA, 201 bp, Bos taurus; identical to SEQ ID NO: 12274

SEQ ID NO: 53374 - DNA, 201 bp, Bos taurus
actggctgggacatgggctctgtgctaatctatggcccctgtcatttgattctccagtaacccatttaaacatgaggatgagagatgctgacagaggagtgacacatccagggccaaaacaagtgcacgtgcttaggagcctcaaggcagggtcttggcgggaaaggagcaggtgagcctgggcgggaaaggatgagattc

SEQ ID NO: 53375 - DNA, 201 bp, Bos taurus; identical to SEQ ID NO: 12275

SEQ ID NO: 53376 - DNA, 201 bp, Bos taurus; identical to SEQ ID NO: 12276

SEQ ID NO: 53377 - DNA, 201 bp, Bos taurus
catcagccagaggaggtggccctgaccagaaggggaagagcccgctgccttcctccgagatccccaggaacagacaccaagcttgggccaggacacccccatgccagcttgaggtcggaggagaaatggagtctgccatccactggctgtgtgacctttggcaaattatttaacacatctgggcctcagttccttcatcta

SEQ ID NO: 53378 - DNA, 201 bp, Bos taurus
ccaaggcaagttgcttcgcatctctgggccgtggaggcccccaccacctataaaatgaggatttgaaaagtatctctcagctacctcactgggctgctgccatcatggacataaaaggcaaaggcccttggaaggaaaaaggagcgatgaagcagtctgcttccaagtattggctgtcggggaggcggggtaggggggcgg

SEQ ID NO: 53379 - DNA, 201 bp, Bos taurus; identical to SEQ ID NO: 12284

SEQ ID NO: 53380 - DNA, 201 bp, Bos taurus; identical to SEQ ID NO: 12286

SEQ ID NO: 53381 - DNA, 201 bp, Bos taurus
tccgagggccaccttgcgtgttggctctgctcagtgcatgacccgctccctccacgtttgccctctgagcaagctgctacagaccaggagagtcactgtacgtggccgcctgggtttgagcgagccctgaggatgctgtccctcaggcacagcggtcctgaatgacagtgcaggcatagtggcctgagagccctttgtcag

SEQ ID NO: 53382 - DNA, 201 bp, Bos taurus; identical to SEQ ID NO: 12287

SEQ ID NO: 53383 - DNA, 201 bp, Bos taurus; identical to SEQ ID NO: 12288

SEQ ID NO: 53384 - DNA, 201 bp, Bos taurus; identical to SEQ ID NO: 12290

SEQ ID NO: 53385 - DNA, 201 bp, Bos taurus
atcctgaaagccaattaaagaaagtgtttcagattggtagagtgatcggttttatcaaatgctccttctaagtcatataattgaggattgagaatttcctataacatctaatatgctagaggtccaaattatttgactggcatagacttaagctgtcctgccccaaagatctttcctattatcttctcataatgtttgagt

SEQ ID NO: 53386 - DNA, 201 bp, Bos taurus; identical to SEQ ID NO: 12291

SEQ ID NO: 53387 - DNA, 201 bp, Bos taurus
ggctctgggaggtgccggggtattggcggaacgggctgcccatgacacatcacgtccgggagactcggggacgtggtggggctgcagcaccaccctttgtcagtccccttccctgggcccgttgacacagacagcctggggtgtttttgccaaagatgttccccaggcccttgctttggcttccgctttaattcaaaacac

SEQ ID NO: 53388 - DNA, 201 bp, Bos taurus
tgctgggtgccagtgccattgtgaaggcagagtcaggtataaatgattcagtgcaggtcctgtggcaatgggtgggagttcagatgaggccaaggtgaacaactggagaacagtgatgaccatgatagaaatgaactgaacctggaccaacatccccagagctcccctggccgccactccatcaaacggtgcagactgccc

SEQ ID NO: 53389 - DNA, 201 bp, Bos taurus
gtgtggggaggttttggtgtggcttccttacctgcgtgaagccccagctgctggcttctgagccccctaagggaatgtgggctgcagtgacccatttgttctgttttatgaggcctggactacaaccaacaataaagttctcagggctcatcttcagagccctgctgaggcaggggacaggactacagggggtccgtcctg

SEQ ID NO: 53390 - DNA, 201 bp, Bos taurus; identical to SEQ ID NO: 12296

SEQ ID NO: 53391 - DNA, 201 bp, Bos taurus; identical to SEQ ID NO: 12297

SEQ ID NO: 53392 - DNA, 201 bp, Bos taurus
ggaggacctcttccgagaggcccatgcggtcctcatgaaggccaaggacctgcctccagcagacactgccatgaaggagaggctgaagcccttagcgcagctgttcttgtagtgagtcccggccagcctgccacggcactcttaagaagtggtgctccctcccctcggctgtgggccaaaacacggctcccggctcagagt

SEQ ID NO: 53393 - DNA, 201 bp, Bos taurus
atgattgtataatctttttctcccagacatgctataattccatctttgatttctccttgagccacaatctaggagagagagtttcagtcttccagtggccgcattttcacattgctctgcgttgttgtggtttatactttgacgggtggttgctggttgtgtgtaatatcggcctgggatcggctggtgtgcaggatatga

SEQ ID NO: 53394 - DNA, 201 bp, Bos taurus; identical to SEQ ID NO: 12300

SEQ ID NO: 53395 - DNA, 201 bp, Bos taurus
ccttgcagaaggtgactatctgtggaccggtccgctttcttggacgtctgatctgatgacaccaacacgaccctcaggccacgctgaccctgggcaaccccagctcccccaccatctgcaggaccaaccaaggtctccgcctgaccatgggccttaaagatcactgtgcgagggggcagtaaagaccctcccaattacctg

SEQ ID NO: 53396 - DNA, 201 bp, Bos taurus; identical to SEQ ID NO: 12301

SEQ ID NO: 53397 - DNA, 201 bp, Bos taurus; identical to SEQ ID NO: 12302

SEQ ID NO: 53398 - DNA, 201 bp, Bos taurus; identical to SEQ ID NO: 12303

SEQ ID NO: 53399 - DNA, 201 bp, Bos taurus
agcgtgtggggcgggtgcctgggctagccgtgggcgtcaccgccgggccccccaggtgctggacgcggtgctgcccgtcatgaaccaggcccgcagcggcgagcagacagtgttccgggcgcgcttcagctccatcacggacacagacatctgcgctgccatggcccgcctgggtgagcccgaccacaacgaggcgctctc

SEQ ID NO: 53400 - DNA, 201 bp, Bos taurus
ctgccagtgaggaccccgcatctttgtcccccagtggaaaccgatgaaatagcacgagagggtctggacgtagcttcatcccacacggatgtcacgttactgctgtggccgccctgacacccgcctgcccccaccctgagccccgacagccccccatccctatgttcttatcattcgaggatgcagataagtgatgtcacg

SEQ ID NO: 53401 - DNA, 201 bp, Bos taurus
tatctgtggtctttaggacggcccttctgacgggtgtgaggagccaccactgcggctccgacgtgcttttctctgttgttccgtctttgtgggaaccgcgcgcgtcagcgagtaatcacggccacgggtcttgctgctgccgcccagcctcttgcttctcctttcgtcctctctgagccttaatttaaggtgtgtgtcttg

SEQ ID NO: 53402 - DNA, 201 bp, Bos taurus; identical to SEQ ID NO: 12304

SEQ ID NO: 53403 - DNA, 201 bp, Bos taurus; identical to SEQ ID NO: 12308

SEQ ID NO: 53404 - DNA, 201 bp, Bos taurus; identical to SEQ ID NO: 12310

SEQ ID NO: 53405 - DNA, 201 bp, Bos taurus; identical to SEQ ID NO: 12317

SEQ ID NO: 53406 - DNA, 201 bp, Bos taurus; identical to SEQ ID NO: 12318

SEQ ID NO: 53407 - DNA, 201 bp, Bos taurus; identical to SEQ ID NO: 12319

SEQ ID NO: 53408 - DNA, 201 bp, Bos taurus
ccagagttagcaccagccctggggagatccttccccttttagacgggcacaaacctcccaaacgaccaagggaatccggattccaattctagctctgagcctcccccttcctgctggtacttcggtggggcacaaggatcatgccagtctggcaggggtgctgagagtgccactccatggcacagcaacactcaagtgcac

SEQ ID NO: 53409 - DNA, 201 bp, Bos taurus; identical to SEQ ID NO: 12320

SEQ ID NO: 53410 - DNA, 201 bp, Bos taurus
gacaaggttgcttttgttctacagagaagctgctctctcaagagtctagaaacagcggaactaagaaggaaagaaaggctgctgacagggcactttcctttcacaagttgcaaactgcttacctcggactctaactcagtgaggttgccaactatatctctgcactccacagctaagtcatcgagatgatcctggaggcat

SEQ ID NO: 53411 - DNA, 201 bp, Bos taurus; identical to SEQ ID NO: 12323

SEQ ID NO: 53412 - DNA, 201 bp, Bos taurus; identical to SEQ ID NO: 12324

SEQ ID NO: 53413 - DNA, 201 bp, Bos taurus; identical to SEQ ID NO: 12325

SEQ ID NO: 53414 - DNA, 201 bp, Bos taurus; identical to SEQ ID NO: 12326

SEQ ID NO: 53415 - DNA, 201 bp, Bos taurus; identical to SEQ ID NO: 12327

SEQ ID NO: 53416 - DNA, 201 bp, Bos taurus; identical to SEQ ID NO: 12328

SEQ ID NO: 53417 - DNA, 201 bp, Bos taurus; identical to SEQ ID NO: 12329

SEQ ID NO: 53418 - DNA, 201 bp, Bos taurus; identical to SEQ ID NO: 12330

SEQ ID NO: 53419 - DNA, 201 bp, Bos taurus
gaaaatgtgcatcagatactgttgtctaagtacttcagagaggaggcaaagccgaggacttatggggaggattctctcacctgaaggcctcataggtcctgcttagttacaatagcatcacaatgcttgtgtactagaaacacttattttacttaataatggccccaaagtgcaagagtagtgatgctgcaattcagatat

SEQ ID NO: 53420 - DNA, 201 bp, Bos taurus; identical to SEQ ID NO: 12331

SEQ ID NO: 53421 - DNA, 201 bp, Bos taurus; identical to SEQ ID NO: 12332

SEQ ID NO: 53422 - DNA, 201 bp, Bos taurus; identical to SEQ ID NO: 12333

SEQ ID NO: 53423 - DNA, 201 bp, Bos taurus; identical to SEQ ID NO: 12334

SEQ ID NO: 53424 - DNA, 201 bp, Bos taurus; identical to SEQ ID NO: 12335

SEQ ID NO: 53425 - DNA, 201 bp, Bos taurus; identical to SEQ ID NO: 12337

SEQ ID NO: 53426 - DNA, 201 bp, Bos taurus; identical to SEQ ID NO: 12339

SEQ ID NO: 53427 - DNA, 201 bp, Bos taurus; identical to SEQ ID NO: 12340

SEQ ID NO: 53428 - DNA, 201 bp, Bos taurus; identical to SEQ ID NO: 12341

SEQ ID NO: 53429 - DNA, 201 bp, Bos taurus; identical to SEQ ID NO: 12342

SEQ ID NO: 53430 - DNA, 201 bp, Bos taurus; identical to SEQ ID NO: 12343

SEQ ID NO: 53431 - DNA, 201 bp, Bos taurus
gcaaggccctgggggccctggccaggagtttgaacttgactccacgtggagctgggcagccactggaaaattttgaatgggagaagccgttaaacgcctcccaaaacaatccctctggccactggagaatggatctggaggagatcagagcagaagcagcagagaacagtgaggtgtctcacatggggggaggccgcccac

SEQ ID NO: 53432 - DNA, 201 bp, Bos taurus; identical to SEQ ID NO: 12344

SEQ ID NO: 53433 - DNA, 201 bp, Bos taurus
gccttgaaaagcgtgcattgggtggaacacagagatggggaggccaggaaggcaggccttgggagaaggtggggtagggagaaacccccaccaaccgcccagctccccatcactccagcctccaggaccatagtgcttcttccgagacccaagtctctgttgcctccttgcttttatccctcctcttatctccacctgcca

SEQ ID NO: 53434 - DNA, 201 bp, Bos taurus
ggccccgcccagatctattcaattcagaattttgggcagtctctacgcgcactccatcttgagaaccccgccccagccccggtggcctctcagaggcagcgctgttctgtcacagaggtgggctttggaaagctccccgagctcaccatgccctccgccaaagtggggcctgaagacctccaggtcttcagcttccagagg

SEQ ID NO: 53435 - DNA, 201 bp, Bos taurus; identical to SEQ ID NO: 12347

SEQ ID NO: 53436 - DNA, 201 bp, Bos taurus; identical to SEQ ID NO: 12348

SEQ ID NO: 53437 - DNA, 201 bp, Bos taurus
agacacgaaagggatccttcatccatgtgcttgcgatgccctggctctggtgaacccaaccaagaggtagttaaatggccccgcagattgcgagtgactcagggaatgcctgggtttatgtatggattagcaccctgatagaccctgagtcgcagaagacgaagactaattacctgacaacgctcccctccgctcgcctgg

SEQ ID NO: 53438 - DNA, 201 bp, Bos taurus; identical to SEQ ID NO: 12350

SEQ ID NO: 53439 - DNA, 201 bp, Bos taurus; identical to SEQ ID NO: 12351

SEQ ID NO: 53440 - DNA, 201 bp, Bos taurus; identical to SEQ ID NO: 12352

SEQ ID NO: 53441 - DNA, 201 bp, Bos taurus; identical to SEQ ID NO: 12354

SEQ ID NO: 53442 - DNA, 201 bp, Bos taurus; identical to SEQ ID NO: 12355

SEQ ID NO: 53443 - DNA, 201 bp, Bos taurus
tctgtgtccacgttcagtgacttcacagagtgagcttgaaattagccatgctggagcatttacaccacagaaattggccaaagctccccacgagggccccggcacccaccgagaccttgtgaagaaacaccgtccagcccagccctgccattaacagtcagaaaacaaaggcccagattgcacgcaccaccttcaaaaact

SEQ ID NO: 53444 - DNA, 201 bp, Bos taurus; identical to SEQ ID NO: 12356

SEQ ID NO: 53445 - DNA, 201 bp, Bos taurus
gctattcaggtcatcaggagttcaaatttaaggtgaggatcttctgcactttgagtaaggactgaacttaactgattctctgcccagcccttgccatggatggcaaagcccagcttagattacgctggccccgtccccagcgtggaaacctcccttccaggttgacactcctctgaaagcgatcctctgtggttccattcg

SEQ ID NO: 53446 - DNA, 201 bp, Bos taurus; identical to SEQ ID NO: 12357

SEQ ID NO: 53447 - DNA, 201 bp, Bos taurus; identical to SEQ ID NO: 12358

SEQ ID NO: 53448 - DNA, 201 bp, Bos taurus
ctgcttgagaaactaccctgaaatgagaactctctggcttcacccaagacctcctgagtcacagactctggggctgggacccaacaagtggtgctttagggggccttaccgagattctcaggtgcaaatgagtgtgagaagggctcctccccaaggccttctcacgcccctgtctttcagccaggtttccccgaatggtcg

SEQ ID NO: 53449 - DNA, 201 bp, Bos taurus
tggcagctctagaagtggaggagggccgtggacgagctcgcctaacactcttgttctggggagcctgggaggatagattccattctgcaagcaggaggccggggagttcgctcatggtgcaggagacagcaggtcatttacactgtgtttgcgatcaggggtcacagagaggggccaggagttgaattccaagaatggcac

SEQ ID NO: 53450 - DNA, 201 bp, Bos taurus; identical to SEQ ID NO: 12359

SEQ ID NO: 53451 - DNA, 201 bp, Bos taurus; identical to SEQ ID NO: 12362

SEQ ID NO: 53452 - DNA, 201 bp, Bos taurus; identical to SEQ ID NO: 12364

SEQ ID NO: 53453 - DNA, 201 bp, Bos taurus; identical to SEQ ID NO: 12365

SEQ ID NO: 53454 - DNA, 201 bp, Bos taurus; identical to SEQ ID NO: 12366

SEQ ID NO: 53455 - DNA, 201 bp, Bos taurus; identical to SEQ ID NO: 12367

SEQ ID NO: 53456 - DNA, 201 bp, Bos taurus; identical to SEQ ID NO: 12368

SEQ ID NO: 53457 - DNA, 201 bp, Bos taurus; identical to SEQ ID NO: 12369

SEQ ID NO: 53458 - DNA, 201 bp, Bos taurus; identical to SEQ ID NO: 12370

SEQ ID NO: 53459 - DNA, 201 bp, Bos taurus; identical to SEQ ID NO: 12371

SEQ ID NO: 53460 - DNA, 201 bp, Bos taurus; identical to SEQ ID NO: 12372

SEQ ID NO: 53461 - DNA, 201 bp, Bos taurus
gctctcagtgtgtgtgaatgtgtgtgggtgtatgtgagttagtgtttgtgcatgtgtgtaagtgtgtgggtatgtgtttgagtgtgccttcgtggccaccgtgagaatgtgtgagttttttaatggaatggtggtagcacagagtaaagggctgtggagcagcaggagatgggttttgtgtctctgttctgtgatgtcctg

SEQ ID NO: 53462 - DNA, 201 bp, Bos taurus
gccacccacctaaaggaagggtctctcccgatgtagctgcaggctttgggtgcagaagcatcctgccctcggcgccagtggctgtagctcacacatgaggtgtccatccagatcctgggccctgggatgggaacacgaccaccaggccttgccccagcgccactccttgtgtgcagtgggtgcttaatcagtgctgacgga

SEQ ID NO: 53463 - DNA, 201 bp, Bos taurus; identical to SEQ ID NO: 12373

SEQ ID NO: 53464 - DNA, 201 bp, Bos taurus; identical to SEQ ID NO: 12374

SEQ ID NO: 53465 - DNA, 201 bp, Bos taurus; identical to SEQ ID NO: 12377

SEQ ID NO: 53466 - DNA, 201 bp, Bos taurus
caggccagctgctccaccatcgccctgcagtctagaaagttcttggaactcattacacgcagtcagaactttttaggacttgaagtgaagctcacataacgtgcaattagccatttggtggccttttgtaccgtcacggtgtcttagacaccccgtttatctggctccacagcagtctcgtcacctccaaaggcaccctgc

SEQ ID NO: 53467 - DNA, 201 bp, Bos taurus; identical to SEQ ID NO: 12378

SEQ ID NO: 53468 - DNA, 201 bp, Bos taurus; identical to SEQ ID NO: 12379

SEQ ID NO: 53469 - DNA, 201 bp, Bos taurus; identical to SEQ ID NO: 12380

SEQ ID NO: 53470 - DNA, 201 bp, Bos taurus; identical to SEQ ID NO: 12381

SEQ ID NO: 53471 - DNA, 201 bp, Bos taurus; identical to SEQ ID NO: 12383

SEQ ID NO: 53472 - DNA, 201 bp, Bos taurus; identical to SEQ ID NO: 12385

SEQ ID NO: 53473 - DNA, 201 bp, Bos taurus; identical to SEQ ID NO: 12386

SEQ ID NO: 53474 - DNA, 201 bp, Bos taurus
ttccttctctccagccctgctgaagatggccaagctgtctgctccaggtctcagatttgacagcagagggtcacaggcgtgtgtagcttggcccacatgtattttgattttggaggtgggggaagagttgtcaccagttaaatctgagaaaatcacatacagttttggaatcctaacttctcctgcaaaatcaggaactat

SEQ ID NO: 53475 - DNA, 201 bp, Bos taurus; identical to SEQ ID NO: 12388

SEQ ID NO: 53476 - DNA, 201 bp, Bos taurus
aatgaatactttgctgggtaaagtattactagttgcaggcttcccccccccgccccacccaccccgccccccgccccgaccctgcggcctttcatcactttgactaagttgtgccaatactctctggcctgaaaagttcctgctgaaaagttaactgaacaaattattggagttcccttgtaggtaactagttgttttctc

SEQ ID NO: 53477 - DNA, 201 bp, Bos taurus; identical to SEQ ID NO: 12390

SEQ ID NO: 53478 - DNA, 201 bp, Bos taurus; identical to SEQ ID NO: 12391

SEQ ID NO: 53479 - DNA, 201 bp, Bos taurus
gtctgtcagtgatagaagtttattagcatttactcaccttgcattagtaatacagcacggtacgttttccattttcattagcagtgtttgatagaatcattagaaaggaagtaaattctctggttcaacaaaataaatgcagcttttgctttgtgacaggtaatataaaagctttcttttgtctctgtgtgtgtgtgggag

SEQ ID NO: 53480 - DNA, 201 bp, Bos taurus; identical to SEQ ID NO: 12392

SEQ ID NO: 53481 - DNA, 201 bp, Bos taurus; identical to SEQ ID NO: 12393

SEQ ID NO: 53482 - DNA, 201 bp, Bos taurus; identical to SEQ ID NO: 12394

SEQ ID NO: 53483 - DNA, 201 bp, Bos taurus; identical to SEQ ID NO: 12395

SEQ ID NO: 53484 - DNA, 201 bp, Bos taurus
ccaggaggaactccgtgggcagccccagctacacgaatgttcttctttacgtggagtctgacttttgcctcccctagttggtcctagatgacttaacccccaacttctcggccccatggggcctcttctgtgccccaggccttcagtgtttaaaggtggccctcacttcattctgaaaccctttctgagccaccaactcca

SEQ ID NO: 53485 - DNA, 201 bp, Bos taurus; identical to SEQ ID NO: 12396

SEQ ID NO: 53486 - DNA, 201 bp, Bos taurus; identical to SEQ ID NO: 12399

SEQ ID NO: 53487 - DNA, 201 bp, Bos taurus; identical to SEQ ID NO: 12400

SEQ ID NO: 53488 - DNA, 201 bp, Bos taurus; identical to SEQ ID NO: 12401

SEQ ID NO: 53489 - DNA, 201 bp, Bos taurus; identical to SEQ ID NO: 12403

SEQ ID NO: 53490 - DNA, 201 bp, Bos taurus; identical to SEQ ID NO: 12404

SEQ ID NO: 53491 - DNA, 201 bp, Bos taurus; identical to SEQ ID NO: 12407

SEQ ID NO: 53492 - DNA, 201 bp, Bos taurus; identical to SEQ ID NO: 12408

SEQ ID NO: 53493 - DNA, 201 bp, Bos taurus; identical to SEQ ID NO: 12411

SEQ ID NO: 53494 - DNA, 201 bp, Bos taurus; identical to SEQ ID NO: 12412

SEQ ID NO: 53495 - DNA, 201 bp, Bos taurus; identical to SEQ ID NO: 12413

SEQ ID NO: 53496 - DNA, 201 bp, Bos taurus; identical to SEQ ID NO: 12414

SEQ ID NO: 53497 - DNA, 201 bp, Bos taurus
aacacagcacttgaacttagggacctgaggaattcacttatttacatttgttatgtgtattaaggcaagcgtttgttcagccttcatatgcatgaggccccgcagtgccatgactggtgcaagagtgactcagtccacagcagcacggtagggcaagactttaaaagggaagggaagggcccgctgagcagagccacacac

SEQ ID NO: 53498 - DNA, 201 bp, Bos taurus
tcctcagatggcagagaaccgagcagagccgtggcaatcagccccctagaagggccctaattccattcatgggggctctaccctttaggtttcatttaattctaatcgcctcccaaaggttctacctcctaataccatcacattatgcgtagagcttcactataggaacttctggcaggacacgaacatctggtcactaac

SEQ ID NO: 53499 - DNA, 201 bp, Bos taurus; identical to SEQ ID NO: 12415

SEQ ID NO: 53500 - DNA, 201 bp, Bos taurus; identical to SEQ ID NO: 12416

SEQ ID NO: 53501 - DNA, 201 bp, Bos taurus; identical to SEQ ID NO: 12418

SEQ ID NO: 53502 - DNA, 201 bp, Bos taurus; identical to SEQ ID NO: 12420

SEQ ID NO: 53503 - DNA, 201 bp, Bos taurus
cttggcggcctgcacaaaccctgctgggcactggggtttgtactgttccccacgggtcaggcaggtggggctgcgggcatttctaggggcccagctgagcgcagggtccccatccttctgcctcagactttcacctcttctcaggaagaggcacctcaggcgatccagaggcccttctcctgcatgctggcttccgtgcag

SEQ ID NO: 53504 - DNA, 201 bp, Bos taurus; identical to SEQ ID NO: 12421

SEQ ID NO: 53505 - DNA, 201 bp, Bos taurus; identical to SEQ ID NO: 12422

SEQ ID NO: 53506 - DNA, 201 bp, Bos taurus; identical to SEQ ID NO: 12423

SEQ ID NO: 53507 - DNA, 201 bp, Bos taurus; identical to SEQ ID NO: 12424

SEQ ID NO: 53508 - DNA, 201 bp, Bos taurus; identical to SEQ ID NO: 12425

SEQ ID NO: 53509 - DNA, 201 bp, Bos taurus; identical to SEQ ID NO: 12426

SEQ ID NO: 53510 - DNA, 201 bp, Bos taurus; identical to SEQ ID NO: 12427

SEQ ID NO: 53511 - DNA, 201 bp, Bos taurus; identical to SEQ ID NO: 12428

SEQ ID NO: 53512 - DNA, 201 bp, Bos taurus; identical to SEQ ID NO: 12431

SEQ ID NO: 53513 - DNA, 201 bp, Bos taurus; identical to SEQ ID NO: 12434

SEQ ID NO: 53514 - DNA, 201 bp, Bos taurus
tcagctcttcgcatcagatcagcttatttaataactgaagaccagcttatttaatcagaacatgtataaatccctagttaacctgctgtttttctaataaagtctaatttgttcttcgtggaaaatgtcagggatcttatgtataggtatgtttagccatttaaagtttgctgtaagcaaacttaagtgatgacactcata

SEQ ID NO: 53515 - DNA, 201 bp, Bos taurus
acagcaacaaggcaaaagcaacagataacttacaggcaaactcccgtaaggatcagttgacttctcagcagaaactctgctggccagaaggcaactgcacgaaatatttaaagtaatgaaagggaaaaacctacaagcaagaatattctacactgaaaggccttcattcagactcgatggagaaatcaaaagctttacaga

SEQ ID NO: 53516 - DNA, 201 bp, Bos taurus
atttctgggaaagtatttctttgtcttacaaaagggaaaagataatgttatcataagtatgagtacctatttccttgttttatttgaaaaaattcctgatttgtttgatttcaaaccgccctctctccctctcttttactgtaccagtacagcctaagtttagagtaggttttttgatatctattaaaaagtattttatat

SEQ ID NO: 53517 - DNA, 201 bp, Bos taurus
taaaactggcaatttttgagtcattagctagaaagaatttaaagtccctgcttcctattggaattcagggaggagcctgtctttttgagatgacaggggtatgtataatggttattctcacagaacagaaacaaatatagagggtctaacctagtactctcaaacttcccttgattttcacacgtagcaaagggacttaag

SEQ ID NO: 53518 - DNA, 201 bp, Bos taurus
ggtcactcagtaattttaaatatatttgtctctgaaggttgctctcaccatattatatcattttggttttattttctctttggagggcccaagcctgagccccatttctgttattgttgagctcaagtttgcactgtgtgttgaatgtggtctgtactgtaagaggcctgggaagtgcagagtggagcccctgccttaaca

SEQ ID NO: 53519 - DNA, 201 bp, Bos taurus
aaaggttgatatttataagatgacagtttcatatttttaatgaaatttgggtcttcccatttttcagcactattagatatctgagaggccaaagaagtatacattttattacaaagagaagaatatagcaaaaaatcagaggtatgatgatcctttgatctgtgagcataaaataatgccatttcattgggccttaatcaa

SEQ ID NO: 53520 - DNA, 201 bp, Bos taurus; identical to SEQ ID NO: 12438

SEQ ID NO: 53521 - DNA, 201 bp, Bos taurus
ctgcgtgtggactgaatccctgggtctaatcctgcactcccagttcctggtccccgctgaaggtttagaagcctctctgggccatcatgcctcaagacacctgcctcacacatctttggggggctttctcttctgggttccaagccagaacttggccaactaaacagaaacatgactcctctgcctctgggaaccctaaac

SEQ ID NO: 53522 - DNA, 201 bp, Bos taurus; identical to SEQ ID NO: 12442

SEQ ID NO: 53523 - DNA, 201 bp, Bos taurus
aaggaggcctatgcctatttttggaggaagcctgctgtttctacaccaataaattaggcgttgtaaaggaaacaggaagaagtctgataaacagggcctcgagaatacaccaatacctcagtaattcatgggaaaactggttaagcaattggaattggatgccttggttcataccttttctaggccctctccttctactta

SEQ ID NO: 53524 - DNA, 201 bp, Bos taurus
tgtcagacactgaaaactagcttcaaattaagaaagcgtctaaggaaaataaaaagcacattcttaattaaaatcacacacttgtaattcttcaggtccaggactatcacaatgtttttcacaatggagaaaaagtgaatctctaactcaaaaataaactccacatctcttgctttacacaaaaatttaaaaaagagcatg

SEQ ID NO: 53525 - DNA, 201 bp, Bos taurus
aatcagtcctaacagtaaggcttggctaggagtccagagcagaactccagctcagggcccgccatgctgaagacagacccggccctgggagggtagcccctggctcctggctctgaactaagctgcccttcgtcttagggaaatattcaagtgacctctgctgccaggcttcacccagcttcagggatgctgttgccggcc

SEQ ID NO: 53526 - DNA, 201 bp, Bos taurus
gagtatctcgaaatctttgaacccccgtaactgagcaatcaatatgctcagaaggtcccgccaacctagcatcagtaactgaaggtaacagctgggagagtggcatcggtggagaaaggggtggacagccgggcttagactgaggtgagctacaacacctcgagcggttttcacaggcagacttcatactatttggaagca

SEQ ID NO: 53527 - DNA, 201 bp, Bos taurus; identical to SEQ ID NO: 12444

SEQ ID NO: 53528 - DNA, 201 bp, Bos taurus; identical to SEQ ID NO: 12445

SEQ ID NO: 53529 - DNA, 201 bp, Bos taurus; identical to SEQ ID NO: 12446

SEQ ID NO: 53530 - DNA, 201 bp, Bos taurus; identical to SEQ ID NO: 12447

SEQ ID NO: 53531 - DNA, 201 bp, Bos taurus; identical to SEQ ID NO: 12448

SEQ ID NO: 53532 - DNA, 201 bp, Bos taurus; identical to SEQ ID NO: 12449

SEQ ID NO: 53533 - DNA, 201 bp, Bos taurus; identical to SEQ ID NO: 12450

SEQ ID NO: 53534 - DNA, 201 bp, Bos taurus; identical to SEQ ID NO: 12451

SEQ ID NO: 53535 - DNA, 201 bp, Bos taurus; identical to SEQ ID NO: 12453

SEQ ID NO: 53536 - DNA, 201 bp, Bos taurus; identical to SEQ ID NO: 12454

SEQ ID NO: 53537 - DNA, 201 bp, Bos taurus; identical to SEQ ID NO: 12455

SEQ ID NO: 53538 - DNA, 201 bp, Bos taurus; identical to SEQ ID NO: 12456

SEQ ID NO: 53539 - DNA, 201 bp, Bos taurus; identical to SEQ ID NO: 12458

SEQ ID NO: 53540 - DNA, 201 bp, Bos taurus; identical to SEQ ID NO: 12459

SEQ ID NO: 53541 - DNA, 201 bp, Bos taurus
taaatagtctaaagattttaagacacatgtgctacttttgttgcagcagattttagttataggaatgaagtatagagttatctgctttaaattgaaaaagcaatcagatttatatgggttctaaagacaccactgctctcaactatagcatgtcctcttagtactaggacaggggaatgtcttgccttgtctgtaacatag

SEQ ID NO: 53542 - DNA, 201 bp, Bos taurus; identical to SEQ ID NO: 12460

SEQ ID NO: 53543 - DNA, 201 bp, Bos taurus; identical to SEQ ID NO: 12461

SEQ ID NO: 53544 - DNA, 201 bp, Bos taurus
tgggcaggggcagagcaccatcacacccataactctgggagtcacctctaattcaagccagaagaatgaggctctagaaacccactaaccctctctcactcatcagtttagacaagcaaactcttctgatgcgtgcatgcgtgctcagtctctttcgtcatgtccaacactatgcgaccccgtggactgtagcccactagg

SEQ ID NO: 53545 - DNA, 201 bp, Bos taurus; identical to SEQ ID NO: 12462

SEQ ID NO: 53546 - DNA, 201 bp, Bos taurus
aacaaatgcccaaaatgtactggcctcaaacaatgatgttacaaatttgtgtgcatagagcaagcaagaatctggaggcagcttagctagatgccactgactcagggcctcttcagggcaaggccaaaatcaaggaatcagccaggactgctgtcatctcaaaagtggatgtgacaaagatcccacggcggcaggctctgg

SEQ ID NO: 53547 - DNA, 201 bp, Bos taurus
gcctgagaatcacacatgctaagtaagtttcaccctccatcctcacatggagatacttccttcatgactaacttgaaaaatccaaattttgttttataatcaaatgtggcaatttctattaggccttccgaacttttaaagttaactcctggcaaatacagacttgaagttttctcctacattgtcccagaagctgaattt

SEQ ID NO: 53548 - DNA, 201 bp, Bos taurus
tggccaaagtactggagtttcagctttagcatcattccttccaaaatgacttataatatttaatacatagcaaccattatgtaaataattgcaagtacaacgtaaatgctacataaatagttaccacaagaatggcaaattcaagttttgttttgaagaaatttctggaattttttcctattattttccatctgagggttg

SEQ ID NO: 53549 - DNA, 201 bp, Bos taurus; identical to SEQ ID NO: 12463

SEQ ID NO: 53550 - DNA, 201 bp, Bos taurus; identical to SEQ ID NO: 12464

SEQ ID NO: 53551 - DNA, 201 bp, Bos taurus; identical to SEQ ID NO: 12465

SEQ ID NO: 53552 - DNA, 201 bp, Bos taurus; identical to SEQ ID NO: 12476

SEQ ID NO: 53553 - DNA, 201 bp, Bos taurus; identical to SEQ ID NO: 12477

SEQ ID NO: 53554 - DNA, 201 bp, Bos taurus; identical to SEQ ID NO: 12478

SEQ ID NO: 53555 - DNA, 201 bp, Bos taurus; identical to SEQ ID NO: 12479

SEQ ID NO: 53556 - DNA, 201 bp, Bos taurus; identical to SEQ ID NO: 12480

SEQ ID NO: 53557 - DNA, 201 bp, Bos taurus; identical to SEQ ID NO: 12482

SEQ ID NO: 53558 - DNA, 201 bp, Bos taurus; identical to SEQ ID NO: 12483

SEQ ID NO: 53559 - DNA, 201 bp, Bos taurus; identical to SEQ ID NO: 12485

SEQ ID NO: 53560 - DNA, 201 bp, Bos taurus; identical to SEQ ID NO: 12486

SEQ ID NO: 53561 - DNA, 201 bp, Bos taurus
acattttaatggagtagaatctgtaaaaacactgaatcactaagctgtacacctgaaactaatataattttgtaaacagattcaatttttaaaataatcagttaagccatgagaaagaagaaacgggggaggcaagtggattactcaacacctgctgattcatctgtcttatttttatctcagcatacaattattaattct

SEQ ID NO: 53562 - DNA, 201 bp, Bos taurus; identical to SEQ ID NO: 12487

SEQ ID NO: 53563 - DNA, 201 bp, Bos taurus; identical to SEQ ID NO: 12488

SEQ ID NO: 53564 - DNA, 201 bp, Bos taurus; identical to SEQ ID NO: 12489

SEQ ID NO: 53565 - DNA, 201 bp, Bos taurus; identical to SEQ ID NO: 12490

SEQ ID NO: 53566 - DNA, 201 bp, Bos taurus; identical to SEQ ID NO: 12491

SEQ ID NO: 53567 - DNA, 201 bp, Bos taurus; identical to SEQ ID NO: 12492

SEQ ID NO: 53568 - DNA, 201 bp, Bos taurus; identical to SEQ ID NO: 12493

SEQ ID NO: 53569 - DNA, 201 bp, Bos taurus; identical to SEQ ID NO: 12496

SEQ ID NO: 53570 - DNA, 201 bp, Bos taurus
tgggatgataccctacaggacatctggggataccaacgcgaggctggtgcagatggaggtcctcatgaattaagtgtgatgttctgaggggctcacggggatgcttgctgtcagtacttcagggccctccagggttggggggtgtttctggttttgtttctgttgtgtttgttttgtttcatttttctgtattatgtattt

SEQ ID NO: 53571 - DNA, 201 bp, Bos taurus
atgtgctgatggtggattctcaggccaccagccaggctgagggtagggggcacttgggaaggtagctctcccagagtccttcagtgataaccttatcagccggccaggtacctcgagggtagaaaggatatcaggcccaagacccagctctgcttctaagtgctgtgtgactttcagcaactcactgacctctctgaattt

SEQ ID NO: 53572 - DNA, 201 bp, Bos taurus; identical to SEQ ID NO: 12499

SEQ ID NO: 53573 - DNA, 201 bp, Bos taurus
agctgtgtgatacagcacaggctggttaggcgaggaccactggctccagggaggggtgggcgctggtgccggagggctcagcaaggagcctcatgtggtgcccaaatgggccacggggtatccagaacagaccctgaatctgaacgcatctgcctcctccgacatctctcaccttctccctgattatcatccagcctccca

SEQ ID NO: 53574 - DNA, 201 bp, Bos taurus; identical to SEQ ID NO: 12500

SEQ ID NO: 53575 - DNA, 201 bp, Bos taurus; identical to SEQ ID NO: 12503

SEQ ID NO: 53576 - DNA, 201 bp, Bos taurus; identical to SEQ ID NO: 12505

SEQ ID NO: 53577 - DNA, 201 bp, Bos taurus; identical to SEQ ID NO: 12506

SEQ ID NO: 53578 - DNA, 201 bp, Bos taurus; identical to SEQ ID NO: 12507

SEQ ID NO: 53579 - DNA, 201 bp, Bos taurus; identical to SEQ ID NO: 12508

SEQ ID NO: 53580 - DNA, 201 bp, Bos taurus; identical to SEQ ID NO: 12509

SEQ ID NO: 53581 - DNA, 201 bp, Bos taurus; identical to SEQ ID NO: 12511

SEQ ID NO: 53582 - DNA, 201 bp, Bos taurus; identical to SEQ ID NO: 12513

SEQ ID NO: 53583 - DNA, 201 bp, Bos taurus
aaacaaattttattacaatatgttatacaacttaattttcttcccctaccagcccacacctatatactttcccttacatcatcctctccatatttattgcatatttatcactccaccatttttaatgttgtactcaagccctgcttagtcacaaaaaatatccctgacaagttcaggttcaggcagttttctctttaaact

SEQ ID NO: 53584 - DNA, 201 bp, Bos taurus; identical to SEQ ID NO: 12517

SEQ ID NO: 53585 - DNA, 201 bp, Bos taurus; identical to SEQ ID NO: 12519

SEQ ID NO: 53586 - DNA, 201 bp, Bos taurus; identical to SEQ ID NO: 12521

SEQ ID NO: 53587 - DNA, 201 bp, Bos taurus; identical to SEQ ID NO: 12524

SEQ ID NO: 53588 - DNA, 201 bp, Bos taurus
cgctcagtgtgatattcatagatgtaacacaaaaattgaagcagacatcctgaaactagcatctgttttcctgtcactgttttaggctattcattgatagggttaacttttcacacaagcaatagctctgtaggggagtttttaaatctgtgcatcatagaagaggaagttgaaggcaaagggaaggaagtaattgtccat

SEQ ID NO: 53589 - DNA, 201 bp, Bos taurus
agtgatttctcattgtatgcctaaattggtgacttaacttttcagttttacaaggtaaaattagaggaaaataagtggttactctgatgttcacacctgtatatacatagctgcaggaagaattgagaaaagagagtgatgtgggtgacatgtacaatgcagagatatagaacaaaggccggcatctcgtggcctgaaact

SEQ ID NO: 53590 - DNA, 201 bp, Bos taurus; identical to SEQ ID NO: 12535

SEQ ID NO: 53591 - DNA, 201 bp, Bos taurus; identical to SEQ ID NO: 12536

SEQ ID NO: 53592 - DNA, 201 bp, Bos taurus; identical to SEQ ID NO: 12537

SEQ ID NO: 53593 - DNA, 201 bp, Bos taurus; identical to SEQ ID NO: 12538

SEQ ID NO: 53594 - DNA, 201 bp, Bos taurus; identical to SEQ ID NO: 12539

SEQ ID NO: 53595 - DNA, 201 bp, Bos taurus; identical to SEQ ID NO: 12543

SEQ ID NO: 53596 - DNA, 201 bp, Bos taurus
gtttggcctaggggtcggccacatactatcttcagcagcctcttggcataagccccagccttcccaaagcagcaggcatccccaagcaggggcccaacctagaaagcagagataggtttaacaaaaacataatgttgactttccccctccagtggggctattctgtaatgtgacttccatatgtttatataaaatgagtgt

SEQ ID NO: 53597 - DNA, 201 bp, Bos taurus
ccaagccatcagtgcaactgtttattgatttgttaaattcagttcttccaatagctgtttcaaatatcactgagtttcctttaaaaatatttccccacaaggtaaaactttcagactcgctgagttatttcgtgctttagatgtgaagaaattctttatgataatatctaaaagtgtgttgccaaaaaaaccctaggtaaa

SEQ ID NO: 53598 - DNA, 201 bp, Bos taurus
aaaaaaaatgaattgtttaaactctacctgaaagccactacctagaggtcagctctgactgttgagatgggggattagcaagttttaaagagatgtgaactgctatcaccaaactgagaccatctactttctgtaatcagaaggactgaaatagcactagaaaaggaaactcattatgcaaataccattgttttgaacctt

SEQ ID NO: 53599 - DNA, 201 bp, Bos taurus; identical to SEQ ID NO: 12545

SEQ ID NO: 53600 - DNA, 201 bp, Bos taurus; identical to SEQ ID NO: 12546

SEQ ID NO: 53601 - DNA, 201 bp, Bos taurus; identical to SEQ ID NO: 12547

SEQ ID NO: 53602 - DNA, 201 bp, Bos taurus; identical to SEQ ID NO: 12549

SEQ ID NO: 53603 - DNA, 201 bp, Bos taurus; identical to SEQ ID NO: 12550

SEQ ID NO: 53604 - DNA, 201 bp, Bos taurus
caaaggacaggagccatccgaagcaccctctggcagtggttttgcagtgaatgaacagtggaagaatggacaaggcacttggcgagggccgtggagctgacttactgcatcacatcctcacgataaaggtgggagcagacttttgtccccacatgcatacacatgagaaaatgaggccaagagcgttggttggaatgactg

SEQ ID NO: 53605 - DNA, 201 bp, Bos taurus; identical to SEQ ID NO: 12551

SEQ ID NO: 53606 - DNA, 201 bp, Bos taurus; identical to SEQ ID NO: 12552

SEQ ID NO: 53607 - DNA, 201 bp, Bos taurus; identical to SEQ ID NO: 12553

SEQ ID NO: 53608 - DNA, 201 bp, Bos taurus; identical to SEQ ID NO: 12554

SEQ ID NO: 53609 - DNA, 201 bp, Bos taurus; identical to SEQ ID NO: 12555

SEQ ID NO: 53610 - DNA, 201 bp, Bos taurus; identical to SEQ ID NO: 12557

SEQ ID NO: 53611 - DNA, 201 bp, Bos taurus
gtcaggccagcatggggttcacaccaggacaggctgagctggaagaagtcacctggagagggattccgaggtcagcagcagtgatggccactccctcccacccgcctcaggcagcagaatgaacattttgcagccacatacctcatgccagggactgtctgtacataaacccagtcctcacggcaggtaaagtgttcttac

SEQ ID NO: 53612 - DNA, 201 bp, Bos taurus; identical to SEQ ID NO: 12561

SEQ ID NO: 53613 - DNA, 201 bp, Bos taurus; identical to SEQ ID NO: 12563

SEQ ID NO: 53614 - DNA, 201 bp, Bos taurus; identical to SEQ ID NO: 12564

SEQ ID NO: 53615 - DNA, 201 bp, Bos taurus; identical to SEQ ID NO: 12565

SEQ ID NO: 53616 - DNA, 201 bp, Bos taurus; identical to SEQ ID NO: 12568

SEQ ID NO: 53617 - DNA, 201 bp, Bos taurus
gtatactaagggtcgtgttacatgtaatactaattggcagaccaaacatctgccggaggcagaaggctgtagtgtgatgtctggactctaaattccatacttaggccctcaaggttggagatcctctgaaggcaggactgcttattggaagggtctttcacccacttaatgctgtttgctccctctcctttactactgttg

SEQ ID NO: 53618 - DNA, 201 bp, Bos taurus; identical to SEQ ID NO: 12570

SEQ ID NO: 53619 - DNA, 201 bp, Bos taurus; identical to SEQ ID NO: 12571

SEQ ID NO: 53620 - DNA, 201 bp, Bos taurus
caaatgtcagacgcagagggcccaagcttttccagcacagcccacagctggaaatggtacaagcctcatattcattctttgtgttggagaagaggtttccagaccttgttcatgacttactgaatgattcaaaatctggagctccgtgctggtgtcagcatgtttccacatccattagtgctggggaaatgctgcccccag

SEQ ID NO: 53621 - DNA, 201 bp, Bos taurus; identical to SEQ ID NO: 12572

SEQ ID NO: 53622 - DNA, 201 bp, Bos taurus; identical to SEQ ID NO: 12573

SEQ ID NO: 53623 - DNA, 201 bp, Bos taurus; identical to SEQ ID NO: 12574

SEQ ID NO: 53624 - DNA, 201 bp, Bos taurus; identical to SEQ ID NO: 12575

SEQ ID NO: 53625 - DNA, 201 bp, Bos taurus; identical to SEQ ID NO: 12576

SEQ ID NO: 53626 - DNA, 201 bp, Bos taurus
tttttttctcttgcctggcataaacatttttgttttaatttttggcttttgatttattttttcacaggacagctattgtatttggacttatcaattatattgtattttctaatgttaatttccatttttagtgttaacttttttcaaccctttgttctagatttgccttatttattcagtcagtcgtttatagctgtttga

SEQ ID NO: 53627 - DNA, 201 bp, Bos taurus; identical to SEQ ID NO: 12577

SEQ ID NO: 53628 - DNA, 201 bp, Bos taurus; identical to SEQ ID NO: 12578

SEQ ID NO: 53629 - DNA, 201 bp, Bos taurus; identical to SEQ ID NO: 12579

SEQ ID NO: 53630 - DNA, 201 bp, Bos taurus; identical to SEQ ID NO: 12580

SEQ ID NO: 53631 - DNA, 201 bp, Bos taurus; identical to SEQ ID NO: 12582

SEQ ID NO: 53632 - DNA, 201 bp, Bos taurus
tcaaaatattttttgttggacttagaatcaagaagagtaaataatgtagctaacatttttaaagaaataactcccagcaaagatacaagaacattttagtaatccctactgtcatggcagattccatgttactggcttatattgttggctttcagaatttagtttctctttattgctgtttctttctcagctcacatttta

SEQ ID NO: 53633 - DNA, 201 bp, Bos taurus; identical to SEQ ID NO: 12583

SEQ ID NO: 53634 - DNA, 201 bp, Bos taurus; identical to SEQ ID NO: 12585

SEQ ID NO: 53635 - DNA, 201 bp, Bos taurus
ccaagatttcttgtttctccttcttgctacacagaattttttaatccagtgtgcacactgccatttcacagttgagtatatggcatcaagggtgacaaatcaggcagccgcaatcagaattacaggtatcgtgggactaattccattccttgccctgatttcaatgtgtttcccatatgatatgacggaagaggactgcgt

SEQ ID NO: 53636 - DNA, 201 bp, Bos taurus
tttctcttaatacattgagatttcattctgagggtttctcaccttcattgtttctgaatagtagtcagctgtccacctgttcctcctctgaaggtaaactatatgcttttcagatgttttcttgctctctcttttttgtttttgttttggctgttacacaattttagtgtgatatatcaagatacagatttactgtaattt

SEQ ID NO: 53637 - DNA, 201 bp, Bos taurus; identical to SEQ ID NO: 12586

SEQ ID NO: 53638 - DNA, 201 bp, Bos taurus
cctcatctagctttttgtttattggggggatttttaatgaggggggtgtggttaggggctcatgatcctccattactttcttttgcattattacatgaaccgtttcatcagggaaatagagaaactaattccagcagcttacaaagattgagtacaaaggggatagcttgggatccttagtccaccaccaacatacatagc

SEQ ID NO: 53639 - DNA, 201 bp, Bos taurus
tctcttgagaatgatcatattcctctggtctgtccatctgtgcaactcaatgcagtagaggtcagaggggagcccagagaggaccccaagacaaaatgacattggttaccggcttaagagactcaaagaactgtcctagaagagagcaaattctattctgagaataggtttttcaagaagaagcagattttccagtttcgg

SEQ ID NO: 53640 - DNA, 201 bp, Bos taurus; identical to SEQ ID NO: 12588

SEQ ID NO: 53641 - DNA, 201 bp, Bos taurus
caggtccggctaacctccagccaatcattaaccctgcccgaggccttcaggacactcacacactcgggaattttaggagcccggaaactcagagcaaagtttattttcagaacatggcctgaagaaggaagcaaaggataaacagggaccaaatgttttaattatttgaaatggtttccaccccaacaccattccccaagt

SEQ ID NO: 53642 - DNA, 201 bp, Bos taurus; identical to SEQ ID NO: 12589

SEQ ID NO: 53643 - DNA, 201 bp, Bos taurus
ctctgcctacagcttctgtgtccatcacccagctgcttctcttcccccttgttctgtatgggtggagctcgatcccccaatgatgggatacaccagaatttgagaccgtttcctctctgctcgagtagggttatcacaaaggaggggccagtcctcctcgcggtcagcctgaattgtcgctttgggaaagtcctgcatggg

SEQ ID NO: 53644 - DNA, 201 bp, Bos taurus; identical to SEQ ID NO: 12591

SEQ ID NO: 53645 - DNA, 201 bp, Bos taurus; identical to SEQ ID NO: 12592

SEQ ID NO: 53646 - DNA, 201 bp, Bos taurus; identical to SEQ ID NO: 12593

SEQ ID NO: 53647 - DNA, 201 bp, Bos taurus; identical to SEQ ID NO: 12595

SEQ ID NO: 53648 - DNA, 201 bp, Bos taurus; identical to SEQ ID NO: 12596

SEQ ID NO: 53649 - DNA, 201 bp, Bos taurus; identical to SEQ ID NO: 12598

SEQ ID NO: 53650 - DNA, 201 bp, Bos taurus
gcttggagacagggcctttacacaaggaatgcagtgaaaacgaccagtgtccctcgatgaagagggcgggacccaaacacacagagggtggaccacgtgcagacatggagaggacggccatccacaagccctatccttgcaacttttatctacatttgaaacattttcaaaacacagttaaaactttaaatatataggatg

SEQ ID NO: 53651 - DNA, 201 bp, Bos taurus; identical to SEQ ID NO: 12599

SEQ ID NO: 53652 - DNA, 201 bp, Bos taurus; identical to SEQ ID NO: 12602

SEQ ID NO: 53653 - DNA, 201 bp, Bos taurus; identical to SEQ ID NO: 12603

SEQ ID NO: 53654 - DNA, 201 bp, Bos taurus; identical to SEQ ID NO: 12604

SEQ ID NO: 53655 - DNA, 201 bp, Bos taurus; identical to SEQ ID NO: 12606

SEQ ID NO: 53656 - DNA, 201 bp, Bos taurus; identical to SEQ ID NO: 12607

SEQ ID NO: 53657 - DNA, 201 bp, Bos taurus; identical to SEQ ID NO: 12608

SEQ ID NO: 53658 - DNA, 201 bp, Bos taurus; identical to SEQ ID NO: 12609

SEQ ID NO: 53659 - DNA, 201 bp, Bos taurus; identical to SEQ ID NO: 12611

SEQ ID NO: 53660 - DNA, 201 bp, Bos taurus; identical to SEQ ID NO: 12612

SEQ ID NO: 53661 - DNA, 201 bp, Bos taurus
gcgcaggcagcccgggcagagggctcaccggggagcgtctgttgtcggttccagaccgagcgaagcgcctcggagttcgggccgcgcgggctgggcgggaagaaggtgaggggaaacaggacggatcagcgttcttagttcttaacaatttccaaagaaggtgggagtgacaaagggacgccggaggccgccgccgccgcc

SEQ ID NO: 53662 - DNA, 201 bp, Bos taurus
tgttgctggttacccttgttgccatctttgtggctgtcatccttactgctgctccctgaccttgaagtcctactatgtgaacttctaaggttgtggaaccaaaaggaacttcaggaaaccatgacctagctcaagcttgataggctgataagcctgtgtgccactgcttttgagaaatcttcttgaagggcactggatcaa

SEQ ID NO: 53663 - DNA, 201 bp, Bos taurus; identical to SEQ ID NO: 12614

SEQ ID NO: 53664 - DNA, 201 bp, Bos taurus; identical to SEQ ID NO: 12615

SEQ ID NO: 53665 - DNA, 201 bp, Bos taurus; identical to SEQ ID NO: 12616

SEQ ID NO: 53666 - DNA, 201 bp, Bos taurus; identical to SEQ ID NO: 12617

SEQ ID NO: 53667 - DNA, 201 bp, Bos taurus; identical to SEQ ID NO: 12618

SEQ ID NO: 53668 - DNA, 201 bp, Bos taurus; identical to SEQ ID NO: 12619

SEQ ID NO: 53669 - DNA, 201 bp, Bos taurus; identical to SEQ ID NO: 12620

SEQ ID NO: 53670 - DNA, 201 bp, Bos taurus; identical to SEQ ID NO: 12621

SEQ ID NO: 53671 - DNA, 201 bp, Bos taurus; identical to SEQ ID NO: 12622

SEQ ID NO: 53672 - DNA, 201 bp, Bos taurus; identical to SEQ ID NO: 12623

SEQ ID NO: 53673 - DNA, 201 bp, Bos taurus; identical to SEQ ID NO: 12624

SEQ ID NO: 53674 - DNA, 201 bp, Bos taurus; identical to SEQ ID NO: 12625

SEQ ID NO: 53675 - DNA, 201 bp, Bos taurus; identical to SEQ ID NO: 12626

SEQ ID NO: 53676 - DNA, 201 bp, Bos taurus; identical to SEQ ID NO: 12627

SEQ ID NO: 53677 - DNA, 201 bp, Bos taurus; identical to SEQ ID NO: 12628

SEQ ID NO: 53678 - DNA, 201 bp, Bos taurus; identical to SEQ ID NO: 12629

SEQ ID NO: 53679 - DNA, 201 bp, Bos taurus; identical to SEQ ID NO: 12630

SEQ ID NO: 53680 - DNA, 201 bp, Bos taurus; identical to SEQ ID NO: 12631

SEQ ID NO: 53681 - DNA, 201 bp, Bos taurus; identical to SEQ ID NO: 12632

SEQ ID NO: 53682 - DNA, 201 bp, Bos taurus; identical to SEQ ID NO: 12633

SEQ ID NO: 53683 - DNA, 201 bp, Bos taurus; identical to SEQ ID NO: 12634

SEQ ID NO: 53684 - DNA, 201 bp, Bos taurus; identical to SEQ ID NO: 12635

SEQ ID NO: 53685 - DNA, 201 bp, Bos taurus; identical to SEQ ID NO: 12636

SEQ ID NO: 53686 - DNA, 201 bp, Bos taurus; identical to SEQ ID NO: 12637

SEQ ID NO: 53687 - DNA, 201 bp, Bos taurus; identical to SEQ ID NO: 12638

SEQ ID NO: 53688 - DNA, 201 bp, Bos taurus; identical to SEQ ID NO: 12639

SEQ ID NO: 53689 - DNA, 201 bp, Bos taurus; identical to SEQ ID NO: 12640

SEQ ID NO: 53690 - DNA, 201 bp, Bos taurus; identical to SEQ ID NO: 12641

SEQ ID NO: 53691 - DNA, 201 bp, Bos taurus; identical to SEQ ID NO: 12644

SEQ ID NO: 53692 - DNA, 201 bp, Bos taurus; identical to SEQ ID NO: 12645

SEQ ID NO: 53693 - DNA, 201 bp, Bos taurus; identical to SEQ ID NO: 12646

SEQ ID NO: 53694 - DNA, 201 bp, Bos taurus; identical to SEQ ID NO: 12647

SEQ ID NO: 53695 - DNA, 201 bp, Bos taurus; identical to SEQ ID NO: 12649

SEQ ID NO: 53696 - DNA, 201 bp, Bos taurus; identical to SEQ ID NO: 12651

SEQ ID NO: 53697 - DNA, 201 bp, Bos taurus; identical to SEQ ID NO: 12652

SEQ ID NO: 53698 - DNA, 201 bp, Bos taurus; identical to SEQ ID NO: 12653

SEQ ID NO: 53699 - DNA, 201 bp, Bos taurus; identical to SEQ ID NO: 12654

SEQ ID NO: 53700 - DNA, 201 bp, Bos taurus; identical to SEQ ID NO: 12655

SEQ ID NO: 53701 - DNA, 201 bp, Bos taurus; identical to SEQ ID NO: 12657

SEQ ID NO: 53702 - DNA, 201 bp, Bos taurus; identical to SEQ ID NO: 12659

SEQ ID NO: 53703 - DNA, 201 bp, Bos taurus; identical to SEQ ID NO: 12662

SEQ ID NO: 53704 - DNA, 201 bp, Bos taurus; identical to SEQ ID NO: 12664

SEQ ID NO: 53705 - DNA, 201 bp, Bos taurus; identical to SEQ ID NO: 12668

SEQ ID NO: 53706 - DNA, 201 bp, Bos taurus; identical to SEQ ID NO: 12671

SEQ ID NO: 53707 - DNA, 201 bp, Bos taurus; identical to SEQ ID NO: 12672

SEQ ID NO: 53708 - DNA, 201 bp, Bos taurus; identical to SEQ ID NO: 12674

SEQ ID NO: 53709 - DNA, 201 bp, Bos taurus; identical to SEQ ID NO: 12675

SEQ ID NO: 53710 - DNA, 201 bp, Bos taurus; identical to SEQ ID NO: 12676

SEQ ID NO: 53711 - DNA, 201 bp, Bos taurus; identical to SEQ ID NO: 12677

SEQ ID NO: 53712 - DNA, 201 bp, Bos taurus; identical to SEQ ID NO: 12678

SEQ ID NO: 53713 - DNA, 201 bp, Bos taurus; identical to SEQ ID NO: 12679

SEQ ID NO: 53714 - DNA, 201 bp, Bos taurus; identical to SEQ ID NO: 12680

SEQ ID NO: 53715 - DNA, 201 bp, Bos taurus; identical to SEQ ID NO: 12684

SEQ ID NO: 53716 - DNA, 201 bp, Bos taurus; identical to SEQ ID NO: 12685

SEQ ID NO: 53717 - DNA, 201 bp, Bos taurus; identical to SEQ ID NO: 12686

SEQ ID NO: 53718 - DNA, 201 bp, Bos taurus; identical to SEQ ID NO: 12687

SEQ ID NO: 53719 - DNA, 201 bp, Bos taurus; identical to SEQ ID NO: 12692

SEQ ID NO: 53720 - DNA, 201 bp, Bos taurus; identical to SEQ ID NO: 12693

SEQ ID NO: 53721 - DNA, 201 bp, Bos taurus; identical to SEQ ID NO: 12694

SEQ ID NO: 53722 - DNA, 201 bp, Bos taurus; identical to SEQ ID NO: 12695

SEQ ID NO: 53723 - DNA, 201 bp, Bos taurus; identical to SEQ ID NO: 12700

SEQ ID NO: 53724 - DNA, 201 bp, Bos taurus; identical to SEQ ID NO: 12701

SEQ ID NO: 53725 - DNA, 201 bp, Bos taurus; identical to SEQ ID NO: 12702

SEQ ID NO: 53726 - DNA, 201 bp, Bos taurus; identical to SEQ ID NO: 12703

SEQ ID NO: 53727 - DNA, 201 bp, Bos taurus; identical to SEQ ID NO: 12705

SEQ ID NO: 53728 - DNA, 201 bp, Bos taurus; identical to SEQ ID NO: 12710

SEQ ID NO: 53729 - DNA, 201 bp, Bos taurus; identical to SEQ ID NO: 12711

SEQ ID NO: 53730 - DNA, 201 bp, Bos taurus; identical to SEQ ID NO: 12712

SEQ ID NO: 53731 - DNA, 201 bp, Bos taurus; identical to SEQ ID NO: 12713

SEQ ID NO: 53732 - DNA, 201 bp, Bos taurus; identical to SEQ ID NO: 12714

SEQ ID NO: 53733 - DNA, 201 bp, Bos taurus; identical to SEQ ID NO: 12715

SEQ ID NO: 53734 - DNA, 201 bp, Bos taurus; identical to SEQ ID NO: 12716

SEQ ID NO: 53735 - DNA, 201 bp, Bos taurus; identical to SEQ ID NO: 12717

SEQ ID NO: 53736 - DNA, 201 bp, Bos taurus; identical to SEQ ID NO: 12718

SEQ ID NO: 53737 - DNA, 201 bp, Bos taurus; identical to SEQ ID NO: 12724

SEQ ID NO: 53738 - DNA, 201 bp, Bos taurus; identical to SEQ ID NO: 12725

SEQ ID NO: 53739 - DNA, 201 bp, Bos taurus; identical to SEQ ID NO: 12726

SEQ ID NO: 53740 - DNA, 201 bp, Bos taurus; identical to SEQ ID NO: 12727

SEQ ID NO: 53741 - DNA, 201 bp, Bos taurus; identical to SEQ ID NO: 12728

SEQ ID NO: 53742 - DNA, 201 bp, Bos taurus; identical to SEQ ID NO: 12729

SEQ ID NO: 53743 - DNA, 201 bp, Bos taurus; identical to SEQ ID NO: 12730

SEQ ID NO: 53744 - DNA, 201 bp, Bos taurus; identical to SEQ ID NO: 12731

SEQ ID NO: 53745 - DNA, 201 bp, Bos taurus; identical to SEQ ID NO: 12732

SEQ ID NO: 53746 - DNA, 201 bp, Bos taurus; identical to SEQ ID NO: 12733

SEQ ID NO: 53747 - DNA, 201 bp, Bos taurus; identical to SEQ ID NO: 12734

SEQ ID NO: 53748 - DNA, 201 bp, Bos taurus; identical to SEQ ID NO: 12735

SEQ ID NO: 53749 - DNA, 201 bp, Bos taurus; identical to SEQ ID NO: 12738

SEQ ID NO: 53750 - DNA, 201 bp, Bos taurus; identical to SEQ ID NO: 12739

SEQ ID NO: 53751 - DNA, 201 bp, Bos taurus; identical to SEQ ID NO: 12740

SEQ ID NO: 53752 - DNA, 201 bp, Bos taurus; identical to SEQ ID NO: 12741

SEQ ID NO: 53753 - DNA, 201 bp, Bos taurus; identical to SEQ ID NO: 12742

SEQ ID NO: 53754 - DNA, 201 bp, Bos taurus; identical to SEQ ID NO: 12743

SEQ ID NO: 53755 - DNA, 201 bp, Bos taurus; identical to SEQ ID NO: 12744

SEQ ID NO: 53756 - DNA, 201 bp, Bos taurus; identical to SEQ ID NO: 12745

SEQ ID NO: 53757 - DNA, 201 bp, Bos taurus; identical to SEQ ID NO: 12746

SEQ ID NO: 53758 - DNA, 201 bp, Bos taurus; identical to SEQ ID NO: 12749

SEQ ID NO: 53759 - DNA, 201 bp, Bos taurus; identical to SEQ ID NO: 12750

SEQ ID NO: 53760 - DNA, 201 bp, Bos taurus; identical to SEQ ID NO: 12751

SEQ ID NO: 53761 - DNA, 201 bp, Bos taurus; identical to SEQ ID NO: 12752

SEQ ID NO: 53762 - DNA, 201 bp, Bos taurus; identical to SEQ ID NO: 12753

SEQ ID NO: 53763 - DNA, 201 bp, Bos taurus; identical to SEQ ID NO: 12754

SEQ ID NO: 53764 - DNA, 201 bp, Bos taurus; identical to SEQ ID NO: 12755

SEQ ID NO: 53765 - DNA, 201 bp, Bos taurus; identical to SEQ ID NO: 12757

SEQ ID NO: 53766 - DNA, 201 bp, Bos taurus; identical to SEQ ID NO: 12758

SEQ ID NO: 53767 - DNA, 201 bp, Bos taurus; identical to SEQ ID NO: 12759

SEQ ID NO: 53768 - DNA, 201 bp, Bos taurus; identical to SEQ ID NO: 12760

SEQ ID NO: 53769 - DNA, 201 bp, Bos taurus
tagcaggtactgtgcatgttaataccttacgtctagcgtgcagcttccttatcctggttgacagaaggcagacaaggaatcgagatggaccctaagcaatcgctgctgcccaacagcactgaaactccatctccaacccgtgggtgagaagccctgcccaggacagcgcccaggggagcctcctcacaagggccaggtcac

SEQ ID NO: 53770 - DNA, 201 bp, Bos taurus; identical to SEQ ID NO: 12763

SEQ ID NO: 53771 - DNA, 201 bp, Bos taurus; identical to SEQ ID NO: 12770

SEQ ID NO: 53772 - DNA, 201 bp, Bos taurus; identical to SEQ ID NO: 12772

SEQ ID NO: 53773 - DNA, 201 bp, Bos taurus; identical to SEQ ID NO: 12773

SEQ ID NO: 53774 - DNA, 201 bp, Bos taurus; identical to SEQ ID NO: 12775

SEQ ID NO: 53775 - DNA, 201 bp, Bos taurus; identical to SEQ ID NO: 12776

SEQ ID NO: 53776 - DNA, 201 bp, Bos taurus; identical to SEQ ID NO: 12777

SEQ ID NO: 53777 - DNA, 201 bp, Bos taurus
tcgccgttaagatgcatttctcacactgcacttctttttccgcttagataaaaatgcaaatttcttagcgtggcttgccctggccctcttctcgggctaagctccttttttttaaaaatatttttgttgtagttgatttaccatgttgtgtcagtttctatgttgtagccacgcgttccgggaaacaaactcgctcagaag

SEQ ID NO: 53778 - DNA, 201 bp, Bos taurus; identical to SEQ ID NO: 12778

SEQ ID NO: 53779 - DNA, 201 bp, Bos taurus; identical to SEQ ID NO: 12779

SEQ ID NO: 53780 - DNA, 201 bp, Bos taurus; identical to SEQ ID NO: 12780

SEQ ID NO: 53781 - DNA, 201 bp, Bos taurus; identical to SEQ ID NO: 12781

SEQ ID NO: 53782 - DNA, 201 bp, Bos taurus; identical to SEQ ID NO: 12782

SEQ ID NO: 53783 - DNA, 201 bp, Bos taurus; identical to SEQ ID NO: 12783

SEQ ID NO: 53784 - DNA, 201 bp, Bos taurus; identical to SEQ ID NO: 12784

SEQ ID NO: 53785 - DNA, 201 bp, Bos taurus
tctgtgtcgcagctgctcctcttttgcatgaaagcatcccagacggtacctaaggatgactgtggctgtatcaacacacccttatttacacaaacaggcttggggctggatggccatagtctgcccacctctgacctggagaattttctgtaccagctcctgcagtacataaagtcaagctgctctctcacaaaagggcag

SEQ ID NO: 53786 - DNA, 201 bp, Bos taurus; identical to SEQ ID NO: 12785

SEQ ID NO: 53787 - DNA, 201 bp, Bos taurus; identical to SEQ ID NO: 12786

SEQ ID NO: 53788 - DNA, 201 bp, Bos taurus; identical to SEQ ID NO: 12788

SEQ ID NO: 53789 - DNA, 201 bp, Bos taurus; identical to SEQ ID NO: 12789

SEQ ID NO: 53790 - DNA, 201 bp, Bos taurus; identical to SEQ ID NO: 12791

SEQ ID NO: 53791 - DNA, 201 bp, Bos taurus
ccctcctgggacaccaccaactccagatgtctctgggagtctgtggtggccccattccagactctgtaccccacctggctcacctcctttctcatcatccgctctgagaggggaggggggccagggaggaaaagtcctcatcaagctccatgtggaagaggggagcaggaagagtttcagtggactaacccttgtagggtt

SEQ ID NO: 53792 - DNA, 201 bp, Bos taurus
ataaccaacgtttttcctatttttaaaaagcatatattcttggtcttgtggctttttctctcctcaacttctggcttactttttcctcttaatttcatttctttatacttttcttccagttcttcattccgtatagcatatgttacttactatgacttttgtgaggcttccattcttcttccgtgtctagttatttccccc

SEQ ID NO: 53793 - DNA, 201 bp, Bos taurus; identical to SEQ ID NO: 12793

SEQ ID NO: 53794 - DNA, 201 bp, Bos taurus
tgcagctcttggctgttttgactcatccacaacctcgaagggaccttgaaggactgagaaagctgggcagacccccaagatgccacttgggccttaaccaatgtgcttctgtcagaaagggggacactgaaagggggatgtcttgagagccctcctgggggacacccaaggggtaaccccggccaaccccagttctttgtg

SEQ ID NO: 53795 - DNA, 201 bp, Bos taurus
tcgtggccccaaaagctgagtccccccagaacacataaaacagggccgttgtctggggaaacgtctctgtagatgtagttaaggatctcaaggtgaggtcgtctccggttaaggtggccctcaatccaactgaccagttccttatgagacaaatgaggaaagacagaggagaagccacgtgaagacagaggcagagacggg

SEQ ID NO: 53796 - DNA, 201 bp, Bos taurus
acactttcgttgcagtggcccaacttaaatccatatatctgagtcactttgctgtgcagcagaaattagtgtaatattgtaaatccaatataactcttgcgtcttgagtattggcctttgcagcagtgagcagctgaacttgggtttggtaccagccttgtccagttacactaaattcttttagtaaaaattttcattgcc

SEQ ID NO: 53797 - DNA, 201 bp, Bos taurus; identical to SEQ ID NO: 12795

SEQ ID NO: 53798 - DNA, 201 bp, Bos taurus; identical to SEQ ID NO: 12796

SEQ ID NO: 53799 - DNA, 201 bp, Bos taurus; identical to SEQ ID NO: 12798

SEQ ID NO: 53800 - DNA, 201 bp, Bos taurus; identical to SEQ ID NO: 12799

SEQ ID NO: 53801 - DNA, 201 bp, Bos taurus; identical to SEQ ID NO: 12800

SEQ ID NO: 53802 - DNA, 201 bp, Bos taurus; identical to SEQ ID NO: 12804

SEQ ID NO: 53803 - DNA, 201 bp, Bos taurus; identical to SEQ ID NO: 12808

SEQ ID NO: 53804 - DNA, 201 bp, Bos taurus; identical to SEQ ID NO: 12809

SEQ ID NO: 53805 - DNA, 201 bp, Bos taurus; identical to SEQ ID NO: 12810

SEQ ID NO: 53806 - DNA, 201 bp, Bos taurus; identical to SEQ ID NO: 12811

SEQ ID NO: 53807 - DNA, 201 bp, Bos taurus; identical to SEQ ID NO: 12816

SEQ ID NO: 53808 - DNA, 201 bp, Bos taurus; identical to SEQ ID NO: 12817

SEQ ID NO: 53809 - DNA, 201 bp, Bos taurus; identical to SEQ ID NO: 12819

SEQ ID NO: 53810 - DNA, 201 bp, Bos taurus; identical to SEQ ID NO: 12820

SEQ ID NO: 53811 - DNA, 201 bp, Bos taurus; identical to SEQ ID NO: 12821

SEQ ID NO: 53812 - DNA, 201 bp, Bos taurus; identical to SEQ ID NO: 12823

SEQ ID NO: 53813 - DNA, 201 bp, Bos taurus; identical to SEQ ID NO: 12825

SEQ ID NO: 53814 - DNA, 201 bp, Bos taurus; identical to SEQ ID NO: 12827

SEQ ID NO: 53815 - DNA, 201 bp, Bos taurus; identical to SEQ ID NO: 12828

SEQ ID NO: 53816 - DNA, 201 bp, Bos taurus; identical to SEQ ID NO: 12830

SEQ ID NO: 53817 - DNA, 201 bp, Bos taurus; identical to SEQ ID NO: 12831

SEQ ID NO: 53818 - DNA, 201 bp, Bos taurus; identical to SEQ ID NO: 12833

SEQ ID NO: 53819 - DNA, 201 bp, Bos taurus; identical to SEQ ID NO: 12834

SEQ ID NO: 53820 - DNA, 201 bp, Bos taurus; identical to SEQ ID NO: 12835

SEQ ID NO: 53821 - DNA, 201 bp, Bos taurus; identical to SEQ ID NO: 12837

SEQ ID NO: 53822 - DNA, 201 bp, Bos taurus; identical to SEQ ID NO: 12838

SEQ ID NO: 53823 - DNA, 201 bp, Bos taurus; identical to SEQ ID NO: 12839

SEQ ID NO: 53824 - DNA, 201 bp, Bos taurus; identical to SEQ ID NO: 12840

SEQ ID NO: 53825 - DNA, 201 bp, Bos taurus; identical to SEQ ID NO: 12844

SEQ ID NO: 53826 - DNA, 201 bp, Bos taurus; identical to SEQ ID NO: 12846

SEQ ID NO: 53827 - DNA, 201 bp, Bos taurus; identical to SEQ ID NO: 12847

SEQ ID NO: 53828 - DNA, 201 bp, Bos taurus; identical to SEQ ID NO: 12849

SEQ ID NO: 53829 - DNA, 201 bp, Bos taurus; identical to SEQ ID NO: 12850

SEQ ID NO: 53830 - DNA, 201 bp, Bos taurus; identical to SEQ ID NO: 12851

SEQ ID NO: 53831 - DNA, 201 bp, Bos taurus; identical to SEQ ID NO: 12854

SEQ ID NO: 53832 - DNA, 201 bp, Bos taurus; identical to SEQ ID NO: 12855

SEQ ID NO: 53833 - DNA, 201 bp, Bos taurus; identical to SEQ ID NO: 12856

SEQ ID NO: 53834 - DNA, 201 bp, Bos taurus; identical to SEQ ID NO: 12857

SEQ ID NO: 53835 - DNA, 201 bp, Bos taurus; identical to SEQ ID NO: 12858

SEQ ID NO: 53836 - DNA, 201 bp, Bos taurus; identical to SEQ ID NO: 12859

SEQ ID NO: 53837 - DNA, 201 bp, Bos taurus; identical to SEQ ID NO: 12862

SEQ ID NO: 53838 - DNA, 201 bp, Bos taurus; identical to SEQ ID NO: 12864

SEQ ID NO: 53839 - DNA, 201 bp, Bos taurus; identical to SEQ ID NO: 12865

SEQ ID NO: 53840 - DNA, 201 bp, Bos taurus
atgacctcatttttataaccttccttattataaattatccctccatcacagcagggaccagcatggctttttacaaccatttagcggcagcgtactcctctgaggcccaagtcaccatggaaacttccccagtatacagttctagagacatccgtgtacaccaaatgggcaaccaacattttcaagaatgactgccctcag

SEQ ID NO: 53841 - DNA, 201 bp, Bos taurus
ctcgctccagcccagggtcttcaaaacaaagccatggagaaagaaaaaccagtctgtcaggaccttttggaagtcacatttcaggccaaagcaagctcccaaggagtctgtgtgccccataccctccactaggaaagctgaaaagtaggaagggacagacaaggccttgcatatcaaggtcccagaggggagcggtcccca

SEQ ID NO: 53842 - DNA, 201 bp, Bos taurus; identical to SEQ ID NO: 12868

SEQ ID NO: 53843 - DNA, 201 bp, Bos taurus; identical to SEQ ID NO: 12869

SEQ ID NO: 53844 - DNA, 201 bp, Bos taurus; identical to SEQ ID NO: 12870

SEQ ID NO: 53845 - DNA, 201 bp, Bos taurus; identical to SEQ ID NO: 12871

SEQ ID NO: 53846 - DNA, 201 bp, Bos taurus; identical to SEQ ID NO: 12873

SEQ ID NO: 53847 - DNA, 201 bp, Bos taurus; identical to SEQ ID NO: 12875

SEQ ID NO: 53848 - DNA, 201 bp, Bos taurus; identical to SEQ ID NO: 12876

SEQ ID NO: 53849 - DNA, 201 bp, Bos taurus; identical to SEQ ID NO: 12877

SEQ ID NO: 53850 - DNA, 201 bp, Bos taurus; identical to SEQ ID NO: 12879

SEQ ID NO: 53851 - DNA, 201 bp, Bos taurus; identical to SEQ ID NO: 12880

SEQ ID NO: 53852 - DNA, 201 bp, Bos taurus
gttgatgtcattccatttcttctgaaggagtaagactacgctccactctcaccccagggttttttctcctttcttccacccagggccaagaccctggctctgagaaggctgtgggcagctaggactctggctcacttccaccatctctaggggtgtgggtccagcttggcctgggacagactggagagaggatgctttcag

SEQ ID NO: 53853 - DNA, 201 bp, Bos taurus
ctcacaataataatgccactaataatagctattaggaaactgaatctctttttaaaaagacagctttatcgagctttacctgacacattatacaaaccatccttttgaagtgtataaatcaatgtgcatcaagtcttctaatacataatttaacattatccagcaccctttaagggctgtgacgacgtaaggttctagggt

SEQ ID NO: 53854 - DNA, 201 bp, Bos taurus; identical to SEQ ID NO: 12881

SEQ ID NO: 53855 - DNA, 201 bp, Bos taurus; identical to SEQ ID NO: 12884

SEQ ID NO: 53856 - DNA, 201 bp, Bos taurus; identical to SEQ ID NO: 12886

SEQ ID NO: 53857 - DNA, 201 bp, Bos taurus; identical to SEQ ID NO: 12887

SEQ ID NO: 53858 - DNA, 201 bp, Bos taurus; identical to SEQ ID NO: 12888

SEQ ID NO: 53859 - DNA, 201 bp, Bos taurus; identical to SEQ ID NO: 12889

SEQ ID NO: 53860 - DNA, 201 bp, Bos taurus; identical to SEQ ID NO: 12891

SEQ ID NO: 53861 - DNA, 201 bp, Bos taurus
cagtgagcatttgtttggaggaagtgtagggaatgagagaacattcacaggttccagcatttattgaactcttactatatcccaggccacgctgggctctgacatcatctgtctccagttcacaacgacctcaaaaggtaggtactcttattacctccttcttcagaaaaaggtgcccctcacaggtggccacaaagggag

SEQ ID NO: 53862 - DNA, 201 bp, Bos taurus
ctggaggtattagccatgggtcaagttcggaggtcagaggtcaaacaggttgtcatcagtttctcacagctatcagagcaagggcaggggaggggccaaacaaaacccaccaacaacacagctggttcttattagccaaatcctgcctccctgtaaagagagatgggtcagtcaggtccacacccaccccagggacacccc

SEQ ID NO: 53863 - DNA, 201 bp, Bos taurus; identical to SEQ ID NO: 12892

SEQ ID NO: 53864 - DNA, 201 bp, Bos taurus; identical to SEQ ID NO: 12894

SEQ ID NO: 53865 - DNA, 201 bp, Bos taurus; identical to SEQ ID NO: 12895

SEQ ID NO: 53866 - DNA, 201 bp, Bos taurus; identical to SEQ ID NO: 12896

SEQ ID NO: 53867 - DNA, 201 bp, Bos taurus; identical to SEQ ID NO: 12898

SEQ ID NO: 53868 - DNA, 201 bp, Bos taurus; identical to SEQ ID NO: 12900

SEQ ID NO: 53869 - DNA, 201 bp, Bos taurus; identical to SEQ ID NO: 12902

SEQ ID NO: 53870 - DNA, 201 bp, Bos taurus; identical to SEQ ID NO: 12903

SEQ ID NO: 53871 - DNA, 201 bp, Bos taurus; identical to SEQ ID NO: 12904

SEQ ID NO: 53872 - DNA, 201 bp, Bos taurus; identical to SEQ ID NO: 12905

SEQ ID NO: 53873 - DNA, 201 bp, Bos taurus; identical to SEQ ID NO: 12906

SEQ ID NO: 53874 - DNA, 201 bp, Bos taurus; identical to SEQ ID NO: 12908

SEQ ID NO: 53875 - DNA, 201 bp, Bos taurus; identical to SEQ ID NO: 12909

SEQ ID NO: 53876 - DNA, 201 bp, Bos taurus; identical to SEQ ID NO: 12910

SEQ ID NO: 53877 - DNA, 201 bp, Bos taurus; identical to SEQ ID NO: 12911

SEQ ID NO: 53878 - DNA, 201 bp, Bos taurus; identical to SEQ ID NO: 12912

SEQ ID NO: 53879 - DNA, 201 bp, Bos taurus
cctcatttccagtctcctctcatgatggcctgacccctgctatttctctcccgcatatacactcccatctcttcctgcagcggttccatgcacattgcagcgtttggccagcctcacaggatgcttgctgcctgccagctcttataccacaggctgttgttgctccttcagacaggattctgcctgcttctgatgaaatcc

SEQ ID NO: 53880 - DNA, 201 bp, Bos taurus; identical to SEQ ID NO: 12913

SEQ ID NO: 53881 - DNA, 201 bp, Bos taurus; identical to SEQ ID NO: 12914

SEQ ID NO: 53882 - DNA, 201 bp, Bos taurus; identical to SEQ ID NO: 12915

SEQ ID NO: 53883 - DNA, 201 bp, Bos taurus; identical to SEQ ID NO: 12916

SEQ ID NO: 53884 - DNA, 201 bp, Bos taurus; identical to SEQ ID NO: 12917

SEQ ID NO: 53885 - DNA, 201 bp, Bos taurus
agcccggctcctcatctacgtagctgctctctgttcccacacccctgtgcttccctgtgtaatgacatccaccatgctggactataatggccaacctacctgtccattctccccatagactgtgagcctagccctggctgtggcacttcacgagcactcaatatggtttctgtgcagtcgcttattcaatgaactgatgtc

SEQ ID NO: 53886 - DNA, 201 bp, Bos taurus; identical to SEQ ID NO: 12919

SEQ ID NO: 53887 - DNA, 201 bp, Bos taurus; identical to SEQ ID NO: 12923

SEQ ID NO: 53888 - DNA, 201 bp, Bos taurus; identical to SEQ ID NO: 12924

SEQ ID NO: 53889 - DNA, 201 bp, Bos taurus; identical to SEQ ID NO: 12925

SEQ ID NO: 53890 - DNA, 201 bp, Bos taurus
tattgacatctcacagtccacctagaattgatttttgtgtatgtgcaaggcaacagctcagggtttatttttttcccatataaacaattggcccaacatcgcatattgaaaagaccatctttccccacttgctcttcagcactacatttgttataaatcagagtggccatatgtctctttctagtttctctactccgttct

SEQ ID NO: 53891 - DNA, 201 bp, Bos taurus
cctaggaaactactgtttcgtgggtccgattgtgtaggtcacatgacgctgaggtgaggtttctttgtctctggtgtttgtaccagtggtttcccaggccagtttgctttgcagaggtgatgaaagtggctgacctgacttttggtttgtatctcatgctcagcagtgactacctgctggtagtaagcttttctgcccact

SEQ ID NO: 53892 - DNA, 201 bp, Bos taurus; identical to SEQ ID NO: 12929

SEQ ID NO: 53893 - DNA, 201 bp, Bos taurus; identical to SEQ ID NO: 12930

SEQ ID NO: 53894 - DNA, 201 bp, Bos taurus; identical to SEQ ID NO: 12931

SEQ ID NO: 53895 - DNA, 201 bp, Bos taurus; identical to SEQ ID NO: 12932

SEQ ID NO: 53896 - DNA, 201 bp, Bos taurus; identical to SEQ ID NO: 12933

SEQ ID NO: 53897 - DNA, 201 bp, Bos taurus; identical to SEQ ID NO: 12935

SEQ ID NO: 53898 - DNA, 201 bp, Bos taurus; identical to SEQ ID NO: 12936

SEQ ID NO: 53899 - DNA, 201 bp, Bos taurus; identical to SEQ ID NO: 12938

SEQ ID NO: 53900 - DNA, 201 bp, Bos taurus; identical to SEQ ID NO: 12939

SEQ ID NO: 53901 - DNA, 201 bp, Bos taurus; identical to SEQ ID NO: 12941

SEQ ID NO: 53902 - DNA, 201 bp, Bos taurus; identical to SEQ ID NO: 12942

SEQ ID NO: 53903 - DNA, 201 bp, Bos taurus; identical to SEQ ID NO: 12943

SEQ ID NO: 53904 - DNA, 201 bp, Bos taurus; identical to SEQ ID NO: 12944

SEQ ID NO: 53905 - DNA, 201 bp, Bos taurus; identical to SEQ ID NO: 12946

SEQ ID NO: 53906 - DNA, 201 bp, Bos taurus; identical to SEQ ID NO: 12947

SEQ ID NO: 53907 - DNA, 201 bp, Bos taurus; identical to SEQ ID NO: 12948

SEQ ID NO: 53908 - DNA, 201 bp, Bos taurus; identical to SEQ ID NO: 12950

SEQ ID NO: 53909 - DNA, 201 bp, Bos taurus
gatatactaatttggaatatatttttgtaatgtaagattttttttcactaaacaagttttttaatagcttttaaaagtcactatagtttttttaaattaacatgttttgttttttttcccaagatatttatggtttaagattcaaaagctacaaaagggcttacaagattttttcttttatctgtttccctagtcactcag

SEQ ID NO: 53910 - DNA, 201 bp, Bos taurus; identical to SEQ ID NO: 12955

SEQ ID NO: 53911 - DNA, 201 bp, Bos taurus
tcaacctgagaaacggaagcggggcctgccccagctccctgccacccctcacttaaacagaccagtgcctgaactgaaggggcttagcagaagctgagccaatgctcagcacgccctggccaacgctccccaagcaggagcaagcaatagggtgtggtgaagagtcatcgtttatcttcctctctggatgcctctttaaaa

SEQ ID NO: 53912 - DNA, 201 bp, Bos taurus
gagagcaggagcctgggtgggctgtcaggggtccgggctccactcttcctgtgcagcttggataatcttcttcccttctctgtgtctcagtttccctctcttgagaggggttgggccaggtggtatctgagggtcactccatcctgagaccccagggagtgcctgtccttccagacctgggggcagcctcggccctccccc

SEQ ID NO: 53913 - DNA, 201 bp, Bos taurus; identical to SEQ ID NO: 12957

SEQ ID NO: 53914 - DNA, 201 bp, Bos taurus; identical to SEQ ID NO: 12958

SEQ ID NO: 53915 - DNA, 201 bp, Bos taurus
aaagtgctgaatcccaggcactggagccccagggaattcccatgactggttttttataaagtctggagatgatcagttgggaggtttagcatgccttctggccctcaagtccgcatcccatttgtcttccgcctcccttccctccaagaaagcaccatccaccaggccattgcttttttttttttttccaaaaacaccatt

SEQ ID NO: 53916 - DNA, 201 bp, Bos taurus; identical to SEQ ID NO: 12960

SEQ ID NO: 53917 - DNA, 201 bp, Bos taurus; identical to SEQ ID NO: 12965

SEQ ID NO: 53918 - DNA, 201 bp, Bos taurus
ccaggttgtgctgttaggccttgaacaagtaccagcaggcatgcccatcaaaggtttgtgttccagacactcctttgtgagttgctggtttggaacttgcggtgcattttcaacccacagaaggaaatgttgcaaatggtggttaacctcctaagctagtttacaaaacccttgtttaaccaaaagatactaaaacatcta

SEQ ID NO: 53919 - DNA, 201 bp, Bos taurus; identical to SEQ ID NO: 12967

SEQ ID NO: 53920 - DNA, 201 bp, Bos taurus
tgcctggacaagcccatgcacagaggggcctggagggctacagtccatggagtcgtgaaaaagtaggacacatctgagcgtgcacacaccatctgccagctctctcctgggcctcggtcattaactgtgtgccaggcagacttaagacagactctttcttgggcttctgtacaactcaacttgtgtacactctctagacac

SEQ ID NO: 53921 - DNA, 201 bp, Bos taurus; identical to SEQ ID NO: 12969

SEQ ID NO: 53922 - DNA, 201 bp, Bos taurus; identical to SEQ ID NO: 12971

SEQ ID NO: 53923 - DNA, 201 bp, Bos taurus
acaggcgggggtgggtcaaggtcgcggcccagggccccctcgcctcctaggtgcgtggtcttctgagcagtggaccccgctgcagcccaagccctcagcctcccaaggggcccttggccccgcctcacctcccacgcaggccaatgcagccttgaaggcacagctttccatcgccctctcgatcatcttctgctcctcact

SEQ ID NO: 53924 - DNA, 201 bp, Bos taurus; identical to SEQ ID NO: 12972

SEQ ID NO: 53925 - DNA, 201 bp, Bos taurus; identical to SEQ ID NO: 12973

SEQ ID NO: 53926 - DNA, 201 bp, Bos taurus; identical to SEQ ID NO: 12974

SEQ ID NO: 53927 - DNA, 201 bp, Bos taurus; identical to SEQ ID NO: 12975

SEQ ID NO: 53928 - DNA, 201 bp, Bos taurus; identical to SEQ ID NO: 12976

SEQ ID NO: 53929 - DNA, 201 bp, Bos taurus; identical to SEQ ID NO: 12977

SEQ ID NO: 53930 - DNA, 201 bp, Bos taurus; identical to SEQ ID NO: 12978

SEQ ID NO: 53931 - DNA, 201 bp, Bos taurus; identical to SEQ ID NO: 12983

SEQ ID NO: 53932 - DNA, 201 bp, Bos taurus; identical to SEQ ID NO: 12986

SEQ ID NO: 53933 - DNA, 201 bp, Bos taurus; identical to SEQ ID NO: 12987

SEQ ID NO: 53934 - DNA, 201 bp, Bos taurus
gagggccgccctcagccccgcccttgaccccgccctgcgccctgccctggcccacctgcgtcttgtagatggtgtagccttccttctcatgctgcagggcggagcggaactcggctttgctctcatagacccgggcgaccaggtggtggctgtagggaggcagggcgcagggtggggggcgagggagggcgtgaacgggcc

SEQ ID NO: 53935 - DNA, 201 bp, Bos taurus
caccaggcctagtctgggaggtgaccctcgcttagcctcctctgtccctctctttgctagtctgagggcagcctcctccaccccaaaccttcccctttcccgaagacaacaaggaggcctgagtgcccgctgttgggggagcagaaagtcacgctcctgctttgtcccctggctctttgctttgcatccctcaaaacccca

SEQ ID NO: 53936 - DNA, 201 bp, Bos taurus; identical to SEQ ID NO: 12988

SEQ ID NO: 53937 - DNA, 201 bp, Bos taurus; identical to SEQ ID NO: 12989

SEQ ID NO: 53938 - DNA, 201 bp, Bos taurus; identical to SEQ ID NO: 12990

SEQ ID NO: 53939 - DNA, 201 bp, Bos taurus
tttgaactgcaccttggaccaatggaaggccccctgcattgccacgcagcctttttcagacatggttcctcatctggaccactggatatggaaaatgaccgagtggccactgttttcttaattctcccaaggatggtgggtctagttccattctaggtgcttaggagatcgtggcatgtaacgggtgctgtcctagctcaa

SEQ ID NO: 53940 - DNA, 201 bp, Bos taurus; identical to SEQ ID NO: 12991

SEQ ID NO: 53941 - DNA, 201 bp, Bos taurus; identical to SEQ ID NO: 12992

SEQ ID NO: 53942 - DNA, 201 bp, Bos taurus
caggcatcagctgggtggggatgaaggtgatgcgcatgcgggataaaagcaataggaagttctatgggagaccacaaaagaatcaagccaggggcttgtgaacctggaaataattccgaatgtagagcacactatggagcagggctaaccggatacagttagaaaggttaaactgcaagaggctgggatggaagagtagca

SEQ ID NO: 53943 - DNA, 201 bp, Bos taurus; identical to SEQ ID NO: 12995

SEQ ID NO: 53944 - DNA, 201 bp, Bos taurus; identical to SEQ ID NO: 12997

SEQ ID NO: 53945 - DNA, 201 bp, Bos taurus; identical to SEQ ID NO: 13000

SEQ ID NO: 53946 - DNA, 201 bp, Bos taurus; identical to SEQ ID NO: 13001

SEQ ID NO: 53947 - DNA, 201 bp, Bos taurus; identical to SEQ ID NO: 13002

SEQ ID NO: 53948 - DNA, 201 bp, Bos taurus; identical to SEQ ID NO: 13004

SEQ ID NO: 53949 - DNA, 201 bp, Bos taurus; identical to SEQ ID NO: 13005

SEQ ID NO: 53950 - DNA, 201 bp, Bos taurus; identical to SEQ ID NO: 13006

SEQ ID NO: 53951 - DNA, 201 bp, Bos taurus; identical to SEQ ID NO: 13007

SEQ ID NO: 53952 - DNA, 201 bp, Bos taurus; identical to SEQ ID NO: 13008

SEQ ID NO: 53953 - DNA, 201 bp, Bos taurus
ctatccctcattgatctgcctaatatctttttggtacacttccaagtaagttgcaggctcgactatactttattcccagacatttcaccatgtatattatcaaggagagttctgtattttattgttcctttgaggtaaaattttaaaacaatgaaatgagtaaataagtgtatacagccacttttgaaaaacttaatggca

SEQ ID NO: 53954 - DNA, 201 bp, Bos taurus
cctactctacttgagccttagttttggatttctgagccacaaagcctgggattggaaaagactcccatgcatagataatggctgtgggaaaagacaagccatgctgtccctttgattgtggccagtgtgtcacctgttgactgtttgccctaaaaccctgcttagcccctgtctgcattatctcaggtgggtgacccttct

SEQ ID NO: 53955 - DNA, 201 bp, Bos taurus
gatggatgcctacaccctaggggagaaggagcagtgttcttggctgaggggtccatgcgctgagcctttttgttctcccctgtcaggtggccttggggcagcacaaagaaaactatttctctgaccctggacctcaagctgtgctgaagcaattccaggaggagttggctgccctggacaaggagattgaggtccgaaatg

SEQ ID NO: 53956 - DNA, 201 bp, Bos taurus; identical to SEQ ID NO: 13009

SEQ ID NO: 53957 - DNA, 201 bp, Bos taurus; identical to SEQ ID NO: 13010

SEQ ID NO: 53958 - DNA, 201 bp, Bos taurus; identical to SEQ ID NO: 13011

SEQ ID NO: 53959 - DNA, 201 bp, Bos taurus; identical to SEQ ID NO: 13012

SEQ ID NO: 53960 - DNA, 201 bp, Bos taurus
cactgccgaggaccctgggttcaatccctggtagggaactaaaattccacaagccatgtagtgaggcaaaaaaaaaaaaaaagtctatataagggtaactggagagtttttcaagaatatttgaattctaaactcggttagtgggtgtaatcataagacagtgggaaaggaatgtgaatgtcattaagacaagatagaatc

SEQ ID NO: 53961 - DNA, 201 bp, Bos taurus; identical to SEQ ID NO: 13014

SEQ ID NO: 53962 - DNA, 201 bp, Bos taurus
cggtaacccttcccccgactccactttccctgttggtactcctgcacacagacagatgcttccttcagaatcctatacagtgtggaaaacgcccacacacgctcctcagtgtggagtccccctgcctctgccataccccccagtagctctggatttctcccctacagcttctccctctcaggctgtggcccctctaacttg

SEQ ID NO: 53963 - DNA, 201 bp, Bos taurus; identical to SEQ ID NO: 13016

SEQ ID NO: 53964 - DNA, 201 bp, Bos taurus; identical to SEQ ID NO: 13017

SEQ ID NO: 53965 - DNA, 201 bp, Bos taurus; identical to SEQ ID NO: 13018

SEQ ID NO: 53966 - DNA, 201 bp, Bos taurus; identical to SEQ ID NO: 13023

SEQ ID NO: 53967 - DNA, 201 bp, Bos taurus; identical to SEQ ID NO: 13024

SEQ ID NO: 53968 - DNA, 201 bp, Bos taurus; identical to SEQ ID NO: 13025

SEQ ID NO: 53969 - DNA, 201 bp, Bos taurus; identical to SEQ ID NO: 13026

SEQ ID NO: 53970 - DNA, 201 bp, Bos taurus; identical to SEQ ID NO: 13027

SEQ ID NO: 53971 - DNA, 201 bp, Bos taurus
ccaggaccggagcttgtagaaacgcattgctgttctcagtaggagaggaacggtcccaacagagcacacttctctctggccctgcaatcttctgtattgttagtctgtctccctgccgagaaaacatcttagctcttgaggtgtgagcccgtgggaacgtaagccagggtgcaggcccctctttgcatgtggaattcacct

SEQ ID NO: 53972 - DNA, 201 bp, Bos taurus; identical to SEQ ID NO: 13028

SEQ ID NO: 53973 - DNA, 201 bp, Bos taurus; identical to SEQ ID NO: 13029

SEQ ID NO: 53974 - DNA, 201 bp, Bos taurus
gagagcagccgtatcacaggtgtgccagctcacctgcagaaactgaactttcaagaacgcgagttcaaacatttcttcgggccgcacgcctgtcatcaccgaggatgaaaaactgagcggtgctcagagctatctgagggctgttggggcaacaaggccgcccttgactgagggcttccagggctgagcctggggccttcg

SEQ ID NO: 53975 - DNA, 201 bp, Bos taurus; identical to SEQ ID NO: 13032

SEQ ID NO: 53976 - DNA, 201 bp, Bos taurus; identical to SEQ ID NO: 13033

SEQ ID NO: 53977 - DNA, 201 bp, Bos taurus; identical to SEQ ID NO: 13034

SEQ ID NO: 53978 - DNA, 201 bp, Bos taurus; identical to SEQ ID NO: 13035

SEQ ID NO: 53979 - DNA, 201 bp, Bos taurus; identical to SEQ ID NO: 13036

SEQ ID NO: 53980 - DNA, 201 bp, Bos taurus; identical to SEQ ID NO: 13037

SEQ ID NO: 53981 - DNA, 201 bp, Bos taurus; identical to SEQ ID NO: 13038

SEQ ID NO: 53982 - DNA, 201 bp, Bos taurus; identical to SEQ ID NO: 13039

SEQ ID NO: 53983 - DNA, 201 bp, Bos taurus; identical to SEQ ID NO: 13040

SEQ ID NO: 53984 - DNA, 201 bp, Bos taurus; identical to SEQ ID NO: 13041

SEQ ID NO: 53985 - DNA, 201 bp, Bos taurus; identical to SEQ ID NO: 13042

SEQ ID NO: 53986 - DNA, 201 bp, Bos taurus; identical to SEQ ID NO: 13044

SEQ ID NO: 53987 - DNA, 201 bp, Bos taurus; identical to SEQ ID NO: 13045

SEQ ID NO: 53988 - DNA, 201 bp, Bos taurus; identical to SEQ ID NO: 13046

SEQ ID NO: 53989 - DNA, 201 bp, Bos taurus; identical to SEQ ID NO: 13047

SEQ ID NO: 53990 - DNA, 201 bp, Bos taurus; identical to SEQ ID NO: 13048

SEQ ID NO: 53991 - DNA, 201 bp, Bos taurus; identical to SEQ ID NO: 13049

SEQ ID NO: 53992 - DNA, 201 bp, Bos taurus; identical to SEQ ID NO: 13050

SEQ ID NO: 53993 - DNA, 201 bp, Bos taurus; identical to SEQ ID NO: 13052

SEQ ID NO: 53994 - DNA, 201 bp, Bos taurus; identical to SEQ ID NO: 13054

SEQ ID NO: 53995 - DNA, 201 bp, Bos taurus; identical to SEQ ID NO: 13056

SEQ ID NO: 53996 - DNA, 201 bp, Bos taurus; identical to SEQ ID NO: 13059

SEQ ID NO: 53997 - DNA, 201 bp, Bos taurus; identical to SEQ ID NO: 13061

SEQ ID NO: 53998 - DNA, 201 bp, Bos taurus; identical to SEQ ID NO: 13062

SEQ ID NO: 53999 - DNA, 201 bp, Bos taurus; identical to SEQ ID NO: 13064

SEQ ID NO: 54000 - DNA, 201 bp, Bos taurus; identical to SEQ ID NO: 13066

SEQ ID NO: 54001 - DNA, 201 bp, Bos taurus; identical to SEQ ID NO: 13067

SEQ ID NO: 54002 - DNA, 201 bp, Bos taurus; identical to SEQ ID NO: 13069

SEQ ID NO: 54003 - DNA, 201 bp, Bos taurus; identical to SEQ ID NO: 13070

SEQ ID NO: 54004 - DNA, 201 bp, Bos taurus; identical to SEQ ID NO: 13071

SEQ ID NO: 54005 - DNA, 201 bp, Bos taurus; identical to SEQ ID NO: 13072

SEQ ID NO: 54006 - DNA, 201 bp, Bos taurus; identical to SEQ ID NO: 13073

SEQ ID NO: 54007 - DNA, 201 bp, Bos taurus; identical to SEQ ID NO: 13074

SEQ ID NO: 54008 - DNA, 201 bp, Bos taurus; identical to SEQ ID NO: 13076

SEQ ID NO: 54009 - DNA, 201 bp, Bos taurus; identical to SEQ ID NO: 13078

SEQ ID NO: 54010 - DNA, 201 bp, Bos taurus; identical to SEQ ID NO: 13079

SEQ ID NO: 54011 - DNA, 201 bp, Bos taurus; identical to SEQ ID NO: 13080

SEQ ID NO: 54012 - DNA, 201 bp, Bos taurus; identical to SEQ ID NO: 13082

SEQ ID NO: 54013 - DNA, 201 bp, Bos taurus; identical to SEQ ID NO: 13084

SEQ ID NO: 54014 - DNA, 201 bp, Bos taurus; identical to SEQ ID NO: 13085

SEQ ID NO: 54015 - DNA, 201 bp, Bos taurus; identical to SEQ ID NO: 13086

SEQ ID NO: 54016 - DNA, 201 bp, Bos taurus; identical to SEQ ID NO: 13088

SEQ ID NO: 54017 - DNA, 201 bp, Bos taurus; identical to SEQ ID NO: 13089

SEQ ID NO: 54018 - DNA, 201 bp, Bos taurus; identical to SEQ ID NO: 13090

SEQ ID NO: 54019 - DNA, 201 bp, Bos taurus; identical to SEQ ID NO: 13091

SEQ ID NO: 54020 - DNA, 201 bp, Bos taurus; identical to SEQ ID NO: 13096

SEQ ID NO: 54021 - DNA, 201 bp, Bos taurus; identical to SEQ ID NO: 13097

SEQ ID NO: 54022 - DNA, 201 bp, Bos taurus; identical to SEQ ID NO: 13098

SEQ ID NO: 54023 - DNA, 201 bp, Bos taurus; identical to SEQ ID NO: 13100

SEQ ID NO: 54024 - DNA, 201 bp, Bos taurus; identical to SEQ ID NO: 13101

SEQ ID NO: 54025 - DNA, 201 bp, Bos taurus; identical to SEQ ID NO: 13102

SEQ ID NO: 54026 - DNA, 201 bp, Bos taurus; identical to SEQ ID NO: 13104

SEQ ID NO: 54027 - DNA, 201 bp, Bos taurus; identical to SEQ ID NO: 13105

SEQ ID NO: 54028 - DNA, 201 bp, Bos taurus; identical to SEQ ID NO: 13106

SEQ ID NO: 54029 - DNA, 201 bp, Bos taurus; identical to SEQ ID NO: 13107

SEQ ID NO: 54030 - DNA, 201 bp, Bos taurus; identical to SEQ ID NO: 13108

SEQ ID NO: 54031 - DNA, 201 bp, Bos taurus; identical to SEQ ID NO: 13109

SEQ ID NO: 54032 - DNA, 201 bp, Bos taurus; identical to SEQ ID NO: 13110

SEQ ID NO: 54033 - DNA, 201 bp, Bos taurus; identical to SEQ ID NO: 13112

SEQ ID NO: 54034 - DNA, 201 bp, Bos taurus; identical to SEQ ID NO: 13113

SEQ ID NO: 54035 - DNA, 201 bp, Bos taurus; identical to SEQ ID NO: 13116

SEQ ID NO: 54036 - DNA, 201 bp, Bos taurus; identical to SEQ ID NO: 13117

SEQ ID NO: 54037 - DNA, 201 bp, Bos taurus; identical to SEQ ID NO: 13118

SEQ ID NO: 54038 - DNA, 201 bp, Bos taurus; identical to SEQ ID NO: 13121

SEQ ID NO: 54039 - DNA, 201 bp, Bos taurus; identical to SEQ ID NO: 13122

SEQ ID NO: 54040 - DNA, 201 bp, Bos taurus; identical to SEQ ID NO: 13123

SEQ ID NO: 54041 - DNA, 201 bp, Bos taurus; identical to SEQ ID NO: 13126

SEQ ID NO: 54042 - DNA, 201 bp, Bos taurus; identical to SEQ ID NO: 13127

SEQ ID NO: 54043 - DNA, 201 bp, Bos taurus; identical to SEQ ID NO: 13128

SEQ ID NO: 54044 - DNA, 201 bp, Bos taurus; identical to SEQ ID NO: 13129

SEQ ID NO: 54045 - DNA, 201 bp, Bos taurus; identical to SEQ ID NO: 13130

SEQ ID NO: 54046 - DNA, 201 bp, Bos taurus; identical to SEQ ID NO: 13132

SEQ ID NO: 54047 - DNA, 201 bp, Bos taurus; identical to SEQ ID NO: 13133

SEQ ID NO: 54048 - DNA, 201 bp, Bos taurus; identical to SEQ ID NO: 13134

SEQ ID NO: 54049 - DNA, 201 bp, Bos taurus; identical to SEQ ID NO: 13135

SEQ ID NO: 54050 - DNA, 201 bp, Bos taurus; identical to SEQ ID NO: 13138

SEQ ID NO: 54051 - DNA, 201 bp, Bos taurus; identical to SEQ ID NO: 13141

SEQ ID NO: 54052 - DNA, 201 bp, Bos taurus; identical to SEQ ID NO: 13142

SEQ ID NO: 54053 - DNA, 201 bp, Bos taurus; identical to SEQ ID NO: 13145

SEQ ID NO: 54054 - DNA, 201 bp, Bos taurus; identical to SEQ ID NO: 13146

SEQ ID NO: 54055 - DNA, 201 bp, Bos taurus; identical to SEQ ID NO: 13148

SEQ ID NO: 54056 - DNA, 201 bp, Bos taurus; identical to SEQ ID NO: 13150

SEQ ID NO: 54057 - DNA, 201 bp, Bos taurus; identical to SEQ ID NO: 13151

SEQ ID NO: 54058 - DNA, 201 bp, Bos taurus; identical to SEQ ID NO: 13152

SEQ ID NO: 54059 - DNA, 201 bp, Bos taurus; identical to SEQ ID NO: 13153

SEQ ID NO: 54060 - DNA, 201 bp, Bos taurus; identical to SEQ ID NO: 13156

SEQ ID NO: 54061 - DNA, 201 bp, Bos taurus; identical to SEQ ID NO: 13157

SEQ ID NO: 54062 - DNA, 201 bp, Bos taurus; identical to SEQ ID NO: 13158

SEQ ID NO: 54063 - DNA, 201 bp, Bos taurus
tagctcctctaggccctcctgcacctgcgcagccactgctccttggacgtggggtagctcctcccagtcgctgcccctggcctcgggccggggttgcgggcgtcgtgtatctcctcccagatgccacccctgacctcagacatggggtagctcctctcagctgccacccctgaccttggacatggggtagctcctctcggc

SEQ ID NO: 54064 - DNA, 201 bp, Bos taurus; identical to SEQ ID NO: 13159

SEQ ID NO: 54065 - DNA, 201 bp, Bos taurus; identical to SEQ ID NO: 13162

SEQ ID NO: 54066 - DNA, 201 bp, Bos taurus; identical to SEQ ID NO: 13163

SEQ ID NO: 54067 - DNA, 201 bp, Bos taurus; identical to SEQ ID NO: 13164

SEQ ID NO: 54068 - DNA, 201 bp, Bos taurus; identical to SEQ ID NO: 13165

SEQ ID NO: 54069 - DNA, 201 bp, Bos taurus; identical to SEQ ID NO: 13166

SEQ ID NO: 54070 - DNA, 201 bp, Bos taurus; identical to SEQ ID NO: 13167

SEQ ID NO: 54071 - DNA, 201 bp, Bos taurus; identical to SEQ ID NO: 13168

SEQ ID NO: 54072 - DNA, 201 bp, Bos taurus; identical to SEQ ID NO: 13169

SEQ ID NO: 54073 - DNA, 201 bp, Bos taurus; identical to SEQ ID NO: 13170

SEQ ID NO: 54074 - DNA, 201 bp, Bos taurus; identical to SEQ ID NO: 13171

SEQ ID NO: 54075 - DNA, 201 bp, Bos taurus; identical to SEQ ID NO: 13172

SEQ ID NO: 54076 - DNA, 201 bp, Bos taurus; identical to SEQ ID NO: 13174

SEQ ID NO: 54077 - DNA, 201 bp, Bos taurus; identical to SEQ ID NO: 13175

SEQ ID NO: 54078 - DNA, 201 bp, Bos taurus; identical to SEQ ID NO: 13176

SEQ ID NO: 54079 - DNA, 201 bp, Bos taurus; identical to SEQ ID NO: 13177

SEQ ID NO: 54080 - DNA, 201 bp, Bos taurus; identical to SEQ ID NO: 13178

SEQ ID NO: 54081 - DNA, 201 bp, Bos taurus; identical to SEQ ID NO: 13180

SEQ ID NO: 54082 - DNA, 201 bp, Bos taurus; identical to SEQ ID NO: 13181

SEQ ID NO: 54083 - DNA, 201 bp, Bos taurus; identical to SEQ ID NO: 13182

SEQ ID NO: 54084 - DNA, 201 bp, Bos taurus; identical to SEQ ID NO: 13183

SEQ ID NO: 54085 - DNA, 201 bp, Bos taurus; identical to SEQ ID NO: 13184

SEQ ID NO: 54086 - DNA, 201 bp, Bos taurus; identical to SEQ ID NO: 13185

SEQ ID NO: 54087 - DNA, 201 bp, Bos taurus; identical to SEQ ID NO: 13187

SEQ ID NO: 54088 - DNA, 201 bp, Bos taurus; identical to SEQ ID NO: 13189

SEQ ID NO: 54089 - DNA, 201 bp, Bos taurus; identical to SEQ ID NO: 13191

SEQ ID NO: 54090 - DNA, 201 bp, Bos taurus; identical to SEQ ID NO: 13192

SEQ ID NO: 54091 - DNA, 201 bp, Bos taurus; identical to SEQ ID NO: 13193

SEQ ID NO: 54092 - DNA, 201 bp, Bos taurus; identical to SEQ ID NO: 13195

SEQ ID NO: 54093 - DNA, 201 bp, Bos taurus; identical to SEQ ID NO: 13196

SEQ ID NO: 54094 - DNA, 201 bp, Bos taurus; identical to SEQ ID NO: 13200

SEQ ID NO: 54095 - DNA, 201 bp, Bos taurus; identical to SEQ ID NO: 13201

SEQ ID NO: 54096 - DNA, 201 bp, Bos taurus; identical to SEQ ID NO: 13202

SEQ ID NO: 54097 - DNA, 201 bp, Bos taurus; identical to SEQ ID NO: 13203

SEQ ID NO: 54098 - DNA, 201 bp, Bos taurus; identical to SEQ ID NO: 13204

SEQ ID NO: 54099 - DNA, 201 bp, Bos taurus; identical to SEQ ID NO: 13205

SEQ ID NO: 54100 - DNA, 201 bp, Bos taurus; identical to SEQ ID NO: 13206

SEQ ID NO: 54101 - DNA, 201 bp, Bos taurus; identical to SEQ ID NO: 13211

SEQ ID NO: 54102 - DNA, 201 bp, Bos taurus; identical to SEQ ID NO: 13212

SEQ ID NO: 54103 - DNA, 201 bp, Bos taurus; identical to SEQ ID NO: 13213

SEQ ID NO: 54104 - DNA, 201 bp, Bos taurus; identical to SEQ ID NO: 13214

SEQ ID NO: 54105 - DNA, 201 bp, Bos taurus; identical to SEQ ID NO: 13215

SEQ ID NO: 54106 - DNA, 201 bp, Bos taurus; identical to SEQ ID NO: 13216

SEQ ID NO: 54107 - DNA, 201 bp, Bos taurus; identical to SEQ ID NO: 13218

SEQ ID NO: 54108 - DNA, 201 bp, Bos taurus
gcttaccttggagagaagagtagcagctgaacccaatgctctggtcccacgtgctgcccttttggaatgacagctgacagggtgggggctctaggcaggcgggagttccctggatagccaaattcagagcatcatgaggacagacatgcagggagctacaatatatatattgtgacagttagtgcaggtgaatggacagga

SEQ ID NO: 54109 - DNA, 201 bp, Bos taurus; identical to SEQ ID NO: 13219

SEQ ID NO: 54110 - DNA, 201 bp, Bos taurus; identical to SEQ ID NO: 13220

SEQ ID NO: 54111 - DNA, 201 bp, Bos taurus; identical to SEQ ID NO: 13221

SEQ ID NO: 54112 - DNA, 201 bp, Bos taurus
ggccctggggtgtttccgtatgctgccttcaccaggcggtgtgctgcgtgttctggaagtaagctcaggacttgaatttcaggttttagtctttctcactggattcccaaaccagcctagtttggtataagagctcacagaatattccttaaaactctccccagctagaacagggaatgaatgaacctggtatactgaaat

SEQ ID NO: 54113 - DNA, 201 bp, Bos taurus
aattacggtttttgattctgtggccactgtggacgtcatggtggtgacttctgtgatgaccgtttttcttttaggttctccattgacattttcatctttgttggtgggcaggccattttcatcaataaaatcattactgaggttagattcctctccagaagtaacaggggacgaagtaactttcttaactttggagatgtc

SEQ ID NO: 54114 - DNA, 201 bp, Bos taurus
tccacctgcaagcgggggaagcacaccccgagggtagaaatgcacttatgtatctcctcccaacgtacccaagcagaatggagtagagacgagagatttgctgttgaatgtgcaggaggagaatcagttgtagtttaagagtgaaggattattacaggattgaagggactggaacatcttgatgggtgaggactggtggtc

SEQ ID NO: 54115 - DNA, 201 bp, Bos taurus; identical to SEQ ID NO: 13222

SEQ ID NO: 54116 - DNA, 201 bp, Bos taurus; identical to SEQ ID NO: 13223

SEQ ID NO: 54117 - DNA, 201 bp, Bos taurus
atgcaggtcagcctggggggcctgccctgtggtgccaaacggagatagttgggctttaagactatgtttacattgtaatcaagccaaaacagtactgaactcctgtgtcgaagggcccttcccagcttcatcatgtgtggattacctccttccagccacgggcaaggggctccatctacttcactctctttgcacctgctc

SEQ ID NO: 54118 - DNA, 201 bp, Bos taurus; identical to SEQ ID NO: 13224

SEQ ID NO: 54119 - DNA, 201 bp, Bos taurus; identical to SEQ ID NO: 13225

SEQ ID NO: 54120 - DNA, 201 bp, Bos taurus
actgcttaagttccccagagggatgcattccagtcaacttaacattcttttctggcctcctgctttcccactcccacgaaggcttcccagggtcaccctcatgtaagctatttgcacttgtaccttatctgttcctgagggagcccacctctgagacagtggttgcagtcatgcaggagggagggtgttgtactggggagg

SEQ ID NO: 54121 - DNA, 201 bp, Bos taurus
ccagttctgtcctaaaagcaggacagccaaggccacgtcctcacattctccgtgggctctaactcctgattctgtccagggagcagagtacagaggcaccgctcccctcagcatggccatcacgctccttcctgcctccttgggaaaccagaagctcagggccccacctttgtggggtccttcagccccacccctgaaaac

SEQ ID NO: 54122 - DNA, 201 bp, Bos taurus
agagaggagactccctggcccctccagtgcccaggagaggttgacagaggaccctgtcagtgtgtctgccctctggaggcccccggtgagcttctcaggcgccaggtgcagtctccacagcttttaaggtggtgctgaataggaacaggtgacttgggatatggccttcatggtgggaggagcttggtaatggggattgga

SEQ ID NO: 54123 - DNA, 201 bp, Bos taurus; identical to SEQ ID NO: 13230

SEQ ID NO: 54124 - DNA, 201 bp, Bos taurus; identical to SEQ ID NO: 13231

SEQ ID NO: 54125 - DNA, 201 bp, Bos taurus
gtctcaggacaaccaccttaggtggccccctactctgaggtggggacccaggagggcaagtggtacagctttgctgtgagctgccgctcatccaagatccgcggggcccagatgcattgaagtgaattcaccgcagaagcttctgggagggccctcttcctccatagggtctctgctctgtgactgcatcttgtgtcccag

SEQ ID NO: 54126 - DNA, 201 bp, Bos taurus; identical to SEQ ID NO: 13232

SEQ ID NO: 54127 - DNA, 201 bp, Bos taurus; identical to SEQ ID NO: 13233

SEQ ID NO: 54128 - DNA, 201 bp, Bos taurus; identical to SEQ ID NO: 13234

SEQ ID NO: 54129 - DNA, 201 bp, Bos taurus; identical to SEQ ID NO: 13235

SEQ ID NO: 54130 - DNA, 201 bp, Bos taurus; identical to SEQ ID NO: 13237

SEQ ID NO: 54131 - DNA, 201 bp, Bos taurus; identical to SEQ ID NO: 13238

SEQ ID NO: 54132 - DNA, 201 bp, Bos taurus; identical to SEQ ID NO: 13239

SEQ ID NO: 54133 - DNA, 201 bp, Bos taurus; identical to SEQ ID NO: 13240

SEQ ID NO: 54134 - DNA, 201 bp, Bos taurus
ggaagctcggggggcgccatctcggggggcgccatctcggatggcccctgcttccccggatggtgggcactgttgggatcatcccctctccagcgggccctgatccttctcatggattctgaatcttaagatggctcggatgggaagtagggctgactggtcttgtggtggctgccctgtgcaaggcccgccctcctgaat

SEQ ID NO: 54135 - DNA, 201 bp, Bos taurus; identical to SEQ ID NO: 13242

SEQ ID NO: 54136 - DNA, 201 bp, Bos taurus; identical to SEQ ID NO: 13243

SEQ ID NO: 54137 - DNA, 201 bp, Bos taurus; identical to SEQ ID NO: 13244

SEQ ID NO: 54138 - DNA, 201 bp, Bos taurus; identical to SEQ ID NO: 13245

SEQ ID NO: 54139 - DNA, 201 bp, Bos taurus
tcttttccctttggcttttttggtttcctcccacccatacttcagtctgctggccccgttcacatgtgaggtcagccttgggtgctttctgtcacctgtccgtgagtgggaaccaggcactttgggcagtctgtgcaggaaagcttagagcacattcctatttaattaggaataaagaggtttatctgaatgtcttaatgt

SEQ ID NO: 54140 - DNA, 201 bp, Bos taurus
cttctcatcttcatggactagaaatttttctggtttgttaagtccagaaaaagcagaataaactccctttaggcttgctttctctagaatggggtgtgaaccagtagaatttgtgttgtttctcagagtggtttttgctcagactagatctaagctgtttttagttaactttctcctgaagtagctgttggaatgttcacc

SEQ ID NO: 54141 - DNA, 201 bp, Bos taurus
aggggggggtcggggaacttccgatgaactctggccgaggtgatggtaatccctgaagccaggatgttctgtgggaaagagctagaagggcaagctgagcggcagtggtcctggggtcagggcctgcaagtccagaggaggggcccgtaccttcctgcctccaacctcacaaacctcccgagactcccatgatgggaaggg

SEQ ID NO: 54142 - DNA, 201 bp, Bos taurus
acttcactagatgggcacaatgaaagaatgggtgagagaagagaatttgtgaacttaatttgagcacaagaaatgatctatctgaagaacagacagaaaagagataagaaagtggagtctcaggaagctgtgggataataccaaaagacccaacactcacgtcattagggttcagaagtagaggagaaaaagactggcgaa

SEQ ID NO: 54143 - DNA, 201 bp, Bos taurus
gtgacccctgtcctgcactcactttggttcttcagcccagctctgcctctgtcatggtaggggggtacctggagtggagcggccaggccccccctggaagtttgggcttcccattctccatactcctgtcctgtccgtggtgatggaggaggggtaccagcctggcagggagaggaggacccattcagggcctggctgggt

SEQ ID NO: 54144 - DNA, 201 bp, Bos taurus; identical to SEQ ID NO: 13250

SEQ ID NO: 54145 - DNA, 201 bp, Bos taurus
gggtggcggccctgttggtctgctccatacccactgtccccttctccttgctaccagaacctggttctgtacagtgctagacacgcatatgctccaggagggggggcctccactcgagagggagcttgcttatgtgcatgatacggagcttccctcgtgtcctactctttgcaaccccatgggctgcagcacgccaggctt

SEQ ID NO: 54146 - DNA, 201 bp, Bos taurus
atgctcagtgaagaagccaaatgtaaaaggccacacgtggtacgagtccattgaaatgaaatgtccagaagaggcaaatccattaggacagagagcagacggggcagccggggctgggccatcacacctatgggattccttttgggggacaaataagaccctgatgctgggaaagactgacggcaaaaggagaagggggtg

SEQ ID NO: 54147 - DNA, 201 bp, Bos taurus
cagaggggaaccaagcacctcagccaaggtcatgctgccgcaggaagggccgtggcccagggtcggggtcagggcactgtgaccgtgctctcattcacactgtctcagagataaccccacggaataacatgagaaagcgtccaagggccccctccctgcccaccacccctggccgggatctaccctttgctgaagctctcc

SEQ ID NO: 54148 - DNA, 201 bp, Bos taurus
accacccctctccctgctacttgggccagcagggcccactcctctctcatttgacagatcaagaaattgagactgggaagtagtggggtaggggtgacgcgaagcggtggctcagaaccagtaggccggtggactcgagccaggacacgcccaagtactcagcagggcgccagtctggggacactccactcgtcactctgt

SEQ ID NO: 54149 - DNA, 201 bp, Bos taurus
tgctcaagcctggccgctccctggccgcctgcacaagccgggtgtcacggctctgtgcctgtcctgctctattccctccacccggcaagcccttcccaccttccttggcctaggtcactctcaatccttctgcaggtgcctccctgagcccctgggtggggcaactctcttctgggcacccccatgggttttcccagtggc

SEQ ID NO: 54150 - DNA, 201 bp, Bos taurus; identical to SEQ ID NO: 13253

SEQ ID NO: 54151 - DNA, 201 bp, Bos taurus; identical to SEQ ID NO: 13254

SEQ ID NO: 54152 - DNA, 201 bp, Bos taurus; identical to SEQ ID NO: 13257

SEQ ID NO: 54153 - DNA, 201 bp, Bos taurus; identical to SEQ ID NO: 13258

SEQ ID NO: 54154 - DNA, 201 bp, Bos taurus; identical to SEQ ID NO: 13259

SEQ ID NO: 54155 - DNA, 201 bp, Bos taurus; identical to SEQ ID NO: 13262

SEQ ID NO: 54156 - DNA, 201 bp, Bos taurus
cacctgctgggttggttttaagaagtatttttgctttaacacccatgatgggagggcgaggctcccgtttcttcatttagcagatgttcatagagcatctttggatgccagtggggaccttgaggactcagcagagagcagatgggtggggccttgcttgagctaatgttgaaggcagagagcatgatggtggtgggccat

SEQ ID NO: 54157 - DNA, 201 bp, Bos taurus; identical to SEQ ID NO: 13264

SEQ ID NO: 54158 - DNA, 201 bp, Bos taurus
ctgagcgactcaacagcgattcaacacaccaggacattgactttgtgcgtgtgtgtctgtgcgattttatcacgtatgcagatttgtaaaatgtacttgcaaggggtcgtctggcagttcccacaccggtgggtctctaaaagcttggcccccgtgggcttgcacatgggcccccagaggctgaggatgctggaggaggat

SEQ ID NO: 54159 - DNA, 201 bp, Bos taurus; identical to SEQ ID NO: 13265

SEQ ID NO: 54160 - DNA, 201 bp, Bos taurus; identical to SEQ ID NO: 13266

SEQ ID NO: 54161 - DNA, 201 bp, Bos taurus; identical to SEQ ID NO: 13271

SEQ ID NO: 54162 - DNA, 201 bp, Bos taurus; identical to SEQ ID NO: 13272

SEQ ID NO: 54163 - DNA, 201 bp, Bos taurus; identical to SEQ ID NO: 13275

SEQ ID NO: 54164 - DNA, 201 bp, Bos taurus
aacaagtgcccaggtggtgctgatgttgctggtccagggaccacattttgagaaccattgcaccaaaggatggatgtggccaggtgatgcagaaagcctctcactcccagctcgctaacctgttaacactgtgtacagaccaggcaactctccatgggcccccacgttccttccctacatctccccctggatgaggctgag

SEQ ID NO: 54165 - DNA, 201 bp, Bos taurus; identical to SEQ ID NO: 13277

SEQ ID NO: 54166 - DNA, 201 bp, Bos taurus; identical to SEQ ID NO: 13279

SEQ ID NO: 54167 - DNA, 201 bp, Bos taurus; identical to SEQ ID NO: 13282

SEQ ID NO: 54168 - DNA, 201 bp, Bos taurus
cagtaatgctcggctgggtgaggacggaagctgcaaagacaatcttaaatgtaatttattgggcaggaaaataggttaggcaaggcctggcctcttcctccgtggatatcttgagcgggatgactgcatttgcttgcagacagagacttacttgggcagtatcttttgacatctggcctgggactaggaggaagttgacat

SEQ ID NO: 54169 - DNA, 201 bp, Bos taurus
agtatctcctaagcctcagcagatgaagcagatgcagttgatacagtcatcagtcttgcatttagagggaagacacacacacaaaagtacatgagcctgtacaaatttgcttatgattgatgccataaggaaacatgcatcagagtaaggagggtctcaaggaaggacaggatgatgtttggggaggagtatgatgctggg

SEQ ID NO: 54170 - DNA, 201 bp, Bos taurus
cagctagttaacgagggggctgagcatggcatttggacagttctgagagcgcccccctgccgcgcgaggctgggtgacatcctggcctcgctgtcacgtcgtttacatgcacttctcttggctcagcctcggcacgccgcgtaaatctacagctgcagaggccgaaatagcatataaaattgaaggatttattttgaggta

SEQ ID NO: 54171 - DNA, 201 bp, Bos taurus
gcacttgggataccttcatatgcaaaacacgttcgaccccatccttgcgtggtgtatattctcctatctaagatcacagcgctggtaatgtggcagaggcaggtttgaactgggcacttaagaccactgcagggtagtgccacttgaagttaatttccacttcccctatgactgtttcagcataggttgtgatattgtgtg

SEQ ID NO: 54172 - DNA, 201 bp, Bos taurus
aaagctcttggtggggttgagagaccctagtgaagatgacaagcagtgggcaagactttgaggactggactgaagtcaccacagtggcgatcttttgcgtcgcatctgtgacccactggtgactcctctgctttccccaggttgcatgtggagatgatgcatttgaaacctcatggagccagtggctttctgtggctctgg

SEQ ID NO: 54173 - DNA, 201 bp, Bos taurus
tgctccaccagtctgcagctcacccatctctctccctctcctcagagctccctattcccctgagacacagtgatcctgaactcggccagttaataaccccgcagtggtagtgttgttgttgaaagttaaagtcactcaattgtgtctgactctttttgaccccatggactatagagcccatggaattctccaggccagaat

SEQ ID NO: 54174 - DNA, 201 bp, Bos taurus; identical to SEQ ID NO: 13283

SEQ ID NO: 54175 - DNA, 201 bp, Bos taurus
cacttttggtcggaaacaaaacttgcttccgatcagaagtaaagccgtcacagcttgtgaaatgccaggggattctggatactgcctgttggcaaatgccactgacaggaaaggcatctcattcataaagtgcagggtgggcttcggggagaatagactgtgcaataggagggggggtggcatttttaccaaaagtcctag

SEQ ID NO: 54176 - DNA, 201 bp, Bos taurus; identical to SEQ ID NO: 13284

SEQ ID NO: 54177 - DNA, 201 bp, Bos taurus; identical to SEQ ID NO: 13286

SEQ ID NO: 54178 - DNA, 201 bp, Bos taurus
cccaggcccctctcagctttgccagtgccgtctcagtgggtcaggcacactcacaccagagcttagctaacaagaacccaagtctgtgttgttgacttgggagccttggaggcccaccgttccaagaaggaagggtgggcttttcagtggtgtgtgtgtgtgtgtgtgtgtgtgtgtgtgtgtgtacgcaatgcgcttggt

SEQ ID NO: 54179 - DNA, 201 bp, Bos taurus
tccccagtgagcctccctcccttatccctatcccacccttctggcctgggcttcctgtgttagacagcaacttctcaccatctgtccataaaattctttttaatttttttattttttggccttaccatgtggcttgcaggatcttagttcccagaccaggggttgaacctgggcccctggcactgagagcacagtcctaac

SEQ ID NO: 54180 - DNA, 201 bp, Bos taurus; identical to SEQ ID NO: 13288

SEQ ID NO: 54181 - DNA, 201 bp, Bos taurus; identical to SEQ ID NO: 13289

SEQ ID NO: 54182 - DNA, 201 bp, Bos taurus; identical to SEQ ID NO: 13290

SEQ ID NO: 54183 - DNA, 201 bp, Bos taurus; identical to SEQ ID NO: 13291

SEQ ID NO: 54184 - DNA, 201 bp, Bos taurus; identical to SEQ ID NO: 13293

SEQ ID NO: 54185 - DNA, 201 bp, Bos taurus; identical to SEQ ID NO: 13294

SEQ ID NO: 54186 - DNA, 201 bp, Bos taurus
ctgcactagtggaatcaaatatacgatctgccctttgagactgcgggtgcagtcctaatcctgactcttacccccggggccctcctatacggcctggccctgccagccccctggcgtgagacagaagtcctcacgtaacgtccaatggcaacacctgccccttccgagaccgcccagtgctgtgctctggtggccggggca

SEQ ID NO: 54187 - DNA, 201 bp, Bos taurus
tgtttttcacacaaactaattttgttcgctctaatcataatgaaaactaaagccaaagtttcatgccacaaaaaaaatggggccagacatttttcttcttttttattggaatgtaactgttttaaaatgctctgtcagtttctgctgtacaacacagaggatcagctacctgcagacacaggcccctccctcctggctctc

SEQ ID NO: 54188 - DNA, 201 bp, Bos taurus
ggtcattttattcatctcattccttaacaaccacctacaaactcccaccctgaagggacgagtcctgtgacacttccctctctctttactctttgtctggttgctatcaatattcactttattcaccttatttcttaagaactctttaaagattgccaccttgctgagaagagtcatttgactcttcccatcctcttgtta

SEQ ID NO: 54189 - DNA, 201 bp, Bos taurus; identical to SEQ ID NO: 13295

SEQ ID NO: 54190 - DNA, 201 bp, Bos taurus; identical to SEQ ID NO: 13296

SEQ ID NO: 54191 - DNA, 201 bp, Bos taurus; identical to SEQ ID NO: 13297

SEQ ID NO: 54192 - DNA, 201 bp, Bos taurus
taagaggaaaattctcacaaaaactgctttatatattagaacatgtgtttagttaatgtataaagaagaaaaaatgtgattacttcatataagagattattcacattggctggatagacttctatttgcaggacttgaattgtttgtgaatatcaagtttaacggatgcgaattatttgagacctcaaagctggtgttgca

SEQ ID NO: 54193 - DNA, 201 bp, Bos taurus
acgtgctgtggcccagcctgaccacgcgcgagcatctggaggtgtttgctgccgtgaaagggctgcggcgagcggacgcccacatggccatctcacggtaatgtgcgcccatgaggctcctctgtgctgtcgctgacaaggagtggggagtagggggacatctccatcttccgggagcagcaggggttgagtggggatggg

SEQ ID NO: 54194 - DNA, 201 bp, Bos taurus; identical to SEQ ID NO: 13299

SEQ ID NO: 54195 - DNA, 201 bp, Bos taurus; identical to SEQ ID NO: 13300

SEQ ID NO: 54196 - DNA, 201 bp, Bos taurus
tctggattccttgcaacatttgcggtcacacctcggtgagccggaatctgggagtggtagcgccagggctgcctgaggggtcagacaggccaatgatgacatcttgttacagctgggaagctgtggtctggtcatctctgtgtgtctgcctgtctgtatgttgtggaaggggtcttcaggagggatggcacagggcacaaa

SEQ ID NO: 54197 - DNA, 201 bp, Bos taurus; identical to SEQ ID NO: 13303

SEQ ID NO: 54198 - DNA, 201 bp, Bos taurus; identical to SEQ ID NO: 13304

SEQ ID NO: 54199 - DNA, 201 bp, Bos taurus
cggcctgctgtcggtcacaaacagaagggactgccctgcggcctcattggaagaggagctccaggtggtggagtccaggcggtctgcacagcaagcaggtggtctgaagaaagggccacggagcctcccctgtggttcagaaggtaaagagtcggcctgcaatgcaggagaaacgggttcaatccctgggtcgggaagatc

SEQ ID NO: 54200 - DNA, 201 bp, Bos taurus
aggactggagaatccaggataaggacgttccagaataaaggacaagtggagaagctgtgaaagggaaagaaagattgctaattcctagaagagaaccggaaccgagaagacacacagagaacagagaaaggggttgtgatgacgccgagaactacctccactcgccgcgattctagagagacagttgcctcgattctagag

SEQ ID NO: 54201 - DNA, 201 bp, Bos taurus
aattataaacttaaaatggaagttgcattttataaagtttaatttccaaaggctgattaaagatttcagaactcgccaaagcatcaacagaattaaatcacttattaaatgcagacatactctgtaacctacagaggacttcacgtcactcaattctttccacacttactgcattctttaacttaagcgctcaacctccta

SEQ ID NO: 54202 - DNA, 201 bp, Bos taurus
ttttaattaaaaaaccgctagttatttttatttaaaatgcaaaaaaaaaaaaagttctttcattacaaaagacaaagctggccacagatctagcctcccacgtttcccagcccaaacactggacgtgaactttgccaccgtgtccaggtcgtgctgccctccgtgcgtctcagaccagcattggcactgactgtcctgcac

SEQ ID NO: 54203 - DNA, 201 bp, Bos taurus; identical to SEQ ID NO: 13306

SEQ ID NO: 54204 - DNA, 201 bp, Bos taurus; identical to SEQ ID NO: 13307

SEQ ID NO: 54205 - DNA, 201 bp, Bos taurus
cagtaagaatgaaggggagggacttgcctggtggtcaaatgttaagaatccacgggccaatgcaggaggcacgggtttgatccctggcccatgtggaagatcccatgtgccttgcaacaactcagcctgcacaccccagctactaaagcctgcatactctagagcctgtgctctgaaacacaataagccatggccatgaga

SEQ ID NO: 54206 - DNA, 201 bp, Bos taurus; identical to SEQ ID NO: 13309

SEQ ID NO: 54207 - DNA, 201 bp, Bos taurus; identical to SEQ ID NO: 13311

SEQ ID NO: 54208 - DNA, 201 bp, Bos taurus
aaggtgagagtggcctcgaaatatggcgtggttagtttttatgggttgcgtaatttcataggttagtgagagggaggattattccaactgtttggggaaaaagcagagactgggccactgcccacattttaggttggtctcagaactgttgcagagcctcggtatgtcatttagcttgctgatgtgttgaaagtgaaactg

SEQ ID NO: 54209 - DNA, 201 bp, Bos taurus; identical to SEQ ID NO: 13312

SEQ ID NO: 54210 - DNA, 201 bp, Bos taurus; identical to SEQ ID NO: 13314

SEQ ID NO: 54211 - DNA, 201 bp, Bos taurus; identical to SEQ ID NO: 13315

SEQ ID NO: 54212 - DNA, 201 bp, Bos taurus; identical to SEQ ID NO: 13317

SEQ ID NO: 54213 - DNA, 201 bp, Bos taurus; identical to SEQ ID NO: 13318

SEQ ID NO: 54214 - DNA, 201 bp, Bos taurus; identical to SEQ ID NO: 13319

SEQ ID NO: 54215 - DNA, 201 bp, Bos taurus; identical to SEQ ID NO: 13321

SEQ ID NO: 54216 - DNA, 201 bp, Bos taurus
taacggcagggacacctggaacctatgcccggaagaggggaatccaccggcttgcatttagtcagcgcgtgggttgccttgagccatctgactgtgctccgttgagggaaacttggaaaggaagctagggaaatgatgaccctccctgggtccttacagggagcccctttgatgagataaccctgcagggtccctcttcct

SEQ ID NO: 54217 - DNA, 201 bp, Bos taurus; identical to SEQ ID NO: 13322

SEQ ID NO: 54218 - DNA, 201 bp, Bos taurus; identical to SEQ ID NO: 13323

SEQ ID NO: 54219 - DNA, 201 bp, Bos taurus; identical to SEQ ID NO: 13324

SEQ ID NO: 54220 - DNA, 201 bp, Bos taurus; identical to SEQ ID NO: 13326

SEQ ID NO: 54221 - DNA, 201 bp, Bos taurus
ctctccacccagaacgatcacacttgagaaggaaccataatggaggtggcctgggtgtcatttcccaccccagctcccctgtctcccaccaaccttctctgtccacccagaatgtacatgaggccagctaatgaggatttcagccccagtctccagagtttctcctatagaagacagggaactggagtactatcagagtta

SEQ ID NO: 54222 - DNA, 201 bp, Bos taurus; identical to SEQ ID NO: 13327

SEQ ID NO: 54223 - DNA, 201 bp, Bos taurus; identical to SEQ ID NO: 13328

SEQ ID NO: 54224 - DNA, 201 bp, Bos taurus
agtttattcagtaacacatgtgtttctcacttcatagttgtacatataattttgactaatgcagtagcacccctctcttgtcatttactaagattgtacatagttcttcagcagtcattagtgtaaacaagaatagactttacatttcttttaaaataaagaatgaactgaatgaaattaaatcattcttgttggctagca

SEQ ID NO: 54225 - DNA, 201 bp, Bos taurus; identical to SEQ ID NO: 13329

SEQ ID NO: 54226 - DNA, 201 bp, Bos taurus; identical to SEQ ID NO: 13331

SEQ ID NO: 54227 - DNA, 201 bp, Bos taurus; identical to SEQ ID NO: 13333

SEQ ID NO: 54228 - DNA, 201 bp, Bos taurus; identical to SEQ ID NO: 13336

SEQ ID NO: 54229 - DNA, 201 bp, Bos taurus
tggatcaggtcactgttcagcataaaagcctctggtggcctcccatggttcctaaataaagcagaaacatggcaccaggccctataaaaattgggcccccgttggcttcactggtggctcagctggtaaagcatctgcttgcaatgggggatccctgggttgggaagatggcctggagaagggaaaggctaccaacgccag

SEQ ID NO: 54230 - DNA, 201 bp, Bos taurus; identical to SEQ ID NO: 13338

SEQ ID NO: 54231 - DNA, 201 bp, Bos taurus
gggcacaggcccctcagacgcctgtcagcaacctttgagacacacccgtccgtcccatacgggggtccaatttgccacctaacttcagagcgcagagtctgggccactgaaccaccatggaagtccccataattctatatttcttatccacaaaacttgtataaaactctgctacttgtttttttaggcaatctttatttc

SEQ ID NO: 54232 - DNA, 201 bp, Bos taurus
aggtgccttcgtgtctcctggggtgtgacacagcagtgtctctcctttccctgtgtggcctcagtgggaccagtctctgggctcatgtcagggcccctgcacaacacaggaggcaggaagccccatggcaggattagcatgtgccggggagacacacagaggctctggggtgacgagcaaggcccccccgggccaatccca

SEQ ID NO: 54233 - DNA, 201 bp, Bos taurus; identical to SEQ ID NO: 13340

SEQ ID NO: 54234 - DNA, 201 bp, Bos taurus; identical to SEQ ID NO: 13341

SEQ ID NO: 54235 - DNA, 201 bp, Bos taurus
agcaaagtgagcacacagggagagcagaacgtggagccagtggccgctgtgcactgccgtaggttcgtgcggatcacccttggtcctgaccccggaagtcgggtcagatctgcctgactcactcctgtgctgcacgctcaagaggagccaaagatgcacgcactgacacagacggtcagcaggcaaaaaaaatggaatgtg

SEQ ID NO: 54236 - DNA, 201 bp, Bos taurus
ggctgacctggtttcccactggcctcagaggagagtaggaggtggccttcagcccctgcctggggggacacagccaggccggccaccaggaggaggcgtgtcttcacagctcatgtgtgtttctcactgcagacagggtgggctcctgcagccctgggccctctctgagggggaggtggggtctcaggaggagtgtgctga

SEQ ID NO: 54237 - DNA, 201 bp, Bos taurus; identical to SEQ ID NO: 13345

SEQ ID NO: 54238 - DNA, 201 bp, Bos taurus; identical to SEQ ID NO: 13346

SEQ ID NO: 54239 - DNA, 201 bp, Bos taurus; identical to SEQ ID NO: 13350

SEQ ID NO: 54240 - DNA, 201 bp, Bos taurus
aggatctatgattcaaggcagagtgtcttcagggcctgtggactcctttgttctttatgttcccaagcatcccgtttccttccgtctcactgctttgacacgctaggcctatcagtcctgccttaggctgcttccctcatggtgcccaggtggctgccacagcccagtcatcacactcagttgcaacaattttttgacata

SEQ ID NO: 54241 - DNA, 201 bp, Bos taurus; identical to SEQ ID NO: 13351

SEQ ID NO: 54242 - DNA, 201 bp, Bos taurus; identical to SEQ ID NO: 13354

SEQ ID NO: 54243 - DNA, 201 bp, Bos taurus; identical to SEQ ID NO: 13356

SEQ ID NO: 54244 - DNA, 201 bp, Bos taurus; identical to SEQ ID NO: 13357

SEQ ID NO: 54245 - DNA, 201 bp, Bos taurus; identical to SEQ ID NO: 13358

SEQ ID NO: 54246 - DNA, 201 bp, Bos taurus; identical to SEQ ID NO: 13359

SEQ ID NO: 54247 - DNA, 201 bp, Bos taurus; identical to SEQ ID NO: 13360

SEQ ID NO: 54248 - DNA, 201 bp, Bos taurus; identical to SEQ ID NO: 13362

SEQ ID NO: 54249 - DNA, 201 bp, Bos taurus; identical to SEQ ID NO: 13363

SEQ ID NO: 54250 - DNA, 201 bp, Bos taurus; identical to SEQ ID NO: 13364

SEQ ID NO: 54251 - DNA, 201 bp, Bos taurus; identical to SEQ ID NO: 13365

SEQ ID NO: 54252 - DNA, 201 bp, Bos taurus; identical to SEQ ID NO: 13366

SEQ ID NO: 54253 - DNA, 201 bp, Bos taurus
agatgcccccaggaaggggtttgaccctgggcaaggccgtccctcaacagctgagatgcattttgatgctgttaatatccctagcagttggggatggactgcttgcgtactgaagtggggccatctggggaccccaccacagcagtcagcacagatattagtcccctttttaagaattaatgatttgcccaaggtcacaca

SEQ ID NO: 54254 - DNA, 201 bp, Bos taurus; identical to SEQ ID NO: 13369

SEQ ID NO: 54255 - DNA, 201 bp, Bos taurus; identical to SEQ ID NO: 13370

SEQ ID NO: 54256 - DNA, 201 bp, Bos taurus
caactaaccatgtgattctttttccattttcattccatagcaccagtccctctatagcccacagaaagagattgggaagagagttgttggaaatctaaatgtgggggcagagaggaatgggtatttgacagggagggtatttaaggaagggtatatttcctttccttaattcaaatggggagtagggaaactcccaaagga

SEQ ID NO: 54257 - DNA, 201 bp, Bos taurus; identical to SEQ ID NO: 13371

SEQ ID NO: 54258 - DNA, 201 bp, Bos taurus; identical to SEQ ID NO: 13372

SEQ ID NO: 54259 - DNA, 201 bp, Bos taurus; identical to SEQ ID NO: 13373

SEQ ID NO: 54260 - DNA, 201 bp, Bos taurus; identical to SEQ ID NO: 13374

SEQ ID NO: 54261 - DNA, 201 bp, Bos taurus; identical to SEQ ID NO: 13375

SEQ ID NO: 54262 - DNA, 201 bp, Bos taurus; identical to SEQ ID NO: 13376

SEQ ID NO: 54263 - DNA, 201 bp, Bos taurus; identical to SEQ ID NO: 13377

SEQ ID NO: 54264 - DNA, 201 bp, Bos taurus; identical to SEQ ID NO: 13378

SEQ ID NO: 54265 - DNA, 201 bp, Bos taurus; identical to SEQ ID NO: 13379

SEQ ID NO: 54266 - DNA, 201 bp, Bos taurus; identical to SEQ ID NO: 13380

SEQ ID NO: 54267 - DNA, 201 bp, Bos taurus; identical to SEQ ID NO: 13381

SEQ ID NO: 54268 - DNA, 201 bp, Bos taurus; identical to SEQ ID NO: 13382

SEQ ID NO: 54269 - DNA, 201 bp, Bos taurus; identical to SEQ ID NO: 13383

SEQ ID NO: 54270 - DNA, 201 bp, Bos taurus; identical to SEQ ID NO: 13384

SEQ ID NO: 54271 - DNA, 201 bp, Bos taurus; identical to SEQ ID NO: 13385

SEQ ID NO: 54272 - DNA, 201 bp, Bos taurus; identical to SEQ ID NO: 13386

SEQ ID NO: 54273 - DNA, 201 bp, Bos taurus; identical to SEQ ID NO: 13388

SEQ ID NO: 54274 - DNA, 201 bp, Bos taurus; identical to SEQ ID NO: 13389

SEQ ID NO: 54275 - DNA, 201 bp, Bos taurus; identical to SEQ ID NO: 13390

SEQ ID NO: 54276 - DNA, 201 bp, Bos taurus; identical to SEQ ID NO: 13391

SEQ ID NO: 54277 - DNA, 201 bp, Bos taurus; identical to SEQ ID NO: 13392

SEQ ID NO: 54278 - DNA, 201 bp, Bos taurus; identical to SEQ ID NO: 13393

SEQ ID NO: 54279 - DNA, 201 bp, Bos taurus; identical to SEQ ID NO: 13394

SEQ ID NO: 54280 - DNA, 201 bp, Bos taurus; identical to SEQ ID NO: 13395

SEQ ID NO: 54281 - DNA, 201 bp, Bos taurus; identical to SEQ ID NO: 13396

SEQ ID NO: 54282 - DNA, 201 bp, Bos taurus; identical to SEQ ID NO: 13397

SEQ ID NO: 54283 - DNA, 201 bp, Bos taurus; identical to SEQ ID NO: 13398

SEQ ID NO: 54284 - DNA, 201 bp, Bos taurus; identical to SEQ ID NO: 13399

SEQ ID NO: 54285 - DNA, 201 bp, Bos taurus; identical to SEQ ID NO: 13400

SEQ ID NO: 54286 - DNA, 201 bp, Bos taurus; identical to SEQ ID NO: 13401

SEQ ID NO: 54287 - DNA, 201 bp, Bos taurus; identical to SEQ ID NO: 13402

SEQ ID NO: 54288 - DNA, 201 bp, Bos taurus; identical to SEQ ID NO: 13404

SEQ ID NO: 54289 - DNA, 201 bp, Bos taurus; identical to SEQ ID NO: 13405

SEQ ID NO: 54290 - DNA, 201 bp, Bos taurus; identical to SEQ ID NO: 13406

SEQ ID NO: 54291 - DNA, 201 bp, Bos taurus; identical to SEQ ID NO: 13407

SEQ ID NO: 54292 - DNA, 201 bp, Bos taurus; identical to SEQ ID NO: 13408

SEQ ID NO: 54293 - DNA, 201 bp, Bos taurus; identical to SEQ ID NO: 13410

SEQ ID NO: 54294 - DNA, 201 bp, Bos taurus; identical to SEQ ID NO: 13411

SEQ ID NO: 54295 - DNA, 201 bp, Bos taurus; identical to SEQ ID NO: 13413

SEQ ID NO: 54296 - DNA, 201 bp, Bos taurus; identical to SEQ ID NO: 13414

SEQ ID NO: 54297 - DNA, 201 bp, Bos taurus; identical to SEQ ID NO: 13415

SEQ ID NO: 54298 - DNA, 201 bp, Bos taurus; identical to SEQ ID NO: 13416

SEQ ID NO: 54299 - DNA, 201 bp, Bos taurus; identical to SEQ ID NO: 13417

SEQ ID NO: 54300 - DNA, 201 bp, Bos taurus; identical to SEQ ID NO: 13418

SEQ ID NO: 54301 - DNA, 201 bp, Bos taurus; identical to SEQ ID NO: 13419

SEQ ID NO: 54302 - DNA, 201 bp, Bos taurus; identical to SEQ ID NO: 13421

SEQ ID NO: 54303 - DNA, 201 bp, Bos taurus; identical to SEQ ID NO: 13422

SEQ ID NO: 54304 - DNA, 201 bp, Bos taurus; identical to SEQ ID NO: 13423

SEQ ID NO: 54305 - DNA, 201 bp, Bos taurus; identical to SEQ ID NO: 13424

SEQ ID NO: 54306 - DNA, 201 bp, Bos taurus; identical to SEQ ID NO: 13425

SEQ ID NO: 54307 - DNA, 201 bp, Bos taurus; identical to SEQ ID NO: 13426

SEQ ID NO: 54308 - DNA, 201 bp, Bos taurus; identical to SEQ ID NO: 13427

SEQ ID NO: 54309 - DNA, 201 bp, Bos taurus; identical to SEQ ID NO: 13428

SEQ ID NO: 54310 - DNA, 201 bp, Bos taurus; identical to SEQ ID NO: 13429

SEQ ID NO: 54311 - DNA, 201 bp, Bos taurus; identical to SEQ ID NO: 13430

SEQ ID NO: 54312 - DNA, 201 bp, Bos taurus; identical to SEQ ID NO: 13431

SEQ ID NO: 54313 - DNA, 201 bp, Bos taurus; identical to SEQ ID NO: 13432

SEQ ID NO: 54314 - DNA, 201 bp, Bos taurus; identical to SEQ ID NO: 13433

SEQ ID NO: 54315 - DNA, 201 bp, Bos taurus; identical to SEQ ID NO: 13434

SEQ ID NO: 54316 - DNA, 201 bp, Bos taurus; identical to SEQ ID NO: 13435

SEQ ID NO: 54317 - DNA, 201 bp, Bos taurus; identical to SEQ ID NO: 13436

SEQ ID NO: 54318 - DNA, 201 bp, Bos taurus; identical to SEQ ID NO: 13437

SEQ ID NO: 54319 - DNA, 201 bp, Bos taurus; identical to SEQ ID NO: 13438

SEQ ID NO: 54320 - DNA, 201 bp, Bos taurus; identical to SEQ ID NO: 13439

SEQ ID NO: 54321 - DNA, 201 bp, Bos taurus; identical to SEQ ID NO: 13440

SEQ ID NO: 54322 - DNA, 201 bp, Bos taurus; identical to SEQ ID NO: 13441

SEQ ID NO: 54323 - DNA, 201 bp, Bos taurus; identical to SEQ ID NO: 13442

SEQ ID NO: 54324 - DNA, 201 bp, Bos taurus; identical to SEQ ID NO: 13443

SEQ ID NO: 54325 - DNA, 201 bp, Bos taurus; identical to SEQ ID NO: 13444

SEQ ID NO: 54326 - DNA, 201 bp, Bos taurus; identical to SEQ ID NO: 13445

SEQ ID NO: 54327 - DNA, 201 bp, Bos taurus; identical to SEQ ID NO: 13446

SEQ ID NO: 54328 - DNA, 201 bp, Bos taurus; identical to SEQ ID NO: 13447

SEQ ID NO: 54329 - DNA, 201 bp, Bos taurus; identical to SEQ ID NO: 13448

SEQ ID NO: 54330 - DNA, 201 bp, Bos taurus; identical to SEQ ID NO: 13449

SEQ ID NO: 54331 - DNA, 201 bp, Bos taurus; identical to SEQ ID NO: 13450

SEQ ID NO: 54332 - DNA, 201 bp, Bos taurus; identical to SEQ ID NO: 13451

SEQ ID NO: 54333 - DNA, 201 bp, Bos taurus; identical to SEQ ID NO: 13452

SEQ ID NO: 54334 - DNA, 201 bp, Bos taurus; identical to SEQ ID NO: 13453

SEQ ID NO: 54335 - DNA, 201 bp, Bos taurus; identical to SEQ ID NO: 13454

SEQ ID NO: 54336 - DNA, 201 bp, Bos taurus; identical to SEQ ID NO: 13455

SEQ ID NO: 54337 - DNA, 201 bp, Bos taurus; identical to SEQ ID NO: 13456

SEQ ID NO: 54338 - DNA, 201 bp, Bos taurus; identical to SEQ ID NO: 13457

SEQ ID NO: 54339 - DNA, 201 bp, Bos taurus; identical to SEQ ID NO: 13458

SEQ ID NO: 54340 - DNA, 201 bp, Bos taurus; identical to SEQ ID NO: 13459

SEQ ID NO: 54341 - DNA, 201 bp, Bos taurus; identical to SEQ ID NO: 13460

SEQ ID NO: 54342 - DNA, 201 bp, Bos taurus; identical to SEQ ID NO: 13461

SEQ ID NO: 54343 - DNA, 201 bp, Bos taurus; identical to SEQ ID NO: 13462

SEQ ID NO: 54344 - DNA, 201 bp, Bos taurus; identical to SEQ ID NO: 13463

SEQ ID NO: 54345 - DNA, 201 bp, Bos taurus; identical to SEQ ID NO: 13465

SEQ ID NO: 54346 - DNA, 201 bp, Bos taurus; identical to SEQ ID NO: 13466

SEQ ID NO: 54347 - DNA, 201 bp, Bos taurus; identical to SEQ ID NO: 13467

SEQ ID NO: 54348 - DNA, 201 bp, Bos taurus; identical to SEQ ID NO: 13468

SEQ ID NO: 54349 - DNA, 201 bp, Bos taurus; identical to SEQ ID NO: 13469

SEQ ID NO: 54350 - DNA, 201 bp, Bos taurus; identical to SEQ ID NO: 13470

SEQ ID NO: 54351 - DNA, 201 bp, Bos taurus; identical to SEQ ID NO: 13472

SEQ ID NO: 54352 - DNA, 201 bp, Bos taurus; identical to SEQ ID NO: 13473

SEQ ID NO: 54353 - DNA, 201 bp, Bos taurus; identical to SEQ ID NO: 13474

SEQ ID NO: 54354 - DNA, 201 bp, Bos taurus; identical to SEQ ID NO: 13475

SEQ ID NO: 54355 - DNA, 201 bp, Bos taurus; identical to SEQ ID NO: 13476

SEQ ID NO: 54356 - DNA, 201 bp, Bos taurus; identical to SEQ ID NO: 13477

SEQ ID NO: 54357 - DNA, 201 bp, Bos taurus; identical to SEQ ID NO: 13478

SEQ ID NO: 54358 - DNA, 201 bp, Bos taurus; identical to SEQ ID NO: 13479

SEQ ID NO: 54359 - DNA, 201 bp, Bos taurus; identical to SEQ ID NO: 13480

SEQ ID NO: 54360 - DNA, 201 bp, Bos taurus; identical to SEQ ID NO: 13481

SEQ ID NO: 54361 - DNA, 201 bp, Bos taurus; identical to SEQ ID NO: 13482

SEQ ID NO: 54362 - DNA, 201 bp, Bos taurus; identical to SEQ ID NO: 13483

SEQ ID NO: 54363 - DNA, 201 bp, Bos taurus; identical to SEQ ID NO: 13484

SEQ ID NO: 54364 - DNA, 201 bp, Bos taurus; identical to SEQ ID NO: 13485

SEQ ID NO: 54365 - DNA, 201 bp, Bos taurus; identical to SEQ ID NO: 13486

SEQ ID NO: 54366 - DNA, 201 bp, Bos taurus; identical to SEQ ID NO: 13487

SEQ ID NO: 54367 - DNA, 201 bp, Bos taurus; identical to SEQ ID NO: 13488

SEQ ID NO: 54368 - DNA, 201 bp, Bos taurus; identical to SEQ ID NO: 13489

SEQ ID NO: 54369 - DNA, 201 bp, Bos taurus; identical to SEQ ID NO: 13490

SEQ ID NO: 54370 - DNA, 201 bp, Bos taurus; identical to SEQ ID NO: 13491

SEQ ID NO: 54371 - DNA, 201 bp, Bos taurus; identical to SEQ ID NO: 13492

SEQ ID NO: 54372 - DNA, 201 bp, Bos taurus; identical to SEQ ID NO: 13493

SEQ ID NO: 54373 - DNA, 201 bp, Bos taurus; identical to SEQ ID NO: 13494

SEQ ID NO: 54374 - DNA, 201 bp, Bos taurus; identical to SEQ ID NO: 13495

SEQ ID NO: 54375 - DNA, 201 bp, Bos taurus; identical to SEQ ID NO: 13496

SEQ ID NO: 54376 - DNA, 201 bp, Bos taurus; identical to SEQ ID NO: 13497

SEQ ID NO: 54377 - DNA, 201 bp, Bos taurus; identical to SEQ ID NO: 13498

SEQ ID NO: 54378 - DNA, 201 bp, Bos taurus; identical to SEQ ID NO: 13499

SEQ ID NO: 54379 - DNA, 201 bp, Bos taurus; identical to SEQ ID NO: 13500

SEQ ID NO: 54380 - DNA, 201 bp, Bos taurus; identical to SEQ ID NO: 13501

SEQ ID NO: 54381 - DNA, 201 bp, Bos taurus; identical to SEQ ID NO: 13502

SEQ ID NO: 54382 - DNA, 201 bp, Bos taurus; identical to SEQ ID NO: 13503

SEQ ID NO: 54383 - DNA, 201 bp, Bos taurus; identical to SEQ ID NO: 13504

SEQ ID NO: 54384 - DNA, 201 bp, Bos taurus; identical to SEQ ID NO: 13505

SEQ ID NO: 54385 - DNA, 201 bp, Bos taurus; identical to SEQ ID NO: 13506

SEQ ID NO: 54386 - DNA, 201 bp, Bos taurus; identical to SEQ ID NO: 13507

SEQ ID NO: 54387 - DNA, 201 bp, Bos taurus; identical to SEQ ID NO: 13508

SEQ ID NO: 54388 - DNA, 201 bp, Bos taurus; identical to SEQ ID NO: 13509

SEQ ID NO: 54389 - DNA, 201 bp, Bos taurus; identical to SEQ ID NO: 13510

SEQ ID NO: 54390 - DNA, 201 bp, Bos taurus; identical to SEQ ID NO: 13511

SEQ ID NO: 54391 - DNA, 201 bp, Bos taurus; identical to SEQ ID NO: 13512

SEQ ID NO: 54392 - DNA, 201 bp, Bos taurus; identical to SEQ ID NO: 13513

SEQ ID NO: 54393 - DNA, 201 bp, Bos taurus; identical to SEQ ID NO: 13514

SEQ ID NO: 54394 - DNA, 201 bp, Bos taurus; identical to SEQ ID NO: 13515

SEQ ID NO: 54395 - DNA, 201 bp, Bos taurus
tgggcttagctgccccatggcatgtgggatcttccccagccaggggtcaaatctgtgtcccttgcactggcaggcaggtccttaaccactgggccaccagggaagtcccctattttattctttgtctatgtagtgccaagtgctcagactggtcatttgactaaactcaccacattgactagttgctttggcatcatgtga

SEQ ID NO: 54396 - DNA, 201 bp, Bos taurus; identical to SEQ ID NO: 13516

SEQ ID NO: 54397 - DNA, 201 bp, Bos taurus; identical to SEQ ID NO: 13517

SEQ ID NO: 54398 - DNA, 201 bp, Bos taurus; identical to SEQ ID NO: 13518

SEQ ID NO: 54399 - DNA, 201 bp, Bos taurus; identical to SEQ ID NO: 13519

SEQ ID NO: 54400 - DNA, 201 bp, Bos taurus; identical to SEQ ID NO: 13520

SEQ ID NO: 54401 - DNA, 201 bp, Bos taurus; identical to SEQ ID NO: 13521

SEQ ID NO: 54402 - DNA, 201 bp, Bos taurus; identical to SEQ ID NO: 13522

SEQ ID NO: 54403 - DNA, 201 bp, Bos taurus; identical to SEQ ID NO: 13523

SEQ ID NO: 54404 - DNA, 201 bp, Bos taurus; identical to SEQ ID NO: 13524

SEQ ID NO: 54405 - DNA, 201 bp, Bos taurus; identical to SEQ ID NO: 13525

SEQ ID NO: 54406 - DNA, 201 bp, Bos taurus; identical to SEQ ID NO: 13526

SEQ ID NO: 54407 - DNA, 201 bp, Bos taurus; identical to SEQ ID NO: 13527

SEQ ID NO: 54408 - DNA, 201 bp, Bos taurus; identical to SEQ ID NO: 13528

SEQ ID NO: 54409 - DNA, 201 bp, Bos taurus; identical to SEQ ID NO: 13529

SEQ ID NO: 54410 - DNA, 201 bp, Bos taurus; identical to SEQ ID NO: 13530

SEQ ID NO: 54411 - DNA, 201 bp, Bos taurus; identical to SEQ ID NO: 13531

SEQ ID NO: 54412 - DNA, 201 bp, Bos taurus; identical to SEQ ID NO: 13532

SEQ ID NO: 54413 - DNA, 201 bp, Bos taurus; identical to SEQ ID NO: 13533

SEQ ID NO: 54414 - DNA, 201 bp, Bos taurus; identical to SEQ ID NO: 13534

SEQ ID NO: 54415 - DNA, 201 bp, Bos taurus; identical to SEQ ID NO: 13535

SEQ ID NO: 54416 - DNA, 201 bp, Bos taurus; identical to SEQ ID NO: 13536

SEQ ID NO: 54417 - DNA, 201 bp, Bos taurus; identical to SEQ ID NO: 13537

SEQ ID NO: 54418 - DNA, 201 bp, Bos taurus; identical to SEQ ID NO: 13538

SEQ ID NO: 54419 - DNA, 201 bp, Bos taurus; identical to SEQ ID NO: 13539

SEQ ID NO: 54420 - DNA, 201 bp, Bos taurus; identical to SEQ ID NO: 13540

SEQ ID NO: 54421 - DNA, 201 bp, Bos taurus; identical to SEQ ID NO: 13541

SEQ ID NO: 54422 - DNA, 201 bp, Bos taurus; identical to SEQ ID NO: 13542

SEQ ID NO: 54423 - DNA, 201 bp, Bos taurus; identical to SEQ ID NO: 13543

SEQ ID NO: 54424 - DNA, 201 bp, Bos taurus; identical to SEQ ID NO: 13544

SEQ ID NO: 54425 - DNA, 201 bp, Bos taurus; identical to SEQ ID NO: 13545

SEQ ID NO: 54426 - DNA, 201 bp, Bos taurus
tgcatgaaaattcagtgctcaaaataatcctcttcaaaatgaaacaaactggcactccctcctttttacttcagccatatattttcactttttattttgcttctatgtattagaacacccttaataggctttatgtaatgctcaaaatcttttccaatacattttgaggatttggtattaagaaaaacttactcttcataa

SEQ ID NO: 54427 - DNA, 201 bp, Bos taurus
attatttaaaatgctggaaactaataaaggtgatagtggttttaaaaaaaaaaaaaaaactttattgggagtatagttgatttacagtgttgttagtttcaacaaagtggaacctgttgtacctatatctacttttttagattgttttctcatatagctctttacagagtgttgagtagagttgcttttgcaatacaggag

SEQ ID NO: 54428 - DNA, 201 bp, Bos taurus; identical to SEQ ID NO: 13549

SEQ ID NO: 54429 - DNA, 201 bp, Bos taurus; identical to SEQ ID NO: 13550

SEQ ID NO: 54430 - DNA, 201 bp, Bos taurus; identical to SEQ ID NO: 13551

SEQ ID NO: 54431 - DNA, 201 bp, Bos taurus; identical to SEQ ID NO: 13552

SEQ ID NO: 54432 - DNA, 201 bp, Bos taurus; identical to SEQ ID NO: 13553

SEQ ID NO: 54433 - DNA, 201 bp, Bos taurus; identical to SEQ ID NO: 13557

SEQ ID NO: 54434 - DNA, 201 bp, Bos taurus; identical to SEQ ID NO: 13558

SEQ ID NO: 54435 - DNA, 201 bp, Bos taurus
aggccaggaggggagcagttcttgtattgatggagtcagagcctgaattctaaggtcaggatatagatattaaaactgcacactcatgggcacatcaaaccttagccatatgggcctttttgttctgaaggttcacaggtgaaattgacttgatacattttctttgatgtttattaaaccataattttgtagaatttgaaa

SEQ ID NO: 54436 - DNA, 201 bp, Bos taurus; identical to SEQ ID NO: 13559

SEQ ID NO: 54437 - DNA, 201 bp, Bos taurus; identical to SEQ ID NO: 13560

SEQ ID NO: 54438 - DNA, 201 bp, Bos taurus; identical to SEQ ID NO: 13561

SEQ ID NO: 54439 - DNA, 201 bp, Bos taurus; identical to SEQ ID NO: 13562

SEQ ID NO: 54440 - DNA, 201 bp, Bos taurus
ttttgctcaaactcaggctggcttagccgtgttggggaaagggagcaattttgcctgaaagctacttctgggactacaggctgaggagggccgaggacaaagggctcctgacctggaacagcttgttagcttctggctggtggtttgtagaggaaggtgggggtggtgaggaggtacgtgattaatcatgtagtcagtggg

SEQ ID NO: 54441 - DNA, 201 bp, Bos taurus
ttttgtaaaatgaaggtaagtagtatgttggaaaagtcctactattgtgtgaggacagagtatttggagctttgataactatctttttgacctctagggaaaatgttaaatatataccaaggatggctgagcagaaaatttaaaagagtctgcatccttgtgatataattaagttattgattcagtcttaggatggcctct

SEQ ID NO: 54442 - DNA, 201 bp, Bos taurus; identical to SEQ ID NO: 13563

SEQ ID NO: 54443 - DNA, 201 bp, Bos taurus
ttcaggtcaatgattctgtgataaagatattatttagtgtcctaaatattcatggcattccccataactgaccccagctcttcacagttcttcatacttacggctaggataaaattcttttgtttccaagtgaaggatgtgggttaagcaggtttggaattctggagctggaagaacaaggagtgggtttagaacaaagga

SEQ ID NO: 54444 - DNA, 201 bp, Bos taurus
acagaaagatcaggtggcaagcaaggattgaatctttattgacagcattgttagaattgaatgtagggcattctatggggataaaccttttgttctatacgtggtaactattttgagtctgatttttctcatcatgatcagacatgatatcatatcagatatcatgaaaagacatgataataatatcagtttctctctatg

SEQ ID NO: 54445 - DNA, 201 bp, Bos taurus; identical to SEQ ID NO: 13566

SEQ ID NO: 54446 - DNA, 201 bp, Bos taurus; identical to SEQ ID NO: 13567

SEQ ID NO: 54447 - DNA, 201 bp, Bos taurus
actcacatatctcccaggttagataattaaactctaaacccaaagatgtatgtgcttattgaacatccacatttgaatgacccatagaaatccaaatacagcatgtccaaactactccctcattcttattgatttctaaatcggtttttctctcggtagataatacaaccaatacacttctccaagccagagagctagctg

SEQ ID NO: 54448 - DNA, 201 bp, Bos taurus; identical to SEQ ID NO: 13569

SEQ ID NO: 54449 - DNA, 201 bp, Bos taurus; identical to SEQ ID NO: 13570

SEQ ID NO: 54450 - DNA, 201 bp, Bos taurus; identical to SEQ ID NO: 13571

SEQ ID NO: 54451 - DNA, 201 bp, Bos taurus; identical to SEQ ID NO: 13572

SEQ ID NO: 54452 - DNA, 201 bp, Bos taurus; identical to SEQ ID NO: 13573

SEQ ID NO: 54453 - DNA, 201 bp, Bos taurus; identical to SEQ ID NO: 13575

SEQ ID NO: 54454 - DNA, 201 bp, Bos taurus; identical to SEQ ID NO: 13577

SEQ ID NO: 54455 - DNA, 201 bp, Bos taurus; identical to SEQ ID NO: 13578

SEQ ID NO: 54456 - DNA, 201 bp, Bos taurus; identical to SEQ ID NO: 13579

SEQ ID NO: 54457 - DNA, 201 bp, Bos taurus; identical to SEQ ID NO: 13580

SEQ ID NO: 54458 - DNA, 201 bp, Bos taurus; identical to SEQ ID NO: 13581

SEQ ID NO: 54459 - DNA, 201 bp, Bos taurus; identical to SEQ ID NO: 13582

SEQ ID NO: 54460 - DNA, 201 bp, Bos taurus; identical to SEQ ID NO: 13583

SEQ ID NO: 54461 - DNA, 201 bp, Bos taurus
tactaccctggggctataactttttataggtctttggccctcctcttccctctcttgtcccaagaagctagtctaatcttataacctttcacccagatcaaaatcgtgggcctgatgagcaagatcttttctaagtgaaataaaaaaataatgaccatctgtgtcatggtacacaaggtttagagattgcagaaaacacat

SEQ ID NO: 54462 - DNA, 201 bp, Bos taurus; identical to SEQ ID NO: 13584

SEQ ID NO: 54463 - DNA, 201 bp, Bos taurus; identical to SEQ ID NO: 13585

SEQ ID NO: 54464 - DNA, 201 bp, Bos taurus; identical to SEQ ID NO: 13586

SEQ ID NO: 54465 - DNA, 201 bp, Bos taurus; identical to SEQ ID NO: 13587

SEQ ID NO: 54466 - DNA, 201 bp, Bos taurus
agtcagagaaagttcatggaaaacaggtgctcacaactaaaaagtcactgttacatctagcctttagttacagtcataaaaaagtaactttcagttttctctagtaatgggaaacaggatagcagggatactgaaaatcctcaataatcccaaagtttccatttgattatgttacaaacttctttacctttaaaataaaaa

SEQ ID NO: 54467 - DNA, 201 bp, Bos taurus; identical to SEQ ID NO: 13588

SEQ ID NO: 54468 - DNA, 201 bp, Bos taurus
caatatgatacctaatcaattttaacataaattaactagactgaatcactgtactactattttcagaacatcagtcttgcagaatgatccagaaataaagaattcttgggacttccctggtggtccagtggttaagatgccacacttacaaggcaggggttgcaggttcaaacccgggtcagggaactaagatcccacatg

SEQ ID NO: 54469 - DNA, 201 bp, Bos taurus; identical to SEQ ID NO: 13590

SEQ ID NO: 54470 - DNA, 201 bp, Bos taurus; identical to SEQ ID NO: 13591

SEQ ID NO: 54471 - DNA, 201 bp, Bos taurus; identical to SEQ ID NO: 13592

SEQ ID NO: 54472 - DNA, 201 bp, Bos taurus
gtccatcttcacctgcacaactcctactcatccttcagacctcagctgaactatctctcccttggaggggcattcccaggtgaccagcacagcccccatacctagacaggcacatggagacccagcacaatgcctggcacaccacagacattatcaaaaccattgctcaatgcagtataccttttactgccccttcacaca

SEQ ID NO: 54473 - DNA, 201 bp, Bos taurus
aatctcaagcattttggctctaagtggtggctccacatcttttcttccaatggctgtttcttagaaccaaattcaagcttccatatttctggctcctactctagcattcatgtccaaagagaagaatttcagaaatagcttggattgactgcctattaggaacactccacactcacatgcatggcactgggccagaatatc

SEQ ID NO: 54474 - DNA, 201 bp, Bos taurus
cctgaatgaccatgtctgcctggatctagaatgagggttgaggatgactctggtactggggtcatgttttcaatgaagaaagagattcccaccacttcaattttcctcttccataaaacattgtgatacacgaaagctctgggttgagacatgggtgctgcagtcttaagtacctcatgtgcaatgtgcaccattatggtg

SEQ ID NO: 54475 - DNA, 201 bp, Bos taurus; identical to SEQ ID NO: 13600

SEQ ID NO: 54476 - DNA, 201 bp, Bos taurus; identical to SEQ ID NO: 13602

SEQ ID NO: 54477 - DNA, 201 bp, Bos taurus; identical to SEQ ID NO: 13605

SEQ ID NO: 54478 - DNA, 201 bp, Bos taurus; identical to SEQ ID NO: 13606

SEQ ID NO: 54479 - DNA, 201 bp, Bos taurus; identical to SEQ ID NO: 13607

SEQ ID NO: 54480 - DNA, 201 bp, Bos taurus
aacaaatgagaagactgaagggagttttctcatgggagtggcagggcaagaggtcaaggaagtcagatgaccaacgctgtcactccagccaaaggttacccggacaacttcggccaagtcacattctctgagtcttagataacttacctgaagaatgaggaagtcaagtccgcttttctccaaaaaccctttctccttaga

SEQ ID NO: 54481 - DNA, 201 bp, Bos taurus; identical to SEQ ID NO: 13609

SEQ ID NO: 54482 - DNA, 201 bp, Bos taurus
agatcacaggcagaagcagttgtggatctgagacaaacctggacttctgacttgaccacagatacagttgttcaaaccgttctgtggggcctggttgaactggtggagctgcgggagaaaagataaactctatacacaatcctgtttgtttatttatttattttggccatgctgtgtggcaagtgagatcttagttcccca

SEQ ID NO: 54483 - DNA, 201 bp, Bos taurus; identical to SEQ ID NO: 13610

SEQ ID NO: 54484 - DNA, 201 bp, Bos taurus
agtagagggcctgcacatgatgagagagaagacagttctaattaatgctaatacagctccttctttctttgcaggtttgggaggtgctctcggttaccttttgggtgccattgactgggcccacttggaactgggaagactgctgggcacggaattccaggtcatgttcttcttctcctcgctggtgctcactttgtgttt

SEQ ID NO: 54485 - DNA, 201 bp, Bos taurus
acatgtaattaattggtgcgctaacctcacaggcattagatgcttagctcttagcccacagctcttcaatagattgtttactcacattcaaccacactctctttaatctgatgcagttggaaaagaggttttcatagggctgttttttggcaccagtacccacactactattataatcagaactcttaaccaggtgttgtt

SEQ ID NO: 54486 - DNA, 201 bp, Bos taurus; identical to SEQ ID NO: 13612

SEQ ID NO: 54487 - DNA, 201 bp, Bos taurus
tcaactcagggccgtgtttaagaaaaaaaaatcattgaacttcagggagtactgagacattctgtcctcagtgttgttactgtgttcccccaattctgaaacctatttcctggcccttcatttaactccctggagaaaatagatcatttctttaagccctagtaaaaggagtaagtccttattagaccacatttttgcctc

SEQ ID NO: 54488 - DNA, 201 bp, Bos taurus
gttagcttatctcatctggattcatctcttggtctaagagggactcagtaggtccaagaggagtgaggtttcagttgagaggccaaactagttcatctttgctagtttattacataaatcatcacagcttctcattgaccttcagtgatcttggccttggctttgcattgtcaaacctcatggattcttttccatacccct

SEQ ID NO: 54489 - DNA, 201 bp, Bos taurus; identical to SEQ ID NO: 13614

SEQ ID NO: 54490 - DNA, 201 bp, Bos taurus
aaactgacacttgaagatacatctgtgtgtactttctttggttcaggaagggaaaataacaacatggggttgtttgtattgcagagaagaactcttcaaggtcagaactggcttcaatctgactgaagctcattggcctgtgatttctgagactgaacaggcacaaaaacacacagtctggattcattatgaagacactat

SEQ ID NO: 54491 - DNA, 201 bp, Bos taurus; identical to SEQ ID NO: 13615

SEQ ID NO: 54492 - DNA, 201 bp, Bos taurus; identical to SEQ ID NO: 13616

SEQ ID NO: 54493 - DNA, 201 bp, Bos taurus; identical to SEQ ID NO: 13620

SEQ ID NO: 54494 - DNA, 201 bp, Bos taurus; identical to SEQ ID NO: 13621

SEQ ID NO: 54495 - DNA, 201 bp, Bos taurus; identical to SEQ ID NO: 13622

SEQ ID NO: 54496 - DNA, 201 bp, Bos taurus; identical to SEQ ID NO: 13623

SEQ ID NO: 54497 - DNA, 201 bp, Bos taurus; identical to SEQ ID NO: 13624

SEQ ID NO: 54498 - DNA, 201 bp, Bos taurus; identical to SEQ ID NO: 13625

SEQ ID NO: 54499 - DNA, 201 bp, Bos taurus; identical to SEQ ID NO: 13626

SEQ ID NO: 54500 - DNA, 201 bp, Bos taurus; identical to SEQ ID NO: 13627

SEQ ID NO: 54501 - DNA, 201 bp, Bos taurus; identical to SEQ ID NO: 13628

SEQ ID NO: 54502 - DNA, 201 bp, Bos taurus; identical to SEQ ID NO: 13629

SEQ ID NO: 54503 - DNA, 201 bp, Bos taurus; identical to SEQ ID NO: 13630

SEQ ID NO: 54504 - DNA, 201 bp, Bos taurus; identical to SEQ ID NO: 13631

SEQ ID NO: 54505 - DNA, 201 bp, Bos taurus; identical to SEQ ID NO: 13632

SEQ ID NO: 54506 - DNA, 201 bp, Bos taurus; identical to SEQ ID NO: 13634

SEQ ID NO: 54507 - DNA, 201 bp, Bos taurus; identical to SEQ ID NO: 13635

SEQ ID NO: 54508 - DNA, 201 bp, Bos taurus; identical to SEQ ID NO: 13637

SEQ ID NO: 54509 - DNA, 201 bp, Bos taurus; identical to SEQ ID NO: 13638

SEQ ID NO: 54510 - DNA, 201 bp, Bos taurus; identical to SEQ ID NO: 13639

SEQ ID NO: 54511 - DNA, 201 bp, Bos taurus; identical to SEQ ID NO: 13640

SEQ ID NO: 54512 - DNA, 201 bp, Bos taurus; identical to SEQ ID NO: 13641

SEQ ID NO: 54513 - DNA, 201 bp, Bos taurus
gtgagagattcttattctcactgtgcattcttatcaataaaagctctcaaagtgtcagtcataataggatttatttttaatccttttcattttgcagttcgtcttttaggttgtgcaactgtttctcatgtgtcccaagaggtcaaggtggttaccgtggccaacagtattcatgctatcaccacagctgccatattttca

SEQ ID NO: 54514 - DNA, 201 bp, Bos taurus; identical to SEQ ID NO: 13644

SEQ ID NO: 54515 - DNA, 201 bp, Bos taurus; identical to SEQ ID NO: 13645

SEQ ID NO: 54516 - DNA, 201 bp, Bos taurus; identical to SEQ ID NO: 13646

SEQ ID NO: 54517 - DNA, 201 bp, Bos taurus; identical to SEQ ID NO: 13647

SEQ ID NO: 54518 - DNA, 201 bp, Bos taurus; identical to SEQ ID NO: 13648

SEQ ID NO: 54519 - DNA, 201 bp, Bos taurus; identical to SEQ ID NO: 13649

SEQ ID NO: 54520 - DNA, 201 bp, Bos taurus; identical to SEQ ID NO: 13650

SEQ ID NO: 54521 - DNA, 201 bp, Bos taurus; identical to SEQ ID NO: 13651

SEQ ID NO: 54522 - DNA, 201 bp, Bos taurus; identical to SEQ ID NO: 13652

SEQ ID NO: 54523 - DNA, 201 bp, Bos taurus; identical to SEQ ID NO: 13654

SEQ ID NO: 54524 - DNA, 201 bp, Bos taurus; identical to SEQ ID NO: 13655

SEQ ID NO: 54525 - DNA, 201 bp, Bos taurus; identical to SEQ ID NO: 13656

SEQ ID NO: 54526 - DNA, 201 bp, Bos taurus; identical to SEQ ID NO: 13657

SEQ ID NO: 54527 - DNA, 201 bp, Bos taurus; identical to SEQ ID NO: 13658

SEQ ID NO: 54528 - DNA, 201 bp, Bos taurus; identical to SEQ ID NO: 13659

SEQ ID NO: 54529 - DNA, 201 bp, Bos taurus; identical to SEQ ID NO: 13660

SEQ ID NO: 54530 - DNA, 201 bp, Bos taurus; identical to SEQ ID NO: 13661

SEQ ID NO: 54531 - DNA, 201 bp, Bos taurus; identical to SEQ ID NO: 13662

SEQ ID NO: 54532 - DNA, 201 bp, Bos taurus; identical to SEQ ID NO: 13663

SEQ ID NO: 54533 - DNA, 201 bp, Bos taurus; identical to SEQ ID NO: 13664

SEQ ID NO: 54534 - DNA, 201 bp, Bos taurus; identical to SEQ ID NO: 13665

SEQ ID NO: 54535 - DNA, 201 bp, Bos taurus; identical to SEQ ID NO: 13666

SEQ ID NO: 54536 - DNA, 201 bp, Bos taurus; identical to SEQ ID NO: 13667

SEQ ID NO: 54537 - DNA, 201 bp, Bos taurus; identical to SEQ ID NO: 13668

SEQ ID NO: 54538 - DNA, 201 bp, Bos taurus; identical to SEQ ID NO: 13669

SEQ ID NO: 54539 - DNA, 201 bp, Bos taurus; identical to SEQ ID NO: 13670

SEQ ID NO: 54540 - DNA, 201 bp, Bos taurus; identical to SEQ ID NO: 13671

SEQ ID NO: 54541 - DNA, 201 bp, Bos taurus; identical to SEQ ID NO: 13672

SEQ ID NO: 54542 - DNA, 201 bp, Bos taurus; identical to SEQ ID NO: 13673

SEQ ID NO: 54543 - DNA, 201 bp, Bos taurus; identical to SEQ ID NO: 13674

SEQ ID NO: 54544 - DNA, 201 bp, Bos taurus; identical to SEQ ID NO: 13675

SEQ ID NO: 54545 - DNA, 201 bp, Bos taurus; identical to SEQ ID NO: 13676

SEQ ID NO: 54546 - DNA, 201 bp, Bos taurus; identical to SEQ ID NO: 13677

SEQ ID NO: 54547 - DNA, 201 bp, Bos taurus; identical to SEQ ID NO: 13678

SEQ ID NO: 54548 - DNA, 201 bp, Bos taurus; identical to SEQ ID NO: 13679

SEQ ID NO: 54549 - DNA, 201 bp, Bos taurus; identical to SEQ ID NO: 13680

SEQ ID NO: 54550 - DNA, 201 bp, Bos taurus; identical to SEQ ID NO: 13681

SEQ ID NO: 54551 - DNA, 201 bp, Bos taurus; identical to SEQ ID NO: 13682

SEQ ID NO: 54552 - DNA, 201 bp, Bos taurus; identical to SEQ ID NO: 13683

SEQ ID NO: 54553 - DNA, 201 bp, Bos taurus; identical to SEQ ID NO: 13684

SEQ ID NO: 54554 - DNA, 201 bp, Bos taurus
attttagaggcctcaggcaggagggttgctattttagactccccaaaaggcaaaagcgaggtcacagcacagaaagaattaaaggacaaactgtgtgatacctgcattttcacggctagcggtggcaaggtagatggcatgcagctatggcagtggaactaatcaaacatgtacatctgattaattttgatgtgttagagg

SEQ ID NO: 54555 - DNA, 201 bp, Bos taurus; identical to SEQ ID NO: 13690

SEQ ID NO: 54556 - DNA, 201 bp, Bos taurus
ttgatcttggcagggcccagcctcctcccttgcttatccaaccattcttgtcttgggattttggtccacaggtgaaagatttccacttgctttgccctacgggaccaactgaggagggcccgacaacccactccaatattcttgtctggagaatcccatggacagaggagcctggagggctatatattccacagagttgca

SEQ ID NO: 54557 - DNA, 201 bp, Bos taurus
aaattttactgaatgctgtgggatatgctaaagtcccaacttcatgcaggattggagagagatgatgtattaattcataatgttactcaagtctctaatgtacattgtggagtttctgagtgttctatagaagttctgataggtttacaatataatactaagtagaacagttctcctcttttctctccccaactcctgctc

SEQ ID NO: 54558 - DNA, 201 bp, Bos taurus
ccatctaccttagcttaaatatatatatatatgttgatatatattaatgcacatatggattttgaaatgtgagattataacctttcaagctattatcatgctcagtacctatgcacttcgataagattaagctgtaagttttagctaattttcttgggatttaattttctgaaaaaattatgaattttcaaatgagtagaa

SEQ ID NO: 54559 - DNA, 201 bp, Bos taurus; identical to SEQ ID NO: 13692

SEQ ID NO: 54560 - DNA, 201 bp, Bos taurus
atcaaggccctagtgattcacagaactggcaaatcagactcaggtctctctaatccttgattttgtgtttttaaatccctaggctatttaatagttccttttcaaactggccgtacttcatatactgttgctgttgttcagtcactcagtggtgtccaacactgcaagcccatgggctgcagcatgccaggcttccctgtt

SEQ ID NO: 54561 - DNA, 201 bp, Bos taurus
ctgagatttttccccttgatttcctaggggtgcaaaaataatcaataagaagcaacaaggcaagttggttacattttagctttgctctcaaaaagagcagcctttatctttgtgaaatatagcttttctgttcaaatgcaaatttgtctcccctttaatggaatttttattagtaccctttattttgaaaatagtaccaat

SEQ ID NO: 54562 - DNA, 201 bp, Bos taurus; identical to SEQ ID NO: 13695

SEQ ID NO: 54563 - DNA, 201 bp, Bos taurus; identical to SEQ ID NO: 13696

SEQ ID NO: 54564 - DNA, 201 bp, Bos taurus; identical to SEQ ID NO: 13697

SEQ ID NO: 54565 - DNA, 201 bp, Bos taurus; identical to SEQ ID NO: 13699

SEQ ID NO: 54566 - DNA, 201 bp, Bos taurus; identical to SEQ ID NO: 13700

SEQ ID NO: 54567 - DNA, 201 bp, Bos taurus
atcaatttaatgactttgtatgaatgcacttttaataaactagaaatgacaagtgaggttaaaacaacagtgcattgcacattatgaaattttgttttgaatatgtctgtgttgtacacctcattctgagcaagcaagtcagaagacctggttcagggggtctccaaaatcattttacaatcaggagcctacaataaccag

SEQ ID NO: 54568 - DNA, 201 bp, Bos taurus; identical to SEQ ID NO: 13701

SEQ ID NO: 54569 - DNA, 201 bp, Bos taurus; identical to SEQ ID NO: 13702

SEQ ID NO: 54570 - DNA, 201 bp, Bos taurus
ttggagtcaacagcaatttttaaagattttatgtatatttcatccctaaaatatattgtgaagatgcacttctagatcattcatcaacatctatttatcatatttgctttcatttactaacataagcatgtatgttagagttgacccaggaatcaaatggattcaataactgtatgtatcatacatcgaacctggactggc

SEQ ID NO: 54571 - DNA, 201 bp, Bos taurus; identical to SEQ ID NO: 13704

SEQ ID NO: 54572 - DNA, 201 bp, Bos taurus; identical to SEQ ID NO: 13705

SEQ ID NO: 54573 - DNA, 201 bp, Bos taurus
ctctgtgatccctatacaaggggcccaagttgattcctggtcagggaactagatcccacatgactcaactaaagcccccacaggctgcaacaaagattgaagatctgtgtgcctcaattaaggcccagcacatctaaatacatagaaaataagaaatgaacaagcaaataaattaatgcataaacaataaataaatattag

SEQ ID NO: 54574 - DNA, 201 bp, Bos taurus
aatggtaagactgcactttagaaatattttaaaatagtagctctaatatattgatatttatcagggttttatatgaattctatgctgttccaatttaaatgattctttttatttttccccaagtatgacttgacactgcagactgcatatattgtcctataagaattttatccttgtgtaaagaactttattttctccaag

SEQ ID NO: 54575 - DNA, 201 bp, Bos taurus
tagacaaggatatatttgaaacaaacatagggctttttcctgcaccttacctttcttgttaaatacttccaataattgacactaaaacgctttaaaaaaatatatagtagttcatagcagcaaatcttctaaatagactatcaacaaacatcacaaaaagtcaccccaaatttgaaaatatgacttacagtaatatgagta

SEQ ID NO: 54576 - DNA, 201 bp, Bos taurus; identical to SEQ ID NO: 13708

SEQ ID NO: 54577 - DNA, 201 bp, Bos taurus
tgtgtatatttaactctaagatgtaatgtcagttttctagtttgacttctccaaaacaaattcccacaaattatgtatgagagagtttcttttgccacacgtcttttctgacattctaatctaatgcaactaggattggctttagtatatagatgttaaagttaatttttatccatatagctattcacttggcacagaata

SEQ ID NO: 54578 - DNA, 201 bp, Bos taurus; identical to SEQ ID NO: 13709

SEQ ID NO: 54579 - DNA, 201 bp, Bos taurus
catcatgagtgccccctggctttctggccagctttctggagtatcactggctctgcagaaggctagtgagaaactggggcttgctgccatcccatcagggtacttagacatggatcctttggccctagtcaagttctgagatgactgcagccctgaccaatacagtggctgcaactttgtaagccttcctgagccagaacc

SEQ ID NO: 54580 - DNA, 201 bp, Bos taurus; identical to SEQ ID NO: 13710

SEQ ID NO: 54581 - DNA, 201 bp, Bos taurus; identical to SEQ ID NO: 13711

SEQ ID NO: 54582 - DNA, 201 bp, Bos taurus
cttgtgggcaagaaccatttttgccctgccatttatttatctttgtatccttcgtgggattagccatacacacttactaaaaatgaatgcacgcatgcacccataacgtatatatacaagtatttatagttgaaggcaatggcaccccactccagtactcttgtctggaaaatcccatggacggaagagcctggtaggctg

SEQ ID NO: 54583 - DNA, 201 bp, Bos taurus; identical to SEQ ID NO: 13712

SEQ ID NO: 54584 - DNA, 201 bp, Bos taurus; identical to SEQ ID NO: 13713

SEQ ID NO: 54585 - DNA, 201 bp, Bos taurus; identical to SEQ ID NO: 13714

SEQ ID NO: 54586 - DNA, 201 bp, Bos taurus; identical to SEQ ID NO: 13715

SEQ ID NO: 54587 - DNA, 201 bp, Bos taurus; identical to SEQ ID NO: 13716

SEQ ID NO: 54588 - DNA, 201 bp, Bos taurus; identical to SEQ ID NO: 13717

SEQ ID NO: 54589 - DNA, 201 bp, Bos taurus
tttcctttgcccttttttctttagtttctcaacatgggcaagtccgtttgttgtgtgctggtttcagcacattggtaaccagtgttgtggcaggactactatggttgcaagatgcccttaacgatgaactatcagggcactttgcaaaagaaaagtttattaattccaggtcctagaagttacacaggacacttaaggcca

SEQ ID NO: 54590 - DNA, 201 bp, Bos taurus
agctcttggtgcccatggaggttatggagaacagtttgtttgcttgtattgaatcttgtattgtccttcccttaggaggactcctgtgaggccttttgtgctgggctgagaccaatctgagagaaagactcagtgctgtgctcagaaccagcccttctacctgggccttttgtcctttcaccaaatctctgagccttcagt

SEQ ID NO: 54591 - DNA, 201 bp, Bos taurus; identical to SEQ ID NO: 13719

SEQ ID NO: 54592 - DNA, 201 bp, Bos taurus
acaagtggtggtgcaaagacaagtggaatgtcatgtagcagagaaggacaaggatgttatggactcagaatgcgctttctgagcaaggatttcggcacagtcctctttgatataaccccaccttagtgggacgctacttgggaatgttctctgtctctttctctgtctgttccctcccctaacccattttggtgatcagca

SEQ ID NO: 54593 - DNA, 201 bp, Bos taurus
aatttaagctgcagagactttaatctttctctacttaaagatttgcatggatccagaacattccaaggcaagttagcaaactagtgttttatcacaacatgtccttaaaagttgaccacagccatgtcataggcgagacccaggcagactttggagccactatcaggaaaaagatttagcaactgatgaaggtcaagtttg

SEQ ID NO: 54594 - DNA, 201 bp, Bos taurus
ggtagaggccagggaagctgctcaatgtcttacaatgtgcatgacagcaccccacagttttaaaaaaataatccagaccagagcatcagctgggctgaacttgagaaatcctggcctaaataacctaacctcagctgacaactaactttctgctcttctaactttaaatctgaacatatgccaatacattaatactgctga

SEQ ID NO: 54595 - DNA, 201 bp, Bos taurus; identical to SEQ ID NO: 13722

SEQ ID NO: 54596 - DNA, 201 bp, Bos taurus; identical to SEQ ID NO: 13723

SEQ ID NO: 54597 - DNA, 201 bp, Bos taurus; identical to SEQ ID NO: 13724

SEQ ID NO: 54598 - DNA, 201 bp, Bos taurus; identical to SEQ ID NO: 13725

SEQ ID NO: 54599 - DNA, 201 bp, Bos taurus
gcggccctgcacacaacaggaacatgtagtgattacagccctggctcctacctgccttcccgcaaggtctctgcattaaacctacctgcatcccatcagtccaataagcctgagtttcccaggcctcccatggtcccccggacctctgtacatgtgagcccgatccatcttcccaaccgcccttattttggcccttgaatt

SEQ ID NO: 54600 - DNA, 201 bp, Bos taurus
taatccttctgccaaaactaccatccttgaacttacaggaggccttagacaccatcgtgatatccacacagcattgcttctgatccaggaactcacttcgcagcaaatgaagcatggccatgggcccgtgctcgtggaagtcactcaacttaccatgttctgcatcatcctgaagaggctagattgatagaatggtagaat

SEQ ID NO: 54601 - DNA, 201 bp, Bos taurus
gactcatggctaatcccctcagagtcatattctgaatgtataaaggctgccaaagttgggtttgtattcataatttctatccactgaatgaattacaatgactctgcacgatgtccccaaacatctgcatcttatggtgtttcgtattggcaggtgcaagcactttactcaatttctgtgcagatcaaacttaactctctg

SEQ ID NO: 54602 - DNA, 201 bp, Bos taurus
ggcggccaacaggcagatgaaaaaatgctcaacgctgctcactattggagaaacgcaatcaaaactacaatgaggcagcagcacctcataccagtcagcatggccgtcatcagaaagtctaccaacaaatgctggagaggctgtggagcaaagggagccctcccacactgctgatgggaatgctggtgcagccactgtgga

SEQ ID NO: 54603 - DNA, 201 bp, Bos taurus; identical to SEQ ID NO: 13729

SEQ ID NO: 54604 - DNA, 201 bp, Bos taurus
ggaattctcagttactgcctggcctctgcagggctacgggaatgtctctggctggccactgtggtgggcacagtgtgggtggctgtctcaggccattctcgctccagccctgccctctcaccgttccttgaccacagcccattcccttcccacctccttcttcctactctgaggctgcctcttgccgggactccaggagag

SEQ ID NO: 54605 - DNA, 201 bp, Bos taurus
gtagtagaattatgattcggttcccgtgggccaacatttccaccccaggagagttactgtgaatagtcagaattctttctttcttgacgcagcctcctggttgggccaatagcatgtgggatgtgggcaacccaccctcacccacctcatacccatcacgaagggagtgggcaacccaccctcacccacctcatacccatc

SEQ ID NO: 54606 - DNA, 201 bp, Bos taurus
tgtcctcactatgctgactcacattctcactgtcaggtcctctcctgccagttctgccactgcagtctgactgtctccttgccttatgcttctgcttattggtgcattctcttgcctcacttcttctatttaccacctttcccatgtatcatccctttatcttttaccccaaccaccattggattcttctgctatgtctca

SEQ ID NO: 54607 - DNA, 201 bp, Bos taurus
atgtgtatgaagcactgacaattgttcttcagaagctgcattgtagattaggaattagaatctagggagtctgcggaggccatatgccaagaacttaagcgcccaaactaggtttttgaatatgttaccagtagatgtggagttagcacttaaacttgaagagtggtaaaaaactgaatcatgggccacctggagcttccc

SEQ ID NO: 54608 - DNA, 201 bp, Bos taurus; identical to SEQ ID NO: 13731

SEQ ID NO: 54609 - DNA, 201 bp, Bos taurus
acagaaaaaccatgtacaagggtaaaccaatctaagaggttttgatacttcatgcatagtgaaataagatattcaaagaaataaaaaagaaagctttatgcagtatagtttgaagcaatatggaacaggattagaaagctgaatgactcaggacttttatctgtgaatagtgacaatcttttttagattaatcctggatgt

SEQ ID NO: 54610 - DNA, 201 bp, Bos taurus
tttattgtctacattttcttttatgagttatttctataactatagtatatatctgaatcacaaacattcttacgtaaccccagtatcattctggtcaagattgattttaatttgaaactttctcaaataatttatttgtttctacaaatcttcaacaattcctacagacacttcatttaaatcagaccgttttagctatca

SEQ ID NO: 54611 - DNA, 201 bp, Bos taurus; identical to SEQ ID NO: 13732

SEQ ID NO: 54612 - DNA, 201 bp, Bos taurus; identical to SEQ ID NO: 13733

SEQ ID NO: 54613 - DNA, 201 bp, Bos taurus; identical to SEQ ID NO: 13734

SEQ ID NO: 54614 - DNA, 201 bp, Bos taurus
aaggttgaaaatatcaacataaatcattggtacatatgcattcttttatatatgggatcatatagtttaattttttcaaaagtgaaaatatcaacttaattacaaacatcataggaatgaaaaaatgttatcattaaaggttgctgttttcacatagaactaggagagagcctcagtgtatggttaatgagttcaaagttt

SEQ ID NO: 54615 - DNA, 201 bp, Bos taurus
tttctcctagttctggaggccgcaaatccaagatcaaggcgccaccatggtcattcggggaccatcttccctgtctggtgcagacttcttattgtggccttgctctgtgtcagaggacccttttctacttttataaaggcatcaatctgtttacgatggctccacactcatgacctaattcccttccagaggccccatctc

SEQ ID NO: 54616 - DNA, 201 bp, Bos taurus; identical to SEQ ID NO: 13737

SEQ ID NO: 54617 - DNA, 201 bp, Bos taurus; identical to SEQ ID NO: 13738

SEQ ID NO: 54618 - DNA, 201 bp, Bos taurus; identical to SEQ ID NO: 13739

SEQ ID NO: 54619 - DNA, 201 bp, Bos taurus; identical to SEQ ID NO: 13742

SEQ ID NO: 54620 - DNA, 201 bp, Bos taurus; identical to SEQ ID NO: 13743

SEQ ID NO: 54621 - DNA, 201 bp, Bos taurus; identical to SEQ ID NO: 13745

SEQ ID NO: 54622 - DNA, 201 bp, Bos taurus; identical to SEQ ID NO: 13746

SEQ ID NO: 54623 - DNA, 201 bp, Bos taurus
ggaaggccagagaagtgtcagagtcaggagagagacaagggtagttcacgggctgacattggtcgaagaaaagctcatccgtgttgcagaaaggttgaattgaatggccaggccacagtagatctgggtttgcacatccctggagaacgaccactggtagtgatgtccaggtgtaatggcaccaggaagactgagctggtg

SEQ ID NO: 54624 - DNA, 201 bp, Bos taurus; identical to SEQ ID NO: 13748

SEQ ID NO: 54625 - DNA, 201 bp, Bos taurus; identical to SEQ ID NO: 13750

SEQ ID NO: 54626 - DNA, 201 bp, Bos taurus; identical to SEQ ID NO: 13751

SEQ ID NO: 54627 - DNA, 201 bp, Bos taurus; identical to SEQ ID NO: 13752

SEQ ID NO: 54628 - DNA, 201 bp, Bos taurus
acggccccaccatccacacaggctcgccaggaaatcaaggcgaaccttcattttttcagtgatcacctcgagaaccgctttggagttcttggagtgatccctgaccaggtggaggaatagacacatggctaatcctggaacgctagagcaaaagcattgaccacagggaaagatggaagggatgaaaacctgcctttcctc

SEQ ID NO: 54629 - DNA, 201 bp, Bos taurus
ggagatgctgcaggctgccctgggagctcccctcttgccggagcgtatcagcaagtagcaacaacctcagagtctcactgcgggggagaccagggccagcagctccctttggaattgcctctagggtgtgaagcaccttgtcttgcgtcccatcctggggaatctcactgcaggggtagggaggcccggctccttcacccc

SEQ ID NO: 54630 - DNA, 201 bp, Bos taurus; identical to SEQ ID NO: 13754

SEQ ID NO: 54631 - DNA, 201 bp, Bos taurus; identical to SEQ ID NO: 13755

SEQ ID NO: 54632 - DNA, 201 bp, Bos taurus; identical to SEQ ID NO: 13756

SEQ ID NO: 54633 - DNA, 201 bp, Bos taurus; identical to SEQ ID NO: 13757

SEQ ID NO: 54634 - DNA, 201 bp, Bos taurus
ccatttccaacctattgcagggcagctcaggcatcataagagagacttaatctctaccgattaagcattaagtgctttctaacatttaaatgttaggctcattttatgattgtgaaagcagcagtaaagcaagagggagagaagtttactgcatcttaacgtgtgtggcaaattgaatttctatcgacaagaagagcttct

SEQ ID NO: 54635 - DNA, 201 bp, Bos taurus; identical to SEQ ID NO: 13758

SEQ ID NO: 54636 - DNA, 201 bp, Bos taurus; identical to SEQ ID NO: 13760

SEQ ID NO: 54637 - DNA, 201 bp, Bos taurus; identical to SEQ ID NO: 13763

SEQ ID NO: 54638 - DNA, 201 bp, Bos taurus; identical to SEQ ID NO: 13764

SEQ ID NO: 54639 - DNA, 201 bp, Bos taurus; identical to SEQ ID NO: 13765

SEQ ID NO: 54640 - DNA, 201 bp, Bos taurus; identical to SEQ ID NO: 13766

SEQ ID NO: 54641 - DNA, 201 bp, Bos taurus; identical to SEQ ID NO: 13767

SEQ ID NO: 54642 - DNA, 201 bp, Bos taurus; identical to SEQ ID NO: 13768

SEQ ID NO: 54643 - DNA, 201 bp, Bos taurus; identical to SEQ ID NO: 13769

SEQ ID NO: 54644 - DNA, 201 bp, Bos taurus; identical to SEQ ID NO: 13770

SEQ ID NO: 54645 - DNA, 201 bp, Bos taurus; identical to SEQ ID NO: 13771

SEQ ID NO: 54646 - DNA, 201 bp, Bos taurus; identical to SEQ ID NO: 13772

SEQ ID NO: 54647 - DNA, 201 bp, Bos taurus; identical to SEQ ID NO: 13774

SEQ ID NO: 54648 - DNA, 201 bp, Bos taurus; identical to SEQ ID NO: 13775

SEQ ID NO: 54649 - DNA, 201 bp, Bos taurus; identical to SEQ ID NO: 13776

SEQ ID NO: 54650 - DNA, 201 bp, Bos taurus; identical to SEQ ID NO: 13777

SEQ ID NO: 54651 - DNA, 201 bp, Bos taurus; identical to SEQ ID NO: 13778

SEQ ID NO: 54652 - DNA, 201 bp, Bos taurus; identical to SEQ ID NO: 13779

SEQ ID NO: 54653 - DNA, 201 bp, Bos taurus; identical to SEQ ID NO: 13780

SEQ ID NO: 54654 - DNA, 201 bp, Bos taurus; identical to SEQ ID NO: 13781

SEQ ID NO: 54655 - DNA, 201 bp, Bos taurus; identical to SEQ ID NO: 13782

SEQ ID NO: 54656 - DNA, 201 bp, Bos taurus; identical to SEQ ID NO: 13783

SEQ ID NO: 54657 - DNA, 201 bp, Bos taurus; identical to SEQ ID NO: 13784

SEQ ID NO: 54658 - DNA, 201 bp, Bos taurus; identical to SEQ ID NO: 13785

SEQ ID NO: 54659 - DNA, 201 bp, Bos taurus; identical to SEQ ID NO: 13786

SEQ ID NO: 54660 - DNA, 201 bp, Bos taurus; identical to SEQ ID NO: 13787

SEQ ID NO: 54661 - DNA, 201 bp, Bos taurus; identical to SEQ ID NO: 13788

SEQ ID NO: 54662 - DNA, 201 bp, Bos taurus; identical to SEQ ID NO: 13789

SEQ ID NO: 54663 - DNA, 201 bp, Bos taurus; identical to SEQ ID NO: 13790

SEQ ID NO: 54664 - DNA, 201 bp, Bos taurus; identical to SEQ ID NO: 13791

SEQ ID NO: 54665 - DNA, 201 bp, Bos taurus; identical to SEQ ID NO: 13792

SEQ ID NO: 54666 - DNA, 201 bp, Bos taurus; identical to SEQ ID NO: 13793

SEQ ID NO: 54667 - DNA, 201 bp, Bos taurus; identical to SEQ ID NO: 13794

SEQ ID NO: 54668 - DNA, 201 bp, Bos taurus; identical to SEQ ID NO: 13795

SEQ ID NO: 54669 - DNA, 201 bp, Bos taurus; identical to SEQ ID NO: 13796

SEQ ID NO: 54670 - DNA, 201 bp, Bos taurus; identical to SEQ ID NO: 13797

SEQ ID NO: 54671 - DNA, 201 bp, Bos taurus; identical to SEQ ID NO: 13798

SEQ ID NO: 54672 - DNA, 201 bp, Bos taurus; identical to SEQ ID NO: 13799

SEQ ID NO: 54673 - DNA, 201 bp, Bos taurus; identical to SEQ ID NO: 13800

SEQ ID NO: 54674 - DNA, 201 bp, Bos taurus; identical to SEQ ID NO: 13801

SEQ ID NO: 54675 - DNA, 201 bp, Bos taurus; identical to SEQ ID NO: 13802

SEQ ID NO: 54676 - DNA, 201 bp, Bos taurus; identical to SEQ ID NO: 13803

SEQ ID NO: 54677 - DNA, 201 bp, Bos taurus; identical to SEQ ID NO: 13804

SEQ ID NO: 54678 - DNA, 201 bp, Bos taurus; identical to SEQ ID NO: 13805

SEQ ID NO: 54679 - DNA, 201 bp, Bos taurus; identical to SEQ ID NO: 13806

SEQ ID NO: 54680 - DNA, 201 bp, Bos taurus; identical to SEQ ID NO: 13807

SEQ ID NO: 54681 - DNA, 201 bp, Bos taurus; identical to SEQ ID NO: 13808

SEQ ID NO: 54682 - DNA, 201 bp, Bos taurus; identical to SEQ ID NO: 13809

SEQ ID NO: 54683 - DNA, 201 bp, Bos taurus; identical to SEQ ID NO: 13810

SEQ ID NO: 54684 - DNA, 201 bp, Bos taurus; identical to SEQ ID NO: 13811

SEQ ID NO: 54685 - DNA, 201 bp, Bos taurus; identical to SEQ ID NO: 13812

SEQ ID NO: 54686 - DNA, 201 bp, Bos taurus; identical to SEQ ID NO: 13813

SEQ ID NO: 54687 - DNA, 201 bp, Bos taurus; identical to SEQ ID NO: 13814

SEQ ID NO: 54688 - DNA, 201 bp, Bos taurus; identical to SEQ ID NO: 13815

SEQ ID NO: 54689 - DNA, 201 bp, Bos taurus; identical to SEQ ID NO: 13816

SEQ ID NO: 54690 - DNA, 201 bp, Bos taurus; identical to SEQ ID NO: 13817

SEQ ID NO: 54691 - DNA, 201 bp, Bos taurus; identical to SEQ ID NO: 13818

SEQ ID NO: 54692 - DNA, 201 bp, Bos taurus; identical to SEQ ID NO: 13819

SEQ ID NO: 54693 - DNA, 201 bp, Bos taurus; identical to SEQ ID NO: 13820

SEQ ID NO: 54694 - DNA, 201 bp, Bos taurus; identical to SEQ ID NO: 13821

SEQ ID NO: 54695 - DNA, 201 bp, Bos taurus; identical to SEQ ID NO: 13822

SEQ ID NO: 54696 - DNA, 201 bp, Bos taurus; identical to SEQ ID NO: 13823

SEQ ID NO: 54697 - DNA, 201 bp, Bos taurus; identical to SEQ ID NO: 13826

SEQ ID NO: 54698 - DNA, 201 bp, Bos taurus; identical to SEQ ID NO: 13827

SEQ ID NO: 54699 - DNA, 201 bp, Bos taurus; identical to SEQ ID NO: 13828

SEQ ID NO: 54700 - DNA, 201 bp, Bos taurus; identical to SEQ ID NO: 13829

SEQ ID NO: 54701 - DNA, 201 bp, Bos taurus; identical to SEQ ID NO: 13830

SEQ ID NO: 54702 - DNA, 201 bp, Bos taurus; identical to SEQ ID NO: 13831

SEQ ID NO: 54703 - DNA, 201 bp, Bos taurus; identical to SEQ ID NO: 13832

SEQ ID NO: 54704 - DNA, 201 bp, Bos taurus
tgatgaggctgtgggctggaaggaaccaaaagtgactgtgtttgttgtcaggttgctctcctttgcctcaagagaacggtcatgggtccctgggtgatgcgtggtgtggactggtcgtgttcctgcagcatcctagttgcactaggagtagttggatgtgcttgtgaaacatgtcagatacagaaataaaagcatgaggat

SEQ ID NO: 54705 - DNA, 201 bp, Bos taurus
taagtgcaggccccctcccctgcacacacagtccagcctctctagccttccggctgtggttcagaccagcatgctgtgtgcagagcttacacgccctctgagggtacatccaaatcttcaagtggcccactcttccatacatttgcatcttgactttaataacacgtgtgtagtcaggtcaccagaaaattgggagaatcc

SEQ ID NO: 54706 - DNA, 201 bp, Bos taurus
cagcagggaccatgaaggcagagactggggatgcttctgcaggccagagagcaccagccagccagcaaccatgcggagccgggggcagggcctggaacactttctccctaatagtccccggaaggaaccaaccctcctgacaccttattcttggacttccggcctctggaactatgagacaagagagataatacactactg

SEQ ID NO: 54707 - DNA, 201 bp, Bos taurus
cacatatccagaaaaagtctgttaattcataaagatacaagtatacctatgttcacagcagcactattcacagtagccaagatatggaagcaacctaagcattcacagacagataaagatgtggtatgtatgtgcaatggaatactactcggccatgaaaaagagtgaaataatgccatctgaagcaacatggagtgacct

SEQ ID NO: 54708 - DNA, 201 bp, Bos taurus; identical to SEQ ID NO: 13833

SEQ ID NO: 54709 - DNA, 201 bp, Bos taurus; identical to SEQ ID NO: 13834

SEQ ID NO: 54710 - DNA, 201 bp, Bos taurus; identical to SEQ ID NO: 13835

SEQ ID NO: 54711 - DNA, 201 bp, Bos taurus; identical to SEQ ID NO: 13836

SEQ ID NO: 54712 - DNA, 201 bp, Bos taurus; identical to SEQ ID NO: 13837

SEQ ID NO: 54713 - DNA, 201 bp, Bos taurus; identical to SEQ ID NO: 13838

SEQ ID NO: 54714 - DNA, 201 bp, Bos taurus; identical to SEQ ID NO: 13840

SEQ ID NO: 54715 - DNA, 201 bp, Bos taurus; identical to SEQ ID NO: 13841

SEQ ID NO: 54716 - DNA, 201 bp, Bos taurus; identical to SEQ ID NO: 13842

SEQ ID NO: 54717 - DNA, 201 bp, Bos taurus; identical to SEQ ID NO: 13844

SEQ ID NO: 54718 - DNA, 201 bp, Bos taurus; identical to SEQ ID NO: 13845

SEQ ID NO: 54719 - DNA, 201 bp, Bos taurus; identical to SEQ ID NO: 13846

SEQ ID NO: 54720 - DNA, 201 bp, Bos taurus; identical to SEQ ID NO: 13848

SEQ ID NO: 54721 - DNA, 201 bp, Bos taurus; identical to SEQ ID NO: 13849

SEQ ID NO: 54722 - DNA, 201 bp, Bos taurus; identical to SEQ ID NO: 13850

SEQ ID NO: 54723 - DNA, 201 bp, Bos taurus; identical to SEQ ID NO: 13853

SEQ ID NO: 54724 - DNA, 201 bp, Bos taurus; identical to SEQ ID NO: 13854

SEQ ID NO: 54725 - DNA, 201 bp, Bos taurus; identical to SEQ ID NO: 13855

SEQ ID NO: 54726 - DNA, 201 bp, Bos taurus; identical to SEQ ID NO: 13856

SEQ ID NO: 54727 - DNA, 201 bp, Bos taurus; identical to SEQ ID NO: 13857

SEQ ID NO: 54728 - DNA, 201 bp, Bos taurus; identical to SEQ ID NO: 13858

SEQ ID NO: 54729 - DNA, 201 bp, Bos taurus; identical to SEQ ID NO: 13859

SEQ ID NO: 54730 - DNA, 201 bp, Bos taurus; identical to SEQ ID NO: 13860

SEQ ID NO: 54731 - DNA, 201 bp, Bos taurus; identical to SEQ ID NO: 13861

SEQ ID NO: 54732 - DNA, 201 bp, Bos taurus; identical to SEQ ID NO: 13862

SEQ ID NO: 54733 - DNA, 201 bp, Bos taurus; identical to SEQ ID NO: 13863

SEQ ID NO: 54734 - DNA, 201 bp, Bos taurus
gtgtgtgcattcaaaacaaagagagggacagagactgagagagagagtgctctgatgacagagtgctcttcttataaggacactagccctagcagataagaggcccgccctttatgacctcattttaccatattagcttctgtagaggcttcataggcacatgcagccactctgggtattagggtttcagcatacagattt

SEQ ID NO: 54735 - DNA, 201 bp, Bos taurus
aagcagttcatgacattggagtttaattatgggcaccattagcatgaaattttgtaaatattttcaaggatattttaaaacataattcatctttttgaaatcttctgcttttctattgcttctctaaccaattcaagatggaaaaaagatagaagactgaacctatttatatcttatttgcattatgtactgcgtaactct

SEQ ID NO: 54736 - DNA, 201 bp, Bos taurus
ataaagactgaaaaaaaaaatgaacagaacctcagaaacctgtgggggcaatataaaaatgtctaacagatgcacaattggattcccagaaggaaaagataggcagaattgaacagtgaaaaatatattagaagaaatagtgaccaaaatttcccaaagtcatacaattataagttctacaagttcagtgatctatgtgta

SEQ ID NO: 54737 - DNA, 201 bp, Bos taurus; identical to SEQ ID NO: 13870

SEQ ID NO: 54738 - DNA, 201 bp, Bos taurus; identical to SEQ ID NO: 13871

SEQ ID NO: 54739 - DNA, 201 bp, Bos taurus
gtacggcaccaggttccttctggacagctccgcgctgctctcctgctctgaagacacatccatcaggtattgggacctgggcggcttcaccaacactgtgcagtaccagggccacacctgccccttgtgggacctggacatcggcccgcacagcctgtatttcgccagcgggtgccacgactgcacggcccacctctggtc

SEQ ID NO: 54740 - DNA, 201 bp, Bos taurus
aaccttacaatgtgtgatttttctgaaagatacatacctcctccctaaatgtacttgctccgcatgtccaaacttgaccttctaatcccctgactacatcgtcaaactattagccagatcagtgagtcactagaaaatccagtgtagaggtaaaactgtgtatttttgtgaaatttatgtgaaatttatcttcaaatttgg

SEQ ID NO: 54741 - DNA, 201 bp, Bos taurus; identical to SEQ ID NO: 13873

SEQ ID NO: 54742 - DNA, 201 bp, Bos taurus; identical to SEQ ID NO: 13875

SEQ ID NO: 54743 - DNA, 201 bp, Bos taurus; identical to SEQ ID NO: 13876

SEQ ID NO: 54744 - DNA, 201 bp, Bos taurus; identical to SEQ ID NO: 13877

SEQ ID NO: 54745 - DNA, 201 bp, Bos taurus
aaaagcaaaacggccctttgttcagctaattaacgaaggcccaactccgaaagcagatgtgtttgcttagctaatcacaagcatgtttctttcaaggaacgtcatttcgagggggccgctcaggggaatgggaaagggggacacagcaacccccccacccacgtcctctctgcctcaggggtctctcacccccagactgag

SEQ ID NO: 54746 - DNA, 201 bp, Bos taurus
agctttaaaatttccttcgagtgtgctctcactgtcatttctaagtttgcaagaaattaaaaacattattatttatatgataatgtatcttataagtgaattgagctgcagtgcattattggattaattttgacaatcactttagtttcaaaatgatcttcaactctgatatttgttcttgttgtgccatttaaagatttt

SEQ ID NO: 54747 - DNA, 201 bp, Bos taurus; identical to SEQ ID NO: 13878

SEQ ID NO: 54748 - DNA, 201 bp, Bos taurus; identical to SEQ ID NO: 13879

SEQ ID NO: 54749 - DNA, 201 bp, Bos taurus
tcttgatccttatggaagccagttaaaattaattggaaaaagcttttaaagacctaagacgcagaccaaatgtatcgccaacccgcggcctcatcccgcacggaacatgaaggtcaccgcgaagctgcagatttatgcagaagggttgggtgatggaaaatgagacaaaagcatttggattttattattccatttactctg

SEQ ID NO: 54750 - DNA, 201 bp, Bos taurus
tattggcctcacattaagatatcacctagaatataaaggagctgggtagctattttctaagaccagttttaaaattaaaatcccatgattcttactattacgacttcataatctacataattaggcctgtagctgatcatctatgatcatttttgagctctgatcacaaatttctatattcctattagatagatctgcttg

SEQ ID NO: 54751 - DNA, 201 bp, Bos taurus; identical to SEQ ID NO: 13880

SEQ ID NO: 54752 - DNA, 201 bp, Bos taurus; identical to SEQ ID NO: 13881

SEQ ID NO: 54753 - DNA, 201 bp, Bos taurus; identical to SEQ ID NO: 13882

SEQ ID NO: 54754 - DNA, 201 bp, Bos taurus; identical to SEQ ID NO: 13883

SEQ ID NO: 54755 - DNA, 201 bp, Bos taurus; identical to SEQ ID NO: 13884

SEQ ID NO: 54756 - DNA, 201 bp, Bos taurus
taaactatgacttcagatccttgtttacttatttgatgcaatctacttacacttccatcaaagtgtgcctctaatgtataagttacatttctaacaacaacaaaaaatgatccaaagctgtgctaattaaaacaaaataggataaataactttaagagataacagcagtatgattcagaagcatgcaaaaagtgtgcagac

SEQ ID NO: 54757 - DNA, 201 bp, Bos taurus
aatgtttataaaaatatttttattaataaaagagaatgaagatagagtatttgcattaatgtaaatacatttgaaaataaagacaaaaatgagccaaagattaagataaagaaaaaaaataatttttaaaaagataagctgattataaaagcagaattaatatcgatcctccccaccaaagctatagtttttttcttggag

SEQ ID NO: 54758 - DNA, 201 bp, Bos taurus
aaattgaaaaatgctccatttataaaaaaattgtctttaagaatgtgtgtaagagtgatgttatttttacttcattagagaatttgctagggaaaccatgcgggcctgggttttgcagggaggaggtttttgtttgtttgtttgtttgtttgtttgtttaacaatattgcttctatcttatgcttcggtatgtggtatctt

SEQ ID NO: 54759 - DNA, 201 bp, Bos taurus
ttaccaaagatgactgtggaaataattcaaggtcatgtaagtctaagtcaatatcagcatatctgttatgcctggcccaggtttgaaatgttttagaagtgtattaattctagcaaatctcatgaaaaccaatgcaaataaaagtaagaaaatgtataaaaaaaatgttaggccaaaaagttaacgaagcacaaatacttt

SEQ ID NO: 54760 - DNA, 201 bp, Bos taurus; identical to SEQ ID NO: 13887

SEQ ID NO: 54761 - DNA, 201 bp, Bos taurus; identical to SEQ ID NO: 13888

SEQ ID NO: 54762 - DNA, 201 bp, Bos taurus
tccctgatatgtagacttctccctgtgtcttcatgttgccttcagtctatacctgtctgcctctgggtccagatttccccatttcataaagacatcagtcccactgtcttagggcctgctgctgctgctgctaagtcacttttgtcatgtccgactctgtgcgacctcatagacggcagcccaccaggctccccagtccct

SEQ ID NO: 54763 - DNA, 201 bp, Bos taurus; identical to SEQ ID NO: 13889

SEQ ID NO: 54764 - DNA, 201 bp, Bos taurus; identical to SEQ ID NO: 13890

SEQ ID NO: 54765 - DNA, 201 bp, Bos taurus; identical to SEQ ID NO: 13894

SEQ ID NO: 54766 - DNA, 201 bp, Bos taurus; identical to SEQ ID NO: 13895

SEQ ID NO: 54767 - DNA, 201 bp, Bos taurus; identical to SEQ ID NO: 13896

SEQ ID NO: 54768 - DNA, 201 bp, Bos taurus; identical to SEQ ID NO: 13897

SEQ ID NO: 54769 - DNA, 201 bp, Bos taurus; identical to SEQ ID NO: 13899

SEQ ID NO: 54770 - DNA, 201 bp, Bos taurus; identical to SEQ ID NO: 13901

SEQ ID NO: 54771 - DNA, 201 bp, Bos taurus; identical to SEQ ID NO: 13902

SEQ ID NO: 54772 - DNA, 201 bp, Bos taurus; identical to SEQ ID NO: 13903

SEQ ID NO: 54773 - DNA, 201 bp, Bos taurus; identical to SEQ ID NO: 13904

SEQ ID NO: 54774 - DNA, 201 bp, Bos taurus; identical to SEQ ID NO: 13905

SEQ ID NO: 54775 - DNA, 201 bp, Bos taurus; identical to SEQ ID NO: 13906

SEQ ID NO: 54776 - DNA, 201 bp, Bos taurus; identical to SEQ ID NO: 13907

SEQ ID NO: 54777 - DNA, 201 bp, Bos taurus; identical to SEQ ID NO: 13908

SEQ ID NO: 54778 - DNA, 201 bp, Bos taurus; identical to SEQ ID NO: 13909

SEQ ID NO: 54779 - DNA, 201 bp, Bos taurus; identical to SEQ ID NO: 13910

SEQ ID NO: 54780 - DNA, 201 bp, Bos taurus; identical to SEQ ID NO: 13911

SEQ ID NO: 54781 - DNA, 201 bp, Bos taurus; identical to SEQ ID NO: 13912

SEQ ID NO: 54782 - DNA, 201 bp, Bos taurus; identical to SEQ ID NO: 13913

SEQ ID NO: 54783 - DNA, 201 bp, Bos taurus; identical to SEQ ID NO: 13914

SEQ ID NO: 54784 - DNA, 201 bp, Bos taurus; identical to SEQ ID NO: 13915

SEQ ID NO: 54785 - DNA, 201 bp, Bos taurus; identical to SEQ ID NO: 13916

SEQ ID NO: 54786 - DNA, 201 bp, Bos taurus
tgcgaagtgactggcacagagactctggcaagtgaacagagtcgtaatgcgtgctaatttctgggaaaaattcttttccttttcactcctggcttaggaggtaataactctgtaactaaagaccttgctagtctcctcacttgtcacacgattccttctcctcccccaataaaatggcatttaacccggcaaagttgtata

SEQ ID NO: 54787 - DNA, 201 bp, Bos taurus; identical to SEQ ID NO: 13917

SEQ ID NO: 54788 - DNA, 201 bp, Bos taurus; identical to SEQ ID NO: 13918

SEQ ID NO: 54789 - DNA, 201 bp, Bos taurus
cttgcctccagaagacctgtcctagaggttacattgtccatcaccacttttccagacgaaatctggtctggatgtctgcctttctcccctcctccttccttttctatcatcaagctgctggtaattttagtaaaatttaacatttgtgtgcttgttccatgagacctattttcctgtgaggtgcacaggttggtgaagaga

SEQ ID NO: 54790 - DNA, 201 bp, Bos taurus
catcctgtaatacgctcctagggctggacggataatgctgctcgcgtctaggtcaggagcttcattatcatggaaaaatcatctgttgcccagatgtcagcatgattgcctgacccgaaatcagagctccagtgtccgctttgggcgtgtgcaatggccatgaacttgggcaagctccgggagatggtgagggacagggag

SEQ ID NO: 54791 - DNA, 201 bp, Bos taurus; identical to SEQ ID NO: 13919

SEQ ID NO: 54792 - DNA, 201 bp, Bos taurus
tttttttttttaaattttggccattctgtgagggatcttggttccctaaccaaggtttgaacccctgccccctgcactggaagcatggagtctaaacaaccggaccaccagggagtccagcaatggactttttttatcttagcgattagacgaaacattaacagataggattttgctagcagaaaatgatatcttggctca

SEQ ID NO: 54793 - DNA, 201 bp, Bos taurus; identical to SEQ ID NO: 13920

SEQ ID NO: 54794 - DNA, 201 bp, Bos taurus; identical to SEQ ID NO: 13921

SEQ ID NO: 54795 - DNA, 201 bp, Bos taurus; identical to SEQ ID NO: 13922

SEQ ID NO: 54796 - DNA, 201 bp, Bos taurus; identical to SEQ ID NO: 13923

SEQ ID NO: 54797 - DNA, 201 bp, Bos taurus; identical to SEQ ID NO: 13926

SEQ ID NO: 54798 - DNA, 201 bp, Bos taurus
tgtgtgtgtgtttacacatttgaagtgtttcagttaattataatttctctttttgatgctcactgttcaatctttggccagtagcagcctcttcaagctgacacatctcaccaaaccccagtggtctttgatagcattcttgctttctgacatgaaaaaaaaaaaaatcctaggctcattttgtccacttgctgtcctggc

SEQ ID NO: 54799 - DNA, 201 bp, Bos taurus; identical to SEQ ID NO: 13929

SEQ ID NO: 54800 - DNA, 201 bp, Bos taurus
ctggccagcacagagggctggaagggaagaaataacatctcctccagggtgacgggggctgcgtgcagcagatgatgcagagcttgtgagggaggctgccaccggcccccctcccttcaccgtcctcccgttctgcctccctgccccctcccacctcctactcagaaccagtgactaattgcatcgcgtttctctttgact

SEQ ID NO: 54801 - DNA, 201 bp, Bos taurus; identical to SEQ ID NO: 13931

SEQ ID NO: 54802 - DNA, 201 bp, Bos taurus; identical to SEQ ID NO: 13932

SEQ ID NO: 54803 - DNA, 201 bp, Bos taurus; identical to SEQ ID NO: 13933

SEQ ID NO: 54804 - DNA, 201 bp, Bos taurus; identical to SEQ ID NO: 13934

SEQ ID NO: 54805 - DNA, 201 bp, Bos taurus; identical to SEQ ID NO: 13935

SEQ ID NO: 54806 - DNA, 201 bp, Bos taurus
ccccgccaggcacagaagccaccagcagtgccaggcagcgtccgcgggctgaacctggaggtgctgggtgcagcagaaagccagctcccagggactctgccggccccttgcccagcaaatgcgtggccatcgactgcgagatggtgggcacaggaccccgagggcgcgtgagtgagctggcccgctgctccgtggtgagct

SEQ ID NO: 54807 - DNA, 201 bp, Bos taurus
ttcctgactctcggccccttcctccacttccacagccagcggcagactgtcaagttctcaagtcagatctctctgaccttcacataaaaggaccttgggattgattatgctgggcccctctgaatcatcccaaaactctccctacctttatttttggttgctctgggtctttgttgctgcatgtgggctttctcttagtac

SEQ ID NO: 54808 - DNA, 201 bp, Bos taurus; identical to SEQ ID NO: 13936

SEQ ID NO: 54809 - DNA, 201 bp, Bos taurus; identical to SEQ ID NO: 13937

SEQ ID NO: 54810 - DNA, 201 bp, Bos taurus; identical to SEQ ID NO: 13938

SEQ ID NO: 54811 - DNA, 201 bp, Bos taurus
gtgagttatgtccatctgccagatctgacttggcttcaggccacggggattaactcccaaggcttctgttggagatgtggttatcacaaccatctggcatttaggataaggccatacaatctgtttagcttaagcccaagggatatgaaacttggtttttaaatattttaattacaatgtgacagatcatgaagggctgat

SEQ ID NO: 54812 - DNA, 201 bp, Bos taurus
gacgggctacaacccatagggtctcaaagagtcagacacgacttggcaagtgagtgcacacacactctgtcagaagttagggggctcctttctatggccatagcacctcacctgacccaccagcctctccctttcactgtctccctcctgcatggcaacgagtcaggacaatcagttatcttacatgtaacaaaagccctg

SEQ ID NO: 54813 - DNA, 201 bp, Bos taurus; identical to SEQ ID NO: 13939

SEQ ID NO: 54814 - DNA, 201 bp, Bos taurus; identical to SEQ ID NO: 13940

SEQ ID NO: 54815 - DNA, 201 bp, Bos taurus; identical to SEQ ID NO: 13941

SEQ ID NO: 54816 - DNA, 201 bp, Bos taurus
ctaaacacattgcccagactttacacagaggcagcactgggtatgacaataaagtgacagtgttggagtccttagagcctgagctatctcaggccttgaggggaatctcatggacacccaggttgcagccacagctttcacctttccctcagaggggttatgctgatgaggtctagtctcaaaaatcttaactcatggtgg

SEQ ID NO: 54817 - DNA, 201 bp, Bos taurus
agtttgttttccctgttttttaacgcgcagaatcgtcaattaacagccttgtttcattttgctgcaacagcgccatctgctgttggccaagcccatgacttgcacaattgaggatcccaggtatgggtttaagctaggaagctaaccaacatctgtgaggtgctctatgcactttgcagacgtggtccacaccacttctct

SEQ ID NO: 54818 - DNA, 201 bp, Bos taurus; identical to SEQ ID NO: 13942

SEQ ID NO: 54819 - DNA, 201 bp, Bos taurus; identical to SEQ ID NO: 13943

SEQ ID NO: 54820 - DNA, 201 bp, Bos taurus; identical to SEQ ID NO: 13944

SEQ ID NO: 54821 - DNA, 201 bp, Bos taurus; identical to SEQ ID NO: 13945

SEQ ID NO: 54822 - DNA, 201 bp, Bos taurus
gcctcacctggtaggatctcacctggctgggcctcacccagctgggcctcacccggcaggatctcacctggctggaccgaagccgcttgctctccagccccgtcttctcctgcatcagggcctccttcttggccaggatggcctcccgcttgtggagctcctcccccagctcctccagtgcccgccgctgctgcaggacct

SEQ ID NO: 54823 - DNA, 201 bp, Bos taurus
ttccctccttctctctagagacatgcccccggggccctggtctgggcagtgtggactttccattgcagtgacctgcagccacccctattaggcctgggctgatgaccaaggagcaagagtggggaaaccaagtccccgggggagggctccagcttggtcactgtgactaagggaacagaggcccctgaggatgatcgagag

SEQ ID NO: 54824 - DNA, 201 bp, Bos taurus; identical to SEQ ID NO: 13946

SEQ ID NO: 54825 - DNA, 201 bp, Bos taurus; identical to SEQ ID NO: 13947

SEQ ID NO: 54826 - DNA, 201 bp, Bos taurus; identical to SEQ ID NO: 13949

SEQ ID NO: 54827 - DNA, 201 bp, Bos taurus; identical to SEQ ID NO: 13950

SEQ ID NO: 54828 - DNA, 201 bp, Bos taurus; identical to SEQ ID NO: 13951

SEQ ID NO: 54829 - DNA, 201 bp, Bos taurus; identical to SEQ ID NO: 13952

SEQ ID NO: 54830 - DNA, 201 bp, Bos taurus; identical to SEQ ID NO: 13953

SEQ ID NO: 54831 - DNA, 201 bp, Bos taurus; identical to SEQ ID NO: 13954

SEQ ID NO: 54832 - DNA, 201 bp, Bos taurus
tgctgattccatcgttctttcgttgttcattgactgtctcctctcgcaagaagccaaggccggggagaaagagcaggtggcccacagtttagggtcatgagaagactgctgtgttgatggtaccctgtaagcatcagcagagtgagaaagggctctctctttcgaggtgtcctttagtctctgtgttttgccaatggcccg

SEQ ID NO: 54833 - DNA, 201 bp, Bos taurus; identical to SEQ ID NO: 13955

SEQ ID NO: 54834 - DNA, 201 bp, Bos taurus; identical to SEQ ID NO: 13956

SEQ ID NO: 54835 - DNA, 201 bp, Bos taurus
gtttaatggctattattattttgtctggctgaaatgttttcttttgtttctgcattttctcacttctctgattttttttaacttggggaaggcctaggcggctagagtttttctaaaaacaagaggcaggtggagtacatggtggggagcgggtgtctgtcctccttatggggaaaggcccataaggccttataacagtgg

SEQ ID NO: 54836 - DNA, 201 bp, Bos taurus; identical to SEQ ID NO: 13960

SEQ ID NO: 54837 - DNA, 201 bp, Bos taurus; identical to SEQ ID NO: 13963

SEQ ID NO: 54838 - DNA, 201 bp, Bos taurus; identical to SEQ ID NO: 13964

SEQ ID NO: 54839 - DNA, 201 bp, Bos taurus; identical to SEQ ID NO: 13965

SEQ ID NO: 54840 - DNA, 201 bp, Bos taurus; identical to SEQ ID NO: 13966

SEQ ID NO: 54841 - DNA, 201 bp, Bos taurus; identical to SEQ ID NO: 13967

SEQ ID NO: 54842 - DNA, 201 bp, Bos taurus
agcaaggacgccaacaatagacacacaagtgtaatatcattctatgaacgaatacctgtaaagctgttagaacaccggaaatctagtaagcccacatgttcgatatcattaatgcagtgcaatgatcattaccttcatggaggtaagaaaaaagggtccagggaaagtcacccgctgattcagcccaagaaaagcaggagg

SEQ ID NO: 54843 - DNA, 201 bp, Bos taurus; identical to SEQ ID NO: 13968

SEQ ID NO: 54844 - DNA, 201 bp, Bos taurus
tgagatgcctgtggaagaggttctccaccattcacagcacgtttggggaccagcctcccttggacacgaaggtggggctacacatggagaagggcttcttgtactgcctgtcccactagatttatttggtgactcagtggtaaagaatccacctgccaagcaggagatgtgggttccatccttgggccagaaagatccctt

SEQ ID NO: 54845 - DNA, 201 bp, Bos taurus
aaggtaattttcaacggtctttcaaagcaaaggctggttgggcatgccaggggagggtacaggtggtccatgcctccacaggcatggcctagcttcatccctccatatgggtcttttctgcttcctgacttcaaagtgagcatgtgatccaaacctggccactctggcctggctagctcatcctcctgttcatcatggtta

SEQ ID NO: 54846 - DNA, 201 bp, Bos taurus
agaaacagaaaacataggcccctgactttttgctcctctcttgaaactgagctagaatgcaattgatattcatatgaacaagtaagtttttgaggtttgacatgcaataccagggaaacaggaccttgagaaaagggagggctcctatgctgctggagggaaaccacaccctaaaactaaggctaaaattcaaattggatt

SEQ ID NO: 54847 - DNA, 201 bp, Bos taurus; identical to SEQ ID NO: 13970

SEQ ID NO: 54848 - DNA, 201 bp, Bos taurus; identical to SEQ ID NO: 13971

SEQ ID NO: 54849 - DNA, 201 bp, Bos taurus
cccacatcctctgcattggaaggcaaattcttaaccactggaccaccagggaagtcccttgtgctcatctttatttggttaggaaactctcctccgtcaggtgctggtgaatgcagctcttcctataaccagccccaaggaaaggggcgtggtctacttctgatgtggagctctggttttgttttgtggttgtggggagac

SEQ ID NO: 54850 - DNA, 201 bp, Bos taurus; identical to SEQ ID NO: 13974

SEQ ID NO: 54851 - DNA, 201 bp, Bos taurus; identical to SEQ ID NO: 13975

SEQ ID NO: 54852 - DNA, 201 bp, Bos taurus; identical to SEQ ID NO: 13976

SEQ ID NO: 54853 - DNA, 201 bp, Bos taurus; identical to SEQ ID NO: 13977

SEQ ID NO: 54854 - DNA, 201 bp, Bos taurus; identical to SEQ ID NO: 13979

SEQ ID NO: 54855 - DNA, 201 bp, Bos taurus; identical to SEQ ID NO: 13980

SEQ ID NO: 54856 - DNA, 201 bp, Bos taurus; identical to SEQ ID NO: 13981

SEQ ID NO: 54857 - DNA, 201 bp, Bos taurus; identical to SEQ ID NO: 13982

SEQ ID NO: 54858 - DNA, 201 bp, Bos taurus; identical to SEQ ID NO: 13984

SEQ ID NO: 54859 - DNA, 201 bp, Bos taurus; identical to SEQ ID NO: 13985

SEQ ID NO: 54860 - DNA, 201 bp, Bos taurus; identical to SEQ ID NO: 13986

SEQ ID NO: 54861 - DNA, 201 bp, Bos taurus; identical to SEQ ID NO: 13987

SEQ ID NO: 54862 - DNA, 201 bp, Bos taurus; identical to SEQ ID NO: 13988

SEQ ID NO: 54863 - DNA, 201 bp, Bos taurus; identical to SEQ ID NO: 13989

SEQ ID NO: 54864 - DNA, 201 bp, Bos taurus; identical to SEQ ID NO: 13990

SEQ ID NO: 54865 - DNA, 201 bp, Bos taurus; identical to SEQ ID NO: 13991

SEQ ID NO: 54866 - DNA, 201 bp, Bos taurus; identical to SEQ ID NO: 13992

SEQ ID NO: 54867 - DNA, 201 bp, Bos taurus; identical to SEQ ID NO: 13993

SEQ ID NO: 54868 - DNA, 201 bp, Bos taurus; identical to SEQ ID NO: 13994

SEQ ID NO: 54869 - DNA, 201 bp, Bos taurus; identical to SEQ ID NO: 13995

SEQ ID NO: 54870 - DNA, 201 bp, Bos taurus; identical to SEQ ID NO: 13996

SEQ ID NO: 54871 - DNA, 201 bp, Bos taurus; identical to SEQ ID NO: 13997

SEQ ID NO: 54872 - DNA, 201 bp, Bos taurus; identical to SEQ ID NO: 13998

SEQ ID NO: 54873 - DNA, 201 bp, Bos taurus; identical to SEQ ID NO: 13999

SEQ ID NO: 54874 - DNA, 201 bp, Bos taurus; identical to SEQ ID NO: 14000

SEQ ID NO: 54875 - DNA, 201 bp, Bos taurus; identical to SEQ ID NO: 14001

SEQ ID NO: 54876 - DNA, 201 bp, Bos taurus; identical to SEQ ID NO: 14002

SEQ ID NO: 54877 - DNA, 201 bp, Bos taurus
gacagtcagcggcagtctggttccagagtccagctgcctggactacatcatgacgtggctgtgggcccctttttagggcccacgagggctgtgaaggcagcaactccagatcgaggatcaagagactcgggctgggacacagctcaggcttgggacagtcaggctggacgcaacaccaaggggccggggtttgcctcctgc

SEQ ID NO: 54878 - DNA, 201 bp, Bos taurus; identical to SEQ ID NO: 14003

SEQ ID NO: 54879 - DNA, 201 bp, Bos taurus; identical to SEQ ID NO: 14004

SEQ ID NO: 54880 - DNA, 201 bp, Bos taurus; identical to SEQ ID NO: 14005

SEQ ID NO: 54881 - DNA, 201 bp, Bos taurus; identical to SEQ ID NO: 14006

SEQ ID NO: 54882 - DNA, 201 bp, Bos taurus; identical to SEQ ID NO: 14007

SEQ ID NO: 54883 - DNA, 201 bp, Bos taurus; identical to SEQ ID NO: 14008

SEQ ID NO: 54884 - DNA, 201 bp, Bos taurus; identical to SEQ ID NO: 14010

SEQ ID NO: 54885 - DNA, 201 bp, Bos taurus; identical to SEQ ID NO: 14011

SEQ ID NO: 54886 - DNA, 201 bp, Bos taurus; identical to SEQ ID NO: 14012

SEQ ID NO: 54887 - DNA, 201 bp, Bos taurus; identical to SEQ ID NO: 14013

SEQ ID NO: 54888 - DNA, 201 bp, Bos taurus; identical to SEQ ID NO: 14014

SEQ ID NO: 54889 - DNA, 201 bp, Bos taurus; identical to SEQ ID NO: 14015

SEQ ID NO: 54890 - DNA, 201 bp, Bos taurus; identical to SEQ ID NO: 14016

SEQ ID NO: 54891 - DNA, 201 bp, Bos taurus; identical to SEQ ID NO: 14018

SEQ ID NO: 54892 - DNA, 201 bp, Bos taurus; identical to SEQ ID NO: 14019

SEQ ID NO: 54893 - DNA, 201 bp, Bos taurus; identical to SEQ ID NO: 14020

SEQ ID NO: 54894 - DNA, 201 bp, Bos taurus; identical to SEQ ID NO: 14021

SEQ ID NO: 54895 - DNA, 201 bp, Bos taurus; identical to SEQ ID NO: 14022

SEQ ID NO: 54896 - DNA, 201 bp, Bos taurus; identical to SEQ ID NO: 14023

SEQ ID NO: 54897 - DNA, 201 bp, Bos taurus; identical to SEQ ID NO: 14024

SEQ ID NO: 54898 - DNA, 201 bp, Bos taurus; identical to SEQ ID NO: 14026

SEQ ID NO: 54899 - DNA, 201 bp, Bos taurus; identical to SEQ ID NO: 14027

SEQ ID NO: 54900 - DNA, 201 bp, Bos taurus; identical to SEQ ID NO: 14028

SEQ ID NO: 54901 - DNA, 201 bp, Bos taurus; identical to SEQ ID NO: 14029

SEQ ID NO: 54902 - DNA, 201 bp, Bos taurus; identical to SEQ ID NO: 14030

SEQ ID NO: 54903 - DNA, 201 bp, Bos taurus; identical to SEQ ID NO: 14031

SEQ ID NO: 54904 - DNA, 201 bp, Bos taurus; identical to SEQ ID NO: 14032

SEQ ID NO: 54905 - DNA, 201 bp, Bos taurus; identical to SEQ ID NO: 14033

SEQ ID NO: 54906 - DNA, 201 bp, Bos taurus; identical to SEQ ID NO: 14034

SEQ ID NO: 54907 - DNA, 201 bp, Bos taurus; identical to SEQ ID NO: 14035

SEQ ID NO: 54908 - DNA, 201 bp, Bos taurus; identical to SEQ ID NO: 14036

SEQ ID NO: 54909 - DNA, 201 bp, Bos taurus; identical to SEQ ID NO: 14037

SEQ ID NO: 54910 - DNA, 201 bp, Bos taurus; identical to SEQ ID NO: 14038

SEQ ID NO: 54911 - DNA, 201 bp, Bos taurus; identical to SEQ ID NO: 14039

SEQ ID NO: 54912 - DNA, 201 bp, Bos taurus; identical to SEQ ID NO: 14040

SEQ ID NO: 54913 - DNA, 201 bp, Bos taurus; identical to SEQ ID NO: 14041

SEQ ID NO: 54914 - DNA, 201 bp, Bos taurus; identical to SEQ ID NO: 14042

SEQ ID NO: 54915 - DNA, 201 bp, Bos taurus; identical to SEQ ID NO: 14043

SEQ ID NO: 54916 - DNA, 201 bp, Bos taurus; identical to SEQ ID NO: 14044

SEQ ID NO: 54917 - DNA, 201 bp, Bos taurus; identical to SEQ ID NO: 14045

SEQ ID NO: 54918 - DNA, 201 bp, Bos taurus; identical to SEQ ID NO: 14046

SEQ ID NO: 54919 - DNA, 201 bp, Bos taurus; identical to SEQ ID NO: 14047

SEQ ID NO: 54920 - DNA, 201 bp, Bos taurus; identical to SEQ ID NO: 14048

SEQ ID NO: 54921 - DNA, 201 bp, Bos taurus; identical to SEQ ID NO: 14049

SEQ ID NO: 54922 - DNA, 201 bp, Bos taurus; identical to SEQ ID NO: 14051

SEQ ID NO: 54923 - DNA, 201 bp, Bos taurus; identical to SEQ ID NO: 14052

SEQ ID NO: 54924 - DNA, 201 bp, Bos taurus; identical to SEQ ID NO: 14053

SEQ ID NO: 54925 - DNA, 201 bp, Bos taurus; identical to SEQ ID NO: 14054

SEQ ID NO: 54926 - DNA, 201 bp, Bos taurus; identical to SEQ ID NO: 14055

SEQ ID NO: 54927 - DNA, 201 bp, Bos taurus; identical to SEQ ID NO: 14056

SEQ ID NO: 54928 - DNA, 201 bp, Bos taurus; identical to SEQ ID NO: 14057

SEQ ID NO: 54929 - DNA, 201 bp, Bos taurus; identical to SEQ ID NO: 14058

SEQ ID NO: 54930 - DNA, 201 bp, Bos taurus; identical to SEQ ID NO: 14059

SEQ ID NO: 54931 - DNA, 201 bp, Bos taurus; identical to SEQ ID NO: 14060

SEQ ID NO: 54932 - DNA, 201 bp, Bos taurus; identical to SEQ ID NO: 14061

SEQ ID NO: 54933 - DNA, 201 bp, Bos taurus; identical to SEQ ID NO: 14062

SEQ ID NO: 54934 - DNA, 201 bp, Bos taurus; identical to SEQ ID NO: 14063

SEQ ID NO: 54935 - DNA, 201 bp, Bos taurus; identical to SEQ ID NO: 14064

SEQ ID NO: 54936 - DNA, 201 bp, Bos taurus; identical to SEQ ID NO: 14065

SEQ ID NO: 54937 - DNA, 201 bp, Bos taurus; identical to SEQ ID NO: 14066

SEQ ID NO: 54938 - DNA, 201 bp, Bos taurus; identical to SEQ ID NO: 14067

SEQ ID NO: 54939 - DNA, 201 bp, Bos taurus; identical to SEQ ID NO: 14068

SEQ ID NO: 54940 - DNA, 201 bp, Bos taurus; identical to SEQ ID NO: 14070

SEQ ID NO: 54941 - DNA, 201 bp, Bos taurus; identical to SEQ ID NO: 14071

SEQ ID NO: 54942 - DNA, 201 bp, Bos taurus; identical to SEQ ID NO: 14072

SEQ ID NO: 54943 - DNA, 201 bp, Bos taurus; identical to SEQ ID NO: 14073

SEQ ID NO: 54944 - DNA, 201 bp, Bos taurus; identical to SEQ ID NO: 14074

SEQ ID NO: 54945 - DNA, 201 bp, Bos taurus; identical to SEQ ID NO: 14075

SEQ ID NO: 54946 - DNA, 201 bp, Bos taurus; identical to SEQ ID NO: 14076

SEQ ID NO: 54947 - DNA, 201 bp, Bos taurus; identical to SEQ ID NO: 14077

SEQ ID NO: 54948 - DNA, 201 bp, Bos taurus; identical to SEQ ID NO: 14078

SEQ ID NO: 54949 - DNA, 201 bp, Bos taurus; identical to SEQ ID NO: 14079

SEQ ID NO: 54950 - DNA, 201 bp, Bos taurus; identical to SEQ ID NO: 14080

SEQ ID NO: 54951 - DNA, 201 bp, Bos taurus; identical to SEQ ID NO: 14081

SEQ ID NO: 54952 - DNA, 201 bp, Bos taurus; identical to SEQ ID NO: 14083

SEQ ID NO: 54953 - DNA, 201 bp, Bos taurus; identical to SEQ ID NO: 14084

SEQ ID NO: 54954 - DNA, 201 bp, Bos taurus; identical to SEQ ID NO: 14085

SEQ ID NO: 54955 - DNA, 201 bp, Bos taurus; identical to SEQ ID NO: 14086

SEQ ID NO: 54956 - DNA, 201 bp, Bos taurus; identical to SEQ ID NO: 14087

SEQ ID NO: 54957 - DNA, 201 bp, Bos taurus; identical to SEQ ID NO: 14088

SEQ ID NO: 54958 - DNA, 201 bp, Bos taurus; identical to SEQ ID NO: 14089

SEQ ID NO: 54959 - DNA, 201 bp, Bos taurus; identical to SEQ ID NO: 14091

SEQ ID NO: 54960 - DNA, 201 bp, Bos taurus; identical to SEQ ID NO: 14093

SEQ ID NO: 54961 - DNA, 201 bp, Bos taurus; identical to SEQ ID NO: 14095

SEQ ID NO: 54962 - DNA, 201 bp, Bos taurus; identical to SEQ ID NO: 14096

SEQ ID NO: 54963 - DNA, 201 bp, Bos taurus; identical to SEQ ID NO: 14097

SEQ ID NO: 54964 - DNA, 201 bp, Bos taurus; identical to SEQ ID NO: 14098

SEQ ID NO: 54965 - DNA, 201 bp, Bos taurus; identical to SEQ ID NO: 14099

SEQ ID NO: 54966 - DNA, 201 bp, Bos taurus; identical to SEQ ID NO: 14100

SEQ ID NO: 54967 - DNA, 201 bp, Bos taurus; identical to SEQ ID NO: 14101

SEQ ID NO: 54968 - DNA, 201 bp, Bos taurus; identical to SEQ ID NO: 14102

SEQ ID NO: 54969 - DNA, 201 bp, Bos taurus; identical to SEQ ID NO: 14103

SEQ ID NO: 54970 - DNA, 201 bp, Bos taurus; identical to SEQ ID NO: 14105

SEQ ID NO: 54971 - DNA, 201 bp, Bos taurus; identical to SEQ ID NO: 14106

SEQ ID NO: 54972 - DNA, 201 bp, Bos taurus; identical to SEQ ID NO: 14107

SEQ ID NO: 54973 - DNA, 201 bp, Bos taurus; identical to SEQ ID NO: 14108

SEQ ID NO: 54974 - DNA, 201 bp, Bos taurus; identical to SEQ ID NO: 14109

SEQ ID NO: 54975 - DNA, 201 bp, Bos taurus; identical to SEQ ID NO: 14110

SEQ ID NO: 54976 - DNA, 201 bp, Bos taurus; identical to SEQ ID NO: 14112

SEQ ID NO: 54977 - DNA, 201 bp, Bos taurus; identical to SEQ ID NO: 14113

SEQ ID NO: 54978 - DNA, 201 bp, Bos taurus; identical to SEQ ID NO: 14114

SEQ ID NO: 54979 - DNA, 201 bp, Bos taurus; identical to SEQ ID NO: 14115

SEQ ID NO: 54980 - DNA, 201 bp, Bos taurus; identical to SEQ ID NO: 14116

SEQ ID NO: 54981 - DNA, 201 bp, Bos taurus; identical to SEQ ID NO: 14117

SEQ ID NO: 54982 - DNA, 201 bp, Bos taurus; identical to SEQ ID NO: 14118

SEQ ID NO: 54983 - DNA, 201 bp, Bos taurus; identical to SEQ ID NO: 14119

SEQ ID NO: 54984 - DNA, 201 bp, Bos taurus; identical to SEQ ID NO: 14120

SEQ ID NO: 54985 - DNA, 201 bp, Bos taurus; identical to SEQ ID NO: 14121

SEQ ID NO: 54986 - DNA, 201 bp, Bos taurus; identical to SEQ ID NO: 14123

SEQ ID NO: 54987 - DNA, 201 bp, Bos taurus; identical to SEQ ID NO: 14124

SEQ ID NO: 54988 - DNA, 201 bp, Bos taurus; identical to SEQ ID NO: 14125

SEQ ID NO: 54989 - DNA, 201 bp, Bos taurus; identical to SEQ ID NO: 14126

SEQ ID NO: 54990 - DNA, 201 bp, Bos taurus; identical to SEQ ID NO: 14127

SEQ ID NO: 54991 - DNA, 201 bp, Bos taurus; identical to SEQ ID NO: 14128

SEQ ID NO: 54992 - DNA, 201 bp, Bos taurus; identical to SEQ ID NO: 14129

SEQ ID NO: 54993 - DNA, 201 bp, Bos taurus; identical to SEQ ID NO: 14130

SEQ ID NO: 54994 - DNA, 201 bp, Bos taurus; identical to SEQ ID NO: 14131

SEQ ID NO: 54995 - DNA, 201 bp, Bos taurus; identical to SEQ ID NO: 14132

SEQ ID NO: 54996 - DNA, 201 bp, Bos taurus; identical to SEQ ID NO: 14133

SEQ ID NO: 54997 - DNA, 201 bp, Bos taurus; identical to SEQ ID NO: 14134

SEQ ID NO: 54998 - DNA, 201 bp, Bos taurus; identical to SEQ ID NO: 14135

SEQ ID NO: 54999 - DNA, 201 bp, Bos taurus; identical to SEQ ID NO: 14136

SEQ ID NO: 55000 - DNA, 201 bp, Bos taurus; identical to SEQ ID NO: 14138

SEQ ID NO: 55001 - DNA, 201 bp, Bos taurus; identical to SEQ ID NO: 14139

SEQ ID NO: 55002 - DNA, 201 bp, Bos taurus; identical to SEQ ID NO: 14140

SEQ ID NO: 55003 - DNA, 201 bp, Bos taurus; identical to SEQ ID NO: 14141

SEQ ID NO: 55004 - DNA, 201 bp, Bos taurus; identical to SEQ ID NO: 14142

SEQ ID NO: 55005 - DNA, 201 bp, Bos taurus; identical to SEQ ID NO: 14143

SEQ ID NO: 55006 - DNA, 201 bp, Bos taurus; identical to SEQ ID NO: 14144

SEQ ID NO: 55007 - DNA, 201 bp, Bos taurus; identical to SEQ ID NO: 14145

SEQ ID NO: 55008 - DNA, 201 bp, Bos taurus; identical to SEQ ID NO: 14147

SEQ ID NO: 55009 - DNA, 201 bp, Bos taurus; identical to SEQ ID NO: 14148

SEQ ID NO: 55010 - DNA, 201 bp, Bos taurus; identical to SEQ ID NO: 14149

SEQ ID NO: 55011 - DNA, 201 bp, Bos taurus; identical to SEQ ID NO: 14150

SEQ ID NO: 55012 - DNA, 201 bp, Bos taurus; identical to SEQ ID NO: 14152

SEQ ID NO: 55013 - DNA, 201 bp, Bos taurus; identical to SEQ ID NO: 14153

SEQ ID NO: 55014 - DNA, 201 bp, Bos taurus; identical to SEQ ID NO: 14154

SEQ ID NO: 55015 - DNA, 201 bp, Bos taurus; identical to SEQ ID NO: 14156

SEQ ID NO: 55016 - DNA, 201 bp, Bos taurus; identical to SEQ ID NO: 14161

SEQ ID NO: 55017 - DNA, 201 bp, Bos taurus; identical to SEQ ID NO: 14163

SEQ ID NO: 55018 - DNA, 201 bp, Bos taurus; identical to SEQ ID NO: 14164

SEQ ID NO: 55019 - DNA, 201 bp, Bos taurus; identical to SEQ ID NO: 14165

SEQ ID NO: 55020 - DNA, 201 bp, Bos taurus; identical to SEQ ID NO: 14166

SEQ ID NO: 55021 - DNA, 201 bp, Bos taurus; identical to SEQ ID NO: 14167

SEQ ID NO: 55022 - DNA, 201 bp, Bos taurus; identical to SEQ ID NO: 14169

SEQ ID NO: 55023 - DNA, 201 bp, Bos taurus; identical to SEQ ID NO: 14173

SEQ ID NO: 55024 - DNA, 201 bp, Bos taurus; identical to SEQ ID NO: 14176

SEQ ID NO: 55025 - DNA, 201 bp, Bos taurus; identical to SEQ ID NO: 14177

SEQ ID NO: 55026 - DNA, 201 bp, Bos taurus; identical to SEQ ID NO: 14178

SEQ ID NO: 55027 - DNA, 201 bp, Bos taurus; identical to SEQ ID NO: 14179

SEQ ID NO: 55028 - DNA, 201 bp, Bos taurus; identical to SEQ ID NO: 14180

SEQ ID NO: 55029 - DNA, 201 bp, Bos taurus; identical to SEQ ID NO: 14181

SEQ ID NO: 55030 - DNA, 201 bp, Bos taurus; identical to SEQ ID NO: 14186

SEQ ID NO: 55031 - DNA, 201 bp, Bos taurus; identical to SEQ ID NO: 14187

SEQ ID NO: 55032 - DNA, 201 bp, Bos taurus; identical to SEQ ID NO: 14188

SEQ ID NO: 55033 - DNA, 201 bp, Bos taurus; identical to SEQ ID NO: 14191

SEQ ID NO: 55034 - DNA, 201 bp, Bos taurus; identical to SEQ ID NO: 14192

SEQ ID NO: 55035 - DNA, 201 bp, Bos taurus; identical to SEQ ID NO: 14193

SEQ ID NO: 55036 - DNA, 201 bp, Bos taurus; identical to SEQ ID NO: 14194

SEQ ID NO: 55037 - DNA, 201 bp, Bos taurus
gctcatgggccccctgaagagctgtaggaaaagcctgcagcttgatatggaaagctgctcatgcttcctgtcttacggacccttcaaacccaaacaccacggtccccaggcctttgtcccctttcagggtccagctcaccattggtctcagatgctgtccccatgtccattgctggacatttgaatattcctcccacagct

SEQ ID NO: 55038 - DNA, 201 bp, Bos taurus; identical to SEQ ID NO: 14196

SEQ ID NO: 55039 - DNA, 201 bp, Bos taurus
ggggagtaagaggaaatggggccagaatcagtgccccctgctgctgagatgaggctgcagagagaggtctggggtcacagtgtcagattctgaaccacacagacaggaagcctcatcaggggcctggtttccagtttctgggagtttttaaagagcatgatagacccatgctgagaaaaatagagcatgctaaagacttcg

SEQ ID NO: 55040 - DNA, 201 bp, Bos taurus; identical to SEQ ID NO: 14197

SEQ ID NO: 55041 - DNA, 201 bp, Bos taurus; identical to SEQ ID NO: 14198

SEQ ID NO: 55042 - DNA, 201 bp, Bos taurus
gactgctaggaatcagtggtagtgatgacaaaagaaaccaagccctagtgaggacaagagtcagggcccagcgaggaacagaatcagggcccattaaggaccagggtcaggatgtagtagggacaaggatcaggtcctcgtgagcatgaaagtcaggctctaatgatgatgagagtcatgccgtagtgaggaccagattca

SEQ ID NO: 55043 - DNA, 201 bp, Bos taurus; identical to SEQ ID NO: 14199

SEQ ID NO: 55044 - DNA, 201 bp, Bos taurus
ttagtctatatcgttggtgacaaacacattttgatataaacattcctcaaaggacattgctggttagaatatcagtactgaatctaaagtatacaaacacataaacacacatgcacatacacacttgaaagctacagaaaatgtaccacacttgtggccctgagaaattcttacaacttgaaaatctaagatggtggctca

SEQ ID NO: 55045 - DNA, 201 bp, Bos taurus; identical to SEQ ID NO: 14200

SEQ ID NO: 55046 - DNA, 201 bp, Bos taurus; identical to SEQ ID NO: 14201

SEQ ID NO: 55047 - DNA, 201 bp, Bos taurus; identical to SEQ ID NO: 14202

SEQ ID NO: 55048 - DNA, 201 bp, Bos taurus; identical to SEQ ID NO: 14204

SEQ ID NO: 55049 - DNA, 201 bp, Bos taurus; identical to SEQ ID NO: 14205

SEQ ID NO: 55050 - DNA, 201 bp, Bos taurus; identical to SEQ ID NO: 14206

SEQ ID NO: 55051 - DNA, 201 bp, Bos taurus; identical to SEQ ID NO: 14210

SEQ ID NO: 55052 - DNA, 201 bp, Bos taurus; identical to SEQ ID NO: 14211

SEQ ID NO: 55053 - DNA, 201 bp, Bos taurus; identical to SEQ ID NO: 14212

SEQ ID NO: 55054 - DNA, 201 bp, Bos taurus; identical to SEQ ID NO: 14213

SEQ ID NO: 55055 - DNA, 201 bp, Bos taurus; identical to SEQ ID NO: 14214

SEQ ID NO: 55056 - DNA, 201 bp, Bos taurus; identical to SEQ ID NO: 14215

SEQ ID NO: 55057 - DNA, 201 bp, Bos taurus; identical to SEQ ID NO: 14217

SEQ ID NO: 55058 - DNA, 201 bp, Bos taurus; identical to SEQ ID NO: 14219

SEQ ID NO: 55059 - DNA, 201 bp, Bos taurus; identical to SEQ ID NO: 14221

SEQ ID NO: 55060 - DNA, 201 bp, Bos taurus; identical to SEQ ID NO: 14222

SEQ ID NO: 55061 - DNA, 201 bp, Bos taurus
cagccaaagaaatgaataaatattaaaacgaacaagcaaaatgccttcaaattccagccacttctagctgtttgcatctggaatcccagcgtgtaggccacgctcacaagagacagcgtcttagactaacagaatgaattaactccacgtggggaggagttaccttgagctcctggtctccaaagagtaacaggctgagct

SEQ ID NO: 55062 - DNA, 201 bp, Bos taurus
ctatatatagcagtgtgtatgctgatattttttaggactagatttcacagcatcggttgaatctctggcaactgcaaaggccacaaggccaggtagcagtagtcctgctgggatgagcatgcctcctccagtgtgagtttttgttatactcagaagcttacccacctggccctggcaggcccttgaatttgagacccgtaa

SEQ ID NO: 55063 - DNA, 201 bp, Bos taurus; identical to SEQ ID NO: 14223

SEQ ID NO: 55064 - DNA, 201 bp, Bos taurus; identical to SEQ ID NO: 14224

SEQ ID NO: 55065 - DNA, 201 bp, Bos taurus; identical to SEQ ID NO: 14225

SEQ ID NO: 55066 - DNA, 201 bp, Bos taurus
atggccctctgcaagttgctgtcattgttttcaaatgctttgtagttgggctgcccagatctggtcttcgcgatgggatggtgacaaaaagggttgcggatgctacagggtggcctgcctgtcacacaagtgcagccccagtgaaactgatgggagattaataggaaataatgggaccctgagtagagcactcgtgtggct

SEQ ID NO: 55067 - DNA, 201 bp, Bos taurus; identical to SEQ ID NO: 14226

SEQ ID NO: 55068 - DNA, 201 bp, Bos taurus; identical to SEQ ID NO: 14227

SEQ ID NO: 55069 - DNA, 201 bp, Bos taurus
aggggcccaggaataatgaaaagaagagtgagattacctttcattgacaaagacgactatacttactctaagtgacaacagaaggaggccaagaagataactgaaggatcctgaagatcaaagggctagaggatttgctctctctttggcacaagggtctagaattgcaaaaaccagaacaaatgtaggatgctaaaatgc

SEQ ID NO: 55070 - DNA, 201 bp, Bos taurus
agttacacacctcccagcaggtcttcctccctgcttggccccagacggttcataatcacttctcttgacatccttggactactgatgttgagaaagcctaggaaccacggccctgtctcaagatgggtcccaagagaacagtgtaccagccaggatttttcttttatattgacctgggttcaagtcccagtatcccacttg

SEQ ID NO: 55071 - DNA, 201 bp, Bos taurus; identical to SEQ ID NO: 14228

SEQ ID NO: 55072 - DNA, 201 bp, Bos taurus; identical to SEQ ID NO: 14229

SEQ ID NO: 55073 - DNA, 201 bp, Bos taurus; identical to SEQ ID NO: 14230

SEQ ID NO: 55074 - DNA, 201 bp, Bos taurus; identical to SEQ ID NO: 14231

SEQ ID NO: 55075 - DNA, 201 bp, Bos taurus; identical to SEQ ID NO: 14232

SEQ ID NO: 55076 - DNA, 201 bp, Bos taurus; identical to SEQ ID NO: 14233

SEQ ID NO: 55077 - DNA, 201 bp, Bos taurus; identical to SEQ ID NO: 14234

SEQ ID NO: 55078 - DNA, 201 bp, Bos taurus; identical to SEQ ID NO: 14235

SEQ ID NO: 55079 - DNA, 201 bp, Bos taurus
tgcatatatatatatatatatatatatatatatatatatatcatacatatgatatatacatatctctcagattcttaaatatatacatacaaaatgtgtgcgtgtgtgtaactgaaccactgcacacctgaaattaatacagcactgtaaatcaagtacacttcaaataagaaaacaattttttttttaatttctgctaaa

SEQ ID NO: 55080 - DNA, 201 bp, Bos taurus
aagggatttccaaagtcacccaaggagtaccaacagatccgagtctggaaacaaaggtctgtccaatcatgatgataataataccagctaacgatgggagttgtctgctcagcccttggtgggtgttactcctttaaccctcatgggccccaggggagtcacacccaggccctgcatgtctccagcatactcgcctgcctg

SEQ ID NO: 55081 - DNA, 201 bp, Bos taurus
taaaagatgtggtccaccttgtctaacccaccagggctagaatgacgcactgaattctcacatcagactgtctgccagcatcagtcccaggcagagtcagcgcgcagagcaaaagcaggaagcacgcaaccccaacggcaccaacagcaaaaccccacccacaccccggctctcagatccaaggaggccaggcagcctgga

SEQ ID NO: 55082 - DNA, 201 bp, Bos taurus; identical to SEQ ID NO: 14239

SEQ ID NO: 55083 - DNA, 201 bp, Bos taurus; identical to SEQ ID NO: 14240

SEQ ID NO: 55084 - DNA, 201 bp, Bos taurus; identical to SEQ ID NO: 14241

SEQ ID NO: 55085 - DNA, 201 bp, Bos taurus; identical to SEQ ID NO: 14243

SEQ ID NO: 55086 - DNA, 201 bp, Bos taurus; identical to SEQ ID NO: 14245

SEQ ID NO: 55087 - DNA, 201 bp, Bos taurus; identical to SEQ ID NO: 14246

SEQ ID NO: 55088 - DNA, 201 bp, Bos taurus; identical to SEQ ID NO: 14248

SEQ ID NO: 55089 - DNA, 201 bp, Bos taurus; identical to SEQ ID NO: 14249

SEQ ID NO: 55090 - DNA, 201 bp, Bos taurus; identical to SEQ ID NO: 14252

SEQ ID NO: 55091 - DNA, 201 bp, Bos taurus; identical to SEQ ID NO: 14253

SEQ ID NO: 55092 - DNA, 201 bp, Bos taurus; identical to SEQ ID NO: 14254

SEQ ID NO: 55093 - DNA, 201 bp, Bos taurus; identical to SEQ ID NO: 14255

SEQ ID NO: 55094 - DNA, 201 bp, Bos taurus; identical to SEQ ID NO: 14256

SEQ ID NO: 55095 - DNA, 201 bp, Bos taurus; identical to SEQ ID NO: 14258

SEQ ID NO: 55096 - DNA, 201 bp, Bos taurus; identical to SEQ ID NO: 14259

SEQ ID NO: 55097 - DNA, 201 bp, Bos taurus; identical to SEQ ID NO: 14260

SEQ ID NO: 55098 - DNA, 201 bp, Bos taurus; identical to SEQ ID NO: 14261

SEQ ID NO: 55099 - DNA, 201 bp, Bos taurus; identical to SEQ ID NO: 14262

SEQ ID NO: 55100 - DNA, 201 bp, Bos taurus; identical to SEQ ID NO: 14263

SEQ ID NO: 55101 - DNA, 201 bp, Bos taurus; identical to SEQ ID NO: 14264

SEQ ID NO: 55102 - DNA, 201 bp, Bos taurus; identical to SEQ ID NO: 14266

SEQ ID NO: 55103 - DNA, 201 bp, Bos taurus; identical to SEQ ID NO: 14268

SEQ ID NO: 55104 - DNA, 201 bp, Bos taurus; identical to SEQ ID NO: 14270

SEQ ID NO: 55105 - DNA, 201 bp, Bos taurus; identical to SEQ ID NO: 14271

SEQ ID NO: 55106 - DNA, 201 bp, Bos taurus; identical to SEQ ID NO: 14274

SEQ ID NO: 55107 - DNA, 201 bp, Bos taurus; identical to SEQ ID NO: 14277

SEQ ID NO: 55108 - DNA, 201 bp, Bos taurus; identical to SEQ ID NO: 14278

SEQ ID NO: 55109 - DNA, 201 bp, Bos taurus; identical to SEQ ID NO: 14279

SEQ ID NO: 55110 - DNA, 201 bp, Bos taurus; identical to SEQ ID NO: 14281

SEQ ID NO: 55111 - DNA, 201 bp, Bos taurus; identical to SEQ ID NO: 14282

SEQ ID NO: 55112 - DNA, 201 bp, Bos taurus; identical to SEQ ID NO: 14283

SEQ ID NO: 55113 - DNA, 201 bp, Bos taurus; identical to SEQ ID NO: 14284

SEQ ID NO: 55114 - DNA, 201 bp, Bos taurus; identical to SEQ ID NO: 14286

SEQ ID NO: 55115 - DNA, 201 bp, Bos taurus; identical to SEQ ID NO: 14287

SEQ ID NO: 55116 - DNA, 201 bp, Bos taurus; identical to SEQ ID NO: 14288

SEQ ID NO: 55117 - DNA, 201 bp, Bos taurus; identical to SEQ ID NO: 14289

SEQ ID NO: 55118 - DNA, 201 bp, Bos taurus; identical to SEQ ID NO: 14291

SEQ ID NO: 55119 - DNA, 201 bp, Bos taurus; identical to SEQ ID NO: 14292

SEQ ID NO: 55120 - DNA, 201 bp, Bos taurus; identical to SEQ ID NO: 14293

SEQ ID NO: 55121 - DNA, 201 bp, Bos taurus; identical to SEQ ID NO: 14297

SEQ ID NO: 55122 - DNA, 201 bp, Bos taurus; identical to SEQ ID NO: 14298

SEQ ID NO: 55123 - DNA, 201 bp, Bos taurus
accagccctactgaatcagagtctgaatgtcacatgatctctcaagtgactactaagtaaactaaactttgagaaacacaggtgtaggtcacacatcaaaattgtcccagttaggtgcaaagatgcagaaatacctgtgttccctgaggtattaacccctgagtaagggctggtcttggtttctttaatcctcttaataaa

SEQ ID NO: 55124 - DNA, 201 bp, Bos taurus
ttattagatgaatggaggctaaatgcagtgcgttttccccatttggaagcttgagcatggctagtcccatattcatcccacactccccaatcccaggcccctccagcctccccgccaaatttggtttaatccttcccatgttaaagttgcaccccaccaaattatctgctccctaaagagcccctctcctgttgccttcac

SEQ ID NO: 55125 - DNA, 201 bp, Bos taurus; identical to SEQ ID NO: 14300

SEQ ID NO: 55126 - DNA, 201 bp, Bos taurus
gactcctctgtccgtggaattttccaggcaagaatattggagcgggtcaccctttccttctgcagggaatcttgatgaatacctaggaaacgctacctccaaagcgtttataaacatatacttgttacaaaatggccattttgaactgagttcagcactcttgacacaagacacttttttcaaaggtcttgtttacaggct

SEQ ID NO: 55127 - DNA, 201 bp, Bos taurus; identical to SEQ ID NO: 14301

SEQ ID NO: 55128 - DNA, 201 bp, Bos taurus
ggtgatttttcattatctataaattatttttaaaatcttttaaattaatttatttttggctggactgggtcttcgctgctttgcacaggctttctatagttgtggtgagcaaaggctactcttcgctgagttgtggggccttctcattgaggtggcttttctttctgcgcagcacaggctctagacgcagccttcagcggt

SEQ ID NO: 55129 - DNA, 201 bp, Bos taurus
gaaaacttagaagggtggtggaaaaagacatgttttctccccgcactcactgttggttatcccaacaccatttatactaataaataatctttccctacttcgctgctcttcttttgttttcttctctataatagatagtatggggtttcccaggtgcatcagtaaaggacccacctaccaatgcaggagacaagagtttga

SEQ ID NO: 55130 - DNA, 201 bp, Bos taurus; identical to SEQ ID NO: 14302

SEQ ID NO: 55131 - DNA, 201 bp, Bos taurus; identical to SEQ ID NO: 14304

SEQ ID NO: 55132 - DNA, 201 bp, Bos taurus; identical to SEQ ID NO: 14305

SEQ ID NO: 55133 - DNA, 201 bp, Bos taurus; identical to SEQ ID NO: 14306

SEQ ID NO: 55134 - DNA, 201 bp, Bos taurus; identical to SEQ ID NO: 14307

SEQ ID NO: 55135 - DNA, 201 bp, Bos taurus; identical to SEQ ID NO: 14308

SEQ ID NO: 55136 - DNA, 201 bp, Bos taurus; identical to SEQ ID NO: 14309

SEQ ID NO: 55137 - DNA, 201 bp, Bos taurus; identical to SEQ ID NO: 14310

SEQ ID NO: 55138 - DNA, 201 bp, Bos taurus
atccgtttaccatgtagcctcccaagtctccttctctgccatcttgaatcttttggatttgaggtacttctgctcattttattaaagagcaaaacagttttgccaagaaatgctatctatcaatagaaaataatgagattcttctgtgcataatacactggggctttctgcttccactatacattgctcacaagccacaca

SEQ ID NO: 55139 - DNA, 201 bp, Bos taurus
agctaggagatgggttgggtactaggcccatcttttggtctatttttttgtcttattcaagacagatgaggacatccctggtggtccagtggttaatactccatactctcatctcaaggggcctgggttcgattcctcgtcaggaaactaagatcctgcatgccacccagtgtggccaaaacaaaacaaaatgagagagat

SEQ ID NO: 55140 - DNA, 201 bp, Bos taurus; identical to SEQ ID NO: 14312

SEQ ID NO: 55141 - DNA, 201 bp, Bos taurus; identical to SEQ ID NO: 14313

SEQ ID NO: 55142 - DNA, 201 bp, Bos taurus
tttgttgggtcgcaaagagtcagaggagactgagcatgcacacacatcgttagtaaaataataggcacagaggatagagggtatatctataaagagcctacagtgttttgtattaaactctttagtaaatttgactagcattttatctccatttattgagaaagacaaagtgtaacctatcagaaaagtcttctggcaact

SEQ ID NO: 55143 - DNA, 201 bp, Bos taurus
tggactgtctctggtccatggttaaccctctccaccatcttccctctgatcgagtcacactgggttctcggcggttttggttgctccataaatacaggctggtatcaggccctgagtgcatggcatttcttcttcctgaacccatattctcccacatatccatttgccttcctcatctctttcaagtgtttgttcaaatgt

SEQ ID NO: 55144 - DNA, 201 bp, Bos taurus; identical to SEQ ID NO: 14315

SEQ ID NO: 55145 - DNA, 201 bp, Bos taurus; identical to SEQ ID NO: 14316

SEQ ID NO: 55146 - DNA, 201 bp, Bos taurus; identical to SEQ ID NO: 14317

SEQ ID NO: 55147 - DNA, 201 bp, Bos taurus
gtaaccataccagttactacaagagagaaaaatcacagacttagttaacttgggtttaacccaaagcattcccccaaagttctggttgatctctaattcagtcctcaactttcaccacttggatttatttccaagatgggatcacttgagaatttgaggttagaaccaatgacagaaaaaaggaagtcttagcaatcatgc

SEQ ID NO: 55148 - DNA, 201 bp, Bos taurus; identical to SEQ ID NO: 14318

SEQ ID NO: 55149 - DNA, 201 bp, Bos taurus; identical to SEQ ID NO: 14319

SEQ ID NO: 55150 - DNA, 201 bp, Bos taurus; identical to SEQ ID NO: 14320

SEQ ID NO: 55151 - DNA, 201 bp, Bos taurus; identical to SEQ ID NO: 14321

SEQ ID NO: 55152 - DNA, 201 bp, Bos taurus; identical to SEQ ID NO: 14322

SEQ ID NO: 55153 - DNA, 201 bp, Bos taurus; identical to SEQ ID NO: 14323

SEQ ID NO: 55154 - DNA, 201 bp, Bos taurus; identical to SEQ ID NO: 14324

SEQ ID NO: 55155 - DNA, 201 bp, Bos taurus; identical to SEQ ID NO: 14325

SEQ ID NO: 55156 - DNA, 201 bp, Bos taurus; identical to SEQ ID NO: 14326

SEQ ID NO: 55157 - DNA, 201 bp, Bos taurus; identical to SEQ ID NO: 14327

SEQ ID NO: 55158 - DNA, 201 bp, Bos taurus; identical to SEQ ID NO: 14328

SEQ ID NO: 55159 - DNA, 201 bp, Bos taurus; identical to SEQ ID NO: 14329

SEQ ID NO: 55160 - DNA, 201 bp, Bos taurus; identical to SEQ ID NO: 14330

SEQ ID NO: 55161 - DNA, 201 bp, Bos taurus; identical to SEQ ID NO: 14331

SEQ ID NO: 55162 - DNA, 201 bp, Bos taurus; identical to SEQ ID NO: 14332

SEQ ID NO: 55163 - DNA, 201 bp, Bos taurus; identical to SEQ ID NO: 14333

SEQ ID NO: 55164 - DNA, 201 bp, Bos taurus; identical to SEQ ID NO: 14338

SEQ ID NO: 55165 - DNA, 201 bp, Bos taurus; identical to SEQ ID NO: 14342

SEQ ID NO: 55166 - DNA, 201 bp, Bos taurus; identical to SEQ ID NO: 14343

SEQ ID NO: 55167 - DNA, 201 bp, Bos taurus; identical to SEQ ID NO: 14344

SEQ ID NO: 55168 - DNA, 201 bp, Bos taurus; identical to SEQ ID NO: 14345

SEQ ID NO: 55169 - DNA, 201 bp, Bos taurus; identical to SEQ ID NO: 14346

SEQ ID NO: 55170 - DNA, 201 bp, Bos taurus; identical to SEQ ID NO: 14349

SEQ ID NO: 55171 - DNA, 201 bp, Bos taurus; identical to SEQ ID NO: 14353

SEQ ID NO: 55172 - DNA, 201 bp, Bos taurus; identical to SEQ ID NO: 14357

SEQ ID NO: 55173 - DNA, 201 bp, Bos taurus
ccttaagttaaaggaagtgttttcttttctaatgttatactctttacctatcagtgtattgctgcaacttgaatcattcttttcctgttgttggagataaagttatcctgtactgatgtatttaacacttgtattttattattgagcatatcaataaaaatattaaaaaagaacagattgttttttaccaactctatagca

SEQ ID NO: 55174 - DNA, 201 bp, Bos taurus
agaatgttgtcagtctaaagagtgacagaggcaacgtttaagggtatcagagacagaagaaggagttaaatagaagttagagagactgggggaattagattaggtcaaagggtagaggatatgggagaaactccctgagcaggctgaaatgcctggaaattgtggtcagcaactggaaaatctaaatttatggcttagagg

SEQ ID NO: 55175 - DNA, 201 bp, Bos taurus; identical to SEQ ID NO: 14360

SEQ ID NO: 55176 - DNA, 201 bp, Bos taurus
cctcagagcctcatcagccctgatttcacacagaccacactgttccccctgcattgggcattttccagagagtttggccaagagttcagactctgtgataagaattcaggtaaatggacagaatgtctggacttgggctacttagtgaggtacgtaaaagagcagaaatgtgacccataggaagagccgagaaagtgggat

SEQ ID NO: 55177 - DNA, 201 bp, Bos taurus; identical to SEQ ID NO: 14361

SEQ ID NO: 55178 - DNA, 201 bp, Bos taurus; identical to SEQ ID NO: 14362

SEQ ID NO: 55179 - DNA, 201 bp, Bos taurus
gttgtggcatgtgggatctattaatagttccccaaccatggatctgaaccccagaccccctgcattgggagcacggagtcttaaccaccggaccaccacggaagtcccttccaatcctaatatcattccaaacagtctttccattaattatgcagtcacataaactaatacttaataaacattattggattattggtatta

SEQ ID NO: 55180 - DNA, 201 bp, Bos taurus; identical to SEQ ID NO: 14363

SEQ ID NO: 55181 - DNA, 201 bp, Bos taurus
agctggggagaaggaagaaggcaacccagggccaaaaagtgaggagccagggcaagaaggtgttctgaagaccgcaggggagcggggacagtctgagtatggagaccttcacccagaacagtgcaccgacagacagaggcgggtcctctgatccagaaacccaccttccttctaaagacacacgtgtcagaacccacacgg

SEQ ID NO: 55182 - DNA, 201 bp, Bos taurus
agcttcatgtaaataattctgtgtactcttgctcagcattgtatctgtgagttatccatgttgtgattcatttattaatacctctctgtagtgttctgtcatgtgacttagaccacagtttatgaatccattctactgttggtggaaatttgggttgtgtccagtttgtagttgttatgaataaagttcctacgaacattt

SEQ ID NO: 55183 - DNA, 201 bp, Bos taurus
tctctgcccccgagtgtgagcttcatgagggcagcagagacgtgggtctctgcacatgtcctggcatctagcagagggcctggcacacagaaggtgctcaatgcttgctgactggctgaggaaagaggaagtccagtcatagaggtgactccggccgtgttgagcgttaaagaagctgaaggtgagggttagggaattggc

SEQ ID NO: 55184 - DNA, 201 bp, Bos taurus
gttcatagttatcagggaaaccaatagaggagcatgtccatcatcttccctttgataaactatcttagcggtgaggttctgatctagagatgagaacaatcgctagctgggccccgggacaagtatgcaggtatttactgatcaaatcaatgattaagaggggaggtcagtcatgtgagtagggtgtaggtgtgatagaga

SEQ ID NO: 55185 - DNA, 201 bp, Bos taurus; identical to SEQ ID NO: 14364

SEQ ID NO: 55186 - DNA, 201 bp, Bos taurus; identical to SEQ ID NO: 14365

SEQ ID NO: 55187 - DNA, 201 bp, Bos taurus
tgccggcctcgttgatggaagggatttagtcataggtaactactttgtgctctgcccttgtgcccttgtctctctgcctatatccttaggatctagaaaaccaggccttgattctactgagtaggtcgaatgattctaggaatggttcttggctttgttgaaataggaggtattggggatagttccttttttacaaaaaag

SEQ ID NO: 55188 - DNA, 201 bp, Bos taurus
catcatcttccctgttcaatctagagttcccccacgaggctggggacggggtgcttctccttctgcgggagggatccaggatctgccattgccgggcccccacctgaggctctgtcccacattatctcttctacttgtaggactcagggtggagttcatgttcacaaggatggcctgacagtgacctctccggtcctgatg

SEQ ID NO: 55189 - DNA, 201 bp, Bos taurus; identical to SEQ ID NO: 14367

SEQ ID NO: 55190 - DNA, 201 bp, Bos taurus
gtgctggtgtgaggcatacagcctagagcaagaaggtgccggagccttccctgcctggtcacgcgggcttctgtggccctgatcccgcataacctgatgatgacaggtatgtaccactgccctaggagcacctgtgtgtgtcacatgtgggcacctgtacaggtgtgctatagttctgcccagttcccctctttgggccag

SEQ ID NO: 55191 - DNA, 201 bp, Bos taurus; identical to SEQ ID NO: 14368

SEQ ID NO: 55192 - DNA, 201 bp, Bos taurus; identical to SEQ ID NO: 14369

SEQ ID NO: 55193 - DNA, 201 bp, Bos taurus; identical to SEQ ID NO: 14370

SEQ ID NO: 55194 - DNA, 201 bp, Bos taurus; identical to SEQ ID NO: 14371

SEQ ID NO: 55195 - DNA, 201 bp, Bos taurus
cctcttctcctgcaggatggggcaggggacaggcactggctggggctccgaacccagcccccatcctcccccaacagccccctccccaggggccaggaaacactactttgagtttccattttgcagtcaaagacatcccatccatgatgaatgatgtcaagtgcttacttttgctggccaaggtttacaagagtcataaaa

SEQ ID NO: 55196 - DNA, 201 bp, Bos taurus; identical to SEQ ID NO: 14374

SEQ ID NO: 55197 - DNA, 201 bp, Bos taurus; identical to SEQ ID NO: 14376

SEQ ID NO: 55198 - DNA, 201 bp, Bos taurus
tctgatgacaaaggaataagttaccacttcttgatttgaggcagttgggattctgctcccctggcctccactttgtctttgattgccggggaaaatggttgtcttggctaatgttaaaagacagatctaagtgtggttggaaagtctgttccaggcattgtcagagctggactgtaatagtgtatgtaactctggaccaca

SEQ ID NO: 55199 - DNA, 201 bp, Bos taurus
ggaccagtacacgggtgagtgtgactttctggccactggagtcacacccacttagagggtcacttgaacactagcaacctttgtctgggaaaagtagtgattgggctcccttaaaggcctgacatcttcagcgatgccactgccttaggcctaaagaacccaggacacgactcacttggcagattaaccattagtaatatg

SEQ ID NO: 55200 - DNA, 201 bp, Bos taurus; identical to SEQ ID NO: 14377

SEQ ID NO: 55201 - DNA, 201 bp, Bos taurus; identical to SEQ ID NO: 14378

SEQ ID NO: 55202 - DNA, 201 bp, Bos taurus; identical to SEQ ID NO: 14379

SEQ ID NO: 55203 - DNA, 201 bp, Bos taurus; identical to SEQ ID NO: 14380

SEQ ID NO: 55204 - DNA, 201 bp, Bos taurus; identical to SEQ ID NO: 14381

SEQ ID NO: 55205 - DNA, 201 bp, Bos taurus; identical to SEQ ID NO: 14382

SEQ ID NO: 55206 - DNA, 201 bp, Bos taurus; identical to SEQ ID NO: 14383

SEQ ID NO: 55207 - DNA, 201 bp, Bos taurus; identical to SEQ ID NO: 14384

SEQ ID NO: 55208 - DNA, 201 bp, Bos taurus; identical to SEQ ID NO: 14385

SEQ ID NO: 55209 - DNA, 201 bp, Bos taurus; identical to SEQ ID NO: 14386

SEQ ID NO: 55210 - DNA, 201 bp, Bos taurus; identical to SEQ ID NO: 14387

SEQ ID NO: 55211 - DNA, 201 bp, Bos taurus; identical to SEQ ID NO: 14388

SEQ ID NO: 55212 - DNA, 201 bp, Bos taurus; identical to SEQ ID NO: 14389

SEQ ID NO: 55213 - DNA, 201 bp, Bos taurus; identical to SEQ ID NO: 14390

SEQ ID NO: 55214 - DNA, 201 bp, Bos taurus; identical to SEQ ID NO: 14391

SEQ ID NO: 55215 - DNA, 201 bp, Bos taurus; identical to SEQ ID NO: 14393

SEQ ID NO: 55216 - DNA, 201 bp, Bos taurus; identical to SEQ ID NO: 14394

SEQ ID NO: 55217 - DNA, 201 bp, Bos taurus; identical to SEQ ID NO: 14395

SEQ ID NO: 55218 - DNA, 201 bp, Bos taurus; identical to SEQ ID NO: 14396

SEQ ID NO: 55219 - DNA, 201 bp, Bos taurus; identical to SEQ ID NO: 14397

SEQ ID NO: 55220 - DNA, 201 bp, Bos taurus; identical to SEQ ID NO: 14398

SEQ ID NO: 55221 - DNA, 201 bp, Bos taurus; identical to SEQ ID NO: 14399

SEQ ID NO: 55222 - DNA, 201 bp, Bos taurus; identical to SEQ ID NO: 14400

SEQ ID NO: 55223 - DNA, 201 bp, Bos taurus; identical to SEQ ID NO: 14401

SEQ ID NO: 55224 - DNA, 201 bp, Bos taurus; identical to SEQ ID NO: 14402

SEQ ID NO: 55225 - DNA, 201 bp, Bos taurus; identical to SEQ ID NO: 14403

SEQ ID NO: 55226 - DNA, 201 bp, Bos taurus; identical to SEQ ID NO: 14404

SEQ ID NO: 55227 - DNA, 201 bp, Bos taurus; identical to SEQ ID NO: 14405

SEQ ID NO: 55228 - DNA, 201 bp, Bos taurus; identical to SEQ ID NO: 14406

SEQ ID NO: 55229 - DNA, 201 bp, Bos taurus; identical to SEQ ID NO: 14407

SEQ ID NO: 55230 - DNA, 201 bp, Bos taurus; identical to SEQ ID NO: 14408

SEQ ID NO: 55231 - DNA, 201 bp, Bos taurus; identical to SEQ ID NO: 14409

SEQ ID NO: 55232 - DNA, 201 bp, Bos taurus; identical to SEQ ID NO: 14410

SEQ ID NO: 55233 - DNA, 201 bp, Bos taurus; identical to SEQ ID NO: 14411

SEQ ID NO: 55234 - DNA, 201 bp, Bos taurus; identical to SEQ ID NO: 14412

SEQ ID NO: 55235 - DNA, 201 bp, Bos taurus; identical to SEQ ID NO: 14413

SEQ ID NO: 55236 - DNA, 201 bp, Bos taurus; identical to SEQ ID NO: 14414

SEQ ID NO: 55237 - DNA, 201 bp, Bos taurus; identical to SEQ ID NO: 14415

SEQ ID NO: 55238 - DNA, 201 bp, Bos taurus; identical to SEQ ID NO: 14416

SEQ ID NO: 55239 - DNA, 201 bp, Bos taurus; identical to SEQ ID NO: 14417

SEQ ID NO: 55240 - DNA, 201 bp, Bos taurus; identical to SEQ ID NO: 14419

SEQ ID NO: 55241 - DNA, 201 bp, Bos taurus; identical to SEQ ID NO: 14420

SEQ ID NO: 55242 - DNA, 201 bp, Bos taurus; identical to SEQ ID NO: 14421

SEQ ID NO: 55243 - DNA, 201 bp, Bos taurus; identical to SEQ ID NO: 14422

SEQ ID NO: 55244 - DNA, 201 bp, Bos taurus; identical to SEQ ID NO: 14423

SEQ ID NO: 55245 - DNA, 201 bp, Bos taurus; identical to SEQ ID NO: 14424

SEQ ID NO: 55246 - DNA, 201 bp, Bos taurus; identical to SEQ ID NO: 14425

SEQ ID NO: 55247 - DNA, 201 bp, Bos taurus; identical to SEQ ID NO: 14426

SEQ ID NO: 55248 - DNA, 201 bp, Bos taurus; identical to SEQ ID NO: 14427

SEQ ID NO: 55249 - DNA, 201 bp, Bos taurus; identical to SEQ ID NO: 14428

SEQ ID NO: 55250 - DNA, 201 bp, Bos taurus; identical to SEQ ID NO: 14429

SEQ ID NO: 55251 - DNA, 201 bp, Bos taurus; identical to SEQ ID NO: 14430

SEQ ID NO: 55252 - DNA, 201 bp, Bos taurus; identical to SEQ ID NO: 14431

SEQ ID NO: 55253 - DNA, 201 bp, Bos taurus; identical to SEQ ID NO: 14432

SEQ ID NO: 55254 - DNA, 201 bp, Bos taurus; identical to SEQ ID NO: 14433

SEQ ID NO: 55255 - DNA, 201 bp, Bos taurus; identical to SEQ ID NO: 14434

SEQ ID NO: 55256 - DNA, 201 bp, Bos taurus; identical to SEQ ID NO: 14435

SEQ ID NO: 55257 - DNA, 201 bp, Bos taurus; identical to SEQ ID NO: 14436

SEQ ID NO: 55258 - DNA, 201 bp, Bos taurus; identical to SEQ ID NO: 14437

SEQ ID NO: 55259 - DNA, 201 bp, Bos taurus; identical to SEQ ID NO: 14438

SEQ ID NO: 55260 - DNA, 201 bp, Bos taurus; identical to SEQ ID NO: 14439

SEQ ID NO: 55261 - DNA, 201 bp, Bos taurus; identical to SEQ ID NO: 14440

SEQ ID NO: 55262 - DNA, 201 bp, Bos taurus; identical to SEQ ID NO: 14441

SEQ ID NO: 55263 - DNA, 201 bp, Bos taurus; identical to SEQ ID NO: 14442

SEQ ID NO: 55264 - DNA, 201 bp, Bos taurus; identical to SEQ ID NO: 14443

SEQ ID NO: 55265 - DNA, 201 bp, Bos taurus; identical to SEQ ID NO: 14444

SEQ ID NO: 55266 - DNA, 201 bp, Bos taurus; identical to SEQ ID NO: 14445

SEQ ID NO: 55267 - DNA, 201 bp, Bos taurus; identical to SEQ ID NO: 14446

SEQ ID NO: 55268 - DNA, 201 bp, Bos taurus; identical to SEQ ID NO: 14447

SEQ ID NO: 55269 - DNA, 201 bp, Bos taurus; identical to SEQ ID NO: 14448

SEQ ID NO: 55270 - DNA, 201 bp, Bos taurus; identical to SEQ ID NO: 14449

SEQ ID NO: 55271 - DNA, 201 bp, Bos taurus; identical to SEQ ID NO: 14450

SEQ ID NO: 55272 - DNA, 201 bp, Bos taurus
gctgtacagcagattggcaaacattgcaaatcaactcttcttcagtttaaaaactgtgaagatctatggaattatcttttttaaaatggtgttgacttttgtaaatcatagcaccttatatctgtacatggctggcattatgcagtatatgccctatgcatcataggcattacacacaatacctttccattatttttcatt

SEQ ID NO: 55273 - DNA, 201 bp, Bos taurus; identical to SEQ ID NO: 14451

SEQ ID NO: 55274 - DNA, 201 bp, Bos taurus; identical to SEQ ID NO: 14452

SEQ ID NO: 55275 - DNA, 201 bp, Bos taurus; identical to SEQ ID NO: 14453

SEQ ID NO: 55276 - DNA, 201 bp, Bos taurus; identical to SEQ ID NO: 14454

SEQ ID NO: 55277 - DNA, 201 bp, Bos taurus; identical to SEQ ID NO: 14455

SEQ ID NO: 55278 - DNA, 201 bp, Bos taurus; identical to SEQ ID NO: 14456

SEQ ID NO: 55279 - DNA, 201 bp, Bos taurus
agtttactctcttggggatccaacttctgttgggtccatgacgcagcatttctctttctcaggctttatctgctcatggtttatgaatgtaaatatgactcattaaaatcctggtttgagatcatacagaaacaggtcatttctggcccctgaataatcttctctattttaaaattagcttctgtatgaaaaagttatctc

SEQ ID NO: 55280 - DNA, 201 bp, Bos taurus; identical to SEQ ID NO: 14457

SEQ ID NO: 55281 - DNA, 201 bp, Bos taurus; identical to SEQ ID NO: 14458

SEQ ID NO: 55282 - DNA, 201 bp, Bos taurus; identical to SEQ ID NO: 14459

SEQ ID NO: 55283 - DNA, 201 bp, Bos taurus; identical to SEQ ID NO: 14460

SEQ ID NO: 55284 - DNA, 201 bp, Bos taurus; identical to SEQ ID NO: 14461

SEQ ID NO: 55285 - DNA, 201 bp, Bos taurus; identical to SEQ ID NO: 14462

SEQ ID NO: 55286 - DNA, 201 bp, Bos taurus; identical to SEQ ID NO: 14463

SEQ ID NO: 55287 - DNA, 201 bp, Bos taurus; identical to SEQ ID NO: 14465

SEQ ID NO: 55288 - DNA, 201 bp, Bos taurus; identical to SEQ ID NO: 14466

SEQ ID NO: 55289 - DNA, 201 bp, Bos taurus; identical to SEQ ID NO: 14467

SEQ ID NO: 55290 - DNA, 201 bp, Bos taurus; identical to SEQ ID NO: 14468

SEQ ID NO: 55291 - DNA, 201 bp, Bos taurus; identical to SEQ ID NO: 14469

SEQ ID NO: 55292 - DNA, 201 bp, Bos taurus; identical to SEQ ID NO: 14470

SEQ ID NO: 55293 - DNA, 201 bp, Bos taurus; identical to SEQ ID NO: 14472

SEQ ID NO: 55294 - DNA, 201 bp, Bos taurus; identical to SEQ ID NO: 14473

SEQ ID NO: 55295 - DNA, 201 bp, Bos taurus; identical to SEQ ID NO: 14474

SEQ ID NO: 55296 - DNA, 201 bp, Bos taurus; identical to SEQ ID NO: 14475

SEQ ID NO: 55297 - DNA, 201 bp, Bos taurus
tgttattttcagttactaagtttggggtaatttgggtagcagtggaaagttagtgtatttacattctgatattacactatgaaaatgatatttattggctttgagtactttcctatcaggtatcatagctatgcagatgtttcacaatataatttatcattttccacttaagccactgaagcactcattcactatctcagt

SEQ ID NO: 55298 - DNA, 201 bp, Bos taurus; identical to SEQ ID NO: 14478

SEQ ID NO: 55299 - DNA, 201 bp, Bos taurus; identical to SEQ ID NO: 14479

SEQ ID NO: 55300 - DNA, 201 bp, Bos taurus; identical to SEQ ID NO: 14481

SEQ ID NO: 55301 - DNA, 201 bp, Bos taurus; identical to SEQ ID NO: 14482

SEQ ID NO: 55302 - DNA, 201 bp, Bos taurus; identical to SEQ ID NO: 14483

SEQ ID NO: 55303 - DNA, 201 bp, Bos taurus
attaaatgcctatgtgactaactagatacagagcacagcattagaggaaagggaggagcttacagtctaacacaattggcaagaatatgcataggcagccgtggcccatggctggttgactctctcaatatggctgcaaactcattaaacacactaggagggatttggtttatactaaacaaagtgaacacatttccactg

SEQ ID NO: 55304 - DNA, 201 bp, Bos taurus; identical to SEQ ID NO: 14484

SEQ ID NO: 55305 - DNA, 201 bp, Bos taurus; identical to SEQ ID NO: 14485

SEQ ID NO: 55306 - DNA, 201 bp, Bos taurus; identical to SEQ ID NO: 14486

SEQ ID NO: 55307 - DNA, 201 bp, Bos taurus; identical to SEQ ID NO: 14487

SEQ ID NO: 55308 - DNA, 201 bp, Bos taurus; identical to SEQ ID NO: 14488

SEQ ID NO: 55309 - DNA, 201 bp, Bos taurus
ggccacatggctaagaaatggtgcggccaggaggcaagtatacacagtctagctcaagagttattaaccatcgtgttttattctcccctaaaagggacacgggcctaagaaagagctgtttaagctcatgtgatgtcttttgtgatgcctggagcatacataaagaatgtatgaatggatcaattaatgaaggtatacata

SEQ ID NO: 55310 - DNA, 201 bp, Bos taurus; identical to SEQ ID NO: 14489

SEQ ID NO: 55311 - DNA, 201 bp, Bos taurus
ttttgttttgctttccaccatcagttttaagaaaaggagatgcttgattcctccaccagtctgggctgtggctggatcttattcatttcaataccatcctttctgggccagcgttgattggaatgatggtggaataaatgatgagtgactccgtctgccccaaatgtgatttcccttagcaccactctctggaatagggga

SEQ ID NO: 55312 - DNA, 201 bp, Bos taurus
ctaaccctttcccctcccatccctcaaatccaggatccctcttgccatagagcccttgttcttaacagctcattccaccttggccggatatttgtgtcccctccctcgtcaccaagctctcccctcctcagcctccagttctcagctgcagcaacatgtcctcagggaggcattccctggccctccctctgtccccgacat

SEQ ID NO: 55313 - DNA, 201 bp, Bos taurus
atattttctaaacatatatgactcacatactacagtaatgtaaaattttacagaggtgagatcattctatacatcttagtttgaaatgtatttacttacatattttagatactgatctatctcattatttttttataaccattgtgtattcaatggtatgaatgtacctcaattaatttcaccaatcccctattaataaac

SEQ ID NO: 55314 - DNA, 201 bp, Bos taurus; identical to SEQ ID NO: 14490

SEQ ID NO: 55315 - DNA, 201 bp, Bos taurus; identical to SEQ ID NO: 14491

SEQ ID NO: 55316 - DNA, 201 bp, Bos taurus; identical to SEQ ID NO: 14492

SEQ ID NO: 55317 - DNA, 201 bp, Bos taurus
agtgcacgaaaacagggtgctaaatagactgtataaaaggcgcttatttatagtatgagagctgaagcaagaaggcagcgtgtctccacgctcagcctcctctgtgaacatttacattgagcaactaaaatttttcatcgctctgtgcagacacgtgtccaaatgactgtggaaggactgaggttgttgattttggtttta

SEQ ID NO: 55318 - DNA, 201 bp, Bos taurus
tgggaactgggtctcaaagatcctgtaaaaactgcaaattcaatgactctgcacatgattactaagttatggtctctggaggtgggccctgagaatctggttggttcttacacacaattattccttctaagtgatgcttccaagaaggctaaggagccagagttagttccaggattccgaatggctattttgtagcaaacc

SEQ ID NO: 55319 - DNA, 201 bp, Bos taurus; identical to SEQ ID NO: 14493

SEQ ID NO: 55320 - DNA, 201 bp, Bos taurus; identical to SEQ ID NO: 14494

SEQ ID NO: 55321 - DNA, 201 bp, Bos taurus
ttaaaaagtatgaaaatattgaccagaaaaaaattttcacatacttttaaaacaggatattgttaacttggtaaatatttgtcactgttcaataatatgattcctcaaagcgaacactacttatagtctccactatcactagaaagatggtgaagtctatgatttgttggtacagatagcctttgaaacaactctattttg

SEQ ID NO: 55322 - DNA, 201 bp, Bos taurus; identical to SEQ ID NO: 14495

SEQ ID NO: 55323 - DNA, 201 bp, Bos taurus
tgccagaagtgaccaggttacatcatcaatcttatttatcatttagaagatatttactgcaattctactctgcatagggcttcatggcagatgtacttcccttggcctttatacaaccctgtaagagcatttcaggactcacaaatgggcaattaaacctacagcctcttcctgagagttctgccctctatttgatatgca

SEQ ID NO: 55324 - DNA, 201 bp, Bos taurus
cagtgtccaagagttcgagggtccatagggatcttgggaggtcacttagtccattcctctgtctctaggaaggactcacctttccccattaaattggaccaccataggacaaattcattctcttttagaaaatactgggaagcagatttttctgtggatcaacacatgaaaacttctccactcttatgcatttacctttgg

SEQ ID NO: 55325 - DNA, 201 bp, Bos taurus
tggcatgctgcattccatggggttgcaaagagtcagatgcaactgagtgactgaacaacaaccaaagtgcacccttttgagatgctccacaggatataattggccacatgacatagtcaaaaggtaactccttcaggctgatccaccttcccagaacccagcatggtatataatggattgtctatgatatgggaaagattt

SEQ ID NO: 55326 - DNA, 201 bp, Bos taurus; identical to SEQ ID NO: 14496

SEQ ID NO: 55327 - DNA, 201 bp, Bos taurus; identical to SEQ ID NO: 14497

SEQ ID NO: 55328 - DNA, 201 bp, Bos taurus
tgaggccatgaagtatattagctacagactatattaactgatcatttgacatttattaagtaacttcttatgtattggtggtggtcacagagagctatagttgctgtgttctaaccataccatcctacactcagctccagaatatgccctgtaactttgtttatatcctctgtcccttgcacatctgtgtttctcttgggc

SEQ ID NO: 55329 - DNA, 201 bp, Bos taurus; identical to SEQ ID NO: 14498

SEQ ID NO: 55330 - DNA, 201 bp, Bos taurus; identical to SEQ ID NO: 14499

SEQ ID NO: 55331 - DNA, 201 bp, Bos taurus; identical to SEQ ID NO: 14500

SEQ ID NO: 55332 - DNA, 201 bp, Bos taurus; identical to SEQ ID NO: 14503

SEQ ID NO: 55333 - DNA, 201 bp, Bos taurus; identical to SEQ ID NO: 14504

SEQ ID NO: 55334 - DNA, 201 bp, Bos taurus
gacagcagaaaatcactaactggtctgggaattaagttaggactccatagttcttgccacatacatctcagtctgggcatctgatggagattttaaatatctaagtatttaaaactagtctacttctgaaatgtgtgattaagtgcttgatttgtattcacttaatacttttgagtgtgctgcatgtcaaggactcttcta

SEQ ID NO: 55335 - DNA, 201 bp, Bos taurus; identical to SEQ ID NO: 14505

SEQ ID NO: 55336 - DNA, 201 bp, Bos taurus; identical to SEQ ID NO: 14506

SEQ ID NO: 55337 - DNA, 201 bp, Bos taurus; identical to SEQ ID NO: 14507

SEQ ID NO: 55338 - DNA, 201 bp, Bos taurus
caactcagctgcatgagggccagtgactttctgtttatttgtttattgcctgctctgcatcttcattgctgcgaggggactttctctagttgtgacaactgggggccactctccagttgcattatggtggcttcttttgttgtggagcactgactctagggcacaggcttcagtatttgcagaacatgggctttgttgccc

SEQ ID NO: 55339 - DNA, 201 bp, Bos taurus
cctggagtatcccatggacaaaggaacctggtgggctacagtccatagggttgcaaagagttgggcatgatgtaatcctagtaggcctcttggaggaagtgatgtttgagttgcaatattgagccaagctaggcacatggatattggggaaagagagttccctgcagagagaatggcaagtgtcaagggcctcaggcagga

SEQ ID NO: 55340 - DNA, 201 bp, Bos taurus; identical to SEQ ID NO: 14508

SEQ ID NO: 55341 - DNA, 201 bp, Bos taurus
aagtggaatctgatggcctcaatttttgaagcctttcattgattctaatttgacaggacttacttggcttttggtgacctggccctggccacctgctcattgaaagtctttatttcctgcttgcagcagagttggaggggctgatagtaggtggtggcggttggtcgtcagtgagaagtggctgaagcccttagaccaagc

SEQ ID NO: 55342 - DNA, 201 bp, Bos taurus; identical to SEQ ID NO: 14509

SEQ ID NO: 55343 - DNA, 201 bp, Bos taurus; identical to SEQ ID NO: 14510

SEQ ID NO: 55344 - DNA, 201 bp, Bos taurus
agtagaaaacctttgttttttgtctgacaatagatgagaaagaagtgcacacctctgtctcctggaacacagatacacatgcgagcacacacacacagacacacacaacactccctttccacacaacaacgaataaggcatggtttgtagagtcttcccacagttggcatggttgtaaatatactacatgttgaagggtta

SEQ ID NO: 55345 - DNA, 201 bp, Bos taurus
acagtggttcagtgtttgagattcttttttcctatcacaaacagtgttaaggttaatacctctgtaaccaaacctttgaacacgtgcctccctggttttgtacagttttggtgtcatttcttgtgagagataatcaacatacagaaaagcacagaaaacatttttacagttagttgagtccacgcaaaaaggaacagcagt

SEQ ID NO: 55346 - DNA, 201 bp, Bos taurus
aataagccaaaatattttttcataacctaagattgggcagtatatcctcaagtttccaaaatcagctgaactctatgcagctaatttgcctttacattttctttgaagcttatgtcaattatagcttatgtggtatggatggcaccagccatgtaatttgtgaagcttgccgcaaaataaaaatgtaggcctccttattca

SEQ ID NO: 55347 - DNA, 201 bp, Bos taurus; identical to SEQ ID NO: 14512

SEQ ID NO: 55348 - DNA, 201 bp, Bos taurus; identical to SEQ ID NO: 14513

SEQ ID NO: 55349 - DNA, 201 bp, Bos taurus; identical to SEQ ID NO: 14514

SEQ ID NO: 55350 - DNA, 201 bp, Bos taurus; identical to SEQ ID NO: 14515

SEQ ID NO: 55351 - DNA, 201 bp, Bos taurus
agttggggagaagatagagatactaagagccttgcttttgtttgactgtctcttgacagttcccgatatagtgttacgttttatcctcatggcaacccgatggttgatagggccgcaaggatcgtcatcacctccattccacaggctaggaaattgagactctgcaggcttttgacttgattgttgtaactagtattcaga

SEQ ID NO: 55352 - DNA, 201 bp, Bos taurus; identical to SEQ ID NO: 14517

SEQ ID NO: 55353 - DNA, 201 bp, Bos taurus
tcgagctgtttaaccaccaggtccctgctggccgtcggtggagggctgcttccaggagcatgaactctctggccctctgtgtcaccctgaatttgggccacgctgacaacctggcagaactagaaatgctctcagtaagtagccctgtgcatggagaagtgggtatggaccgaacggaggcagggcccttagcatctgtga

SEQ ID NO: 55354 - DNA, 201 bp, Bos taurus; identical to SEQ ID NO: 14518

SEQ ID NO: 55355 - DNA, 201 bp, Bos taurus
tgcaaatcaaaatcatgtaaccaaacactaacatgctgcaaggatacattcttgcttaaggacatgtatccattatagggcagaaggaagaaaatagagggttcaaagaaagcctttctttcatgactttcttctattaaaatagttccatcaactattcactatctcctttttttttagaagtcaattaaataaatcaag

SEQ ID NO: 55356 - DNA, 201 bp, Bos taurus
agccaaacaaggtaattaattaatcacacaggatgtcctgctcctaggcagccgtatttctatcttccttgtgccaatggcctccaaccaggcaggcctacagtgttccttttttcagctacaaagttttcattccttttgcctgcctttcagtttctaccacatgcaaatgatggtggccaactcctttgcagagcaagc

SEQ ID NO: 55357 - DNA, 201 bp, Bos taurus; identical to SEQ ID NO: 14519

SEQ ID NO: 55358 - DNA, 201 bp, Bos taurus; identical to SEQ ID NO: 14520

SEQ ID NO: 55359 - DNA, 201 bp, Bos taurus; identical to SEQ ID NO: 14521

SEQ ID NO: 55360 - DNA, 201 bp, Bos taurus
tgtaaagataatgagaataatgttaaggccaatggtgctaaaaaaaagaaaaagagaaaagaaatcacaaacgcttgaattcatttatatgataaattctcctcttttccaggccacatcccacctgggagaacactggctcatgtttggcttgctaagtggtagccatgtttccctttcatgttgataatgaaaatagaa

SEQ ID NO: 55361 - DNA, 201 bp, Bos taurus
tttcactttagcatgaaaggatggcttcagggatctcatgatatcatgaactgtgggccacctcaagaagggctttaagtatcataaagggataaaattttggaggtttagaagtatgatctgggttcagcccactgccttttccctcagcatgcctccccagtcccctgctgtggcagacagcagatggctttattgaac

SEQ ID NO: 55362 - DNA, 201 bp, Bos taurus; identical to SEQ ID NO: 14522

SEQ ID NO: 55363 - DNA, 201 bp, Bos taurus; identical to SEQ ID NO: 14523

SEQ ID NO: 55364 - DNA, 201 bp, Bos taurus; identical to SEQ ID NO: 14524

SEQ ID NO: 55365 - DNA, 201 bp, Bos taurus
gctggggagaggatatgactaatagtcatttgatgagtttatttattggggtcttcagccatcaggatgccgtctttgtctctggggcctcagagaattcctggcagtttttaaacttgaaagtgaaagttgctcagtcttgtctgactctttgcgaccccatggactatataatccatgggattcttcaggccagagtac

SEQ ID NO: 55366 - DNA, 201 bp, Bos taurus; identical to SEQ ID NO: 14525

SEQ ID NO: 55367 - DNA, 201 bp, Bos taurus; identical to SEQ ID NO: 14526

SEQ ID NO: 55368 - DNA, 201 bp, Bos taurus
cttgaaggggttgcccagggaggtggggggaagagagggaggaagagaaagcagagtgtcagtcactgggattgggaaccaggccctggatgcgaccccccaaaggcttccactcatcttcacctttattctcagagtctcccaaaggctggtgccaaagctgacaacaggccatctgtggctgaccatcaccgctcttca

SEQ ID NO: 55369 - DNA, 201 bp, Bos taurus
aactaaagagttcacactaagactagtgcagccaaataaatagatacgtttttttttctttttaagcgagagaaaaaaatgattccagaggcctcatcgtgggctcccgccctgtgcctttacatacagtctcaggcgctggggcgtgacagcactgcttaagccctgaaaaagccaagggttcgggccacgttccttgta

SEQ ID NO: 55370 - DNA, 201 bp, Bos taurus; identical to SEQ ID NO: 14527

SEQ ID NO: 55371 - DNA, 201 bp, Bos taurus; identical to SEQ ID NO: 14528

SEQ ID NO: 55372 - DNA, 201 bp, Bos taurus; identical to SEQ ID NO: 14529

SEQ ID NO: 55373 - DNA, 201 bp, Bos taurus; identical to SEQ ID NO: 14530

SEQ ID NO: 55374 - DNA, 201 bp, Bos taurus
gacattaactgtggtaacaagctattagatcatcaactctgtgcttcttccagggcgggcaaagtatctaaaataacacagttatcatgactgcctcctcgaaggtaaatacattaactctcactcccaattaacaaaggggctctttacacacttaagctaaatccctctgtgctgtataaaatacttgaggtatccaat

SEQ ID NO: 55375 - DNA, 201 bp, Bos taurus
cagggcggggctggttgcgctactggcctctggggagtggcagccacggatgagctgcacactctgcagggtaagagcagcccccacaaaccaagaataatgggggccaaatgttattggtgctgaggttaaactccttgacatagagggatacttgaactgggtctaaccagaggaatactcacatacaatgtaaaatat

SEQ ID NO: 55376 - DNA, 201 bp, Bos taurus
actaatggcaccctgctcaaaggaagagtgctgtcctaacacatggaactagggggaagggggggacagagacactggttccaggagggaaagaggccaacaataatggggacagagcaactaaatgataccttgggagcagcagattttcatgcagtttcaagaagcagctcgttttcctcccagggaatggccatcaga

SEQ ID NO: 55377 - DNA, 201 bp, Bos taurus; identical to SEQ ID NO: 14533

SEQ ID NO: 55378 - DNA, 201 bp, Bos taurus
tctaacagacacatcaatggcattacaaaggcagaagacatctgatactccagtttctctatttcagggtacagatgctcatatttaagggaaaaaattttggccataccctgtggcatgggagattttagttttccaaggatccaacccatattccctgcaatggaagtgcaggataaccactgggctgccagggagtcc

SEQ ID NO: 55379 - DNA, 201 bp, Bos taurus; identical to SEQ ID NO: 14534

SEQ ID NO: 55380 - DNA, 201 bp, Bos taurus; identical to SEQ ID NO: 14535

SEQ ID NO: 55381 - DNA, 201 bp, Bos taurus; identical to SEQ ID NO: 14536

SEQ ID NO: 55382 - DNA, 201 bp, Bos taurus; identical to SEQ ID NO: 14537

SEQ ID NO: 55383 - DNA, 201 bp, Bos taurus; identical to SEQ ID NO: 14538

SEQ ID NO: 55384 - DNA, 201 bp, Bos taurus
ataaattattaaaccactctgtgcctcattttcctcatctgtaaaaatgaggattatgacagtattcatgttcaccttgcagaactgttgtgaagatgaatagattccatgtaatacccttggcaacatacgggtggtgctcctttgtcctattcttggaaacttgcacaccaagctaaagtcatttttattatttgtttt

SEQ ID NO: 55385 - DNA, 201 bp, Bos taurus; identical to SEQ ID NO: 14539

SEQ ID NO: 55386 - DNA, 201 bp, Bos taurus
aatctacaactatagcaactgagagctagctaaagttctgaatatccagagtcagattattttaaaattcttgactaggagttgactttctgagcaatgatatcatagtagatcttaagaactaagaaagacgctaaatctttgcagatcttcatgtaagtgtcagacattttcctctataagagaagaccttctaagttc

SEQ ID NO: 55387 - DNA, 201 bp, Bos taurus; identical to SEQ ID NO: 14540

SEQ ID NO: 55388 - DNA, 201 bp, Bos taurus; identical to SEQ ID NO: 14541

SEQ ID NO: 55389 - DNA, 201 bp, Bos taurus; identical to SEQ ID NO: 14542

SEQ ID NO: 55390 - DNA, 201 bp, Bos taurus; identical to SEQ ID NO: 14544

SEQ ID NO: 55391 - DNA, 201 bp, Bos taurus
agtctggaaagttgatgtcctcctcctcctcttggcctctcctcagttctcccagttactttcagtggcagcaccctgttccttaccaggatctcctgctgttagacacctcaggcaagtgggcctggccaaggtgggtggtttctatcaatagttccctaacacagccgccctccacctcccatggttcaggcagtaatg

SEQ ID NO: 55392 - DNA, 201 bp, Bos taurus; identical to SEQ ID NO: 14545

SEQ ID NO: 55393 - DNA, 201 bp, Bos taurus; identical to SEQ ID NO: 14546

SEQ ID NO: 55394 - DNA, 201 bp, Bos taurus
aagctccaggagatagtgatggacagggaggcctggcgtgctgcagtccacggggttgcaaagagtcagacataactgagtgaacagcaacacagattttgccaagggcatcacctcctatagtaagagagagagacccggtgtcgttctctttagagacaaaggggaaaggaaacgttcctttcaggaaacctgatcatg

SEQ ID NO: 55395 - DNA, 201 bp, Bos taurus
atctatatagaatacagatgcaaatttaggctcagaggggttagagaacttgctcaaggtcacaaagttaatagtaggtggatttgggatccactcaggcctgattcccaaaacctatgtatgctctgtggagaaaaactgaaaaccaaggacttgcagcaaatgtaataaataccacttccaatttctttcctgtattgg

SEQ ID NO: 55396 - DNA, 201 bp, Bos taurus
tggacagctttggaatacactcagggtcctccctagggggggcacgccttttctcccctgtgtcctcactccaggcccagtgagattgtgtgaagaagcccgggcttgtggacaggggagggcagagtccgcggaggacactcccgcggctggccggctgctcaggggaaaggttcagacgctttttgaccgggcactgtt

SEQ ID NO: 55397 - DNA, 201 bp, Bos taurus
gaaatccagcactccggccgaggcatctcggcagcactgcatggttcttaattgtactttcttttcacaatgtgtaaagatgtttgttttcagatcctcacctctcaaggcaaaacagaacttcaaagatttcaaacttcaaagaacacaagaaaattaacgtgatatttgggagctgtaacctgtgtttcctcttgccaa

SEQ ID NO: 55398 - DNA, 201 bp, Bos taurus; identical to SEQ ID NO: 14547

SEQ ID NO: 55399 - DNA, 201 bp, Bos taurus; identical to SEQ ID NO: 14549

SEQ ID NO: 55400 - DNA, 201 bp, Bos taurus; identical to SEQ ID NO: 14550

SEQ ID NO: 55401 - DNA, 201 bp, Bos taurus; identical to SEQ ID NO: 14551

SEQ ID NO: 55402 - DNA, 201 bp, Bos taurus
gaatgacaacacaggctagaaaacacgtccacgtttcaagtgagccgattgtgaaactaggagaatgcctctgttatctgtaaacacccacactggccttcggtatctacatatgctctttattttcacactcatacactgactccctgagacgagatctacccagcacagaccccgccaggcacagcactgcatgccagg

SEQ ID NO: 55403 - DNA, 201 bp, Bos taurus; identical to SEQ ID NO: 14554

SEQ ID NO: 55404 - DNA, 201 bp, Bos taurus
gttgtcatgtccattttatagaggaggaaactcaggcccagacaagttaaacaacttgcccattgtcgcacagctggtgagtaatggaggtagtgcctcttgcatgagacagtaggctcagggcccagggccacaatacctttagaagccacaggaatgttgtaatttgtttcagaataaggaggaaaagaaattcaaaat

SEQ ID NO: 55405 - DNA, 201 bp, Bos taurus; identical to SEQ ID NO: 14555

SEQ ID NO: 55406 - DNA, 201 bp, Bos taurus
aaaattttatggggcattcattctctgtataatatagtttctttatcatttatttaaagttgatttttcatattctacctttccagtcaggaggataatacatgtaattctgtatatcccattatctgatgatgtatgtcacttggtctccttcaatttacacttttacaatatttgaaataatttctctattcttctccc

SEQ ID NO: 55407 - DNA, 201 bp, Bos taurus
gtgccaaaagaaataacattttaaatgatgaagaaatttgtcttaatttccttaaagttggaataaaagatatgtaaattttcaaagaagcctgtaagaactgatgttgctgaaataatactgtactaacacttagtctcagttttcctcttagctttctacagtattttctaaagtgtcctacacagcaagatggggaag

SEQ ID NO: 55408 - DNA, 201 bp, Bos taurus; identical to SEQ ID NO: 14556

SEQ ID NO: 55409 - DNA, 201 bp, Bos taurus; identical to SEQ ID NO: 14557

SEQ ID NO: 55410 - DNA, 201 bp, Bos taurus; identical to SEQ ID NO: 14558

SEQ ID NO: 55411 - DNA, 201 bp, Bos taurus; identical to SEQ ID NO: 14559

SEQ ID NO: 55412 - DNA, 201 bp, Bos taurus; identical to SEQ ID NO: 14560

SEQ ID NO: 55413 - DNA, 201 bp, Bos taurus; identical to SEQ ID NO: 14561

SEQ ID NO: 55414 - DNA, 201 bp, Bos taurus
tgtaccctctgtgtgttctgtcctcaccgacctccctgtaatgtcctctgcctggaaaaaccttccttcaatctgcctgtccatctctctttaagtcctttaagttttagcttaagagttacttcctctataagccctttctgaatttcccagatgcacttagatgtttctttcttaatgttctctttgttctttgtacac

SEQ ID NO: 55415 - DNA, 201 bp, Bos taurus
gacacagggatgagaatttggagatggtcttaatagggaaaatttccacagtagttgtaagtattgtcatacacaattatggaacacagtctcctacttgctctaatcgagtatttagttatctgtggacagaaaaataaaatctgagagaatatgacctgattactatatttccctggtaatttcttcagttaagaagat

SEQ ID NO: 55416 - DNA, 201 bp, Bos taurus; identical to SEQ ID NO: 14564

SEQ ID NO: 55417 - DNA, 201 bp, Bos taurus; identical to SEQ ID NO: 14565

SEQ ID NO: 55418 - DNA, 201 bp, Bos taurus
gtctggacttggggttattttgatggatcataatgcctttgaggttcatccgtgctttggtgggtgttagtctgttgaaaatcaatagtgttccattgcacggatgaactgcagtcatttgcccgttcacctgttgaagttgtccagtcactatcacagtggataccccttcagagggatcttgcctgaatgactgtgggg

SEQ ID NO: 55419 - DNA, 201 bp, Bos taurus
caccttctcctagtgaagaagaggttgtcatcttaagaattttatttggtgatgctgggatccagttttggttgaatagtggatggcagcaggcacataggttcttctttcaacttgcattagggaagcaggagagcaagccaggttgatggtgggagggagggggcaggaagagagctagttggaggaggcctttgaact

SEQ ID NO: 55420 - DNA, 201 bp, Bos taurus; identical to SEQ ID NO: 14566

SEQ ID NO: 55421 - DNA, 201 bp, Bos taurus; identical to SEQ ID NO: 14567

SEQ ID NO: 55422 - DNA, 201 bp, Bos taurus; identical to SEQ ID NO: 14568

SEQ ID NO: 55423 - DNA, 201 bp, Bos taurus; identical to SEQ ID NO: 14570

SEQ ID NO: 55424 - DNA, 201 bp, Bos taurus
tgatgtcggaaactgggaaggcccttttgggagcttgctttctcagaataagtcctcaggaccatggaaaacatttgggcctttctttctgtgaaaacagtgttgcttcacccttacatgatggatttagccctcagcccttgtagggttacaagagaatcagggcaaccttcagggctggcctcctggggccccggctcc

SEQ ID NO: 55425 - DNA, 201 bp, Bos taurus; identical to SEQ ID NO: 14571

SEQ ID NO: 55426 - DNA, 201 bp, Bos taurus; identical to SEQ ID NO: 14572

SEQ ID NO: 55427 - DNA, 201 bp, Bos taurus
cattctgttttgtaaattagtgaatggaggagaggatgaagtgaactgcctaaattcatccagtgagtatgtggcagggccaaaatttgaacttggactatctggttcccacacatatatatttaactactgtatgaagtttggccagtgagagaaaggaagaaagatctctggggggcaggctgagataggcagcacacg

SEQ ID NO: 55428 - DNA, 201 bp, Bos taurus; identical to SEQ ID NO: 14574

SEQ ID NO: 55429 - DNA, 201 bp, Bos taurus
tctcctcctgtcctcaatctttcccagaatcagggtcttttcaaaatcctgttggacgctgattattcatcaggcctcgagccaggcccaggtgagccttcggaaagcactcagtcagaagctgtgtgtgaaggatcaccttctgccctccaattgcaggtcacaattcaccaggccagttaggagaacagggaaaagtca

SEQ ID NO: 55430 - DNA, 201 bp, Bos taurus
ttggaaccaaggactggggtaaaggcataggcctctagggttccaggtcccaaggtcaacgtgatgtgctatactttctgatgtcagaaagggccttctaaaataagatacacattgctactatcctgtctgctgtttcaccccaatgcaactgcccccagaacctcaggccatgttcctatttggaaatagggtctttgt

SEQ ID NO: 55431 - DNA, 201 bp, Bos taurus; identical to SEQ ID NO: 14576

SEQ ID NO: 55432 - DNA, 201 bp, Bos taurus
cgggaaaagagctaccacaatctacaacagctacaaagctattttataaactagaagcttcgagagtcccatctcttgctcctgatgtcagagggccaaacgttcattcctagatcaagattactttcactggattgttttttgaagggctagttccccttgaaagtatatttttttgttgttgtttttaatgagaagagt

SEQ ID NO: 55433 - DNA, 201 bp, Bos taurus
gctaagagcccaaaacaaaagctaaaattaatgttaaaggtgaagaaaatctcagaagcagtcccatccagtcgatcacaaacttgaaaaagaaaatctttgtctccttatagggctttcttatcctctttcctctgaacaatctttcttttgcctccagccaagaatttttttattaatccaaaacaaaactgtaatatt

SEQ ID NO: 55434 - DNA, 201 bp, Bos taurus; identical to SEQ ID NO: 14578

SEQ ID NO: 55435 - DNA, 201 bp, Bos taurus
ggccagaacatcaaaatagaatgagaggatgagctacccagcagggaaaagaaaaagccaaaatgagcacgacctgtcctgcagggagcttcacccgagttccaatgggccccctccttgctgtgatgcccggctatcatcatcttgaaattcttcataactttttaacaaatggaactacattttgctttcccactgggt

SEQ ID NO: 55436 - DNA, 201 bp, Bos taurus
tttgagtaagctccaggagttggtgatggacagggaggcctggcctgctgcagttcatggggtcgcaaagagtcggacacgactgagtgactaaactgaactaaggagtaaaaacaggccccataaaaagggtctggagtccaaatggtcttcaacttcttaacaacaactatggaagctggaagacaagttttctgaaga

SEQ ID NO: 55437 - DNA, 201 bp, Bos taurus; identical to SEQ ID NO: 14581

SEQ ID NO: 55438 - DNA, 201 bp, Bos taurus; identical to SEQ ID NO: 14582

SEQ ID NO: 55439 - DNA, 201 bp, Bos taurus
gtccatttatggttgtgggacagtacctaagatgtctgggagtcttgctgctgacagttgctagcagatcagactgcctcctggcccaaggtgtgaaacatggattgtgactccacactgggtctctgttgggcttcccttctcctgatcctttggccacagaaggcaggcttttcttggttcttctgtctatggctgctg

SEQ ID NO: 55440 - DNA, 201 bp, Bos taurus; identical to SEQ ID NO: 14584

SEQ ID NO: 55441 - DNA, 201 bp, Bos taurus; identical to SEQ ID NO: 14585

SEQ ID NO: 55442 - DNA, 201 bp, Bos taurus; identical to SEQ ID NO: 14586

SEQ ID NO: 55443 - DNA, 201 bp, Bos taurus; identical to SEQ ID NO: 14587

SEQ ID NO: 55444 - DNA, 201 bp, Bos taurus; identical to SEQ ID NO: 14591

SEQ ID NO: 55445 - DNA, 201 bp, Bos taurus; identical to SEQ ID NO: 14592

SEQ ID NO: 55446 - DNA, 201 bp, Bos taurus; identical to SEQ ID NO: 14594

SEQ ID NO: 55447 - DNA, 201 bp, Bos taurus; identical to SEQ ID NO: 14595

SEQ ID NO: 55448 - DNA, 201 bp, Bos taurus; identical to SEQ ID NO: 14596

SEQ ID NO: 55449 - DNA, 201 bp, Bos taurus; identical to SEQ ID NO: 14597

SEQ ID NO: 55450 - DNA, 201 bp, Bos taurus
tgatacgtccctcccttgtcctcaggaggagtgctggcatctccatgactacctactgggcaccctgggtccctatgtgatcaacgtgaccagggcagccgtggcctgcagtcaccagcggtgccatggccatggccgttgtgcttggcaaaacccaggacaactagaagtctttctgcatctgcagccagatggcagccc

SEQ ID NO: 55451 - DNA, 201 bp, Bos taurus
gtcacagagtcagacacagctgagcgcacacacaaaggataccagtgtatgtataactgaatcatgtcgctggacgccttgaccaacgctacgtgatcaatcaagcatatgccaaaatacaagtctaacaaaaagaaaataaatccctattgtattttttttcaggcttctggcaccttggcctgtgtcacagccctggag

SEQ ID NO: 55452 - DNA, 201 bp, Bos taurus; identical to SEQ ID NO: 14598

SEQ ID NO: 55453 - DNA, 201 bp, Bos taurus; identical to SEQ ID NO: 14599

SEQ ID NO: 55454 - DNA, 201 bp, Bos taurus; identical to SEQ ID NO: 14603

SEQ ID NO: 55455 - DNA, 201 bp, Bos taurus; identical to SEQ ID NO: 14605

SEQ ID NO: 55456 - DNA, 201 bp, Bos taurus; identical to SEQ ID NO: 14606

SEQ ID NO: 55457 - DNA, 201 bp, Bos taurus; identical to SEQ ID NO: 14607

SEQ ID NO: 55458 - DNA, 201 bp, Bos taurus; identical to SEQ ID NO: 14608

SEQ ID NO: 55459 - DNA, 201 bp, Bos taurus; identical to SEQ ID NO: 14609

SEQ ID NO: 55460 - DNA, 201 bp, Bos taurus; identical to SEQ ID NO: 14610

SEQ ID NO: 55461 - DNA, 201 bp, Bos taurus; identical to SEQ ID NO: 14611

SEQ ID NO: 55462 - DNA, 201 bp, Bos taurus; identical to SEQ ID NO: 14612

SEQ ID NO: 55463 - DNA, 201 bp, Bos taurus; identical to SEQ ID NO: 14613

SEQ ID NO: 55464 - DNA, 201 bp, Bos taurus; identical to SEQ ID NO: 14614

SEQ ID NO: 55465 - DNA, 201 bp, Bos taurus; identical to SEQ ID NO: 14617

SEQ ID NO: 55466 - DNA, 201 bp, Bos taurus; identical to SEQ ID NO: 14618

SEQ ID NO: 55467 - DNA, 201 bp, Bos taurus; identical to SEQ ID NO: 14619

SEQ ID NO: 55468 - DNA, 201 bp, Bos taurus; identical to SEQ ID NO: 14620

SEQ ID NO: 55469 - DNA, 201 bp, Bos taurus; identical to SEQ ID NO: 14622

SEQ ID NO: 55470 - DNA, 201 bp, Bos taurus; identical to SEQ ID NO: 14623

SEQ ID NO: 55471 - DNA, 201 bp, Bos taurus; identical to SEQ ID NO: 14627

SEQ ID NO: 55472 - DNA, 201 bp, Bos taurus; identical to SEQ ID NO: 14629

SEQ ID NO: 55473 - DNA, 201 bp, Bos taurus; identical to SEQ ID NO: 14630

SEQ ID NO: 55474 - DNA, 201 bp, Bos taurus; identical to SEQ ID NO: 14631

SEQ ID NO: 55475 - DNA, 201 bp, Bos taurus; identical to SEQ ID NO: 14632

SEQ ID NO: 55476 - DNA, 201 bp, Bos taurus; identical to SEQ ID NO: 14633

SEQ ID NO: 55477 - DNA, 201 bp, Bos taurus; identical to SEQ ID NO: 14634

SEQ ID NO: 55478 - DNA, 201 bp, Bos taurus; identical to SEQ ID NO: 14635

SEQ ID NO: 55479 - DNA, 201 bp, Bos taurus
actccttttggatgtgaatgtgggaaattaactatttccaggccggaagatggctgatcttcctgccgttggtgagactttccccttggtttgccagtccgtgaacagacctggccaaggccacgccaaagagatttagggtggctacaccagttcttcctccacagcctgcaggctgtgcagccccaggtccactggatt

SEQ ID NO: 55480 - DNA, 201 bp, Bos taurus
ttttggggtgaggttcacgaaatcagcccggggtggggagagatttcgtctagctgtgtgatctttcagaaaagtaagtggaacatgctgcctcttttcagttctgtcagtgcttccacatggaaaccaaacgcaataaaatttttccaaaacctgttctggctgagccccctgtctctcacggagtcaccccttgggtag

SEQ ID NO: 55481 - DNA, 201 bp, Bos taurus
aggccagggagggcttaagggactcccttagtttttaactgctgcctctttagctttcccaagagctagaactagtaaagaaaagtacgaaggtctgacaagtcaccaataaccagcttggccacaggtcaaggtacaatatttagaataatggtcaataataaaataatacaaacaacaatacccaaaagaaatagagta

SEQ ID NO: 55482 - DNA, 201 bp, Bos taurus; identical to SEQ ID NO: 14639

SEQ ID NO: 55483 - DNA, 201 bp, Bos taurus
cttgctttcacataattccactttctctttcatgttccttgagtcatgaactttccttgaaattttttatcctattcttcgagaaataggcattcttttcaacatgaattcttcgcttttgtgctccagcttcctgttttgctctatttcctgcctcctcctcttagcagggactttgaccctcaagaagcccctgctcct

SEQ ID NO: 55484 - DNA, 201 bp, Bos taurus
ggttatttactctttctctgtttctgctcattttgtcagactgggatcagacgaaaggtaaatagccgcagtatttgtgtcaatacatagttgttcagtcgcttcgtcgtgtccagctctttgcaaccccatggactgcagcactccaggctcccctgtccttcagtatctccctggagtttgctcagactcatgtccatc

SEQ ID NO: 55485 - DNA, 201 bp, Bos taurus; identical to SEQ ID NO: 14641

SEQ ID NO: 55486 - DNA, 201 bp, Bos taurus
gttaccaggggaggagccctgcgaggggtggatggtgggagggaaccacgggttagatacaagtcattgtcaaagtcttagtttttggttggtgagttcacgggttcactattaaaattaactacttaaaaaaaataactaagtgacagttgcacagcaacatagatgccactgcacttaaaatggttaaaatggcaaatt

SEQ ID NO: 55487 - DNA, 201 bp, Bos taurus
gaaaatgttctaaaattgattaatgatgatggttgtatcactatgtaaatttactaaaaatcactgaagtatattcctgcaataaataaatctcaggatacgtaaaatataccaccaacaaagttgtttataagggaaaagaacatactatgatagctgcgaagctggcctgaaagatgctttcaacaactgactctagat

SEQ ID NO: 55488 - DNA, 201 bp, Bos taurus; identical to SEQ ID NO: 14643

SEQ ID NO: 55489 - DNA, 201 bp, Bos taurus; identical to SEQ ID NO: 14644

SEQ ID NO: 55490 - DNA, 201 bp, Bos taurus; identical to SEQ ID NO: 14645

SEQ ID NO: 55491 - DNA, 201 bp, Bos taurus; identical to SEQ ID NO: 14646

SEQ ID NO: 55492 - DNA, 201 bp, Bos taurus; identical to SEQ ID NO: 14647

SEQ ID NO: 55493 - DNA, 201 bp, Bos taurus; identical to SEQ ID NO: 14648

SEQ ID NO: 55494 - DNA, 201 bp, Bos taurus; identical to SEQ ID NO: 14649

SEQ ID NO: 55495 - DNA, 201 bp, Bos taurus; identical to SEQ ID NO: 14650

SEQ ID NO: 55496 - DNA, 201 bp, Bos taurus; identical to SEQ ID NO: 14651

SEQ ID NO: 55497 - DNA, 201 bp, Bos taurus; identical to SEQ ID NO: 14652

SEQ ID NO: 55498 - DNA, 201 bp, Bos taurus; identical to SEQ ID NO: 14653

SEQ ID NO: 55499 - DNA, 201 bp, Bos taurus; identical to SEQ ID NO: 14654

SEQ ID NO: 55500 - DNA, 201 bp, Bos taurus; identical to SEQ ID NO: 14656

SEQ ID NO: 55501 - DNA, 201 bp, Bos taurus; identical to SEQ ID NO: 14659

SEQ ID NO: 55502 - DNA, 201 bp, Bos taurus; identical to SEQ ID NO: 14660

SEQ ID NO: 55503 - DNA, 201 bp, Bos taurus; identical to SEQ ID NO: 14661

SEQ ID NO: 55504 - DNA, 201 bp, Bos taurus; identical to SEQ ID NO: 14662

SEQ ID NO: 55505 - DNA, 201 bp, Bos taurus; identical to SEQ ID NO: 14663

SEQ ID NO: 55506 - DNA, 201 bp, Bos taurus; identical to SEQ ID NO: 14664

SEQ ID NO: 55507 - DNA, 201 bp, Bos taurus; identical to SEQ ID NO: 14665

SEQ ID NO: 55508 - DNA, 201 bp, Bos taurus; identical to SEQ ID NO: 14666

SEQ ID NO: 55509 - DNA, 201 bp, Bos taurus; identical to SEQ ID NO: 14667

SEQ ID NO: 55510 - DNA, 201 bp, Bos taurus; identical to SEQ ID NO: 14668

SEQ ID NO: 55511 - DNA, 201 bp, Bos taurus; identical to SEQ ID NO: 14669

SEQ ID NO: 55512 - DNA, 201 bp, Bos taurus; identical to SEQ ID NO: 14670

SEQ ID NO: 55513 - DNA, 201 bp, Bos taurus; identical to SEQ ID NO: 14671

SEQ ID NO: 55514 - DNA, 201 bp, Bos taurus; identical to SEQ ID NO: 14672

SEQ ID NO: 55515 - DNA, 201 bp, Bos taurus; identical to SEQ ID NO: 14673

SEQ ID NO: 55516 - DNA, 201 bp, Bos taurus; identical to SEQ ID NO: 14674

SEQ ID NO: 55517 - DNA, 201 bp, Bos taurus; identical to SEQ ID NO: 14675

SEQ ID NO: 55518 - DNA, 201 bp, Bos taurus; identical to SEQ ID NO: 14676

SEQ ID NO: 55519 - DNA, 201 bp, Bos taurus; identical to SEQ ID NO: 14677

SEQ ID NO: 55520 - DNA, 201 bp, Bos taurus; identical to SEQ ID NO: 14678

SEQ ID NO: 55521 - DNA, 201 bp, Bos taurus; identical to SEQ ID NO: 14679

SEQ ID NO: 55522 - DNA, 201 bp, Bos taurus; identical to SEQ ID NO: 14680

SEQ ID NO: 55523 - DNA, 201 bp, Bos taurus; identical to SEQ ID NO: 14682

SEQ ID NO: 55524 - DNA, 201 bp, Bos taurus; identical to SEQ ID NO: 14683

SEQ ID NO: 55525 - DNA, 201 bp, Bos taurus; identical to SEQ ID NO: 14685

SEQ ID NO: 55526 - DNA, 201 bp, Bos taurus; identical to SEQ ID NO: 14686

SEQ ID NO: 55527 - DNA, 201 bp, Bos taurus; identical to SEQ ID NO: 14687

SEQ ID NO: 55528 - DNA, 201 bp, Bos taurus
atgtgcatccctgtgctgaggagtgccttctcttctgcactttgcaaatgctcacatcacacggtttccatggcaaccggcatccctcagggaggggagcgtggaggggccctcagaaaggactcggggaaaggaccagcttggatccaggaggagggaaacgcccaggagggaggcagcacggcctagtcccgctgctgc

SEQ ID NO: 55529 - DNA, 201 bp, Bos taurus
aacacagaatgtaaagggaggcgtcctgactcacactcagtttggctttatcacagcacgtaagccgcatccaggcctttccccttaatctcacgacggtgctttccctaaaaagatcatgccgcgtgattttcccccgaatgcttcaccccagctgtgcaggcctctttcctgtttatcacggctgcactgaactttatt

SEQ ID NO: 55530 - DNA, 201 bp, Bos taurus; identical to SEQ ID NO: 14688

SEQ ID NO: 55531 - DNA, 201 bp, Bos taurus; identical to SEQ ID NO: 14689

SEQ ID NO: 55532 - DNA, 201 bp, Bos taurus; identical to SEQ ID NO: 14690

SEQ ID NO: 55533 - DNA, 201 bp, Bos taurus; identical to SEQ ID NO: 14691

SEQ ID NO: 55534 - DNA, 201 bp, Bos taurus; identical to SEQ ID NO: 14692

SEQ ID NO: 55535 - DNA, 201 bp, Bos taurus; identical to SEQ ID NO: 14693

SEQ ID NO: 55536 - DNA, 201 bp, Bos taurus
tccacaggctgcacagtccgttggatcgcaaagagtcggacacgaccgagtgactttcactttcacacagaagtccagctgtgagccccaaactgagacggacaaatcacgggaggaaggacacagtgtccagcctgggctgcaaagataactgcaggagaggggaagggccccaagggagactagggacggcgacccccg

SEQ ID NO: 55537 - DNA, 201 bp, Bos taurus
aatgaggcccatcagagctttcaaacgggctcagctgaattcccttttctgccaggaaagggacacaggctaccttccccaagcacaccccactctccgcggatggccacgtgctcacacaccaggaagctctccgcagcctttccttgtggctttcttgggggcccggttgagcaagtgacagcccacgtggaactgatg

SEQ ID NO: 55538 - DNA, 201 bp, Bos taurus; identical to SEQ ID NO: 14699

SEQ ID NO: 55539 - DNA, 201 bp, Bos taurus; identical to SEQ ID NO: 14702

SEQ ID NO: 55540 - DNA, 201 bp, Bos taurus
catgaaggctgggagaaaccttcattcacactggcccacagctctgttcccatgactccagctctacttcccaccaaggcagtgcctgtcagtacatcctggaagaacaagtggcctacgatcacctcagatccagctctcccaccaaagccatggggcacagcagaatgcattgggacactcccccacaaaagatgtacc

SEQ ID NO: 55541 - DNA, 201 bp, Bos taurus; identical to SEQ ID NO: 14703

SEQ ID NO: 55542 - DNA, 201 bp, Bos taurus
attcaatgatgagcttgttaaaaattcatctccttacttgctatttgacttccctcatcctacgagaggacttccatggtggttcagctgtaaagtacatgtttccaatgagggagacaccagactgatccttgagtctggaagatctcctgaagaaataaatggcaacccactccagtattcttgcctaggaaatctcat

SEQ ID NO: 55543 - DNA, 201 bp, Bos taurus; identical to SEQ ID NO: 14704

SEQ ID NO: 55544 - DNA, 201 bp, Bos taurus; identical to SEQ ID NO: 14708

SEQ ID NO: 55545 - DNA, 201 bp, Bos taurus; identical to SEQ ID NO: 14709

SEQ ID NO: 55546 - DNA, 201 bp, Bos taurus; identical to SEQ ID NO: 14710

SEQ ID NO: 55547 - DNA, 201 bp, Bos taurus; identical to SEQ ID NO: 14711

SEQ ID NO: 55548 - DNA, 201 bp, Bos taurus
tgtcattgctgtgaaggctttaggccccacatcaggcttcccagcccagggatccggcaaaagactgggaatccccagtgagcctgactgtgaaggccaatgtgatttgattacatgacctccacaggactaggggaaacagaaactccactctaggagggcacaaacagacctgctgtgcaccaggacccaggggaaagg

SEQ ID NO: 55549 - DNA, 201 bp, Bos taurus
ataaagttagaaaaatgaataataatttaatatcctgtcattctaattagtatgttgatgtctcagtaactttgctaacatgatccatgtaaaaatcaatcatctggttatttcattaatgcccttttctttaatagcataggcacatctggaatacactaaaatttataccaaaaaggaaagattaatcacttacactta

SEQ ID NO: 55550 - DNA, 201 bp, Bos taurus
gacatcatacagtggcattgtataggggcccgacagcgtacttccctctggtcaccagagctatatgctctgtggctgcccctactgagccctgttgtagcagggccaactatgtgagagagctggtaaggggctggcctctggcccagtaagctgtgagatcatgtcttgtgctgtcctggaaggtggggtgctggtgcc

SEQ ID NO: 55551 - DNA, 201 bp, Bos taurus; identical to SEQ ID NO: 14714

SEQ ID NO: 55552 - DNA, 201 bp, Bos taurus; identical to SEQ ID NO: 14718

SEQ ID NO: 55553 - DNA, 201 bp, Bos taurus; identical to SEQ ID NO: 14719

SEQ ID NO: 55554 - DNA, 201 bp, Bos taurus
tttaggtagagatgaggaagggaaaaaaacaatgtttattatggaattcattgtcttgtctaacgacttgttaaatagtaagagatgacttctaaagaaacaaggacagtgtagggaaattaacaagatagtgcccgtcaggctctcaccccagctctcatgccctcttgccccatattgtgtaaaaaatgactttgcatg

SEQ ID NO: 55555 - DNA, 201 bp, Bos taurus; identical to SEQ ID NO: 14720

SEQ ID NO: 55556 - DNA, 201 bp, Bos taurus; identical to SEQ ID NO: 14721

SEQ ID NO: 55557 - DNA, 201 bp, Bos taurus; identical to SEQ ID NO: 14723

SEQ ID NO: 55558 - DNA, 201 bp, Bos taurus
gctgtaggattcacttctaagatcatgcttgtggttgttgttagcagaccacgtttcctctatggctgttggctggatatttcagtttcttaacacatgaatttctctcaacaaagcagcttactttacccagagcaagaaatccaagagcaagaaagtgaatgcccaagatgaagctatgatcttttataatgtaatctt

SEQ ID NO: 55559 - DNA, 201 bp, Bos taurus
gtgataattttaaagagccatcctggttctagaacttgttatggggcagcctgaggtccctgctgtaactgcatcacagcccacttctctggcaacccagccccacctccttctttctccttgacagtgctgtcaactgaacacacttcccagtaactttctatagtgacacctcagtcttagactccatttctgggggaa

SEQ ID NO: 55560 - DNA, 201 bp, Bos taurus; identical to SEQ ID NO: 14725

SEQ ID NO: 55561 - DNA, 201 bp, Bos taurus; identical to SEQ ID NO: 14726

SEQ ID NO: 55562 - DNA, 201 bp, Bos taurus; identical to SEQ ID NO: 14727

SEQ ID NO: 55563 - DNA, 201 bp, Bos taurus; identical to SEQ ID NO: 14728

SEQ ID NO: 55564 - DNA, 201 bp, Bos taurus; identical to SEQ ID NO: 14730

SEQ ID NO: 55565 - DNA, 201 bp, Bos taurus; identical to SEQ ID NO: 14731

SEQ ID NO: 55566 - DNA, 201 bp, Bos taurus; identical to SEQ ID NO: 14732

SEQ ID NO: 55567 - DNA, 201 bp, Bos taurus; identical to SEQ ID NO: 14733

SEQ ID NO: 55568 - DNA, 201 bp, Bos taurus; identical to SEQ ID NO: 14734

SEQ ID NO: 55569 - DNA, 201 bp, Bos taurus; identical to SEQ ID NO: 14735

SEQ ID NO: 55570 - DNA, 201 bp, Bos taurus
atacattgtcaatagtagtaaaagaaagagcaatgattaacattttgcttctggtgattgataaagcacaaacttgtcctgttttatctcaggttctgcctttagtctgaaacaaaattggcatgtggctgtgaatttgaattaatggcagtgttccaatcttgaatattttgcacctctcacacaaaatattccagtgtc

SEQ ID NO: 55571 - DNA, 201 bp, Bos taurus; identical to SEQ ID NO: 14740

SEQ ID NO: 55572 - DNA, 201 bp, Bos taurus; identical to SEQ ID NO: 14741

SEQ ID NO: 55573 - DNA, 201 bp, Bos taurus; identical to SEQ ID NO: 14742

SEQ ID NO: 55574 - DNA, 201 bp, Bos taurus; identical to SEQ ID NO: 14743

SEQ ID NO: 55575 - DNA, 201 bp, Bos taurus; identical to SEQ ID NO: 14744

SEQ ID NO: 55576 - DNA, 201 bp, Bos taurus
tagcaagatatgggctgccgaagcctggagcgaggggcgcaaaaaggaactcctggaggaattaaagttgggcagaaagtgccacaggggtcaggacctgtgggcctacaggtgggagtattcccacaggggatatttttggacatagagtagggtgagagacttggcagcagaagaacccagagttccttcccctgtctg

SEQ ID NO: 55577 - DNA, 201 bp, Bos taurus
ttttcagtggccattccaacctgcctcactcttggtactttctgtccctcagaggatacacaagtagttacaaaactgcatgattcaattcttagtgaaagcatgtctttgggaaacttacctggcctactttcctaagtgggaaagagtctgaatgaacatttccaaatttattaagacaggtttctaaaacaaattctc

SEQ ID NO: 55578 - DNA, 201 bp, Bos taurus; identical to SEQ ID NO: 14746

SEQ ID NO: 55579 - DNA, 201 bp, Bos taurus; identical to SEQ ID NO: 14749

SEQ ID NO: 55580 - DNA, 201 bp, Bos taurus; identical to SEQ ID NO: 14750

SEQ ID NO: 55581 - DNA, 201 bp, Bos taurus; identical to SEQ ID NO: 14751

SEQ ID NO: 55582 - DNA, 201 bp, Bos taurus; identical to SEQ ID NO: 14754

SEQ ID NO: 55583 - DNA, 201 bp, Bos taurus
acacccctgcccctgtgtgtacagcctcctccattagcaacatctgtctctggagtgctgtatttgttaaaattgatgaacctatgctgatacaacattatggttcactcttgatgttgcacactctgtgtatttggacaaatactagattggtgcaaacataattgcagtttttgtattgttgaaatttgccatttgata

SEQ ID NO: 55584 - DNA, 201 bp, Bos taurus; identical to SEQ ID NO: 14755

SEQ ID NO: 55585 - DNA, 201 bp, Bos taurus; identical to SEQ ID NO: 14756

SEQ ID NO: 55586 - DNA, 201 bp, Bos taurus; identical to SEQ ID NO: 14757

SEQ ID NO: 55587 - DNA, 201 bp, Bos taurus; identical to SEQ ID NO: 14758

SEQ ID NO: 55588 - DNA, 201 bp, Bos taurus; identical to SEQ ID NO: 14771

SEQ ID NO: 55589 - DNA, 201 bp, Bos taurus; identical to SEQ ID NO: 14774

SEQ ID NO: 55590 - DNA, 201 bp, Bos taurus; identical to SEQ ID NO: 14775

SEQ ID NO: 55591 - DNA, 201 bp, Bos taurus; identical to SEQ ID NO: 14777

SEQ ID NO: 55592 - DNA, 201 bp, Bos taurus
accacagtgggggactgtctggcctcaggcatccattcctccacttccctcctccagcgcccactgagggtcattgcttccttccaacctgcttctccccaagggcagaaggcctgctggaccaccatattacatcactccaggattatatcactccaggagctgccgttctcatcatgctctaggtggatagcatctcct

SEQ ID NO: 55593 - DNA, 201 bp, Bos taurus; identical to SEQ ID NO: 14782

SEQ ID NO: 55594 - DNA, 201 bp, Bos taurus; identical to SEQ ID NO: 14783

SEQ ID NO: 55595 - DNA, 201 bp, Bos taurus; identical to SEQ ID NO: 14784

SEQ ID NO: 55596 - DNA, 201 bp, Bos taurus; identical to SEQ ID NO: 14785

SEQ ID NO: 55597 - DNA, 201 bp, Bos taurus; identical to SEQ ID NO: 14786

SEQ ID NO: 55598 - DNA, 201 bp, Bos taurus; identical to SEQ ID NO: 14787

SEQ ID NO: 55599 - DNA, 201 bp, Bos taurus; identical to SEQ ID NO: 14789

SEQ ID NO: 55600 - DNA, 201 bp, Bos taurus; identical to SEQ ID NO: 14790

SEQ ID NO: 55601 - DNA, 201 bp, Bos taurus
tactaagatcccagtgcctctgttttctcatcacaagtggtcacaagatgtatctcaaagctttgaggggcagagtaatgagaacatgtatgcaaccccccggcccatgtccataagcggcaaagattcattcctctttctttttttttttttaattttatttatttacttagttggctgcaccatgtcttcattgcaaca

SEQ ID NO: 55602 - DNA, 201 bp, Bos taurus
acaaatagggacgggggagaccgcagcccaactcgccgcgctttggatgaggaggggactcggtttgctggggtcgcatctcggaggttccggggccagtggtctcctttccttcatccctgggtcggctgggtcatacgagaggaaaacttcttggggacttgagagcgtctagaaacggcctcctgtgattttgtgcgc

SEQ ID NO: 55603 - DNA, 201 bp, Bos taurus; identical to SEQ ID NO: 14793

SEQ ID NO: 55604 - DNA, 201 bp, Bos taurus; identical to SEQ ID NO: 14794

SEQ ID NO: 55605 - DNA, 201 bp, Bos taurus; identical to SEQ ID NO: 14796

SEQ ID NO: 55606 - DNA, 201 bp, Bos taurus
ttttttctgtgtctggtagagatgcagacttgaaagtggatgaacattagaagtgttttcagtgatctttggagtttgggtgttatttttccttcctcacaggattgttaggataaaaagaggtatagtatagaaaaacacttagggaactataaggaatttttatatgtaagattttttaagccgaatactcagtcttaa

SEQ ID NO: 55607 - DNA, 201 bp, Bos taurus
gcctctgtcctctcgcaccaatgaggacagggcacaactcttaccctaacactcgccctgaccatgctcctcgtgtttgctggatcttgtatccttctctttcttcatttactctctcacgttgcatgcctcagcagattcctgaggaaaggtgcctggatgttaaattttccatgtctgaaaatacattgcttgtatccc

SEQ ID NO: 55608 - DNA, 201 bp, Bos taurus; identical to SEQ ID NO: 14799

SEQ ID NO: 55609 - DNA, 201 bp, Bos taurus; identical to SEQ ID NO: 14800

SEQ ID NO: 55610 - DNA, 201 bp, Bos taurus; identical to SEQ ID NO: 14801

SEQ ID NO: 55611 - DNA, 201 bp, Bos taurus
tggccattcataaagacccattactccaaacaaccaacctgagagcccttcaactgcgactccacacacacaagggagtgacaactggccagaaaggccccgaggctttctccagagaacactacagtttctaatcaactcaaagacaaactaagctctccctaagagaaaatgcgtcaccccatgcacggatctacttgt

SEQ ID NO: 55612 - DNA, 201 bp, Bos taurus
cttccagatgtgccagggcacgagagagccgaaggagcctccggcccagtggtctcctgccgtggctgggaggctgggaagagctggcctctgtgtcccagacttcaggactgccaaggcagctgggcagatccctactcaagagcttcatgcaaatccatgtgagcagggcaagaaagacttctgtgctgcacctgcagg

SEQ ID NO: 55613 - DNA, 201 bp, Bos taurus; identical to SEQ ID NO: 14802

SEQ ID NO: 55614 - DNA, 201 bp, Bos taurus; identical to SEQ ID NO: 14803

SEQ ID NO: 55615 - DNA, 201 bp, Bos taurus; identical to SEQ ID NO: 14804

SEQ ID NO: 55616 - DNA, 201 bp, Bos taurus; identical to SEQ ID NO: 14805

SEQ ID NO: 55617 - DNA, 201 bp, Bos taurus; identical to SEQ ID NO: 14807

SEQ ID NO: 55618 - DNA, 201 bp, Bos taurus; identical to SEQ ID NO: 14808

SEQ ID NO: 55619 - DNA, 201 bp, Bos taurus; identical to SEQ ID NO: 14810

SEQ ID NO: 55620 - DNA, 201 bp, Bos taurus; identical to SEQ ID NO: 14811

SEQ ID NO: 55621 - DNA, 201 bp, Bos taurus
aaagcaaaaacctcctgttctttctgctcggccagaacccaccggcagtgaggctcttggacaccaggtggcgcccaagtaaggccgaacgaggagcttcgggacaggctcgctctgaggggaaacagcgaccacaaactcagatggagaggattaaggtgatggacggccaaagagacgtgtcctggctctggtagggtg

SEQ ID NO: 55622 - DNA, 201 bp, Bos taurus; identical to SEQ ID NO: 14812

SEQ ID NO: 55623 - DNA, 201 bp, Bos taurus; identical to SEQ ID NO: 14814

SEQ ID NO: 55624 - DNA, 201 bp, Bos taurus; identical to SEQ ID NO: 14815

SEQ ID NO: 55625 - DNA, 201 bp, Bos taurus; identical to SEQ ID NO: 14816

SEQ ID NO: 55626 - DNA, 201 bp, Bos taurus; identical to SEQ ID NO: 14817

SEQ ID NO: 55627 - DNA, 201 bp, Bos taurus; identical to SEQ ID NO: 14820

SEQ ID NO: 55628 - DNA, 201 bp, Bos taurus; identical to SEQ ID NO: 14821

SEQ ID NO: 55629 - DNA, 201 bp, Bos taurus; identical to SEQ ID NO: 14822

SEQ ID NO: 55630 - DNA, 201 bp, Bos taurus
aggctctctgctcagggccacacagtaagcagccaaggggccaaatagagaattccaaccaggatgtctgacttggagactgggcttgcttccttctcgtatgcctccgttaacaaaggagacctctctataagtcaaaacagcgtcatcctgtctgggaaaaatgaaactgtgtggaataaaggccaacactgcataacg

SEQ ID NO: 55631 - DNA, 201 bp, Bos taurus; identical to SEQ ID NO: 14824

SEQ ID NO: 55632 - DNA, 201 bp, Bos taurus; identical to SEQ ID NO: 14825

SEQ ID NO: 55633 - DNA, 201 bp, Bos taurus; identical to SEQ ID NO: 14826

SEQ ID NO: 55634 - DNA, 201 bp, Bos taurus
ttaaatccaggcactctcaagctgtgtataaacaaagctaatataaatggagggctgactaaatacaacctatctggataattcaggccccaagtcaatcatctaaaaaagattattttgttctgcctggttggttcactgtatatggaactaaacatctgccatatgtacataccttttctggtgcacttgagaaaattc

SEQ ID NO: 55635 - DNA, 201 bp, Bos taurus; identical to SEQ ID NO: 14827

SEQ ID NO: 55636 - DNA, 201 bp, Bos taurus; identical to SEQ ID NO: 14828

SEQ ID NO: 55637 - DNA, 201 bp, Bos taurus; identical to SEQ ID NO: 14829

SEQ ID NO: 55638 - DNA, 201 bp, Bos taurus; identical to SEQ ID NO: 14830

SEQ ID NO: 55639 - DNA, 201 bp, Bos taurus; identical to SEQ ID NO: 14831

SEQ ID NO: 55640 - DNA, 201 bp, Bos taurus; identical to SEQ ID NO: 14832

SEQ ID NO: 55641 - DNA, 201 bp, Bos taurus; identical to SEQ ID NO: 14833

SEQ ID NO: 55642 - DNA, 201 bp, Bos taurus; identical to SEQ ID NO: 14834

SEQ ID NO: 55643 - DNA, 201 bp, Bos taurus; identical to SEQ ID NO: 14835

SEQ ID NO: 55644 - DNA, 201 bp, Bos taurus; identical to SEQ ID NO: 14836

SEQ ID NO: 55645 - DNA, 201 bp, Bos taurus; identical to SEQ ID NO: 14837

SEQ ID NO: 55646 - DNA, 201 bp, Bos taurus; identical to SEQ ID NO: 14838

SEQ ID NO: 55647 - DNA, 201 bp, Bos taurus; identical to SEQ ID NO: 14839

SEQ ID NO: 55648 - DNA, 201 bp, Bos taurus; identical to SEQ ID NO: 14841

SEQ ID NO: 55649 - DNA, 201 bp, Bos taurus
ctgttgtgagttgggcatcttagtcacaaactagtactacttgcaagggatatgccatcacccctttggcctaggagccagccagacaatgcgcctcttggatgcccaatcctcattgtgattctgctggagcactgcctgttccctcgcctctctccaaaggtcagcccgaggtctgcactccaccgctaatgggtgcac

SEQ ID NO: 55650 - DNA, 201 bp, Bos taurus; identical to SEQ ID NO: 14843

SEQ ID NO: 55651 - DNA, 201 bp, Bos taurus; identical to SEQ ID NO: 14844

SEQ ID NO: 55652 - DNA, 201 bp, Bos taurus; identical to SEQ ID NO: 14845

SEQ ID NO: 55653 - DNA, 201 bp, Bos taurus; identical to SEQ ID NO: 14847

SEQ ID NO: 55654 - DNA, 201 bp, Bos taurus
gccaccgcctggccactgccccattgttcgtcaagcctccagcagcaggaggcaggggacatgtggagtctctctcaccctccggccccacatccaggccctttcatcataccacagacagaccctttccaagaacttgaatggggatccacaacctcccctctgatcgctcattaatctgccccttcagacattcctctg

SEQ ID NO: 55655 - DNA, 201 bp, Bos taurus
aaaggtgaaccctggacatctctgactctcatgataggctgtctcactttcctttgtccactaaagccctcacccaggccctgttgctagtaaaccaaggatccctggagcagcgagctatcacgcctgcacctctgtaccagtggcttccaagctgggcagattctggctttgttcagcctctacaggtatacagatggc

SEQ ID NO: 55656 - DNA, 201 bp, Bos taurus; identical to SEQ ID NO: 14850

SEQ ID NO: 55657 - DNA, 201 bp, Bos taurus; identical to SEQ ID NO: 14851

SEQ ID NO: 55658 - DNA, 201 bp, Bos taurus; identical to SEQ ID NO: 14852

SEQ ID NO: 55659 - DNA, 201 bp, Bos taurus; identical to SEQ ID NO: 14853

SEQ ID NO: 55660 - DNA, 201 bp, Bos taurus; identical to SEQ ID NO: 14854

SEQ ID NO: 55661 - DNA, 201 bp, Bos taurus
gcttttgtctttattttcactaatcctccaattcagcacagacccaacttcctcactggttgtcttctccaagagccagccttgagggcccccttgtgtccgagagaattaaaatccccagagcactgtttgcacaatggcttctgatctgctcgaataatattatcaggcaatggccctgggtattgaaatcccacccag

SEQ ID NO: 55662 - DNA, 201 bp, Bos taurus; identical to SEQ ID NO: 14855

SEQ ID NO: 55663 - DNA, 201 bp, Bos taurus; identical to SEQ ID NO: 14856

SEQ ID NO: 55664 - DNA, 201 bp, Bos taurus; identical to SEQ ID NO: 14857

SEQ ID NO: 55665 - DNA, 201 bp, Bos taurus; identical to SEQ ID NO: 14858

SEQ ID NO: 55666 - DNA, 201 bp, Bos taurus; identical to SEQ ID NO: 14859

SEQ ID NO: 55667 - DNA, 201 bp, Bos taurus; identical to SEQ ID NO: 14861

SEQ ID NO: 55668 - DNA, 201 bp, Bos taurus
tctggcctattctctctaataagccaagagttatccaatcatctgcaaatcaaacagttcatagcattatggaagaataacaactcttatatgccacttactatgtgccaggccttgctctaagcattttatagtattatttaatcctcccaacaaaccctatgaggcaagtactattattactcctattttacagttgag

SEQ ID NO: 55669 - DNA, 201 bp, Bos taurus; identical to SEQ ID NO: 14863

SEQ ID NO: 55670 - DNA, 201 bp, Bos taurus; identical to SEQ ID NO: 14864

SEQ ID NO: 55671 - DNA, 201 bp, Bos taurus
ctgcaacccagctcttttaagagtacactaccataagacaaacagcccctccactccccagagagccctaaactcactggccctcaggtccctcctcatcggagtctcgtccatcttcctcatcgctgaacttgagcttctcagtgtagtcgacctcctcgtgggcccctaaggggaaaagtgaagcatggtaacccaagc

SEQ ID NO: 55672 - DNA, 201 bp, Bos taurus; identical to SEQ ID NO: 14867

SEQ ID NO: 55673 - DNA, 201 bp, Bos taurus
agaaccagaagggctttcaaatgagggtgaaatgtgagtgaccagagggcaactgaggacatttccaacgtctccatttaggagggaagggagggcccttgggtacaggagcagagagccttgcccgggtctggatgagattcacccccaccctcacccatcctctgacaatacctcatcccacatcacactgaggggccc

SEQ ID NO: 55674 - DNA, 201 bp, Bos taurus
ggtatttccagctcactggtaacttcctggaggcagcaatatctttggcaggaagccatctcttctgtcaccttggccacaaggccctgctccaggccttgaattgataatccacaggagtggacccttctcctgagtcattccctcctggagaggcaaggatagaagagggcagctcttaggacccattggcaccctcac

SEQ ID NO: 55675 - DNA, 201 bp, Bos taurus
tacccttggggtccacactaatttgttggattgtataaatattctgaccaaaaatgttttgaaaatcgctgccagaagcccttgggccaggactcagggaatgtgacaaaaagctctcggtgcaggagaggagggatcaggacaacgtcccaggttccccggcgggcaagggtctcagggtctcagaatcaagggccgtgt

SEQ ID NO: 55676 - DNA, 201 bp, Bos taurus
catttcagggccaaatgcttaccactaggaagccaaatccaacaaagagtgcaacagtgacagtggtagcagccagggaaatgaggatgattttgctgggtgtcaggggccccgggggtttcgctgctgttactgaatctgttccctccagttgagtgtctggatgtttagtggtgtagtcctctgtggtccccaggtctg

SEQ ID NO: 55677 - DNA, 201 bp, Bos taurus
gatggtactgcggatggtggaggcagaagattgaggaaatgtgaccatggctgatggagaagtgggagatctattcaattatggaagtggccacccacagggaagagggtgtgcaggaacagggtctgatactcttgtgatctagtcactgggtataaggatagtgctggaggaagagatgacagaataagatttacccat

SEQ ID NO: 55678 - DNA, 201 bp, Bos taurus; identical to SEQ ID NO: 14869

SEQ ID NO: 55679 - DNA, 201 bp, Bos taurus; identical to SEQ ID NO: 14870

SEQ ID NO: 55680 - DNA, 201 bp, Bos taurus; identical to SEQ ID NO: 14871

SEQ ID NO: 55681 - DNA, 201 bp, Bos taurus
ccttgccctgtcagccacctctgaatccccaccaggtgccttcctgggtggattcgataagatgacctgccctctcccagtcctctccttcacccgtctcagcatcagttgttttctatgaaaacagtggattggttaggttttgtgcagggtcttgggttagagccacaatggatttgaggatgagtattttctttttct

SEQ ID NO: 55682 - DNA, 201 bp, Bos taurus
atctgagtgtttgctatgctgactctgttgcaggtggggcaggagaaggctgtgaggagctgagtgtggacggggcctgggcccagtcagagcatcatgggctttgatatggtcgctgctgttatcatcctctcaacatctttgtccttgtctcttcagtagaaccttgtctcaccaggacctgtgatcacaaggactgag

SEQ ID NO: 55683 - DNA, 201 bp, Bos taurus
gagttttcctctctcatggaaggacgtagtgtctgtctttcaagactctttcatgttgcagctgatatcacagaaatacaaaggagtatgaaagaggactctgaatgattatacagcaaacaaactggaggaactagaagaaatgggtttatacaacctgccaagacaatcatgaagaaacagaatagctgaacagatcaa

SEQ ID NO: 55684 - DNA, 201 bp, Bos taurus
gttcagagcgtttgacttgccccgggccactcagccaacaaaccccaagacagagcccagcacccatgtttccagcctccaggcactccccttgcagcaggctgctccagacagacagatggccagactggagtccttcctgagactctaagaaacccacctgcatttcctgcagtatctcctcctgaattctgagctgtc

SEQ ID NO: 55685 - DNA, 201 bp, Bos taurus; identical to SEQ ID NO: 14872

SEQ ID NO: 55686 - DNA, 201 bp, Bos taurus; identical to SEQ ID NO: 14874

SEQ ID NO: 55687 - DNA, 201 bp, Bos taurus
tgggactttcttcttttttcctatgactcccagttctacattttcaaagcctctttcattactcatctgctgtgccgattccctgaacgccgaggcggccgcagctcccgaggcattcacggcttctccctcctcacagctcgctggctcccgctccatcgctgtcgacgccacaggactgctggcgcggcaggtcccgcc

SEQ ID NO: 55688 - DNA, 201 bp, Bos taurus; identical to SEQ ID NO: 14876

SEQ ID NO: 55689 - DNA, 201 bp, Bos taurus; identical to SEQ ID NO: 14877

SEQ ID NO: 55690 - DNA, 201 bp, Bos taurus
cttaacagagtgaaccaagctactttcagtttctgtacttttaatttttgataggttcggccagtgagaaagggcatgagactacgatcccaatagcccgcgagctcaggacagtctgtaatcaccgagtctgtgtacatgtctttccgtttccatcaggctccttttgctgccaggacgcccctaggttaataagcgttc

SEQ ID NO: 55691 - DNA, 201 bp, Bos taurus
gcttttattcctaattgcagactacaagacttttttgatcttatctttcccaagacactatgctgacatagtccagagctccttgttttcaccccaggccgttctcttttgggctagtcttgggaacgatcagcaagtgcgtaggcagcattcatgtctgatgccaatctggtgttccaaggtccattctttcatgatcca

SEQ ID NO: 55692 - DNA, 201 bp, Bos taurus; identical to SEQ ID NO: 14878

SEQ ID NO: 55693 - DNA, 201 bp, Bos taurus; identical to SEQ ID NO: 14879

SEQ ID NO: 55694 - DNA, 201 bp, Bos taurus; identical to SEQ ID NO: 14880

SEQ ID NO: 55695 - DNA, 201 bp, Bos taurus; identical to SEQ ID NO: 14883

SEQ ID NO: 55696 - DNA, 201 bp, Bos taurus; identical to SEQ ID NO: 14884

SEQ ID NO: 55697 - DNA, 201 bp, Bos taurus; identical to SEQ ID NO: 14885

SEQ ID NO: 55698 - DNA, 201 bp, Bos taurus; identical to SEQ ID NO: 14886

SEQ ID NO: 55699 - DNA, 201 bp, Bos taurus; identical to SEQ ID NO: 14887

SEQ ID NO: 55700 - DNA, 201 bp, Bos taurus; identical to SEQ ID NO: 14888

SEQ ID NO: 55701 - DNA, 201 bp, Bos taurus; identical to SEQ ID NO: 14889

SEQ ID NO: 55702 - DNA, 201 bp, Bos taurus; identical to SEQ ID NO: 14890

SEQ ID NO: 55703 - DNA, 201 bp, Bos taurus
tgatcttgatgttacttggatcttccctgggtctccattcattgcctgcccagccaggccactatttggggctggaagatggagaaagaccactaagatcttcttttatggagtcctgggtctgagaccataagaattagtcactcaccagcataggaccgagcttttttccaatctgcaatagaaaaaagagacgtgagt

SEQ ID NO: 55704 - DNA, 201 bp, Bos taurus; identical to SEQ ID NO: 14892

SEQ ID NO: 55705 - DNA, 201 bp, Bos taurus
aaaatgatacgtaaagccaacaatatcaaagttgcttcttttaaaattaataaaataagatcaagaaaaaattatcaatataagaaatgaaaaagggttcgttgtagttttagcccataataaagcaacagaatattgtaaacaatattatatgtattataaattataataaatattataaatatttaaatattataaatt

SEQ ID NO: 55706 - DNA, 201 bp, Bos taurus
gcgaagtcttttgtcatctgaacccccagggaatgccaagaattcgggagtgggtagccttcgctttcaccagaggaacattccggacccaggaattgaaccggggtattccacagatctttactagctagctactgtaaagtgagcccagctttttcaagtgtattaggtggctctgaaaagagcctttgggttgttgaa

SEQ ID NO: 55707 - DNA, 201 bp, Bos taurus; identical to SEQ ID NO: 14894

SEQ ID NO: 55708 - DNA, 201 bp, Bos taurus; identical to SEQ ID NO: 14895

SEQ ID NO: 55709 - DNA, 201 bp, Bos taurus
gcttgtcctctgagcacaagcctgacggggaggctgagctgtaaatatcagggctttgctgcatcaacattcatatcacaatgcaaggagccaagcttccgctctgagagtttccaaataaggccctgagaggatggttcaggtgcaaaaatcaaattctacttggtacttaaattcctcagcattctaggctgccaaacc

SEQ ID NO: 55710 - DNA, 201 bp, Bos taurus; identical to SEQ ID NO: 14899

SEQ ID NO: 55711 - DNA, 201 bp, Bos taurus; identical to SEQ ID NO: 14900

SEQ ID NO: 55712 - DNA, 201 bp, Bos taurus; identical to SEQ ID NO: 14901

SEQ ID NO: 55713 - DNA, 201 bp, Bos taurus; identical to SEQ ID NO: 14902

SEQ ID NO: 55714 - DNA, 201 bp, Bos taurus; identical to SEQ ID NO: 14903

SEQ ID NO: 55715 - DNA, 201 bp, Bos taurus; identical to SEQ ID NO: 14904

SEQ ID NO: 55716 - DNA, 201 bp, Bos taurus; identical to SEQ ID NO: 14905

SEQ ID NO: 55717 - DNA, 201 bp, Bos taurus; identical to SEQ ID NO: 14908

SEQ ID NO: 55718 - DNA, 201 bp, Bos taurus; identical to SEQ ID NO: 14912

SEQ ID NO: 55719 - DNA, 201 bp, Bos taurus
tagagctctttagaatatatgtcctgacacaaggttaaagtacggcagccaatgctatttatacagactacagcaaaggacatagtccacagctgcttaaacgcaacgagacctatctccccatgtctgcaaagcacactattcacaccagaacttcttctggcaacaagatctggctaccttttatggagataatccagt

SEQ ID NO: 55720 - DNA, 201 bp, Bos taurus
cgcaagtggtgtacactaataaatcccttgctcctaaagaatgttctatgtgtaactttcttcctgatgtcgaatcgtgcgcttggcccttcagacaccacagtcaactgctgagcaagtctaagtagcctaaaggagtcgaagcaccactccaggcggccaactccatcctaaggaattatttatgcctgatgagcctct

SEQ ID NO: 55721 - DNA, 201 bp, Bos taurus
agcttctggcgctcgcggtcccctttctactcaaacgcattaaattggggcgggggtgggggccgcgtgaagtgagagaggtgatgctggatggccaggaccgcataggttatcctgggtgggtcgtgaaactgaaaggggcggacgggatggcggactcctaactagtggtccaggcccatccctgcatccctgcatctc

SEQ ID NO: 55722 - DNA, 201 bp, Bos taurus; identical to SEQ ID NO: 14914

SEQ ID NO: 55723 - DNA, 201 bp, Bos taurus; identical to SEQ ID NO: 14915

SEQ ID NO: 55724 - DNA, 201 bp, Bos taurus
gcggcttctgggccaggaaatctcgcggtgagcaacgtgaggtcacaaaccggaaatgcatagcttttcttgacctaggacccctggcgaacgttaaagaatggccggaggtctcacctgagagttcatctagcgattcctataacttgtgttaaacttttccacagttattataaatgtgaaataagtacctggttacta

SEQ ID NO: 55725 - DNA, 201 bp, Bos taurus
aaaactcctggaagatctcataggcaagacatttcctcacataaatcatacgatgttttcttaggacaaaaataaacaaatgagatctaaccacacttacaagcttttgcacagcaaaggaaaccatgagcaaaacaaaagacaacctacagaatgggaaaaaatatttgcaaatgatgcaactgacaaaggcttaatttc

SEQ ID NO: 55726 - DNA, 201 bp, Bos taurus
gagcaggcgagaaagagtgggtacaggaacagtcaggctggtgaggaggtgattgccatagtcctggaggaatgatggggtttcaacaaagggagtggccatgggagatgaggaagctggtggaacgacattcagcaggtagaatcggtctgacctggagtcctaagtcctttgaattgcaggatgaggatacctctggcc

SEQ ID NO: 55727 - DNA, 201 bp, Bos taurus; identical to SEQ ID NO: 14917

SEQ ID NO: 55728 - DNA, 201 bp, Bos taurus; identical to SEQ ID NO: 14919

SEQ ID NO: 55729 - DNA, 201 bp, Bos taurus
agcatcagggtcttttccaatgagtcagttcttcacatcacatggccaaagtattggagtttcagcttcagcatcagtccttctgatgaatattcaggactgtttatattcctttgtaatggcctctcacaattctgggagtttagagcagttgcaggtgtcccggggacaggaaagataactacacatcatcctagcccc

SEQ ID NO: 55730 - DNA, 201 bp, Bos taurus; identical to SEQ ID NO: 14921

SEQ ID NO: 55731 - DNA, 201 bp, Bos taurus; identical to SEQ ID NO: 14922

SEQ ID NO: 55732 - DNA, 201 bp, Bos taurus; identical to SEQ ID NO: 14923

SEQ ID NO: 55733 - DNA, 201 bp, Bos taurus; identical to SEQ ID NO: 14924

SEQ ID NO: 55734 - DNA, 201 bp, Bos taurus; identical to SEQ ID NO: 14925

SEQ ID NO: 55735 - DNA, 201 bp, Bos taurus; identical to SEQ ID NO: 14926

SEQ ID NO: 55736 - DNA, 201 bp, Bos taurus; identical to SEQ ID NO: 14927

SEQ ID NO: 55737 - DNA, 201 bp, Bos taurus; identical to SEQ ID NO: 14928

SEQ ID NO: 55738 - DNA, 201 bp, Bos taurus; identical to SEQ ID NO: 14929

SEQ ID NO: 55739 - DNA, 201 bp, Bos taurus; identical to SEQ ID NO: 14930

SEQ ID NO: 55740 - DNA, 201 bp, Bos taurus; identical to SEQ ID NO: 14931

SEQ ID NO: 55741 - DNA, 201 bp, Bos taurus; identical to SEQ ID NO: 14932

SEQ ID NO: 55742 - DNA, 201 bp, Bos taurus; identical to SEQ ID NO: 14933

SEQ ID NO: 55743 - DNA, 201 bp, Bos taurus; identical to SEQ ID NO: 14934

SEQ ID NO: 55744 - DNA, 201 bp, Bos taurus; identical to SEQ ID NO: 14935

SEQ ID NO: 55745 - DNA, 201 bp, Bos taurus; identical to SEQ ID NO: 14936

SEQ ID NO: 55746 - DNA, 201 bp, Bos taurus; identical to SEQ ID NO: 14937

SEQ ID NO: 55747 - DNA, 201 bp, Bos taurus; identical to SEQ ID NO: 14938

SEQ ID NO: 55748 - DNA, 201 bp, Bos taurus; identical to SEQ ID NO: 14939

SEQ ID NO: 55749 - DNA, 201 bp, Bos taurus; identical to SEQ ID NO: 14940

SEQ ID NO: 55750 - DNA, 201 bp, Bos taurus; identical to SEQ ID NO: 14941

SEQ ID NO: 55751 - DNA, 201 bp, Bos taurus; identical to SEQ ID NO: 14942

SEQ ID NO: 55752 - DNA, 201 bp, Bos taurus; identical to SEQ ID NO: 14943

SEQ ID NO: 55753 - DNA, 201 bp, Bos taurus; identical to SEQ ID NO: 14944

SEQ ID NO: 55754 - DNA, 201 bp, Bos taurus; identical to SEQ ID NO: 14945

SEQ ID NO: 55755 - DNA, 201 bp, Bos taurus; identical to SEQ ID NO: 14946

SEQ ID NO: 55756 - DNA, 201 bp, Bos taurus; identical to SEQ ID NO: 14947

SEQ ID NO: 55757 - DNA, 201 bp, Bos taurus; identical to SEQ ID NO: 14948

SEQ ID NO: 55758 - DNA, 201 bp, Bos taurus; identical to SEQ ID NO: 14949

SEQ ID NO: 55759 - DNA, 201 bp, Bos taurus; identical to SEQ ID NO: 14950

SEQ ID NO: 55760 - DNA, 201 bp, Bos taurus; identical to SEQ ID NO: 14951

SEQ ID NO: 55761 - DNA, 201 bp, Bos taurus; identical to SEQ ID NO: 14952

SEQ ID NO: 55762 - DNA, 201 bp, Bos taurus; identical to SEQ ID NO: 14953

SEQ ID NO: 55763 - DNA, 201 bp, Bos taurus; identical to SEQ ID NO: 14954

SEQ ID NO: 55764 - DNA, 201 bp, Bos taurus; identical to SEQ ID NO: 14955

SEQ ID NO: 55765 - DNA, 201 bp, Bos taurus; identical to SEQ ID NO: 14956

SEQ ID NO: 55766 - DNA, 201 bp, Bos taurus; identical to SEQ ID NO: 14957

SEQ ID NO: 55767 - DNA, 201 bp, Bos taurus; identical to SEQ ID NO: 14958

SEQ ID NO: 55768 - DNA, 201 bp, Bos taurus; identical to SEQ ID NO: 14959

SEQ ID NO: 55769 - DNA, 201 bp, Bos taurus; identical to SEQ ID NO: 14960

SEQ ID NO: 55770 - DNA, 201 bp, Bos taurus; identical to SEQ ID NO: 14961

SEQ ID NO: 55771 - DNA, 201 bp, Bos taurus; identical to SEQ ID NO: 14962

SEQ ID NO: 55772 - DNA, 201 bp, Bos taurus; identical to SEQ ID NO: 14963

SEQ ID NO: 55773 - DNA, 201 bp, Bos taurus; identical to SEQ ID NO: 14964

SEQ ID NO: 55774 - DNA, 201 bp, Bos taurus; identical to SEQ ID NO: 14965

SEQ ID NO: 55775 - DNA, 201 bp, Bos taurus; identical to SEQ ID NO: 14966

SEQ ID NO: 55776 - DNA, 201 bp, Bos taurus; identical to SEQ ID NO: 14967

SEQ ID NO: 55777 - DNA, 201 bp, Bos taurus; identical to SEQ ID NO: 14968

SEQ ID NO: 55778 - DNA, 201 bp, Bos taurus; identical to SEQ ID NO: 14969

SEQ ID NO: 55779 - DNA, 201 bp, Bos taurus; identical to SEQ ID NO: 14970

SEQ ID NO: 55780 - DNA, 201 bp, Bos taurus; identical to SEQ ID NO: 14971

SEQ ID NO: 55781 - DNA, 201 bp, Bos taurus; identical to SEQ ID NO: 14972

SEQ ID NO: 55782 - DNA, 201 bp, Bos taurus; identical to SEQ ID NO: 14973

SEQ ID NO: 55783 - DNA, 201 bp, Bos taurus; identical to SEQ ID NO: 14974

SEQ ID NO: 55784 - DNA, 201 bp, Bos taurus; identical to SEQ ID NO: 14975

SEQ ID NO: 55785 - DNA, 201 bp, Bos taurus; identical to SEQ ID NO: 14976

SEQ ID NO: 55786 - DNA, 201 bp, Bos taurus; identical to SEQ ID NO: 14977

SEQ ID NO: 55787 - DNA, 201 bp, Bos taurus; identical to SEQ ID NO: 14978

SEQ ID NO: 55788 - DNA, 201 bp, Bos taurus; identical to SEQ ID NO: 14979

SEQ ID NO: 55789 - DNA, 201 bp, Bos taurus; identical to SEQ ID NO: 14980

SEQ ID NO: 55790 - DNA, 201 bp, Bos taurus; identical to SEQ ID NO: 14981

SEQ ID NO: 55791 - DNA, 201 bp, Bos taurus; identical to SEQ ID NO: 14982

SEQ ID NO: 55792 - DNA, 201 bp, Bos taurus; identical to SEQ ID NO: 14983

SEQ ID NO: 55793 - DNA, 201 bp, Bos taurus; identical to SEQ ID NO: 14984

SEQ ID NO: 55794 - DNA, 201 bp, Bos taurus; identical to SEQ ID NO: 14985

SEQ ID NO: 55795 - DNA, 201 bp, Bos taurus; identical to SEQ ID NO: 14986

SEQ ID NO: 55796 - DNA, 201 bp, Bos taurus; identical to SEQ ID NO: 14987

SEQ ID NO: 55797 - DNA, 201 bp, Bos taurus; identical to SEQ ID NO: 14988

SEQ ID NO: 55798 - DNA, 201 bp, Bos taurus; identical to SEQ ID NO: 14989

SEQ ID NO: 55799 - DNA, 201 bp, Bos taurus; identical to SEQ ID NO: 14990

SEQ ID NO: 55800 - DNA, 201 bp, Bos taurus; identical to SEQ ID NO: 14991

SEQ ID NO: 55801 - DNA, 201 bp, Bos taurus; identical to SEQ ID NO: 14992

SEQ ID NO: 55802 - DNA, 201 bp, Bos taurus; identical to SEQ ID NO: 14993

SEQ ID NO: 55803 - DNA, 201 bp, Bos taurus; identical to SEQ ID NO: 14994

SEQ ID NO: 55804 - DNA, 201 bp, Bos taurus; identical to SEQ ID NO: 14995

SEQ ID NO: 55805 - DNA, 201 bp, Bos taurus; identical to SEQ ID NO: 14996

SEQ ID NO: 55806 - DNA, 201 bp, Bos taurus; identical to SEQ ID NO: 14997

SEQ ID NO: 55807 - DNA, 201 bp, Bos taurus; identical to SEQ ID NO: 14998

SEQ ID NO: 55808 - DNA, 201 bp, Bos taurus; identical to SEQ ID NO: 14999

SEQ ID NO: 55809 - DNA, 201 bp, Bos taurus; identical to SEQ ID NO: 15000

SEQ ID NO: 55810 - DNA, 201 bp, Bos taurus; identical to SEQ ID NO: 15001

SEQ ID NO: 55811 - DNA, 201 bp, Bos taurus; identical to SEQ ID NO: 15002

SEQ ID NO: 55812 - DNA, 201 bp, Bos taurus; identical to SEQ ID NO: 15003

SEQ ID NO: 55813 - DNA, 201 bp, Bos taurus; identical to SEQ ID NO: 15004

SEQ ID NO: 55814 - DNA, 201 bp, Bos taurus; identical to SEQ ID NO: 15005

SEQ ID NO: 55815 - DNA, 201 bp, Bos taurus; identical to SEQ ID NO: 15006

SEQ ID NO: 55816 - DNA, 201 bp, Bos taurus; identical to SEQ ID NO: 15007

SEQ ID NO: 55817 - DNA, 201 bp, Bos taurus; identical to SEQ ID NO: 15008

SEQ ID NO: 55818 - DNA, 201 bp, Bos taurus; identical to SEQ ID NO: 15009

SEQ ID NO: 55819 - DNA, 201 bp, Bos taurus; identical to SEQ ID NO: 15010

SEQ ID NO: 55820 - DNA, 201 bp, Bos taurus; identical to SEQ ID NO: 15012

SEQ ID NO: 55821 - DNA, 201 bp, Bos taurus; identical to SEQ ID NO: 15013

SEQ ID NO: 55822 - DNA, 201 bp, Bos taurus
acacttgactttgatctctcgtgtcctgtgaacttggctgtggcgctgaagggatggtctttcaaaaagcagatctaatcttggccttgccctgctggcctgccaggcgtgcccagccccgctgggcagggagatccctgaagtagcccctgttagctcccccgtcgcctccctgtctggtccttggacagaccaggctct

SEQ ID NO: 55823 - DNA, 201 bp, Bos taurus
attccttttcctgcctgctttaatcactactgctgtctgtctggagagctgtgacgtcactaacccagactctcggtaccgaggtagagaggcctcagtgcttccacctgagctctctgcagaggtgactagaatggaatagggcatatcgtggctttggataaaaagggggtttccacttccttgtgcagggctcagctc

SEQ ID NO: 55824 - DNA, 201 bp, Bos taurus
aaatatcaagggcaatttcaagttggaaaatggcctttgttgcccacaaaaagcacgatgaatatgttaacctctgtgtggccacagtcgctcccgaggacgtgctttcacagccctttcacaatgactgcctctctgcttcatcaccagcacccggctcttgaggaatcagagacgcaccgagctgggccttgtctggtg

SEQ ID NO: 55825 - DNA, 201 bp, Bos taurus
ttctgcagacagtaacgtttctgtgtggtgtcattaacaactcgacgctcgggcacggaggcagcagccctggctccgactcccgaggccggaactgaccgaggttttcccttccgacttcagtggcgctcctggctttcctgtctcccagcgtcctgcgggaacccaggcctgacacaccctgtgtacaacccgtcaaga

SEQ ID NO: 55826 - DNA, 201 bp, Bos taurus
gccccaccttcatggggcagggcatggttcccagcagacgtcagatgactcctgaccccgctggccttccctcggagggggtcattcgtccaggtgggcctcgggaaagtacaggttggggtcccaccaggaggcacggacgcttcagggacagtttctaaagatgagggcggtgagtcacaggccggttcccagcaccac

SEQ ID NO: 55827 - DNA, 201 bp, Bos taurus; identical to SEQ ID NO: 15017

SEQ ID NO: 55828 - DNA, 201 bp, Bos taurus; identical to SEQ ID NO: 15019

SEQ ID NO: 55829 - DNA, 201 bp, Bos taurus
tgagggccacccgccttccagcccagaagccctgcccttccaagtccacttgggtcgggcagacttctttgctgctggtgaccacagagtaagcatggaaatcaaagcagagaaccaaggccaaggtgaacattaatgtggctgctgcctggtgagatgttggttcatggggggccagaccccaacatgcaggtgacccct

SEQ ID NO: 55830 - DNA, 201 bp, Bos taurus; identical to SEQ ID NO: 15021

SEQ ID NO: 55831 - DNA, 201 bp, Bos taurus; identical to SEQ ID NO: 15022

SEQ ID NO: 55832 - DNA, 201 bp, Bos taurus; identical to SEQ ID NO: 15023

SEQ ID NO: 55833 - DNA, 201 bp, Bos taurus; identical to SEQ ID NO: 15024

SEQ ID NO: 55834 - DNA, 201 bp, Bos taurus; identical to SEQ ID NO: 15025

SEQ ID NO: 55835 - DNA, 201 bp, Bos taurus; identical to SEQ ID NO: 15026

SEQ ID NO: 55836 - DNA, 201 bp, Bos taurus; identical to SEQ ID NO: 15027

SEQ ID NO: 55837 - DNA, 201 bp, Bos taurus
cctgcaatgctttaggtgttagtagcaaaaagtcaaattagagtcagtaatgacacagacatattcttcaagcggactgcctcctggcctgatggggcacgtgtatagctttaccaccgattaatgatactgagtcttactctacaccggcactctcaaagtccaagcaacttaggggaataaaccttcatctctcaagaa

SEQ ID NO: 55838 - DNA, 201 bp, Bos taurus
gcccttggtgactcctggtgattgagctccttacgcttctattcgtttcatgaaaaggtagcccaggtgtgcctgccctgaggcccagtaccttcctcccgaccccgtggcaccagagtctcagcccctcgccgtgacacctggcagcctcacccttgtacctgctgggctggcacccacgtggtcagctcctctcaccac

SEQ ID NO: 55839 - DNA, 201 bp, Bos taurus; identical to SEQ ID NO: 15029

SEQ ID NO: 55840 - DNA, 201 bp, Bos taurus; identical to SEQ ID NO: 15033

SEQ ID NO: 55841 - DNA, 201 bp, Bos taurus; identical to SEQ ID NO: 15035

SEQ ID NO: 55842 - DNA, 201 bp, Bos taurus; identical to SEQ ID NO: 15036

SEQ ID NO: 55843 - DNA, 201 bp, Bos taurus; identical to SEQ ID NO: 15037

SEQ ID NO: 55844 - DNA, 201 bp, Bos taurus
ttcagcctgaaggccctagaatcggtgcttggcaacaggggaagccaccgcgctgagaagcgaattcattggaatcagcagcccccgtgcacagcagcaggggagcccgggccatgacaaaggcacagcaaagcaaaaccaaaaacatacgtaaaaaaaattggaaaaagatcattctagtagctcttcagcagtcggaac

SEQ ID NO: 55845 - DNA, 201 bp, Bos taurus; identical to SEQ ID NO: 15038

SEQ ID NO: 55846 - DNA, 201 bp, Bos taurus; identical to SEQ ID NO: 15039

SEQ ID NO: 55847 - DNA, 201 bp, Bos taurus
ccacatggttacgttatcagcacattaaagcaggagtgcttagagacaggaagaaacagataaggactacggtcttcacagaactcattctaataccttctacatcttggaaggtgagaaaccagcagaggttgcaagtgtcctgccatggcatctcctgtcctttgtccctaggtcaggagaacacgctcctcacgtcca

SEQ ID NO: 55848 - DNA, 201 bp, Bos taurus; identical to SEQ ID NO: 15040

SEQ ID NO: 55849 - DNA, 201 bp, Bos taurus; identical to SEQ ID NO: 15041

SEQ ID NO: 55850 - DNA, 201 bp, Bos taurus; identical to SEQ ID NO: 15043

SEQ ID NO: 55851 - DNA, 201 bp, Bos taurus; identical to SEQ ID NO: 15044

SEQ ID NO: 55852 - DNA, 201 bp, Bos taurus
aactaaaccctttaaaatgttatgtctggccaaaattttaagatgcataaagttcaaaaagaagtcaattgatactcatctacccacactcccagcgaaacggccttgcctatagtacctgatatcttgcctgtcatgtttttatagcatttatatgaggtgttgacccttaacccaaggacaccagacccccatgctggc

SEQ ID NO: 55853 - DNA, 201 bp, Bos taurus; identical to SEQ ID NO: 15048

SEQ ID NO: 55854 - DNA, 201 bp, Bos taurus; identical to SEQ ID NO: 15049

SEQ ID NO: 55855 - DNA, 201 bp, Bos taurus; identical to SEQ ID NO: 15050

SEQ ID NO: 55856 - DNA, 201 bp, Bos taurus; identical to SEQ ID NO: 15051

SEQ ID NO: 55857 - DNA, 201 bp, Bos taurus; identical to SEQ ID NO: 15052

SEQ ID NO: 55858 - DNA, 201 bp, Bos taurus; identical to SEQ ID NO: 15053

SEQ ID NO: 55859 - DNA, 201 bp, Bos taurus; identical to SEQ ID NO: 15054

SEQ ID NO: 55860 - DNA, 201 bp, Bos taurus
caaaatagctgaagactagatgcgtataaatctgatttctaaaagttttgcttgacatcataaggaaacatttaagaagctaagtcttaggtgtcagtgtgtgttaccaagctccaacccaacaatatctgctatgtttgccactgtttttagcatgattaatgaagaaatgctttattcataatttatttatttatcctt

SEQ ID NO: 55861 - DNA, 201 bp, Bos taurus
atgggtgggctctcctgacacttaggaatctcccagaagttccagacggaattttagagtgaatcgcaagctctttccaagggcctctactggatgctcaagagaagcctggttgaaggaggattcttgaaattatccacattggtggtgcctcagcaggaaatttcaccctcatctggcccatgtgtcactcagagcaga

SEQ ID NO: 55862 - DNA, 201 bp, Bos taurus; identical to SEQ ID NO: 15055

SEQ ID NO: 55863 - DNA, 201 bp, Bos taurus
atcatttaacctgtagatccacagagatgtgtactatggaatttgtaaggccctcgtaagctccaaaattctgattctaaagttagtctcagcgcaagtcgtcagcgcagaacaaaggaaagaggccctcagccctcactcggaggcagacatgagttcatcaagcagaaaactctctagtgagttgtcagtctttgaagt

SEQ ID NO: 55864 - DNA, 201 bp, Bos taurus; identical to SEQ ID NO: 15056

SEQ ID NO: 55865 - DNA, 201 bp, Bos taurus
aagccagctcaagatctcagtcaactcttcccattagaaataaaaatgcccacatatatactgctttcagtgttcctattgatattgtatccctcaagcttttgacttaaatctttcctattcttccgaccttatgtcagtactacagactacaacagccttacctgagtgtctggtcattgtaccgtatctgatggggtg

SEQ ID NO: 55866 - DNA, 201 bp, Bos taurus; identical to SEQ ID NO: 15059

SEQ ID NO: 55867 - DNA, 201 bp, Bos taurus; identical to SEQ ID NO: 15061

SEQ ID NO: 55868 - DNA, 201 bp, Bos taurus; identical to SEQ ID NO: 15062

SEQ ID NO: 55869 - DNA, 201 bp, Bos taurus; identical to SEQ ID NO: 15063

SEQ ID NO: 55870 - DNA, 201 bp, Bos taurus; identical to SEQ ID NO: 15064

SEQ ID NO: 55871 - DNA, 201 bp, Bos taurus; identical to SEQ ID NO: 15066

SEQ ID NO: 55872 - DNA, 201 bp, Bos taurus; identical to SEQ ID NO: 15067

SEQ ID NO: 55873 - DNA, 201 bp, Bos taurus; identical to SEQ ID NO: 15068

SEQ ID NO: 55874 - DNA, 201 bp, Bos taurus; identical to SEQ ID NO: 15069

SEQ ID NO: 55875 - DNA, 201 bp, Bos taurus; identical to SEQ ID NO: 15070

SEQ ID NO: 55876 - DNA, 201 bp, Bos taurus; identical to SEQ ID NO: 15071

SEQ ID NO: 55877 - DNA, 201 bp, Bos taurus; identical to SEQ ID NO: 15072

SEQ ID NO: 55878 - DNA, 201 bp, Bos taurus; identical to SEQ ID NO: 15073

SEQ ID NO: 55879 - DNA, 201 bp, Bos taurus; identical to SEQ ID NO: 15074

SEQ ID NO: 55880 - DNA, 201 bp, Bos taurus; identical to SEQ ID NO: 15075

SEQ ID NO: 55881 - DNA, 201 bp, Bos taurus
acctggaaaaggcagggaatagattatccccctggagcttctagagggggcacgtctaggagacatgttgattctggcccaattgatactgattttggacctcaggtgtacagaacaattaaacaataaatctctgttatttgaaggctccaagattgtggtgcttcgttacagaagccttaggaaactgacctaggcccc

SEQ ID NO: 55882 - DNA, 201 bp, Bos taurus; identical to SEQ ID NO: 15076

SEQ ID NO: 55883 - DNA, 201 bp, Bos taurus
gcatgactacccattccatggattccccattgcctggagaattccactggacagaggagcctggtaggctacagtccacagggccgccaagagtcggtcatgactaaagcaacctggcatgcacgcacaatggagacaatatttaaagactggacagtgaacagtacttaaggaaggaatctgccagaaggttagggccca

SEQ ID NO: 55884 - DNA, 201 bp, Bos taurus
catggcctcccaccctcaaccccttgacctttcatttatttttaaaatttttactgcaacctgggattctcttgtaagctctttccttttctctctacatgcactatcacatggccgaggacttattccctcctatagaacatattgaagtgcaattcctacttctgtgctgagtcttgagtctccaacttccatccactc

SEQ ID NO: 55885 - DNA, 201 bp, Bos taurus
tgaaaacccattccagtactcttgcctgggaattcccatggacagaggagcctggcaggctacagtccatgggattgcaaagagtgggacacgactaggcacatgtttgcacacagcatgcctacatcttagcctatatcctttacatcttctcctctcatcagaggtacattctccttcctgctgtctaagaccaacatc

SEQ ID NO: 55886 - DNA, 201 bp, Bos taurus
ttcttaccagactttacagagacactgcaaggttctccgtggggactgagaagagcgtactgcaccgtgcctggatgaggaggttgataatgagtgatgcaggaggttaaaagtactgccagtagcagcatcctcatctctagcaacatatacaggaaaactagcatccagccccacaaccccagatgggtgttatccttt

SEQ ID NO: 55887 - DNA, 201 bp, Bos taurus; identical to SEQ ID NO: 15077

SEQ ID NO: 55888 - DNA, 201 bp, Bos taurus; identical to SEQ ID NO: 15078

SEQ ID NO: 55889 - DNA, 201 bp, Bos taurus; identical to SEQ ID NO: 15079

SEQ ID NO: 55890 - DNA, 201 bp, Bos taurus; identical to SEQ ID NO: 15080

SEQ ID NO: 55891 - DNA, 201 bp, Bos taurus; identical to SEQ ID NO: 15081

SEQ ID NO: 55892 - DNA, 201 bp, Bos taurus; identical to SEQ ID NO: 15082

SEQ ID NO: 55893 - DNA, 201 bp, Bos taurus; identical to SEQ ID NO: 15084

SEQ ID NO: 55894 - DNA, 201 bp, Bos taurus; identical to SEQ ID NO: 15086

SEQ ID NO: 55895 - DNA, 201 bp, Bos taurus; identical to SEQ ID NO: 15087

SEQ ID NO: 55896 - DNA, 201 bp, Bos taurus
actaaagtcatttgtttgtggctgctgatagaaaatggtaaagcatataactaattatataataaatataaataatatctcctagggcctttttagtttacagagtacttgcatgtgccttgtttcatttaattattataatagtattgacaggtaatattacagcttaattacagaatagaaactaatgcctcacgtgtc

SEQ ID NO: 55897 - DNA, 201 bp, Bos taurus; identical to SEQ ID NO: 15089

SEQ ID NO: 55898 - DNA, 201 bp, Bos taurus; identical to SEQ ID NO: 15091

SEQ ID NO: 55899 - DNA, 201 bp, Bos taurus; identical to SEQ ID NO: 15094

SEQ ID NO: 55900 - DNA, 201 bp, Bos taurus; identical to SEQ ID NO: 15095

SEQ ID NO: 55901 - DNA, 201 bp, Bos taurus; identical to SEQ ID NO: 15097

SEQ ID NO: 55902 - DNA, 201 bp, Bos taurus; identical to SEQ ID NO: 15098

SEQ ID NO: 55903 - DNA, 201 bp, Bos taurus; identical to SEQ ID NO: 15100

SEQ ID NO: 55904 - DNA, 201 bp, Bos taurus; identical to SEQ ID NO: 15101

SEQ ID NO: 55905 - DNA, 201 bp, Bos taurus; identical to SEQ ID NO: 15102

SEQ ID NO: 55906 - DNA, 201 bp, Bos taurus
caagcccagatttctattgttccatagttccttcctttttctcctgaattaggtttcatctccatatctccacttaaagataaattatgctcataagaagaagtgcagacagactttgaatttcaatttagttttacttccattatattgcaaatgccttcaaaagctatgctaatctgttattttaaactgctttattac

SEQ ID NO: 55907 - DNA, 201 bp, Bos taurus; identical to SEQ ID NO: 15103

SEQ ID NO: 55908 - DNA, 201 bp, Bos taurus; identical to SEQ ID NO: 15104

SEQ ID NO: 55909 - DNA, 201 bp, Bos taurus; identical to SEQ ID NO: 15105

SEQ ID NO: 55910 - DNA, 201 bp, Bos taurus; identical to SEQ ID NO: 15106

SEQ ID NO: 55911 - DNA, 201 bp, Bos taurus; identical to SEQ ID NO: 15108

SEQ ID NO: 55912 - DNA, 201 bp, Bos taurus; identical to SEQ ID NO: 15110

SEQ ID NO: 55913 - DNA, 201 bp, Bos taurus; identical to SEQ ID NO: 15112

SEQ ID NO: 55914 - DNA, 201 bp, Bos taurus; identical to SEQ ID NO: 15113

SEQ ID NO: 55915 - DNA, 201 bp, Bos taurus; identical to SEQ ID NO: 15114

SEQ ID NO: 55916 - DNA, 201 bp, Bos taurus; identical to SEQ ID NO: 15115

SEQ ID NO: 55917 - DNA, 201 bp, Bos taurus
ttgtctcagactgcatagataatgaaaaatggcctgcttacactgcaagagtagcaaaaagatatgtttgtttgtgtgtgtgtgtgtgtgtcttgtctttggggccagaaaagaagtagaatgactaacgcaaacactgaacaaaattaatacatatttttatcatccttaatttctaacaaattgcaagaaatgactgga

SEQ ID NO: 55918 - DNA, 201 bp, Bos taurus
tctatccaatatatcttgcataatccaacatatgtaactttcaacacagtaggcaagactcacaaaataaacattaatatcctctcaaattagagactgcctgttattagactacaaggtttgattgttttttatttttccttgccccctgttcttacagttaagagttgggtagttgctggttttatgtaatagcaattc

SEQ ID NO: 55919 - DNA, 201 bp, Bos taurus
gggaaaggctacccactccagtattctggccaggagaattccatagactatatagtccatggggtctcaaagagtcccacacaactcaaagactttcactctcaactcaatcttaagagtcagggaagagtgtctgtataaacagtcccaatataggtttcaactccatgtgattctttatcttcctgctcatctctggct

SEQ ID NO: 55920 - DNA, 201 bp, Bos taurus
aagaatctgataattcagttccaccccaggcctatgctaatattcagccaattgtggaatgccttgacctctgtggaagatgcattcgggttctgtgcagtatcagattgggagtttgggcccagatacaatttttattagaaattgagagtcaggcataataaggaggggggattttgatcacaaaagaaatgtatagga

SEQ ID NO: 55921 - DNA, 201 bp, Bos taurus; identical to SEQ ID NO: 15118

SEQ ID NO: 55922 - DNA, 201 bp, Bos taurus; identical to SEQ ID NO: 15119

SEQ ID NO: 55923 - DNA, 201 bp, Bos taurus; identical to SEQ ID NO: 15120

SEQ ID NO: 55924 - DNA, 201 bp, Bos taurus; identical to SEQ ID NO: 15121

SEQ ID NO: 55925 - DNA, 201 bp, Bos taurus; identical to SEQ ID NO: 15122

SEQ ID NO: 55926 - DNA, 201 bp, Bos taurus; identical to SEQ ID NO: 15123

SEQ ID NO: 55927 - DNA, 201 bp, Bos taurus; identical to SEQ ID NO: 15125

SEQ ID NO: 55928 - DNA, 201 bp, Bos taurus; identical to SEQ ID NO: 15126

SEQ ID NO: 55929 - DNA, 201 bp, Bos taurus; identical to SEQ ID NO: 15127

SEQ ID NO: 55930 - DNA, 201 bp, Bos taurus; identical to SEQ ID NO: 15128

SEQ ID NO: 55931 - DNA, 201 bp, Bos taurus
gttattcacattgtctctctgacccaacctcagaagtttttgatcgtttctttgttttctggtatgaaaacatatcccagttcatagtaaatattttctggcacagatctgaaacctaataatcctattttctttcagtgggattggttattttgagaatattatgtgacttgtagatgtgctcatagctagtggtttagt

SEQ ID NO: 55932 - DNA, 201 bp, Bos taurus
ccgtcaatctagggtaataaaacaattcaaggttttacttaatcccaggcatccaaagttaccagtgactgttggctcaacaaaaacaagttatttggagttgggacagatgagaaggaatctgtgttgagggtagcatttctcagagtgctcagctttcaaatccttgagaatatcctctctaaatctcccttgcttttt

SEQ ID NO: 55933 - DNA, 201 bp, Bos taurus; identical to SEQ ID NO: 15129

SEQ ID NO: 55934 - DNA, 201 bp, Bos taurus
aaggcctggtgaagtacagtttggtcctgctgataaagggaactagctagggggagagccttttccactgagtaggaggtatatctggtgagagaagcaggacttatggttataggccttagggaccccgtgaggctccaagatgtcaaagcagcatttaatattgcaagttaatgtcaagcctcccattacaacatgaaa

SEQ ID NO: 55935 - DNA, 201 bp, Bos taurus; identical to SEQ ID NO: 15131

SEQ ID NO: 55936 - DNA, 201 bp, Bos taurus
gctttcagtggctttaattttcaatggtaagcacagcttctatatagtgttgtcaaaaccgcaatgaagtcatgtcattgaatattaaaggcccggcccgcggaatgccaacacagagatttgaatttcatgctcgctcctaaacatcaagacaaatatgtctaatttcataaaaacccggccagccccagggaggctgac

SEQ ID NO: 55937 - DNA, 201 bp, Bos taurus; identical to SEQ ID NO: 15132

SEQ ID NO: 55938 - DNA, 201 bp, Bos taurus; identical to SEQ ID NO: 15133

SEQ ID NO: 55939 - DNA, 201 bp, Bos taurus; identical to SEQ ID NO: 15134

SEQ ID NO: 55940 - DNA, 201 bp, Bos taurus
gcccacaggcccacttcagccctgcctgtcacaaggtgtgaaggaccctggaggcaggacccaaggtgggtggaggggcccaaatgactgggaccctgcccagctcctttccctgtcttctgtgggaagtggaggtgccgggcattgtctaaagatggaagggagccagttaacctctgtcaggccgtgtcttgggcacat

SEQ ID NO: 55941 - DNA, 201 bp, Bos taurus
aaaaggaagtggccctgcgccccagccatgaaccccccacatagggaaacttggagcctgggggcccacgtctggtctctccaccagcccgggcccccgcctgtctcagtctctctctggcaggacgaaggttggggcaagtgtgacagcccgtccgtgagacgttcatttccactccgtgcagagcaggtgcaggccagt

SEQ ID NO: 55942 - DNA, 201 bp, Bos taurus; identical to SEQ ID NO: 15136

SEQ ID NO: 55943 - DNA, 201 bp, Bos taurus; identical to SEQ ID NO: 15137

SEQ ID NO: 55944 - DNA, 201 bp, Bos taurus; identical to SEQ ID NO: 15139

SEQ ID NO: 55945 - DNA, 201 bp, Bos taurus
taacagatttttacctttcaaatgaaatatttcaggaaaatgcctacagtgattggaagttgttgcactgtttaatcttggccagcctggggaccagctgtgatgtgaaggaattaaatgcagggctttagattgagaaaacctgagtatggccagtcagttaacctctctgagcctcagtttacctgcttgtaaaatgga

SEQ ID NO: 55946 - DNA, 201 bp, Bos taurus
cacataggccacagagaagagggaaagcaaagaataagatgatatgaaagaaaggaagcagcagagaagggagaaaaagcccagcaggagagaggagagaagcagcaggcagcgggccctgctcaggagggaaggaagctgccccagacctcgggatcctccaggagacaggccccgtgctctggcttcagccctgcgtca

SEQ ID NO: 55947 - DNA, 201 bp, Bos taurus
ccctcgccacttgaaccagtgtctggcttcgtttatctttgacatcaagtctagcctcagggactcatctttcttggggccgttccccactgcaaccacttctcttccccacctcaactgagaagacagggctgacccccctcacacacaccccacgggccagtccgtcctctccttctcccagagctcctcttcgtcctg

SEQ ID NO: 55948 - DNA, 201 bp, Bos taurus; identical to SEQ ID NO: 15141

SEQ ID NO: 55949 - DNA, 201 bp, Bos taurus; identical to SEQ ID NO: 15142

SEQ ID NO: 55950 - DNA, 201 bp, Bos taurus
caggatcctatggaatgactaatttgtgtgggggcccagcatacatgaaacctcggtgcctgcaagagtgatgtttctatttcccccagtcctgtggaactcccacagtcaaaacccactggccttcaaagccaaatattctagagattccccctccctatgccagtccctcaggctgtggagcctgatgtgtggggctca

SEQ ID NO: 55951 - DNA, 201 bp, Bos taurus
tctgagccccaggttccttatcgatgaaatggggagacatacttctcaaggtgtgaagaaacattaagacagtgtgcagagagcacggccagctcagagtcgctcgctgtcggaacgttccacagcgttctgagcagctgtggacggtctggcagccctgagagccgaaggtccccacacataccactgctcccaaggcct

SEQ ID NO: 55952 - DNA, 201 bp, Bos taurus
ggggaattggtctgagttaggaaaaggcaaaaggatatttcaggtggacaaaacaatatgagttaaaatagggagacagaaaaatcaagggacttctgggaacaatgaacagaaaaatggggagatgtggttgtgtgtttggaaaagggaaatctcattctacttcatgtctcaagtagaatgagtataagaaagagactt

SEQ ID NO: 55953 - DNA, 201 bp, Bos taurus; identical to SEQ ID NO: 15144

SEQ ID NO: 55954 - DNA, 201 bp, Bos taurus; identical to SEQ ID NO: 15145

SEQ ID NO: 55955 - DNA, 201 bp, Bos taurus
ggaggggcatggcaactcactccagtattcctgcctggagaatcccatggatagtgggctacaattcatggcactgcaaagtgtcagacactattgaagcaactcagcacacatgcacacatctgattaattgctgttctttgggaggggatggaggccaccattttggtgacttcactctgcctaattcttcccaaagtc

SEQ ID NO: 55956 - DNA, 201 bp, Bos taurus; identical to SEQ ID NO: 15146

SEQ ID NO: 55957 - DNA, 201 bp, Bos taurus
gtatatttttaatactaagttgacattgactgacatgcaaggaaataagcatacacatcattgcttggggacaaacccaacttggtaaagactcattttgtattgtttggcaatgtctgtgcttagatcccatagttaatttctaggaattttgtctaagcaaattatgaggaatatgttgaaggatttttgtataaggct

SEQ ID NO: 55958 - DNA, 201 bp, Bos taurus
aaacctagctacagagagaggctgtccagtttggggctaatagtgatttctctttgaaatagaaagatttaactgtgggcctgaaacacaaagggggtgtagaggcagctggtaggaatgaactttccctgaggcactgagaagagtgtgctgaagattattatctttcaagatggaaatgatcataccgctcagaaaccc

SEQ ID NO: 55959 - DNA, 201 bp, Bos taurus; identical to SEQ ID NO: 15147

SEQ ID NO: 55960 - DNA, 201 bp, Bos taurus; identical to SEQ ID NO: 15149

SEQ ID NO: 55961 - DNA, 201 bp, Bos taurus; identical to SEQ ID NO: 15150

SEQ ID NO: 55962 - DNA, 201 bp, Bos taurus
tttgaatatgctatctaggttggtcataactttccttccaaggagggcatttaaattattattattattgttattttggctgttctctgaaatcttagttcccccaccagggatcaaaagctgtattgggatcttggagtcttaaccactagacttccacagaagtctcaagcctttttgaataggatcagtctcgagaag

SEQ ID NO: 55963 - DNA, 201 bp, Bos taurus
agagagaaagacccaggttagagaagaaaagagttattgaaaatgtaggggcattgttgaaaaatgcagatggttggatgcgtgtggatgtcttgtgtgcatagccccctgacatagtgtgcaccgtcggctgtcaacttgaaattttctgtacagtggctcctgagaggttttgttgttttttattttttaatcagctaa

SEQ ID NO: 55964 - DNA, 201 bp, Bos taurus
atgccaattgtattaaagaaaatgacccatatatataacttctctggaagaaaaatccaagaaaacaacagggctggcctctgcagtagggaactgaaagattgagagggatttgaggaaaacttattcttcctgcagatcattagtttttacaagactgtacttttacaaaacatggccaataattactttttccaaaaa

SEQ ID NO: 55965 - DNA, 201 bp, Bos taurus; identical to SEQ ID NO: 15152

SEQ ID NO: 55966 - DNA, 201 bp, Bos taurus
gaatctgctgtggggttgagaacacaccaagttaagaaaacaggttctggtgtctctttccctgtttaaggcttccaaaccaagcctgctaataccaatcgcgtatgttatggaggacactgtattcctaattattttagggtaatgtatttagctacacactaaattaacactaattgaacttggaagaggttcagaaag

SEQ ID NO: 55967 - DNA, 201 bp, Bos taurus; identical to SEQ ID NO: 15154

SEQ ID NO: 55968 - DNA, 201 bp, Bos taurus; identical to SEQ ID NO: 15156

SEQ ID NO: 55969 - DNA, 201 bp, Bos taurus; identical to SEQ ID NO: 15158

SEQ ID NO: 55970 - DNA, 201 bp, Bos taurus; identical to SEQ ID NO: 15159

SEQ ID NO: 55971 - DNA, 201 bp, Bos taurus; identical to SEQ ID NO: 15160

SEQ ID NO: 55972 - DNA, 201 bp, Bos taurus; identical to SEQ ID NO: 15162

SEQ ID NO: 55973 - DNA, 201 bp, Bos taurus
ttctgcactggtgtctttctgaattttagtttaaagctcattagcctatttgtctgttttttgtgcaaaaaccatgctggaaattcttggttggcccagcttatattttgacaaatataccaatatgggtccatcatgtttgagatcagattaggaatgcccaccctgctgaatttgactcaagacaagatttattttaat

SEQ ID NO: 55974 - DNA, 201 bp, Bos taurus
gaaagtctgcgttattgtttacatttgggtataatgacagcaaccaatgtatagtgcaatacagtgtaaggaattcatgtgtatatcatagactacttgacgtagaaccaaatggaaaattgtagagaccttgctctaatgtaatcttcagttacctgattcattaatcatttgtatggtacttaaagactgctgttctcc

SEQ ID NO: 55975 - DNA, 201 bp, Bos taurus
gatttagtcatttcatgtcaaagtgtgatccagtacagagattctaatttgagaaatcgccggggacccaggcttcttcctttttaagcttggccatcctttcaggttcaagacactcatccttgtgtccaaatgacggaacgcacacctccacttttctagagcacagtctgaatctcacctgtgttgggttggccaaaa

SEQ ID NO: 55976 - DNA, 201 bp, Bos taurus; identical to SEQ ID NO: 15163

SEQ ID NO: 55977 - DNA, 201 bp, Bos taurus; identical to SEQ ID NO: 15166

SEQ ID NO: 55978 - DNA, 201 bp, Bos taurus; identical to SEQ ID NO: 15167

SEQ ID NO: 55979 - DNA, 201 bp, Bos taurus; identical to SEQ ID NO: 15168

SEQ ID NO: 55980 - DNA, 201 bp, Bos taurus; identical to SEQ ID NO: 15169

SEQ ID NO: 55981 - DNA, 201 bp, Bos taurus; identical to SEQ ID NO: 15170

SEQ ID NO: 55982 - DNA, 201 bp, Bos taurus; identical to SEQ ID NO: 15171

SEQ ID NO: 55983 - DNA, 201 bp, Bos taurus; identical to SEQ ID NO: 15172

SEQ ID NO: 55984 - DNA, 201 bp, Bos taurus
tcctttaaggttcagcagacgtctcttctctgttctccctcaccaacgacacagccttagcaggaacttctctcttaattagccttgagtaagaatttctcaacagagtgctggaaccactttgtcccaaatagcattatgattttcttctaatcagttcagttcagtcactcagttgtgtctgactcttgtgactccatg

SEQ ID NO: 55985 - DNA, 201 bp, Bos taurus; identical to SEQ ID NO: 15173

SEQ ID NO: 55986 - DNA, 201 bp, Bos taurus; identical to SEQ ID NO: 15174

SEQ ID NO: 55987 - DNA, 201 bp, Bos taurus; identical to SEQ ID NO: 15175

SEQ ID NO: 55988 - DNA, 201 bp, Bos taurus; identical to SEQ ID NO: 15179

SEQ ID NO: 55989 - DNA, 201 bp, Bos taurus; identical to SEQ ID NO: 15180

SEQ ID NO: 55990 - DNA, 201 bp, Bos taurus; identical to SEQ ID NO: 15181

SEQ ID NO: 55991 - DNA, 201 bp, Bos taurus; identical to SEQ ID NO: 15182

SEQ ID NO: 55992 - DNA, 201 bp, Bos taurus; identical to SEQ ID NO: 15184

SEQ ID NO: 55993 - DNA, 201 bp, Bos taurus; identical to SEQ ID NO: 15185

SEQ ID NO: 55994 - DNA, 201 bp, Bos taurus; identical to SEQ ID NO: 15186

SEQ ID NO: 55995 - DNA, 201 bp, Bos taurus; identical to SEQ ID NO: 15188

SEQ ID NO: 55996 - DNA, 201 bp, Bos taurus; identical to SEQ ID NO: 15189

SEQ ID NO: 55997 - DNA, 201 bp, Bos taurus; identical to SEQ ID NO: 15197

SEQ ID NO: 55998 - DNA, 201 bp, Bos taurus; identical to SEQ ID NO: 15198

SEQ ID NO: 55999 - DNA, 201 bp, Bos taurus; identical to SEQ ID NO: 15199

SEQ ID NO: 56000 - DNA, 201 bp, Bos taurus; identical to SEQ ID NO: 15200

SEQ ID NO: 56001 - DNA, 201 bp, Bos taurus; identical to SEQ ID NO: 15201

SEQ ID NO: 56002 - DNA, 201 bp, Bos taurus; identical to SEQ ID NO: 15202

SEQ ID NO: 56003 - DNA, 201 bp, Bos taurus; identical to SEQ ID NO: 15203

SEQ ID NO: 56004 - DNA, 201 bp, Bos taurus; identical to SEQ ID NO: 15204

SEQ ID NO: 56005 - DNA, 201 bp, Bos taurus; identical to SEQ ID NO: 15205

SEQ ID NO: 56006 - DNA, 201 bp, Bos taurus; identical to SEQ ID NO: 15206

SEQ ID NO: 56007 - DNA, 201 bp, Bos taurus; identical to SEQ ID NO: 15207

SEQ ID NO: 56008 - DNA, 201 bp, Bos taurus; identical to SEQ ID NO: 15208

SEQ ID NO: 56009 - DNA, 201 bp, Bos taurus; identical to SEQ ID NO: 15209

SEQ ID NO: 56010 - DNA, 201 bp, Bos taurus; identical to SEQ ID NO: 15210

SEQ ID NO: 56011 - DNA, 201 bp, Bos taurus; identical to SEQ ID NO: 15212

SEQ ID NO: 56012 - DNA, 201 bp, Bos taurus; identical to SEQ ID NO: 15214

SEQ ID NO: 56013 - DNA, 201 bp, Bos taurus; identical to SEQ ID NO: 15215

SEQ ID NO: 56014 - DNA, 201 bp, Bos taurus; identical to SEQ ID NO: 15216

SEQ ID NO: 56015 - DNA, 201 bp, Bos taurus; identical to SEQ ID NO: 15218

SEQ ID NO: 56016 - DNA, 201 bp, Bos taurus; identical to SEQ ID NO: 15219

SEQ ID NO: 56017 - DNA, 201 bp, Bos taurus; identical to SEQ ID NO: 15220

SEQ ID NO: 56018 - DNA, 201 bp, Bos taurus; identical to SEQ ID NO: 15221

SEQ ID NO: 56019 - DNA, 201 bp, Bos taurus
tctgccgtccatttcggagttctccatgcctcctctcaaggctgctcttgatggccacttctaatgctattaaaaatgttaggggatgagaacactcagtagtttgccccgggcccctcttcaggctctgagagcaccagtatttcaccttgattgcatttgttccatgataatattggatgagtttgttaattttctatt

SEQ ID NO: 56020 - DNA, 201 bp, Bos taurus; identical to SEQ ID NO: 15222

SEQ ID NO: 56021 - DNA, 201 bp, Bos taurus; identical to SEQ ID NO: 15223

SEQ ID NO: 56022 - DNA, 201 bp, Bos taurus; identical to SEQ ID NO: 15224

SEQ ID NO: 56023 - DNA, 201 bp, Bos taurus
agagctcctgacctaagggcttccacgtattgatgggcacaagggggcccaagaggtgacatcacatggctgagatcacgcagcttgggaatggcctatttgcaggtgggtgaggtttttctgagtggtgcacatttgaccttggagctcctttctcaccccagctcaacccgtgtgctcccgttcccaggagctggccca

SEQ ID NO: 56024 - DNA, 201 bp, Bos taurus; identical to SEQ ID NO: 15226

SEQ ID NO: 56025 - DNA, 201 bp, Bos taurus; identical to SEQ ID NO: 15227

SEQ ID NO: 56026 - DNA, 201 bp, Bos taurus; identical to SEQ ID NO: 15228

SEQ ID NO: 56027 - DNA, 201 bp, Bos taurus; identical to SEQ ID NO: 15229

SEQ ID NO: 56028 - DNA, 201 bp, Bos taurus; identical to SEQ ID NO: 15230

SEQ ID NO: 56029 - DNA, 201 bp, Bos taurus; identical to SEQ ID NO: 15231

SEQ ID NO: 56030 - DNA, 201 bp, Bos taurus; identical to SEQ ID NO: 15232

SEQ ID NO: 56031 - DNA, 201 bp, Bos taurus
caactgcgatggtctcctgggggagaggctgaagaggttcagacttgttgggagcggtcatcactacctaagccatgatgcttctccaaataatttaggttttttttttttggccatgctgtgttgcatgtgggatcttagtcctctcccaggagttgaatctgcgccctcctgtattggaagcatggaatcttaaccact

SEQ ID NO: 56032 - DNA, 201 bp, Bos taurus; identical to SEQ ID NO: 15235

SEQ ID NO: 56033 - DNA, 201 bp, Bos taurus; identical to SEQ ID NO: 15236

SEQ ID NO: 56034 - DNA, 201 bp, Bos taurus
gcttataacccatattcctttctatccttggcaactctatctgccaggcattatgcctatccctatagcatatatcaacaaagatgtggtttctgctctcagatagttagcactctatatataagacatgtgtgtttcaggaaaagtagctcctgcctatgcttcttccatggaattatcatttctttttgaaagactata

SEQ ID NO: 56035 - DNA, 201 bp, Bos taurus; identical to SEQ ID NO: 15238

SEQ ID NO: 56036 - DNA, 201 bp, Bos taurus
gttttacacacaggaagcctaaccatcacaaaaaccctaaagggtagatttccagtctgttgttgctgtgaagacagtctggccaaaatggggttagtaaatttcctgctgtcacacagatagcaaatgagggagctgagactgactcctgatctttctggtaccaaggcccatagtctttgcactcaatgatattggggt

SEQ ID NO: 56037 - DNA, 201 bp, Bos taurus; identical to SEQ ID NO: 15239

SEQ ID NO: 56038 - DNA, 201 bp, Bos taurus; identical to SEQ ID NO: 15240

SEQ ID NO: 56039 - DNA, 201 bp, Bos taurus; identical to SEQ ID NO: 15241

SEQ ID NO: 56040 - DNA, 201 bp, Bos taurus; identical to SEQ ID NO: 15242

SEQ ID NO: 56041 - DNA, 201 bp, Bos taurus; identical to SEQ ID NO: 15243

SEQ ID NO: 56042 - DNA, 201 bp, Bos taurus
agtgactgaacaacaagaggtatttggtgaagctgtgaaggtaaacgggacctccaggagctgagtgtggaccagagaatgaacagatgcaggcctatgacagaacttccggaactgaatcctcccttttggggtggtaggaagaatgacaggaactagcaggaaatggaaagccagtggccggaggaggatgggacacag

SEQ ID NO: 56043 - DNA, 201 bp, Bos taurus
tttgtccccaccttgatgaacactgggtccctttgccttctgtttgcagtcaactaataggtacaaaaacagagggtggaaaaagatacacacatacacggcacacacaaatgctggtgctatctcaatttacctaacttcccagaaggcctaaggctcctgtttggtaacaatctttgcagaatatctccttcttgttaa

SEQ ID NO: 56044 - DNA, 201 bp, Bos taurus; identical to SEQ ID NO: 15244

SEQ ID NO: 56045 - DNA, 201 bp, Bos taurus; identical to SEQ ID NO: 15245

SEQ ID NO: 56046 - DNA, 201 bp, Bos taurus; identical to SEQ ID NO: 15246

SEQ ID NO: 56047 - DNA, 201 bp, Bos taurus
cagagagaggaataagaacatggtcttgcctctgacttgtctcaccccctcaatctcatcctcctttatcctggtgagatacacccagagcaggccaagcgatctttgggattttaagctttcagatagggccctgagtcgcagcaattgccttagaggtcaccgggtagtgattgattgcctttatagaagtcagtcata

SEQ ID NO: 56048 - DNA, 201 bp, Bos taurus; identical to SEQ ID NO: 15247

SEQ ID NO: 56049 - DNA, 201 bp, Bos taurus
gaaatggcaaaccactcccgtactcttgtctgggaaatcccatggctggagaagcctggtaggctacagtccgtggggtagcaaagagttggatatgaccaagcgacttcagtcccagtttccgagtatcccgacaatcgagagaacacaagcagcaatgagttcagttgggttacagaggcccgattctaagtgcgtgaa

SEQ ID NO: 56050 - DNA, 201 bp, Bos taurus; identical to SEQ ID NO: 15248

SEQ ID NO: 56051 - DNA, 201 bp, Bos taurus; identical to SEQ ID NO: 15249

SEQ ID NO: 56052 - DNA, 201 bp, Bos taurus
gatgccgggagggattgggggcaggaggagaaggggacgacggaggatgagatggctggacggcaccaccgacccgatgaacatgagctggggtgaactccgggagttggtgctggacagggaggcccggcgtgctgcaattcatggggttgcaaagagtcggacatgactgagcgactgaaccgaattctcagggcttgt

SEQ ID NO: 56053 - DNA, 201 bp, Bos taurus; identical to SEQ ID NO: 15250

SEQ ID NO: 56054 - DNA, 201 bp, Bos taurus; identical to SEQ ID NO: 15251

SEQ ID NO: 56055 - DNA, 201 bp, Bos taurus
cgtgttcattgactaacacccattttcaggctttgtctaatttttcctttgtgaagattagggaataattggatagatctggcctttgaggtgtaaggggtaggtgccaagtcactgtttctaggaccaccctttgggcagttgtatccaccttgtttccccttcttacctctgaaccccactttgggtggcccctacaat

SEQ ID NO: 56056 - DNA, 201 bp, Bos taurus; identical to SEQ ID NO: 15252

SEQ ID NO: 56057 - DNA, 201 bp, Bos taurus; identical to SEQ ID NO: 15253

SEQ ID NO: 56058 - DNA, 201 bp, Bos taurus; identical to SEQ ID NO: 15256

SEQ ID NO: 56059 - DNA, 201 bp, Bos taurus
ccttaaaagagatgcacagtctcaaatcctcatgaaaacgacagtaccaactactctgaactattcatatgtgtgagaatgaatcttgggtatctgcctccaagctgatatcatttaaacaacattctgattggtacccatcctgcggatcaaaactctgtggtaccaaaccacttacaaaaagtaaaatatttttaccca

SEQ ID NO: 56060 - DNA, 201 bp, Bos taurus; identical to SEQ ID NO: 15258

SEQ ID NO: 56061 - DNA, 201 bp, Bos taurus; identical to SEQ ID NO: 15259

SEQ ID NO: 56062 - DNA, 201 bp, Bos taurus; identical to SEQ ID NO: 15260

SEQ ID NO: 56063 - DNA, 201 bp, Bos taurus
gtggttacctcgtgcccttcacagggttgttgttgcaaggctcccacttgccagagccaacaatgcttgactctatgtagtacccgaccagctctttagcatctttgggttcctcccatgtaacgaccactgatgtgtctgtgtttctgcttgggatgatattgcttggaggcttggggatgtctgagaaaagaagaaaat

SEQ ID NO: 56064 - DNA, 201 bp, Bos taurus; identical to SEQ ID NO: 15261

SEQ ID NO: 56065 - DNA, 201 bp, Bos taurus
gataaagcagcgttgcttcttcaccattttgtggtgcccttaccaatgattgttatcgattttttcggggaaccagaacacctgcatgatggccacattttggggaatcagaacacctccaggatggccacactctcaagggtgttatgggggcctccaagcactccggtagcttttcagcatttgtaagaagacttcgcc

SEQ ID NO: 56066 - DNA, 201 bp, Bos taurus; identical to SEQ ID NO: 15262

SEQ ID NO: 56067 - DNA, 201 bp, Bos taurus
aacagggccagcattagatcagctgatttgactcataaaactctgaaggacacattttcaaagtttcacccacttacatgtgacagaagtcattgagtagctggcccattttaagataagtggtcataaaggacactcaggatctccggggagggacatagctccccatgacgactcctgtgcaatcagggctgagaatct

SEQ ID NO: 56068 - DNA, 201 bp, Bos taurus
cagcctctgccccttctttcttttgggttcatctgccagggagaaggccacctgctggtctgcatgctgccttgcaatcggggcctctgctgggggcgctagaactcacagcttcacaagtgtccatgcggattaagaggggagtctggtaaggcccaccggctgcagtcctgagtggattccactcactgaggctagtgg

SEQ ID NO: 56069 - DNA, 201 bp, Bos taurus
atatgtgcacttgtagctgattcatatggatgtatggcaaaaaccactacaatatcgtaaatagccaccaattaaaataaattaattaatttgttaaaagacaaaaaaagaagggttgggaggaaaggtttagaattcttttagaattccagaatgagttagctaattgcccccatagagtaggggaggaaccacagggga

SEQ ID NO: 56070 - DNA, 201 bp, Bos taurus; identical to SEQ ID NO: 15263

SEQ ID NO: 56071 - DNA, 201 bp, Bos taurus; identical to SEQ ID NO: 15264

SEQ ID NO: 56072 - DNA, 201 bp, Bos taurus; identical to SEQ ID NO: 15266

SEQ ID NO: 56073 - DNA, 201 bp, Bos taurus; identical to SEQ ID NO: 15268

SEQ ID NO: 56074 - DNA, 201 bp, Bos taurus; identical to SEQ ID NO: 15269

SEQ ID NO: 56075 - DNA, 201 bp, Bos taurus; identical to SEQ ID NO: 15272

SEQ ID NO: 56076 - DNA, 201 bp, Bos taurus
cactctaagttggaaactaagaggtaataaaaatagaagaaagatatttcaatgcaaaaatcctcattacaggaaagtgagtttcaaaggactgtgggcctgagaagcatctgaggggcttggtaaaaatgtcaatccctaggctccactctactctactccatagctctgatctccacaaggagatcaaaccagcccatc

SEQ ID NO: 56077 - DNA, 201 bp, Bos taurus; identical to SEQ ID NO: 15273

SEQ ID NO: 56078 - DNA, 201 bp, Bos taurus
gatttgtactggaaatgttgtgacgtcctatgattgttccaggatgtcttatttattacaactcactcatctgccatcatggttataatgctttaaacaaattttgcattttaggtaatggaagagtgtggatggaggtggggacaaatttaattttcatgattggatagagaagttaatggttaaccttatgccctacct

SEQ ID NO: 56079 - DNA, 201 bp, Bos taurus; identical to SEQ ID NO: 15275

SEQ ID NO: 56080 - DNA, 201 bp, Bos taurus; identical to SEQ ID NO: 15276

SEQ ID NO: 56081 - DNA, 201 bp, Bos taurus; identical to SEQ ID NO: 15278

SEQ ID NO: 56082 - DNA, 201 bp, Bos taurus; identical to SEQ ID NO: 15279

SEQ ID NO: 56083 - DNA, 201 bp, Bos taurus
tgttgcaggggccccaagcccaggtgacttcctgggggaacaagtgacacgagtgggtgaagcctcagagaagaggcctctgctcagctccaggtaggaatatgcacccagttttgccagatctgctgagttttcataaaagccccatgtctggaattttcaaagtgaaaatatcctgatccatgtggccaagccattcag

SEQ ID NO: 56084 - DNA, 201 bp, Bos taurus
tatgcagatttgctaaggaaaagcctttctcaaggtacaatggaggcgtgtgtgtgtattgatgtaagagagagaacaatagagaagcagatcaccacccgtctggcttgcatcacctttccttcatcacgtatttgatcttgggtttagtcctgattcggagaaggcaatggcaccccactccagtactcttgcctggaa

SEQ ID NO: 56085 - DNA, 201 bp, Bos taurus; identical to SEQ ID NO: 15282

SEQ ID NO: 56086 - DNA, 201 bp, Bos taurus; identical to SEQ ID NO: 15283

SEQ ID NO: 56087 - DNA, 201 bp, Bos taurus; identical to SEQ ID NO: 15284

SEQ ID NO: 56088 - DNA, 201 bp, Bos taurus; identical to SEQ ID NO: 15285

SEQ ID NO: 56089 - DNA, 201 bp, Bos taurus; identical to SEQ ID NO: 15286

SEQ ID NO: 56090 - DNA, 201 bp, Bos taurus; identical to SEQ ID NO: 15287

SEQ ID NO: 56091 - DNA, 201 bp, Bos taurus; identical to SEQ ID NO: 15288

SEQ ID NO: 56092 - DNA, 201 bp, Bos taurus; identical to SEQ ID NO: 15289

SEQ ID NO: 56093 - DNA, 201 bp, Bos taurus
ggccagaatgaaggcttcctgacaaatggctgctgcgctgacccagagcagccttgctgatagctccagggtttctgttgctgctgttattattagcatcaagccaccaggctggccacaggccgctcatcgagagctgggctgtaggacctgctgctgaggctcccacagggcctaccgccacactccaggatctaccgc

SEQ ID NO: 56094 - DNA, 201 bp, Bos taurus
tataaaactcgaccccagtattcctgaaactagacttcttggttgtgttcacagctggggttgctctccatcctaccccctcttcccttctggccttagcgccccaagggacaggtggaagcctgcccacatgccttcccctggagcccgggtgcttcttgctaggtgattaagtggcctactccatgttctgtggctaca

SEQ ID NO: 56095 - DNA, 201 bp, Bos taurus
tttctttatgtttaaaacaggaagagatgagaggcctttggaactcagtgttttcttttgagagcttcctggtaattcccatcacaaagcagggagggaagagcagggccaggatgggggaaggaggcttctccccaaaggggccttcccatccctagatcttacccccacagggcaactgagaggcttgtagactggctc

SEQ ID NO: 56096 - DNA, 201 bp, Bos taurus; identical to SEQ ID NO: 15290

SEQ ID NO: 56097 - DNA, 201 bp, Bos taurus; identical to SEQ ID NO: 15291

SEQ ID NO: 56098 - DNA, 201 bp, Bos taurus
tcttggtccccctagaaggacacacggaagcctgaactgaccttccctccctggaggggagggttctccacagcttccacggtggccagagggctccccccacaaccacacctgtgaacagtctcctctgctccaccttagggcagggaggagccccatcctatgagctttggtttgataaagacggccaggaagaaaaag

SEQ ID NO: 56099 - DNA, 201 bp, Bos taurus; identical to SEQ ID NO: 15292

SEQ ID NO: 56100 - DNA, 201 bp, Bos taurus; identical to SEQ ID NO: 15293

SEQ ID NO: 56101 - DNA, 201 bp, Bos taurus; identical to SEQ ID NO: 15294

SEQ ID NO: 56102 - DNA, 201 bp, Bos taurus
ttaaacagcactgagcatacaaaaataaatttggggataaataaagcttatttactcaataaaaggttcaccctatcattctaatcaagagaagtcccttaaaaactggacatacttcatgtgcagccttttagaagcacatactgtgtagggagagagggtttgttaggtcgagtgctccctagggcacagctctgactt

SEQ ID NO: 56103 - DNA, 201 bp, Bos taurus; identical to SEQ ID NO: 15295

SEQ ID NO: 56104 - DNA, 201 bp, Bos taurus
gtcccccaggatgaagacaacttccggctgcagcagccataccgctgtctggaaggctcgctccatctgccactccctggaggccaagaggaaaggaggggtggtgtgttccggttcttgtctacctcacacctcccggggtttaaagctctgagaggaaatacagtagccctgccttcatctgtctggcctccccaaccc

SEQ ID NO: 56105 - DNA, 201 bp, Bos taurus; identical to SEQ ID NO: 15299

SEQ ID NO: 56106 - DNA, 201 bp, Bos taurus; identical to SEQ ID NO: 15301

SEQ ID NO: 56107 - DNA, 201 bp, Bos taurus; identical to SEQ ID NO: 15302

SEQ ID NO: 56108 - DNA, 201 bp, Bos taurus; identical to SEQ ID NO: 15303

SEQ ID NO: 56109 - DNA, 201 bp, Bos taurus; identical to SEQ ID NO: 15304

SEQ ID NO: 56110 - DNA, 201 bp, Bos taurus; identical to SEQ ID NO: 15305

SEQ ID NO: 56111 - DNA, 201 bp, Bos taurus; identical to SEQ ID NO: 15306

SEQ ID NO: 56112 - DNA, 201 bp, Bos taurus; identical to SEQ ID NO: 15307

SEQ ID NO: 56113 - DNA, 201 bp, Bos taurus; identical to SEQ ID NO: 15308

SEQ ID NO: 56114 - DNA, 201 bp, Bos taurus; identical to SEQ ID NO: 15309

SEQ ID NO: 56115 - DNA, 201 bp, Bos taurus; identical to SEQ ID NO: 15310

SEQ ID NO: 56116 - DNA, 201 bp, Bos taurus
taactaagatagcagtgtcaagttctcagaacaatagtaaaggggagagattactacgatttgcccgttatccacatgcagtgccttaggcctcagtttgactagtctaatggtggaattgctgatgctcttccaacagggaacattttagggacaaggagttctcagggcctctctcaagcttgtacgtttgaaggtaga

SEQ ID NO: 56117 - DNA, 201 bp, Bos taurus; identical to SEQ ID NO: 15311

SEQ ID NO: 56118 - DNA, 201 bp, Bos taurus; identical to SEQ ID NO: 15312

SEQ ID NO: 56119 - DNA, 201 bp, Bos taurus; identical to SEQ ID NO: 15313

SEQ ID NO: 56120 - DNA, 201 bp, Bos taurus; identical to SEQ ID NO: 15314

SEQ ID NO: 56121 - DNA, 201 bp, Bos taurus
atctcagtaccccagacccctaggctggggccaggggttcagttgtgcaaatcctgaccccagaagggcaaatgggacaggaccgcaggcaattctgcgcagtggcgctgggggaaggccgccggcaggaaagacaccgagctgccttctcaacactgtgacacagattaaggggttcatggtggaattgggggaatgaaa

SEQ ID NO: 56122 - DNA, 201 bp, Bos taurus; identical to SEQ ID NO: 15319

SEQ ID NO: 56123 - DNA, 201 bp, Bos taurus; identical to SEQ ID NO: 15320

SEQ ID NO: 56124 - DNA, 201 bp, Bos taurus; identical to SEQ ID NO: 15321

SEQ ID NO: 56125 - DNA, 201 bp, Bos taurus
aggcaaggaggccaggaggaggtctgaaagacctggggacaggaagtatctaaccagagccatccttagagcgatgtgagcaggtgcactgggacagggaaatgtgagatggccagcacagagggtcaggtgcccacaactaagatgtaaactagatcagaggtagtggggacagagagggggtgatgactgttagttacc

SEQ ID NO: 56126 - DNA, 201 bp, Bos taurus
ggggacttggactaattgtccaggttagtctggacagagaccataggtgtccatctcatgcagaatggatggagagaccagaggtggggccaggttgggaaaggctccctattgtcatcgagattaatttgtgtgacctctgacggcagaaaccagaccggtgctcacctgtttcaggtgagggctcagaagagggaggcc

SEQ ID NO: 56127 - DNA, 201 bp, Bos taurus
aaaattatttgtgtctctcccaggcctggcccatccaaatctcctaggtgtggccttccattctgtatctggctcatggagaccttagaggccacatcctgaagatggcagctccatcacatgacagacgcctgggtctctgaaggaccacgtggagcagaggcccctgtctgactcccactggacatgaacatgagcaag

SEQ ID NO: 56128 - DNA, 201 bp, Bos taurus; identical to SEQ ID NO: 15322

SEQ ID NO: 56129 - DNA, 201 bp, Bos taurus
tcttttattccgctcaggagcctgccgcttgggcagggctcagtaggtacaactcacatctactgcacgtggtattggctgggatagctctaccaaggccagaagatccacttccaagacggcttgtttctgaggctggcgagttgtgttggcttcacctccatgtgggcttctccacggggcctcctgggcttcttcgaa

SEQ ID NO: 56130 - DNA, 201 bp, Bos taurus; identical to SEQ ID NO: 15323

SEQ ID NO: 56131 - DNA, 201 bp, Bos taurus; identical to SEQ ID NO: 15324

SEQ ID NO: 56132 - DNA, 201 bp, Bos taurus; identical to SEQ ID NO: 15325

SEQ ID NO: 56133 - DNA, 201 bp, Bos taurus; identical to SEQ ID NO: 15326

SEQ ID NO: 56134 - DNA, 201 bp, Bos taurus; identical to SEQ ID NO: 15327

SEQ ID NO: 56135 - DNA, 201 bp, Bos taurus; identical to SEQ ID NO: 15331

SEQ ID NO: 56136 - DNA, 201 bp, Bos taurus; identical to SEQ ID NO: 15332

SEQ ID NO: 56137 - DNA, 201 bp, Bos taurus; identical to SEQ ID NO: 15333

SEQ ID NO: 56138 - DNA, 201 bp, Bos taurus; identical to SEQ ID NO: 15335

SEQ ID NO: 56139 - DNA, 201 bp, Bos taurus; identical to SEQ ID NO: 15336

SEQ ID NO: 56140 - DNA, 201 bp, Bos taurus; identical to SEQ ID NO: 15337

SEQ ID NO: 56141 - DNA, 201 bp, Bos taurus; identical to SEQ ID NO: 15338

SEQ ID NO: 56142 - DNA, 201 bp, Bos taurus; identical to SEQ ID NO: 15339

SEQ ID NO: 56143 - DNA, 201 bp, Bos taurus; identical to SEQ ID NO: 15340

SEQ ID NO: 56144 - DNA, 201 bp, Bos taurus; identical to SEQ ID NO: 15341

SEQ ID NO: 56145 - DNA, 201 bp, Bos taurus
aaaatgttggttttgacttttatatggaagtgagggtgaagacggagggtgctatagttttgccagttcttagggactcgtgttggctgatagtcatggagtcttaacccatgttctatgctctaaacatctcaaacgtacttgctaatcttaatcctcacaacaaaccttaggaatgaataaccccatttagcagttgaa

SEQ ID NO: 56146 - DNA, 201 bp, Bos taurus; identical to SEQ ID NO: 15344

SEQ ID NO: 56147 - DNA, 201 bp, Bos taurus; identical to SEQ ID NO: 15345

SEQ ID NO: 56148 - DNA, 201 bp, Bos taurus; identical to SEQ ID NO: 15346

SEQ ID NO: 56149 - DNA, 201 bp, Bos taurus; identical to SEQ ID NO: 15347

SEQ ID NO: 56150 - DNA, 201 bp, Bos taurus; identical to SEQ ID NO: 15348

SEQ ID NO: 56151 - DNA, 201 bp, Bos taurus; identical to SEQ ID NO: 15349

SEQ ID NO: 56152 - DNA, 201 bp, Bos taurus; identical to SEQ ID NO: 15350

SEQ ID NO: 56153 - DNA, 201 bp, Bos taurus; identical to SEQ ID NO: 15351

SEQ ID NO: 56154 - DNA, 201 bp, Bos taurus; identical to SEQ ID NO: 15352

SEQ ID NO: 56155 - DNA, 201 bp, Bos taurus; identical to SEQ ID NO: 15354

SEQ ID NO: 56156 - DNA, 201 bp, Bos taurus
tagtcagggaactgagatctcacatgcttcgtggccaaaaaatcaaaacatagagcagaagcaatattataataaattcaataaagacttaaaaagaaaaatatgaacaccccacttacaaccgaggtttctagcagtcataatggctgctactagctatgcattattgacaagaaaattgacaagaaaattcatggatct

SEQ ID NO: 56157 - DNA, 201 bp, Bos taurus; identical to SEQ ID NO: 15355

SEQ ID NO: 56158 - DNA, 201 bp, Bos taurus; identical to SEQ ID NO: 15358

SEQ ID NO: 56159 - DNA, 201 bp, Bos taurus; identical to SEQ ID NO: 15359

SEQ ID NO: 56160 - DNA, 201 bp, Bos taurus; identical to SEQ ID NO: 15361

SEQ ID NO: 56161 - DNA, 201 bp, Bos taurus; identical to SEQ ID NO: 15362

SEQ ID NO: 56162 - DNA, 201 bp, Bos taurus; identical to SEQ ID NO: 15363

SEQ ID NO: 56163 - DNA, 201 bp, Bos taurus; identical to SEQ ID NO: 15364

SEQ ID NO: 56164 - DNA, 201 bp, Bos taurus; identical to SEQ ID NO: 15365

SEQ ID NO: 56165 - DNA, 201 bp, Bos taurus
atctctttaataactgcctgcacttggacagcatggaacttgctgaggcctttagactgctcagttcacccaaatcccagtatgtggaacagcccccttcttcaaaagtctaggacacttgtaggcctcaaggaagtgagaccttgactccataggagagagagtaacttcacaccctgactcaaaggagactggggggag

SEQ ID NO: 56166 - DNA, 201 bp, Bos taurus; identical to SEQ ID NO: 15366

SEQ ID NO: 56167 - DNA, 201 bp, Bos taurus; identical to SEQ ID NO: 15367

SEQ ID NO: 56168 - DNA, 201 bp, Bos taurus; identical to SEQ ID NO: 15368

SEQ ID NO: 56169 - DNA, 201 bp, Bos taurus
atgtaactacatgtttattagtttgggtttttaaaaacacactttattctacttttactatcctaagtcatctatcagtgagttaaacctttctttatgttcctaaagaacgtatgtgccatgtaatatttctactactttttcctttttctctctgaaactgttttttgttttcttaaatattcctgtttgaaatcggac

SEQ ID NO: 56170 - DNA, 201 bp, Bos taurus
ggaggattcaggaggcaggtgtcagagcagaaaaccaaagatctccactccagccaccggagtgatttcaccagcacagtgatgccaggctggcctgaacggggttccagtgattcctgtaattgactcccaaatgactgggttctattgtctccatcgctaggcgttacaagaagtggtctgagtgctgaggggcttttc

SEQ ID NO: 56171 - DNA, 201 bp, Bos taurus
cagccgccatactggttttgtagagaatcgctccagtaagccttcaacagattttcctctgggcccctgaagcagactggcctgtagcagcaaggcctcacgagactagaagcttctggtgagtagaagccatgtgtttcgactttgagtagcagcgtgaaccagggaagggcactggctgggccactgatgaatgcctgt

SEQ ID NO: 56172 - DNA, 201 bp, Bos taurus; identical to SEQ ID NO: 15371

SEQ ID NO: 56173 - DNA, 201 bp, Bos taurus; identical to SEQ ID NO: 15372

SEQ ID NO: 56174 - DNA, 201 bp, Bos taurus
cgcttctggccacatcagctgtggctgcaagactgagattctagcccagctccgtcgggtgtttgtccccttccactggagttccatcatctgtggaccgagtggcatggcacggccaccgccactggccgccgtctgtctagcgttcattcaaagagaaaccagcgacctgccagagttgacgtccgcacacagacctgg

SEQ ID NO: 56175 - DNA, 201 bp, Bos taurus; identical to SEQ ID NO: 15373

SEQ ID NO: 56176 - DNA, 201 bp, Bos taurus; identical to SEQ ID NO: 15374

SEQ ID NO: 56177 - DNA, 201 bp, Bos taurus; identical to SEQ ID NO: 15377

SEQ ID NO: 56178 - DNA, 201 bp, Bos taurus; identical to SEQ ID NO: 15378

SEQ ID NO: 56179 - DNA, 201 bp, Bos taurus; identical to SEQ ID NO: 15379

SEQ ID NO: 56180 - DNA, 201 bp, Bos taurus; identical to SEQ ID NO: 15381

SEQ ID NO: 56181 - DNA, 201 bp, Bos taurus; identical to SEQ ID NO: 15383

SEQ ID NO: 56182 - DNA, 201 bp, Bos taurus; identical to SEQ ID NO: 15384

SEQ ID NO: 56183 - DNA, 201 bp, Bos taurus; identical to SEQ ID NO: 15385

SEQ ID NO: 56184 - DNA, 201 bp, Bos taurus; identical to SEQ ID NO: 15386

SEQ ID NO: 56185 - DNA, 201 bp, Bos taurus; identical to SEQ ID NO: 15387

SEQ ID NO: 56186 - DNA, 201 bp, Bos taurus; identical to SEQ ID NO: 15388

SEQ ID NO: 56187 - DNA, 201 bp, Bos taurus; identical to SEQ ID NO: 15389

SEQ ID NO: 56188 - DNA, 201 bp, Bos taurus; identical to SEQ ID NO: 15390

SEQ ID NO: 56189 - DNA, 201 bp, Bos taurus
aagagctaagagcccacatgactcatggccacgaaaccaaaacataaaacagaattaatattgtaacaaatgctacaaaggctttaaaaatggttcacatcatttaaaaagtatatggccttatacgtgtaaatgtacacctggctgaagatatactgtgatgggatatagatgcatattataaccaagtaaagggaactt

SEQ ID NO: 56190 - DNA, 201 bp, Bos taurus; identical to SEQ ID NO: 15391

SEQ ID NO: 56191 - DNA, 201 bp, Bos taurus; identical to SEQ ID NO: 15392

SEQ ID NO: 56192 - DNA, 201 bp, Bos taurus; identical to SEQ ID NO: 15393

SEQ ID NO: 56193 - DNA, 201 bp, Bos taurus; identical to SEQ ID NO: 15394

SEQ ID NO: 56194 - DNA, 201 bp, Bos taurus; identical to SEQ ID NO: 15395

SEQ ID NO: 56195 - DNA, 201 bp, Bos taurus
ttgtaaggtttccaagcatctcaaaaaaagattctttagattacaagtgatgcctaagtctagagcgcttctgacaggcaaagtttcgttacattcggtaccctgtttccttgatttttgttgctgggagggattgaggcaggagaaaaaggggacgacagaggatgagatggctggatggcatcaccaactcgatggacg

SEQ ID NO: 56196 - DNA, 201 bp, Bos taurus; identical to SEQ ID NO: 15396

SEQ ID NO: 56197 - DNA, 201 bp, Bos taurus; identical to SEQ ID NO: 15397

SEQ ID NO: 56198 - DNA, 201 bp, Bos taurus
aagtgggtgtgggttggggcagccgaaaaatgacagctgggtggcagctgacgttggccgtcggagaggcaacaaagaacaagaaacagaccgggccgccagcgcctctcacaacccacgcgactcaggcagtctgtcttgaaatatgtaaggacgctgcaaagaaaagaacaattccaactgtaagaacacccctgcgga

SEQ ID NO: 56199 - DNA, 201 bp, Bos taurus; identical to SEQ ID NO: 15400

SEQ ID NO: 56200 - DNA, 201 bp, Bos taurus
acaccaccccctttcaacaggccctggcacccaagatctgtgctgggtcccctgtcaagctttgcctttcccacagtgaatggaagcatgcggtgtgcagctactggagtctggcctccttcacttagcaaggtgctcctttctgcttgtatcaatggtttgttcctttttattgctgagtaatgttcttttgcctgaata

SEQ ID NO: 56201 - DNA, 201 bp, Bos taurus; identical to SEQ ID NO: 15403

SEQ ID NO: 56202 - DNA, 201 bp, Bos taurus
tagtgttgtgtctcataattctgtgggccaggaattcagacagggagctaacagcaagagtgacttgtgtctgctgcagaatgtctgggcacacagctggcggctgtgggcctctctcgcctttcctctctgtgcatgtctatggcgcggcgtctccggggaaccactgttcctataggcctggggtcccagagcaagtgt

SEQ ID NO: 56203 - DNA, 201 bp, Bos taurus
ttgcaggggaaggtaaacaggccgtcagcacagaccgaggatccgagagacagacgtgtggggacttggtgtgtgaaaggtggtgtttcagagaaccatcaaagtgtgtgtgagcagtggtaccggctggctttccagttgggaaaaattatataattagatccctacttctgtcgcgcacagaacgtttcaagtgaatag

SEQ ID NO: 56204 - DNA, 201 bp, Bos taurus; identical to SEQ ID NO: 15404

SEQ ID NO: 56205 - DNA, 201 bp, Bos taurus; identical to SEQ ID NO: 15405

SEQ ID NO: 56206 - DNA, 201 bp, Bos taurus
ctatgtttatagagtggtattttcttactagaaaagtcattcatttttaatctccttgatactcaatgtacattgaatagctataggaaaaagaatatcagggtaatcacattaaaaatgattagttttgttaaatgccagctcttgaatgttatctttctatatcagtctgtataatattttctccttagtatacttaaa

SEQ ID NO: 56207 - DNA, 201 bp, Bos taurus; identical to SEQ ID NO: 15407

SEQ ID NO: 56208 - DNA, 201 bp, Bos taurus
tgtgggtgtgtgtttttggtggcgaggcccgtggctgattctcctttcactccttcaagcatcagcctgggctctggtttcctttcctggttcaggaggtgccggggctgtcgttaaccctggccagggctgggcgggccaccttaggatggaggccgcacacagaccccacttggggtgagcagatagccggcccaggag

SEQ ID NO: 56209 - DNA, 201 bp, Bos taurus
tctgtcattatttgtttaagtctgaaagctgttttaaataaacacatgctcattttatgtattaaaagcaacaaagagggaagaagaaaacctgggccatcgtcatgtgatctggacaaaccccccgcctatatgttcagggtgcactcagcccctggttgtgtcgggactggccagggctctgcccgacctcagggatgg

SEQ ID NO: 56210 - DNA, 201 bp, Bos taurus; identical to SEQ ID NO: 15408

SEQ ID NO: 56211 - DNA, 201 bp, Bos taurus
ttcccctcccccgtctccctccaaggaaaagcaggtgctatttccaaccagcagtcgcaggccagccttctatcagccccaagtccccgccaatggccatgtccgacatgactgatgagtttctggatgacctctgggcttggggaaaccctcaaatatcttctgactcattaagacacatacgtatgtctggtgtagttg

SEQ ID NO: 56212 - DNA, 201 bp, Bos taurus
gaggaatagctcctgttttcctattgttttctccttccttgtgaggtgtgcggtgatttgtcagcatcactgagctgcacaacctcgggggcatgggtacagttgtgcccaactgcaggtaagttggttacttgaggagatcctccaagcatccaataacagggtatctgccgatcgcagctttcccctagtcagggaatg

SEQ ID NO: 56213 - DNA, 201 bp, Bos taurus; identical to SEQ ID NO: 15411

SEQ ID NO: 56214 - DNA, 201 bp, Bos taurus; identical to SEQ ID NO: 15415

SEQ ID NO: 56215 - DNA, 201 bp, Bos taurus
gatgggagagcgccaccgcaggcaaaaaagacaggcatgcaggcccctacaggcaaagagttacagcaaatagatcgggtgtgctgagactctcagctcctggaattctatcagaaaggctaccggccaggaaacgagacagacagagctgtgtcactggtcagagcctcaggctgccctgcccgagggaggccatctggg

SEQ ID NO: 56216 - DNA, 201 bp, Bos taurus; identical to SEQ ID NO: 15418

SEQ ID NO: 56217 - DNA, 201 bp, Bos taurus; identical to SEQ ID NO: 15419

SEQ ID NO: 56218 - DNA, 201 bp, Bos taurus; identical to SEQ ID NO: 15420

SEQ ID NO: 56219 - DNA, 201 bp, Bos taurus; identical to SEQ ID NO: 15421

SEQ ID NO: 56220 - DNA, 201 bp, Bos taurus; identical to SEQ ID NO: 15423

SEQ ID NO: 56221 - DNA, 201 bp, Bos taurus; identical to SEQ ID NO: 15424

SEQ ID NO: 56222 - DNA, 201 bp, Bos taurus
tgtccatcctggaggaggacaaggactggcggccagccatcaccatcaagcaggtatgcgcccatgcccaccctccccagtggagcccagcccgcggccgaagagcctgcccttcccaccactctgttctctctcatgcagatcttattaggaatacaggaacttctaaacgaaccaaatatccaagacccagctcaagca

SEQ ID NO: 56223 - DNA, 201 bp, Bos taurus; identical to SEQ ID NO: 15426

SEQ ID NO: 56224 - DNA, 201 bp, Bos taurus; identical to SEQ ID NO: 15427

SEQ ID NO: 56225 - DNA, 201 bp, Bos taurus; identical to SEQ ID NO: 15428

SEQ ID NO: 56226 - DNA, 201 bp, Bos taurus; identical to SEQ ID NO: 15429

SEQ ID NO: 56227 - DNA, 201 bp, Bos taurus; identical to SEQ ID NO: 15430

SEQ ID NO: 56228 - DNA, 201 bp, Bos taurus
gagcaccctctcttgttccccagacaggccaccccgattctgagcagccccatcccctcacacctggggtgaggggctgcaaggaagccggggagactgcgaggggccttagcgcccattgttgctttctctccaaggaagggggaggtgccccactgtggaaggggaatgggatgggatggggtgcccacgcttgccaca

SEQ ID NO: 56229 - DNA, 201 bp, Bos taurus
tgtggggaagtgggagcgagggaggcaggtgggagctagcagcccgggctgtcgggggcaggtacggatggcagcgggctttggggctgcatggccaaagtggcacttgaaatggagtcttccccctgcaggtgtggacttgttaacagaatccacgccgggtctcagcttcctctgggcctgacctaggcctaagcccgg

SEQ ID NO: 56230 - DNA, 201 bp, Bos taurus
cttggtcaaggggccaaaggaaggaaaaggggtgcagctgcaatttggaagcctggtgggaagatgccctgggagaggctgtctcaagatcctttttttttccctctgaggccacgtgtgtagaatgtgggaaggctggatggaagaggaggcacaagggaccccagtaatggaggggtcactaggattagtgaagcgacc

SEQ ID NO: 56231 - DNA, 201 bp, Bos taurus
aagcaaaggcaaagaattctattctggatgcgagcaaagcagctgcatcgatgccagccggggcgacttctgccagacagaaggcatgggggctggcctgcttctgcgacttctgagctcagtgattcttttgcagggggtcgaggtcaggagcgagcgagcaagggaaactgctgtctgttctcgctccctcccccgacc

SEQ ID NO: 56232 - DNA, 201 bp, Bos taurus; identical to SEQ ID NO: 15432

SEQ ID NO: 56233 - DNA, 201 bp, Bos taurus; identical to SEQ ID NO: 15433

SEQ ID NO: 56234 - DNA, 201 bp, Bos taurus; identical to SEQ ID NO: 15435

SEQ ID NO: 56235 - DNA, 201 bp, Bos taurus; identical to SEQ ID NO: 15436

SEQ ID NO: 56236 - DNA, 201 bp, Bos taurus; identical to SEQ ID NO: 15437

SEQ ID NO: 56237 - DNA, 201 bp, Bos taurus; identical to SEQ ID NO: 15438

SEQ ID NO: 56238 - DNA, 201 bp, Bos taurus
ttttgctttggcgttggtgagcgagaactgctagactcccggacaaggctgagtgaagatgaaaagaagcaaagatgggtgctaagatgaattttctgagccatttcaacttcagaacaaaatcttaagaatatgagaagaaataatccacacacaaaaaatggagcaaagcacttagaattaggaagagaaactgacact

SEQ ID NO: 56239 - DNA, 201 bp, Bos taurus; identical to SEQ ID NO: 15441

SEQ ID NO: 56240 - DNA, 201 bp, Bos taurus; identical to SEQ ID NO: 15442

SEQ ID NO: 56241 - DNA, 201 bp, Bos taurus; identical to SEQ ID NO: 15443

SEQ ID NO: 56242 - DNA, 201 bp, Bos taurus; identical to SEQ ID NO: 15445

SEQ ID NO: 56243 - DNA, 201 bp, Bos taurus
ttcctgattgtttttttaaaggcaaagtgatttattggaatttgtcttcagtaagctgtgctgtattaagttgaataatagaaagtagaaaaacatggccttggcagttgatttttaaagttcatctttctcattataactagcagatagtaaagttcatgtgacagcatcttactgacatgcacttttttctgccctgaa

SEQ ID NO: 56244 - DNA, 201 bp, Bos taurus; identical to SEQ ID NO: 15447

SEQ ID NO: 56245 - DNA, 201 bp, Bos taurus
ctctgaggcccagacctagcaggcggccttcaaacagaactgtccttacacgccctaaatttagggttgttagtcttgaaaaacatcctacgcttctcactgctgacggcttcgcgtccaactaaaccaccatcagctcttacttgagcatctcaaacacgacacatcggctcagactctgacaccttcctccccctgctg

SEQ ID NO: 56246 - DNA, 201 bp, Bos taurus; identical to SEQ ID NO: 15448

SEQ ID NO: 56247 - DNA, 201 bp, Bos taurus
tgtccctgagccctgagaaagatacatcccaggtaacacagaccaggaaacgaatgtctccagaaactcagtgcagatgaaaactgacccatcccattgccgaattacgccaccccctttacctcctgctgacgacagcaaggctgggggtgagcagcgggtgagttttttaaccacagagcaagtcctacagctgtggcc

SEQ ID NO: 56248 - DNA, 201 bp, Bos taurus
ggctcccttcaggctcctctcagccacctggctgtgatcatccccagaatagccatcaggctgagaactcactcacctggtcccaggggtccagccctgcccaggtaaggccaggtgcaagagggcagctgaaggatgtgtagggcgagaaccccatctgctgaaacaaggccaggttcacggtgataaagaacccacgtg

SEQ ID NO: 56249 - DNA, 201 bp, Bos taurus
gggttattgttattttacatttcacagtgaggccagaggggtgacccctggaagatgctggctggtcctcccttcatctcgataagcacccttttcagagatgggaggtttccatggctggtgagggggatctctggggccagccaaaagatgctgatctcccccagcccaaattgcctcccctctctgggcttgtgaaag

SEQ ID NO: 56250 - DNA, 201 bp, Bos taurus
gggttctctttaaagtgatttgctcagctctgggggcttggggaccttctgtagagaggcactgtctcatttttctgtctcatataatcaggtttggttcagaattcaggaggcagtgtgctctaggtcagtttgagctcctgcagcttgtcctcaggcagtgtgttgtagcacaggctcacaccacacatacgggtcttc

SEQ ID NO: 56251 - DNA, 201 bp, Bos taurus; identical to SEQ ID NO: 15449

SEQ ID NO: 56252 - DNA, 201 bp, Bos taurus; identical to SEQ ID NO: 15450

SEQ ID NO: 56253 - DNA, 201 bp, Bos taurus; identical to SEQ ID NO: 15451

SEQ ID NO: 56254 - DNA, 201 bp, Bos taurus; identical to SEQ ID NO: 15452

SEQ ID NO: 56255 - DNA, 201 bp, Bos taurus; identical to SEQ ID NO: 15453

SEQ ID NO: 56256 - DNA, 201 bp, Bos taurus; identical to SEQ ID NO: 15454

SEQ ID NO: 56257 - DNA, 201 bp, Bos taurus
acagggatttttattcctctctgtctgcaagttgacagtgactcaagaatgtcaggtttggctcgtggggcagtttagactgcggaagccttccagtcctggggccatgctggggccatgtgaggcgggccaggttccatcgcagagtgcaggggctgtaagagtgtttaatactcatgtgctatttcctgctatttcgtt

SEQ ID NO: 56258 - DNA, 201 bp, Bos taurus; identical to SEQ ID NO: 15460

SEQ ID NO: 56259 - DNA, 201 bp, Bos taurus; identical to SEQ ID NO: 15461

SEQ ID NO: 56260 - DNA, 201 bp, Bos taurus
acgtggctgccacaaaccagtccaattcctctcccatgattcagtgtcattccttgtccagattcatggcccagcgtgggcccgtgaaccagtgttctgatctcttccctcaagttttagcttgagtgtttgttttcctgttgctcagtcactgcccacgatcattgttttcagggtgacacgatacatccacagaatgat

SEQ ID NO: 56261 - DNA, 201 bp, Bos taurus; identical to SEQ ID NO: 15462

SEQ ID NO: 56262 - DNA, 201 bp, Bos taurus; identical to SEQ ID NO: 15463

SEQ ID NO: 56263 - DNA, 201 bp, Bos taurus; identical to SEQ ID NO: 15464

SEQ ID NO: 56264 - DNA, 201 bp, Bos taurus; identical to SEQ ID NO: 15465

SEQ ID NO: 56265 - DNA, 201 bp, Bos taurus; identical to SEQ ID NO: 15466

SEQ ID NO: 56266 - DNA, 201 bp, Bos taurus
gcctagtaagatgggggggcagagtgggcaggcagccatagcctaaatggcctgggttttgagttgtgctgaccagggttcaagtactccaaaccaaaatactcatggataacagcactggccaatagaacgcaaggcatatgtcatgttagtttttctagtagcctcattctcaaaaaaaaaaaaaagcgcaaagaaaca

SEQ ID NO: 56267 - DNA, 201 bp, Bos taurus; identical to SEQ ID NO: 15468

SEQ ID NO: 56268 - DNA, 201 bp, Bos taurus
cagagactccatattgtcctcaagagtcgccaggatcatttctgtccagagacgtttattttcttttgttgtatgagcacaattgtgtggcccctaagcttgtcccttctccgtgtcaggatagtcacctcagttccaatcgtcacatggagagatggcaagactggccccaaagcctcctgcccctgaggagcaccagga

SEQ ID NO: 56269 - DNA, 201 bp, Bos taurus
aactggtcatcactgcaggtgttttctggtggtttctggcagagctaagccatagcatttaggaaaggagttgacaacaaggaagacttgccgtttctgacgcccataggggtgagatccgctatcatcccaggggatggttcgatcaggcaaccacttacgtttctgtatcttcatgataatcacatatcttaggaaagc

SEQ ID NO: 56270 - DNA, 201 bp, Bos taurus; identical to SEQ ID NO: 15469

SEQ ID NO: 56271 - DNA, 201 bp, Bos taurus; identical to SEQ ID NO: 15470

SEQ ID NO: 56272 - DNA, 201 bp, Bos taurus
tcctgtaatctaagaaatgggggcctcacaaaagccttgtgtccaccagccccgcaggggcctgcacgttggatacccaggcaggaggagggccagattttagccctgtggaaacctggcccaaatctttgtccatttgctctagtagaacagctggggctggacctggggctgggtggaaggagggggagggtgggcttt

SEQ ID NO: 56273 - DNA, 201 bp, Bos taurus; identical to SEQ ID NO: 15475

SEQ ID NO: 56274 - DNA, 201 bp, Bos taurus; identical to SEQ ID NO: 15476

SEQ ID NO: 56275 - DNA, 201 bp, Bos taurus; identical to SEQ ID NO: 15477

SEQ ID NO: 56276 - DNA, 201 bp, Bos taurus; identical to SEQ ID NO: 15478

SEQ ID NO: 56277 - DNA, 201 bp, Bos taurus; identical to SEQ ID NO: 15479

SEQ ID NO: 56278 - DNA, 201 bp, Bos taurus; identical to SEQ ID NO: 15480

SEQ ID NO: 56279 - DNA, 201 bp, Bos taurus; identical to SEQ ID NO: 15481

SEQ ID NO: 56280 - DNA, 201 bp, Bos taurus; identical to SEQ ID NO: 15483

SEQ ID NO: 56281 - DNA, 201 bp, Bos taurus; identical to SEQ ID NO: 15484

SEQ ID NO: 56282 - DNA, 201 bp, Bos taurus
caatgccttctccagattacagttttggagagaagctggtgaggtagcatcttcagaaagctgcttggaaatgacctttctctttgcactcctgccctggggaagacagtgttgagaaaaagtacctctctcctccaatgaaaccgaactcataggtgcttggtcttctcatctgtgtgtgtcctaatccatgcctcccct

SEQ ID NO: 56283 - DNA, 201 bp, Bos taurus
ttctttatcatcttcctgttcgttttccagcacttcttccacctcacaggtttccttctttctggacagttctccctttcctgtggagccttcctctgccttttttaatgaaggtctattttcccacgtttctttttttatttatatattttttcaacctgacactgaaagcacagcctgccttttcctaagcaaggcaga

SEQ ID NO: 56284 - DNA, 201 bp, Bos taurus; identical to SEQ ID NO: 15485

SEQ ID NO: 56285 - DNA, 201 bp, Bos taurus
gaggggaggagggggagaccagtttccagtggccaaactttcctaattaccttcacagcagctctcgggtccctgggcgactctcctgaaaaagagaaatcgcctctggatgcgggccccaagcagggagcaggcctgcgattggcccaagataattgggctgttgtctgggtctcggggaaaggtctgtttgggaacatt

SEQ ID NO: 56286 - DNA, 201 bp, Bos taurus
caacccatgtcccctgcattaacaggtggatttataaccactggaccaccagtaactccctgctcttggcttttgtgtggggccagttctgtggctcccacttctttggcgctcccattgcacgctcctttatccccgctgcttcctcatggttccttggtaagaactcagttttagagccaaatgggccaaggttaagtc

SEQ ID NO: 56287 - DNA, 201 bp, Bos taurus; identical to SEQ ID NO: 15489

SEQ ID NO: 56288 - DNA, 201 bp, Bos taurus; identical to SEQ ID NO: 15491

SEQ ID NO: 56289 - DNA, 201 bp, Bos taurus; identical to SEQ ID NO: 15492

SEQ ID NO: 56290 - DNA, 201 bp, Bos taurus; identical to SEQ ID NO: 15493

SEQ ID NO: 56291 - DNA, 201 bp, Bos taurus; identical to SEQ ID NO: 15494

SEQ ID NO: 56292 - DNA, 201 bp, Bos taurus; identical to SEQ ID NO: 15495

SEQ ID NO: 56293 - DNA, 201 bp, Bos taurus
ctacccagccttgctagatgaaagaagaggggagggttatattgggacaggtgcccttcttcccgtgtcctggttagatgtccacccaggtggtggcccagtgttcaggcttctgatttggaagtcatcagactgtcccctgcagggtcagctggacaggagctctggccaggacctcaccccgtaccccatccagcctgg

SEQ ID NO: 56294 - DNA, 201 bp, Bos taurus
tctctgaacagctcagattggcctcttcccttgcacctgggactactggaagcatgaataaacatttgtggaatgaatgcttgactcccaaattttctttatgatgggcctgtggtgccatctctgctggcagcatggcgcccaccaggggaggggaaccttgggtgagggaggaagtccaggttgctgctggtagcccag

SEQ ID NO: 56295 - DNA, 201 bp, Bos taurus; identical to SEQ ID NO: 15496

SEQ ID NO: 56296 - DNA, 201 bp, Bos taurus; identical to SEQ ID NO: 15497

SEQ ID NO: 56297 - DNA, 201 bp, Bos taurus
tggcagaactcaaataaggtctgcggtttacagaccttcacactggaccaatgttaatttcttagttttgacaaaagcaccaccacaaatggttaaatcatgttaacactggggggagctaggtgaaggtagagcgttaggaaactccggatccatccatccgcgcaacatttctgcagctataaaactggttcaaatttg

SEQ ID NO: 56298 - DNA, 201 bp, Bos taurus
ctttgtaaattaaatagaggattaccatattccatgatgtaacctgctagtcccacctaacagggttatttttgtgcttcattgtacaccttccggtgaggtggttttattttgaatggccgaatttgctcaggttttcccgaagtactttattgactgctgctgccagttactgtttggtaaacataggaaaaggaaaaa

SEQ ID NO: 56299 - DNA, 201 bp, Bos taurus; identical to SEQ ID NO: 15498

SEQ ID NO: 56300 - DNA, 201 bp, Bos taurus
tttagaaataaattctaagtctgggcagtcccagatttgtggtgtctggtgagagctcccttcccggctcacagccggctgccttctccctgtggtctcctgtggcacttgagctctcaagttctctggtggaactctgctcaacgtcatgtggcagtctggatgggaggggagtttgggggagaatggatacgtgtacac

SEQ ID NO: 56301 - DNA, 201 bp, Bos taurus
cgggtgaagcccagagcatatcccttcctctctgcccttttaatttttatttattttttagtagcaagcaaggcagtcattgtgcgggactgctgggggcaggaggcccgtggtcatgcggaaatccacggtgaggatgtctcaccacagtcagtacctgtgttgtctggcacattaattgaaaggaagtcaccctttgtg

SEQ ID NO: 56302 - DNA, 201 bp, Bos taurus; identical to SEQ ID NO: 15500

SEQ ID NO: 56303 - DNA, 201 bp, Bos taurus
ctgttttcagcagcctcactctttccaggctcttcccccatcccttcccaaccaagttccttttttgtacaagcaggtgcggctaaataattaatagggtgggaaaacttgttggaaatagtacagctcatgtttatttttaagcagctgagttatagagccctgctgcaggtgcagtgcaggtggggaaagcgtctttgg

SEQ ID NO: 56304 - DNA, 201 bp, Bos taurus; identical to SEQ ID NO: 15501

SEQ ID NO: 56305 - DNA, 201 bp, Bos taurus; identical to SEQ ID NO: 15503

SEQ ID NO: 56306 - DNA, 201 bp, Bos taurus; identical to SEQ ID NO: 15504

SEQ ID NO: 56307 - DNA, 201 bp, Bos taurus; identical to SEQ ID NO: 15506

SEQ ID NO: 56308 - DNA, 201 bp, Bos taurus; identical to SEQ ID NO: 15507

SEQ ID NO: 56309 - DNA, 201 bp, Bos taurus; identical to SEQ ID NO: 15508

SEQ ID NO: 56310 - DNA, 201 bp, Bos taurus
gaggtgcgttagcacagcctgctgctgtctccaggcagtctctttagccaatccctgcctcctgaacctgcctccatcctagctcccctgagctatggctgatagaaaatgttcatgcctctgcaagtttccagccaggggtttggagctgggcagcaacctggttctcctgccccagaagctccagtctttctatctctg

SEQ ID NO: 56311 - DNA, 201 bp, Bos taurus; identical to SEQ ID NO: 15510

SEQ ID NO: 56312 - DNA, 201 bp, Bos taurus; identical to SEQ ID NO: 15515

SEQ ID NO: 56313 - DNA, 201 bp, Bos taurus; identical to SEQ ID NO: 15516

SEQ ID NO: 56314 - DNA, 201 bp, Bos taurus
gggcctggagatgggatgtgtcccacaggaaagacacaaagaattgccctgctccaaatgctagtagcccccagttgagaaacctgtacattaagaaacatccaggggccatatgagcctgcaatcccactctggccatatatcctgacaaaactgtaattcaaaaaagatacatgcatatattcataggagccctattta

SEQ ID NO: 56315 - DNA, 201 bp, Bos taurus; identical to SEQ ID NO: 15519

SEQ ID NO: 56316 - DNA, 201 bp, Bos taurus
ggacatctggaccttcctgtctggctaatcctccagccaagggaacccaatcaaaaccaacagaggaatccaaccaagccaatcacaggatcatgaaaagcaatacattgttgttctaagccattatgttctagggcgtgtttgtcatgcagccaaggctcactgagacatgttgtaagaagccaagctgagattcgaacc

SEQ ID NO: 56317 - DNA, 201 bp, Bos taurus; identical to SEQ ID NO: 15521

SEQ ID NO: 56318 - DNA, 201 bp, Bos taurus
ttacatgtgtcccagctctttttctcccaccatggattttcagacagttgtaccctgtcagttaggtatttcttggggagaacatgcatagctttggggtaatagatatcttgtgatgattatcttctagctatcgtttcctatccgttgtgccaacagacctcacccatgaacattttagaaaatgtcagctgtgcagtt

SEQ ID NO: 56319 - DNA, 201 bp, Bos taurus
gataattctttgccggtgggatggatggcgggcgaaagtgtgggggaggggggcaggtggagcgtgcagggagagggcctgccccttgccttgtaaggccgttagcagcctctccggtctcgacgcgacaaccgaaaatgtctgcaggtatcgctagatgtctcagtgggaggactgtcccagccaacctggaatgccagc

SEQ ID NO: 56320 - DNA, 201 bp, Bos taurus; identical to SEQ ID NO: 15527

SEQ ID NO: 56321 - DNA, 201 bp, Bos taurus; identical to SEQ ID NO: 15528

SEQ ID NO: 56322 - DNA, 201 bp, Bos taurus; identical to SEQ ID NO: 15529

SEQ ID NO: 56323 - DNA, 201 bp, Bos taurus; identical to SEQ ID NO: 15530

SEQ ID NO: 56324 - DNA, 201 bp, Bos taurus; identical to SEQ ID NO: 15531

SEQ ID NO: 56325 - DNA, 201 bp, Bos taurus
caactaaatggtttggaatgaaaaaaagattgagaacccaggaggaaatgtttcttcccatgcatgaaagctgaatggcctgggttatagagagttatctgtggtcagatctcacttggaaggcgaatgagatccctaagggtagggcacccttaaaagatatttcaacatatccattaagggaggcctataaattctagg

SEQ ID NO: 56326 - DNA, 201 bp, Bos taurus
ttcttactattgtggaaaatagagcccactggcccaaacccaaagcatggacttggagacacgaggtgcagcgggaagcgaggctttaatgatggtcttacaggatggcctctggtgggcaggcacagccatggcagttacaacaagcattttatattttggcatgcaaggtccctccgccggttcctcattggttgagta

SEQ ID NO: 56327 - DNA, 201 bp, Bos taurus; identical to SEQ ID NO: 15533

SEQ ID NO: 56328 - DNA, 201 bp, Bos taurus; identical to SEQ ID NO: 15534

SEQ ID NO: 56329 - DNA, 201 bp, Bos taurus; identical to SEQ ID NO: 15535

SEQ ID NO: 56330 - DNA, 201 bp, Bos taurus; identical to SEQ ID NO: 15537

SEQ ID NO: 56331 - DNA, 201 bp, Bos taurus; identical to SEQ ID NO: 15538

SEQ ID NO: 56332 - DNA, 201 bp, Bos taurus; identical to SEQ ID NO: 15541

SEQ ID NO: 56333 - DNA, 201 bp, Bos taurus; identical to SEQ ID NO: 15543

SEQ ID NO: 56334 - DNA, 201 bp, Bos taurus
aagaaaaacacaaatatctccataaaaatttaagaggttatactctacattaaaaaaattaacaagctggagtatttcatacaggagttaaatcacaaaacgtctgcagtcttcactgttagacctctatacaagagagagtatgttttactttgtagtccccaacataaaatggattttaagaaaactttaagacaacca

SEQ ID NO: 56335 - DNA, 201 bp, Bos taurus
agagagtctttgtacccggaagccctactgggccctgcttggtatctgatgctgcagagcaaacaagattctcagctctgagacaaaaggcctcatcacttgctgcaatagcagtggttggtgtacagtattcatgctggttccccaagccccagttccccaagggtgatgcaaaagggggacaggggccggcagacacaa

SEQ ID NO: 56336 - DNA, 201 bp, Bos taurus
taggacatgactgagtgactttcattttcactttacatattcatcataacacacaaaaaagaggtccaggatcaaatagattagggaaacagcaggttaaggagactttaacaaggttttttattgcaggacttctcagagcctttagcacattaacgtgcactcatctatccaaccagcatatagtcagtgtctaccgtg

SEQ ID NO: 56337 - DNA, 201 bp, Bos taurus; identical to SEQ ID NO: 15544

SEQ ID NO: 56338 - DNA, 201 bp, Bos taurus; identical to SEQ ID NO: 15545

SEQ ID NO: 56339 - DNA, 201 bp, Bos taurus; identical to SEQ ID NO: 15546

SEQ ID NO: 56340 - DNA, 201 bp, Bos taurus
gcttgctcactgggtccaggtggtgattactgggcccctccattgtaaagttgtgctgctttgcaattcctttccacctctaagagccttgtgataagacatctaggttctcactggccttgtttgcctctttcctggcaaacaaatggtctaaactgaccagtgcaggcttcttatatacggaaaaaggaaactctgccg

SEQ ID NO: 56341 - DNA, 201 bp, Bos taurus
ttggccacatccaagacagctggggaacttattaaaagtaccaattaccatggacagctctttcttacagaagaattcaattactaaatgtagaaagaataagggaaatagaaggccattataaaccaaatatcacagtaataattgttgcaagcaagatccacgggtggatgctaaaatgagtgggtgaaagtttaggaa

SEQ ID NO: 56342 - DNA, 201 bp, Bos taurus; identical to SEQ ID NO: 15547

SEQ ID NO: 56343 - DNA, 201 bp, Bos taurus
gtatatccattggaagtatattacattcattgtatgaataatctatttttgtttcttgtaatgctggatgcgtgggttgtgttaaaaattcttttgaagtcttttagtagagaggggatcatttaacttgctcatatcttagcttctgcctattctaatttttaatatataatatgggttgaagcctagactaaatgaggc

SEQ ID NO: 56344 - DNA, 201 bp, Bos taurus
ttagatgaggactggtgctatggagggaaaaaaaaacccaaatcagagcagtgggtggcggtgggctgcacttttaaatagggtggttggaggaggcctcgctgagaagttgatgtgtgagcaattacttgaagtacatgagagatgaaccacatgctggcaacgtggggccagttaggaccaaggaatagccagtgcaaa

SEQ ID NO: 56345 - DNA, 201 bp, Bos taurus; identical to SEQ ID NO: 15548

SEQ ID NO: 56346 - DNA, 201 bp, Bos taurus
tgagagtctcactccctaggtaagattggccctggaatcagcatgtttgaaagcttccttgagtcaagtataggtggtcctaggaccacactttaagaaacgtccctctggtctcaggccatgaaccattcagctcccacaggtatgggcttactttggggtgatgaaaatgttctaaaattgtgatgatgattgtgaata

SEQ ID NO: 56347 - DNA, 201 bp, Bos taurus
aatcttagttcccctggccagggattgaacccagagctctggcactggaagctcagagtcctcaccactgaaccaccagggaattccctcaattgactctaaattggggagattattgtaggtgggcctggcttaatcaggtgagtccttaaaagaagtcagattcaagcagaagagacttctgcttgctttgaatacgca

SEQ ID NO: 56348 - DNA, 201 bp, Bos taurus; identical to SEQ ID NO: 15549

SEQ ID NO: 56349 - DNA, 201 bp, Bos taurus
cgtggaccctcgggaaacaggccctgagtgatggctgagcgataccgtgctctttcccaaacttgtcacatccagaaggatcactcaaagcacagtggtgtgagcagtcctgattcccaggcctcactctccgagattctaattgtcaaggtctgggaccctttgcactgaggccacacgtgggcaactctgaatgagcat

SEQ ID NO: 56350 - DNA, 201 bp, Bos taurus
caatgggagcagaggttggaatgtgcaggctgctctctggatggggccacaagccaaggagtgtgggcagcctctagaagctggaaaagtcaaggcaacagattgtcccctagaagctccacaaagaaccagctctaccaacatgttgacttttaacctgtttaagactcctgatctccagaactgtgagatgataaataa

SEQ ID NO: 56351 - DNA, 201 bp, Bos taurus; identical to SEQ ID NO: 15550

SEQ ID NO: 56352 - DNA, 201 bp, Bos taurus; identical to SEQ ID NO: 15551

SEQ ID NO: 56353 - DNA, 201 bp, Bos taurus; identical to SEQ ID NO: 15552

SEQ ID NO: 56354 - DNA, 201 bp, Bos taurus; identical to SEQ ID NO: 15554

SEQ ID NO: 56355 - DNA, 201 bp, Bos taurus; identical to SEQ ID NO: 15555

SEQ ID NO: 56356 - DNA, 201 bp, Bos taurus; identical to SEQ ID NO: 15558

SEQ ID NO: 56357 - DNA, 201 bp, Bos taurus; identical to SEQ ID NO: 15559

SEQ ID NO: 56358 - DNA, 201 bp, Bos taurus; identical to SEQ ID NO: 15561

SEQ ID NO: 56359 - DNA, 201 bp, Bos taurus
tttaattttatctacatattacacttagaaatacttcaagtttgcctttaatttttttaaaagtgtgtttcttctcagccagaacaatatacggtgagacttagatctgggaatagaaaagtttcaattccttctgttagaatgataagcccagcgagagcaggaacctcatctctcttgttcacttatttccctggagcc

SEQ ID NO: 56360 - DNA, 201 bp, Bos taurus
agaatcaggggttggggagaggtgactgctggggccacagtaccacatctgtgtgaaagcttgaatacagacattttttaaggaaaaaaaaaatcttacaaaagacattagtggagtgttatttatagatttggagaatctcaaagatctttggatttttttcagaatgtcaatgatctcttttaattgtttaatcatctt

SEQ ID NO: 56361 - DNA, 201 bp, Bos taurus; identical to SEQ ID NO: 15562

SEQ ID NO: 56362 - DNA, 201 bp, Bos taurus; identical to SEQ ID NO: 15563

SEQ ID NO: 56363 - DNA, 201 bp, Bos taurus; identical to SEQ ID NO: 15564

SEQ ID NO: 56364 - DNA, 201 bp, Bos taurus
ctcctccgtccatgggattttctaggccattgccttctccgggtgactctctagttcttacaaattttccttcctaaagaacacgttatgctgcagggcaactgggcctatgagtcacaactactgagcctgtgctctcgtgcccaagagttgcaaatactgaagcccacgtgcctagagtctgctccacaagagaagcca

SEQ ID NO: 56365 - DNA, 201 bp, Bos taurus
aagaggagaaagcagagaaatctcaaggacacaaggattcctctattgaaaacacaaaggcatttatgatgcagaacttcagaatgggaaccctgggccacagaggctgcctgcgcttctcagttaaagctgatgatggagcagccaaacacaactcactgaggacaactctatcgaatgtcacaagtagatgcctgaggg

SEQ ID NO: 56366 - DNA, 201 bp, Bos taurus
gccttgtgctcccgccgactgtgactgtcgctcgagtcctggtggctgctggacaggttcctcaagctaccgaagcaggagatggagaccttgtcatccatggcctccccgatcttctccagggtggatgcagaggtgtgaattggagagtcccctgagtagcgggaaggggaactggagcgcatctgcagcttggcagac

SEQ ID NO: 56367 - DNA, 201 bp, Bos taurus
ggtctccgaggtaagtactctgcccactcttcccccctggaaccttcagcctgtagcctgaggtcctggctgagtcctctggcctcagaggtgatccacatgggaggtccatgtcaggagctggggctgagaggagagagcagacaggctggctctggcctctccaggcatccccaggccacttctttctccaccacagaa

SEQ ID NO: 56368 - DNA, 201 bp, Bos taurus; identical to SEQ ID NO: 15565

SEQ ID NO: 56369 - DNA, 201 bp, Bos taurus; identical to SEQ ID NO: 15566

SEQ ID NO: 56370 - DNA, 201 bp, Bos taurus; identical to SEQ ID NO: 15567

SEQ ID NO: 56371 - DNA, 201 bp, Bos taurus; identical to SEQ ID NO: 15568

SEQ ID NO: 56372 - DNA, 201 bp, Bos taurus; identical to SEQ ID NO: 15569

SEQ ID NO: 56373 - DNA, 201 bp, Bos taurus
ccgggccattgctggacagagttgagtatcccagggatgggcatgtgccgtccagttcatcccagccgcccttccctgctgtattacaccagcctggcttaactcagtcacacagcctggcctctgcagggttttaagtttctaacccttgcaatgaagtaggtgcatgtgtgctatcttttcagttgtgtctgactcttt

SEQ ID NO: 56374 - DNA, 201 bp, Bos taurus
cctgatgtgctgcagtccatggggttgcaaagagttgcacacgactgagtgactgaactgattgactgtcttgaaccattgaggggggaaaaaagaaatgctcaaactgtttaccctggcccactcactctatattattgagccccagtccaactcgctgacctccttggctaggattttccttcttgttcatgagattcc

SEQ ID NO: 56375 - DNA, 201 bp, Bos taurus; identical to SEQ ID NO: 15572

SEQ ID NO: 56376 - DNA, 201 bp, Bos taurus; identical to SEQ ID NO: 15573

SEQ ID NO: 56377 - DNA, 201 bp, Bos taurus; identical to SEQ ID NO: 15574

SEQ ID NO: 56378 - DNA, 201 bp, Bos taurus; identical to SEQ ID NO: 15575

SEQ ID NO: 56379 - DNA, 201 bp, Bos taurus; identical to SEQ ID NO: 15576

SEQ ID NO: 56380 - DNA, 201 bp, Bos taurus
ggacagctggaggtagaggcttactggggagatacacttgtgaaaaagggcagaggggtgagctgacctgcaatatgcttgcagctgaggcctctagaacgtggacaagaacttgacctgggacagacttccagagtcccaaattgagagagaggtgctgagcctttgaacccttgatccaaaggattattggccaactgc

SEQ ID NO: 56381 - DNA, 201 bp, Bos taurus; identical to SEQ ID NO: 15577

SEQ ID NO: 56382 - DNA, 201 bp, Bos taurus
ggcagttttcactagggagttctccagccatcacgtcatgatttatttatttttatttttgtaaatcatgccagtcatttttacttttaaattgagtcaggagagaagctgtgagacttcaggtgaatgagggattgctagggttgtacagtagaaagttttaaaggttttggttttgcataatggatggtatctctggaa

SEQ ID NO: 56383 - DNA, 201 bp, Bos taurus
tgatctgagtccagatgaagtggttttttgggtgtagaagaggaggagatctttcttggtatccagcacccagacaggagtctcctgggccttgttatgcacgtggggctcttttgttatgtaggaaggacttgttgtggctggtagaagcttcatctttggcctcaggagggtggcctcccggcttcctaggtggtcttc

SEQ ID NO: 56384 - DNA, 201 bp, Bos taurus
cagcgaggagaggagagcctggcctggagtgagaagtgcataatgcacctgcttctcaattctgttttaaaagtaacagaattattggtctcttctctccatttctgggccctttccttcttctttatgcaggaggagttgtcaaggaaaatacaatcatgtcatgaaaatttcaagtccttaacgtctgtggatgtgttt

SEQ ID NO: 56385 - DNA, 201 bp, Bos taurus; identical to SEQ ID NO: 15579

SEQ ID NO: 56386 - DNA, 201 bp, Bos taurus; identical to SEQ ID NO: 15580

SEQ ID NO: 56387 - DNA, 201 bp, Bos taurus
agtggacctcttccacaacaccaaggaatgaaccatgaccaatataagcaattatgctcatttaattccccattgccaagagacttgtggccagtgagaactgagcagtggacagctcagggcttttgagaaatataatctctaaagattaaaaaataaaaagtggccagtgataggatgaggaaggatagcaattcattt

SEQ ID NO: 56388 - DNA, 201 bp, Bos taurus; identical to SEQ ID NO: 15581

SEQ ID NO: 56389 - DNA, 201 bp, Bos taurus; identical to SEQ ID NO: 15582

SEQ ID NO: 56390 - DNA, 201 bp, Bos taurus
ctgtgcagggtcttagctgtggtatgcaggatcttcaggaccctttttagtttcggcatgcagaatctttaatttctgcacacaaactcttagatgcagcacgtgagttctagttccctgaccagggatcaaacctgggccctcttcattgagaatgcagagtcttagccactggagcaccagggaagtccctgtgcattc

SEQ ID NO: 56391 - DNA, 201 bp, Bos taurus; identical to SEQ ID NO: 15583

SEQ ID NO: 56392 - DNA, 201 bp, Bos taurus; identical to SEQ ID NO: 15584

SEQ ID NO: 56393 - DNA, 201 bp, Bos taurus
gagagatggaaagtggagaaggcccagaaagatgttttgcatctggcagagattctgccatctcagtcatccctgtaggcattcacacaaccccctctcacgagaggccccaagctttcagatctcagcttacatgctgtttctgcttcgggtcagacagaactagcttccagacccagctctaatactttggccacctga

SEQ ID NO: 56394 - DNA, 201 bp, Bos taurus; identical to SEQ ID NO: 15585

SEQ ID NO: 56395 - DNA, 201 bp, Bos taurus; identical to SEQ ID NO: 15586

SEQ ID NO: 56396 - DNA, 201 bp, Bos taurus; identical to SEQ ID NO: 15587

SEQ ID NO: 56397 - DNA, 201 bp, Bos taurus
attaggtttcaatgaggtcatgaaggtggggcctccatgatgagattagtgtccctaaatgaagaggaagagaccagagtgtccatgcactctctttctctgccatggacactgtgagaaggtggccgtctgcaagccaggaagggagccctcaccaggaacccaatcatgctggtgcttttggtcttggagttttcagct

SEQ ID NO: 56398 - DNA, 201 bp, Bos taurus; identical to SEQ ID NO: 15588

SEQ ID NO: 56399 - DNA, 201 bp, Bos taurus; identical to SEQ ID NO: 15589

SEQ ID NO: 56400 - DNA, 201 bp, Bos taurus; identical to SEQ ID NO: 15590

SEQ ID NO: 56401 - DNA, 201 bp, Bos taurus; identical to SEQ ID NO: 15591

SEQ ID NO: 56402 - DNA, 201 bp, Bos taurus
gcatgggccataggtgaatgggacccacgtattaacctcagagcatctgctggacccattttggatgctccctgggaactgagaaaccggagggagccatctttgcaatttcaggccactttgctgatcccagtgcctgtgggtgtcactttggaattctccctctagtctgagcaccagtaagcacaccccacttagaac

SEQ ID NO: 56403 - DNA, 201 bp, Bos taurus; identical to SEQ ID NO: 15592

SEQ ID NO: 56404 - DNA, 201 bp, Bos taurus
caaggtcgcagcaattcccgtcagctcaggagtcatccacttggtgggcagaggtggggtgggctgatggcagcctgtggaccaaaggccccacctctgccaaaatggcaggtaagccttccttgagggctccaagagtggacagcatctgatggcttctctggaaggagctgcgcctctggatgagcctcctgtttcagg

SEQ ID NO: 56405 - DNA, 201 bp, Bos taurus; identical to SEQ ID NO: 15593

SEQ ID NO: 56406 - DNA, 201 bp, Bos taurus; identical to SEQ ID NO: 15594

SEQ ID NO: 56407 - DNA, 201 bp, Bos taurus; identical to SEQ ID NO: 15596

SEQ ID NO: 56408 - DNA, 201 bp, Bos taurus
ttctcaggatgttcagatactcctaaaactcccagacaggggaccagggtgtgtggaatgcgtcccatcttgggtttattttagatcaagggtccccaacccctgggccaccgaccaggtacttcccgtcaaatcagtgatggcattagattagaaatattgtgcacaaacatataatgagctggaatcatcctgaaacca

SEQ ID NO: 56409 - DNA, 201 bp, Bos taurus; identical to SEQ ID NO: 15598

SEQ ID NO: 56410 - DNA, 201 bp, Bos taurus; identical to SEQ ID NO: 15600

SEQ ID NO: 56411 - DNA, 201 bp, Bos taurus; identical to SEQ ID NO: 15601

SEQ ID NO: 56412 - DNA, 201 bp, Bos taurus; identical to SEQ ID NO: 15602

SEQ ID NO: 56413 - DNA, 201 bp, Bos taurus; identical to SEQ ID NO: 15603

SEQ ID NO: 56414 - DNA, 201 bp, Bos taurus; identical to SEQ ID NO: 15604

SEQ ID NO: 56415 - DNA, 201 bp, Bos taurus; identical to SEQ ID NO: 15605

SEQ ID NO: 56416 - DNA, 201 bp, Bos taurus; identical to SEQ ID NO: 15606

SEQ ID NO: 56417 - DNA, 201 bp, Bos taurus; identical to SEQ ID NO: 15607

SEQ ID NO: 56418 - DNA, 201 bp, Bos taurus; identical to SEQ ID NO: 15608

SEQ ID NO: 56419 - DNA, 201 bp, Bos taurus; identical to SEQ ID NO: 15609

SEQ ID NO: 56420 - DNA, 201 bp, Bos taurus; identical to SEQ ID NO: 15610

SEQ ID NO: 56421 - DNA, 201 bp, Bos taurus; identical to SEQ ID NO: 15611

SEQ ID NO: 56422 - DNA, 201 bp, Bos taurus; identical to SEQ ID NO: 15612

SEQ ID NO: 56423 - DNA, 201 bp, Bos taurus; identical to SEQ ID NO: 15615

SEQ ID NO: 56424 - DNA, 201 bp, Bos taurus; identical to SEQ ID NO: 15618

SEQ ID NO: 56425 - DNA, 201 bp, Bos taurus; identical to SEQ ID NO: 15619

SEQ ID NO: 56426 - DNA, 201 bp, Bos taurus; identical to SEQ ID NO: 15621

SEQ ID NO: 56427 - DNA, 201 bp, Bos taurus; identical to SEQ ID NO: 15626

SEQ ID NO: 56428 - DNA, 201 bp, Bos taurus; identical to SEQ ID NO: 15629

SEQ ID NO: 56429 - DNA, 201 bp, Bos taurus; identical to SEQ ID NO: 15630

SEQ ID NO: 56430 - DNA, 201 bp, Bos taurus; identical to SEQ ID NO: 15631

SEQ ID NO: 56431 - DNA, 201 bp, Bos taurus; identical to SEQ ID NO: 15632

SEQ ID NO: 56432 - DNA, 201 bp, Bos taurus; identical to SEQ ID NO: 15633

SEQ ID NO: 56433 - DNA, 201 bp, Bos taurus; identical to SEQ ID NO: 15634

SEQ ID NO: 56434 - DNA, 201 bp, Bos taurus; identical to SEQ ID NO: 15635

SEQ ID NO: 56435 - DNA, 201 bp, Bos taurus; identical to SEQ ID NO: 15636

SEQ ID NO: 56436 - DNA, 201 bp, Bos taurus; identical to SEQ ID NO: 15637

SEQ ID NO: 56437 - DNA, 201 bp, Bos taurus; identical to SEQ ID NO: 15639

SEQ ID NO: 56438 - DNA, 201 bp, Bos taurus; identical to SEQ ID NO: 15641

SEQ ID NO: 56439 - DNA, 201 bp, Bos taurus; identical to SEQ ID NO: 15642

SEQ ID NO: 56440 - DNA, 201 bp, Bos taurus; identical to SEQ ID NO: 15645

SEQ ID NO: 56441 - DNA, 201 bp, Bos taurus; identical to SEQ ID NO: 15647

SEQ ID NO: 56442 - DNA, 201 bp, Bos taurus; identical to SEQ ID NO: 15648

SEQ ID NO: 56443 - DNA, 201 bp, Bos taurus; identical to SEQ ID NO: 15649

SEQ ID NO: 56444 - DNA, 201 bp, Bos taurus; identical to SEQ ID NO: 15651

SEQ ID NO: 56445 - DNA, 201 bp, Bos taurus; identical to SEQ ID NO: 15654

SEQ ID NO: 56446 - DNA, 201 bp, Bos taurus; identical to SEQ ID NO: 15658

SEQ ID NO: 56447 - DNA, 201 bp, Bos taurus; identical to SEQ ID NO: 15659

SEQ ID NO: 56448 - DNA, 201 bp, Bos taurus; identical to SEQ ID NO: 15660

SEQ ID NO: 56449 - DNA, 201 bp, Bos taurus; identical to SEQ ID NO: 15661

SEQ ID NO: 56450 - DNA, 201 bp, Bos taurus; identical to SEQ ID NO: 15662

SEQ ID NO: 56451 - DNA, 201 bp, Bos taurus; identical to SEQ ID NO: 15663

SEQ ID NO: 56452 - DNA, 201 bp, Bos taurus; identical to SEQ ID NO: 15665

SEQ ID NO: 56453 - DNA, 201 bp, Bos taurus; identical to SEQ ID NO: 15666

SEQ ID NO: 56454 - DNA, 201 bp, Bos taurus; identical to SEQ ID NO: 15667

SEQ ID NO: 56455 - DNA, 201 bp, Bos taurus; identical to SEQ ID NO: 15668

SEQ ID NO: 56456 - DNA, 201 bp, Bos taurus; identical to SEQ ID NO: 15669

SEQ ID NO: 56457 - DNA, 201 bp, Bos taurus; identical to SEQ ID NO: 15670

SEQ ID NO: 56458 - DNA, 201 bp, Bos taurus; identical to SEQ ID NO: 15671

SEQ ID NO: 56459 - DNA, 201 bp, Bos taurus; identical to SEQ ID NO: 15672

SEQ ID NO: 56460 - DNA, 201 bp, Bos taurus; identical to SEQ ID NO: 15673

SEQ ID NO: 56461 - DNA, 201 bp, Bos taurus; identical to SEQ ID NO: 15674

SEQ ID NO: 56462 - DNA, 201 bp, Bos taurus; identical to SEQ ID NO: 15675

SEQ ID NO: 56463 - DNA, 201 bp, Bos taurus; identical to SEQ ID NO: 15676

SEQ ID NO: 56464 - DNA, 201 bp, Bos taurus; identical to SEQ ID NO: 15677

SEQ ID NO: 56465 - DNA, 201 bp, Bos taurus; identical to SEQ ID NO: 15678

SEQ ID NO: 56466 - DNA, 201 bp, Bos taurus; identical to SEQ ID NO: 15679

SEQ ID NO: 56467 - DNA, 201 bp, Bos taurus; identical to SEQ ID NO: 15680

SEQ ID NO: 56468 - DNA, 201 bp, Bos taurus; identical to SEQ ID NO: 15681

SEQ ID NO: 56469 - DNA, 201 bp, Bos taurus; identical to SEQ ID NO: 15682

SEQ ID NO: 56470 - DNA, 201 bp, Bos taurus; identical to SEQ ID NO: 15683

SEQ ID NO: 56471 - DNA, 201 bp, Bos taurus; identical to SEQ ID NO: 15684

SEQ ID NO: 56472 - DNA, 201 bp, Bos taurus; identical to SEQ ID NO: 15685

SEQ ID NO: 56473 - DNA, 201 bp, Bos taurus; identical to SEQ ID NO: 15686

SEQ ID NO: 56474 - DNA, 201 bp, Bos taurus; identical to SEQ ID NO: 15687

SEQ ID NO: 56475 - DNA, 201 bp, Bos taurus; identical to SEQ ID NO: 15688

SEQ ID NO: 56476 - DNA, 201 bp, Bos taurus; identical to SEQ ID NO: 15689

SEQ ID NO: 56477 - DNA, 201 bp, Bos taurus; identical to SEQ ID NO: 15690

SEQ ID NO: 56478 - DNA, 201 bp, Bos taurus; identical to SEQ ID NO: 15691

SEQ ID NO: 56479 - DNA, 201 bp, Bos taurus; identical to SEQ ID NO: 15692

SEQ ID NO: 56480 - DNA, 201 bp, Bos taurus; identical to SEQ ID NO: 15693

SEQ ID NO: 56481 - DNA, 201 bp, Bos taurus; identical to SEQ ID NO: 15694

SEQ ID NO: 56482 - DNA, 201 bp, Bos taurus; identical to SEQ ID NO: 15695

SEQ ID NO: 56483 - DNA, 201 bp, Bos taurus; identical to SEQ ID NO: 15696

SEQ ID NO: 56484 - DNA, 201 bp, Bos taurus; identical to SEQ ID NO: 15697

SEQ ID NO: 56485 - DNA, 201 bp, Bos taurus; identical to SEQ ID NO: 15698

SEQ ID NO: 56486 - DNA, 201 bp, Bos taurus; identical to SEQ ID NO: 15699

SEQ ID NO: 56487 - DNA, 201 bp, Bos taurus; identical to SEQ ID NO: 15700

SEQ ID NO: 56488 - DNA, 201 bp, Bos taurus; identical to SEQ ID NO: 15701

SEQ ID NO: 56489 - DNA, 201 bp, Bos taurus; identical to SEQ ID NO: 15702

SEQ ID NO: 56490 - DNA, 201 bp, Bos taurus; identical to SEQ ID NO: 15703

SEQ ID NO: 56491 - DNA, 201 bp, Bos taurus; identical to SEQ ID NO: 15704

SEQ ID NO: 56492 - DNA, 201 bp, Bos taurus; identical to SEQ ID NO: 15705

SEQ ID NO: 56493 - DNA, 201 bp, Bos taurus; identical to SEQ ID NO: 15706

SEQ ID NO: 56494 - DNA, 201 bp, Bos taurus; identical to SEQ ID NO: 15707

SEQ ID NO: 56495 - DNA, 201 bp, Bos taurus; identical to SEQ ID NO: 15708

SEQ ID NO: 56496 - DNA, 201 bp, Bos taurus; identical to SEQ ID NO: 15709

SEQ ID NO: 56497 - DNA, 201 bp, Bos taurus; identical to SEQ ID NO: 15710

SEQ ID NO: 56498 - DNA, 201 bp, Bos taurus; identical to SEQ ID NO: 15711

SEQ ID NO: 56499 - DNA, 201 bp, Bos taurus; identical to SEQ ID NO: 15712

SEQ ID NO: 56500 - DNA, 201 bp, Bos taurus; identical to SEQ ID NO: 15713

SEQ ID NO: 56501 - DNA, 201 bp, Bos taurus; identical to SEQ ID NO: 15714

SEQ ID NO: 56502 - DNA, 201 bp, Bos taurus; identical to SEQ ID NO: 15715

SEQ ID NO: 56503 - DNA, 201 bp, Bos taurus; identical to SEQ ID NO: 15716

SEQ ID NO: 56504 - DNA, 201 bp, Bos taurus; identical to SEQ ID NO: 15717

SEQ ID NO: 56505 - DNA, 201 bp, Bos taurus; identical to SEQ ID NO: 15718

SEQ ID NO: 56506 - DNA, 201 bp, Bos taurus; identical to SEQ ID NO: 15719

SEQ ID NO: 56507 - DNA, 201 bp, Bos taurus; identical to SEQ ID NO: 15720

SEQ ID NO: 56508 - DNA, 201 bp, Bos taurus; identical to SEQ ID NO: 15721

SEQ ID NO: 56509 - DNA, 201 bp, Bos taurus; identical to SEQ ID NO: 15722

SEQ ID NO: 56510 - DNA, 201 bp, Bos taurus; identical to SEQ ID NO: 15723

SEQ ID NO: 56511 - DNA, 201 bp, Bos taurus; identical to SEQ ID NO: 15724

SEQ ID NO: 56512 - DNA, 201 bp, Bos taurus; identical to SEQ ID NO: 15725

SEQ ID NO: 56513 - DNA, 201 bp, Bos taurus; identical to SEQ ID NO: 15726

SEQ ID NO: 56514 - DNA, 201 bp, Bos taurus; identical to SEQ ID NO: 15727

SEQ ID NO: 56515 - DNA, 201 bp, Bos taurus; identical to SEQ ID NO: 15729

SEQ ID NO: 56516 - DNA, 201 bp, Bos taurus; identical to SEQ ID NO: 15730

SEQ ID NO: 56517 - DNA, 201 bp, Bos taurus; identical to SEQ ID NO: 15731

SEQ ID NO: 56518 - DNA, 201 bp, Bos taurus; identical to SEQ ID NO: 15734

SEQ ID NO: 56519 - DNA, 201 bp, Bos taurus; identical to SEQ ID NO: 15735

SEQ ID NO: 56520 - DNA, 201 bp, Bos taurus; identical to SEQ ID NO: 15738

SEQ ID NO: 56521 - DNA, 201 bp, Bos taurus; identical to SEQ ID NO: 15739

SEQ ID NO: 56522 - DNA, 201 bp, Bos taurus
aacagtatatcctcactggaaaaaaaaccagcaacccacgagtgaataagcgtgtccgcagcctggtggaagagtgactgatgctgtaactgaactcatcctcaagcacagctccgaatgcctgttaggctggaaaactgttgtgctgcgtggtaactggacataaaccaaggcggtcacatggctgattcacctgggctg

SEQ ID NO: 56523 - DNA, 201 bp, Bos taurus; identical to SEQ ID NO: 15741

SEQ ID NO: 56524 - DNA, 201 bp, Bos taurus; identical to SEQ ID NO: 15742

SEQ ID NO: 56525 - DNA, 201 bp, Bos taurus
atctgacattcgtcattttcttagcttgtgttctaagtgttatttattacaagtctgggtactgcattttcaaaataaaaaaattttaaaacataaatttacacctaccaggacggctcagattaaacactaatgacattgctggcagagggcgagtgtaaattggaacaagcactgcagaacactaactctgttttctaa

SEQ ID NO: 56526 - DNA, 201 bp, Bos taurus; identical to SEQ ID NO: 15743

SEQ ID NO: 56527 - DNA, 201 bp, Bos taurus; identical to SEQ ID NO: 15744

SEQ ID NO: 56528 - DNA, 201 bp, Bos taurus; identical to SEQ ID NO: 15745

SEQ ID NO: 56529 - DNA, 201 bp, Bos taurus; identical to SEQ ID NO: 15746

SEQ ID NO: 56530 - DNA, 201 bp, Bos taurus; identical to SEQ ID NO: 15747

SEQ ID NO: 56531 - DNA, 201 bp, Bos taurus
gggaccccttattcgtgacccctcacggccgaagccacctcgggtttttctggagagaagatgctggaataatgcatgatgatgaccgtactgggggatctgcggtgggggcccggcatgtcctaatcgctctaccatggatgctgcatgtgctggtggggggacgcttatgtcctctgctgaaacactctgactccaact

SEQ ID NO: 56532 - DNA, 201 bp, Bos taurus
cgaagcggctgccccgcaccagcaggtgcagcaggaagcagagcagctccaggcccgcggagaccaggaagaagatgagcgtgccggcccgctcgtccggcagcagcagcttggtgaggatgcggctcagcgagaccatcactcctgcggtgcctgaggaggaggggccgtgacgcccgccccgccctccctctcggcccc

SEQ ID NO: 56533 - DNA, 201 bp, Bos taurus
ctgtggagccctgtgccaaggtcacaggtgcgcagccccacaccagggtcgtctctggatctgactgagccccatagcaaccattgccatgggctccccttattgaatctggccagcttcctgaccccgtattaggtaaaaacacccaccctcacccatctcctaatcccacccttccggcaggaattttctttgtcccga

SEQ ID NO: 56534 - DNA, 201 bp, Bos taurus; identical to SEQ ID NO: 15748

SEQ ID NO: 56535 - DNA, 201 bp, Bos taurus; identical to SEQ ID NO: 15750

SEQ ID NO: 56536 - DNA, 201 bp, Bos taurus; identical to SEQ ID NO: 15751

SEQ ID NO: 56537 - DNA, 201 bp, Bos taurus
aaccaagctcccttcagactccactgccctacagagggctcggggggccgcagcgaggaggtgccgcatttactctctgtgcaatgaggcctgtaacagatgacagctgagctccaaagctcacagtaccggcaagagtttaaacactgacaatctgtaaccgcgtttcatctgactccaagcagctgcgggcctccatcc

SEQ ID NO: 56538 - DNA, 201 bp, Bos taurus; identical to SEQ ID NO: 15752

SEQ ID NO: 56539 - DNA, 201 bp, Bos taurus
gctgactgacgggctgctgttgtcagtagctgtcagttatcacgccatcagaacatggagtcgtttctaagctgagcttactgtcggtttgcaaagcgccggagagaagaggcctgaaaggccagcacgtgagctaaacaggtccggactctcagacccagagggtcgtcaggagtccgctctgaccctgccccggttctc

SEQ ID NO: 56540 - DNA, 201 bp, Bos taurus
tgacctgcccttcggtccacttcagagtccctcacaggtttttctggcactctcccccgtgggactgtaccaaccttaaagactagtcttgatcaaactcgaccagcactttagagcaggccacgccctcctgctgtgtgacagtcctcagcctgtctgcagggtcccctgccctctctcttttcctttgtttgagtcaca

SEQ ID NO: 56541 - DNA, 201 bp, Bos taurus
tcgcttgtgttcttgaactggaaccgtaagaagagaactaatcgtcaatgccgctatgcagatgggggtccaccagtgtgacggcccaccacacactgcacgcaagcgccccaaggcaggtggaaaactctcatcttccaggcaggcaggatgccttcctacgtccatctgctctcagaaccttccagtgggccctggttt

SEQ ID NO: 56542 - DNA, 201 bp, Bos taurus
aggccacaaagagttgtaagtgatctagagatggtttaaagcacaagagaggattccgatgttacatgcatatactgcaccatttcatataaggggcttgagcatcttgggattttggtagctcggaagtgaggggtagtagagggtgagggttctgggaccaacccactgaggataccaagggatgagtataatcccaga

SEQ ID NO: 56543 - DNA, 201 bp, Bos taurus
gtgaggctaccatcagccttctgacggcacgtcaggaggagggccatctgcctcagtcatctgagaccctgaacagtgacgatgtccacgaccggatgtcaggagcagacgatgcgggtgctggggcctcaccgtggtgggacagagcagcatggtgagagactgcatcaagcaactctcaacagcgctcgatgtaaaact

SEQ ID NO: 56544 - DNA, 201 bp, Bos taurus
tgtgagatctcctgctgagaaggccgtctcctgaaaagcctggaggcacaagccataactgagcctccacccagtctacatcggtggatctgcccaaccacggctgcacctcagggccactcggggagctccgacaggcacggaggccctgatcctcacgtgcagcctagctgagaaccactgatctcattcactctactc

SEQ ID NO: 56545 - DNA, 201 bp, Bos taurus
gagggcgtctccgaccctctctgcatccccgccagccccctttccatcttcactcagtggggccagcgccctggtgatgagcctgtgtcctcagccttgcagtcgccttcactttgagggaaagtgagttgggggagggtggagggaatcctctccccacccccgaccctgctcgctaacccaggaagatgctgtgacttg

SEQ ID NO: 56546 - DNA, 201 bp, Bos taurus
aaaaagcacctccttccgcccctctggcaaggggccatgtgccctgccctcctcaccttaccccctggctccctagggtctggtgtccaggctgaggacctggcgacagggtctcctctgggcctctcaatgcccaaagaagctgacttagaactggcacagctttcaacgcctgtgggtttctccagattacaagaacca

SEQ ID NO: 56547 - DNA, 201 bp, Bos taurus; identical to SEQ ID NO: 15757

SEQ ID NO: 56548 - DNA, 201 bp, Bos taurus; identical to SEQ ID NO: 15758

SEQ ID NO: 56549 - DNA, 201 bp, Bos taurus; identical to SEQ ID NO: 15759

SEQ ID NO: 56550 - DNA, 201 bp, Bos taurus; identical to SEQ ID NO: 15760

SEQ ID NO: 56551 - DNA, 201 bp, Bos taurus
caggggagaccctcagccgctgcctccggggcgaagcgggccagccccccggccggggcggccacactcagtcacacaggctggctccctaggcccctcctctccgtctcctgtgtctcttctgtgtcctggtgtcagcgctgtgggacatgcccatgatacaggcgtgtggttggccctacggaggctacggtcccgggg

SEQ ID NO: 56552 - DNA, 201 bp, Bos taurus
caaaacgctgcagaacgagattctagaaagtggccaaggaacccacaggaaggcgaaagaagggagacacagggaacagggagcgtaagtgaagcggcaggtgtggccatcgggaggtcgagctacatttaatgtgagcgacgtaaatgcactcattaggaggcagatgggcagcgtggatacacacacacaacccggtta

SEQ ID NO: 56553 - DNA, 201 bp, Bos taurus
cccctagccccagccctcagaagggcgccaggacctcagcccgcctggccaccgcgacccttccccaggtccagctccgtcacaccgggcgggcactgcccgggttggaaacaagaggggagggccggaccctgttgggttgatttatcgttcgtcagagagcctctgggttctaccaggaagacaggaggccacctcccc

SEQ ID NO: 56554 - DNA, 201 bp, Bos taurus; identical to SEQ ID NO: 15761

SEQ ID NO: 56555 - DNA, 201 bp, Bos taurus
gaggggcaggtgctgaccgctgtcacacggagctggtggctgtgacagtcagagcccagtcgacccaccccaacctccctaacgatatcagctaaagcgtcgaggccttggcccggcactacctgcgcgttctcacgcccgcactcccgccggacggggccggagtctccacccacccccatgaccagctctggccaacag

SEQ ID NO: 56556 - DNA, 201 bp, Bos taurus; identical to SEQ ID NO: 15762

SEQ ID NO: 56557 - DNA, 201 bp, Bos taurus
cttggcgcacggagcggttggtgtcacggatcacgcaagggcctgtgcttagagcactgccagtggaactcaatgacccgtgagggggaggagactgtaaacgcctcgtatgggccaggccctaaaggaggcccttctgcgagtgggatgtcatttaatcctcccaagtgttgaacgagcaagaatgggttcctccaagag

SEQ ID NO: 56558 - DNA, 201 bp, Bos taurus
ggaatcaggatggcttcccagaggagagggcactggcacagggccttggcggatgagcaggagtttgccacgcaggcaggagaaaggagggagagctctttaggcagcaaatgtggccaggtgcctgtgtgcggagaaggcaatggcaccccactccagtactcttgcctggaaactcccatggatggagtagcctggtag

SEQ ID NO: 56559 - DNA, 201 bp, Bos taurus; identical to SEQ ID NO: 15764

SEQ ID NO: 56560 - DNA, 201 bp, Bos taurus; identical to SEQ ID NO: 15765

SEQ ID NO: 56561 - DNA, 201 bp, Bos taurus; identical to SEQ ID NO: 15766

SEQ ID NO: 56562 - DNA, 201 bp, Bos taurus; identical to SEQ ID NO: 15767

SEQ ID NO: 56563 - DNA, 201 bp, Bos taurus; identical to SEQ ID NO: 15768

SEQ ID NO: 56564 - DNA, 201 bp, Bos taurus; identical to SEQ ID NO: 15769

SEQ ID NO: 56565 - DNA, 201 bp, Bos taurus; identical to SEQ ID NO: 15770

SEQ ID NO: 56566 - DNA, 201 bp, Bos taurus
gtcaacgtggcccaggacacggctcggggcacaatcactcagtcgcgagctatagcccatgcggtacccgggggcagaggaaacgtcctgaacgccatccagctcctagagacaaggcccggcctcgccgcgcaagcctgtccattcaagccaagcgggagcaggacgcgtcgaggcccggagacggggccccggcgcgcc

SEQ ID NO: 56567 - DNA, 201 bp, Bos taurus; identical to SEQ ID NO: 15771

SEQ ID NO: 56568 - DNA, 201 bp, Bos taurus; identical to SEQ ID NO: 15772

SEQ ID NO: 56569 - DNA, 201 bp, Bos taurus; identical to SEQ ID NO: 15773

SEQ ID NO: 56570 - DNA, 201 bp, Bos taurus; identical to SEQ ID NO: 15774

SEQ ID NO: 56571 - DNA, 201 bp, Bos taurus; identical to SEQ ID NO: 15775

SEQ ID NO: 56572 - DNA, 201 bp, Bos taurus; identical to SEQ ID NO: 15776

SEQ ID NO: 56573 - DNA, 201 bp, Bos taurus
ctggcgtgctgtgattcatagggtcgcaaagagtcgggcacaactgagcgactgaactgaactgaactgatgctgactaaatatactaccagttctttgaatgtcattcttcactggccttgaatctgagggtataaggaggaggcttttgtttggttcatataatttaaatttggtatcttcaaagagaatttcttccta

SEQ ID NO: 56574 - DNA, 201 bp, Bos taurus
ccaaccatactgaatcatctgccccatgggtcaagtaactagttgtatgtatgtaaaactgcgtgtaaagaaaaacacattaaagtatttggccagttagcgtgaaagaatttttaaagaaatgaaatcctaaatgcatgatgaattgctatatattagacagcatgaatgaattggcccatgtgatgctttaatgtttat

SEQ ID NO: 56575 - DNA, 201 bp, Bos taurus; identical to SEQ ID NO: 15780

SEQ ID NO: 56576 - DNA, 201 bp, Bos taurus; identical to SEQ ID NO: 15781

SEQ ID NO: 56577 - DNA, 201 bp, Bos taurus
tgtccttctttgtttctgcatctattagcttttctaaagatagctgttacagcttgtttctttctttctttactcatggaaagtctcagaagtcatagtatatggccacagttttttttttttttttctgtaattaccagcaagcaggggactcactggagatcctttcaccaggaaggcctctacataagtctgctaggt

SEQ ID NO: 56578 - DNA, 201 bp, Bos taurus; identical to SEQ ID NO: 15782

SEQ ID NO: 56579 - DNA, 201 bp, Bos taurus; identical to SEQ ID NO: 15784

SEQ ID NO: 56580 - DNA, 201 bp, Bos taurus
cacagcaaatatgtatgtatgaatatcaaaaatagcataaatgaaagcaccaaaattctaccgttcattttatgcttgacgttgagattttctgacatcttggttcatgttactatatagacttactccataaaaggtagataaaagaaagataaagtcttcatagacaaagccatctagaaagagaaaagcaactgagga

SEQ ID NO: 56581 - DNA, 201 bp, Bos taurus
ctggtgttcatccactttgagaataaaataatgggatctattagttggaaaaaacaggatcaggagtctcactgagtaaattatgtatattacatatggactgtgtttctcaaataagatcccctctaacaggcctccttcacatttatgaattagttgccatgttagcttaagaaaggaagaaacagacaggacattata

SEQ ID NO: 56582 - DNA, 201 bp, Bos taurus; identical to SEQ ID NO: 15786

SEQ ID NO: 56583 - DNA, 201 bp, Bos taurus; identical to SEQ ID NO: 15789

SEQ ID NO: 56584 - DNA, 201 bp, Bos taurus; identical to SEQ ID NO: 15790

SEQ ID NO: 56585 - DNA, 201 bp, Bos taurus
gttctttccgggataaatcatgaacagaagaccctggagggctacagtccatagggtcacaaagagtcagacactactgtgcacagattggccataaatcgcagcaaagggagcaaaattttacagaagaggtttgcaattaatctttcttataaatatttgatatgaggtgattaaaagatcatctgctttttatatccc

SEQ ID NO: 56586 - DNA, 201 bp, Bos taurus; identical to SEQ ID NO: 15791

SEQ ID NO: 56587 - DNA, 201 bp, Bos taurus
gagtcagacacgacttaaacaacaacaacaaagggcatggatggcactttaattttcttaactgaagacaaataggtttttcagagaaaatagagcatgtggatctgctgctatttctgaaaatagagataggatgctattagggtgagggctacagggaaatgaggaagattagtcttctaaatggatcttaaattttgt

SEQ ID NO: 56588 - DNA, 201 bp, Bos taurus; identical to SEQ ID NO: 15794

SEQ ID NO: 56589 - DNA, 201 bp, Bos taurus; identical to SEQ ID NO: 15795

SEQ ID NO: 56590 - DNA, 201 bp, Bos taurus; identical to SEQ ID NO: 15798

SEQ ID NO: 56591 - DNA, 201 bp, Bos taurus; identical to SEQ ID NO: 15799

SEQ ID NO: 56592 - DNA, 201 bp, Bos taurus
agttgttgttgactcactgtctctcatgttcaatacccagtttatgaggaaataccattatatatagaacatacccacattggccctttgtgctttactatctttattgttatcaacttgttctcagttcagttcagttcagttgttcagtcgtgtctgactctttgtgaccccatgaatcgtagcacgccaggcctccct

SEQ ID NO: 56593 - DNA, 201 bp, Bos taurus
agtagaggcctgtgcattaggtaataggtatacagaccttggtgtggaattcaagttagctgaactcattggacctgatgagcaaggaactgaccctaacgtctcagggccatagcctggggaaaacctgggtaatgctgatttaagcagatacccatggatgagagagattttgtgaaagtccagcccactccagtgctc

SEQ ID NO: 56594 - DNA, 201 bp, Bos taurus; identical to SEQ ID NO: 15800

SEQ ID NO: 56595 - DNA, 201 bp, Bos taurus; identical to SEQ ID NO: 15801

SEQ ID NO: 56596 - DNA, 201 bp, Bos taurus; identical to SEQ ID NO: 15802

SEQ ID NO: 56597 - DNA, 201 bp, Bos taurus; identical to SEQ ID NO: 15803

SEQ ID NO: 56598 - DNA, 201 bp, Bos taurus; identical to SEQ ID NO: 15804

SEQ ID NO: 56599 - DNA, 201 bp, Bos taurus; identical to SEQ ID NO: 15805

SEQ ID NO: 56600 - DNA, 201 bp, Bos taurus; identical to SEQ ID NO: 15806

SEQ ID NO: 56601 - DNA, 201 bp, Bos taurus; identical to SEQ ID NO: 15807

SEQ ID NO: 56602 - DNA, 201 bp, Bos taurus; identical to SEQ ID NO: 15808

SEQ ID NO: 56603 - DNA, 201 bp, Bos taurus; identical to SEQ ID NO: 15809

SEQ ID NO: 56604 - DNA, 201 bp, Bos taurus; identical to SEQ ID NO: 15810

SEQ ID NO: 56605 - DNA, 201 bp, Bos taurus; identical to SEQ ID NO: 15811

SEQ ID NO: 56606 - DNA, 201 bp, Bos taurus; identical to SEQ ID NO: 15812

SEQ ID NO: 56607 - DNA, 201 bp, Bos taurus; identical to SEQ ID NO: 15813

SEQ ID NO: 56608 - DNA, 201 bp, Bos taurus; identical to SEQ ID NO: 15814

SEQ ID NO: 56609 - DNA, 201 bp, Bos taurus; identical to SEQ ID NO: 15815

SEQ ID NO: 56610 - DNA, 201 bp, Bos taurus; identical to SEQ ID NO: 15816

SEQ ID NO: 56611 - DNA, 201 bp, Bos taurus; identical to SEQ ID NO: 15817

SEQ ID NO: 56612 - DNA, 201 bp, Bos taurus; identical to SEQ ID NO: 15818

SEQ ID NO: 56613 - DNA, 201 bp, Bos taurus; identical to SEQ ID NO: 15819

SEQ ID NO: 56614 - DNA, 201 bp, Bos taurus; identical to SEQ ID NO: 15820

SEQ ID NO: 56615 - DNA, 201 bp, Bos taurus; identical to SEQ ID NO: 15821

SEQ ID NO: 56616 - DNA, 201 bp, Bos taurus; identical to SEQ ID NO: 15822

SEQ ID NO: 56617 - DNA, 201 bp, Bos taurus; identical to SEQ ID NO: 15823

SEQ ID NO: 56618 - DNA, 201 bp, Bos taurus; identical to SEQ ID NO: 15824

SEQ ID NO: 56619 - DNA, 201 bp, Bos taurus; identical to SEQ ID NO: 15825

SEQ ID NO: 56620 - DNA, 201 bp, Bos taurus; identical to SEQ ID NO: 15826

SEQ ID NO: 56621 - DNA, 201 bp, Bos taurus; identical to SEQ ID NO: 15828

SEQ ID NO: 56622 - DNA, 201 bp, Bos taurus; identical to SEQ ID NO: 15829

SEQ ID NO: 56623 - DNA, 201 bp, Bos taurus; identical to SEQ ID NO: 15831

SEQ ID NO: 56624 - DNA, 201 bp, Bos taurus; identical to SEQ ID NO: 15832

SEQ ID NO: 56625 - DNA, 201 bp, Bos taurus; identical to SEQ ID NO: 15833

SEQ ID NO: 56626 - DNA, 201 bp, Bos taurus; identical to SEQ ID NO: 15834

SEQ ID NO: 56627 - DNA, 201 bp, Bos taurus; identical to SEQ ID NO: 15835

SEQ ID NO: 56628 - DNA, 201 bp, Bos taurus; identical to SEQ ID NO: 15836

SEQ ID NO: 56629 - DNA, 201 bp, Bos taurus; identical to SEQ ID NO: 15837

SEQ ID NO: 56630 - DNA, 201 bp, Bos taurus; identical to SEQ ID NO: 15838

SEQ ID NO: 56631 - DNA, 201 bp, Bos taurus; identical to SEQ ID NO: 15839

SEQ ID NO: 56632 - DNA, 201 bp, Bos taurus; identical to SEQ ID NO: 15840

SEQ ID NO: 56633 - DNA, 201 bp, Bos taurus; identical to SEQ ID NO: 15841

SEQ ID NO: 56634 - DNA, 201 bp, Bos taurus; identical to SEQ ID NO: 15842

SEQ ID NO: 56635 - DNA, 201 bp, Bos taurus; identical to SEQ ID NO: 15843

SEQ ID NO: 56636 - DNA, 201 bp, Bos taurus; identical to SEQ ID NO: 15844

SEQ ID NO: 56637 - DNA, 201 bp, Bos taurus; identical to SEQ ID NO: 15845

SEQ ID NO: 56638 - DNA, 201 bp, Bos taurus; identical to SEQ ID NO: 15846

SEQ ID NO: 56639 - DNA, 201 bp, Bos taurus; identical to SEQ ID NO: 15847

SEQ ID NO: 56640 - DNA, 201 bp, Bos taurus; identical to SEQ ID NO: 15848

SEQ ID NO: 56641 - DNA, 201 bp, Bos taurus; identical to SEQ ID NO: 15849

SEQ ID NO: 56642 - DNA, 201 bp, Bos taurus; identical to SEQ ID NO: 15850

SEQ ID NO: 56643 - DNA, 201 bp, Bos taurus; identical to SEQ ID NO: 15851

SEQ ID NO: 56644 - DNA, 201 bp, Bos taurus; identical to SEQ ID NO: 15852

SEQ ID NO: 56645 - DNA, 201 bp, Bos taurus; identical to SEQ ID NO: 15853

SEQ ID NO: 56646 - DNA, 201 bp, Bos taurus; identical to SEQ ID NO: 15854

SEQ ID NO: 56647 - DNA, 201 bp, Bos taurus; identical to SEQ ID NO: 15855

SEQ ID NO: 56648 - DNA, 201 bp, Bos taurus; identical to SEQ ID NO: 15857

SEQ ID NO: 56649 - DNA, 201 bp, Bos taurus; identical to SEQ ID NO: 15858

SEQ ID NO: 56650 - DNA, 201 bp, Bos taurus; identical to SEQ ID NO: 15859

SEQ ID NO: 56651 - DNA, 201 bp, Bos taurus; identical to SEQ ID NO: 15860

SEQ ID NO: 56652 - DNA, 201 bp, Bos taurus; identical to SEQ ID NO: 15861

SEQ ID NO: 56653 - DNA, 201 bp, Bos taurus; identical to SEQ ID NO: 15862

SEQ ID NO: 56654 - DNA, 201 bp, Bos taurus; identical to SEQ ID NO: 15863

SEQ ID NO: 56655 - DNA, 201 bp, Bos taurus; identical to SEQ ID NO: 15864

SEQ ID NO: 56656 - DNA, 201 bp, Bos taurus; identical to SEQ ID NO: 15865

SEQ ID NO: 56657 - DNA, 201 bp, Bos taurus; identical to SEQ ID NO: 15866

SEQ ID NO: 56658 - DNA, 201 bp, Bos taurus; identical to SEQ ID NO: 15867

SEQ ID NO: 56659 - DNA, 201 bp, Bos taurus; identical to SEQ ID NO: 15868

SEQ ID NO: 56660 - DNA, 201 bp, Bos taurus; identical to SEQ ID NO: 15869

SEQ ID NO: 56661 - DNA, 201 bp, Bos taurus; identical to SEQ ID NO: 15870

SEQ ID NO: 56662 - DNA, 201 bp, Bos taurus; identical to SEQ ID NO: 15871

SEQ ID NO: 56663 - DNA, 201 bp, Bos taurus; identical to SEQ ID NO: 15872

SEQ ID NO: 56664 - DNA, 201 bp, Bos taurus; identical to SEQ ID NO: 15873

SEQ ID NO: 56665 - DNA, 201 bp, Bos taurus; identical to SEQ ID NO: 15874

SEQ ID NO: 56666 - DNA, 201 bp, Bos taurus; identical to SEQ ID NO: 15875

SEQ ID NO: 56667 - DNA, 201 bp, Bos taurus; identical to SEQ ID NO: 15876

SEQ ID NO: 56668 - DNA, 201 bp, Bos taurus; identical to SEQ ID NO: 15877

SEQ ID NO: 56669 - DNA, 201 bp, Bos taurus; identical to SEQ ID NO: 15878

SEQ ID NO: 56670 - DNA, 201 bp, Bos taurus; identical to SEQ ID NO: 15879

SEQ ID NO: 56671 - DNA, 201 bp, Bos taurus; identical to SEQ ID NO: 15880

SEQ ID NO: 56672 - DNA, 201 bp, Bos taurus; identical to SEQ ID NO: 15881

SEQ ID NO: 56673 - DNA, 201 bp, Bos taurus; identical to SEQ ID NO: 15882

SEQ ID NO: 56674 - DNA, 201 bp, Bos taurus; identical to SEQ ID NO: 15883

SEQ ID NO: 56675 - DNA, 201 bp, Bos taurus; identical to SEQ ID NO: 15884

SEQ ID NO: 56676 - DNA, 201 bp, Bos taurus; identical to SEQ ID NO: 15885

SEQ ID NO: 56677 - DNA, 201 bp, Bos taurus; identical to SEQ ID NO: 15886

SEQ ID NO: 56678 - DNA, 201 bp, Bos taurus; identical to SEQ ID NO: 15887

SEQ ID NO: 56679 - DNA, 201 bp, Bos taurus; identical to SEQ ID NO: 15888

SEQ ID NO: 56680 - DNA, 201 bp, Bos taurus; identical to SEQ ID NO: 15889

SEQ ID NO: 56681 - DNA, 201 bp, Bos taurus; identical to SEQ ID NO: 15890

SEQ ID NO: 56682 - DNA, 201 bp, Bos taurus
ttcataaaatagggctgtgagcacctacctctagggttgtttggaggatcaaatgtgcaccaggagtagaagctttgatcattcctttaaacttggcaaagctctggccagacctgttatttattgaatattctcatcaaccatgggcttccccagtggctcagatagtgaaaagtctgcctgctctgcagtagacccagg

SEQ ID NO: 56683 - DNA, 201 bp, Bos taurus; identical to SEQ ID NO: 15891

SEQ ID NO: 56684 - DNA, 201 bp, Bos taurus; identical to SEQ ID NO: 15892

SEQ ID NO: 56685 - DNA, 201 bp, Bos taurus; identical to SEQ ID NO: 15893

SEQ ID NO: 56686 - DNA, 201 bp, Bos taurus; identical to SEQ ID NO: 15894

SEQ ID NO: 56687 - DNA, 201 bp, Bos taurus; identical to SEQ ID NO: 15895

SEQ ID NO: 56688 - DNA, 201 bp, Bos taurus; identical to SEQ ID NO: 15896

SEQ ID NO: 56689 - DNA, 201 bp, Bos taurus; identical to SEQ ID NO: 15897

SEQ ID NO: 56690 - DNA, 201 bp, Bos taurus; identical to SEQ ID NO: 15898

SEQ ID NO: 56691 - DNA, 201 bp, Bos taurus; identical to SEQ ID NO: 15899

SEQ ID NO: 56692 - DNA, 201 bp, Bos taurus; identical to SEQ ID NO: 15900

SEQ ID NO: 56693 - DNA, 201 bp, Bos taurus; identical to SEQ ID NO: 15901

SEQ ID NO: 56694 - DNA, 201 bp, Bos taurus; identical to SEQ ID NO: 15902

SEQ ID NO: 56695 - DNA, 201 bp, Bos taurus; identical to SEQ ID NO: 15903

SEQ ID NO: 56696 - DNA, 201 bp, Bos taurus; identical to SEQ ID NO: 15904

SEQ ID NO: 56697 - DNA, 201 bp, Bos taurus; identical to SEQ ID NO: 15905

SEQ ID NO: 56698 - DNA, 201 bp, Bos taurus; identical to SEQ ID NO: 15906

SEQ ID NO: 56699 - DNA, 201 bp, Bos taurus; identical to SEQ ID NO: 15907

SEQ ID NO: 56700 - DNA, 201 bp, Bos taurus; identical to SEQ ID NO: 15908

SEQ ID NO: 56701 - DNA, 201 bp, Bos taurus; identical to SEQ ID NO: 15909

SEQ ID NO: 56702 - DNA, 201 bp, Bos taurus; identical to SEQ ID NO: 15910

SEQ ID NO: 56703 - DNA, 201 bp, Bos taurus; identical to SEQ ID NO: 15911

SEQ ID NO: 56704 - DNA, 201 bp, Bos taurus; identical to SEQ ID NO: 15912

SEQ ID NO: 56705 - DNA, 201 bp, Bos taurus; identical to SEQ ID NO: 15913

SEQ ID NO: 56706 - DNA, 201 bp, Bos taurus; identical to SEQ ID NO: 15914

SEQ ID NO: 56707 - DNA, 201 bp, Bos taurus; identical to SEQ ID NO: 15915

SEQ ID NO: 56708 - DNA, 201 bp, Bos taurus; identical to SEQ ID NO: 15916

SEQ ID NO: 56709 - DNA, 201 bp, Bos taurus; identical to SEQ ID NO: 15917

SEQ ID NO: 56710 - DNA, 201 bp, Bos taurus; identical to SEQ ID NO: 15918

SEQ ID NO: 56711 - DNA, 201 bp, Bos taurus; identical to SEQ ID NO: 15919

SEQ ID NO: 56712 - DNA, 201 bp, Bos taurus; identical to SEQ ID NO: 15920

SEQ ID NO: 56713 - DNA, 201 bp, Bos taurus; identical to SEQ ID NO: 15921

SEQ ID NO: 56714 - DNA, 201 bp, Bos taurus; identical to SEQ ID NO: 15922

SEQ ID NO: 56715 - DNA, 201 bp, Bos taurus; identical to SEQ ID NO: 15923

SEQ ID NO: 56716 - DNA, 201 bp, Bos taurus; identical to SEQ ID NO: 15924

SEQ ID NO: 56717 - DNA, 201 bp, Bos taurus; identical to SEQ ID NO: 15925

SEQ ID NO: 56718 - DNA, 201 bp, Bos taurus; identical to SEQ ID NO: 15927

SEQ ID NO: 56719 - DNA, 201 bp, Bos taurus; identical to SEQ ID NO: 15928

SEQ ID NO: 56720 - DNA, 201 bp, Bos taurus; identical to SEQ ID NO: 15929

SEQ ID NO: 56721 - DNA, 201 bp, Bos taurus; identical to SEQ ID NO: 15930

SEQ ID NO: 56722 - DNA, 201 bp, Bos taurus; identical to SEQ ID NO: 15931

SEQ ID NO: 56723 - DNA, 201 bp, Bos taurus; identical to SEQ ID NO: 15936

SEQ ID NO: 56724 - DNA, 201 bp, Bos taurus; identical to SEQ ID NO: 15937

SEQ ID NO: 56725 - DNA, 201 bp, Bos taurus; identical to SEQ ID NO: 15938

SEQ ID NO: 56726 - DNA, 201 bp, Bos taurus; identical to SEQ ID NO: 15939

SEQ ID NO: 56727 - DNA, 201 bp, Bos taurus; identical to SEQ ID NO: 15940

SEQ ID NO: 56728 - DNA, 201 bp, Bos taurus; identical to SEQ ID NO: 15941

SEQ ID NO: 56729 - DNA, 201 bp, Bos taurus; identical to SEQ ID NO: 15942

SEQ ID NO: 56730 - DNA, 201 bp, Bos taurus; identical to SEQ ID NO: 15943

SEQ ID NO: 56731 - DNA, 201 bp, Bos taurus; identical to SEQ ID NO: 15944

SEQ ID NO: 56732 - DNA, 201 bp, Bos taurus; identical to SEQ ID NO: 15945

SEQ ID NO: 56733 - DNA, 201 bp, Bos taurus; identical to SEQ ID NO: 15946

SEQ ID NO: 56734 - DNA, 201 bp, Bos taurus; identical to SEQ ID NO: 15947

SEQ ID NO: 56735 - DNA, 201 bp, Bos taurus; identical to SEQ ID NO: 15948

SEQ ID NO: 56736 - DNA, 201 bp, Bos taurus; identical to SEQ ID NO: 15949

SEQ ID NO: 56737 - DNA, 201 bp, Bos taurus; identical to SEQ ID NO: 15950

SEQ ID NO: 56738 - DNA, 201 bp, Bos taurus; identical to SEQ ID NO: 15951

SEQ ID NO: 56739 - DNA, 201 bp, Bos taurus; identical to SEQ ID NO: 15952

SEQ ID NO: 56740 - DNA, 201 bp, Bos taurus; identical to SEQ ID NO: 15953

SEQ ID NO: 56741 - DNA, 201 bp, Bos taurus; identical to SEQ ID NO: 15954

SEQ ID NO: 56742 - DNA, 201 bp, Bos taurus; identical to SEQ ID NO: 15955

SEQ ID NO: 56743 - DNA, 201 bp, Bos taurus; identical to SEQ ID NO: 15956

SEQ ID NO: 56744 - DNA, 201 bp, Bos taurus; identical to SEQ ID NO: 15957

SEQ ID NO: 56745 - DNA, 201 bp, Bos taurus; identical to SEQ ID NO: 15958

SEQ ID NO: 56746 - DNA, 201 bp, Bos taurus; identical to SEQ ID NO: 15959

SEQ ID NO: 56747 - DNA, 201 bp, Bos taurus; identical to SEQ ID NO: 15963

SEQ ID NO: 56748 - DNA, 201 bp, Bos taurus; identical to SEQ ID NO: 15964

SEQ ID NO: 56749 - DNA, 201 bp, Bos taurus; identical to SEQ ID NO: 15965

SEQ ID NO: 56750 - DNA, 201 bp, Bos taurus; identical to SEQ ID NO: 15967

SEQ ID NO: 56751 - DNA, 201 bp, Bos taurus; identical to SEQ ID NO: 15968

SEQ ID NO: 56752 - DNA, 201 bp, Bos taurus; identical to SEQ ID NO: 15970

SEQ ID NO: 56753 - DNA, 201 bp, Bos taurus; identical to SEQ ID NO: 15973

SEQ ID NO: 56754 - DNA, 201 bp, Bos taurus; identical to SEQ ID NO: 15975

SEQ ID NO: 56755 - DNA, 201 bp, Bos taurus; identical to SEQ ID NO: 15976

SEQ ID NO: 56756 - DNA, 201 bp, Bos taurus; identical to SEQ ID NO: 15979

SEQ ID NO: 56757 - DNA, 201 bp, Bos taurus; identical to SEQ ID NO: 15980

SEQ ID NO: 56758 - DNA, 201 bp, Bos taurus; identical to SEQ ID NO: 15981

SEQ ID NO: 56759 - DNA, 201 bp, Bos taurus; identical to SEQ ID NO: 15982

SEQ ID NO: 56760 - DNA, 201 bp, Bos taurus; identical to SEQ ID NO: 15983

SEQ ID NO: 56761 - DNA, 201 bp, Bos taurus; identical to SEQ ID NO: 15984

SEQ ID NO: 56762 - DNA, 201 bp, Bos taurus; identical to SEQ ID NO: 15986

SEQ ID NO: 56763 - DNA, 201 bp, Bos taurus; identical to SEQ ID NO: 15988

SEQ ID NO: 56764 - DNA, 201 bp, Bos taurus; identical to SEQ ID NO: 15991

SEQ ID NO: 56765 - DNA, 201 bp, Bos taurus; identical to SEQ ID NO: 15995

SEQ ID NO: 56766 - DNA, 201 bp, Bos taurus; identical to SEQ ID NO: 15999

SEQ ID NO: 56767 - DNA, 201 bp, Bos taurus; identical to SEQ ID NO: 16000

SEQ ID NO: 56768 - DNA, 201 bp, Bos taurus; identical to SEQ ID NO: 16001

SEQ ID NO: 56769 - DNA, 201 bp, Bos taurus; identical to SEQ ID NO: 16003

SEQ ID NO: 56770 - DNA, 201 bp, Bos taurus; identical to SEQ ID NO: 16005

SEQ ID NO: 56771 - DNA, 201 bp, Bos taurus; identical to SEQ ID NO: 16006

SEQ ID NO: 56772 - DNA, 201 bp, Bos taurus; identical to SEQ ID NO: 16007

SEQ ID NO: 56773 - DNA, 201 bp, Bos taurus; identical to SEQ ID NO: 16008

SEQ ID NO: 56774 - DNA, 201 bp, Bos taurus; identical to SEQ ID NO: 16009

SEQ ID NO: 56775 - DNA, 201 bp, Bos taurus; identical to SEQ ID NO: 16010

SEQ ID NO: 56776 - DNA, 201 bp, Bos taurus; identical to SEQ ID NO: 16012

SEQ ID NO: 56777 - DNA, 201 bp, Bos taurus; identical to SEQ ID NO: 16014

SEQ ID NO: 56778 - DNA, 201 bp, Bos taurus; identical to SEQ ID NO: 16015

SEQ ID NO: 56779 - DNA, 201 bp, Bos taurus; identical to SEQ ID NO: 16016

SEQ ID NO: 56780 - DNA, 201 bp, Bos taurus; identical to SEQ ID NO: 16018

SEQ ID NO: 56781 - DNA, 201 bp, Bos taurus; identical to SEQ ID NO: 16019

SEQ ID NO: 56782 - DNA, 201 bp, Bos taurus; identical to SEQ ID NO: 16020

SEQ ID NO: 56783 - DNA, 201 bp, Bos taurus; identical to SEQ ID NO: 16021

SEQ ID NO: 56784 - DNA, 201 bp, Bos taurus; identical to SEQ ID NO: 16022

SEQ ID NO: 56785 - DNA, 201 bp, Bos taurus; identical to SEQ ID NO: 16024

SEQ ID NO: 56786 - DNA, 201 bp, Bos taurus; identical to SEQ ID NO: 16025

SEQ ID NO: 56787 - DNA, 201 bp, Bos taurus; identical to SEQ ID NO: 16026

SEQ ID NO: 56788 - DNA, 201 bp, Bos taurus; identical to SEQ ID NO: 16027

SEQ ID NO: 56789 - DNA, 201 bp, Bos taurus; identical to SEQ ID NO: 16028

SEQ ID NO: 56790 - DNA, 201 bp, Bos taurus; identical to SEQ ID NO: 16029

SEQ ID NO: 56791 - DNA, 201 bp, Bos taurus; identical to SEQ ID NO: 16030

SEQ ID NO: 56792 - DNA, 201 bp, Bos taurus
cccagagcctcactctgagcacagttttgtctcccaagactgcgttgacctttctataaagggctgagatcagaccaacgtgatgctgggagtgcaccaggagaagcaatagctgggtaggtcaagttctgatgcattgtgagtacatactcagtcgtgtccaactctgtgactccatgaactgtgcatgggattatccca

SEQ ID NO: 56793 - DNA, 201 bp, Bos taurus; identical to SEQ ID NO: 16031

SEQ ID NO: 56794 - DNA, 201 bp, Bos taurus
acagtcctgaggttgaccataagggccaaaaggtagaaggtggcccaattcctagcaatccctgccccttccccaaaatagttggtataatcttatccagcccataaaactaagcaaaccgcagggcccctcatcttctgacatggcctacagtctatgatggcctggcatgcggcagtccatggagtcacaaagagtcag

SEQ ID NO: 56795 - DNA, 201 bp, Bos taurus; identical to SEQ ID NO: 16032

SEQ ID NO: 56796 - DNA, 201 bp, Bos taurus; identical to SEQ ID NO: 16034

SEQ ID NO: 56797 - DNA, 201 bp, Bos taurus; identical to SEQ ID NO: 16036

SEQ ID NO: 56798 - DNA, 201 bp, Bos taurus; identical to SEQ ID NO: 16037

SEQ ID NO: 56799 - DNA, 201 bp, Bos taurus; identical to SEQ ID NO: 16038

SEQ ID NO: 56800 - DNA, 201 bp, Bos taurus
tatcatggccagtagctgtcactctgggtcactccacaaagggcgtggtctttcctcctcccacctcagccagttttgccaatctgactggccagcagcttggacagatctttctctgctgcatacagatgggcaccaacctgatcctgaaagctgggcatgggcacactgccaggccatcagcatcagctttctcaacag

SEQ ID NO: 56801 - DNA, 201 bp, Bos taurus; identical to SEQ ID NO: 16040

SEQ ID NO: 56802 - DNA, 201 bp, Bos taurus
ctattaaaccctaaggccccgtttcccctcccctcagcccctggtaaccaccattctgctttctgccttgtgaacctgattaccctaggaacctcatatacgtgaaatcatagggcctcttttctttagtcagagtcttgtttcacttagtgtgttttattttctttaacaaatacttgcttgatactcatgtggtctgct

SEQ ID NO: 56803 - DNA, 201 bp, Bos taurus; identical to SEQ ID NO: 16042

SEQ ID NO: 56804 - DNA, 201 bp, Bos taurus; identical to SEQ ID NO: 16044

SEQ ID NO: 56805 - DNA, 201 bp, Bos taurus; identical to SEQ ID NO: 16045

SEQ ID NO: 56806 - DNA, 201 bp, Bos taurus
aggtgttggctggtttggccagcagggagatggtctggattgttcggcaaacaatatgtaggagtgccagcagaggggcaagtggtcagcaatcagcagcgtggccctgcagtggctactttgtacgactctctggaccacatgtaactgtgtgtattcctgcaggggttttgccttccatgctgagaaggctatagaaag

SEQ ID NO: 56807 - DNA, 201 bp, Bos taurus; identical to SEQ ID NO: 16046

SEQ ID NO: 56808 - DNA, 201 bp, Bos taurus; identical to SEQ ID NO: 16047

SEQ ID NO: 56809 - DNA, 201 bp, Bos taurus; identical to SEQ ID NO: 16048

SEQ ID NO: 56810 - DNA, 201 bp, Bos taurus
atcactccccactccttaagctcaggctgtgcttggtgacttcattccagagtggacagtatggaagaggggtgggagagaacctttacagtgaacaaatttgaaaagcactacctcacctgggtgatcgaggtcaacatcaacaatcaacatcatgttgagagtgtgtacttctgatatgatgtcatgacaactggcact

SEQ ID NO: 56811 - DNA, 201 bp, Bos taurus; identical to SEQ ID NO: 16049

SEQ ID NO: 56812 - DNA, 201 bp, Bos taurus; identical to SEQ ID NO: 16050

SEQ ID NO: 56813 - DNA, 201 bp, Bos taurus; identical to SEQ ID NO: 16051

SEQ ID NO: 56814 - DNA, 201 bp, Bos taurus
gatttattttgtacattcttagcaagatgtgtcccatgctaatatcccctttgttttacaccatttcaatttaggaaaggtttcatagactgttctgcttcagggtgtcctaggaaacctgtctggcctatttttgcatgtctctagatggtgactgcagccatgaaattaaaagacgcttactccttggaaggaaagtta

SEQ ID NO: 56815 - DNA, 201 bp, Bos taurus; identical to SEQ ID NO: 16052

SEQ ID NO: 56816 - DNA, 201 bp, Bos taurus; identical to SEQ ID NO: 16054

SEQ ID NO: 56817 - DNA, 201 bp, Bos taurus; identical to SEQ ID NO: 16055

SEQ ID NO: 56818 - DNA, 201 bp, Bos taurus
tttctttacatgcggtgcaaggccatgattggtgggatatgttaagcaacatttgggggttaaactgaaaaggaagtctcctgttagacagaaccatgaagaccatatgggacagtactcaccatttttcctcctagatatagaagctcaggagtcttctcatcttagcatttcacactcatttgcacgtcgtcgtggtcg

SEQ ID NO: 56819 - DNA, 201 bp, Bos taurus
aacagtccacacttcagccacagtgtgctggcctcttctagggcccctcctaagtctcagtgccccacagggcccatgtggctgcccactccttctcgtcctcagctagcagaccccgaaagcagggtgaggcccattagccttggctatcacccggtcaaccttccttatttttgttcagttgttgagtcgcgtctgact

SEQ ID NO: 56820 - DNA, 201 bp, Bos taurus; identical to SEQ ID NO: 16057

SEQ ID NO: 56821 - DNA, 201 bp, Bos taurus; identical to SEQ ID NO: 16059

SEQ ID NO: 56822 - DNA, 201 bp, Bos taurus; identical to SEQ ID NO: 16060

SEQ ID NO: 56823 - DNA, 201 bp, Bos taurus; identical to SEQ ID NO: 16061

SEQ ID NO: 56824 - DNA, 201 bp, Bos taurus; identical to SEQ ID NO: 16062

SEQ ID NO: 56825 - DNA, 201 bp, Bos taurus; identical to SEQ ID NO: 16063

SEQ ID NO: 56826 - DNA, 201 bp, Bos taurus; identical to SEQ ID NO: 16064

SEQ ID NO: 56827 - DNA, 201 bp, Bos taurus; identical to SEQ ID NO: 16065

SEQ ID NO: 56828 - DNA, 201 bp, Bos taurus; identical to SEQ ID NO: 16066

SEQ ID NO: 56829 - DNA, 201 bp, Bos taurus
ttttagtcattgaagatattggctgagttcaaccatttgccgtaaaggccattccaaactttaaatctatatattgcaaaaactgaaggactgtagttagcggggatgatgttaagtgtggccaaggacactgcggcaagttttcaagcactgagtttctatttcaagatcatagacttactaaagagagtgacaaatgct

SEQ ID NO: 56830 - DNA, 201 bp, Bos taurus
ggaatcttcttaccagcttcattttcacggcccaccctggtgggatgttggcttcactcgttttcatgtaaggacatccttcatctttctttttgggggcattgcccccttgggccctccctcacacccaaagcgctctccttttggtgtgaaattaagcagatggagtcagagcagagccttgcagggtacggcataatt

SEQ ID NO: 56831 - DNA, 201 bp, Bos taurus
gcaatggacatggccatgacctgctgctttagctagttctgcgagcccagtgcctgtgcattaatgattagaggagaagcgggtgatgtccagaacttcgtggaggatgttttctcataatggccagttggttttacatgataccttgacagatgaaaataaggactatacccataatggtaataatgacagtaatcatag

SEQ ID NO: 56832 - DNA, 201 bp, Bos taurus; identical to SEQ ID NO: 16069

SEQ ID NO: 56833 - DNA, 201 bp, Bos taurus
ggctgttcactacaagggacacggtttggagcctgacgttagttaactgcccactttttttaaaaaaaaatcagtttcttcagaggaacacaacaaaatccgggggctctacaatatatatcattcatgaatggatactacgcaaaatactaagtacatgaagaaaaaaaatgtgagccaaaaagcagtcaatggagactt

SEQ ID NO: 56834 - DNA, 201 bp, Bos taurus
aaactacacatgaacatgactttggaagaaaaatgccaaggtcaacttgactgcctcttggcaaacaagtacaatcagtggccatcacatactatgggtcgttccatcctagagtgcccagtgctttctcagatccactcggaagggtcctgactcagaacccacagcagagaagtaggaaggagagggccactcagaggt

SEQ ID NO: 56835 - DNA, 201 bp, Bos taurus
tggccccatttgactttctgtacaagggactcagtcattgcctgacccagtcatgcccaccatgtgtaacctcacccctggtcagggcagatcgacccaaagaggtggcccacccaacctgaggctagaatgtgtaagatagccagatgcaaaggaataatccaggtcaattatttctttctttccggaacctgaacacag

SEQ ID NO: 56836 - DNA, 201 bp, Bos taurus
tgatggcctgggagcctggaccagccgccgacccattgcccaccaccgtctctgagctctggttgaccggacttgaagacgcaggcagcagcccattaaaaaagtcaggggccgctggaccctgagtgggcaatgaggccatagccacctgtccaaagataatcagagtctgtcacctcccattctctttccgtcccctcc

SEQ ID NO: 56837 - DNA, 201 bp, Bos taurus
agagtctgaggccttatctactgaaacaataaaactcaaatccaactcaactactaacatgactgactcaactcctcacactaagagcccaacagaagagcggcaggcccactagtaataagcataaaatcatttatgccagtctctactattgtttccatacacactgtccagcattcaattagaaacaccccaaaaaag

SEQ ID NO: 56838 - DNA, 201 bp, Bos taurus; identical to SEQ ID NO: 16070

SEQ ID NO: 56839 - DNA, 201 bp, Bos taurus; identical to SEQ ID NO: 16071

SEQ ID NO: 56840 - DNA, 201 bp, Bos taurus; identical to SEQ ID NO: 16072

SEQ ID NO: 56841 - DNA, 201 bp, Bos taurus; identical to SEQ ID NO: 16073

SEQ ID NO: 56842 - DNA, 201 bp, Bos taurus; identical to SEQ ID NO: 16074

SEQ ID NO: 56843 - DNA, 201 bp, Bos taurus; identical to SEQ ID NO: 16075

SEQ ID NO: 56844 - DNA, 201 bp, Bos taurus; identical to SEQ ID NO: 16076

SEQ ID NO: 56845 - DNA, 201 bp, Bos taurus
tcacacgagctgatgagatgccagagccgtgaggatggggtgttggacgttaggagactcttctcatcggcagaaacatatttgagaccctggccatcgtgaagcacagggtggtccccagggggattgtcctgcctgcccttgggtctggattcagctggcagagttgggcctcgtttgttccctccgcactgccttagg

SEQ ID NO: 56846 - DNA, 201 bp, Bos taurus; identical to SEQ ID NO: 16077

SEQ ID NO: 56847 - DNA, 201 bp, Bos taurus; identical to SEQ ID NO: 16078

SEQ ID NO: 56848 - DNA, 201 bp, Bos taurus; identical to SEQ ID NO: 16079

SEQ ID NO: 56849 - DNA, 201 bp, Bos taurus; identical to SEQ ID NO: 16080

SEQ ID NO: 56850 - DNA, 201 bp, Bos taurus
tgtagaattattcttaatttctgcaggactcattttaatcactgacctccattatccacagagagaaagtgaaatgactgagttccagagtgaagggcgtatgcacaaccatcactcagggatgagagtggctttgctgggtaggggggtgaggtgggggcggctgtctctttgtgtttcctcctcatctctgtcaagatg

SEQ ID NO: 56851 - DNA, 201 bp, Bos taurus; identical to SEQ ID NO: 16081

SEQ ID NO: 56852 - DNA, 201 bp, Bos taurus; identical to SEQ ID NO: 16082

SEQ ID NO: 56853 - DNA, 201 bp, Bos taurus; identical to SEQ ID NO: 16083

SEQ ID NO: 56854 - DNA, 201 bp, Bos taurus; identical to SEQ ID NO: 16084

SEQ ID NO: 56855 - DNA, 201 bp, Bos taurus
tgagttgtctgaaccctgagacttggtagcagagagaagtgccaactgctgttcacagaggtcttcctgggatggtgggggccactgtggggagcgagccgcgcagcggggagaaggaggtctgcagtctttgctttgataaatgatgccctgtggggccccgctgtaacactgcacaggctccacgcaggacccagcaaa

SEQ ID NO: 56856 - DNA, 201 bp, Bos taurus; identical to SEQ ID NO: 16085

SEQ ID NO: 56857 - DNA, 201 bp, Bos taurus
ttgaggacaagacagcatctgcctgctcctgtttcgggtcactgctgaaatgccacctcctcaggaaggccttgctgaaggcccagtcttctctatcaccaagtgctgtcggcttcttccaagacacggatcaccatttgtaatcacacatttgttgagtcatttgttgtctagaacagaagctctgtgaaagggccaggc

SEQ ID NO: 56858 - DNA, 201 bp, Bos taurus
agaggtcagtggtcttaggacaggcaggagataagccactagctatgtgaagtcatgttgactttgatctgctaggccttttggctccgaaagaaaggcatcaatgagccagaggtcctctaatctccttagagataagctgaaaccgcttggctggggtagggggatccaggcttctctctgtgcactgaggccagactc

SEQ ID NO: 56859 - DNA, 201 bp, Bos taurus; identical to SEQ ID NO: 16086

SEQ ID NO: 56860 - DNA, 201 bp, Bos taurus
ttttaaatccatttgccccaattatttggctatcacaagaaaacttaagtgggattatcaggaaaattaccttcatcctttactccctttgtgctcgcacactgcttgtaggagctagaagagccaggaacatacaggtctcaggaatgcctgtggctgactctcttatcttgaatttattttcttaaggactctaacaag

SEQ ID NO: 56861 - DNA, 201 bp, Bos taurus; identical to SEQ ID NO: 16087

SEQ ID NO: 56862 - DNA, 201 bp, Bos taurus; identical to SEQ ID NO: 16088

SEQ ID NO: 56863 - DNA, 201 bp, Bos taurus; identical to SEQ ID NO: 16089

SEQ ID NO: 56864 - DNA, 201 bp, Bos taurus; identical to SEQ ID NO: 16090

SEQ ID NO: 56865 - DNA, 201 bp, Bos taurus; identical to SEQ ID NO: 16091

SEQ ID NO: 56866 - DNA, 201 bp, Bos taurus; identical to SEQ ID NO: 16092

SEQ ID NO: 56867 - DNA, 201 bp, Bos taurus
ctctccccacctcctccttggccatgttttgtaacatcatcgcccacggcatctctctgtctttgtcactgccttgccttctttattctctaacttggctcccctagtcacacattaaggaaggctttccctggtggcgctgtggataagaatccggcgaccaacacaggggacatgggttcaatccccagtccaggaaga

SEQ ID NO: 56868 - DNA, 201 bp, Bos taurus
ccattttactttaaaatcgttattatgtaaatttgcagaagacaaattttaagtatacctcaagtgttcctataaatttaagacatttagtaatacttcagggtggcttgcaacttaaattctataacttttgttaggaagtgtaggattccattgtggaataaactgtagatgccccccaacaccccaccccctcatcag

SEQ ID NO: 56869 - DNA, 201 bp, Bos taurus
cctgctgttccttctccccctcagctgccagtccttctcctcctgtgcccctcgaggtaacgctcaatccatcgtgcaccctcacaaagagagctttgctcagtgagaaaagcatccttgtgcctccccgggatgtggaccagccgctctcccagctgtgcggtgtcaggttacttaaccgcctgcctcctggtgcagctc

SEQ ID NO: 56870 - DNA, 201 bp, Bos taurus; identical to SEQ ID NO: 16093

SEQ ID NO: 56871 - DNA, 201 bp, Bos taurus; identical to SEQ ID NO: 16094

SEQ ID NO: 56872 - DNA, 201 bp, Bos taurus; identical to SEQ ID NO: 16095

SEQ ID NO: 56873 - DNA, 201 bp, Bos taurus
gtgccaggcactgggcccaggcacacgccctgccctgggcagcccccggttgcacgtgggagacctcgaatgttagggtgaactggcaccccacagccccgccttgctgaatcctgggcccaccccactcctagagattgtgatcaactgggtttgggaagggacagtggaatctgcattttaacagatgatccgggtgat

SEQ ID NO: 56874 - DNA, 201 bp, Bos taurus
taactggcctctggcactgggaatgcttccagtagctcctgcaaactttgagttcctgttcaccagagtgaccaccgactacttgctgagacatcttcacgaaggcgcaggtggccgaggttggaggctgagggagcacgcagaaagagagggctgagcagttcctcttagcactggaattcacacagatttgaatattca

SEQ ID NO: 56875 - DNA, 201 bp, Bos taurus
cttgcttctcttccatcgcatggaggctggtgcgctgcagggtgttatcatcagttcttttcttctcacttccacacctcctctgggccctttggttctcttttatgactcaaattatagtaagattacagttaaactatggcttgaaatcacatctgtctcttgagctcaccacctgcaaacccaggtgccttctgcacg

SEQ ID NO: 56876 - DNA, 201 bp, Bos taurus; identical to SEQ ID NO: 16096

SEQ ID NO: 56877 - DNA, 201 bp, Bos taurus
tgggtccctgtagaggcaaccaggatatacagtgaaaacagctacgataagataacaactacaacaataacaactaacaagaaagaggctctttctctgtggccccacgcagtcagtactgggcacttcctatggagagaacctggcctttggagcagggggagctgggctcatatttcatctctgctcctcctatcaaca

SEQ ID NO: 56878 - DNA, 201 bp, Bos taurus
aacttgatcttcttggccccattctgtatttcagagtcacagcccaagacactagctttctttggagagggtcaacatgtttaaacgtgcctactccaacaccttccaatgtgttttctgtgtggccagacaggagttctgcccttctgagaaccagaagtctcccataggggtggggaaggcaggcaatttcagaattct

SEQ ID NO: 56879 - DNA, 201 bp, Bos taurus; identical to SEQ ID NO: 16097

SEQ ID NO: 56880 - DNA, 201 bp, Bos taurus
gcacagctgggactaggacacatagccagagcgtgctcactgatcagggttactctaaaatgtctgagaaaaggaaaacatggctgggggtcacaccccggaggagggccagcttccagtgtcaccaccagattctctggtgccccttgatgagtcatttatggtaaatgaaagtgatcctcattttcaaggagatgtcca

SEQ ID NO: 56881 - DNA, 201 bp, Bos taurus
ggaagaagccatctcaataatccaggccagaggaaggaggagtctgcagagactgagtcaggtaacatttgaggaccaggatgaggtggaagtcagagaacagaagacagagctgacagcagggcctcaacagatgaagcggctgcacccctctgcacattaaataaagctaaaaaaaataataaagactagtgtccctgt

SEQ ID NO: 56882 - DNA, 201 bp, Bos taurus; identical to SEQ ID NO: 16098

SEQ ID NO: 56883 - DNA, 201 bp, Bos taurus
cctgtcgtgagaactggagctgattcgtgttaaatgccaggcacggagcctgccccaagctcaatgaaccatcgccatgtcggtggccagagccactagcggtgcagcccgaatcctcccctccatgtgggtacctggatgttgagtctcccccgatgggcccccaggccatagcgcttggaagtggatgcatggagctgg

SEQ ID NO: 56884 - DNA, 201 bp, Bos taurus
ctgggaagccaagaacggcccagatgtggggcagatgtcctgttacccctgagatcaacatgtgggaaacagagtccccacagggagtggcaaagaagcagaaacaggcagggcccctgccaccttctctaggaagatctacttctgggatagttacctacagatgtgattccagccccaggcagacaggctctgccactg

SEQ ID NO: 56885 - DNA, 201 bp, Bos taurus
cctagactgtgacagatgcaaggctcgggtacccacggcttctcatccaccggagctcaacgctctgactcaccacgggccttgtgttagtttcctggggctgccgctttgcagtaccacaaactggatgacttcaaacacgttgagtttaccctctcacagatccagaagccagagtctgggaccagggtgtccctgggc

SEQ ID NO: 56886 - DNA, 201 bp, Bos taurus
ttgagacccactgagacagtcagttgggtttgaattcactacctccctgccccaatcgcttcttggccttttgtctgagaccaagtgtgaattcactctccggattggtttgtggcctcttcaggagacgagaaaatccataacgaaaggccattaagagagacagaagaagagagggtctctcttcttccccgggaccgt

SEQ ID NO: 56887 - DNA, 201 bp, Bos taurus; identical to SEQ ID NO: 16099

SEQ ID NO: 56888 - DNA, 201 bp, Bos taurus; identical to SEQ ID NO: 16101

SEQ ID NO: 56889 - DNA, 201 bp, Bos taurus; identical to SEQ ID NO: 16103

SEQ ID NO: 56890 - DNA, 201 bp, Bos taurus
caagaaaaattattattagagacccacctaattaacatatttctagtgtttcccagtgaaggcagaggcctttcttaactggcgctctctgaaatagtcacttgacaattggcacacctcaggcacgattgcccgccaaagctagtggggcctgcgcactcagcagcggttgcccactcccttccctccaagaccgctgcg

SEQ ID NO: 56891 - DNA, 201 bp, Bos taurus; identical to SEQ ID NO: 16104

SEQ ID NO: 56892 - DNA, 201 bp, Bos taurus
gtggatggagcgcagattgccacttccgactctcagcttctctccccacttcctgccccatcattcacatcgtctacaccagtaattctttttttttttttattcagatcttctttaatctttgttggaagagcttatccacgaattctgttttttaaaaactttgtatttggcgttggagtatagcctattaacaatgtt

SEQ ID NO: 56893 - DNA, 201 bp, Bos taurus; identical to SEQ ID NO: 16107

SEQ ID NO: 56894 - DNA, 201 bp, Bos taurus
ctcagttaccctaggaaatctgaggttactggggccagtgcatgaggctaaaatggtcaccacaaacctaagcaaaggtgccaggggtgggatcttagccggctggagacagtaagttagagctatgggagtggcatgagaaggagacagacagacagactgactcggcgcagagccccaggaaaaaagcagaaggccaca

SEQ ID NO: 56895 - DNA, 201 bp, Bos taurus
tctgcagtggtccctgagctggcagtgggctggtttgtctggtgtcctcactgacatgcctgttcctggtgacttgtgaatataacatgccaggcagagcggggccaggactgtgccaggcagaacaatggtattctaccaggctccctgcctgcatacagttgtacgtgaccacacacccctgtgtgtgacttctttttt

SEQ ID NO: 56896 - DNA, 201 bp, Bos taurus; identical to SEQ ID NO: 16108

SEQ ID NO: 56897 - DNA, 201 bp, Bos taurus
ctgggttgacaccttttagtagcttccccatcttcctctctgacaaccagactgtccccttggccttgaaatcctacctattgtggcccctgtcaaattacaggcaattccccacctccaggtaaaacttggcatcagccagaaatgtccttcccttccccatcccctgggtcatgcttcctcaaccttcgcatcttggtt

SEQ ID NO: 56898 - DNA, 201 bp, Bos taurus
gagaatgctattaataaacatgctaggtgcttatcaggagaagattttttaaaaaagaaagacgactccaaatacagagtgtgatgtgagcaattgccaactcgaacttcggagtgacccagtttccaacaaggcagtatcctgggtgcctctgtcttctgccagcggtcactgacacctaagaagaagctccccggcttg

SEQ ID NO: 56899 - DNA, 201 bp, Bos taurus
tgctgcctttcagtggacagcggccatctaactccgatgtgtctgcaaaatgcactgacgcacaacagccgcactccaaggacagaccagcgggaatgacgtaagacaatgatgtcctaaggccaagatgttgcctacactcaccccagtcttctcaaacacacacacacacacacacaatgctcgaataagtaaccttgg

SEQ ID NO: 56900 - DNA, 201 bp, Bos taurus
caacatcagtagcatcctgaccacgtattagctgttggtcctggcccagctgttgacccacttactagttcattcattcactcattcattcaccacctatctattaactgcctgccttgtgacgggccttcgagatctgatgtcttccacttaaatagcccgctgtttctgcttcaaccctcatgttacctggagcgagcc

SEQ ID NO: 56901 - DNA, 201 bp, Bos taurus; identical to SEQ ID NO: 16109

SEQ ID NO: 56902 - DNA, 201 bp, Bos taurus; identical to SEQ ID NO: 16111

SEQ ID NO: 56903 - DNA, 201 bp, Bos taurus; identical to SEQ ID NO: 16112

SEQ ID NO: 56904 - DNA, 201 bp, Bos taurus; identical to SEQ ID NO: 16113

SEQ ID NO: 56905 - DNA, 201 bp, Bos taurus; identical to SEQ ID NO: 16114

SEQ ID NO: 56906 - DNA, 201 bp, Bos taurus; identical to SEQ ID NO: 16115

SEQ ID NO: 56907 - DNA, 201 bp, Bos taurus; identical to SEQ ID NO: 16116

SEQ ID NO: 56908 - DNA, 201 bp, Bos taurus
ttatgtccaccacctggtccatcagttctgtcttgggtcagttgcttccttgggctggttgtactcatttgaggggccaacactcacctggctgccactcctccaggtcagccgtctatgattctacaagatacctatgattcaacacatgggagcagttggcagtcatccttctgtgggtgccctgccccggcctctctg

SEQ ID NO: 56909 - DNA, 201 bp, Bos taurus; identical to SEQ ID NO: 16118

SEQ ID NO: 56910 - DNA, 201 bp, Bos taurus; identical to SEQ ID NO: 16119

SEQ ID NO: 56911 - DNA, 201 bp, Bos taurus; identical to SEQ ID NO: 16120

SEQ ID NO: 56912 - DNA, 201 bp, Bos taurus
agcggcgaagatacaggacttgctcctcaggctttgtgtgaacaggcctcagacagtgcagtgttgtaagacgcccggaggtttctaaatgaaggcagagtgggacctgcaaccaggagcagggcctgctgtggggtggggcagctcggggatgagggcactaggcccagtgagatggggtcttggccccaagcagcccct

SEQ ID NO: 56913 - DNA, 201 bp, Bos taurus
gatgtttttctgctccgctcccatagttagtaagagggtgagtcactaagtcgaatataagcacggcttggagtaatttattccaggatcatgaagacacgcttctcggcaagagaatctctgctgaacccagcgccccgatgaacacagaggcttcctcagccgctgcgatcgcattttggagtatcgatatcatgtttt

SEQ ID NO: 56914 - DNA, 201 bp, Bos taurus; identical to SEQ ID NO: 16121

SEQ ID NO: 56915 - DNA, 201 bp, Bos taurus; identical to SEQ ID NO: 16122

SEQ ID NO: 56916 - DNA, 201 bp, Bos taurus; identical to SEQ ID NO: 16123

SEQ ID NO: 56917 - DNA, 201 bp, Bos taurus; identical to SEQ ID NO: 16124

SEQ ID NO: 56918 - DNA, 201 bp, Bos taurus; identical to SEQ ID NO: 16125

SEQ ID NO: 56919 - DNA, 201 bp, Bos taurus; identical to SEQ ID NO: 16126

SEQ ID NO: 56920 - DNA, 201 bp, Bos taurus; identical to SEQ ID NO: 16128

SEQ ID NO: 56921 - DNA, 201 bp, Bos taurus; identical to SEQ ID NO: 16129

SEQ ID NO: 56922 - DNA, 201 bp, Bos taurus; identical to SEQ ID NO: 16130

SEQ ID NO: 56923 - DNA, 201 bp, Bos taurus; identical to SEQ ID NO: 16131

SEQ ID NO: 56924 - DNA, 201 bp, Bos taurus; identical to SEQ ID NO: 16132

SEQ ID NO: 56925 - DNA, 201 bp, Bos taurus; identical to SEQ ID NO: 16133

SEQ ID NO: 56926 - DNA, 201 bp, Bos taurus; identical to SEQ ID NO: 16134

SEQ ID NO: 56927 - DNA, 201 bp, Bos taurus; identical to SEQ ID NO: 16135

SEQ ID NO: 56928 - DNA, 201 bp, Bos taurus; identical to SEQ ID NO: 16136

SEQ ID NO: 56929 - DNA, 201 bp, Bos taurus; identical to SEQ ID NO: 16137

SEQ ID NO: 56930 - DNA, 201 bp, Bos taurus; identical to SEQ ID NO: 16138

SEQ ID NO: 56931 - DNA, 201 bp, Bos taurus; identical to SEQ ID NO: 16142

SEQ ID NO: 56932 - DNA, 201 bp, Bos taurus; identical to SEQ ID NO: 16143

SEQ ID NO: 56933 - DNA, 201 bp, Bos taurus; identical to SEQ ID NO: 16144

SEQ ID NO: 56934 - DNA, 201 bp, Bos taurus; identical to SEQ ID NO: 16145

SEQ ID NO: 56935 - DNA, 201 bp, Bos taurus; identical to SEQ ID NO: 16146

SEQ ID NO: 56936 - DNA, 201 bp, Bos taurus; identical to SEQ ID NO: 16147

SEQ ID NO: 56937 - DNA, 201 bp, Bos taurus; identical to SEQ ID NO: 16148

SEQ ID NO: 56938 - DNA, 201 bp, Bos taurus; identical to SEQ ID NO: 16149

SEQ ID NO: 56939 - DNA, 201 bp, Bos taurus; identical to SEQ ID NO: 16150

SEQ ID NO: 56940 - DNA, 201 bp, Bos taurus; identical to SEQ ID NO: 16151

SEQ ID NO: 56941 - DNA, 201 bp, Bos taurus; identical to SEQ ID NO: 16152

SEQ ID NO: 56942 - DNA, 201 bp, Bos taurus; identical to SEQ ID NO: 16153

SEQ ID NO: 56943 - DNA, 201 bp, Bos taurus; identical to SEQ ID NO: 16154

SEQ ID NO: 56944 - DNA, 201 bp, Bos taurus; identical to SEQ ID NO: 16155

SEQ ID NO: 56945 - DNA, 201 bp, Bos taurus; identical to SEQ ID NO: 16156

SEQ ID NO: 56946 - DNA, 201 bp, Bos taurus; identical to SEQ ID NO: 16157

SEQ ID NO: 56947 - DNA, 201 bp, Bos taurus
tgtgataaatgcattggcatagggggttatttcagaaaagaacaagcagctctttttttttttcgcttaatattggttaagttctcttcctcatccaacatgtatgttttggtccttgtgtcttggttccatcctttgacttgttttctacatgaaagcaaaatggatacaggcatgccaggtctttatccacataataca

SEQ ID NO: 56948 - DNA, 201 bp, Bos taurus; identical to SEQ ID NO: 16158

SEQ ID NO: 56949 - DNA, 201 bp, Bos taurus
gtggagattctgggcacagaagggtccctgcaccacctgcaaccataagtacttcccagcttctcacctgtctgcccaggagcctggcccagcaggaggcgcaggcaaccaaggagccaggagagagaccacagaacatgagagcattacacactgcacttcacagctaggggccacacagatggcacccctcttccactc

SEQ ID NO: 56950 - DNA, 201 bp, Bos taurus
ctaaccacagactcatggggagatggtccctgtggcattggggggttcgccaaaatgtggatgcagggctcctggaattcacggatgatccagggaaagggagctggtgggtcacagtcaaggggcccagcgggttaggaagtgggtgccatggaggcaagtgaccagaaagcgactcaagcacaggagagtgaggcgtgg

SEQ ID NO: 56951 - DNA, 201 bp, Bos taurus; identical to SEQ ID NO: 16160

SEQ ID NO: 56952 - DNA, 201 bp, Bos taurus; identical to SEQ ID NO: 16161

SEQ ID NO: 56953 - DNA, 201 bp, Bos taurus
taacttgatgtaaaatgtttgcataagcaatataagctccaggatagaacatgtgtcctgttggctgaggagatgaactgttgacaatacattccagggccgtcatcgcttttatcagaagtaaaccattcaatgcccctcacaggtgtattgtattcaccgcctgacactccccagcaggggtggcacttcacagtgggc

SEQ ID NO: 56954 - DNA, 201 bp, Bos taurus; identical to SEQ ID NO: 16162

SEQ ID NO: 56955 - DNA, 201 bp, Bos taurus; identical to SEQ ID NO: 16164

SEQ ID NO: 56956 - DNA, 201 bp, Bos taurus
ctgagttaagcattgacccctctgggatgctgtgagattatgttacgagtgtctgttctctcactttttttgcccctaaaacatggtcaggcctggcaccaggtcacttgatctcccagactgatgaaggagagagcaggtgagaaggagaccgttgaggggggcgcagtcaaagtgaggctggagttctcagagtctgca

SEQ ID NO: 56957 - DNA, 201 bp, Bos taurus
gtccaaagccccctgttggggagaagagctcccctcagagtcagtagacacagctgaaagagagctgaagagaatttacagtgtctgtggatgtgaagcagagaaaaggctcaatttcaagaaggaagggggctttccaaatttttaaacatgcaacacctaaagcatatttacttgtaagagctgaattttgcaggtgaa

SEQ ID NO: 56958 - DNA, 201 bp, Bos taurus; identical to SEQ ID NO: 16168

SEQ ID NO: 56959 - DNA, 201 bp, Bos taurus; identical to SEQ ID NO: 16169

SEQ ID NO: 56960 - DNA, 201 bp, Bos taurus; identical to SEQ ID NO: 16171

SEQ ID NO: 56961 - DNA, 201 bp, Bos taurus; identical to SEQ ID NO: 16172

SEQ ID NO: 56962 - DNA, 201 bp, Bos taurus; identical to SEQ ID NO: 16173

SEQ ID NO: 56963 - DNA, 201 bp, Bos taurus; identical to SEQ ID NO: 16174

SEQ ID NO: 56964 - DNA, 201 bp, Bos taurus; identical to SEQ ID NO: 16177

SEQ ID NO: 56965 - DNA, 201 bp, Bos taurus; identical to SEQ ID NO: 16179

SEQ ID NO: 56966 - DNA, 201 bp, Bos taurus
aaaaacaaaaaacctctctgcaaacttaaatgagcaaatgacctaaaggaaatttaccgccatggggagtcattaaatttgaaggcctccctgggggcctcggagaagccatcactccatgactccagcccatggaatcatttgagaatgcccttcccgggactggataaaatgatgcaggctgattttccatctgcaggg

SEQ ID NO: 56967 - DNA, 201 bp, Bos taurus
gaagggaagcccaagaataatggaatgggtagcctatcccttaagaactcaatgtatacaacgattcctgcagcaggttgcaacctggaagagcagctccagggagagaagcagtgagtgccccctcatgatgcaagatatgctgacgtgggccctatctgcacattgcgtacataggaatattgtttccttcccccagaa

SEQ ID NO: 56968 - DNA, 201 bp, Bos taurus; identical to SEQ ID NO: 16182

SEQ ID NO: 56969 - DNA, 201 bp, Bos taurus; identical to SEQ ID NO: 16183

SEQ ID NO: 56970 - DNA, 201 bp, Bos taurus
ctaggatggcccatatcctggcatctctgggtgctacagggaagatttctcaaacagcagtctttgtcactcattccacatttatttattatcttttgaatattaggaattatcacattgaaaacattatgcagtatgtgtcttaatagaacataccctaacctggctgcatggttataacaaaaaataaagagcccagag

SEQ ID NO: 56971 - DNA, 201 bp, Bos taurus
cccacaaaatacccttgaattagtaaataatacatccacaagactgaccgatctatggtcttagaaatcaggattgtggttacccttaagggagaggtggaagtgaattgtcctacaggccgtttctgaagtgagagtcaaattttgttacttgacctgaatgctaattacatgggtgcgttttgccgaaattcttcctgc

SEQ ID NO: 56972 - DNA, 201 bp, Bos taurus; identical to SEQ ID NO: 16186

SEQ ID NO: 56973 - DNA, 201 bp, Bos taurus; identical to SEQ ID NO: 16188

SEQ ID NO: 56974 - DNA, 201 bp, Bos taurus; identical to SEQ ID NO: 16190

SEQ ID NO: 56975 - DNA, 201 bp, Bos taurus
ttgaatattactatgcagaatgtgatatacattatattttttatgccagctttggatcttggaataatattttaaatatttcttcacatagatcacactcgttttgtattatgtttgtatttaacatagctctttaagaacagactttagcacagttctggccattgtaagtggaactttcttgatatattttctatctga

SEQ ID NO: 56976 - DNA, 201 bp, Bos taurus; identical to SEQ ID NO: 16193

SEQ ID NO: 56977 - DNA, 201 bp, Bos taurus
tatttatgcatttcctccttcatggacttgtaaataggagattacattttgtagtttagctattaataatatatattactaagttatacagttttgtttcaaattctggctccaccacttactatgtgcctatcactagctagattgatccaattatgtgaaagtttttagtataactggtattaattttcttttttttta

SEQ ID NO: 56978 - DNA, 201 bp, Bos taurus; identical to SEQ ID NO: 16194

SEQ ID NO: 56979 - DNA, 201 bp, Bos taurus; identical to SEQ ID NO: 16195

SEQ ID NO: 56980 - DNA, 201 bp, Bos taurus; identical to SEQ ID NO: 16197

SEQ ID NO: 56981 - DNA, 201 bp, Bos taurus
cttaatcactccttaatgaaatgagtcctttttctttctttcttttaagtagactgcattttaatttaaaatgtagctatgatgtgaacacacctactaaatttgaaatataactttcttgacaatatcagaaaagaatagactgtactttatcatctttcttcagtgtcttatgaacttattcaacctgaccatgaccca

SEQ ID NO: 56982 - DNA, 201 bp, Bos taurus; identical to SEQ ID NO: 16198

SEQ ID NO: 56983 - DNA, 201 bp, Bos taurus; identical to SEQ ID NO: 16201

SEQ ID NO: 56984 - DNA, 201 bp, Bos taurus; identical to SEQ ID NO: 16202

SEQ ID NO: 56985 - DNA, 201 bp, Bos taurus; identical to SEQ ID NO: 16203

SEQ ID NO: 56986 - DNA, 201 bp, Bos taurus; identical to SEQ ID NO: 16204

SEQ ID NO: 56987 - DNA, 201 bp, Bos taurus; identical to SEQ ID NO: 16205

SEQ ID NO: 56988 - DNA, 201 bp, Bos taurus; identical to SEQ ID NO: 16206

SEQ ID NO: 56989 - DNA, 201 bp, Bos taurus; identical to SEQ ID NO: 16207

SEQ ID NO: 56990 - DNA, 201 bp, Bos taurus
ttatatttgcatctccattatttagcacaatggttggccatatagaagataatcagtatcaaccgaaaaacagggctcccatgttgcaccaccaccatcccgcattgttctgtgagttacctcttctttctcatatattgtccacgtgtccactgatgtttatggtgttggctctgtccccttggcttaaaaattggatag

SEQ ID NO: 56991 - DNA, 201 bp, Bos taurus; identical to SEQ ID NO: 16208

SEQ ID NO: 56992 - DNA, 201 bp, Bos taurus
acaactagtgctgggacacctgaaggtaatcgtgtgcacccggccctctgcaaactctaggttgggggtgcttcacacagggctcctttgaaagtgaggagtgattggaatcctgtataagaggccactgtcaaagcaaaaaagagaataatatctcccccatgaaagtgagagcagaggcaacctctgccactgactcct

SEQ ID NO: 56993 - DNA, 201 bp, Bos taurus; identical to SEQ ID NO: 16209

SEQ ID NO: 56994 - DNA, 201 bp, Bos taurus; identical to SEQ ID NO: 16212

SEQ ID NO: 56995 - DNA, 201 bp, Bos taurus; identical to SEQ ID NO: 16213

SEQ ID NO: 56996 - DNA, 201 bp, Bos taurus
gagcgactgaactgaagagaactgaactgaactgatggcagtatagacttcatgaagtcttctaggaagacttcatgaagaaatgttatgtggactagatgttagggtgttggtgagatttcatcaggcagagtttggggaaggcaacccagaaaccaggaattataaggaacaatgtcatggaagtagaataattaagga

SEQ ID NO: 56997 - DNA, 201 bp, Bos taurus; identical to SEQ ID NO: 16214

SEQ ID NO: 56998 - DNA, 201 bp, Bos taurus; identical to SEQ ID NO: 16215

SEQ ID NO: 56999 - DNA, 201 bp, Bos taurus
gaaaaatggcctaaaaatatcagatctttattgacacagaataggaaaattgactaaagttcctttatgtccaggactttctcctgttaatcaatagcctagggatgatcaaattaaggccccacttccctagagggacagtccctgctgtgacaaatctgaccttgttatcagagccaatttgagcactatctggtctaa

SEQ ID NO: 57000 - DNA, 201 bp, Bos taurus
tatgaatccacccctcctccaagtctccacaggactcagaggacccaggacagcctgaaaatcccaggtggatgagtgagcctccagaagacctgaagctactattcagaaaggccaaaaatcttcttaaaccctaagctaagtacccatagcaactatcttctttatgcttcccagcaatcaatccactcagagtaatat

SEQ ID NO: 57001 - DNA, 201 bp, Bos taurus
gcagaggtgacggcagcggctccgcgtccgggtcaagcggccaaagtgacgaacgtggacgccaggggcacacgtggacgggtccgcgccccggcccgtccctggtcctgcccagaaggggctggggagagggggcgctatttcaacctgcctgatgctcttgaactcagattttcccccttactctccaacttcaggcct

SEQ ID NO: 57002 - DNA, 201 bp, Bos taurus; identical to SEQ ID NO: 16216

SEQ ID NO: 57003 - DNA, 201 bp, Bos taurus; identical to SEQ ID NO: 16217

SEQ ID NO: 57004 - DNA, 201 bp, Bos taurus
ttggctgggtgccctcgtgtaaccgtacggaacttcacggaatgcgggtcacggcttcattttcctttccgtctgaagaggcgagggcctgtgctagcagatggggtgcttttctatgaagcgcagtgaaagcaagacgccagtgtggttcatgccagggccccgcagacggctcgcccgttcagaagacggcagttctct

SEQ ID NO: 57005 - DNA, 201 bp, Bos taurus; identical to SEQ ID NO: 16220

SEQ ID NO: 57006 - DNA, 201 bp, Bos taurus
taggtccgtgcaagaccttcctggtaggctggccgcccttcgtccaccccctccggatgcctatgttccctgctccaaggccctgccagagttctcttatcaaattcacatactatactgtcccctccttccttaagaccttccagtgacttctagtttctctcaggataagaatacatttttcagttggcccatgcaagg

SEQ ID NO: 57007 - DNA, 201 bp, Bos taurus; identical to SEQ ID NO: 16221

SEQ ID NO: 57008 - DNA, 201 bp, Bos taurus; identical to SEQ ID NO: 16223

SEQ ID NO: 57009 - DNA, 201 bp, Bos taurus; identical to SEQ ID NO: 16225

SEQ ID NO: 57010 - DNA, 201 bp, Bos taurus; identical to SEQ ID NO: 16226

SEQ ID NO: 57011 - DNA, 201 bp, Bos taurus; identical to SEQ ID NO: 16227

SEQ ID NO: 57012 - DNA, 201 bp, Bos taurus; identical to SEQ ID NO: 16228

SEQ ID NO: 57013 - DNA, 201 bp, Bos taurus; identical to SEQ ID NO: 16229

SEQ ID NO: 57014 - DNA, 201 bp, Bos taurus; identical to SEQ ID NO: 16230

SEQ ID NO: 57015 - DNA, 201 bp, Bos taurus; identical to SEQ ID NO: 16231

SEQ ID NO: 57016 - DNA, 201 bp, Bos taurus; identical to SEQ ID NO: 16232

SEQ ID NO: 57017 - DNA, 201 bp, Bos taurus; identical to SEQ ID NO: 16233

SEQ ID NO: 57018 - DNA, 201 bp, Bos taurus; identical to SEQ ID NO: 16234

SEQ ID NO: 57019 - DNA, 201 bp, Bos taurus; identical to SEQ ID NO: 16235

SEQ ID NO: 57020 - DNA, 201 bp, Bos taurus; identical to SEQ ID NO: 16236

SEQ ID NO: 57021 - DNA, 201 bp, Bos taurus; identical to SEQ ID NO: 16237

SEQ ID NO: 57022 - DNA, 201 bp, Bos taurus; identical to SEQ ID NO: 16238

SEQ ID NO: 57023 - DNA, 201 bp, Bos taurus; identical to SEQ ID NO: 16239

SEQ ID NO: 57024 - DNA, 201 bp, Bos taurus; identical to SEQ ID NO: 16240

SEQ ID NO: 57025 - DNA, 201 bp, Bos taurus; identical to SEQ ID NO: 16241

SEQ ID NO: 57026 - DNA, 201 bp, Bos taurus; identical to SEQ ID NO: 16242

SEQ ID NO: 57027 - DNA, 201 bp, Bos taurus; identical to SEQ ID NO: 16243

SEQ ID NO: 57028 - DNA, 201 bp, Bos taurus; identical to SEQ ID NO: 16244

SEQ ID NO: 57029 - DNA, 201 bp, Bos taurus; identical to SEQ ID NO: 16245

SEQ ID NO: 57030 - DNA, 201 bp, Bos taurus; identical to SEQ ID NO: 16246

SEQ ID NO: 57031 - DNA, 201 bp, Bos taurus; identical to SEQ ID NO: 16248

SEQ ID NO: 57032 - DNA, 201 bp, Bos taurus; identical to SEQ ID NO: 16249

SEQ ID NO: 57033 - DNA, 201 bp, Bos taurus; identical to SEQ ID NO: 16250

SEQ ID NO: 57034 - DNA, 201 bp, Bos taurus; identical to SEQ ID NO: 16251

SEQ ID NO: 57035 - DNA, 201 bp, Bos taurus; identical to SEQ ID NO: 16252

SEQ ID NO: 57036 - DNA, 201 bp, Bos taurus; identical to SEQ ID NO: 16253

SEQ ID NO: 57037 - DNA, 201 bp, Bos taurus; identical to SEQ ID NO: 16254

SEQ ID NO: 57038 - DNA, 201 bp, Bos taurus; identical to SEQ ID NO: 16255

SEQ ID NO: 57039 - DNA, 201 bp, Bos taurus; identical to SEQ ID NO: 16256

SEQ ID NO: 57040 - DNA, 201 bp, Bos taurus; identical to SEQ ID NO: 16257

SEQ ID NO: 57041 - DNA, 201 bp, Bos taurus; identical to SEQ ID NO: 16258

SEQ ID NO: 57042 - DNA, 201 bp, Bos taurus; identical to SEQ ID NO: 16259

SEQ ID NO: 57043 - DNA, 201 bp, Bos taurus; identical to SEQ ID NO: 16260

SEQ ID NO: 57044 - DNA, 201 bp, Bos taurus; identical to SEQ ID NO: 16261

SEQ ID NO: 57045 - DNA, 201 bp, Bos taurus; identical to SEQ ID NO: 16262

SEQ ID NO: 57046 - DNA, 201 bp, Bos taurus; identical to SEQ ID NO: 16263

SEQ ID NO: 57047 - DNA, 201 bp, Bos taurus; identical to SEQ ID NO: 16264

SEQ ID NO: 57048 - DNA, 201 bp, Bos taurus; identical to SEQ ID NO: 16265

SEQ ID NO: 57049 - DNA, 201 bp, Bos taurus; identical to SEQ ID NO: 16266

SEQ ID NO: 57050 - DNA, 201 bp, Bos taurus; identical to SEQ ID NO: 16267

SEQ ID NO: 57051 - DNA, 201 bp, Bos taurus; identical to SEQ ID NO: 16268

SEQ ID NO: 57052 - DNA, 201 bp, Bos taurus; identical to SEQ ID NO: 16269

SEQ ID NO: 57053 - DNA, 201 bp, Bos taurus; identical to SEQ ID NO: 16270

SEQ ID NO: 57054 - DNA, 201 bp, Bos taurus; identical to SEQ ID NO: 16271

SEQ ID NO: 57055 - DNA, 201 bp, Bos taurus; identical to SEQ ID NO: 16272

SEQ ID NO: 57056 - DNA, 201 bp, Bos taurus; identical to SEQ ID NO: 16274

SEQ ID NO: 57057 - DNA, 201 bp, Bos taurus; identical to SEQ ID NO: 16275

SEQ ID NO: 57058 - DNA, 201 bp, Bos taurus; identical to SEQ ID NO: 16276

SEQ ID NO: 57059 - DNA, 201 bp, Bos taurus; identical to SEQ ID NO: 16277

SEQ ID NO: 57060 - DNA, 201 bp, Bos taurus; identical to SEQ ID NO: 16278

SEQ ID NO: 57061 - DNA, 201 bp, Bos taurus; identical to SEQ ID NO: 16279

SEQ ID NO: 57062 - DNA, 201 bp, Bos taurus; identical to SEQ ID NO: 16280

SEQ ID NO: 57063 - DNA, 201 bp, Bos taurus; identical to SEQ ID NO: 16281

SEQ ID NO: 57064 - DNA, 201 bp, Bos taurus; identical to SEQ ID NO: 16282

SEQ ID NO: 57065 - DNA, 201 bp, Bos taurus; identical to SEQ ID NO: 16283

SEQ ID NO: 57066 - DNA, 201 bp, Bos taurus; identical to SEQ ID NO: 16284

SEQ ID NO: 57067 - DNA, 201 bp, Bos taurus; identical to SEQ ID NO: 16285

SEQ ID NO: 57068 - DNA, 201 bp, Bos taurus; identical to SEQ ID NO: 16286

SEQ ID NO: 57069 - DNA, 201 bp, Bos taurus; identical to SEQ ID NO: 16287

SEQ ID NO: 57070 - DNA, 201 bp, Bos taurus; identical to SEQ ID NO: 16288

SEQ ID NO: 57071 - DNA, 201 bp, Bos taurus; identical to SEQ ID NO: 16289

SEQ ID NO: 57072 - DNA, 201 bp, Bos taurus; identical to SEQ ID NO: 16290

SEQ ID NO: 57073 - DNA, 201 bp, Bos taurus; identical to SEQ ID NO: 16291

SEQ ID NO: 57074 - DNA, 201 bp, Bos taurus; identical to SEQ ID NO: 16292

SEQ ID NO: 57075 - DNA, 201 bp, Bos taurus; identical to SEQ ID NO: 16293

SEQ ID NO: 57076 - DNA, 201 bp, Bos taurus; identical to SEQ ID NO: 16294

SEQ ID NO: 57077 - DNA, 201 bp, Bos taurus; identical to SEQ ID NO: 16295

SEQ ID NO: 57078 - DNA, 201 bp, Bos taurus; identical to SEQ ID NO: 16296

SEQ ID NO: 57079 - DNA, 201 bp, Bos taurus; identical to SEQ ID NO: 16297

SEQ ID NO: 57080 - DNA, 201 bp, Bos taurus; identical to SEQ ID NO: 16298

SEQ ID NO: 57081 - DNA, 201 bp, Bos taurus; identical to SEQ ID NO: 16299

SEQ ID NO: 57082 - DNA, 201 bp, Bos taurus; identical to SEQ ID NO: 16300

SEQ ID NO: 57083 - DNA, 201 bp, Bos taurus; identical to SEQ ID NO: 16301

SEQ ID NO: 57084 - DNA, 201 bp, Bos taurus; identical to SEQ ID NO: 16302

SEQ ID NO: 57085 - DNA, 201 bp, Bos taurus; identical to SEQ ID NO: 16303

SEQ ID NO: 57086 - DNA, 201 bp, Bos taurus; identical to SEQ ID NO: 16304

SEQ ID NO: 57087 - DNA, 201 bp, Bos taurus; identical to SEQ ID NO: 16305

SEQ ID NO: 57088 - DNA, 201 bp, Bos taurus; identical to SEQ ID NO: 16306

SEQ ID NO: 57089 - DNA, 201 bp, Bos taurus; identical to SEQ ID NO: 16307

SEQ ID NO: 57090 - DNA, 201 bp, Bos taurus; identical to SEQ ID NO: 16308

SEQ ID NO: 57091 - DNA, 201 bp, Bos taurus; identical to SEQ ID NO: 16310

SEQ ID NO: 57092 - DNA, 201 bp, Bos taurus; identical to SEQ ID NO: 16311

SEQ ID NO: 57093 - DNA, 201 bp, Bos taurus; identical to SEQ ID NO: 16312

SEQ ID NO: 57094 - DNA, 201 bp, Bos taurus; identical to SEQ ID NO: 16313

SEQ ID NO: 57095 - DNA, 201 bp, Bos taurus; identical to SEQ ID NO: 16314

SEQ ID NO: 57096 - DNA, 201 bp, Bos taurus; identical to SEQ ID NO: 16315

SEQ ID NO: 57097 - DNA, 201 bp, Bos taurus; identical to SEQ ID NO: 16316

SEQ ID NO: 57098 - DNA, 201 bp, Bos taurus; identical to SEQ ID NO: 16318

SEQ ID NO: 57099 - DNA, 201 bp, Bos taurus; identical to SEQ ID NO: 16319

SEQ ID NO: 57100 - DNA, 201 bp, Bos taurus; identical to SEQ ID NO: 16320

SEQ ID NO: 57101 - DNA, 201 bp, Bos taurus; identical to SEQ ID NO: 16321

SEQ ID NO: 57102 - DNA, 201 bp, Bos taurus; identical to SEQ ID NO: 16322

SEQ ID NO: 57103 - DNA, 201 bp, Bos taurus; identical to SEQ ID NO: 16323

SEQ ID NO: 57104 - DNA, 201 bp, Bos taurus; identical to SEQ ID NO: 16324

SEQ ID NO: 57105 - DNA, 201 bp, Bos taurus; identical to SEQ ID NO: 16325

SEQ ID NO: 57106 - DNA, 201 bp, Bos taurus; identical to SEQ ID NO: 16326

SEQ ID NO: 57107 - DNA, 201 bp, Bos taurus; identical to SEQ ID NO: 16327

SEQ ID NO: 57108 - DNA, 201 bp, Bos taurus; identical to SEQ ID NO: 16328

SEQ ID NO: 57109 - DNA, 201 bp, Bos taurus; identical to SEQ ID NO: 16329

SEQ ID NO: 57110 - DNA, 201 bp, Bos taurus; identical to SEQ ID NO: 16330

SEQ ID NO: 57111 - DNA, 201 bp, Bos taurus; identical to SEQ ID NO: 16331

SEQ ID NO: 57112 - DNA, 201 bp, Bos taurus; identical to SEQ ID NO: 16332

SEQ ID NO: 57113 - DNA, 201 bp, Bos taurus; identical to SEQ ID NO: 16333

SEQ ID NO: 57114 - DNA, 201 bp, Bos taurus; identical to SEQ ID NO: 16334

SEQ ID NO: 57115 - DNA, 201 bp, Bos taurus; identical to SEQ ID NO: 16335

SEQ ID NO: 57116 - DNA, 201 bp, Bos taurus; identical to SEQ ID NO: 16336

SEQ ID NO: 57117 - DNA, 201 bp, Bos taurus; identical to SEQ ID NO: 16337

SEQ ID NO: 57118 - DNA, 201 bp, Bos taurus; identical to SEQ ID NO: 16338

SEQ ID NO: 57119 - DNA, 201 bp, Bos taurus; identical to SEQ ID NO: 16339

SEQ ID NO: 57120 - DNA, 201 bp, Bos taurus
aggtaggaacttgctatgaattttctagaacatgacagagtccggtagggctggagtagagtgcacagaggttacttggggaatctaaggtgggaaattaactaggggccagaccaagaaggactttcttagccatggtaaggatgtgcagttttgttcttagtggtgttcaaagctgtagaacgatttggacccagaaaa

SEQ ID NO: 57121 - DNA, 201 bp, Bos taurus; identical to SEQ ID NO: 16340

SEQ ID NO: 57122 - DNA, 201 bp, Bos taurus
atgtcctcacgaggtgggcctaagacagtgacaccaaactccatgtcttggaacccaccctccatctgaacccaaagattaaaaaggcagtaagcttcatgtttaggccagagatgcaaaagttcctccccctcaatccctaatactgagtttggcaaggggtatttttttttccaaaaagttaaatgagaaactatatca

SEQ ID NO: 57123 - DNA, 201 bp, Bos taurus; identical to SEQ ID NO: 16341

SEQ ID NO: 57124 - DNA, 201 bp, Bos taurus
ccagaaaaactgatggtctagttccagtctggaggccggcgggctcaaaacccagggggagctgatctttctatttaagcaaaggcaagaaaaatgctgatgtcctagtctgaaggccatcagacagaaaagatatttctcttgcttacaggaggatttcccatttttgttctattcaggacttcagctaattggatgttg

SEQ ID NO: 57125 - DNA, 201 bp, Bos taurus
tacacacagagggaagaagcttttgaaggtgtatctttgccgtcatcgctctgtcttgtaacaagccctgcagtccttgccagtaggtgggcttcctctgcgtggtacctgcttcggcttagcaacatcctcatctcttacaaggatgctgttgaaaatggctgaacctgaggagacacctggtggagacaggaagcattc

SEQ ID NO: 57126 - DNA, 201 bp, Bos taurus; identical to SEQ ID NO: 16342

SEQ ID NO: 57127 - DNA, 201 bp, Bos taurus
ggtagcagatctgggagtggaatccatgtctgtctggctcaaagcttcaacttttaaccacggttctcctttctttagaagttatttttcggtctgatgttagaacccagctgccttaccatagtagaaaaggaacagtaatgtcccattttttgaagatttatttaaagcaaagtttctcaaccttagcaaaatgagcac

SEQ ID NO: 57128 - DNA, 201 bp, Bos taurus; identical to SEQ ID NO: 16343

SEQ ID NO: 57129 - DNA, 201 bp, Bos taurus; identical to SEQ ID NO: 16344

SEQ ID NO: 57130 - DNA, 201 bp, Bos taurus; identical to SEQ ID NO: 16345

SEQ ID NO: 57131 - DNA, 201 bp, Bos taurus
ggacctactctaactaggccagtgattctggtagctgccagaagacaaggtgaatggcttctgcagaccgtggacctggccccaaggctggccagagcatttgcctttggattcacaaaaatctaccccacaaacagaatcccatgagggcatgctatcttctgtttcaatgtccacgttataatccatattactatttta

SEQ ID NO: 57132 - DNA, 201 bp, Bos taurus
cacgaggcctcagagctgtacgtgacttggggtgtcacatggtccagctgtctgctgcccacgcatcacctcccgtccccagctgtttctccccagccctcggccttgttcaggagtttcagaccatgttctgagctgtcctcggagtctactgaggcacattagctcctaccgtggggctgtgaggagactgaacgggaa

SEQ ID NO: 57133 - DNA, 201 bp, Bos taurus; identical to SEQ ID NO: 16346

SEQ ID NO: 57134 - DNA, 201 bp, Bos taurus; identical to SEQ ID NO: 16347

SEQ ID NO: 57135 - DNA, 201 bp, Bos taurus; identical to SEQ ID NO: 16348

SEQ ID NO: 57136 - DNA, 201 bp, Bos taurus; identical to SEQ ID NO: 16349

SEQ ID NO: 57137 - DNA, 201 bp, Bos taurus
agagtcagacatgacttagcgcctgaacaacaacgagctaaagggaagagtgatagaaagggctagagagcagggcctgtgagcagatgtcagactccagagttatttcatccagagtggaaaagtctagaaggaagaggatgagagggcctgggttgatttaacaacgcgctttaagcccacgagaggctcttactctca

SEQ ID NO: 57138 - DNA, 201 bp, Bos taurus
tgctcaatggtttcttctaaagtcaaaattacacgtatcctatgatccagcaatgccactcctacgtatttgtccaagagaaatgaaagcatatacccccaaaaatatgtgtactaatatgtctccagagctttattcataattgccaaaaaccagaactgcaaattctcttcaaaaagagaagggatctattggaataca

SEQ ID NO: 57139 - DNA, 201 bp, Bos taurus; identical to SEQ ID NO: 16350

SEQ ID NO: 57140 - DNA, 201 bp, Bos taurus
ttgaagcgtcttagaatcgttttccatgtgacagaagagtttgtttctttcagaaacataactttttattatgctttccacagtctccaaacaccctgtcttacctccttaaaaaagagtgataaattgtaatgcattaattaatgtttattttacagtaatgactcccagggttcctgacctgaatgatcccaggctgtt

SEQ ID NO: 57141 - DNA, 201 bp, Bos taurus; identical to SEQ ID NO: 16351

SEQ ID NO: 57142 - DNA, 201 bp, Bos taurus; identical to SEQ ID NO: 16352

SEQ ID NO: 57143 - DNA, 201 bp, Bos taurus; identical to SEQ ID NO: 16353

SEQ ID NO: 57144 - DNA, 201 bp, Bos taurus; identical to SEQ ID NO: 16354

SEQ ID NO: 57145 - DNA, 201 bp, Bos taurus; identical to SEQ ID NO: 16355

SEQ ID NO: 57146 - DNA, 201 bp, Bos taurus; identical to SEQ ID NO: 16356

SEQ ID NO: 57147 - DNA, 201 bp, Bos taurus; identical to SEQ ID NO: 16357

SEQ ID NO: 57148 - DNA, 201 bp, Bos taurus; identical to SEQ ID NO: 16358

SEQ ID NO: 57149 - DNA, 201 bp, Bos taurus; identical to SEQ ID NO: 16359

SEQ ID NO: 57150 - DNA, 201 bp, Bos taurus; identical to SEQ ID NO: 16360

SEQ ID NO: 57151 - DNA, 201 bp, Bos taurus; identical to SEQ ID NO: 16361

SEQ ID NO: 57152 - DNA, 201 bp, Bos taurus; identical to SEQ ID NO: 16362

SEQ ID NO: 57153 - DNA, 201 bp, Bos taurus
tctgttggtaattatatgtcttcttcagaaaaatgtctattcagctcattttgcccattttgtaagtggaatatttgtgatttttttttgctattgagttacatgaattccaaacatactttggttattaaccccttctcaaatatatgatttgcaagtatttttcccattctgtatgttgctttttcatttgttaactgt

SEQ ID NO: 57154 - DNA, 201 bp, Bos taurus
gtgaaccagaaaaaaatggaaaatatgaacagaataatgacaagtactgaaattgaaactgtgattaaaacttccaaacaaaaggccagggacggaaaacatagcaggtgaattatttcaagcatttagagaagagttaacacctattcttcccaaatcattccaaaaaattgcagaagaaggaacactccaaagctcatt

SEQ ID NO: 57155 - DNA, 201 bp, Bos taurus
ttcgaagctggaccttcaagctgcaactgagaatgtgagtagtccaaccccttataggaagaaagtgagagctgggtgctttggcctgctccatctataacgcacctgggaataaccatgagatgtgctcatagacacatgaaaaatctgcttctttgtttaatgggagactcatggaggccaagtcccagtggctttctg

SEQ ID NO: 57156 - DNA, 201 bp, Bos taurus
agtgttcccctgttgaaaatgaatgattttatacaagaccaacacctgtaatcaaaatggatgaaggaaaaagagaaaagcactctttaagcaaggccctgcactttatttctgagaagggtaaaacctgaaaattgtccaagttacaatagtgaccaaacacccccttttcctggccaatgagtaattcctgcttcttta

SEQ ID NO: 57157 - DNA, 201 bp, Bos taurus
tggtctatagtttctactgagacatctgcttatagcctggttggggtttcattgtaagttacttcatttttttctgcatttcagattatttatttttgactatttcatacaatgagtcttacagaaggtctttttgcgttaatctgccctgttgtctgtactttctattgcattcttcatcttatttcttgaattcttcag

SEQ ID NO: 57158 - DNA, 201 bp, Bos taurus
gccatgatgcttgaaacatgatgtaaaagaggttcaaggtgatagtagaattttgcacagctagagggtatttagaggtcaggtgaaggacatccttgaaagccaggccaagggcatttgaactttgacttacagtgaggagttcttaatgattttgtggcagaacctgagatgttcagtgacctacaggttccatgggcc

SEQ ID NO: 57159 - DNA, 201 bp, Bos taurus
catagcacagggcagtggccagcagaactgaactggaaccctggctcagtccctcctggttctgtaaccttgggtgaatatcttaccctcgctgatactcggttctggcctacgggtcttgggagaaaacaggataccaacctgagtgagaagcttttagcatcaaggcttggacagtttagtatctgccttagcataagt

SEQ ID NO: 57160 - DNA, 201 bp, Bos taurus; identical to SEQ ID NO: 16365

SEQ ID NO: 57161 - DNA, 201 bp, Bos taurus; identical to SEQ ID NO: 16366

SEQ ID NO: 57162 - DNA, 201 bp, Bos taurus
ccaaaggccaacaatccatagctggtcagtgggtgagaaaagaggagtttcaggggtgtgtggggggaggggctacatgcagaacatcaccatcagctttgatggccatctagaaatcagttatcagtggtctgaccagcatcatcttgattgttttaagtacagttactcttcagttccaggatcagttcactcccattt

SEQ ID NO: 57163 - DNA, 201 bp, Bos taurus; identical to SEQ ID NO: 16368

SEQ ID NO: 57164 - DNA, 201 bp, Bos taurus; identical to SEQ ID NO: 16369

SEQ ID NO: 57165 - DNA, 201 bp, Bos taurus; identical to SEQ ID NO: 16370

SEQ ID NO: 57166 - DNA, 201 bp, Bos taurus; identical to SEQ ID NO: 16371

SEQ ID NO: 57167 - DNA, 201 bp, Bos taurus; identical to SEQ ID NO: 16372

SEQ ID NO: 57168 - DNA, 201 bp, Bos taurus; identical to SEQ ID NO: 16373

SEQ ID NO: 57169 - DNA, 201 bp, Bos taurus; identical to SEQ ID NO: 16375

SEQ ID NO: 57170 - DNA, 201 bp, Bos taurus
atattagaagcattggcctgatctcagggatttttaaaaacacacacacagacagatgtagaagtcgatatagatgcgtgtacatacgtgaaagcagcagcaatgggcaccctgagtggccagattttggtgtctacaaaccaggctccactcaaaggaaacagaggccttggaaaagtgagtgattcaggactggggcag

SEQ ID NO: 57171 - DNA, 201 bp, Bos taurus; identical to SEQ ID NO: 16377

SEQ ID NO: 57172 - DNA, 201 bp, Bos taurus; identical to SEQ ID NO: 16378

SEQ ID NO: 57173 - DNA, 201 bp, Bos taurus; identical to SEQ ID NO: 16379

SEQ ID NO: 57174 - DNA, 201 bp, Bos taurus; identical to SEQ ID NO: 16380

SEQ ID NO: 57175 - DNA, 201 bp, Bos taurus; identical to SEQ ID NO: 16381

SEQ ID NO: 57176 - DNA, 201 bp, Bos taurus
ggcgagtggaacttccacaagaggcgggcacagatagcggattccagcatacctggtcatcccacaaacattcactgcacaccttccacaggctgagatacggccatgaaggacctagaaaaggccccagcgccgcaggacctaaaagggcactcactccccctgacagctgagttctgaaggaaggaagaaggggtgttc

SEQ ID NO: 57177 - DNA, 201 bp, Bos taurus; identical to SEQ ID NO: 16384

SEQ ID NO: 57178 - DNA, 201 bp, Bos taurus; identical to SEQ ID NO: 16385

SEQ ID NO: 57179 - DNA, 201 bp, Bos taurus; identical to SEQ ID NO: 16387

SEQ ID NO: 57180 - DNA, 201 bp, Bos taurus
cttctctcttaagcgtagtgtttgttttctaggaaccctcttttaaaaagactatcaaactggtacatatccagaggagaataatcaaaacactgagggatttctgagctggaaattttacaaaatgaaaaaggacaaaaaaataaattgcaagctattcccacttaccttgatgctgattctctatctgagtcgatctag

SEQ ID NO: 57181 - DNA, 201 bp, Bos taurus
ggtaaggcccctgtcccctgaggagtgaagccagcggctctcctgctctgagatagattgcctgagcctcagcatcctcctagcagacggtctttctgtgtgcagggggccagtgctgggttccgcttttgggcttaaatgcttcctatcaggaaagaggaagtggaatagcgggaggctttcttgtgaggaggatatctg

SEQ ID NO: 57182 - DNA, 201 bp, Bos taurus; identical to SEQ ID NO: 16390

SEQ ID NO: 57183 - DNA, 201 bp, Bos taurus; identical to SEQ ID NO: 16391

SEQ ID NO: 57184 - DNA, 201 bp, Bos taurus; identical to SEQ ID NO: 16393

SEQ ID NO: 57185 - DNA, 201 bp, Bos taurus; identical to SEQ ID NO: 16394

SEQ ID NO: 57186 - DNA, 201 bp, Bos taurus; identical to SEQ ID NO: 16395

SEQ ID NO: 57187 - DNA, 201 bp, Bos taurus; identical to SEQ ID NO: 16396

SEQ ID NO: 57188 - DNA, 201 bp, Bos taurus; identical to SEQ ID NO: 16397

SEQ ID NO: 57189 - DNA, 201 bp, Bos taurus; identical to SEQ ID NO: 16398

SEQ ID NO: 57190 - DNA, 201 bp, Bos taurus; identical to SEQ ID NO: 16399

SEQ ID NO: 57191 - DNA, 201 bp, Bos taurus; identical to SEQ ID NO: 16400

SEQ ID NO: 57192 - DNA, 201 bp, Bos taurus; identical to SEQ ID NO: 16401

SEQ ID NO: 57193 - DNA, 201 bp, Bos taurus; identical to SEQ ID NO: 16402

SEQ ID NO: 57194 - DNA, 201 bp, Bos taurus; identical to SEQ ID NO: 16403

SEQ ID NO: 57195 - DNA, 201 bp, Bos taurus
tgtaggacaatggattttaaattttatttgcaaatttgtgtttgctttcatgaactagaatctcataaactcaactttatgaatgtgaaaggcctactccgattagcaaaaacacgtatactttaaagatttttaaatgaggacccaagtatatgtagtaactacaaccagaataacaatgagctgtcttttagaaggcca

SEQ ID NO: 57196 - DNA, 201 bp, Bos taurus; identical to SEQ ID NO: 16405

SEQ ID NO: 57197 - DNA, 201 bp, Bos taurus; identical to SEQ ID NO: 16406

SEQ ID NO: 57198 - DNA, 201 bp, Bos taurus
atttctcccagcaatctggattccagtttgtgactcattcagcttggctctcgcataaatgtactctgcatacaagttaaataagcagggccctcaaaacagtgtgtcccatcccaacccagggggagttgtgaggagttttatagtcaagggtagggttgctgatacggaatgggtgtgtgcagggccctcacgccttca

SEQ ID NO: 57199 - DNA, 201 bp, Bos taurus
gagacgagacgtggacggtgcggggagtgggccaactgcttcacgctgtgctgccgagccctgggctttgaagcccgctacgtctgggattacacaggtgcgtagtgtggtggggggccccgaggctggggtgcacactcctgccttgtagtctgaggctccgcttgctttctgtaagataacaggtttttttatggggag

SEQ ID NO: 57200 - DNA, 201 bp, Bos taurus
ctttctctatgctttggggcttgccttggagctgctggtcaaggagggtctctcgcagctcttccagctggaaaccactgttacaattggaggcctgctagcctgggtatagcttgtgggagacccccatgtctgattagtctcaggctttggactgctcagggcctgtgtctcggggtttagccttctcaggagtgtcta

SEQ ID NO: 57201 - DNA, 201 bp, Bos taurus
tccagtgatcagccggtttccttcatcaagctgttcactcctgtgaaacctaacaagttaagagttcagtgttaacttaaggccagcacagccaacacccgcctgccccgaggctccggctcaggaggatcaggagtgacctactctcaccctcactcactcactttaatggcccttgtttaaaacatcacttgaattatc

SEQ ID NO: 57202 - DNA, 201 bp, Bos taurus
ccttgaaagtgaactctaaatgtcctggagagtaaagcctctctttgcaaaatacttaatcacattccccgggaggaattccctcatcttttgtggctcagtgccttggccacttgccaccaggaatgaaggtaaattctcactctggagacagttatgggaagcctcttcgggctccagccatttggaccatgttcttaa

SEQ ID NO: 57203 - DNA, 201 bp, Bos taurus; identical to SEQ ID NO: 16407

SEQ ID NO: 57204 - DNA, 201 bp, Bos taurus
gcctgtgtccttcaacatagtgtaagtcagctcaggctgctaacaaaatgcgcagactgggtggctcaaacagctgggagtccaagatcgaggtgctggcgtgccatttctaaggcccatccccttgttcatcgatggcctcttctctgggtatactgacgtggcctcctccgtgagtgtgtgtgagtgtgcatgtgtgtt

SEQ ID NO: 57205 - DNA, 201 bp, Bos taurus
gtgctggatcaagactcagctctcctaccaacaccatgcctcagtgactacattttaagttgaattcatattgctgtttacacttggcctcagtagcctccgattcctagatatgcagctggtcttccacgtggactataaagtacgccgaggacacacctgcttctctgacgttgcattcaggctctccttacggcacag

SEQ ID NO: 57206 - DNA, 201 bp, Bos taurus; identical to SEQ ID NO: 16409

SEQ ID NO: 57207 - DNA, 201 bp, Bos taurus; identical to SEQ ID NO: 16410

SEQ ID NO: 57208 - DNA, 201 bp, Bos taurus
ccggatgttccagggcctctgaaattctggagcaggaatatagtgtgatgaatatgatattttagagtgatgtaagaaagcaattctacagctgggaatacacttttaaaaactggccactgagcatttatgaagatgctcattgaagagtggtttgtaacattacgaacgggaaacaatatgaatgtgagttcatatgag

SEQ ID NO: 57209 - DNA, 201 bp, Bos taurus
tactggcccaccacacaacttcactagtgaattttatcccagacaaattcaactttaaaatgggaaataaatctctaacagaaatgaggggcatcagaaacttagcctatagctaacatcctggccagattcatataaatatatatatatagatggagctcttttttgcaagtacccacttcattgggaattaaaggaaac

SEQ ID NO: 57210 - DNA, 201 bp, Bos taurus; identical to SEQ ID NO: 16413

SEQ ID NO: 57211 - DNA, 201 bp, Bos taurus; identical to SEQ ID NO: 16414

SEQ ID NO: 57212 - DNA, 201 bp, Bos taurus; identical to SEQ ID NO: 16415

SEQ ID NO: 57213 - DNA, 201 bp, Bos taurus; identical to SEQ ID NO: 16416

SEQ ID NO: 57214 - DNA, 201 bp, Bos taurus
ggtattttgtgtttcgttgatgcttgaattagactgttccctggggaaataaatcatgacatggaagggcccctcctctgtaggggagtgccttcccaaccaccagtccagagggacactagctcgcatttgtgtcctagtctttcttatctctaaccctgattagcgctttatggttcaggaatgacctgcctgccaagg

SEQ ID NO: 57215 - DNA, 201 bp, Bos taurus; identical to SEQ ID NO: 16419

SEQ ID NO: 57216 - DNA, 201 bp, Bos taurus; identical to SEQ ID NO: 16426

SEQ ID NO: 57217 - DNA, 201 bp, Bos taurus; identical to SEQ ID NO: 16429

SEQ ID NO: 57218 - DNA, 201 bp, Bos taurus; identical to SEQ ID NO: 16431

SEQ ID NO: 57219 - DNA, 201 bp, Bos taurus; identical to SEQ ID NO: 16432

SEQ ID NO: 57220 - DNA, 201 bp, Bos taurus; identical to SEQ ID NO: 16433

SEQ ID NO: 57221 - DNA, 201 bp, Bos taurus; identical to SEQ ID NO: 16434

SEQ ID NO: 57222 - DNA, 201 bp, Bos taurus; identical to SEQ ID NO: 16435

SEQ ID NO: 57223 - DNA, 201 bp, Bos taurus; identical to SEQ ID NO: 16436

SEQ ID NO: 57224 - DNA, 201 bp, Bos taurus; identical to SEQ ID NO: 16437

SEQ ID NO: 57225 - DNA, 201 bp, Bos taurus; identical to SEQ ID NO: 16438

SEQ ID NO: 57226 - DNA, 201 bp, Bos taurus; identical to SEQ ID NO: 16439

SEQ ID NO: 57227 - DNA, 201 bp, Bos taurus; identical to SEQ ID NO: 16440

SEQ ID NO: 57228 - DNA, 201 bp, Bos taurus; identical to SEQ ID NO: 16441

SEQ ID NO: 57229 - DNA, 201 bp, Bos taurus; identical to SEQ ID NO: 16443

SEQ ID NO: 57230 - DNA, 201 bp, Bos taurus; identical to SEQ ID NO: 16444

SEQ ID NO: 57231 - DNA, 201 bp, Bos taurus; identical to SEQ ID NO: 16445

SEQ ID NO: 57232 - DNA, 201 bp, Bos taurus; identical to SEQ ID NO: 16446

SEQ ID NO: 57233 - DNA, 201 bp, Bos taurus; identical to SEQ ID NO: 16447

SEQ ID NO: 57234 - DNA, 201 bp, Bos taurus; identical to SEQ ID NO: 16448

SEQ ID NO: 57235 - DNA, 201 bp, Bos taurus
cattctcagcatccagggcactaaagaggagagcccacaggaaggcaaaggcgtcagtgccacgcacactgttcacgtgtgtgtttcctggtacacacacgtgagcccctcataagcagctaacgtctactgtgatcaaaactgcaactccctgggtcaactgtctaaattttataaagttactatcaaaaaagaagctct

SEQ ID NO: 57236 - DNA, 201 bp, Bos taurus
gaaggtttggccaggcagagtctgcacccaagctcaactgtgtggcggttggcagagttaggtcctcactggctcttggttggaggctgctctcagttcattgccccaggggccacttggtagggcagatggcttccatctctcagcggtgccctgcagtgcctggcattttgggttcagtgaatgatgcctagttaccca

SEQ ID NO: 57237 - DNA, 201 bp, Bos taurus
tgagattggacttccaatgattacccaccctcggcgatgtcctcggggtgcttctgtgagattgagcttctcctatgggggcctcagtggggcacagggggcagggttccagttttctgggtgcagctgggctcccaggaggtgtgtgacaaaggccttgtttcccagctgccatgatggagatttgctacatcccaacat

SEQ ID NO: 57238 - DNA, 201 bp, Bos taurus
gacacatgagatggtgtttctaagatgaaaaggctggtgaacagcagcggtaggagcagaacctagccctgcaaccaccctggcaggcctggcaaggggacgcttcctgtgcgctgcagtgtctaaccttgggctctgcagagcaatatcctcacttcgctgacagggtggcagaaagggaggctgagaggagtcccagca

SEQ ID NO: 57239 - DNA, 201 bp, Bos taurus; identical to SEQ ID NO: 16450

SEQ ID NO: 57240 - DNA, 201 bp, Bos taurus; identical to SEQ ID NO: 16451

SEQ ID NO: 57241 - DNA, 201 bp, Bos taurus; identical to SEQ ID NO: 16453

SEQ ID NO: 57242 - DNA, 201 bp, Bos taurus
acaaggagaagttggagctcgcgttgctgagctggaagcacagaaggcagtacccatgctgacctctgtgtatttggaggccacaaagccagatgccctcgtgtgacccatcccccgattccagcttcttccattaaaacctgctcattctgttcttccgggaggccacagaaataatgtgctgaacacctgtcaaagcca

SEQ ID NO: 57243 - DNA, 201 bp, Bos taurus; identical to SEQ ID NO: 16456

SEQ ID NO: 57244 - DNA, 201 bp, Bos taurus; identical to SEQ ID NO: 16459

SEQ ID NO: 57245 - DNA, 201 bp, Bos taurus; identical to SEQ ID NO: 16460

SEQ ID NO: 57246 - DNA, 201 bp, Bos taurus; identical to SEQ ID NO: 16461

SEQ ID NO: 57247 - DNA, 201 bp, Bos taurus
taaggcaagcctttctttttccttactgaaataatttcagaaatgcactattggaatgttgtttaagatagacaaaatcatattcacaaaaaataccaatcgttcacttcaaggaacactgtctttatagtgtacaaacataacgtacaattctttgggcaggttagttttttcatgtagatcataaaatatattggtcaa

SEQ ID NO: 57248 - DNA, 201 bp, Bos taurus; identical to SEQ ID NO: 16462

SEQ ID NO: 57249 - DNA, 201 bp, Bos taurus; identical to SEQ ID NO: 16463

SEQ ID NO: 57250 - DNA, 201 bp, Bos taurus; identical to SEQ ID NO: 16464

SEQ ID NO: 57251 - DNA, 201 bp, Bos taurus
cagaatcaggcctgccgcttcagctggatgacttgttccccgaggtcacctcctacctcttgggtctgtttcactcacagcctcatcttgaagacccaacaaagttctggccccttctcccacaaagcattttctgttttcttccacatcttccaaattagatcaactttctcctctgaacctctgatcaactgttaccgc

SEQ ID NO: 57252 - DNA, 201 bp, Bos taurus; identical to SEQ ID NO: 16465

SEQ ID NO: 57253 - DNA, 201 bp, Bos taurus
acatgactgagcagctaacactttcactctccccaggctttggggagcaaaggtgttccctggcaggtctcacacaggctgtttctggaaatctggccaaaccagccctcagcccctggctgctgctcccctggacctgttgctcctccttggaattcacgctactggacagcttgtttttcatacacattttgctttatc

SEQ ID NO: 57254 - DNA, 201 bp, Bos taurus; identical to SEQ ID NO: 16468

SEQ ID NO: 57255 - DNA, 201 bp, Bos taurus; identical to SEQ ID NO: 16469

SEQ ID NO: 57256 - DNA, 201 bp, Bos taurus; identical to SEQ ID NO: 16470

SEQ ID NO: 57257 - DNA, 201 bp, Bos taurus; identical to SEQ ID NO: 16471

SEQ ID NO: 57258 - DNA, 201 bp, Bos taurus
agtccatccaggaggaaggactctcctctgagatcagtgggacagtgtctggagactcatatcctgagagagggactcgtgaaggcaaaccagccagcagcgtggcctcagactgtgcttccctgtccaggtctgacccttgataatggccccgatactttgggataggaggattatggaggtggatcaagaaagtaggta

SEQ ID NO: 57259 - DNA, 201 bp, Bos taurus; identical to SEQ ID NO: 16475

SEQ ID NO: 57260 - DNA, 201 bp, Bos taurus; identical to SEQ ID NO: 16476

SEQ ID NO: 57261 - DNA, 201 bp, Bos taurus
gaagagtcaatctcagtttaacttcctcatttgacagacgaggtggaaatgaagtggattccttagtcacgctgaacccagaaagcccttttatgaggagtggtgagggccgaagaagagatttcccttctgtactacttagaaaggaacttcttgggtgattcagtaccccacggagggaatcagggcccagatggcctt

SEQ ID NO: 57262 - DNA, 201 bp, Bos taurus; identical to SEQ ID NO: 16478

SEQ ID NO: 57263 - DNA, 201 bp, Bos taurus
ggtgaaggacccagcccatttataaaggctgtggccttccccatgtgtcatagtgtgtgattttaattttgcaagaccctggccaggaaagaaagaataatgggtcaacatgacctcctatcttgtttaagtttgaaaaatctatttcaagaagctaagcacaaaatggccttcctcgaagagatttttctgcattagggt

SEQ ID NO: 57264 - DNA, 201 bp, Bos taurus; identical to SEQ ID NO: 16480

SEQ ID NO: 57265 - DNA, 201 bp, Bos taurus
agaggagaggtctccaggtggcccccacgcatttctgatttgcagaatcaccaggctttattctgttaagactctactgagagatgacaggctcccaccccgaggccaacagctggagcagggaaacagggttacacctgagttattcaaggttggcctttgtggggactagaacagccaacacttggcccctttgtgcta

SEQ ID NO: 57266 - DNA, 201 bp, Bos taurus
aatttgctagacaagccagcacaggagaaagctgagttctggggagaagcaggggttggggagaagagaccttatgtggcctaaggatgaacacgagggggaaagtgcccagtggtttgggctggagatccagaatataaatgtgctggaaaggatgaagagggccagattcatggactgcagacccctgctttgtagaca

SEQ ID NO: 57267 - DNA, 201 bp, Bos taurus; identical to SEQ ID NO: 16484

SEQ ID NO: 57268 - DNA, 201 bp, Bos taurus; identical to SEQ ID NO: 16485

SEQ ID NO: 57269 - DNA, 201 bp, Bos taurus; identical to SEQ ID NO: 16486

SEQ ID NO: 57270 - DNA, 201 bp, Bos taurus; identical to SEQ ID NO: 16488

SEQ ID NO: 57271 - DNA, 201 bp, Bos taurus
ggacctggattcagctgattatgctccagggcaaatcctccagcactgggttcacatccctgtgaatgaagtcaggagtcctggcttggccttaccacatagagtgttgagtgtttgcattgtgggaaactcatttaacatattaaaaaaaaaatttttttttgtctttgtggcttgcaggatcttagttcctcaaccaag

SEQ ID NO: 57272 - DNA, 201 bp, Bos taurus; identical to SEQ ID NO: 16491

SEQ ID NO: 57273 - DNA, 201 bp, Bos taurus; identical to SEQ ID NO: 16492

SEQ ID NO: 57274 - DNA, 201 bp, Bos taurus; identical to SEQ ID NO: 16493

SEQ ID NO: 57275 - DNA, 201 bp, Bos taurus; identical to SEQ ID NO: 16494

SEQ ID NO: 57276 - DNA, 201 bp, Bos taurus; identical to SEQ ID NO: 16496

SEQ ID NO: 57277 - DNA, 201 bp, Bos taurus; identical to SEQ ID NO: 16497

SEQ ID NO: 57278 - DNA, 201 bp, Bos taurus
cacgtcactatttccaaaatatgctcaaagatgtgatctcaatcaagggaggatccatctttaccacacaccctttcctggtgttcaaaaccaaactgctagaaacataaagataaaaggaatcaccagaaactgaggaggaactggtcaccctccagctccttgcataagcccacatgggctctgacatgggcggtgatg

SEQ ID NO: 57279 - DNA, 201 bp, Bos taurus
ggtttcaggcccacaaacagctccagaccctaacatattggtggctttcagtcacccagccactgtggcaggaccggggctctagggtccatgttctcttcgtcagattaggccacctcctgaggccctctggctcactggagaagactctaatgctgggaaagattgaaggcaggaggagaaggggacgacagaggaaga

SEQ ID NO: 57280 - DNA, 201 bp, Bos taurus
aactccaggccatggccttccccttctgggggttaagaaaagccagtacttctcgctcttggcacttcctctgaggacagttggagacaacgtttatcagcggagccctggcactgtggccaccacattccgccctctgatgacaaggacctggaggggtgcagcgggaagtagggctgggggaggggtgcctgggaggag

SEQ ID NO: 57281 - DNA, 201 bp, Bos taurus; identical to SEQ ID NO: 16498

SEQ ID NO: 57282 - DNA, 201 bp, Bos taurus; identical to SEQ ID NO: 16499

SEQ ID NO: 57283 - DNA, 201 bp, Bos taurus; identical to SEQ ID NO: 16501

SEQ ID NO: 57284 - DNA, 201 bp, Bos taurus; identical to SEQ ID NO: 16502

SEQ ID NO: 57285 - DNA, 201 bp, Bos taurus; identical to SEQ ID NO: 16503

SEQ ID NO: 57286 - DNA, 201 bp, Bos taurus; identical to SEQ ID NO: 16504

SEQ ID NO: 57287 - DNA, 201 bp, Bos taurus; identical to SEQ ID NO: 16505

SEQ ID NO: 57288 - DNA, 201 bp, Bos taurus; identical to SEQ ID NO: 16506

SEQ ID NO: 57289 - DNA, 201 bp, Bos taurus; identical to SEQ ID NO: 16507

SEQ ID NO: 57290 - DNA, 201 bp, Bos taurus; identical to SEQ ID NO: 16508

SEQ ID NO: 57291 - DNA, 201 bp, Bos taurus; identical to SEQ ID NO: 16509

SEQ ID NO: 57292 - DNA, 201 bp, Bos taurus; identical to SEQ ID NO: 16510

SEQ ID NO: 57293 - DNA, 201 bp, Bos taurus; identical to SEQ ID NO: 16511

SEQ ID NO: 57294 - DNA, 201 bp, Bos taurus; identical to SEQ ID NO: 16513

SEQ ID NO: 57295 - DNA, 201 bp, Bos taurus; identical to SEQ ID NO: 16514

SEQ ID NO: 57296 - DNA, 201 bp, Bos taurus; identical to SEQ ID NO: 16515

SEQ ID NO: 57297 - DNA, 201 bp, Bos taurus; identical to SEQ ID NO: 16516

SEQ ID NO: 57298 - DNA, 201 bp, Bos taurus; identical to SEQ ID NO: 16517

SEQ ID NO: 57299 - DNA, 201 bp, Bos taurus; identical to SEQ ID NO: 16518

SEQ ID NO: 57300 - DNA, 201 bp, Bos taurus; identical to SEQ ID NO: 16519

SEQ ID NO: 57301 - DNA, 201 bp, Bos taurus; identical to SEQ ID NO: 16520

SEQ ID NO: 57302 - DNA, 201 bp, Bos taurus; identical to SEQ ID NO: 16521

SEQ ID NO: 57303 - DNA, 201 bp, Bos taurus; identical to SEQ ID NO: 16522

SEQ ID NO: 57304 - DNA, 201 bp, Bos taurus; identical to SEQ ID NO: 16523

SEQ ID NO: 57305 - DNA, 201 bp, Bos taurus; identical to SEQ ID NO: 16524

SEQ ID NO: 57306 - DNA, 201 bp, Bos taurus; identical to SEQ ID NO: 16525

SEQ ID NO: 57307 - DNA, 201 bp, Bos taurus; identical to SEQ ID NO: 16526

SEQ ID NO: 57308 - DNA, 201 bp, Bos taurus; identical to SEQ ID NO: 16527

SEQ ID NO: 57309 - DNA, 201 bp, Bos taurus; identical to SEQ ID NO: 16528

SEQ ID NO: 57310 - DNA, 201 bp, Bos taurus; identical to SEQ ID NO: 16529

SEQ ID NO: 57311 - DNA, 201 bp, Bos taurus; identical to SEQ ID NO: 16530

SEQ ID NO: 57312 - DNA, 201 bp, Bos taurus; identical to SEQ ID NO: 16531

SEQ ID NO: 57313 - DNA, 201 bp, Bos taurus; identical to SEQ ID NO: 16532

SEQ ID NO: 57314 - DNA, 201 bp, Bos taurus; identical to SEQ ID NO: 16534

SEQ ID NO: 57315 - DNA, 201 bp, Bos taurus; identical to SEQ ID NO: 16535

SEQ ID NO: 57316 - DNA, 201 bp, Bos taurus; identical to SEQ ID NO: 16536

SEQ ID NO: 57317 - DNA, 201 bp, Bos taurus; identical to SEQ ID NO: 16537

SEQ ID NO: 57318 - DNA, 201 bp, Bos taurus; identical to SEQ ID NO: 16538

SEQ ID NO: 57319 - DNA, 201 bp, Bos taurus; identical to SEQ ID NO: 16539

SEQ ID NO: 57320 - DNA, 201 bp, Bos taurus; identical to SEQ ID NO: 16540

SEQ ID NO: 57321 - DNA, 201 bp, Bos taurus; identical to SEQ ID NO: 16541

SEQ ID NO: 57322 - DNA, 201 bp, Bos taurus; identical to SEQ ID NO: 16542

SEQ ID NO: 57323 - DNA, 201 bp, Bos taurus; identical to SEQ ID NO: 16543

SEQ ID NO: 57324 - DNA, 201 bp, Bos taurus; identical to SEQ ID NO: 16544

SEQ ID NO: 57325 - DNA, 201 bp, Bos taurus; identical to SEQ ID NO: 16545

SEQ ID NO: 57326 - DNA, 201 bp, Bos taurus; identical to SEQ ID NO: 16546

SEQ ID NO: 57327 - DNA, 201 bp, Bos taurus; identical to SEQ ID NO: 16547

SEQ ID NO: 57328 - DNA, 201 bp, Bos taurus; identical to SEQ ID NO: 16548

SEQ ID NO: 57329 - DNA, 201 bp, Bos taurus; identical to SEQ ID NO: 16549

SEQ ID NO: 57330 - DNA, 201 bp, Bos taurus; identical to SEQ ID NO: 16550

SEQ ID NO: 57331 - DNA, 201 bp, Bos taurus
aaaaaccaaaactttgatttttcacaccttctctgctcagaatccttgggagtccttctcaaagcactatggtactctatcacttcatccagtgggcaaactgcactgacatcctttttattcttaactaaatttacacagttgtaccacctacaccgtattttaccctctgggataatgatacccctaccctaccaatgc

SEQ ID NO: 57332 - DNA, 201 bp, Bos taurus; identical to SEQ ID NO: 16556

SEQ ID NO: 57333 - DNA, 201 bp, Bos taurus; identical to SEQ ID NO: 16557

SEQ ID NO: 57334 - DNA, 201 bp, Bos taurus
acgagctgatgagaaatgtgtagggttgtggaaagcaaatcagagaagctgagtgagtgaggagaaaataatggtccgtgtcagcaaagggatggcccagcgtgagagatgaaagcctggtgagattttaaactgcccacatgcccattcctgcaggtttccgtgaacaaatagggccacatgtggtcacaccaaaaatat

SEQ ID NO: 57335 - DNA, 201 bp, Bos taurus; identical to SEQ ID NO: 16559

SEQ ID NO: 57336 - DNA, 201 bp, Bos taurus; identical to SEQ ID NO: 16561

SEQ ID NO: 57337 - DNA, 201 bp, Bos taurus; identical to SEQ ID NO: 16562

SEQ ID NO: 57338 - DNA, 201 bp, Bos taurus; identical to SEQ ID NO: 16564

SEQ ID NO: 57339 - DNA, 201 bp, Bos taurus; identical to SEQ ID NO: 16567

SEQ ID NO: 57340 - DNA, 201 bp, Bos taurus; identical to SEQ ID NO: 16569

SEQ ID NO: 57341 - DNA, 201 bp, Bos taurus; identical to SEQ ID NO: 16570

SEQ ID NO: 57342 - DNA, 201 bp, Bos taurus
tccacaaaaggccatgcagcaacgaagacccagtacagccataaataaataagtagaattatatatatataaaatcctagcacatttttatagtaagaaacctaaaaaaaaataatgcgatactgaaaaaaagcacctgtaaatatgttgattaataaatatgagacatatggtaagccacagcttaacttaccctcctta

SEQ ID NO: 57343 - DNA, 201 bp, Bos taurus; identical to SEQ ID NO: 16576

SEQ ID NO: 57344 - DNA, 201 bp, Bos taurus; identical to SEQ ID NO: 16578

SEQ ID NO: 57345 - DNA, 201 bp, Bos taurus; identical to SEQ ID NO: 16579

SEQ ID NO: 57346 - DNA, 201 bp, Bos taurus; identical to SEQ ID NO: 16580

SEQ ID NO: 57347 - DNA, 201 bp, Bos taurus; identical to SEQ ID NO: 16583

SEQ ID NO: 57348 - DNA, 201 bp, Bos taurus; identical to SEQ ID NO: 16584

SEQ ID NO: 57349 - DNA, 201 bp, Bos taurus; identical to SEQ ID NO: 16585

SEQ ID NO: 57350 - DNA, 201 bp, Bos taurus; identical to SEQ ID NO: 16586

SEQ ID NO: 57351 - DNA, 201 bp, Bos taurus; identical to SEQ ID NO: 16588

SEQ ID NO: 57352 - DNA, 201 bp, Bos taurus; identical to SEQ ID NO: 16589

SEQ ID NO: 57353 - DNA, 201 bp, Bos taurus; identical to SEQ ID NO: 16591

SEQ ID NO: 57354 - DNA, 201 bp, Bos taurus; identical to SEQ ID NO: 16592

SEQ ID NO: 57355 - DNA, 201 bp, Bos taurus; identical to SEQ ID NO: 16593

SEQ ID NO: 57356 - DNA, 201 bp, Bos taurus; identical to SEQ ID NO: 16594

SEQ ID NO: 57357 - DNA, 201 bp, Bos taurus; identical to SEQ ID NO: 16595

SEQ ID NO: 57358 - DNA, 201 bp, Bos taurus; identical to SEQ ID NO: 16596

SEQ ID NO: 57359 - DNA, 201 bp, Bos taurus; identical to SEQ ID NO: 16597

SEQ ID NO: 57360 - DNA, 201 bp, Bos taurus; identical to SEQ ID NO: 16598

SEQ ID NO: 57361 - DNA, 201 bp, Bos taurus; identical to SEQ ID NO: 16603

SEQ ID NO: 57362 - DNA, 201 bp, Bos taurus; identical to SEQ ID NO: 16604

SEQ ID NO: 57363 - DNA, 201 bp, Bos taurus; identical to SEQ ID NO: 16606

SEQ ID NO: 57364 - DNA, 201 bp, Bos taurus; identical to SEQ ID NO: 16607

SEQ ID NO: 57365 - DNA, 201 bp, Bos taurus; identical to SEQ ID NO: 16609

SEQ ID NO: 57366 - DNA, 201 bp, Bos taurus; identical to SEQ ID NO: 16610

SEQ ID NO: 57367 - DNA, 201 bp, Bos taurus; identical to SEQ ID NO: 16611

SEQ ID NO: 57368 - DNA, 201 bp, Bos taurus; identical to SEQ ID NO: 16612

SEQ ID NO: 57369 - DNA, 201 bp, Bos taurus; identical to SEQ ID NO: 16613

SEQ ID NO: 57370 - DNA, 201 bp, Bos taurus; identical to SEQ ID NO: 16615

SEQ ID NO: 57371 - DNA, 201 bp, Bos taurus; identical to SEQ ID NO: 16616

SEQ ID NO: 57372 - DNA, 201 bp, Bos taurus; identical to SEQ ID NO: 16617

SEQ ID NO: 57373 - DNA, 201 bp, Bos taurus; identical to SEQ ID NO: 16618

SEQ ID NO: 57374 - DNA, 201 bp, Bos taurus; identical to SEQ ID NO: 16620

SEQ ID NO: 57375 - DNA, 201 bp, Bos taurus; identical to SEQ ID NO: 16621

SEQ ID NO: 57376 - DNA, 201 bp, Bos taurus; identical to SEQ ID NO: 16623

SEQ ID NO: 57377 - DNA, 201 bp, Bos taurus; identical to SEQ ID NO: 16624

SEQ ID NO: 57378 - DNA, 201 bp, Bos taurus; identical to SEQ ID NO: 16626

SEQ ID NO: 57379 - DNA, 201 bp, Bos taurus; identical to SEQ ID NO: 16627

SEQ ID NO: 57380 - DNA, 201 bp, Bos taurus; identical to SEQ ID NO: 16629

SEQ ID NO: 57381 - DNA, 201 bp, Bos taurus; identical to SEQ ID NO: 16631

SEQ ID NO: 57382 - DNA, 201 bp, Bos taurus; identical to SEQ ID NO: 16634

SEQ ID NO: 57383 - DNA, 201 bp, Bos taurus; identical to SEQ ID NO: 16639

SEQ ID NO: 57384 - DNA, 201 bp, Bos taurus; identical to SEQ ID NO: 16640

SEQ ID NO: 57385 - DNA, 201 bp, Bos taurus; identical to SEQ ID NO: 16641

SEQ ID NO: 57386 - DNA, 201 bp, Bos taurus; identical to SEQ ID NO: 16642

SEQ ID NO: 57387 - DNA, 201 bp, Bos taurus; identical to SEQ ID NO: 16643

SEQ ID NO: 57388 - DNA, 201 bp, Bos taurus; identical to SEQ ID NO: 16645

SEQ ID NO: 57389 - DNA, 201 bp, Bos taurus; identical to SEQ ID NO: 16649

SEQ ID NO: 57390 - DNA, 201 bp, Bos taurus; identical to SEQ ID NO: 16651

SEQ ID NO: 57391 - DNA, 201 bp, Bos taurus; identical to SEQ ID NO: 16652

SEQ ID NO: 57392 - DNA, 201 bp, Bos taurus; identical to SEQ ID NO: 16653

SEQ ID NO: 57393 - DNA, 201 bp, Bos taurus; identical to SEQ ID NO: 16654

SEQ ID NO: 57394 - DNA, 201 bp, Bos taurus; identical to SEQ ID NO: 16655

SEQ ID NO: 57395 - DNA, 201 bp, Bos taurus; identical to SEQ ID NO: 16656

SEQ ID NO: 57396 - DNA, 201 bp, Bos taurus; identical to SEQ ID NO: 16657

SEQ ID NO: 57397 - DNA, 201 bp, Bos taurus; identical to SEQ ID NO: 16662

SEQ ID NO: 57398 - DNA, 201 bp, Bos taurus; identical to SEQ ID NO: 16663

SEQ ID NO: 57399 - DNA, 201 bp, Bos taurus; identical to SEQ ID NO: 16666

SEQ ID NO: 57400 - DNA, 201 bp, Bos taurus; identical to SEQ ID NO: 16667

SEQ ID NO: 57401 - DNA, 201 bp, Bos taurus; identical to SEQ ID NO: 16671

SEQ ID NO: 57402 - DNA, 201 bp, Bos taurus; identical to SEQ ID NO: 16672

SEQ ID NO: 57403 - DNA, 201 bp, Bos taurus; identical to SEQ ID NO: 16674

SEQ ID NO: 57404 - DNA, 201 bp, Bos taurus; identical to SEQ ID NO: 16675

SEQ ID NO: 57405 - DNA, 201 bp, Bos taurus; identical to SEQ ID NO: 16676

SEQ ID NO: 57406 - DNA, 201 bp, Bos taurus; identical to SEQ ID NO: 16679

SEQ ID NO: 57407 - DNA, 201 bp, Bos taurus; identical to SEQ ID NO: 16680

SEQ ID NO: 57408 - DNA, 201 bp, Bos taurus; identical to SEQ ID NO: 16682

SEQ ID NO: 57409 - DNA, 201 bp, Bos taurus; identical to SEQ ID NO: 16684

SEQ ID NO: 57410 - DNA, 201 bp, Bos taurus; identical to SEQ ID NO: 16687

SEQ ID NO: 57411 - DNA, 201 bp, Bos taurus; identical to SEQ ID NO: 16688

SEQ ID NO: 57412 - DNA, 201 bp, Bos taurus; identical to SEQ ID NO: 16690

SEQ ID NO: 57413 - DNA, 201 bp, Bos taurus; identical to SEQ ID NO: 16691

SEQ ID NO: 57414 - DNA, 201 bp, Bos taurus; identical to SEQ ID NO: 16692

SEQ ID NO: 57415 - DNA, 201 bp, Bos taurus; identical to SEQ ID NO: 16693

SEQ ID NO: 57416 - DNA, 201 bp, Bos taurus; identical to SEQ ID NO: 16694

SEQ ID NO: 57417 - DNA, 201 bp, Bos taurus; identical to SEQ ID NO: 16696

SEQ ID NO: 57418 - DNA, 201 bp, Bos taurus; identical to SEQ ID NO: 16698

SEQ ID NO: 57419 - DNA, 201 bp, Bos taurus; identical to SEQ ID NO: 16699

SEQ ID NO: 57420 - DNA, 201 bp, Bos taurus; identical to SEQ ID NO: 16700

SEQ ID NO: 57421 - DNA, 201 bp, Bos taurus; identical to SEQ ID NO: 16701

SEQ ID NO: 57422 - DNA, 201 bp, Bos taurus; identical to SEQ ID NO: 16702

SEQ ID NO: 57423 - DNA, 201 bp, Bos taurus; identical to SEQ ID NO: 16703

SEQ ID NO: 57424 - DNA, 201 bp, Bos taurus; identical to SEQ ID NO: 16704

SEQ ID NO: 57425 - DNA, 201 bp, Bos taurus; identical to SEQ ID NO: 16705

SEQ ID NO: 57426 - DNA, 201 bp, Bos taurus; identical to SEQ ID NO: 16706

SEQ ID NO: 57427 - DNA, 201 bp, Bos taurus; identical to SEQ ID NO: 16707

SEQ ID NO: 57428 - DNA, 201 bp, Bos taurus; identical to SEQ ID NO: 16709

SEQ ID NO: 57429 - DNA, 201 bp, Bos taurus
aatgtctgtgtagatactttcacaggaggtgcccaagaactgacggtcatagttccctctttactcattttctcaaatttagcaaacattggtcagtgcccgtggggctggcaaacagacagataaactgtctgctgtaactgcagtgtgaagagctttttgtaaaatatatttaaaaaaaaaaagtgctgaaggaatagg

SEQ ID NO: 57430 - DNA, 201 bp, Bos taurus; identical to SEQ ID NO: 16710

SEQ ID NO: 57431 - DNA, 201 bp, Bos taurus; identical to SEQ ID NO: 16716

SEQ ID NO: 57432 - DNA, 201 bp, Bos taurus; identical to SEQ ID NO: 16718

SEQ ID NO: 57433 - DNA, 201 bp, Bos taurus; identical to SEQ ID NO: 16720

SEQ ID NO: 57434 - DNA, 201 bp, Bos taurus; identical to SEQ ID NO: 16721

SEQ ID NO: 57435 - DNA, 201 bp, Bos taurus; identical to SEQ ID NO: 16722

SEQ ID NO: 57436 - DNA, 201 bp, Bos taurus; identical to SEQ ID NO: 16723

SEQ ID NO: 57437 - DNA, 201 bp, Bos taurus; identical to SEQ ID NO: 16724

SEQ ID NO: 57438 - DNA, 201 bp, Bos taurus; identical to SEQ ID NO: 16725

SEQ ID NO: 57439 - DNA, 201 bp, Bos taurus; identical to SEQ ID NO: 16726

SEQ ID NO: 57440 - DNA, 201 bp, Bos taurus; identical to SEQ ID NO: 16727

SEQ ID NO: 57441 - DNA, 201 bp, Bos taurus; identical to SEQ ID NO: 16728

SEQ ID NO: 57442 - DNA, 201 bp, Bos taurus; identical to SEQ ID NO: 16729

SEQ ID NO: 57443 - DNA, 201 bp, Bos taurus; identical to SEQ ID NO: 16730

SEQ ID NO: 57444 - DNA, 201 bp, Bos taurus; identical to SEQ ID NO: 16731

SEQ ID NO: 57445 - DNA, 201 bp, Bos taurus; identical to SEQ ID NO: 16732

SEQ ID NO: 57446 - DNA, 201 bp, Bos taurus; identical to SEQ ID NO: 16733

SEQ ID NO: 57447 - DNA, 201 bp, Bos taurus; identical to SEQ ID NO: 16734

SEQ ID NO: 57448 - DNA, 201 bp, Bos taurus
ttccataagcatgcccctgagagctaagttcttctcttcatcctctctgaatccagtgaaatcaggtctggaatatctctttcactgatccaagtatccccgttcattctccatgtggtcactaatttgaacttaataaaatatgtcacatcactacaatgggtaaactttttctagtaagtgtagagtaagttcattctt

SEQ ID NO: 57449 - DNA, 201 bp, Bos taurus; identical to SEQ ID NO: 16735

SEQ ID NO: 57450 - DNA, 201 bp, Bos taurus; identical to SEQ ID NO: 16736

SEQ ID NO: 57451 - DNA, 201 bp, Bos taurus; identical to SEQ ID NO: 16737

SEQ ID NO: 57452 - DNA, 201 bp, Bos taurus; identical to SEQ ID NO: 16738

SEQ ID NO: 57453 - DNA, 201 bp, Bos taurus; identical to SEQ ID NO: 16739

SEQ ID NO: 57454 - DNA, 201 bp, Bos taurus; identical to SEQ ID NO: 16740

SEQ ID NO: 57455 - DNA, 201 bp, Bos taurus; identical to SEQ ID NO: 16741

SEQ ID NO: 57456 - DNA, 201 bp, Bos taurus; identical to SEQ ID NO: 16742

SEQ ID NO: 57457 - DNA, 201 bp, Bos taurus; identical to SEQ ID NO: 16743

SEQ ID NO: 57458 - DNA, 201 bp, Bos taurus; identical to SEQ ID NO: 16744

SEQ ID NO: 57459 - DNA, 201 bp, Bos taurus; identical to SEQ ID NO: 16745

SEQ ID NO: 57460 - DNA, 201 bp, Bos taurus; identical to SEQ ID NO: 16746

SEQ ID NO: 57461 - DNA, 201 bp, Bos taurus; identical to SEQ ID NO: 16747

SEQ ID NO: 57462 - DNA, 201 bp, Bos taurus; identical to SEQ ID NO: 16748

SEQ ID NO: 57463 - DNA, 201 bp, Bos taurus; identical to SEQ ID NO: 16749

SEQ ID NO: 57464 - DNA, 201 bp, Bos taurus; identical to SEQ ID NO: 16750

SEQ ID NO: 57465 - DNA, 201 bp, Bos taurus; identical to SEQ ID NO: 16751

SEQ ID NO: 57466 - DNA, 201 bp, Bos taurus; identical to SEQ ID NO: 16753

SEQ ID NO: 57467 - DNA, 201 bp, Bos taurus; identical to SEQ ID NO: 16754

SEQ ID NO: 57468 - DNA, 201 bp, Bos taurus; identical to SEQ ID NO: 16756

SEQ ID NO: 57469 - DNA, 201 bp, Bos taurus; identical to SEQ ID NO: 16757

SEQ ID NO: 57470 - DNA, 201 bp, Bos taurus; identical to SEQ ID NO: 16758

SEQ ID NO: 57471 - DNA, 201 bp, Bos taurus; identical to SEQ ID NO: 16759

SEQ ID NO: 57472 - DNA, 201 bp, Bos taurus; identical to SEQ ID NO: 16760

SEQ ID NO: 57473 - DNA, 201 bp, Bos taurus; identical to SEQ ID NO: 16761

SEQ ID NO: 57474 - DNA, 201 bp, Bos taurus; identical to SEQ ID NO: 16762

SEQ ID NO: 57475 - DNA, 201 bp, Bos taurus; identical to SEQ ID NO: 16763

SEQ ID NO: 57476 - DNA, 201 bp, Bos taurus; identical to SEQ ID NO: 16764

SEQ ID NO: 57477 - DNA, 201 bp, Bos taurus; identical to SEQ ID NO: 16765

SEQ ID NO: 57478 - DNA, 201 bp, Bos taurus; identical to SEQ ID NO: 16766

SEQ ID NO: 57479 - DNA, 201 bp, Bos taurus; identical to SEQ ID NO: 16769

SEQ ID NO: 57480 - DNA, 201 bp, Bos taurus; identical to SEQ ID NO: 16770

SEQ ID NO: 57481 - DNA, 201 bp, Bos taurus; identical to SEQ ID NO: 16771

SEQ ID NO: 57482 - DNA, 201 bp, Bos taurus; identical to SEQ ID NO: 16772

SEQ ID NO: 57483 - DNA, 201 bp, Bos taurus; identical to SEQ ID NO: 16773

SEQ ID NO: 57484 - DNA, 201 bp, Bos taurus; identical to SEQ ID NO: 16774

SEQ ID NO: 57485 - DNA, 201 bp, Bos taurus; identical to SEQ ID NO: 16775

SEQ ID NO: 57486 - DNA, 201 bp, Bos taurus; identical to SEQ ID NO: 16776

SEQ ID NO: 57487 - DNA, 201 bp, Bos taurus; identical to SEQ ID NO: 16777

SEQ ID NO: 57488 - DNA, 201 bp, Bos taurus; identical to SEQ ID NO: 16778

SEQ ID NO: 57489 - DNA, 201 bp, Bos taurus; identical to SEQ ID NO: 16779

SEQ ID NO: 57490 - DNA, 201 bp, Bos taurus; identical to SEQ ID NO: 16780

SEQ ID NO: 57491 - DNA, 201 bp, Bos taurus; identical to SEQ ID NO: 16781

SEQ ID NO: 57492 - DNA, 201 bp, Bos taurus; identical to SEQ ID NO: 16782

SEQ ID NO: 57493 - DNA, 201 bp, Bos taurus; identical to SEQ ID NO: 16783

SEQ ID NO: 57494 - DNA, 201 bp, Bos taurus
tggaaattgtttacattctatgacaatttcacagcatatgaaagaaaatttggctttggtggactctctctcataatcagctcactgaatagaagaagaaagctcaagactagagtttctgtccacagaaatgcagtgcctttaatagtcacagttacatattccaaagaaaggacaaatcgtgctatgataagtaagtgg

SEQ ID NO: 57495 - DNA, 201 bp, Bos taurus; identical to SEQ ID NO: 16784

SEQ ID NO: 57496 - DNA, 201 bp, Bos taurus; identical to SEQ ID NO: 16786

SEQ ID NO: 57497 - DNA, 201 bp, Bos taurus; identical to SEQ ID NO: 16787

SEQ ID NO: 57498 - DNA, 201 bp, Bos taurus
ttctccaaacgggcccttggctcagagcgggctcagtcatcatcacccgcaggcaaaggaggagctagctgggatgacgcattctcctctttctcagcacgtacgggcccccagacagcccaggccaggagaagcctgctcagtccgcacccgcttcaggcttctcccactttatctgtctggggcacttgcccttggcta

SEQ ID NO: 57499 - DNA, 201 bp, Bos taurus
atcaatacacacacacacacacacacacacacacacacacacacacacacagacccctcctcgcctccagaaaagtgaaagtaagaagggccgctaaaggggtttgctctttgcagtactcaaatggctgctattaaagaattctgtgttgatgcccagatggatgggcctgcagagaatttataaagaaaaagggaaact

SEQ ID NO: 57500 - DNA, 201 bp, Bos taurus; identical to SEQ ID NO: 16788

SEQ ID NO: 57501 - DNA, 201 bp, Bos taurus
gaagagccctgctcaccctgcggccccagcggaatgccacatcctccacatgaacctctcccgttcccccgagtatgtgaccttgtcttttccgtactctcatgcaagtgtcagcctcctctatggccttttcagactttctatcagctatgtcagtaaagtctatccaatatatacccatatcgacatacttctccagat

SEQ ID NO: 57502 - DNA, 201 bp, Bos taurus; identical to SEQ ID NO: 16791

SEQ ID NO: 57503 - DNA, 201 bp, Bos taurus; identical to SEQ ID NO: 16793

SEQ ID NO: 57504 - DNA, 201 bp, Bos taurus; identical to SEQ ID NO: 16794

SEQ ID NO: 57505 - DNA, 201 bp, Bos taurus; identical to SEQ ID NO: 16795

SEQ ID NO: 57506 - DNA, 201 bp, Bos taurus
tctctctgttattcctcattccagttcttgatactggtgttcggtaaactttccctcttctcatcggaaacctgacgctctttgactgtaggagggccggtgtccccgctctgcccgctggtgcgcgcgcgcttccctgcgtcggtctcctcttccctagctgtgcgctcctcatcggaacgctgcttcaggcgctgctgt

SEQ ID NO: 57507 - DNA, 201 bp, Bos taurus
ctgccacggcccaccgcgtcccgctcccagccacagccctgcccatttgccgccttaactgggctgaacccctggccctgctctcagtccattctgttgttagggattatctcctgtaccattttttcataaaaccaaaatcactaccatcaaatggcctttgtacctttaaaaaggtctgcttaaaattctgtttttaaa

SEQ ID NO: 57508 - DNA, 201 bp, Bos taurus
tgcatttcactcatttaaagcatatgtgtcaatggtgtttagtaatgtaatgttcagagagttctgagactttcaccacagtcaatttcagaatattttcatcactccattagccgtcacttcccattggtggtggtggtttagtcgctaagttgtgtctgactcttgcgatcccgtggactgtagcctgtcaggctcctc

SEQ ID NO: 57509 - DNA, 201 bp, Bos taurus; identical to SEQ ID NO: 16799

SEQ ID NO: 57510 - DNA, 201 bp, Bos taurus; identical to SEQ ID NO: 16800

SEQ ID NO: 57511 - DNA, 201 bp, Bos taurus; identical to SEQ ID NO: 16801

SEQ ID NO: 57512 - DNA, 201 bp, Bos taurus; identical to SEQ ID NO: 16803

SEQ ID NO: 57513 - DNA, 201 bp, Bos taurus; identical to SEQ ID NO: 16804

SEQ ID NO: 57514 - DNA, 201 bp, Bos taurus
cccccaaggccagagattcgggactccagaggcttgtccccaccgagcaagcgccccttggatggacgccgggacagaatccactccactgtcagattacaagggaaagaacagacggaggtggccggggaggcttgtgatcactagagaggatcaaaagggcacttttctcacccccgcgccttccagaccgcctgcttg

SEQ ID NO: 57515 - DNA, 201 bp, Bos taurus; identical to SEQ ID NO: 16805

SEQ ID NO: 57516 - DNA, 201 bp, Bos taurus
ggagggccttacctgagagccgggtcctgttctccacaggggctgtttagcgacggaggagtggatcacatcccacggctctggccccggagtatctcgcttgtgtgctttcttacttagtcgagctgttaaattgagttgttttccgttccccaaacctacctgccttctctatttctgtcgtgtggccagttcccgctt

SEQ ID NO: 57517 - DNA, 201 bp, Bos taurus; identical to SEQ ID NO: 16809

SEQ ID NO: 57518 - DNA, 201 bp, Bos taurus; identical to SEQ ID NO: 16810

SEQ ID NO: 57519 - DNA, 201 bp, Bos taurus; identical to SEQ ID NO: 16813

SEQ ID NO: 57520 - DNA, 201 bp, Bos taurus; identical to SEQ ID NO: 16814

SEQ ID NO: 57521 - DNA, 201 bp, Bos taurus; identical to SEQ ID NO: 16815

SEQ ID NO: 57522 - DNA, 201 bp, Bos taurus; identical to SEQ ID NO: 16816

SEQ ID NO: 57523 - DNA, 201 bp, Bos taurus; identical to SEQ ID NO: 16817

SEQ ID NO: 57524 - DNA, 201 bp, Bos taurus; identical to SEQ ID NO: 16818

SEQ ID NO: 57525 - DNA, 201 bp, Bos taurus; identical to SEQ ID NO: 16819

SEQ ID NO: 57526 - DNA, 201 bp, Bos taurus; identical to SEQ ID NO: 16820

SEQ ID NO: 57527 - DNA, 201 bp, Bos taurus; identical to SEQ ID NO: 16821

SEQ ID NO: 57528 - DNA, 201 bp, Bos taurus; identical to SEQ ID NO: 16822

SEQ ID NO: 57529 - DNA, 201 bp, Bos taurus; identical to SEQ ID NO: 16823

SEQ ID NO: 57530 - DNA, 201 bp, Bos taurus; identical to SEQ ID NO: 16824

SEQ ID NO: 57531 - DNA, 201 bp, Bos taurus; identical to SEQ ID NO: 16825

SEQ ID NO: 57532 - DNA, 201 bp, Bos taurus; identical to SEQ ID NO: 16826

SEQ ID NO: 57533 - DNA, 201 bp, Bos taurus; identical to SEQ ID NO: 16827

SEQ ID NO: 57534 - DNA, 201 bp, Bos taurus; identical to SEQ ID NO: 16828

SEQ ID NO: 57535 - DNA, 201 bp, Bos taurus; identical to SEQ ID NO: 16829

SEQ ID NO: 57536 - DNA, 201 bp, Bos taurus; identical to SEQ ID NO: 16830

SEQ ID NO: 57537 - DNA, 201 bp, Bos taurus; identical to SEQ ID NO: 16831

SEQ ID NO: 57538 - DNA, 201 bp, Bos taurus; identical to SEQ ID NO: 16832

SEQ ID NO: 57539 - DNA, 201 bp, Bos taurus; identical to SEQ ID NO: 16833

SEQ ID NO: 57540 - DNA, 201 bp, Bos taurus; identical to SEQ ID NO: 16834

SEQ ID NO: 57541 - DNA, 201 bp, Bos taurus; identical to SEQ ID NO: 16835

SEQ ID NO: 57542 - DNA, 201 bp, Bos taurus; identical to SEQ ID NO: 16836

SEQ ID NO: 57543 - DNA, 201 bp, Bos taurus; identical to SEQ ID NO: 16838

SEQ ID NO: 57544 - DNA, 201 bp, Bos taurus; identical to SEQ ID NO: 16839

SEQ ID NO: 57545 - DNA, 201 bp, Bos taurus; identical to SEQ ID NO: 16840

SEQ ID NO: 57546 - DNA, 201 bp, Bos taurus; identical to SEQ ID NO: 16841

SEQ ID NO: 57547 - DNA, 201 bp, Bos taurus; identical to SEQ ID NO: 16842

SEQ ID NO: 57548 - DNA, 201 bp, Bos taurus; identical to SEQ ID NO: 16843

SEQ ID NO: 57549 - DNA, 201 bp, Bos taurus; identical to SEQ ID NO: 16844

SEQ ID NO: 57550 - DNA, 201 bp, Bos taurus; identical to SEQ ID NO: 16845

SEQ ID NO: 57551 - DNA, 201 bp, Bos taurus; identical to SEQ ID NO: 16846

SEQ ID NO: 57552 - DNA, 201 bp, Bos taurus; identical to SEQ ID NO: 16847

SEQ ID NO: 57553 - DNA, 201 bp, Bos taurus; identical to SEQ ID NO: 16848

SEQ ID NO: 57554 - DNA, 201 bp, Bos taurus; identical to SEQ ID NO: 16849

SEQ ID NO: 57555 - DNA, 201 bp, Bos taurus; identical to SEQ ID NO: 16851

SEQ ID NO: 57556 - DNA, 201 bp, Bos taurus; identical to SEQ ID NO: 16852

SEQ ID NO: 57557 - DNA, 201 bp, Bos taurus; identical to SEQ ID NO: 16853

SEQ ID NO: 57558 - DNA, 201 bp, Bos taurus; identical to SEQ ID NO: 16854

SEQ ID NO: 57559 - DNA, 201 bp, Bos taurus; identical to SEQ ID NO: 16855

SEQ ID NO: 57560 - DNA, 201 bp, Bos taurus; identical to SEQ ID NO: 16856

SEQ ID NO: 57561 - DNA, 201 bp, Bos taurus; identical to SEQ ID NO: 16857

SEQ ID NO: 57562 - DNA, 201 bp, Bos taurus; identical to SEQ ID NO: 16858

SEQ ID NO: 57563 - DNA, 201 bp, Bos taurus; identical to SEQ ID NO: 16859

SEQ ID NO: 57564 - DNA, 201 bp, Bos taurus; identical to SEQ ID NO: 16860

SEQ ID NO: 57565 - DNA, 201 bp, Bos taurus; identical to SEQ ID NO: 16861

SEQ ID NO: 57566 - DNA, 201 bp, Bos taurus; identical to SEQ ID NO: 16862

SEQ ID NO: 57567 - DNA, 201 bp, Bos taurus; identical to SEQ ID NO: 16863

SEQ ID NO: 57568 - DNA, 201 bp, Bos taurus; identical to SEQ ID NO: 16864

SEQ ID NO: 57569 - DNA, 201 bp, Bos taurus; identical to SEQ ID NO: 16865

SEQ ID NO: 57570 - DNA, 201 bp, Bos taurus; identical to SEQ ID NO: 16866

SEQ ID NO: 57571 - DNA, 201 bp, Bos taurus; identical to SEQ ID NO: 16867

SEQ ID NO: 57572 - DNA, 201 bp, Bos taurus; identical to SEQ ID NO: 16868

SEQ ID NO: 57573 - DNA, 201 bp, Bos taurus; identical to SEQ ID NO: 16869

SEQ ID NO: 57574 - DNA, 201 bp, Bos taurus; identical to SEQ ID NO: 16870

SEQ ID NO: 57575 - DNA, 201 bp, Bos taurus; identical to SEQ ID NO: 16871

SEQ ID NO: 57576 - DNA, 201 bp, Bos taurus; identical to SEQ ID NO: 16872

SEQ ID NO: 57577 - DNA, 201 bp, Bos taurus; identical to SEQ ID NO: 16873

SEQ ID NO: 57578 - DNA, 201 bp, Bos taurus; identical to SEQ ID NO: 16874

SEQ ID NO: 57579 - DNA, 201 bp, Bos taurus; identical to SEQ ID NO: 16877

SEQ ID NO: 57580 - DNA, 201 bp, Bos taurus; identical to SEQ ID NO: 16878

SEQ ID NO: 57581 - DNA, 201 bp, Bos taurus; identical to SEQ ID NO: 16879

SEQ ID NO: 57582 - DNA, 201 bp, Bos taurus; identical to SEQ ID NO: 16880

SEQ ID NO: 57583 - DNA, 201 bp, Bos taurus; identical to SEQ ID NO: 16881

SEQ ID NO: 57584 - DNA, 201 bp, Bos taurus; identical to SEQ ID NO: 16882

SEQ ID NO: 57585 - DNA, 201 bp, Bos taurus; identical to SEQ ID NO: 16884

SEQ ID NO: 57586 - DNA, 201 bp, Bos taurus; identical to SEQ ID NO: 16885

SEQ ID NO: 57587 - DNA, 201 bp, Bos taurus; identical to SEQ ID NO: 16886

SEQ ID NO: 57588 - DNA, 201 bp, Bos taurus
tatctggctgcgcttgctgggagtctttctataattgcattcaagcagcccagtgagtatcctagtccccatagacacacaagcttaatctttaagtaactggtatagctcttcgatgaatgtatggccaggcgatttactgatactgaagaaattcgattccctgtagttattttcctatacttcattctctggagacca

SEQ ID NO: 57589 - DNA, 201 bp, Bos taurus; identical to SEQ ID NO: 16887

SEQ ID NO: 57590 - DNA, 201 bp, Bos taurus; identical to SEQ ID NO: 16889

SEQ ID NO: 57591 - DNA, 201 bp, Bos taurus; identical to SEQ ID NO: 16890

SEQ ID NO: 57592 - DNA, 201 bp, Bos taurus; identical to SEQ ID NO: 16892

SEQ ID NO: 57593 - DNA, 201 bp, Bos taurus; identical to SEQ ID NO: 16893

SEQ ID NO: 57594 - DNA, 201 bp, Bos taurus; identical to SEQ ID NO: 16894

SEQ ID NO: 57595 - DNA, 201 bp, Bos taurus; identical to SEQ ID NO: 16895

SEQ ID NO: 57596 - DNA, 201 bp, Bos taurus; identical to SEQ ID NO: 16897

SEQ ID NO: 57597 - DNA, 201 bp, Bos taurus; identical to SEQ ID NO: 16898

SEQ ID NO: 57598 - DNA, 201 bp, Bos taurus
tatgtttccttagaattcgccctcttaaaggtttatgtgtacatgaaaattggtgcgaacaaaacttctcctttgatggttatgcattattataaccacctgcagataatcatgaccggcttcagtatagtgctgtttctgatggaacacttggcaagatagttctgtagctggaatcatcttgagagacttttaaagaca

SEQ ID NO: 57599 - DNA, 201 bp, Bos taurus; identical to SEQ ID NO: 16900

SEQ ID NO: 57600 - DNA, 201 bp, Bos taurus
atgatgtatgtagtagcactttgtgggctattgagctctataaagagaggacaggatgattattgctgttcctatgggtttattaataattactgatgaatttaaagccctaggatagagttgggaatgatatcccaaatttcaaatctagagaactcttggaaggagagaaggagagatagatgaagaattttattaaga

SEQ ID NO: 57601 - DNA, 201 bp, Bos taurus; identical to SEQ ID NO: 16904

SEQ ID NO: 57602 - DNA, 201 bp, Bos taurus; identical to SEQ ID NO: 16907

SEQ ID NO: 57603 - DNA, 201 bp, Bos taurus; identical to SEQ ID NO: 16908

SEQ ID NO: 57604 - DNA, 201 bp, Bos taurus; identical to SEQ ID NO: 16909

SEQ ID NO: 57605 - DNA, 201 bp, Bos taurus; identical to SEQ ID NO: 16910

SEQ ID NO: 57606 - DNA, 201 bp, Bos taurus; identical to SEQ ID NO: 16911

SEQ ID NO: 57607 - DNA, 201 bp, Bos taurus
acccactcctggcttccaagtattatgccctccacgctgtatgggttggtatccaagagcatcatgttatccaggggcctattggatatggttgccaagtgtctaggaatgtgtcatcaaatcaataaagttcttagacttcacatacaatggagtgaaagataagagctatcacaagcactatcagtgatcctttagtct

SEQ ID NO: 57608 - DNA, 201 bp, Bos taurus
agatgcaaaacttacatcttaatcttcactctccattccactcccaaccaggtttcttgagctataatcaaaacaaatggtaggccaggtgggggatgagacatttactcttagttaagcacagactgcatttttttaatataggaaaatcttaaaatggcctcaaggcagtatttgatagggatctatcctggctttggg

SEQ ID NO: 57609 - DNA, 201 bp, Bos taurus; identical to SEQ ID NO: 16912

SEQ ID NO: 57610 - DNA, 201 bp, Bos taurus; identical to SEQ ID NO: 16913

SEQ ID NO: 57611 - DNA, 201 bp, Bos taurus; identical to SEQ ID NO: 16915

SEQ ID NO: 57612 - DNA, 201 bp, Bos taurus; identical to SEQ ID NO: 16916

SEQ ID NO: 57613 - DNA, 201 bp, Bos taurus; identical to SEQ ID NO: 16917

SEQ ID NO: 57614 - DNA, 201 bp, Bos taurus; identical to SEQ ID NO: 16918

SEQ ID NO: 57615 - DNA, 201 bp, Bos taurus; identical to SEQ ID NO: 16919

SEQ ID NO: 57616 - DNA, 201 bp, Bos taurus; identical to SEQ ID NO: 16920

SEQ ID NO: 57617 - DNA, 201 bp, Bos taurus; identical to SEQ ID NO: 16921

SEQ ID NO: 57618 - DNA, 201 bp, Bos taurus
agaccgagaagaaagaaggggccccggagcaggggggatgcagagcttagtgctcacatctgggggtctcttgtgaaaggctgagagcagagctattcagtggccccgtgtctgctgggtgttaccagtttgactgggatgccccatggggatttgggactgagtggtacaaacgtgagactagtgttaacaggcacctct

SEQ ID NO: 57619 - DNA, 201 bp, Bos taurus
ggagctctccttgctggccggccctccccggcctggacgaggagagcagaagccctctgtcagctgagcagatgtgtattgagccccaagggttgggtcctgggttgtgccctaggcccagggatttacaaatgaatggggtacagtcctcacccccccaccccagtgaagccatctccagcagagggtccaggcccttaa

SEQ ID NO: 57620 - DNA, 201 bp, Bos taurus; identical to SEQ ID NO: 16922

SEQ ID NO: 57621 - DNA, 201 bp, Bos taurus
attgattgtagtaatccaaattttctggattttccctcgatgacttgtgagggaaaaactctcccctagtcttttctcaggactttctgtgagactccaaaggcctcacatgttctcaacaagaagtccgctctggtccctttacatcacactccttgttaacattctctcttcccacaagcccataggaaggcggcacca

SEQ ID NO: 57622 - DNA, 201 bp, Bos taurus; identical to SEQ ID NO: 16923

SEQ ID NO: 57623 - DNA, 201 bp, Bos taurus; identical to SEQ ID NO: 16924

SEQ ID NO: 57624 - DNA, 201 bp, Bos taurus; identical to SEQ ID NO: 16925

SEQ ID NO: 57625 - DNA, 201 bp, Bos taurus; identical to SEQ ID NO: 16926

SEQ ID NO: 57626 - DNA, 201 bp, Bos taurus; identical to SEQ ID NO: 16927

SEQ ID NO: 57627 - DNA, 201 bp, Bos taurus; identical to SEQ ID NO: 16929

SEQ ID NO: 57628 - DNA, 201 bp, Bos taurus; identical to SEQ ID NO: 16930

SEQ ID NO: 57629 - DNA, 201 bp, Bos taurus; identical to SEQ ID NO: 16931

SEQ ID NO: 57630 - DNA, 201 bp, Bos taurus
aggtaacaaaaaaattaagactgggtttcaagctcttgttagctcactgtgagtttgagcaagtaatttctacttcctaggcctattcctttgtgtgttctaatccagtgattcttttcggggaatgtgatcctgctgtccaagtaccacgtatttctgtggcctagggaccatgcaaggttctgggttacagcttttttt

SEQ ID NO: 57631 - DNA, 201 bp, Bos taurus; identical to SEQ ID NO: 16933

SEQ ID NO: 57632 - DNA, 201 bp, Bos taurus; identical to SEQ ID NO: 16934

SEQ ID NO: 57633 - DNA, 201 bp, Bos taurus; identical to SEQ ID NO: 16935

SEQ ID NO: 57634 - DNA, 201 bp, Bos taurus
atattcctggcatggcctttactacttttcatgtgtgtagttttactgtctgcttgcaattttttcttttgtgaacttttagtattttggtgtagctgggacagcagaatccttggggcccatctttagcgctttatgcttctgcttgatcccaagccacaagagatttagatttaagaagttccatttggctgctcacag

SEQ ID NO: 57635 - DNA, 201 bp, Bos taurus; identical to SEQ ID NO: 16936

SEQ ID NO: 57636 - DNA, 201 bp, Bos taurus; identical to SEQ ID NO: 16937

SEQ ID NO: 57637 - DNA, 201 bp, Bos taurus
tgaggccctctgatggagacttggggctcctgcctgcagccctatgtgccatcttgaagtatgttccccaggcttacttaatctttcagatgactcaaccgtggccaacatcttgactgcaaaacgatgggaacccctcacaagagccaccctccaaggccactctcaaatttctgatccacaaaatatgagaggttttgt

SEQ ID NO: 57638 - DNA, 201 bp, Bos taurus; identical to SEQ ID NO: 16938

SEQ ID NO: 57639 - DNA, 201 bp, Bos taurus; identical to SEQ ID NO: 16939

SEQ ID NO: 57640 - DNA, 201 bp, Bos taurus; identical to SEQ ID NO: 16940

SEQ ID NO: 57641 - DNA, 201 bp, Bos taurus; identical to SEQ ID NO: 16941

SEQ ID NO: 57642 - DNA, 201 bp, Bos taurus; identical to SEQ ID NO: 16943

SEQ ID NO: 57643 - DNA, 201 bp, Bos taurus; identical to SEQ ID NO: 16944

SEQ ID NO: 57644 - DNA, 201 bp, Bos taurus
gacgatcccattaacagaaaaggaaaatgaggtacagagatactgataagttagctccacagccagtaagtgataatcaaatctaattgatttcaaagtccaagggtgcaccctttttttttcccttgtgaaccacctaccattctaggaatgcagatttcaatcaaatataaagcaagattttccaaaaattagttatac

SEQ ID NO: 57645 - DNA, 201 bp, Bos taurus
aattatatttaattaaataaaattaatttatatttaattaaatcaaattaaactatatgactttctgaaaaaggcaaaattatgaagacagtaaaaacatcaatggttgccattggttatgggggtaagggtggatttgtggaggaggggtgaatagttgaagcacagaggatttttaggacagtgaaaatatgatatcgt

SEQ ID NO: 57646 - DNA, 201 bp, Bos taurus; identical to SEQ ID NO: 16946

SEQ ID NO: 57647 - DNA, 201 bp, Bos taurus
ggtataatatttattagtaattatattaataattaaaatcattaatgttaagtgtgcaattaaataactttatgacataaatagttatgtaacaatcaccacattcacaaactggaacatttgccaaaactattccacacatttgaagtcaattcctttatctaatccactagcctctggcaattactgatattctctcac

SEQ ID NO: 57648 - DNA, 201 bp, Bos taurus
tcaatttctcatttctaaattgggaaagagagcactgttgagatggaggcccttttcagcaaaaccatgattgtttctgtttgtctgttagtagcgttgatgcttgccaggtgcaggacttaaggccccaccatcagtgagcttcactaatttcttttgtaaaattgggatgataattctttataggatttttgtgaggat

SEQ ID NO: 57649 - DNA, 201 bp, Bos taurus; identical to SEQ ID NO: 16947

SEQ ID NO: 57650 - DNA, 201 bp, Bos taurus; identical to SEQ ID NO: 16949

SEQ ID NO: 57651 - DNA, 201 bp, Bos taurus; identical to SEQ ID NO: 16950

SEQ ID NO: 57652 - DNA, 201 bp, Bos taurus; identical to SEQ ID NO: 16951

SEQ ID NO: 57653 - DNA, 201 bp, Bos taurus; identical to SEQ ID NO: 16955

SEQ ID NO: 57654 - DNA, 201 bp, Bos taurus
tgtgagcgggcctccagtcactaaccacgtcttcctgtgatcctgcacaggtcatatctgccaagactgtcacagacagagactagctcccctgaggagacgcatggcccccctggaactgtgcccttgtggcacatccaggagcctgagcagcttagacctgggacgtgcacaccgccgtgggtgtggcaaccccatgag

SEQ ID NO: 57655 - DNA, 201 bp, Bos taurus; identical to SEQ ID NO: 16957

SEQ ID NO: 57656 - DNA, 201 bp, Bos taurus; identical to SEQ ID NO: 16958

SEQ ID NO: 57657 - DNA, 201 bp, Bos taurus; identical to SEQ ID NO: 16959

SEQ ID NO: 57658 - DNA, 201 bp, Bos taurus; identical to SEQ ID NO: 16960

SEQ ID NO: 57659 - DNA, 201 bp, Bos taurus; identical to SEQ ID NO: 16961

SEQ ID NO: 57660 - DNA, 201 bp, Bos taurus
tttagctttggattttaagtgtattggtaagttatttgggagttttaagtgtaagagtaatagtaatctggctgttgtatgtaggatggactgcagaggtactaaagtagaaaatggattaccagttagatagcgatcacaatccaagcaagaaatgatggtagagtagggatgtggctatgaaaatgctgagaagtgacc

SEQ ID NO: 57661 - DNA, 201 bp, Bos taurus
ttgtactctatcccaaataacaatagaaataattctatataggtatctcctgcttttcaaaagttcactttacaccatgtcccttttaaaaaagacctacattactatgttttccctaacagaaataaatttgaagaggatttttgcttttacaaaaaacggtgaaaagcaaaagtagcattcagtgtttgttctggagag

SEQ ID NO: 57662 - DNA, 201 bp, Bos taurus; identical to SEQ ID NO: 16962

SEQ ID NO: 57663 - DNA, 201 bp, Bos taurus
tcccaacccagggatcgaacccaggcctcccacattgcaggcagacactttaacctctgagccaccaaggaagccctggtcctgccagaacactgatcaacaggcctgatgtggtggaaagcgtgaactttgaaatcagacagaagatttgaatcttggccacttaaatagcttatgtgaccttgggcaagtccaggtaga

SEQ ID NO: 57664 - DNA, 201 bp, Bos taurus; identical to SEQ ID NO: 16963

SEQ ID NO: 57665 - DNA, 201 bp, Bos taurus
gaggcccacccacagggcagctgggggccaacagtactccccatgttcttcttatctttacagaaaatgggcacccagaacacaacagcccgcgagacaccgagccaaactgcagcaaaggccttggagagggcaaagagccagctgcgtggggagaaggggcagaggggagacaaaggtgagggccaagccgcgtggtgg

SEQ ID NO: 57666 - DNA, 201 bp, Bos taurus
gagctgaccaccaccccagatgttctctaagacccctctaagcaggaacacttatgcaagtctacacccctagatctcctgctgaaatccctctgcaagagaaaattcattcgccttgtggatttgagctccctctgtgtcctgctggggacagcccctgaatggactgtagactttctaggtgtcaggtgttatcctcaa

SEQ ID NO: 57667 - DNA, 201 bp, Bos taurus; identical to SEQ ID NO: 16964

SEQ ID NO: 57668 - DNA, 201 bp, Bos taurus
taaagacttaggaggagacagatggagaaagaaacagacgcaaagatgaaggcaaagaagaaggaggtgattttgcgacagagcctatgtggcccacaaagcctaaaacagtttctgtctggtgctttacagaagtttcagttcagttcagttcagtttagttgctcagtcgtgtccgactctttgtgaccccatgaactg

SEQ ID NO: 57669 - DNA, 201 bp, Bos taurus
ggcaatagcagccacagcttcccaggccctgttggggaactcgggctcctgggctgcccctgggggaactggtctggatcagggtaggggtgtggcctgcccgtggtgaatttgtctggatcagggcgccggtgcctctcgattctctgctatctggacaccaggactgaagtatcatcactcctactatctagagatagg

SEQ ID NO: 57670 - DNA, 201 bp, Bos taurus; identical to SEQ ID NO: 16965

SEQ ID NO: 57671 - DNA, 201 bp, Bos taurus; identical to SEQ ID NO: 16966

SEQ ID NO: 57672 - DNA, 201 bp, Bos taurus; identical to SEQ ID NO: 16967

SEQ ID NO: 57673 - DNA, 201 bp, Bos taurus; identical to SEQ ID NO: 16968

SEQ ID NO: 57674 - DNA, 201 bp, Bos taurus; identical to SEQ ID NO: 16969

SEQ ID NO: 57675 - DNA, 201 bp, Bos taurus; identical to SEQ ID NO: 16970

SEQ ID NO: 57676 - DNA, 201 bp, Bos taurus; identical to SEQ ID NO: 16971

SEQ ID NO: 57677 - DNA, 201 bp, Bos taurus; identical to SEQ ID NO: 16972

SEQ ID NO: 57678 - DNA, 201 bp, Bos taurus; identical to SEQ ID NO: 16973

SEQ ID NO: 57679 - DNA, 201 bp, Bos taurus; identical to SEQ ID NO: 16976

SEQ ID NO: 57680 - DNA, 201 bp, Bos taurus; identical to SEQ ID NO: 16977

SEQ ID NO: 57681 - DNA, 201 bp, Bos taurus; identical to SEQ ID NO: 16978

SEQ ID NO: 57682 - DNA, 201 bp, Bos taurus; identical to SEQ ID NO: 16979

SEQ ID NO: 57683 - DNA, 201 bp, Bos taurus; identical to SEQ ID NO: 16980

SEQ ID NO: 57684 - DNA, 201 bp, Bos taurus; identical to SEQ ID NO: 16981

SEQ ID NO: 57685 - DNA, 201 bp, Bos taurus; identical to SEQ ID NO: 16982

SEQ ID NO: 57686 - DNA, 201 bp, Bos taurus; identical to SEQ ID NO: 16983

SEQ ID NO: 57687 - DNA, 201 bp, Bos taurus; identical to SEQ ID NO: 16984

SEQ ID NO: 57688 - DNA, 201 bp, Bos taurus; identical to SEQ ID NO: 16985

SEQ ID NO: 57689 - DNA, 201 bp, Bos taurus; identical to SEQ ID NO: 16986

SEQ ID NO: 57690 - DNA, 201 bp, Bos taurus; identical to SEQ ID NO: 16987

SEQ ID NO: 57691 - DNA, 201 bp, Bos taurus; identical to SEQ ID NO: 16988

SEQ ID NO: 57692 - DNA, 201 bp, Bos taurus; identical to SEQ ID NO: 16989

SEQ ID NO: 57693 - DNA, 201 bp, Bos taurus; identical to SEQ ID NO: 16990

SEQ ID NO: 57694 - DNA, 201 bp, Bos taurus; identical to SEQ ID NO: 16991

SEQ ID NO: 57695 - DNA, 201 bp, Bos taurus; identical to SEQ ID NO: 16992

SEQ ID NO: 57696 - DNA, 201 bp, Bos taurus; identical to SEQ ID NO: 16993

SEQ ID NO: 57697 - DNA, 201 bp, Bos taurus; identical to SEQ ID NO: 16994

SEQ ID NO: 57698 - DNA, 201 bp, Bos taurus; identical to SEQ ID NO: 16995

SEQ ID NO: 57699 - DNA, 201 bp, Bos taurus; identical to SEQ ID NO: 16996

SEQ ID NO: 57700 - DNA, 201 bp, Bos taurus; identical to SEQ ID NO: 16997

SEQ ID NO: 57701 - DNA, 201 bp, Bos taurus; identical to SEQ ID NO: 16998

SEQ ID NO: 57702 - DNA, 201 bp, Bos taurus; identical to SEQ ID NO: 16999

SEQ ID NO: 57703 - DNA, 201 bp, Bos taurus
agcccggggccaagaccagctcactccccaccggtcctgcgagatcatgctgtgatgtttaggacggagagtaggcacagtgcagcctgtgtctagctagcggtcaggccagatgggctggagtgggtatctgatctattaccactgcctcttcccctctctcttggcctgctctgtgacagtgaagttcccaacaattag

SEQ ID NO: 57704 - DNA, 201 bp, Bos taurus
tctttcgtgtgccctctgggttgggcacttcctagaggagtctgcctctaggtcttgttgccatcgcaaccagagctctccattgcctgggaaagccgaatgaaagccaggccaggaaccctgggttcccaaagcatcttctgagttcttggggtctccccttgtctcagcaggaacaaaagaacagaatggatctattgg

SEQ ID NO: 57705 - DNA, 201 bp, Bos taurus
caggcttaggggggacccgccttgctaggaggccagcagggggtaggactctggtgcctgagccccagggagcgatgggatcacagggctgagatgggtcagtggcctcctttcgcaggaaaggaaaccaaggccatcaactcccctgatcacattttggtgtcagatcatgtcagtctgtgatggtcggggatgcactct

SEQ ID NO: 57706 - DNA, 201 bp, Bos taurus; identical to SEQ ID NO: 17000

SEQ ID NO: 57707 - DNA, 201 bp, Bos taurus; identical to SEQ ID NO: 17001

SEQ ID NO: 57708 - DNA, 201 bp, Bos taurus; identical to SEQ ID NO: 17002

SEQ ID NO: 57709 - DNA, 201 bp, Bos taurus
ggaaggaaaatgaaataattgcattcggactcgcttgaaacaattcatctgtgtgtccacgaagatcctgagggcctgtggacactgcaaagtaacacgcgggtttgttctgtggtttctgcctccctgtgtgcctggcaggaacggggaaagggagtatctcggagcaggtggatttctactccccattgtgcaaagctg

SEQ ID NO: 57710 - DNA, 201 bp, Bos taurus; identical to SEQ ID NO: 17004

SEQ ID NO: 57711 - DNA, 201 bp, Bos taurus; identical to SEQ ID NO: 17006

SEQ ID NO: 57712 - DNA, 201 bp, Bos taurus; identical to SEQ ID NO: 17007

SEQ ID NO: 57713 - DNA, 201 bp, Bos taurus; identical to SEQ ID NO: 17008

SEQ ID NO: 57714 - DNA, 201 bp, Bos taurus; identical to SEQ ID NO: 17010

SEQ ID NO: 57715 - DNA, 201 bp, Bos taurus; identical to SEQ ID NO: 17011

SEQ ID NO: 57716 - DNA, 201 bp, Bos taurus; identical to SEQ ID NO: 17012

SEQ ID NO: 57717 - DNA, 201 bp, Bos taurus; identical to SEQ ID NO: 17013

SEQ ID NO: 57718 - DNA, 201 bp, Bos taurus; identical to SEQ ID NO: 17014

SEQ ID NO: 57719 - DNA, 201 bp, Bos taurus; identical to SEQ ID NO: 17015

SEQ ID NO: 57720 - DNA, 201 bp, Bos taurus
acaactgttcacaaaaccatgtcttcctgcctctattgtatactacttggctctgaaatacatttgggggcaagtgaaccacaacagttcctccagtaagggagtgagcaaggtgagtgtgatcttatgtaacagtcacatcggaagcagctgggggaaacaagagcttggtataacccagaccagccacaggaaagatct

SEQ ID NO: 57721 - DNA, 201 bp, Bos taurus; identical to SEQ ID NO: 17016

SEQ ID NO: 57722 - DNA, 201 bp, Bos taurus
ccaaagagcacaggccaaggccaaagcctaagtggttgccatggaaatgggttaattacccaatcagacttttttctgagaatgttactataaatatccttggccttttccactggccttgaagttgagatgtaagatctagagcctccgtatctacaagagccttgtataaactgtgcatggtatgtaggcaacagaagc

SEQ ID NO: 57723 - DNA, 201 bp, Bos taurus; identical to SEQ ID NO: 17017

SEQ ID NO: 57724 - DNA, 201 bp, Bos taurus; identical to SEQ ID NO: 17019

SEQ ID NO: 57725 - DNA, 201 bp, Bos taurus; identical to SEQ ID NO: 17020

SEQ ID NO: 57726 - DNA, 201 bp, Bos taurus
aaaaccagaggagcaaagaccttatatccttcggtgaaaataaaggactaggctgcagggcccacatgcccttgctgtggcctcccaagtgtggctttctaagccatggttgagcaggacatgctctgagttacactttcagagccaccacctcctcctcgctccatgtggcagcccctggccctcctgtcacctgtccca

SEQ ID NO: 57727 - DNA, 201 bp, Bos taurus
aaaaacttaaaaaagaaaagagctgcttcgtgtctagcacaacaggtataaatatttctccaccaaccaggccccatttctctgaaatttcagaacaccatggacaaagggagggtctcgcttgttttcagaaaggaaagagaggacgggtgaaaggtccaggcgtgaatcctgctgtggacacctcaacaagacgatgga

SEQ ID NO: 57728 - DNA, 201 bp, Bos taurus; identical to SEQ ID NO: 17022

SEQ ID NO: 57729 - DNA, 201 bp, Bos taurus
gtggtttcttacaaacctaagcatgatctcaccacacaacacagcaagtgcactccatggtatttacctgaaggagctggaaacatttccacacaaaaatacgcatgtggatatatacagcaatattattcataaatgccccaaactagaagcaaccaagatgcattttaataagtggatggaaaaacaaaattatggcac

SEQ ID NO: 57730 - DNA, 201 bp, Bos taurus; identical to SEQ ID NO: 17023

SEQ ID NO: 57731 - DNA, 201 bp, Bos taurus
ttttgtttcttattgtagtaacattgctatacaacttggtgtgtgttgtaggtgaatccgagaggcaaggagttgaggccaaggaagagacttttaatccgggagtcagcaagttgagaagatggcaggctagcacctcaaaataaccattcttaccagggcctggttgccaggttcttttaaggatcagagatgagggga

SEQ ID NO: 57732 - DNA, 201 bp, Bos taurus; identical to SEQ ID NO: 17027

SEQ ID NO: 57733 - DNA, 201 bp, Bos taurus; identical to SEQ ID NO: 17028

SEQ ID NO: 57734 - DNA, 201 bp, Bos taurus; identical to SEQ ID NO: 17029

SEQ ID NO: 57735 - DNA, 201 bp, Bos taurus
atggaaaaaatgccatacatccatgcaatggaatattatttggtcataaaatgagtgaagtatggatacattcttttagatacatgagcttcaaaaacattatactgagtgaaagaagccagacacaaacgactgtataaggtttgattccatttataaaaactcttcgggatctgaaagtctatggatgtgtgtagctgc

SEQ ID NO: 57736 - DNA, 201 bp, Bos taurus; identical to SEQ ID NO: 17030

SEQ ID NO: 57737 - DNA, 201 bp, Bos taurus; identical to SEQ ID NO: 17031

SEQ ID NO: 57738 - DNA, 201 bp, Bos taurus; identical to SEQ ID NO: 17032

SEQ ID NO: 57739 - DNA, 201 bp, Bos taurus
ccttccctgacctgcaccctgctttctgcatcctcaatgaggcaggcagtgagcctcaacttaataactttccactctcggcctgctggcttttcatctcaaaacaaaagtgatacatacaaataaataagcatcccaaacatgcaagcaaaccagtcgtgtccccttaaaatcaactgtctgggaggcccggtgcttcct

SEQ ID NO: 57740 - DNA, 201 bp, Bos taurus; identical to SEQ ID NO: 17033

SEQ ID NO: 57741 - DNA, 201 bp, Bos taurus
gaaatccaagttggttccgggggaagtgaagagactagaggtctttgctgggaaagagaggagcccggggtgagggccccaaagtggccaaaaagatgctacttggatgacacctggcaggagagggggtcgtttgataagagtaggggtatctgagctagtgatttgggggagatggagagattctgtttcttgacaagg

SEQ ID NO: 57742 - DNA, 201 bp, Bos taurus; identical to SEQ ID NO: 17034

SEQ ID NO: 57743 - DNA, 201 bp, Bos taurus; identical to SEQ ID NO: 17036

SEQ ID NO: 57744 - DNA, 201 bp, Bos taurus
tttggaccccaaagctctcttctcttctggtctctcgaggaaggcagtttgcctcctcagccctgtctgtggctgtgtaagcaggaccgctcaggccagttctggcgtgggacaccctccatgcgcaggcgatgcaaataattattacattggcagctcattgctttcagtcaaccagtattttaaagaggatggccattt

SEQ ID NO: 57745 - DNA, 201 bp, Bos taurus; identical to SEQ ID NO: 17037

SEQ ID NO: 57746 - DNA, 201 bp, Bos taurus; identical to SEQ ID NO: 17038

SEQ ID NO: 57747 - DNA, 201 bp, Bos taurus; identical to SEQ ID NO: 17039

SEQ ID NO: 57748 - DNA, 201 bp, Bos taurus
cagcttgggactgttctcacagcaagggttgcatcacagctaaggccttgggacctgtgtctttcagaattaaaaggacccatctggaataccctcgactcccctggtgtccagagacacccaggcctgggtccataacctggtgtaggaatgtccagtcactggcttcccttcctccccaaacaccgcaggtcattcttt

SEQ ID NO: 57749 - DNA, 201 bp, Bos taurus
caggccaaatatgcattttcatctctgtcctgaatggggcagggagtcgctaagatggtttggagagcagtttgggatggcaaacgggacctccagccactcaaggccactggcagctgaagacggcagatgggctcaaaaggtgacttctgtggactcaggctcaatgatgatgctcctctgttatggactcagggagac

SEQ ID NO: 57750 - DNA, 201 bp, Bos taurus; identical to SEQ ID NO: 17041

SEQ ID NO: 57751 - DNA, 201 bp, Bos taurus; identical to SEQ ID NO: 17043

SEQ ID NO: 57752 - DNA, 201 bp, Bos taurus; identical to SEQ ID NO: 17044

SEQ ID NO: 57753 - DNA, 201 bp, Bos taurus
tatacatgtattatatatattgtaatatcttgttattatatatataaaacatgcttgtttttcaaagaattttctgtttcatcttggttgtcaaatttattggcatacagattttattatacacccttatcatccatttgatgtctgtggaagctgtagtaatacccccattttctctctcttttggtaattgtcttttct

SEQ ID NO: 57754 - DNA, 201 bp, Bos taurus; identical to SEQ ID NO: 17045

SEQ ID NO: 57755 - DNA, 201 bp, Bos taurus
tgtctattgggagagatggacgagggacaaagataggctttattgttagcacatttagatacagataggtcctgcctcttttgaaagaagacccctcaaagggccacctccagctgcttcctctcctcttattcctgctgtgctggaaaggagaggaaagggtgcaggcctgggggatgtgtagctgatgtgagcagaagc

SEQ ID NO: 57756 - DNA, 201 bp, Bos taurus; identical to SEQ ID NO: 17047

SEQ ID NO: 57757 - DNA, 201 bp, Bos taurus; identical to SEQ ID NO: 17048

SEQ ID NO: 57758 - DNA, 201 bp, Bos taurus; identical to SEQ ID NO: 17049

SEQ ID NO: 57759 - DNA, 201 bp, Bos taurus; identical to SEQ ID NO: 17051

SEQ ID NO: 57760 - DNA, 201 bp, Bos taurus; identical to SEQ ID NO: 17053

SEQ ID NO: 57761 - DNA, 201 bp, Bos taurus; identical to SEQ ID NO: 17055

SEQ ID NO: 57762 - DNA, 201 bp, Bos taurus; identical to SEQ ID NO: 17056

SEQ ID NO: 57763 - DNA, 201 bp, Bos taurus; identical to SEQ ID NO: 17058

SEQ ID NO: 57764 - DNA, 201 bp, Bos taurus; identical to SEQ ID NO: 17059

SEQ ID NO: 57765 - DNA, 201 bp, Bos taurus; identical to SEQ ID NO: 17061

SEQ ID NO: 57766 - DNA, 201 bp, Bos taurus; identical to SEQ ID NO: 17062

SEQ ID NO: 57767 - DNA, 201 bp, Bos taurus; identical to SEQ ID NO: 17063

SEQ ID NO: 57768 - DNA, 201 bp, Bos taurus; identical to SEQ ID NO: 17064

SEQ ID NO: 57769 - DNA, 201 bp, Bos taurus; identical to SEQ ID NO: 17066

SEQ ID NO: 57770 - DNA, 201 bp, Bos taurus; identical to SEQ ID NO: 17067

SEQ ID NO: 57771 - DNA, 201 bp, Bos taurus; identical to SEQ ID NO: 17068

SEQ ID NO: 57772 - DNA, 201 bp, Bos taurus; identical to SEQ ID NO: 17069

SEQ ID NO: 57773 - DNA, 201 bp, Bos taurus; identical to SEQ ID NO: 17071

SEQ ID NO: 57774 - DNA, 201 bp, Bos taurus; identical to SEQ ID NO: 17076

SEQ ID NO: 57775 - DNA, 201 bp, Bos taurus; identical to SEQ ID NO: 17077

SEQ ID NO: 57776 - DNA, 201 bp, Bos taurus; identical to SEQ ID NO: 17079

SEQ ID NO: 57777 - DNA, 201 bp, Bos taurus; identical to SEQ ID NO: 17083

SEQ ID NO: 57778 - DNA, 201 bp, Bos taurus; identical to SEQ ID NO: 17088

SEQ ID NO: 57779 - DNA, 201 bp, Bos taurus; identical to SEQ ID NO: 17089

SEQ ID NO: 57780 - DNA, 201 bp, Bos taurus; identical to SEQ ID NO: 17092

SEQ ID NO: 57781 - DNA, 201 bp, Bos taurus; identical to SEQ ID NO: 17093

SEQ ID NO: 57782 - DNA, 201 bp, Bos taurus; identical to SEQ ID NO: 17094

SEQ ID NO: 57783 - DNA, 201 bp, Bos taurus; identical to SEQ ID NO: 17095

SEQ ID NO: 57784 - DNA, 201 bp, Bos taurus; identical to SEQ ID NO: 17099

SEQ ID NO: 57785 - DNA, 201 bp, Bos taurus; identical to SEQ ID NO: 17100

SEQ ID NO: 57786 - DNA, 201 bp, Bos taurus; identical to SEQ ID NO: 17101

SEQ ID NO: 57787 - DNA, 201 bp, Bos taurus; identical to SEQ ID NO: 17102

SEQ ID NO: 57788 - DNA, 201 bp, Bos taurus; identical to SEQ ID NO: 17103

SEQ ID NO: 57789 - DNA, 201 bp, Bos taurus; identical to SEQ ID NO: 17104

SEQ ID NO: 57790 - DNA, 201 bp, Bos taurus; identical to SEQ ID NO: 17105

SEQ ID NO: 57791 - DNA, 201 bp, Bos taurus; identical to SEQ ID NO: 17106

SEQ ID NO: 57792 - DNA, 201 bp, Bos taurus; identical to SEQ ID NO: 17108

SEQ ID NO: 57793 - DNA, 201 bp, Bos taurus; identical to SEQ ID NO: 17110

SEQ ID NO: 57794 - DNA, 201 bp, Bos taurus; identical to SEQ ID NO: 17111

SEQ ID NO: 57795 - DNA, 201 bp, Bos taurus; identical to SEQ ID NO: 17113

SEQ ID NO: 57796 - DNA, 201 bp, Bos taurus; identical to SEQ ID NO: 17114

SEQ ID NO: 57797 - DNA, 201 bp, Bos taurus; identical to SEQ ID NO: 17116

SEQ ID NO: 57798 - DNA, 201 bp, Bos taurus; identical to SEQ ID NO: 17118

SEQ ID NO: 57799 - DNA, 201 bp, Bos taurus; identical to SEQ ID NO: 17119

SEQ ID NO: 57800 - DNA, 201 bp, Bos taurus; identical to SEQ ID NO: 17122

SEQ ID NO: 57801 - DNA, 201 bp, Bos taurus; identical to SEQ ID NO: 17123

SEQ ID NO: 57802 - DNA, 201 bp, Bos taurus; identical to SEQ ID NO: 17124

SEQ ID NO: 57803 - DNA, 201 bp, Bos taurus; identical to SEQ ID NO: 17125

SEQ ID NO: 57804 - DNA, 201 bp, Bos taurus; identical to SEQ ID NO: 17128

SEQ ID NO: 57805 - DNA, 201 bp, Bos taurus; identical to SEQ ID NO: 17130

SEQ ID NO: 57806 - DNA, 201 bp, Bos taurus; identical to SEQ ID NO: 17131

SEQ ID NO: 57807 - DNA, 201 bp, Bos taurus; identical to SEQ ID NO: 17132

SEQ ID NO: 57808 - DNA, 201 bp, Bos taurus; identical to SEQ ID NO: 17135

SEQ ID NO: 57809 - DNA, 201 bp, Bos taurus; identical to SEQ ID NO: 17136

SEQ ID NO: 57810 - DNA, 201 bp, Bos taurus; identical to SEQ ID NO: 17138

SEQ ID NO: 57811 - DNA, 201 bp, Bos taurus; identical to SEQ ID NO: 17139

SEQ ID NO: 57812 - DNA, 201 bp, Bos taurus; identical to SEQ ID NO: 17140

SEQ ID NO: 57813 - DNA, 201 bp, Bos taurus; identical to SEQ ID NO: 17141

SEQ ID NO: 57814 - DNA, 201 bp, Bos taurus; identical to SEQ ID NO: 17145

SEQ ID NO: 57815 - DNA, 201 bp, Bos taurus; identical to SEQ ID NO: 17146

SEQ ID NO: 57816 - DNA, 201 bp, Bos taurus; identical to SEQ ID NO: 17147

SEQ ID NO: 57817 - DNA, 201 bp, Bos taurus; identical to SEQ ID NO: 17149

SEQ ID NO: 57818 - DNA, 201 bp, Bos taurus; identical to SEQ ID NO: 17150

SEQ ID NO: 57819 - DNA, 201 bp, Bos taurus; identical to SEQ ID NO: 17151

SEQ ID NO: 57820 - DNA, 201 bp, Bos taurus; identical to SEQ ID NO: 17154

SEQ ID NO: 57821 - DNA, 201 bp, Bos taurus; identical to SEQ ID NO: 17155

SEQ ID NO: 57822 - DNA, 201 bp, Bos taurus; identical to SEQ ID NO: 17157

SEQ ID NO: 57823 - DNA, 201 bp, Bos taurus; identical to SEQ ID NO: 17159

SEQ ID NO: 57824 - DNA, 201 bp, Bos taurus; identical to SEQ ID NO: 17160

SEQ ID NO: 57825 - DNA, 201 bp, Bos taurus; identical to SEQ ID NO: 17161

SEQ ID NO: 57826 - DNA, 201 bp, Bos taurus; identical to SEQ ID NO: 17163

SEQ ID NO: 57827 - DNA, 201 bp, Bos taurus; identical to SEQ ID NO: 17164

SEQ ID NO: 57828 - DNA, 201 bp, Bos taurus; identical to SEQ ID NO: 17166

SEQ ID NO: 57829 - DNA, 201 bp, Bos taurus; identical to SEQ ID NO: 17167

SEQ ID NO: 57830 - DNA, 201 bp, Bos taurus; identical to SEQ ID NO: 17168

SEQ ID NO: 57831 - DNA, 201 bp, Bos taurus; identical to SEQ ID NO: 17169

SEQ ID NO: 57832 - DNA, 201 bp, Bos taurus; identical to SEQ ID NO: 17171

SEQ ID NO: 57833 - DNA, 201 bp, Bos taurus; identical to SEQ ID NO: 17172

SEQ ID NO: 57834 - DNA, 201 bp, Bos taurus; identical to SEQ ID NO: 17173

SEQ ID NO: 57835 - DNA, 201 bp, Bos taurus; identical to SEQ ID NO: 17174

SEQ ID NO: 57836 - DNA, 201 bp, Bos taurus; identical to SEQ ID NO: 17177

SEQ ID NO: 57837 - DNA, 201 bp, Bos taurus; identical to SEQ ID NO: 17179

SEQ ID NO: 57838 - DNA, 201 bp, Bos taurus; identical to SEQ ID NO: 17181

SEQ ID NO: 57839 - DNA, 201 bp, Bos taurus
gggctgggtcgaccttctccgtggccacccctttcttgagtggctgggagccaaagttggcacgaaaataaagttgttcaggcctctgcccatgtgttggtgtgttttgtgcccggtggggagggcacgctcctcgtggaggcgggggaggagctagcatgcgcggccgtgccctcgcctcaaagggaggcgggctcagcc

SEQ ID NO: 57840 - DNA, 201 bp, Bos taurus; identical to SEQ ID NO: 17182

SEQ ID NO: 57841 - DNA, 201 bp, Bos taurus; identical to SEQ ID NO: 17183

SEQ ID NO: 57842 - DNA, 201 bp, Bos taurus; identical to SEQ ID NO: 17184

SEQ ID NO: 57843 - DNA, 201 bp, Bos taurus
ctttaagctcgaaacgaggccagtttggagtcaagcgagttctgctcccgcacagaaagcggcgggaacctcggcgccccctggtgacgacccaagaaaccgcgcctgggacccggggccgcgtcgcccgaagccgggggcggggcgggtctcgccaactccaggacaaactcgcaagatactaacactagggccccaact

SEQ ID NO: 57844 - DNA, 201 bp, Bos taurus; identical to SEQ ID NO: 17185

SEQ ID NO: 57845 - DNA, 201 bp, Bos taurus
cacgctgggctcggcagccatgcctcggagtggaagaaaaatgtggaaaccggagaggggcttccgagttgccggcctgctccttctggacggggcttgccgggtctccagagccctgatccacgccagctccaagaccttcatgctttttgtggcttgggtgagctcacctcgtcaggccctaacagctaccaggggctg

SEQ ID NO: 57846 - DNA, 201 bp, Bos taurus; identical to SEQ ID NO: 17186

SEQ ID NO: 57847 - DNA, 201 bp, Bos taurus
agcaggcacatttctaaattagaaggcataattcttatgccaacaaatgttggagaaccactggtctagggaatctttaaaccctaattatacatgaccagtgacccttatttcatgttcagtcacctgggaaaacaggctgcatgtggtccagccgaggagctgtcagctgctcaccagctgttaaggggtctgtgttaa

SEQ ID NO: 57848 - DNA, 201 bp, Bos taurus
tggcctccaggctattatttttttttttcaggcaaatttcctgccttttttttttccttctttttctggcttccatttgcttcagtggcagcaacagcagtagcagctggccctctagattagctttaatccgcttgctatttatagcacactctgtaaacctcatcatacttgtgattccctatttaaatgtgtcttcct

SEQ ID NO: 57849 - DNA, 201 bp, Bos taurus; identical to SEQ ID NO: 17188

SEQ ID NO: 57850 - DNA, 201 bp, Bos taurus; identical to SEQ ID NO: 17189

SEQ ID NO: 57851 - DNA, 201 bp, Bos taurus; identical to SEQ ID NO: 17190

SEQ ID NO: 57852 - DNA, 201 bp, Bos taurus
tgaaaaccattcagatcagagatgtcacatagcttaaccttgcagactgcaggagtaaaaataggcccatgagtagaaacaggcccatgagaccttcccaatgctggagtgtggcaaagacttcctgggcaccagctgaatccagactcagaccacggggactgtgtgataggaggcagagagggccctgcagatgggtct

SEQ ID NO: 57853 - DNA, 201 bp, Bos taurus
gagagccaggccatgtctgtggacctcactgcgactgtcgtcctaccctttggcacctctgcaggcagttgcttcaggaaccaagcctcctccaacacttaacttgaataacggccaaaccaaggccacacagaactgaacccgatcctgccccagaaataaatcatttccactttagcctcctgaagtggaagttacctg

SEQ ID NO: 57854 - DNA, 201 bp, Bos taurus
aggaatgtctagcttcaagctgcctgtgctagaggcaggcatagccaaggagaagctgaatggggccagagcagtcagttcaccccaggccagaggccactgggagaccctgctgcgttgactcattacagcgaaacgtgcagccaaagaaactgaaaaacttcacgtgttggcccaacccctgaaaatggtcggaaaagg

SEQ ID NO: 57855 - DNA, 201 bp, Bos taurus
cattcagctttaaaaacaaattaaagggggaggccttcttggtaatgatgacacttttacttttgtttccattttatttgtttagactgaaagaaaggatccgggcccagaaaggccaactctctaaaatggatttgattttgaacagtcaacaaaagcaaaaaatgttcttaggtgctatttacatccgcacccaaatta

SEQ ID NO: 57856 - DNA, 201 bp, Bos taurus
tctgcagccccagctgacatcttgctgcaatcaggtgagaaactctgagcccgacccatcctgctaagctgctccggaattcctggcccactggcactgcaaggtgagaagcgtttgtcgttgtgtgaagcagttaagttttagggtgttttgttacaaaggcgtgggccactaatacagttacttacaatgccataagac

SEQ ID NO: 57857 - DNA, 201 bp, Bos taurus
attaaaaagaacctgggggtgagcaaggtcaaagctgctccaagctccatgcaaagattgaagaaaaatgaatttagggctgccttagtgctgatgagaacaagttgctggcagaagttttttctaatagcaagtggtaagtattaaaatacaaagctttcctgttctaaaaaggagacctggtgctaaagaaagctgcat

SEQ ID NO: 57858 - DNA, 201 bp, Bos taurus
tggaaacttagggctgaataagaacatcagggtccgagagggaagtcacaaaagccaagtgcatttgggatttttgttgcttagaaagaggcctaaatccggggaatgctctctccctctagcccttctctccctctcttgccttgccacctcctacctttggcccagctacacagcttccccactgttcctcccctcctc

SEQ ID NO: 57859 - DNA, 201 bp, Bos taurus
gtgggcctgggcccctcctggggaggcccgatacatgtgatgggggtttctgacttggaaacaatttcataagccatcctgggagtaggtaaggcaagagaggcccccagaacctcaggcccgatcctcccgggtttctgagaacctggccgctgttttctttcccccaacagacatgactaccttggtgcccccagtggc

SEQ ID NO: 57860 - DNA, 201 bp, Bos taurus; identical to SEQ ID NO: 17192

SEQ ID NO: 57861 - DNA, 201 bp, Bos taurus; identical to SEQ ID NO: 17193

SEQ ID NO: 57862 - DNA, 201 bp, Bos taurus
ctttttatgagcaagcaagagcccattttagagaggccattcacaaagagaatggaaaacagcttgaatggaatgtgatttgagcactagggccatgctcggctctgtaggacgaatccaagagtgggactaagttgcagcaacagactggtgaccaacatgttcccccgagacatttttatgccctatggatggcaacca

SEQ ID NO: 57863 - DNA, 201 bp, Bos taurus; identical to SEQ ID NO: 17194

SEQ ID NO: 57864 - DNA, 201 bp, Bos taurus; identical to SEQ ID NO: 17195

SEQ ID NO: 57865 - DNA, 201 bp, Bos taurus; identical to SEQ ID NO: 17196

SEQ ID NO: 57866 - DNA, 201 bp, Bos taurus
gatgtggcacaggctggtaactgggaggttagacttttccttttttaaatatttatttatgtgcctgttccaggtctttgctgcagcagattcttgtgaataaggccttagttgcggcaagtgtgatctagttccctgaccagggatcaaacccggacccccagcattgggagcatggagtcttagccactggatcacaag

SEQ ID NO: 57867 - DNA, 201 bp, Bos taurus
gaattcgctaatgagaagatccaagcagatccacttgtgatctgagtgttcattgctgcaccgcctctccaagctcccaagggcatctctctacgtaatattaatgcctggccaggtcccatccattctgacagacaaaggacaggcgctactttacatttatgtgcagcctctttatttcattatactgagtgccttctg

SEQ ID NO: 57868 - DNA, 201 bp, Bos taurus; identical to SEQ ID NO: 17197

SEQ ID NO: 57869 - DNA, 201 bp, Bos taurus; identical to SEQ ID NO: 17198

SEQ ID NO: 57870 - DNA, 201 bp, Bos taurus
tatggccttgacttaatacagtgccgctcctgttcagggctgtgcaggctctcccagtgtctcaattacaggtttttaagttggagtctgttgggccatgtggggtcatgtttgcacctctggtctacctggctcttgctgggaagttggggtcatttgtgctttgggtggccccagacacgcccaggcaggctctcaaga

SEQ ID NO: 57871 - DNA, 201 bp, Bos taurus; identical to SEQ ID NO: 17199

SEQ ID NO: 57872 - DNA, 201 bp, Bos taurus; identical to SEQ ID NO: 17200

SEQ ID NO: 57873 - DNA, 201 bp, Bos taurus; identical to SEQ ID NO: 17201

SEQ ID NO: 57874 - DNA, 201 bp, Bos taurus; identical to SEQ ID NO: 17202

SEQ ID NO: 57875 - DNA, 201 bp, Bos taurus; identical to SEQ ID NO: 17203

SEQ ID NO: 57876 - DNA, 201 bp, Bos taurus
actcaaatttgccttcttattcccaattttattgccacaagcatcactcagaggctcagttttttttttaattgacaattctaatagaatactaatagctttatatccttcacagttctcttccacaatccattattcacactaagccagttctaatcacactatttcctcaattaaatcctttagtaagcagcactttat

SEQ ID NO: 57877 - DNA, 201 bp, Bos taurus
aagcttcccttttagttcagccctgggatattatttaattccaatatggaaatttgaattttcctgtgggaaatctatgggaagacaaatgtgaagtgaactccttcttattgcacaatgaaaaggagctttgaggacagtccttttttaacttctctgtttctggatggtgatgtgtatgaatctgaagcattgaccttc

SEQ ID NO: 57878 - DNA, 201 bp, Bos taurus; identical to SEQ ID NO: 17204
